United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 9

SEQ ID NO: 328113 - RNA, 21 nt, Bordetella pertussis
cgcgccgcuguggacgccgcc

SEQ ID NO: 328114 - RNA, 23 nt, Bordetella pertussis
cgcgccgcuguugcccaccagcc

SEQ ID NO: 328115 - RNA, 22 nt, Bordetella pertussis
cgcgccgcuuucucccgccgcu

SEQ ID NO: 328116 - RNA, 17 nt, Bordetella pertussis
cgcgccggacaucagcc

SEQ ID NO: 328117 - RNA, 19 nt, Bordetella pertussis
cgcgccggcagggcggcca

SEQ ID NO: 328118 - RNA, 22 nt, Bordetella pertussis
cgcgccggcagggcggccaggc

SEQ ID NO: 328119 - RNA, 13 nt, Bordetella pertussis
cgcgccggcaucg

SEQ ID NO: 328120 - RNA, 16 nt, Bordetella pertussis
cgcgccggccagcggc

SEQ ID NO: 328121 - RNA, 16 nt, Bordetella pertussis
cgcgccggccagggcc

SEQ ID NO: 328122 - RNA, 17 nt, Bordetella pertussis
cgcgccggccagggcca

SEQ ID NO: 328123 - RNA, 21 nt, Bordetella pertussis
cgcgccggccagggccaccac

SEQ ID NO: 328124 - RNA, 18 nt, Bordetella pertussis
cgcgccggcccaaggccc

SEQ ID NO: 328125 - RNA, 19 nt, Bordetella pertussis
cgcgccggcccaggcgcgc

SEQ ID NO: 328126 - RNA, 20 nt, Bordetella pertussis
cgcgccggccgcggggcugg

SEQ ID NO: 328127 - RNA, 14 nt, Bordetella pertussis
cgcgccggccgcca

SEQ ID NO: 328128 - RNA, 13 nt, Bordetella pertussis
cgcgccggccggu

SEQ ID NO: 328129 - RNA, 15 nt, Bordetella pertussis
cgcgccggccggugg

SEQ ID NO: 328130 - RNA, 14 nt, Bordetella pertussis
cgcgccggccugcg

SEQ ID NO: 328131 - RNA, 16 nt, Bordetella pertussis
cgcgccggccugcgcc

SEQ ID NO: 328132 - RNA, 16 nt, Bordetella pertussis
cgcgccggccugggcg

SEQ ID NO: 328133 - RNA, 15 nt, Bordetella pertussis
cgcgccggcgcgcga

SEQ ID NO: 328134 - RNA, 20 nt, Bordetella pertussis
cgcgccggcgccggcgcgcc

SEQ ID NO: 328135 - RNA, 13 nt, Bordetella pertussis
cgcgccggcgcgc

SEQ ID NO: 328136 - RNA, 23 nt, Bordetella pertussis
cgcgccggcggccugcaggccgu

SEQ ID NO: 328137 - RNA, 15 nt, Bordetella pertussis
cgcgccgugcagacg

SEQ ID NO: 328138 - RNA, 19 nt, Bordetella pertussis
cgcgccgugcagacggcgg

SEQ ID NO: 328139 - RNA, 22 nt, Bordetella pertussis
cgcgccguucagggacgggcca

SEQ ID NO: 328140 - RNA, 19 nt, Bordetella pertussis
cgcgccuacagcagcggcu

SEQ ID NO: 328141 - RNA, 21 nt, Bordetella pertussis
cgcgccuacagcagcggcucg

SEQ ID NO: 328142 - RNA, 22 nt, Bordetella pertussis
cgcgccguucucaggccgaggc

SEQ ID NO: 328143 - RNA, 18 nt, Bordetella pertussis
cgcgccuaccggcgccga

SEQ ID NO: 328144 - RNA, 21 nt, Bordetella pertussis
cgcgccuaccggcgccgacgc

SEQ ID NO: 328145 - RNA, 18 nt, Bordetella pertussis
cgcgccuauaucgacggc

SEQ ID NO: 328146 - RNA, 20 nt, Bordetella pertussis
cgcgccuauaucgacggcgc

SEQ ID NO: 328147 - RNA, 22 nt, Bordetella pertussis
cgcgccuauaucgacggcgccu

SEQ ID NO: 328148 - RNA, 23 nt, Bordetella pertussis
cgcgccuauaucgacggcgccua

SEQ ID NO: 328149 - RNA, 13 nt, Bordetella pertussis
cgcgccuccagcu

SEQ ID NO: 328150 - RNA, 12 nt, Bordetella pertussis
cgcgcgcgcaga

SEQ ID NO: 328151 - RNA, 11 nt, Bordetella pertussis
cgcgcgcgccc

SEQ ID NO: 328152 - RNA, 13 nt, Bordetella pertussis
cgcgcgcgccgcc

SEQ ID NO: 328153 - RNA, 12 nt, Bordetella pertussis
cgcgcgcgccgg

SEQ ID NO: 328154 - RNA, 12 nt, Bordetella pertussis
cgcgcgcgcgca

SEQ ID NO: 328155 - RNA, 16 nt, Bordetella pertussis
cgcgcgcgcgcacagg

SEQ ID NO: 328156 - RNA, 14 nt, Bordetella pertussis
cgcgcgcgcgcagc

SEQ ID NO: 328157 - RNA, 17 nt, Bordetella pertussis
cgcgcgcggaucgacgc

SEQ ID NO: 328158 - RNA, 11 nt, Bordetella pertussis
cgcgcgcggca

SEQ ID NO: 328159 - RNA, 13 nt, Bordetella pertussis
cgcgcgcgcgccg

SEQ ID NO: 328160 - RNA, 12 nt, Bordetella pertussis
cgcgcgcggcca

SEQ ID NO: 328161 - RNA, 14 nt, Bordetella pertussis
cgcgcgcggccggc

SEQ ID NO: 328162 - RNA, 20 nt, Bordetella pertussis
cgcgcgcggccggcgcgccg

SEQ ID NO: 328163 - RNA, 21 nt, Bordetella pertussis
cgcgcgcggccggcgcgccgg

SEQ ID NO: 328164 - RNA, 11 nt, Bordetella pertussis
cgcgcgcggcg

SEQ ID NO: 328165 - RNA, 14 nt, Bordetella pertussis
cgcgcgcggcgccu

SEQ ID NO: 328166 - RNA, 13 nt, Bordetella pertussis
cgcgcgcgggcgu

SEQ ID NO: 328167 - RNA, 22 nt, Bordetella pertussis
cgcgcgcgguugagcgccaggg

SEQ ID NO: 328168 - RNA, 13 nt, Bordetella pertussis
cgcgcgcgugccg

SEQ ID NO: 328169 - RNA, 17 nt, Bordetella pertussis
cgcgcgcugcacggccu

SEQ ID NO: 328170 - RNA, 13 nt, Bordetella pertussis
cgcgcgcuggcgc

SEQ ID NO: 328171 - RNA, 18 nt, Bordetella pertussis
cgcgcgcuucaggcgccg

SEQ ID NO: 328172 - RNA, 17 nt, Bordetella pertussis
cgcgcgcuuccucgacc

SEQ ID NO: 328173 - RNA, 20 nt, Bordetella pertussis
cgcgcgcuuccucgaccagg

SEQ ID NO: 328174 - RNA, 21 nt, Bordetella pertussis
cgcgcgcuuccucgaccaggu

SEQ ID NO: 328175 - RNA, 18 nt, Bordetella pertussis
cgcgcggauauucgucgg

SEQ ID NO: 328176 - RNA, 21 nt, Bordetella pertussis
cgcgcggauauucgucggccg

SEQ ID NO: 328177 - RNA, 13 nt, Bordetella pertussis
cgcgcggauccag

SEQ ID NO: 328178 - RNA, 18 nt, Bordetella pertussis
cgcgcggauccagccaug

SEQ ID NO: 328179 - RNA, 15 nt, Bordetella pertussis
cgcgcggaucgacgc

SEQ ID NO: 328180 - RNA, 20 nt, Bordetella pertussis
cgcgcggaugaucgcgcagc

SEQ ID NO: 328181 - RNA, 14 nt, Bordetella pertussis
cgcgcggccagcgc

SEQ ID NO: 328182 - RNA, 16 nt, Bordetella pertussis
cgcgcggccagcgccg

SEQ ID NO: 328183 - RNA, 12 nt, Bordetella pertussis
cgcgcggccagu

SEQ ID NO: 328184 - RNA, 15 nt, Bordetella pertussis
cgcgcggccaguucg

SEQ ID NO: 328185 - RNA, 20 nt, Bordetella pertussis
cgcgcggccaguucgacgcc

SEQ ID NO: 328186 - RNA, 14 nt, Bordetella pertussis
cgcgcggccccggc

SEQ ID NO: 328187 - RNA, 13 nt, Bordetella pertussis
cgcgcggccgagg

SEQ ID NO: 328188 - RNA, 12 nt, Bordetella pertussis
cgcgcggccggc

SEQ ID NO: 328189 - RNA, 13 nt, Bordetella pertussis
cgcgcggccggca

SEQ ID NO: 328190 - RNA, 14 nt, Bordetella pertussis
cgcgcggccggccg

SEQ ID NO: 328191 - RNA, 23 nt, Bordetella pertussis
cgcgcggccggccgcgcccaugc

SEQ ID NO: 328192 - RNA, 13 nt, Bordetella pertussis
cgcgcggccggcg

SEQ ID NO: 328193 - RNA, 14 nt, Bordetella pertussis
cgcgcggccggcgc

SEQ ID NO: 328194 - RNA, 15 nt, Bordetella pertussis
cgcgcggccggcgcg

SEQ ID NO: 328195 - RNA, 12 nt, Bordetella pertussis
cgcgcggcgaca

SEQ ID NO: 328196 - RNA, 13 nt, Bordetella pertussis
cgcgcggccguca

SEQ ID NO: 328197 - RNA, 13 nt, Bordetella pertussis
cgcgcggccgugu

SEQ ID NO: 328198 - RNA, 15 nt, Bordetella pertussis
cgcgcggccucgacg

SEQ ID NO: 328199 - RNA, 12 nt, Bordetella pertussis
cgcgcggccugg

SEQ ID NO: 328200 - RNA, 17 nt, Bordetella pertussis
cgcgcggccugggcggc

SEQ ID NO: 328201 - RNA, 14 nt, Bordetella pertussis
cgcgcggcgcagcg

SEQ ID NO: 328202 - RNA, 15 nt, Bordetella pertussis
cgcgcggcgcagcgc

SEQ ID NO: 328203 - RNA, 18 nt, Bordetella pertussis
cgcgcggcgcguucagca

SEQ ID NO: 328204 - RNA, 22 nt, Bordetella pertussis
cgcgcggcgcugcacgcggccg

SEQ ID NO: 328205 - RNA, 14 nt, Bordetella pertussis
cgcgcggcggaucg

SEQ ID NO: 328206 - RNA, 17 nt, Bordetella pertussis
cgcgcggcggcaccagc

SEQ ID NO: 328207 - RNA, 15 nt, Bordetella pertussis
cgcgcggcgccgcgc

SEQ ID NO: 328208 - RNA, 14 nt, Bordetella pertussis
cgcgcggcgccugg

SEQ ID NO: 328209 - RNA, 17 nt, Bordetella pertussis
cgcgcggcucgccgcgc

SEQ ID NO: 328210 - RNA, 13 nt, Bordetella pertussis
cgcgcggcuggcu

SEQ ID NO: 328211 - RNA, 15 nt, Bordetella pertussis
cgcgcgggccagcag

SEQ ID NO: 328212 - RNA, 24 nt, Bordetella pertussis
cgcgcggguuggucgucagcgccg

SEQ ID NO: 328213 - RNA, 19 nt, Bordetella pertussis
cgcgcgguacgcaccgccg

SEQ ID NO: 328214 - RNA, 17 nt, Bordetella pertussis
cgcgcgguauccagguc

SEQ ID NO: 328215 - RNA, 19 nt, Bordetella pertussis
cgcgcgguauccaggucga

SEQ ID NO: 328216 - RNA, 19 nt, Bordetella pertussis
cgcgcgguggcacgacgcg

SEQ ID NO: 328217 - RNA, 21 nt, Bordetella pertussis
cgcgcggugucgccgccgcgc

SEQ ID NO: 328218 - RNA, 22 nt, Bordetella pertussis
cgcgcggugucgccgccgcgcc

SEQ ID NO: 328219 - RNA, 21 nt, Bordetella pertussis
cgcgcgguguucgagccggac

SEQ ID NO: 328220 - RNA, 21 nt, Bordetella pertussis
cgcgcgguucgcauagcgccg

SEQ ID NO: 328221 - RNA, 17 nt, Bordetella pertussis
cgcgcgguugagcgcca

SEQ ID NO: 328222 - RNA, 19 nt, Bordetella pertussis
cgcgcgguugagcgccagg

SEQ ID NO: 328223 - RNA, 15 nt, Bordetella pertussis
cgcgcguaucggcgc

SEQ ID NO: 328224 - RNA, 16 nt, Bordetella pertussis
cgcgcguaucggcgcg

SEQ ID NO: 328225 - RNA, 14 nt, Bordetella pertussis
cgcgcucauggcgc

SEQ ID NO: 328226 - RNA, 13 nt, Bordetella pertussis
cgcgcuccagcau

SEQ ID NO: 328227 - RNA, 16 nt, Bordetella pertussis
cgcgcuccugcucggc

SEQ ID NO: 328228 - RNA, 19 nt, Bordetella pertussis
cgcgcuccugcucggcgau

SEQ ID NO: 328229 - RNA, 21 nt, Bordetella pertussis
cgcgcucgaacaucgcgaagg

SEQ ID NO: 328230 - RNA, 20 nt, Bordetella pertussis
cgcgcucgaauggcugcgcg

SEQ ID NO: 328231 - RNA, 23 nt, Bordetella pertussis
cgcgcucgagcaucuggcgcaug

SEQ ID NO: 328232 - RNA, 14 nt, Bordetella pertussis
cgcgcucgcccggc

SEQ ID NO: 328233 - RNA, 17 nt, Bordetella pertussis
cgcgcucgcccggccac

SEQ ID NO: 328234 - RNA, 20 nt, Bordetella pertussis
cgcgcucgcccggccacgug

SEQ ID NO: 328235 - RNA, 13 nt, Bordetella pertussis
cgcgcucgcgcca

SEQ ID NO: 328236 - RNA, 14 nt, Bordetella pertussis
cgcgcucgcgccag

SEQ ID NO: 328237 - RNA, 16 nt, Bordetella pertussis
cgcgcucgcgccaggc

SEQ ID NO: 328238 - RNA, 15 nt, Bordetella pertussis
cgcgcucgcccagcc

SEQ ID NO: 328239 - RNA, 20 nt, Bordetella pertussis
cgcgcucgcccagccgccug

SEQ ID NO: 328240 - RNA, 14 nt, Bordetella pertussis
cgcgcugacagcgc

SEQ ID NO: 328241 - RNA, 22 nt, Bordetella pertussis
cgcgcugaauccggggugccug

SEQ ID NO: 328242 - RNA, 13 nt, Bordetella pertussis
cgcgcugacgaaa

SEQ ID NO: 328243 - RNA, 19 nt, Bordetella pertussis
cgcgcugcaauugcgcggc

SEQ ID NO: 328244 - RNA, 13 nt, Bordetella pertussis
cgcgcugcacggc

SEQ ID NO: 328245 - RNA, 15 nt, Bordetella pertussis
cgcgcugcacggccu

SEQ ID NO: 328246 - RNA, 16 nt, Bordetella pertussis
cgcgcugauccuggcu

SEQ ID NO: 328247 - RNA, 16 nt, Bordetella pertussis
cgcgcugcccaccgcc

SEQ ID NO: 328248 - RNA, 20 nt, Bordetella pertussis
cgcgcugcccaccgccgugg

SEQ ID NO: 328249 - RNA, 23 nt, Bordetella pertussis
cgcgcugccugaaaccgcaggca

SEQ ID NO: 328250 - RNA, 15 nt, Bordetella pertussis
cgcgcugcgacagca

SEQ ID NO: 328251 - RNA, 20 nt, Bordetella pertussis
cgcgcugcgacagcagcaug

SEQ ID NO: 328252 - RNA, 14 nt, Bordetella pertussis
cgcgcugcgcgccg

SEQ ID NO: 328253 - RNA, 17 nt, Bordetella pertussis
cgcgcugcggucagcug

SEQ ID NO: 328254 - RNA, 20 nt, Bordetella pertussis
cgcgcugcucuccaugcuga

SEQ ID NO: 328255 - RNA, 17 nt, Bordetella pertussis
cgcgcugcugcaggccg

SEQ ID NO: 328256 - RNA, 20 nt, Bordetella pertussis
cgcgcugcugcaggccggcg

SEQ ID NO: 328257 - RNA, 12 nt, Bordetella pertussis
cgcgcuggaaga

SEQ ID NO: 328258 - RNA, 15 nt, Bordetella pertussis
cgcgcuggacgucgg

SEQ ID NO: 328259 - RNA, 20 nt, Bordetella pertussis
cgcgcugcugccgucggcgu

SEQ ID NO: 328260 - RNA, 22 nt, Bordetella pertussis
cgcgcuggccccagaugccggu

SEQ ID NO: 328261 - RNA, 21 nt, Bordetella pertussis
cgcgcuggcccgcgcgagcgg

SEQ ID NO: 328262 - RNA, 21 nt, Bordetella pertussis
cgcgcuguuccagccaguaca

SEQ ID NO: 328263 - RNA, 19 nt, Bordetella pertussis
cgcgcuguugcuccaggcc

SEQ ID NO: 328264 - RNA, 22 nt, Bordetella pertussis
cgcgcuguugcuccaggccggc

SEQ ID NO: 328265 - RNA, 22 nt, Bordetella pertussis
cgcgcuucacccuggaugccau

SEQ ID NO: 328266 - RNA, 18 nt, Bordetella pertussis
cgcgcuucaggcgccgca

SEQ ID NO: 328267 - RNA, 19 nt, Bordetella pertussis
cgcgcuucaggcgccgcag

SEQ ID NO: 328268 - RNA, 12 nt, Bordetella pertussis
cgcgcuucgucg

SEQ ID NO: 328269 - RNA, 16 nt, Bordetella pertussis
cgcgcuucgucggcgu

SEQ ID NO: 328270 - RNA, 18 nt, Bordetella pertussis
cgcgcuucuuggcgacca

SEQ ID NO: 328271 - RNA, 19 nt, Bordetella pertussis
cgcgcuucuuggcgaccag

SEQ ID NO: 328272 - RNA, 22 nt, Bordetella pertussis
cgcgcuucuuggcgaccaggcc

SEQ ID NO: 328273 - RNA, 19 nt, Bordetella pertussis
cgcgcuuccucgaccaggu

SEQ ID NO: 328274 - RNA, 23 nt, Bordetella pertussis
cgcgcuugaacuccgcggcgucg

SEQ ID NO: 328275 - RNA, 18 nt, Bordetella pertussis
cgcgcuugacguccagcg

SEQ ID NO: 328276 - RNA, 19 nt, Bordetella pertussis
cgcgcuugacguccagcga

SEQ ID NO: 328277 - RNA, 14 nt, Bordetella pertussis
cgcgcuugagcggc

SEQ ID NO: 328278 - RNA, 17 nt, Bordetella pertussis
cgcgcuugggacgcuuc

SEQ ID NO: 328279 - RNA, 15 nt, Bordetella pertussis
cgcgcuuggucagca

SEQ ID NO: 328280 - RNA, 16 nt, Bordetella pertussis
cgcgcuuucagguggg

SEQ ID NO: 328281 - RNA, 18 nt, Bordetella pertussis
cgcgcuuucaggugggcg

SEQ ID NO: 328282 - RNA, 19 nt, Bordetella pertussis
cgcgcuuuuccccgcccag

SEQ ID NO: 328283 - RNA, 20 nt, Bordetella pertussis
cgcgcuuuuccccgcccagc

SEQ ID NO: 328284 - RNA, 22 nt, Bordetella pertussis
cgcggaaauccguaguccagca

SEQ ID NO: 328285 - RNA, 13 nt, Bordetella pertussis
cgcggaccuccug

SEQ ID NO: 328286 - RNA, 20 nt, Bordetella pertussis
cgcggaccugcucgagcggc

SEQ ID NO: 328287 - RNA, 23 nt, Bordetella pertussis
cgcggcacgaaaagccgcggccg

SEQ ID NO: 328288 - RNA, 14 nt, Bordetella pertussis
cgcggcacugaugc

SEQ ID NO: 328289 - RNA, 17 nt, Bordetella pertussis
cgcggcagccuggggcg

SEQ ID NO: 328290 - RNA, 13 nt, Bordetella pertussis
cgcggcagggcca

SEQ ID NO: 328291 - RNA, 16 nt, Bordetella pertussis
cgcggcagggcgucgg

SEQ ID NO: 328292 - RNA, 19 nt, Bordetella pertussis
cgcggcagggcgucggccg

SEQ ID NO: 328293 - RNA, 22 nt, Bordetella pertussis
cgcggcagggcgucggccgcgc

SEQ ID NO: 328294 - RNA, 21 nt, Bordetella pertussis
cgcggcagguucugcgcgucc

SEQ ID NO: 328295 - RNA, 16 nt, Bordetella pertussis
cgcggcauagcccagg

SEQ ID NO: 328296 - RNA, 19 nt, Bordetella pertussis
cgcggcauagcccaggccg

SEQ ID NO: 328297 - RNA, 17 nt, Bordetella pertussis
cgcggcauacgccgaug

SEQ ID NO: 328298 - RNA, 15 nt, Bordetella pertussis
cgcggcaucggccau

SEQ ID NO: 328299 - RNA, 16 nt, Bordetella pertussis
cgcggcaugccgcugc

SEQ ID NO: 328300 - RNA, 23 nt, Bordetella pertussis
cgcggcaugccgcugcaggucgg

SEQ ID NO: 328301 - RNA, 14 nt, Bordetella pertussis
cgcggcaugcgcau

SEQ ID NO: 328302 - RNA, 18 nt, Bordetella pertussis
cgcggcaugcgcaugcug

SEQ ID NO: 328303 - RNA, 15 nt, Bordetella pertussis
cgcggcauggcgccg

SEQ ID NO: 328304 - RNA, 17 nt, Bordetella pertussis
cgcggccaaccccgagg

SEQ ID NO: 328305 - RNA, 15 nt, Bordetella pertussis
cgcggccaauggccg

SEQ ID NO: 328306 - RNA, 14 nt, Bordetella pertussis
cgcggccaccaggc

SEQ ID NO: 328307 - RNA, 15 nt, Bordetella pertussis
cgcggccaccaggcu

SEQ ID NO: 328308 - RNA, 16 nt, Bordetella pertussis
cgcggccaccaggcug

SEQ ID NO: 328309 - RNA, 16 nt, Bordetella pertussis
cgcggccacccugccg

SEQ ID NO: 328310 - RNA, 19 nt, Bordetella pertussis
cgcggccacccugccgugc

SEQ ID NO: 328311 - RNA, 14 nt, Bordetella pertussis
cgcggccacgccca

SEQ ID NO: 328312 - RNA, 18 nt, Bordetella pertussis
cgcggccacggccugccc

SEQ ID NO: 328313 - RNA, 21 nt, Bordetella pertussis
cgcggccacggccugcccggg

SEQ ID NO: 328314 - RNA, 22 nt, Bordetella pertussis
cgcggccacggccugcccgggc

SEQ ID NO: 328315 - RNA, 22 nt, Bordetella pertussis
cgcggccagaccuugcgcgacg

SEQ ID NO: 328316 - RNA, 10 nt, Bordetella pertussis
cgcggccagc

SEQ ID NO: 328317 - RNA, 12 nt, Bordetella pertussis
cgcggccagcac

SEQ ID NO: 328318 - RNA, 14 nt, Bordetella pertussis
cgcggccagcaccg

SEQ ID NO: 328319 - RNA, 17 nt, Bordetella pertussis
cgcggccagcaccggcc

SEQ ID NO: 328320 - RNA, 22 nt, Bordetella pertussis
cgcggccagcaccggcccgaag

SEQ ID NO: 328321 - RNA, 21 nt, Bordetella pertussis
cgcggccagcaccggccgccg

SEQ ID NO: 328322 - RNA, 17 nt, Bordetella pertussis
cgcggccagcagcgcgu

SEQ ID NO: 328323 - RNA, 13 nt, Bordetella pertussis
cgcggccagccac

SEQ ID NO: 328324 - RNA, 21 nt, Bordetella pertussis
cgcggccagccacgccggcgc

SEQ ID NO: 328325 - RNA, 13 nt, Bordetella pertussis
cgcggccagccgg

SEQ ID NO: 328326 - RNA, 15 nt, Bordetella pertussis
cgcggccagcgccgg

SEQ ID NO: 328327 - RNA, 13 nt, Bordetella pertussis
cgcggccagcgcg

SEQ ID NO: 328328 - RNA, 14 nt, Bordetella pertussis
cgcggccagcggca

SEQ ID NO: 328329 - RNA, 16 nt, Bordetella pertussis
cgcggccagcggcagg

SEQ ID NO: 328330 - RNA, 14 nt, Bordetella pertussis
cgcggccagcggcg

SEQ ID NO: 328331 - RNA, 12 nt, Bordetella pertussis
cgcggccaggcc

SEQ ID NO: 328332 - RNA, 14 nt, Bordetella pertussis
cgcggccaggccca

SEQ ID NO: 328333 - RNA, 21 nt, Bordetella pertussis
cgcggccagggcugcggcggg

SEQ ID NO: 328334 - RNA, 18 nt, Bordetella pertussis
cgcggccagggugccccg

SEQ ID NO: 328335 - RNA, 14 nt, Bordetella pertussis
cgcggccagcgcgu

SEQ ID NO: 328336 - RNA, 17 nt, Bordetella pertussis
cgcggccagcgcgucga

SEQ ID NO: 328337 - RNA, 20 nt, Bordetella pertussis
cgcggccaugcggugcgccg

SEQ ID NO: 328338 - RNA, 21 nt, Bordetella pertussis
cgcggccaugcggugcgccgc

SEQ ID NO: 328339 - RNA, 17 nt, Bordetella pertussis
cgcggccauguccagca

SEQ ID NO: 328340 - RNA, 12 nt, Bordetella pertussis
cgcggcccacgg

SEQ ID NO: 328341 - RNA, 18 nt, Bordetella pertussis
cgcggcccacggccagca

SEQ ID NO: 328342 - RNA, 12 nt, Bordetella pertussis
cgcggccgacgu

SEQ ID NO: 328343 - RNA, 15 nt, Bordetella pertussis
cgcggccgacgugga

SEQ ID NO: 328344 - RNA, 17 nt, Bordetella pertussis
cgcggccgacguggacc

SEQ ID NO: 328345 - RNA, 15 nt, Bordetella pertussis
cgcggccgagcgggc

SEQ ID NO: 328346 - RNA, 21 nt, Bordetella pertussis
cgcggccgagcuccucgagcg

SEQ ID NO: 328347 - RNA, 18 nt, Bordetella pertussis
cgcggccgaggccagcgu

SEQ ID NO: 328348 - RNA, 22 nt, Bordetella pertussis
cgcggccgaggccagcgugccc

SEQ ID NO: 328349 - RNA, 20 nt, Bordetella pertussis
cgcggccgcccccagcgcgc

SEQ ID NO: 328350 - RNA, 13 nt, Bordetella pertussis
cgcggccuggccg

SEQ ID NO: 328351 - RNA, 17 nt, Bordetella pertussis
cgcggccugcuccggcg

SEQ ID NO: 328352 - RNA, 21 nt, Bordetella pertussis
cgcggccuugcaugcgccgca

SEQ ID NO: 328353 - RNA, 24 nt, Bordetella pertussis
cgcggccuugcaugcgccgcacca

SEQ ID NO: 328354 - RNA, 12 nt, Bordetella pertussis
cgcggcgaaaug

SEQ ID NO: 328355 - RNA, 23 nt, Bordetella pertussis
cgcggccuuggucgcgaccucgg

SEQ ID NO: 328356 - RNA, 19 nt, Bordetella pertussis
cgcggcgaaggcgcggcug

SEQ ID NO: 328357 - RNA, 13 nt, Bordetella pertussis
cgcggcgacagcg

SEQ ID NO: 328358 - RNA, 14 nt, Bordetella pertussis
cgcggcgcccagcu

SEQ ID NO: 328359 - RNA, 19 nt, Bordetella pertussis
cgcggcgcccagcuggcgc

SEQ ID NO: 328360 - RNA, 14 nt, Bordetella pertussis
cgcggcgcccccgc

SEQ ID NO: 328361 - RNA, 17 nt, Bordetella pertussis
cgcggcgcccgccugcg

SEQ ID NO: 328362 - RNA, 14 nt, Bordetella pertussis
cgcggcgcccgcgc

SEQ ID NO: 328363 - RNA, 15 nt, Bordetella pertussis
cgcggcgcccgcgca

SEQ ID NO: 328364 - RNA, 10 nt, Bordetella pertussis
cgcggcgccg

SEQ ID NO: 328365 - RNA, 12 nt, Bordetella pertussis
cgcggcgccgca

SEQ ID NO: 328366 - RNA, 14 nt, Bordetella pertussis
cgcggcgccgcauu

SEQ ID NO: 328367 - RNA, 18 nt, Bordetella pertussis
cgcggcgccgccggcggc

SEQ ID NO: 328368 - RNA, 12 nt, Bordetella pertussis
cgcggcgccgcu

SEQ ID NO: 328369 - RNA, 18 nt, Bordetella pertussis
cgcggcgccgcuggccac

SEQ ID NO: 328370 - RNA, 14 nt, Bordetella pertussis
cgcggcgccggccg

SEQ ID NO: 328371 - RNA, 15 nt, Bordetella pertussis
cgcggcgccggccgu

SEQ ID NO: 328372 - RNA, 19 nt, Bordetella pertussis
cgcggcgccggccgucauc

SEQ ID NO: 328373 - RNA, 21 nt, Bordetella pertussis
cgcggcgccggccgucaucca

SEQ ID NO: 328374 - RNA, 19 nt, Bordetella pertussis
cgcggcgccggccuccagc

SEQ ID NO: 328375 - RNA, 13 nt, Bordetella pertussis
cgcggcgcggccu

SEQ ID NO: 328376 - RNA, 14 nt, Bordetella pertussis
cgcggcgcggcgca

SEQ ID NO: 328377 - RNA, 13 nt, Bordetella pertussis
cgcggcgcggucg

SEQ ID NO: 328378 - RNA, 17 nt, Bordetella pertussis
cgcggcgcgugccagca

SEQ ID NO: 328379 - RNA, 20 nt, Bordetella pertussis
cgcggcgcgugccagcaggu

SEQ ID NO: 328380 - RNA, 19 nt, Bordetella pertussis
cgcggcgcguucagcagca

SEQ ID NO: 328381 - RNA, 16 nt, Bordetella pertussis
cgcggcgcuacgccgc

SEQ ID NO: 328382 - RNA, 20 nt, Bordetella pertussis
cgcggcgcugcacgcggccg

SEQ ID NO: 328383 - RNA, 20 nt, Bordetella pertussis
cgcggcgcgucgcgcgccag

SEQ ID NO: 328384 - RNA, 16 nt, Bordetella pertussis
cgcggcgcuggcgccg

SEQ ID NO: 328385 - RNA, 17 nt, Bordetella pertussis
cgcggcgcuggcgccgc

SEQ ID NO: 328386 - RNA, 12 nt, Bordetella pertussis
cgcggcgcugug

SEQ ID NO: 328387 - RNA, 19 nt, Bordetella pertussis
cgcggcggacugcgccgca

SEQ ID NO: 328388 - RNA, 20 nt, Bordetella pertussis
cgcgggcggucggcgcggcg

SEQ ID NO: 328389 - RNA, 15 nt, Bordetella pertussis
cgcggcggaucggcg

SEQ ID NO: 328390 - RNA, 16 nt, Bordetella pertussis
cgcgggcugcgacagg

SEQ ID NO: 328391 - RNA, 21 nt, Bordetella pertussis
cgcggggacaggcaccgccgc

SEQ ID NO: 328392 - RNA, 22 nt, Bordetella pertussis
cgcggggacuggcucccaccgg

SEQ ID NO: 328393 - RNA, 23 nt, Bordetella pertussis
cgcggggauggcuuccugcggca

SEQ ID NO: 328394 - RNA, 13 nt, Bordetella pertussis
cgcggggccaggc

SEQ ID NO: 328395 - RNA, 14 nt, Bordetella pertussis
cgcggggccaggcg

SEQ ID NO: 328396 - RNA, 15 nt, Bordetella pertussis
cgcggguccaggccc

SEQ ID NO: 328397 - RNA, 15 nt, Bordetella pertussis
cgcgggugcgcagca

SEQ ID NO: 328398 - RNA, 12 nt, Bordetella pertussis
cgcgguagcgcc

SEQ ID NO: 328399 - RNA, 13 nt, Bordetella pertussis
cgcgguagcgccc

SEQ ID NO: 328400 - RNA, 17 nt, Bordetella pertussis
cgcgguaggacggcagc

SEQ ID NO: 328401 - RNA, 14 nt, Bordetella pertussis
cgcgguauggccgc

SEQ ID NO: 328402 - RNA, 15 nt, Bordetella pertussis
cgcgguauggccgcc

SEQ ID NO: 328403 - RNA, 16 nt, Bordetella pertussis
cgcgguauucgcgcug

SEQ ID NO: 328404 - RNA, 22 nt, Bordetella pertussis
cgcgguauucgcugcuggccgc

SEQ ID NO: 328405 - RNA, 17 nt, Bordetella pertussis
cgcgguauucggcgacc

SEQ ID NO: 328406 - RNA, 18 nt, Bordetella pertussis
cgcgguauucggcgacca

SEQ ID NO: 328407 - RNA, 17 nt, Bordetella pertussis
cgcgguauugccggaug

SEQ ID NO: 328408 - RNA, 15 nt, Bordetella pertussis
cgcgguauugcgcca

SEQ ID NO: 328409 - RNA, 22 nt, Bordetella pertussis
cgcgguauugcgccaccccgcc

SEQ ID NO: 328410 - RNA, 21 nt, Bordetella pertussis
cgcggucacaucuguccugau

SEQ ID NO: 328411 - RNA, 14 nt, Bordetella pertussis
cgcggucagcauga

SEQ ID NO: 328412 - RNA, 18 nt, Bordetella pertussis
cgcgguccaccucgucgu

SEQ ID NO: 328413 - RNA, 15 nt, Bordetella pertussis
cgcgguccacgcccu

SEQ ID NO: 328414 - RNA, 13 nt, Bordetella pertussis
cgcgguccacgcg

SEQ ID NO: 328415 - RNA, 21 nt, Bordetella pertussis
cgcgguccagcaaggcgucga

SEQ ID NO: 328416 - RNA, 15 nt, Bordetella pertussis
cgcgguccagcacgg

SEQ ID NO: 328417 - RNA, 16 nt, Bordetella pertussis
cgcgguccagcacggc

SEQ ID NO: 328418 - RNA, 12 nt, Bordetella pertussis
cgcgguccagcc

SEQ ID NO: 328419 - RNA, 21 nt, Bordetella pertussis
cgcgguccaugcgaaagcggc

SEQ ID NO: 328420 - RNA, 20 nt, Bordetella pertussis
cgcggucgggaucauccugu

SEQ ID NO: 328421 - RNA, 18 nt, Bordetella pertussis
cgcggugaggcggccggg

SEQ ID NO: 328422 - RNA, 14 nt, Bordetella pertussis
cgcgguugagcgcc

SEQ ID NO: 328423 - RNA, 16 nt, Bordetella pertussis
cgcgguugagcgccag

SEQ ID NO: 328424 - RNA, 20 nt, Bordetella pertussis
cgcgguugagcgccagggcc

SEQ ID NO: 328425 - RNA, 18 nt, Bordetella pertussis
cgcgguugguuugcggcg

SEQ ID NO: 328426 - RNA, 24 nt, Bordetella pertussis
cgcgguugguuugcggcgcgaccu

SEQ ID NO: 328427 - RNA, 13 nt, Bordetella pertussis
cgcgguugggcgc

SEQ ID NO: 328428 - RNA, 16 nt, Bordetella pertussis
cgcgguugggcgcaca

SEQ ID NO: 328429 - RNA, 13 nt, Bordetella pertussis
cgcguacgcggcg

SEQ ID NO: 328430 - RNA, 13 nt, Bordetella pertussis
cgcguagcccaug

SEQ ID NO: 328431 - RNA, 13 nt, Bordetella pertussis
cgcguagcgcggc

SEQ ID NO: 328432 - RNA, 24 nt, Bordetella pertussis
cgcguaggucaggcccacgccgcc

SEQ ID NO: 328433 - RNA, 20 nt, Bordetella pertussis
cgcguagugguaugaccggc

SEQ ID NO: 328434 - RNA, 22 nt, Bordetella pertussis
cgcguagugguaugaccggcgc

SEQ ID NO: 328435 - RNA, 23 nt, Bordetella pertussis
cgcguagugguaugaccggcgcg

SEQ ID NO: 328436 - RNA, 20 nt, Bordetella pertussis
cgcguaugacgcgcugaugc

SEQ ID NO: 328437 - RNA, 16 nt, Bordetella pertussis
cgcguaugcggcagca

SEQ ID NO: 328438 - RNA, 13 nt, Bordetella pertussis
cgcguauggcggc

SEQ ID NO: 328439 - RNA, 15 nt, Bordetella pertussis
cgcguauuccggguc

SEQ ID NO: 328440 - RNA, 22 nt, Bordetella pertussis
cgcgucaaggggcuguaccugg

SEQ ID NO: 328441 - RNA, 16 nt, Bordetella pertussis
cgcgucacgcugaacu

SEQ ID NO: 328442 - RNA, 13 nt, Bordetella pertussis
cgcgucaggccgg

SEQ ID NO: 328443 - RNA, 17 nt, Bordetella pertussis
cgcgucaggccgggcag

SEQ ID NO: 328444 - RNA, 16 nt, Bordetella pertussis
cgcgucaggcgagcgc

SEQ ID NO: 328445 - RNA, 19 nt, Bordetella pertussis
cgcgucaggcgagcgcggc

SEQ ID NO: 328446 - RNA, 20 nt, Bordetella pertussis
cgcgucaggcgagcgcggcg

SEQ ID NO: 328447 - RNA, 23 nt, Bordetella pertussis
cgcgucaguugggcgcgcccagc

SEQ ID NO: 328448 - RNA, 18 nt, Bordetella pertussis
cgcgucauacgacgcggc

SEQ ID NO: 328449 - RNA, 16 nt, Bordetella pertussis
cgcgucauggcgugcg

SEQ ID NO: 328450 - RNA, 17 nt, Bordetella pertussis
cgcguccaagcagaccc

SEQ ID NO: 328451 - RNA, 20 nt, Bordetella pertussis
cgcguccaagcagacccgcg

SEQ ID NO: 328452 - RNA, 21 nt, Bordetella pertussis
cgcguccaagcagacccgcgc

SEQ ID NO: 328453 - RNA, 13 nt, Bordetella pertussis
cgcguccagcgcg

SEQ ID NO: 328454 - RNA, 14 nt, Bordetella pertussis
cgcguccagcgcgc

SEQ ID NO: 328455 - RNA, 18 nt, Bordetella pertussis
cgcguccagcgcgcggcc

SEQ ID NO: 328456 - RNA, 19 nt, Bordetella pertussis
cgcguccagcgcgcggccu

SEQ ID NO: 328457 - RNA, 13 nt, Bordetella pertussis
cgcguccaggcca

SEQ ID NO: 328458 - RNA, 17 nt, Bordetella pertussis
cgcguccaggcccagcg

SEQ ID NO: 328459 - RNA, 17 nt, Bordetella pertussis
cgcguccaggcccuggc

SEQ ID NO: 328460 - RNA, 21 nt, Bordetella pertussis
cgcguccaggcccuggcggcg

SEQ ID NO: 328461 - RNA, 19 nt, Bordetella pertussis
cgcguccaggugcggcggc

SEQ ID NO: 328462 - RNA, 20 nt, Bordetella pertussis
cgcguccaucuggaccgcgc

SEQ ID NO: 328463 - RNA, 16 nt, Bordetella pertussis
cgcgucccgugccggc

SEQ ID NO: 328464 - RNA, 18 nt, Bordetella pertussis
cgcgucccgugccggccg

SEQ ID NO: 328465 - RNA, 22 nt, Bordetella pertussis
cgcgucccgugccggccggacc

SEQ ID NO: 328466 - RNA, 21 nt, Bordetella pertussis
cgcguccggcgcccgccgccg

SEQ ID NO: 328467 - RNA, 22 nt, Bordetella pertussis
cgcguccggugcgauagcgccg

SEQ ID NO: 328468 - RNA, 12 nt, Bordetella pertussis
cgcguccucggc

SEQ ID NO: 328469 - RNA, 15 nt, Bordetella pertussis
cgcguccucggccag

SEQ ID NO: 328470 - RNA, 18 nt, Bordetella pertussis
cgcguccucggccagccg

SEQ ID NO: 328471 - RNA, 13 nt, Bordetella pertussis
cgcguccugcgcc

SEQ ID NO: 328472 - RNA, 18 nt, Bordetella pertussis
cgcguccugcgccaguug

SEQ ID NO: 328473 - RNA, 14 nt, Bordetella pertussis
cgcguccuggcgcg

SEQ ID NO: 328474 - RNA, 15 nt, Bordetella pertussis
cgcguccuggcgcga

SEQ ID NO: 328475 - RNA, 14 nt, Bordetella pertussis
cgcguccugggccg

SEQ ID NO: 328476 - RNA, 15 nt, Bordetella pertussis
cgcguccuuggcggc

SEQ ID NO: 328477 - RNA, 20 nt, Bordetella pertussis
cgcgucgacggugcgcgcca

SEQ ID NO: 328478 - RNA, 21 nt, Bordetella pertussis
cgcgucgacggugcgcgccac

SEQ ID NO: 328479 - RNA, 15 nt, Bordetella pertussis
cgcgucgagcagcgc

SEQ ID NO: 328480 - RNA, 16 nt, Bordetella pertussis
cgcgucgagcagcgca

SEQ ID NO: 328481 - RNA, 19 nt, Bordetella pertussis
cgcgucgagcaggccggcg

SEQ ID NO: 328482 - RNA, 20 nt, Bordetella pertussis
cgcgucgagcaggccggcgu

SEQ ID NO: 328483 - RNA, 23 nt, Bordetella pertussis
cgcgucgagcgcgacgcgcucgu

SEQ ID NO: 328484 - RNA, 17 nt, Bordetella pertussis
cgcgucgauccggcagc

SEQ ID NO: 328485 - RNA, 19 nt, Bordetella pertussis
cgcgucgauccggcagcag

SEQ ID NO: 328486 - RNA, 20 nt, Bordetella pertussis
cgcgucgauccggcagcagc

SEQ ID NO: 328487 - RNA, 21 nt, Bordetella pertussis
cgcgucgauccggcagcagca

SEQ ID NO: 328488 - RNA, 16 nt, Bordetella pertussis
cgcgucgauggagucg

SEQ ID NO: 328489 - RNA, 15 nt, Bordetella pertussis
cgcgucgccgcgccg

SEQ ID NO: 328490 - RNA, 15 nt, Bordetella pertussis
cgcgucgccggcgau

SEQ ID NO: 328491 - RNA, 14 nt, Bordetella pertussis
cgcgucgcgcggcg

SEQ ID NO: 328492 - RNA, 20 nt, Bordetella pertussis
cgcgucgcguagcgcggccg

SEQ ID NO: 328493 - RNA, 21 nt, Bordetella pertussis
cgcgucgcguagcgcggccgg

SEQ ID NO: 328494 - RNA, 14 nt, Bordetella pertussis
cgcgucgcugcgcg

SEQ ID NO: 328495 - RNA, 14 nt, Bordetella pertussis
cgcgucgcuggccg

SEQ ID NO: 328496 - RNA, 15 nt, Bordetella pertussis
cgcgucgcuggccgg

SEQ ID NO: 328497 - RNA, 16 nt, Bordetella pertussis
cgcgucgcuggccgga

SEQ ID NO: 328498 - RNA, 19 nt, Bordetella pertussis
cgcgucgcgguacaggcug

SEQ ID NO: 328499 - RNA, 22 nt, Bordetella pertussis
cgcgucgcucauggaggggcgc

SEQ ID NO: 328500 - RNA, 18 nt, Bordetella pertussis
cgcgucggacgcgcgccg

SEQ ID NO: 328501 - RNA, 19 nt, Bordetella pertussis
cgcgucggccagcgccgcg

SEQ ID NO: 328502 - RNA, 13 nt, Bordetella pertussis
cgcgucggccgcg

SEQ ID NO: 328503 - RNA, 17 nt, Bordetella pertussis
cgcgucggccucaucga

SEQ ID NO: 328504 - RNA, 13 nt, Bordetella pertussis
cgcgucggcgccg

SEQ ID NO: 328505 - RNA, 16 nt, Bordetella pertussis
cgcgucguccagcgug

SEQ ID NO: 328506 - RNA, 22 nt, Bordetella pertussis
cgcgucguccagcguggcgcag

SEQ ID NO: 328507 - RNA, 14 nt, Bordetella pertussis
cgcgucgugcccgc

SEQ ID NO: 328508 - RNA, 15 nt, Bordetella pertussis
cgcgucgugcccgcc

SEQ ID NO: 328509 - RNA, 21 nt, Bordetella pertussis
cgcgucguugcgccgaucgcg

SEQ ID NO: 328510 - RNA, 23 nt, Bordetella pertussis
cgcgucguugcgccgaucgcggc

SEQ ID NO: 328511 - RNA, 21 nt, Bordetella pertussis
cgcgucuccagcgccggcagc

SEQ ID NO: 328512 - RNA, 21 nt, Bordetella pertussis
cgcgucuggaggacgagcggg

SEQ ID NO: 328513 - RNA, 19 nt, Bordetella pertussis
cgcgucuuggcgggcacca

SEQ ID NO: 328514 - RNA, 20 nt, Bordetella pertussis
cgcgucuucaguugacgccg

SEQ ID NO: 328515 - RNA, 16 nt, Bordetella pertussis
cgcgugacggccgcca

SEQ ID NO: 328516 - RNA, 19 nt, Bordetella pertussis
cgcgugguggcgcagaugg

SEQ ID NO: 328517 - RNA, 17 nt, Bordetella pertussis
cgcgugucccagccggc

SEQ ID NO: 328518 - RNA, 19 nt, Bordetella pertussis
cgcguucagcagcaggccc

SEQ ID NO: 328519 - RNA, 20 nt, Bordetella pertussis
cgcguucagcagcaggcccu

SEQ ID NO: 328520 - RNA, 21 nt, Bordetella pertussis
cgcguucacgccggcgcgccg

SEQ ID NO: 328521 - RNA, 22 nt, Bordetella pertussis
cgcguucagggcgccgcggcgg

SEQ ID NO: 328522 - RNA, 19 nt, Bordetella pertussis
cgcguugaccggcuggcgc

SEQ ID NO: 328523 - RNA, 14 nt, Bordetella pertussis
cgcguugagcgccg

SEQ ID NO: 328524 - RNA, 15 nt, Bordetella pertussis
cgcguugagcgccga

SEQ ID NO: 328525 - RNA, 20 nt, Bordetella pertussis
cgcguugcaccgcgucggcc

SEQ ID NO: 328526 - RNA, 18 nt, Bordetella pertussis
cgcguugcagccacaggc

SEQ ID NO: 328527 - RNA, 15 nt, Bordetella pertussis
cgcguugcgcugccc

SEQ ID NO: 328528 - RNA, 16 nt, Bordetella pertussis
cgcguugcgcugcccg

SEQ ID NO: 328529 - RNA, 22 nt, Bordetella pertussis
cgcguuggcgaggacaggccag

SEQ ID NO: 328530 - RNA, 16 nt, Bordetella pertussis
cgcguuguucgggccg

SEQ ID NO: 328531 - RNA, 17 nt, Bordetella pertussis
cgcguuguucgggccgg

SEQ ID NO: 328532 - RNA, 20 nt, Bordetella pertussis
cgcguuguucgggccggcug

SEQ ID NO: 328533 - RNA, 21 nt, Bordetella pertussis
cgcguuucccucggugcugcu

SEQ ID NO: 328534 - RNA, 22 nt, Bordetella pertussis
cgcguuucccucggugcugcug

SEQ ID NO: 328535 - RNA, 17 nt, Bordetella pertussis
cgcucaucaucgcgcug

SEQ ID NO: 328536 - RNA, 18 nt, Bordetella pertussis
cgcucaucaucgcgcugg

SEQ ID NO: 328537 - RNA, 22 nt, Bordetella pertussis
cgcucaucaucgcgcuggcgcg

SEQ ID NO: 328538 - RNA, 14 nt, Bordetella pertussis
cgcucauccaggcg

SEQ ID NO: 328539 - RNA, 19 nt, Bordetella pertussis
cgcucaugaaacgaucggc

SEQ ID NO: 328540 - RNA, 15 nt, Bordetella pertussis
cgcucaugaccagcg

SEQ ID NO: 328541 - RNA, 17 nt, Bordetella pertussis
cgcucaugaccagcggc

SEQ ID NO: 328542 - RNA, 20 nt, Bordetella pertussis
cgcucaugaccagcggcgug

SEQ ID NO: 328543 - RNA, 22 nt, Bordetella pertussis
cgcucaugaccagcggcgugau

SEQ ID NO: 328544 - RNA, 17 nt, Bordetella pertussis
cgcucaugccggcaagc

SEQ ID NO: 328545 - RNA, 21 nt, Bordetella pertussis
cgcucauggaggggcgcaggc

SEQ ID NO: 328546 - RNA, 22 nt, Bordetella pertussis
cgcucauggaggggcgcaggca

SEQ ID NO: 328547 - RNA, 15 nt, Bordetella pertussis
cgcucauguucgggc

SEQ ID NO: 328548 - RNA, 14 nt, Bordetella pertussis
cgcuccaccagcac

SEQ ID NO: 328549 - RNA, 13 nt, Bordetella pertussis
cgcuccagcaugu

SEQ ID NO: 328550 - RNA, 19 nt, Bordetella pertussis
cgcuccagggcgucggcga

SEQ ID NO: 328551 - RNA, 15 nt, Bordetella pertussis
cgcuccauggcgccg

SEQ ID NO: 328552 - RNA, 19 nt, Bordetella pertussis
cgcuccauggcgccggcgg

SEQ ID NO: 328553 - RNA, 20 nt, Bordetella pertussis
cgcuccauggcgccggcggc

SEQ ID NO: 328554 - RNA, 19 nt, Bordetella pertussis
cgcuccgccauggaggcgc

SEQ ID NO: 328555 - RNA, 13 nt, Bordetella pertussis
cgcuccggcauga

SEQ ID NO: 328556 - RNA, 21 nt, Bordetella pertussis
cgcuccggcugcgcgcgcagc

SEQ ID NO: 328557 - RNA, 13 nt, Bordetella pertussis
cgcuccucgcgcg

SEQ ID NO: 328558 - RNA, 19 nt, Bordetella pertussis
cgcuccuggaacuugggau

SEQ ID NO: 328559 - RNA, 18 nt, Bordetella pertussis
cgcuccuucgugguggcg

SEQ ID NO: 328560 - RNA, 19 nt, Bordetella pertussis
cgcucgaaaaagcccugcg

SEQ ID NO: 328561 - RNA, 15 nt, Bordetella pertussis
cgcucgaagcgcaug

SEQ ID NO: 328562 - RNA, 14 nt, Bordetella pertussis
cgcucgaaggcgcc

SEQ ID NO: 328563 - RNA, 20 nt, Bordetella pertussis
cgcucgaauggcugcgcgcc

SEQ ID NO: 328564 - RNA, 22 nt, Bordetella pertussis
cgcucgaauggcugcgcgccgu

SEQ ID NO: 328565 - RNA, 15 nt, Bordetella pertussis
cgcucgaccgaaaug

SEQ ID NO: 328566 - RNA, 15 nt, Bordetella pertussis
cgcucgaggccaggc

SEQ ID NO: 328567 - RNA, 20 nt, Bordetella pertussis
cgcucgaggccaggcugacc

SEQ ID NO: 328568 - RNA, 18 nt, Bordetella pertussis
cgcucgagcgccugcagc

SEQ ID NO: 328569 - RNA, 14 nt, Bordetella pertussis
cgcucgaugcgcca

SEQ ID NO: 328570 - RNA, 15 nt, Bordetella pertussis
cgcucgaugcgccag

SEQ ID NO: 328571 - RNA, 22 nt, Bordetella pertussis
cgcucgaugcgccaguccagcg

SEQ ID NO: 328572 - RNA, 13 nt, Bordetella pertussis
cgcucgcccagcc

SEQ ID NO: 328573 - RNA, 16 nt, Bordetella pertussis
cgcucgcccagccgcc

SEQ ID NO: 328574 - RNA, 21 nt, Bordetella pertussis
cgcucgcccccgcgccgcgca

SEQ ID NO: 328575 - RNA, 19 nt, Bordetella pertussis
cgcucgccccggcgcgcag

SEQ ID NO: 328576 - RNA, 14 nt, Bordetella pertussis
cgcucgcccggcca

SEQ ID NO: 328577 - RNA, 14 nt, Bordetella pertussis
cgcucggcgcugcc

SEQ ID NO: 328578 - RNA, 22 nt, Bordetella pertussis
cgcucggcguugcuggcaaagc

SEQ ID NO: 328579 - RNA, 20 nt, Bordetella pertussis
cgcucggcuuccugccgcac

SEQ ID NO: 328580 - RNA, 21 nt, Bordetella pertussis
cgcucgggcagcucgcggucg

SEQ ID NO: 328581 - RNA, 14 nt, Bordetella pertussis
cgcucgggcgcggc

SEQ ID NO: 328582 - RNA, 15 nt, Bordetella pertussis
cgcucgggcgcggca

SEQ ID NO: 328583 - RNA, 16 nt, Bordetella pertussis
cgcucgggcucgcgcg

SEQ ID NO: 328584 - RNA, 20 nt, Bordetella pertussis
cgcucgucaugaucccgcgc

SEQ ID NO: 328585 - RNA, 14 nt, Bordetella pertussis
cgcucuugagcgcg

SEQ ID NO: 328586 - RNA, 17 nt, Bordetella pertussis
cgcucuugagcgcggcc

SEQ ID NO: 328587 - RNA, 20 nt, Bordetella pertussis
cgcucuugagcgcggccucg

SEQ ID NO: 328588 - RNA, 23 nt, Bordetella pertussis
cgcucuugagcgcggccucgccg

SEQ ID NO: 328589 - RNA, 16 nt, Bordetella pertussis
cgcucuugcgcgcgcc

SEQ ID NO: 328590 - RNA, 14 nt, Bordetella pertussis
cgcugaccggccug

SEQ ID NO: 328591 - RNA, 15 nt, Bordetella pertussis
cgcugaccggccugg

SEQ ID NO: 328592 - RNA, 16 nt, Bordetella pertussis
cgcugaccggccuggu

SEQ ID NO: 328593 - RNA, 20 nt, Bordetella pertussis
cgcugaccugcacgauggcg

SEQ ID NO: 328594 - RNA, 17 nt, Bordetella pertussis
cgcugaccuggugugcc

SEQ ID NO: 328595 - RNA, 14 nt, Bordetella pertussis
cgcugacgccgaug

SEQ ID NO: 328596 - RNA, 23 nt, Bordetella pertussis
cgcugaucagguccaugaacgcc

SEQ ID NO: 328597 - RNA, 14 nt, Bordetella pertussis
cgcugaucgccggc

SEQ ID NO: 328598 - RNA, 16 nt, Bordetella pertussis
cgcugaucgccggcgc

SEQ ID NO: 328599 - RNA, 13 nt, Bordetella pertussis
cgcugaucggccg

SEQ ID NO: 328600 - RNA, 15 nt, Bordetella pertussis
cgcugcccaggaugg

SEQ ID NO: 328601 - RNA, 17 nt, Bordetella pertussis
cgcugcccgucgcuggc

SEQ ID NO: 328602 - RNA, 19 nt, Bordetella pertussis
cgcugcccguuggcgucga

SEQ ID NO: 328603 - RNA, 15 nt, Bordetella pertussis
cgcugcccugcugcu

SEQ ID NO: 328604 - RNA, 16 nt, Bordetella pertussis
cgcugcccugcugcug

SEQ ID NO: 328605 - RNA, 14 nt, Bordetella pertussis
cgcugccgaccagc

SEQ ID NO: 328606 - RNA, 15 nt, Bordetella pertussis
cgcugccgaccagca

SEQ ID NO: 328607 - RNA, 20 nt, Bordetella pertussis
cgcugccgagacggccgccg

SEQ ID NO: 328608 - RNA, 20 nt, Bordetella pertussis
cgcugccugccggccggcca

SEQ ID NO: 328609 - RNA, 20 nt, Bordetella pertussis
cgcugcgaaaaagcccgcgc

SEQ ID NO: 328610 - RNA, 23 nt, Bordetella pertussis
cgcugcgaaaaagcccgcgccac

SEQ ID NO: 328611 - RNA, 14 nt, Bordetella pertussis
cgcugcgaaacagc

SEQ ID NO: 328612 - RNA, 17 nt, Bordetella pertussis
cgcugcgaaacagcagc

SEQ ID NO: 328613 - RNA, 18 nt, Bordetella pertussis
cgcugcgacagcagcaug

SEQ ID NO: 328614 - RNA, 15 nt, Bordetella pertussis
cgcugcgccuuggcg

SEQ ID NO: 328615 - RNA, 18 nt, Bordetella pertussis
cgcugcgccuuggcgcgc

SEQ ID NO: 328616 - RNA, 21 nt, Bordetella pertussis
cgcugcgcgaaacggccgggu

SEQ ID NO: 328617 - RNA, 13 nt, Bordetella pertussis
cgcugcgcgaacg

SEQ ID NO: 328618 - RNA, 12 nt, Bordetella pertussis
cgcugcgcgccg

SEQ ID NO: 328619 - RNA, 15 nt, Bordetella pertussis
cgcugcgcgccgccg

SEQ ID NO: 328620 - RNA, 19 nt, Bordetella pertussis
cgcugcgcgcggccuggcg

SEQ ID NO: 328621 - RNA, 17 nt, Bordetella pertussis
cgcugcgcuggccgcga

SEQ ID NO: 328622 - RNA, 22 nt, Bordetella pertussis
cgcugcggcaagggugccuguc

SEQ ID NO: 328623 - RNA, 13 nt, Bordetella pertussis
cgcugcggccggu

SEQ ID NO: 328624 - RNA, 20 nt, Bordetella pertussis
cgcugcgggaggugccgcag

SEQ ID NO: 328625 - RNA, 17 nt, Bordetella pertussis
cgcugcggucgcgaucg

SEQ ID NO: 328626 - RNA, 20 nt, Bordetella pertussis
cgcugcggucgcgaucgucg

SEQ ID NO: 328627 - RNA, 18 nt, Bordetella pertussis
cgcugcucgaaacgcugg

SEQ ID NO: 328628 - RNA, 21 nt, Bordetella pertussis
cgcugcucgacagcagcccgc

SEQ ID NO: 328629 - RNA, 23 nt, Bordetella pertussis
cgcugcucgacagcagcccgcug

SEQ ID NO: 328630 - RNA, 17 nt, Bordetella pertussis
cgcugcucuccaugcug

SEQ ID NO: 328631 - RNA, 17 nt, Bordetella pertussis
cgcugcucuuggcgccg

SEQ ID NO: 328632 - RNA, 14 nt, Bordetella pertussis
cgcugcugaccgac

SEQ ID NO: 328633 - RNA, 15 nt, Bordetella pertussis
cgcugcugaccgacg

SEQ ID NO: 328634 - RNA, 21 nt, Bordetella pertussis
cgcugcugauccucgccagcg

SEQ ID NO: 328635 - RNA, 22 nt, Bordetella pertussis
cgcugcugcaggccggcgcgca

SEQ ID NO: 328636 - RNA, 19 nt, Bordetella pertussis
cgcugcuggccaagcgcgc

SEQ ID NO: 328637 - RNA, 20 nt, Bordetella pertussis
cgcugcuggccaagcgcgcc

SEQ ID NO: 328638 - RNA, 15 nt, Bordetella pertussis
cgcugcuggccgcgg

SEQ ID NO: 328639 - RNA, 13 nt, Bordetella pertussis
cgcugcuggccgg

SEQ ID NO: 328640 - RNA, 14 nt, Bordetella pertussis
cgcugcuggccggc

SEQ ID NO: 328641 - RNA, 14 nt, Bordetella pertussis
cgcugcuggcggcg

SEQ ID NO: 328642 - RNA, 14 nt, Bordetella pertussis
cgcugcugucgcgc

SEQ ID NO: 328643 - RNA, 16 nt, Bordetella pertussis
cgcugcugucgcgcug

SEQ ID NO: 328644 - RNA, 19 nt, Bordetella pertussis
cgcugcugucgcgcugccc

SEQ ID NO: 328645 - RNA, 24 nt, Bordetella pertussis
cgcuggaaacuaaaucgcggcucg

SEQ ID NO: 328646 - RNA, 17 nt, Bordetella pertussis
cgcuggaagacguggcc

SEQ ID NO: 328647 - RNA, 18 nt, Bordetella pertussis
cgcuggacgcccuggcgc

SEQ ID NO: 328648 - RNA, 13 nt, Bordetella pertussis
cgcuggacgcgcc

SEQ ID NO: 328649 - RNA, 18 nt, Bordetella pertussis
cgcuggagaacaggcggc

SEQ ID NO: 328650 - RNA, 16 nt, Bordetella pertussis
cgcuggagaccggcau

SEQ ID NO: 328651 - RNA, 17 nt, Bordetella pertussis
cgcuggagaccggcaug

SEQ ID NO: 328652 - RNA, 18 nt, Bordetella pertussis
cgcuggagaccggcaugg

SEQ ID NO: 328653 - RNA, 15 nt, Bordetella pertussis
cgcuggagcgcggcg

SEQ ID NO: 328654 - RNA, 21 nt, Bordetella pertussis
cgcuggauggucacgcccagg

SEQ ID NO: 328655 - RNA, 20 nt, Bordetella pertussis
cgcuggcaucgucgcgcugc

SEQ ID NO: 328656 - RNA, 21 nt, Bordetella pertussis
cgcuggccacguugucgcgcg

SEQ ID NO: 328657 - RNA, 13 nt, Bordetella pertussis
cgcuggccagccg

SEQ ID NO: 328658 - RNA, 21 nt, Bordetella pertussis
cgcuggccaucaccgccuccg

SEQ ID NO: 328659 - RNA, 23 nt, Bordetella pertussis
cgcuggccaucaccgccuccggg

SEQ ID NO: 328660 - RNA, 12 nt, Bordetella pertussis
cgcuggccaucg

SEQ ID NO: 328661 - RNA, 21 nt, Bordetella pertussis
cgcuggccaucguacgcgugg

SEQ ID NO: 328662 - RNA, 14 nt, Bordetella pertussis
cgcuggccaugccg

SEQ ID NO: 328663 - RNA, 18 nt, Bordetella pertussis
cgcuggccaugccgucgc

SEQ ID NO: 328664 - RNA, 20 nt, Bordetella pertussis
cgcuggcccacucggugcgc

SEQ ID NO: 328665 - RNA, 20 nt, Bordetella pertussis
cgcuggcccaguucgcgcag

SEQ ID NO: 328666 - RNA, 22 nt, Bordetella pertussis
cgcuggcccaguucgcgcagca

SEQ ID NO: 328667 - RNA, 12 nt, Bordetella pertussis
cgcuggcccgcg

SEQ ID NO: 328668 - RNA, 13 nt, Bordetella pertussis
cgcuggcccgcgc

SEQ ID NO: 328669 - RNA, 20 nt, Bordetella pertussis
cgcuggcccgcgcgagcggc

SEQ ID NO: 328670 - RNA, 14 nt, Bordetella pertussis
cgcuggccgccaug

SEQ ID NO: 328671 - RNA, 14 nt, Bordetella pertussis
cgcuggccgcccgc

SEQ ID NO: 328672 - RNA, 16 nt, Bordetella pertussis
cgcuggccgcccgcgg

SEQ ID NO: 328673 - RNA, 19 nt, Bordetella pertussis
cgcuggccgcccgcggccu

SEQ ID NO: 328674 - RNA, 18 nt, Bordetella pertussis
cgcuggccgcgcccgccg

SEQ ID NO: 328675 - RNA, 13 nt, Bordetella pertussis
cgcuggccggccg

SEQ ID NO: 328676 - RNA, 15 nt, Bordetella pertussis
cgcuggccggccgcg

SEQ ID NO: 328677 - RNA, 13 nt, Bordetella pertussis
cgcuggccggcgu

SEQ ID NO: 328678 - RNA, 14 nt, Bordetella pertussis
cgcuggccggcgug

SEQ ID NO: 328679 - RNA, 13 nt, Bordetella pertussis
cgcuggccgucgc

SEQ ID NO: 328680 - RNA, 18 nt, Bordetella pertussis
cgcuggccugccgcgccg

SEQ ID NO: 328681 - RNA, 17 nt, Bordetella pertussis
cgcuggccuggccgccg

SEQ ID NO: 328682 - RNA, 23 nt, Bordetella pertussis
cgcuggccuggccgccggcggcg

SEQ ID NO: 328683 - RNA, 20 nt, Bordetella pertussis
cgcuggcgaagaacaccgcc

SEQ ID NO: 328684 - RNA, 18 nt, Bordetella pertussis
cgcuggcgaagaccguga

SEQ ID NO: 328685 - RNA, 16 nt, Bordetella pertussis
cgcuggcgagcauggc

SEQ ID NO: 328686 - RNA, 18 nt, Bordetella pertussis
cgcuggcgaucaggccgc

SEQ ID NO: 328687 - RNA, 20 nt, Bordetella pertussis
cgcuggcgaugcccaccagc

SEQ ID NO: 328688 - RNA, 18 nt, Bordetella pertussis
cgcuggcgauggccugau

SEQ ID NO: 328689 - RNA, 16 nt, Bordetella pertussis
cgcuggcgcaaggacg

SEQ ID NO: 328690 - RNA, 17 nt, Bordetella pertussis
cgcugggauggguacgc

SEQ ID NO: 328691 - RNA, 17 nt, Bordetella pertussis
cgcugggcacauccagc

SEQ ID NO: 328692 - RNA, 19 nt, Bordetella pertussis
cgcugggcaggcuggcgcg

SEQ ID NO: 328693 - RNA, 16 nt, Bordetella pertussis
cgcugggccagcaucg

SEQ ID NO: 328694 - RNA, 17 nt, Bordetella pertussis
cgcugggccaggccggc

SEQ ID NO: 328695 - RNA, 18 nt, Bordetella pertussis
cgcugggccaggccggcc

SEQ ID NO: 328696 - RNA, 19 nt, Bordetella pertussis
cgcugggcgaggcgcuggc

SEQ ID NO: 328697 - RNA, 14 nt, Bordetella pertussis
cgcugggcgccagc

SEQ ID NO: 328698 - RNA, 21 nt, Bordetella pertussis
cgcugggcgccagcagcacgu

SEQ ID NO: 328699 - RNA, 20 nt, Bordetella pertussis
cgcugggcgguugcgcugcu

SEQ ID NO: 328700 - RNA, 18 nt, Bordetella pertussis
cgcugggcuacgacccgc

SEQ ID NO: 328701 - RNA, 15 nt, Bordetella pertussis
cgcugggcgcgcaca

SEQ ID NO: 328702 - RNA, 18 nt, Bordetella pertussis
cgcuggucgagagccugg

SEQ ID NO: 328703 - RNA, 16 nt, Bordetella pertussis
cgcuggucgcgcagca

SEQ ID NO: 328704 - RNA, 23 nt, Bordetella pertussis
cgcuggucgggaugccccgcccg

SEQ ID NO: 328705 - RNA, 18 nt, Bordetella pertussis
cgcuggucguaucgccgc

SEQ ID NO: 328706 - RNA, 14 nt, Bordetella pertussis
cgcuggucgucgcg

SEQ ID NO: 328707 - RNA, 18 nt, Bordetella pertussis
cgcuggugaagucggccc

SEQ ID NO: 328708 - RNA, 13 nt, Bordetella pertussis
cgcuggugcuggc

SEQ ID NO: 328709 - RNA, 15 nt, Bordetella pertussis
cgcuggugcuggccg

SEQ ID NO: 328710 - RNA, 17 nt, Bordetella pertussis
cgcugguggccaccagc

SEQ ID NO: 328711 - RNA, 22 nt, Bordetella pertussis
cgcuguacugguaccaggcggc

SEQ ID NO: 328712 - RNA, 22 nt, Bordetella pertussis
cgcuguagaggcgcggcucgcc

SEQ ID NO: 328713 - RNA, 14 nt, Bordetella pertussis
cgcuguagcgcagc

SEQ ID NO: 328714 - RNA, 15 nt, Bordetella pertussis
cgcuguagcgcagcc

SEQ ID NO: 328715 - RNA, 23 nt, Bordetella pertussis
cggaaugucguugcacagcacgu

SEQ ID NO: 328716 - RNA, 15 nt, Bordetella pertussis
cggacaacgccagga

SEQ ID NO: 328717 - RNA, 13 nt, Bordetella pertussis
cggacaacgcgcg

SEQ ID NO: 328718 - RNA, 15 nt, Bordetella pertussis
cggacaacgcgcgcc

SEQ ID NO: 328719 - RNA, 21 nt, Bordetella pertussis
cggacacguacaaccgcgccg

SEQ ID NO: 328720 - RNA, 14 nt, Bordetella pertussis
cggacacgcccugg

SEQ ID NO: 328721 - RNA, 19 nt, Bordetella pertussis
cggacagaugccguccugg

SEQ ID NO: 328722 - RNA, 20 nt, Bordetella pertussis
cggacagaugccguccuggc

SEQ ID NO: 328723 - RNA, 18 nt, Bordetella pertussis
cggacagggccgcgagca

SEQ ID NO: 328724 - RNA, 19 nt, Bordetella pertussis
cggacaggucggcgcccac

SEQ ID NO: 328725 - RNA, 21 nt, Bordetella pertussis
cggaccagcgguugcgccagc

SEQ ID NO: 328726 - RNA, 16 nt, Bordetella pertussis
cggaccagggcucgua

SEQ ID NO: 328727 - RNA, 22 nt, Bordetella pertussis
cggacccaggccucggcuugca

SEQ ID NO: 328728 - RNA, 13 nt, Bordetella pertussis
cggacccaguucg

SEQ ID NO: 328729 - RNA, 17 nt, Bordetella pertussis
cggacccaguucggccg

SEQ ID NO: 328730 - RNA, 13 nt, Bordetella pertussis
cggacccgcgccg

SEQ ID NO: 328731 - RNA, 14 nt, Bordetella pertussis
cggacccgcgccgc

SEQ ID NO: 328732 - RNA, 20 nt, Bordetella pertussis
cggaccgcugugcgcguucc

SEQ ID NO: 328733 - RNA, 16 nt, Bordetella pertussis
cggaccuccugguccg

SEQ ID NO: 328734 - RNA, 16 nt, Bordetella pertussis
cggaccugcucgagcg

SEQ ID NO: 328735 - RNA, 18 nt, Bordetella pertussis
cggaccugcucgagcggc

SEQ ID NO: 328736 - RNA, 20 nt, Bordetella pertussis
cggaccuugcgaggcccggc

SEQ ID NO: 328737 - RNA, 23 nt, Bordetella pertussis
cggaccuugcgaggcccggccug

SEQ ID NO: 328738 - RNA, 22 nt, Bordetella pertussis
cggacgauguagaucuggcgcg

SEQ ID NO: 328739 - RNA, 23 nt, Bordetella pertussis
cggacgcaaccggucggccggca

SEQ ID NO: 328740 - RNA, 21 nt, Bordetella pertussis
cggacgcaccuuucugcugcu

SEQ ID NO: 328741 - RNA, 21 nt, Bordetella pertussis
cggacgcaaaaacgcccggcg

SEQ ID NO: 328742 - RNA, 16 nt, Bordetella pertussis
cggacgccauggcggc

SEQ ID NO: 328743 - RNA, 23 nt, Bordetella pertussis
cggacgccauggcggcggccacg

SEQ ID NO: 328744 - RNA, 12 nt, Bordetella pertussis
cggacgccagcc

SEQ ID NO: 328745 - RNA, 16 nt, Bordetella pertussis
cggacgccagcccugg

SEQ ID NO: 328746 - RNA, 13 nt, Bordetella pertussis
cggacgcccugaa

SEQ ID NO: 328747 - RNA, 15 nt, Bordetella pertussis
cggacgccucgccgg

SEQ ID NO: 328748 - RNA, 16 nt, Bordetella pertussis
cggacgcgccgggcga

SEQ ID NO: 328749 - RNA, 11 nt, Bordetella pertussis
cggacgcgcgc

SEQ ID NO: 328750 - RNA, 12 nt, Bordetella pertussis
cggacgcgcgcc

SEQ ID NO: 328751 - RNA, 20 nt, Bordetella pertussis
cggacgcgcgccgcaucaug

SEQ ID NO: 328752 - RNA, 14 nt, Bordetella pertussis
cggacgcggccggc

SEQ ID NO: 328753 - RNA, 15 nt, Bordetella pertussis
cggacgcggccggca

SEQ ID NO: 328754 - RNA, 12 nt, Bordetella pertussis
cggacggcgccu

SEQ ID NO: 328755 - RNA, 15 nt, Bordetella pertussis
cggacggcgggcgcc

SEQ ID NO: 328756 - RNA, 23 nt, Bordetella pertussis
cggacggguaucgucgaccugga

SEQ ID NO: 328757 - RNA, 20 nt, Bordetella pertussis
cggacguagucgcacgcggc

SEQ ID NO: 328758 - RNA, 15 nt, Bordetella pertussis
cggacgugggcgccu

SEQ ID NO: 328759 - RNA, 23 nt, Bordetella pertussis
cggacugaacgcguccaggcccu

SEQ ID NO: 328760 - RNA, 22 nt, Bordetella pertussis
cggacuggauauggcgccgcac

SEQ ID NO: 328761 - RNA, 24 nt, Bordetella pertussis
cggacuggauauggcgccgcacau

SEQ ID NO: 328762 - RNA, 17 nt, Bordetella pertussis
cggacuggccgcgccgc

SEQ ID NO: 328763 - RNA, 20 nt, Bordetella pertussis
cggacuggccgcgccgcugg

SEQ ID NO: 328764 - RNA, 20 nt, Bordetella pertussis
cggacuggcgcgcaccaugg

SEQ ID NO: 328765 - RNA, 17 nt, Bordetella pertussis
cggacuggcuggucagg

SEQ ID NO: 328766 - RNA, 20 nt, Bordetella pertussis
cggagaaagaagcccccgcg

SEQ ID NO: 328767 - RNA, 21 nt, Bordetella pertussis
cggagaaaucgccgccggcgg

SEQ ID NO: 328768 - RNA, 14 nt, Bordetella pertussis
cggagcacggaaga

SEQ ID NO: 328769 - RNA, 17 nt, Bordetella pertussis
cggagcagucgcgcagc

SEQ ID NO: 328770 - RNA, 18 nt, Bordetella pertussis
cggagcagucgcgcagcc

SEQ ID NO: 328771 - RNA, 19 nt, Bordetella pertussis
cggagccaguccccgcagg

SEQ ID NO: 328772 - RNA, 18 nt, Bordetella pertussis
cggagcccgucaggcgga

SEQ ID NO: 328773 - RNA, 13 nt, Bordetella pertussis
cggagccuguccc

SEQ ID NO: 328774 - RNA, 22 nt, Bordetella pertussis
cggaggagguggcuggugccag

SEQ ID NO: 328775 - RNA, 20 nt, Bordetella pertussis
cggaggauacggccagcgcc

SEQ ID NO: 328776 - RNA, 20 nt, Bordetella pertussis
cggaggcuuuguggcgucgg

SEQ ID NO: 328777 - RNA, 18 nt, Bordetella pertussis
cggauagugguucaugcg

SEQ ID NO: 328778 - RNA, 15 nt, Bordetella pertussis
cggauauggccggcg

SEQ ID NO: 328779 - RNA, 16 nt, Bordetella pertussis
cggauauucgucggcc

SEQ ID NO: 328780 - RNA, 20 nt, Bordetella pertussis
cggauauucgucggccgccg

SEQ ID NO: 328781 - RNA, 20 nt, Bordetella pertussis
cggaucaagcggcccgcgcc

SEQ ID NO: 328782 - RNA, 12 nt, Bordetella pertussis
cggaucacgcua

SEQ ID NO: 328783 - RNA, 13 nt, Bordetella pertussis
cggaucagcgccu

SEQ ID NO: 328784 - RNA, 22 nt, Bordetella pertussis
cggaucgaaaccggcgcgcgcg

SEQ ID NO: 328785 - RNA, 13 nt, Bordetella pertussis
cggaucgaaccca

SEQ ID NO: 328786 - RNA, 21 nt, Bordetella pertussis
cggaucgacgcgauguccagc

SEQ ID NO: 328787 - RNA, 14 nt, Bordetella pertussis
cggaucgccgggca

SEQ ID NO: 328788 - RNA, 23 nt, Bordetella pertussis
cggaucgucuuuuuacaggcagc

SEQ ID NO: 328789 - RNA, 13 nt, Bordetella pertussis
cggaucgugcgcc

SEQ ID NO: 328790 - RNA, 21 nt, Bordetella pertussis
cggaucucggccagcagcgcc

SEQ ID NO: 328791 - RNA, 17 nt, Bordetella pertussis
cggaugccguccacgcc

SEQ ID NO: 328792 - RNA, 17 nt, Bordetella pertussis
cggaugccgucuuggcg

SEQ ID NO: 328793 - RNA, 18 nt, Bordetella pertussis
cggaugccgucuuggcgg

SEQ ID NO: 328794 - RNA, 20 nt, Bordetella pertussis
cggaugcgcaggacggcgcc

SEQ ID NO: 328795 - RNA, 21 nt, Bordetella pertussis
cggaugcgcaggacggcgccg

SEQ ID NO: 328796 - RNA, 13 nt, Bordetella pertussis
cggaugcgccgcc

SEQ ID NO: 328797 - RNA, 19 nt, Bordetella pertussis
cggaugcgccgccccaguu

SEQ ID NO: 328798 - RNA, 13 nt, Bordetella pertussis
cggaugcgcgccu

SEQ ID NO: 328799 - RNA, 17 nt, Bordetella pertussis
cggaugcgcguggcgcg

SEQ ID NO: 328800 - RNA, 13 nt, Bordetella pertussis
cggcaagaagauc

SEQ ID NO: 328801 - RNA, 18 nt, Bordetella pertussis
cggcaagacggcgcucgg

SEQ ID NO: 328802 - RNA, 15 nt, Bordetella pertussis
cggcaagcacgaaca

SEQ ID NO: 328803 - RNA, 14 nt, Bordetella pertussis
cggcaagcagccgg

SEQ ID NO: 328804 - RNA, 18 nt, Bordetella pertussis
cggcaagccgcggcgguu

SEQ ID NO: 328805 - RNA, 23 nt, Bordetella pertussis
cggcaagcgcucgccggcgcgca

SEQ ID NO: 328806 - RNA, 12 nt, Bordetella pertussis
cggcaaggccgc

SEQ ID NO: 328807 - RNA, 14 nt, Bordetella pertussis
cggcaaggccgcga

SEQ ID NO: 328808 - RNA, 17 nt, Bordetella pertussis
cggcaaggccgcgaacg

SEQ ID NO: 328809 - RNA, 21 nt, Bordetella pertussis
cggcaaggccgcgaacgcgcc

SEQ ID NO: 328810 - RNA, 14 nt, Bordetella pertussis
cggcaaggcgcaca

SEQ ID NO: 328811 - RNA, 19 nt, Bordetella pertussis
cggcaaggggccagccugg

SEQ ID NO: 328812 - RNA, 20 nt, Bordetella pertussis
cggcaaggggccagccuggc

SEQ ID NO: 328813 - RNA, 21 nt, Bordetella pertussis
cggcaaggggccagccuggcg

SEQ ID NO: 328814 - RNA, 18 nt, Bordetella pertussis
cggcaagggugccugucc

SEQ ID NO: 328815 - RNA, 20 nt, Bordetella pertussis
cggcaagguagccgaugacc

SEQ ID NO: 328816 - RNA, 22 nt, Bordetella pertussis
cggcaaggucagcagcaugccu

SEQ ID NO: 328817 - RNA, 18 nt, Bordetella pertussis
cggcaagguccaggcgcg

SEQ ID NO: 328818 - RNA, 20 nt, Bordetella pertussis
cggcaagguccaggcgcgca

SEQ ID NO: 328819 - RNA, 15 nt, Bordetella pertussis
cggcaagucgacgcu

SEQ ID NO: 328820 - RNA, 21 nt, Bordetella pertussis
cggcaagucgacgcugaucgg

SEQ ID NO: 328821 - RNA, 21 nt, Bordetella pertussis
cggcaaucgaaaagcccgccg

SEQ ID NO: 328822 - RNA, 19 nt, Bordetella pertussis
cggcaaucuugccgccggg

SEQ ID NO: 328823 - RNA, 22 nt, Bordetella pertussis
cggcaaucuugccgccgggcau

SEQ ID NO: 328824 - RNA, 15 nt, Bordetella pertussis
cggcaccagcaggcc

SEQ ID NO: 328825 - RNA, 17 nt, Bordetella pertussis
cggcaccagcaggccgg

SEQ ID NO: 328826 - RNA, 13 nt, Bordetella pertussis
cggcaccagccgg

SEQ ID NO: 328827 - RNA, 13 nt, Bordetella pertussis
cggcaccaucgcc

SEQ ID NO: 328828 - RNA, 17 nt, Bordetella pertussis
cggcaccaucgccgccu

SEQ ID NO: 328829 - RNA, 20 nt, Bordetella pertussis
cggcaccaucugcgucgcgu

SEQ ID NO: 328830 - RNA, 14 nt, Bordetella pertussis
cggcaccaugcgca

SEQ ID NO: 328831 - RNA, 16 nt, Bordetella pertussis
cggcaccauugccggc

SEQ ID NO: 328832 - RNA, 17 nt, Bordetella pertussis
cggcaccauugccggcg

SEQ ID NO: 328833 - RNA, 18 nt, Bordetella pertussis
cggcaccauugccggcgc

SEQ ID NO: 328834 - RNA, 20 nt, Bordetella pertussis
cggcaccauugccggcgcgc

SEQ ID NO: 328835 - RNA, 17 nt, Bordetella pertussis
cggcacccagccggacc

SEQ ID NO: 328836 - RNA, 15 nt, Bordetella pertussis
cggcaccgcgcagcc

SEQ ID NO: 328837 - RNA, 16 nt, Bordetella pertussis
cggcaccgcgcagccc

SEQ ID NO: 328838 - RNA, 17 nt, Bordetella pertussis
cggcaccgcgcagcccg

SEQ ID NO: 328839 - RNA, 18 nt, Bordetella pertussis
cggcaccgcgcagcccgg

SEQ ID NO: 328840 - RNA, 21 nt, Bordetella pertussis
cggcaccuucuuccaggcgcc

SEQ ID NO: 328841 - RNA, 20 nt, Bordetella pertussis
cggcacgaauguggucgccg

SEQ ID NO: 328842 - RNA, 20 nt, Bordetella pertussis
cggcacgacgaucggccuga

SEQ ID NO: 328843 - RNA, 21 nt, Bordetella pertussis
cggcacgacgcugaugcccag

SEQ ID NO: 328844 - RNA, 13 nt, Bordetella pertussis
cggcacgacggcc

SEQ ID NO: 328845 - RNA, 18 nt, Bordetella pertussis
cggcacgacggccuccgc

SEQ ID NO: 328846 - RNA, 20 nt, Bordetella pertussis
cggcacgaucggcgccuggc

SEQ ID NO: 328847 - RNA, 16 nt, Bordetella pertussis
cggcacgcacagcaug

SEQ ID NO: 328848 - RNA, 20 nt, Bordetella pertussis
cggcacgcacagcaugcgcu

SEQ ID NO: 328849 - RNA, 22 nt, Bordetella pertussis
cggcacgcacagcaugcgcugg

SEQ ID NO: 328850 - RNA, 12 nt, Bordetella pertussis
cggcacggccag

SEQ ID NO: 328851 - RNA, 14 nt, Bordetella pertussis
cggcacggccagca

SEQ ID NO: 328852 - RNA, 16 nt, Bordetella pertussis
cggcacggccagcggc

SEQ ID NO: 328853 - RNA, 17 nt, Bordetella pertussis
cggcacggccagcggcg

SEQ ID NO: 328854 - RNA, 13 nt, Bordetella pertussis
cggcacggccggc

SEQ ID NO: 328855 - RNA, 15 nt, Bordetella pertussis
cggcacggccggccu

SEQ ID NO: 328856 - RNA, 18 nt, Bordetella pertussis
cggcacggccggccugca

SEQ ID NO: 328857 - RNA, 14 nt, Bordetella pertussis
cggcacggccggcc

SEQ ID NO: 328858 - RNA, 19 nt, Bordetella pertussis
cggcacggcggcaaagucg

SEQ ID NO: 328859 - RNA, 21 nt, Bordetella pertussis
cggcacggcuggguucaggcc

SEQ ID NO: 328860 - RNA, 18 nt, Bordetella pertussis
cggcacgggucaggcugc

SEQ ID NO: 328861 - RNA, 13 nt, Bordetella pertussis
cggcacgguggcg

SEQ ID NO: 328862 - RNA, 22 nt, Bordetella pertussis
cggcacgguggcgaaggccgcc

SEQ ID NO: 328863 - RNA, 23 nt, Bordetella pertussis
cggcacgguggcgaaggccgccg

SEQ ID NO: 328864 - RNA, 23 nt, Bordetella pertussis
cggcacgucauugcaucgcagca

SEQ ID NO: 328865 - RNA, 13 nt, Bordetella pertussis
cggcacguccgag

SEQ ID NO: 328866 - RNA, 13 nt, Bordetella pertussis
cggcacguccggc

SEQ ID NO: 328867 - RNA, 18 nt, Bordetella pertussis
cggcacguccggcacggc

SEQ ID NO: 328868 - RNA, 19 nt, Bordetella pertussis
cggcacguccggcacggcg

SEQ ID NO: 328869 - RNA, 17 nt, Bordetella pertussis
cggcacguaccaggcgc

SEQ ID NO: 328870 - RNA, 22 nt, Bordetella pertussis
cggcacguaccaggcgcugacc

SEQ ID NO: 328871 - RNA, 13 nt, Bordetella pertussis
cggcacgucgggc

SEQ ID NO: 328872 - RNA, 21 nt, Bordetella pertussis
cggcacgugccggauggcgcg

SEQ ID NO: 328873 - RNA, 18 nt, Bordetella pertussis
cggcacugaugcugguca

SEQ ID NO: 328874 - RNA, 15 nt, Bordetella pertussis
cggcagcagcagcgu

SEQ ID NO: 328875 - RNA, 17 nt, Bordetella pertussis
cggcagcagcgcgccgg

SEQ ID NO: 328876 - RNA, 23 nt, Bordetella pertussis
cggcagcagggauucggcgaacg

SEQ ID NO: 328877 - RNA, 14 nt, Bordetella pertussis
cggcagcagggcca

SEQ ID NO: 328878 - RNA, 17 nt, Bordetella pertussis
cggcagcagggccacgc

SEQ ID NO: 328879 - RNA, 22 nt, Bordetella pertussis
cggcagccggccauggccgcca

SEQ ID NO: 328880 - RNA, 14 nt, Bordetella pertussis
cggcagccuggggc

SEQ ID NO: 328881 - RNA, 21 nt, Bordetella pertussis
cggcagcgacuucuaccugga

SEQ ID NO: 328882 - RNA, 13 nt, Bordetella pertussis
cggcagcgcguau

SEQ ID NO: 328883 - RNA, 12 nt, Bordetella pertussis
cggcagcggcca

SEQ ID NO: 328884 - RNA, 14 nt, Bordetella pertussis
cggcagcggccagc

SEQ ID NO: 328885 - RNA, 16 nt, Bordetella pertussis
cggcagcggccagcgc

SEQ ID NO: 328886 - RNA, 17 nt, Bordetella pertussis
cggcagcggccagcgcg

SEQ ID NO: 328887 - RNA, 18 nt, Bordetella pertussis
cggcagcggccagcgcgg

SEQ ID NO: 328888 - RNA, 23 nt, Bordetella pertussis
cggcagcggcgccaugcgcacca

SEQ ID NO: 328889 - RNA, 14 nt, Bordetella pertussis
cggcagcgggucga

SEQ ID NO: 328890 - RNA, 18 nt, Bordetella pertussis
cggcagcguaucgcccgc

SEQ ID NO: 328891 - RNA, 21 nt, Bordetella pertussis
cggcagcguaucgcccgcgcg

SEQ ID NO: 328892 - RNA, 22 nt, Bordetella pertussis
cggcagcguaucgcccgcgcgg

SEQ ID NO: 328893 - RNA, 22 nt, Bordetella pertussis
cggcagcgucaauccgccgcca

SEQ ID NO: 328894 - RNA, 18 nt, Bordetella pertussis
cggcagcucgcgcugcgc

SEQ ID NO: 328895 - RNA, 21 nt, Bordetella pertussis
cggcagcucggcgaagccgca

SEQ ID NO: 328896 - RNA, 15 nt, Bordetella pertussis
cggcagggcgucggc

SEQ ID NO: 328897 - RNA, 17 nt, Bordetella pertussis
cggcaggggcucgcgcc

SEQ ID NO: 328898 - RNA, 21 nt, Bordetella pertussis
cggcaggggcucgcgcccgag

SEQ ID NO: 328899 - RNA, 23 nt, Bordetella pertussis
cggcaggggcucgcgcccgagcg

SEQ ID NO: 328900 - RNA, 17 nt, Bordetella pertussis
cggcagggucucggcca

SEQ ID NO: 328901 - RNA, 20 nt, Bordetella pertussis
cggcagggucucggccacgg

SEQ ID NO: 328902 - RNA, 22 nt, Bordetella pertussis
cggcagggugacgggcugggcc

SEQ ID NO: 328903 - RNA, 23 nt, Bordetella pertussis
cggcagcuugucgaucgccacca

SEQ ID NO: 328904 - RNA, 15 nt, Bordetella pertussis
cggcaggucgaugcc

SEQ ID NO: 328905 - RNA, 22 nt, Bordetella pertussis
cggcaggugcgucacgcacagc

SEQ ID NO: 328906 - RNA, 19 nt, Bordetella pertussis
cggcagugucaggaugccc

SEQ ID NO: 328907 - RNA, 19 nt, Bordetella pertussis
cggcagugggcggugacca

SEQ ID NO: 328908 - RNA, 20 nt, Bordetella pertussis
cggcauacauccucgaugcc

SEQ ID NO: 328909 - RNA, 20 nt, Bordetella pertussis
cggcauacgccgauggcgcg

SEQ ID NO: 328910 - RNA, 19 nt, Bordetella pertussis
cggcauagcccaggccgcc

SEQ ID NO: 328911 - RNA, 22 nt, Bordetella pertussis
cggcauaggcggcgcaggccag

SEQ ID NO: 328912 - RNA, 20 nt, Bordetella pertussis
cggcaucaguucaggcuggc

SEQ ID NO: 328913 - RNA, 20 nt, Bordetella pertussis
cggcauccagcucggcgaug

SEQ ID NO: 328914 - RNA, 21 nt, Bordetella pertussis
cggcaucccugcuugcgcgga

SEQ ID NO: 328915 - RNA, 22 nt, Bordetella pertussis
cggcaucgagaaaccagccgcc

SEQ ID NO: 328916 - RNA, 24 nt, Bordetella pertussis
cggcaugccguccacgcccagcgc

SEQ ID NO: 328917 - RNA, 14 nt, Bordetella pertussis
cggcaugcgcaugc

SEQ ID NO: 328918 - RNA, 18 nt, Bordetella pertussis
cggcaugcgccagccagc

SEQ ID NO: 328919 - RNA, 21 nt, Bordetella pertussis
cggcaugcgccagccagcgca

SEQ ID NO: 328920 - RNA, 17 nt, Bordetella pertussis
cggcaugcgccggcccg

SEQ ID NO: 328921 - RNA, 18 nt, Bordetella pertussis
cggcaugcgccggcccgg

SEQ ID NO: 328922 - RNA, 15 nt, Bordetella pertussis
cggcauggccagcuu

SEQ ID NO: 328923 - RNA, 18 nt, Bordetella pertussis
cggcauggccagcuucgg

SEQ ID NO: 328924 - RNA, 16 nt, Bordetella pertussis
cggcauggccaggaag

SEQ ID NO: 328925 - RNA, 13 nt, Bordetella pertussis
cggcauggccggc

SEQ ID NO: 328926 - RNA, 14 nt, Bordetella pertussis
cggcauggccggca

SEQ ID NO: 328927 - RNA, 23 nt, Bordetella pertussis
cggcauggcgaucgaacgcggcc

SEQ ID NO: 328928 - RNA, 13 nt, Bordetella pertussis
cggcauggcgccg

SEQ ID NO: 328929 - RNA, 15 nt, Bordetella pertussis
cggcauggcgccgcg

SEQ ID NO: 328930 - RNA, 18 nt, Bordetella pertussis
cggcauggcgccgcgccg

SEQ ID NO: 328931 - RNA, 13 nt, Bordetella pertussis
cggcauggcgcgc

SEQ ID NO: 328932 - RNA, 21 nt, Bordetella pertussis
cggcauuucgcauaccggccg

SEQ ID NO: 328933 - RNA, 19 nt, Bordetella pertussis
cggccaacagcucgcgcca

SEQ ID NO: 328934 - RNA, 22 nt, Bordetella pertussis
cggccaacagcucgcgccaggg

SEQ ID NO: 328935 - RNA, 16 nt, Bordetella pertussis
cggccaacggcuggcu

SEQ ID NO: 328936 - RNA, 15 nt, Bordetella pertussis
cggccaagacgcggg

SEQ ID NO: 328937 - RNA, 22 nt, Bordetella pertussis
cggccaagacgcggggacaggc

SEQ ID NO: 328938 - RNA, 16 nt, Bordetella pertussis
cggccaagcagcgccu

SEQ ID NO: 328939 - RNA, 15 nt, Bordetella pertussis
cggccaaggcaagca

SEQ ID NO: 328940 - RNA, 15 nt, Bordetella pertussis
cggccaccagcggcg

SEQ ID NO: 328941 - RNA, 16 nt, Bordetella pertussis
cggccaccagcggcgc

SEQ ID NO: 328942 - RNA, 17 nt, Bordetella pertussis
cggccaccagcggcgcc

SEQ ID NO: 328943 - RNA, 14 nt, Bordetella pertussis
cggccaccaggccg

SEQ ID NO: 328944 - RNA, 16 nt, Bordetella pertussis
cggccaccaggccguc

SEQ ID NO: 328945 - RNA, 19 nt, Bordetella pertussis
cggccaccaggccgucggc

SEQ ID NO: 328946 - RNA, 23 nt, Bordetella pertussis
cggccaccaugcggucgaugacc

SEQ ID NO: 328947 - RNA, 18 nt, Bordetella pertussis
cggccacccggaucgaca

SEQ ID NO: 328948 - RNA, 18 nt, Bordetella pertussis
cggccacccugccgugca

SEQ ID NO: 328949 - RNA, 23 nt, Bordetella pertussis
cggccaccucuucagcccggcgc

SEQ ID NO: 328950 - RNA, 15 nt, Bordetella pertussis
cggccaccuggcgca

SEQ ID NO: 328951 - RNA, 16 nt, Bordetella pertussis
cggccaccuggcgcaa

SEQ ID NO: 328952 - RNA, 13 nt, Bordetella pertussis
cggccacgaccgg

SEQ ID NO: 328953 - RNA, 22 nt, Bordetella pertussis
cggccacgauguugcgcaggcu

SEQ ID NO: 328954 - RNA, 23 nt, Bordetella pertussis
cggccacgauguugcgcaggcug

SEQ ID NO: 328955 - RNA, 14 nt, Bordetella pertussis
cggccacgcagcgc

SEQ ID NO: 328956 - RNA, 15 nt, Bordetella pertussis
cggccacgcagcgcg

SEQ ID NO: 328957 - RNA, 14 nt, Bordetella pertussis
cggccacgcccaag

SEQ ID NO: 328958 - RNA, 16 nt, Bordetella pertussis
cggccagggcugcggc

SEQ ID NO: 328959 - RNA, 19 nt, Bordetella pertussis
cggccagggcugcggcggg

SEQ ID NO: 328960 - RNA, 16 nt, Bordetella pertussis
cggccaggggcgcugg

SEQ ID NO: 328961 - RNA, 17 nt, Bordetella pertussis
cggccaggggcgcuggu

SEQ ID NO: 328962 - RNA, 18 nt, Bordetella pertussis
cggccaggggcgcugguc

SEQ ID NO: 328963 - RNA, 20 nt, Bordetella pertussis
cggccaggggcgcuggucga

SEQ ID NO: 328964 - RNA, 18 nt, Bordetella pertussis
cggccagggucaggggca

SEQ ID NO: 328965 - RNA, 20 nt, Bordetella pertussis
cggccagggugccccgccgg

SEQ ID NO: 328966 - RNA, 15 nt, Bordetella pertussis
cggccaggucgcgca

SEQ ID NO: 328967 - RNA, 13 nt, Bordetella pertussis
cggccaggucggc

SEQ ID NO: 328968 - RNA, 14 nt, Bordetella pertussis
cggccaggucggcg

SEQ ID NO: 328969 - RNA, 20 nt, Bordetella pertussis
cggccaggucggcggccagc

SEQ ID NO: 328970 - RNA, 21 nt, Bordetella pertussis
cggccaggucggcggccagcg

SEQ ID NO: 328971 - RNA, 16 nt, Bordetella pertussis
cggccaggucggcguc

SEQ ID NO: 328972 - RNA, 17 nt, Bordetella pertussis
cggccaggucggcgucg

SEQ ID NO: 328973 - RNA, 12 nt, Bordetella pertussis
cggccaggugcg

SEQ ID NO: 328974 - RNA, 13 nt, Bordetella pertussis
cggccaguccacc

SEQ ID NO: 328975 - RNA, 14 nt, Bordetella pertussis
cggccagucgcggu

SEQ ID NO: 328976 - RNA, 15 nt, Bordetella pertussis
cggccagucgcggug

SEQ ID NO: 328977 - RNA, 17 nt, Bordetella pertussis
cggccaguggcgcggcg

SEQ ID NO: 328978 - RNA, 16 nt, Bordetella pertussis
cggccaguucgacgcc

SEQ ID NO: 328979 - RNA, 17 nt, Bordetella pertussis
cggccaguucgacgccc

SEQ ID NO: 328980 - RNA, 20 nt, Bordetella pertussis
cggccaguucgacgcccaug

SEQ ID NO: 328981 - RNA, 15 nt, Bordetella pertussis
cggccaguucguccg

SEQ ID NO: 328982 - RNA, 13 nt, Bordetella pertussis
cggccaucgggcu

SEQ ID NO: 328983 - RNA, 19 nt, Bordetella pertussis
cggccaucuuggugcgcgc

SEQ ID NO: 328984 - RNA, 13 nt, Bordetella pertussis
cggccaugcccag

SEQ ID NO: 328985 - RNA, 15 nt, Bordetella pertussis
cggccaugcccaggc

SEQ ID NO: 328986 - RNA, 13 nt, Bordetella pertussis
cggccaugccgac

SEQ ID NO: 328987 - RNA, 15 nt, Bordetella pertussis
cggccaugccgacgg

SEQ ID NO: 328988 - RNA, 16 nt, Bordetella pertussis
cggccaugccggguug

SEQ ID NO: 328989 - RNA, 19 nt, Bordetella pertussis
cggccaugccgucaccggc

SEQ ID NO: 328990 - RNA, 20 nt, Bordetella pertussis
cggccaugccgucaccggcu

SEQ ID NO: 328991 - RNA, 15 nt, Bordetella pertussis
cggccaugcgcgcca

SEQ ID NO: 328992 - RNA, 17 nt, Bordetella pertussis
cggccaugcgcgccagc

SEQ ID NO: 328993 - RNA, 16 nt, Bordetella pertussis
cggccaugcucagcag

SEQ ID NO: 328994 - RNA, 18 nt, Bordetella pertussis
cggcccaaggccccgcga

SEQ ID NO: 328995 - RNA, 12 nt, Bordetella pertussis
cggcccacccgg

SEQ ID NO: 328996 - RNA, 19 nt, Bordetella pertussis
cggcccacccggcacgcgc

SEQ ID NO: 328997 - RNA, 13 nt, Bordetella pertussis
cggcccaggcgcg

SEQ ID NO: 328998 - RNA, 16 nt, Bordetella pertussis
cggcccaggcgcgcug

SEQ ID NO: 328999 - RNA, 16 nt, Bordetella pertussis
cggcccaggcguccag

SEQ ID NO: 329000 - RNA, 12 nt, Bordetella pertussis
cggcccagguca

SEQ ID NO: 329001 - RNA, 16 nt, Bordetella pertussis
cggcccaggucaucgc

SEQ ID NO: 329002 - RNA, 20 nt, Bordetella pertussis
cggcccaggucaucgccagg

SEQ ID NO: 329003 - RNA, 15 nt, Bordetella pertussis
cggcccaucgugcgc

SEQ ID NO: 329004 - RNA, 16 nt, Bordetella pertussis
cggcccaugaccggcg

SEQ ID NO: 329005 - RNA, 20 nt, Bordetella pertussis
cggcccaugaccggcguguc

SEQ ID NO: 329006 - RNA, 19 nt, Bordetella pertussis
cggccccggcucccgcgcc

SEQ ID NO: 329007 - RNA, 20 nt, Bordetella pertussis
cggccccggcucccgcgcca

SEQ ID NO: 329008 - RNA, 14 nt, Bordetella pertussis
cggccccguccuua

SEQ ID NO: 329009 - RNA, 19 nt, Bordetella pertussis
cggccccugcccugcggcu

SEQ ID NO: 329010 - RNA, 16 nt, Bordetella pertussis
cggcccgccacgcagg

SEQ ID NO: 329011 - RNA, 20 nt, Bordetella pertussis
cggcccgccacgcaggcggg

SEQ ID NO: 329012 - RNA, 21 nt, Bordetella pertussis
cggcccgccacgcaggcgggc

SEQ ID NO: 329013 - RNA, 22 nt, Bordetella pertussis
cggcccgccacgcgggccggcc

SEQ ID NO: 329014 - RNA, 13 nt, Bordetella pertussis
cggcccgccagga

SEQ ID NO: 329015 - RNA, 18 nt, Bordetella pertussis
cggcccgccccacggcga

SEQ ID NO: 329016 - RNA, 17 nt, Bordetella pertussis
cggcccgcccgcccugg

SEQ ID NO: 329017 - RNA, 13 nt, Bordetella pertussis
cggcccgcgccag

SEQ ID NO: 329018 - RNA, 17 nt, Bordetella pertussis
cggcccgcgccagcgcc

SEQ ID NO: 329019 - RNA, 18 nt, Bordetella pertussis
cggcccgcgccagcgcca

SEQ ID NO: 329020 - RNA, 13 nt, Bordetella pertussis
cggcccgcuccag

SEQ ID NO: 329021 - RNA, 19 nt, Bordetella pertussis
cggcccgcuccaggcggcc

SEQ ID NO: 329022 - RNA, 14 nt, Bordetella pertussis
cggcccggccaagc

SEQ ID NO: 329023 - RNA, 12 nt, Bordetella pertussis
cggcccggccgc

SEQ ID NO: 329024 - RNA, 21 nt, Bordetella pertussis
cggcccggccgccgccggcaa

SEQ ID NO: 329025 - RNA, 15 nt, Bordetella pertussis
cggcccggcggcaaa

SEQ ID NO: 329026 - RNA, 20 nt, Bordetella pertussis
cggcccggcgggccggcuca

SEQ ID NO: 329027 - RNA, 21 nt, Bordetella pertussis
cggcccggcgucgggucagcc

SEQ ID NO: 329028 - RNA, 13 nt, Bordetella pertussis
cggcccggcgccg

SEQ ID NO: 329029 - RNA, 20 nt, Bordetella pertussis
cggcccgggcgagauggcgu

SEQ ID NO: 329030 - RNA, 15 nt, Bordetella pertussis
cggcccgggugggcg

SEQ ID NO: 329031 - RNA, 18 nt, Bordetella pertussis
cggcccgggugggcggca

SEQ ID NO: 329032 - RNA, 21 nt, Bordetella pertussis
cggcccgggugggcggcaucg

SEQ ID NO: 329033 - RNA, 15 nt, Bordetella pertussis
cggcccggugcagcc

SEQ ID NO: 329034 - RNA, 23 nt, Bordetella pertussis
cggcccggugcagccgccgcagg

SEQ ID NO: 329035 - RNA, 20 nt, Bordetella pertussis
cggcccgugccacggcuucg

SEQ ID NO: 329036 - RNA, 16 nt, Bordetella pertussis
cggcccgugcgcaacg

SEQ ID NO: 329037 - RNA, 18 nt, Bordetella pertussis
cggcccguuggcaggcca

SEQ ID NO: 329038 - RNA, 20 nt, Bordetella pertussis
cggcccguuggcaggccagc

SEQ ID NO: 329039 - RNA, 21 nt, Bordetella pertussis
cggcccugcaggaacucgcac

SEQ ID NO: 329040 - RNA, 17 nt, Bordetella pertussis
cggcccugccgcccugg

SEQ ID NO: 329041 - RNA, 21 nt, Bordetella pertussis
cggcccugccgcccuggcgca

SEQ ID NO: 329042 - RNA, 14 nt, Bordetella pertussis
cggcccuggcaagg

SEQ ID NO: 329043 - RNA, 17 nt, Bordetella pertussis
cggcccugggccagcca

SEQ ID NO: 329044 - RNA, 20 nt, Bordetella pertussis
cggcccugggcgcggcggug

SEQ ID NO: 329045 - RNA, 17 nt, Bordetella pertussis
cggcccuggucgucgcg

SEQ ID NO: 329046 - RNA, 13 nt, Bordetella pertussis
cggcccuggucua

SEQ ID NO: 329047 - RNA, 19 nt, Bordetella pertussis
cggcccugucggccgaacc

SEQ ID NO: 329048 - RNA, 16 nt, Bordetella pertussis
cggcccuguucgcgcg

SEQ ID NO: 329049 - RNA, 24 nt, Bordetella pertussis
cggcccuugcgcgaacggcaggug

SEQ ID NO: 329050 - RNA, 19 nt, Bordetella pertussis
cggcccuugcgcgaaggcc

SEQ ID NO: 329051 - RNA, 21 nt, Bordetella pertussis
cggcccuugcgcgaaggccgc

SEQ ID NO: 329052 - RNA, 23 nt, Bordetella pertussis
cggcccuugcgcgaaggccgccc

SEQ ID NO: 329053 - RNA, 20 nt, Bordetella pertussis
cggccgaaaccgccgcggcu

SEQ ID NO: 329054 - RNA, 23 nt, Bordetella pertussis
cggccgaaaccgccgcggcuugc

SEQ ID NO: 329055 - RNA, 20 nt, Bordetella pertussis
cggccgaaccgcgcagccgc

SEQ ID NO: 329056 - RNA, 18 nt, Bordetella pertussis
cggccgaagcgcaagccc

SEQ ID NO: 329057 - RNA, 15 nt, Bordetella pertussis
cggccgacagcuugc

SEQ ID NO: 329058 - RNA, 20 nt, Bordetella pertussis
cggccgacagcuugcgcugg

SEQ ID NO: 329059 - RNA, 15 nt, Bordetella pertussis
cggccgaccggcgcg

SEQ ID NO: 329060 - RNA, 17 nt, Bordetella pertussis
cggccgaccggcgcgcg

SEQ ID NO: 329061 - RNA, 19 nt, Bordetella pertussis
cggccgaccggcgcgcgcg

SEQ ID NO: 329062 - RNA, 15 nt, Bordetella pertussis
cggccgacggcgcug

SEQ ID NO: 329063 - RNA, 16 nt, Bordetella pertussis
cggccgacggcgcugg

SEQ ID NO: 329064 - RNA, 19 nt, Bordetella pertussis
cggccgacguggaccgcgc

SEQ ID NO: 329065 - RNA, 20 nt, Bordetella pertussis
cggccgacguggaccgcgcg

SEQ ID NO: 329066 - RNA, 19 nt, Bordetella pertussis
cggccgacucgaaacgggc

SEQ ID NO: 329067 - RNA, 15 nt, Bordetella pertussis
cggccgacugcugua

SEQ ID NO: 329068 - RNA, 23 nt, Bordetella pertussis
cggccgacugcuguacgacagca

SEQ ID NO: 329069 - RNA, 19 nt, Bordetella pertussis
cggccgagaacgccgucgg

SEQ ID NO: 329070 - RNA, 23 nt, Bordetella pertussis
cggccgagaacgccgucggggug

SEQ ID NO: 329071 - RNA, 21 nt, Bordetella pertussis
cggccgagcuccucgagcgug

SEQ ID NO: 329072 - RNA, 20 nt, Bordetella pertussis
cggccgagcgggccagcgcg

SEQ ID NO: 329073 - RNA, 13 nt, Bordetella pertussis
cggccgaggucgg

SEQ ID NO: 329074 - RNA, 16 nt, Bordetella pertussis
cggccgaggucggcgg

SEQ ID NO: 329075 - RNA, 16 nt, Bordetella pertussis
cggccgauagccgcgg

SEQ ID NO: 329076 - RNA, 20 nt, Bordetella pertussis
cggccgauagccgcggcgcc

SEQ ID NO: 329077 - RNA, 21 nt, Bordetella pertussis
cggccgauagccgcggcgccg

SEQ ID NO: 329078 - RNA, 16 nt, Bordetella pertussis
cggccgauagccguga

SEQ ID NO: 329079 - RNA, 18 nt, Bordetella pertussis
cggccgaugacaucgccg

SEQ ID NO: 329080 - RNA, 20 nt, Bordetella pertussis
cggccgaugacaucgccgcu

SEQ ID NO: 329081 - RNA, 22 nt, Bordetella pertussis
cggccgaugacaucgccgcugc

SEQ ID NO: 329082 - RNA, 15 nt, Bordetella pertussis
cggccgccagcgcca

SEQ ID NO: 329083 - RNA, 16 nt, Bordetella pertussis
cggccgccagguagcg

SEQ ID NO: 329084 - RNA, 15 nt, Bordetella pertussis
cggccgccaggucgg

SEQ ID NO: 329085 - RNA, 15 nt, Bordetella pertussis
cggccgcccacggca

SEQ ID NO: 329086 - RNA, 13 nt, Bordetella pertussis
cggccgcccagca

SEQ ID NO: 329087 - RNA, 15 nt, Bordetella pertussis
cggccgcccaggcgc

SEQ ID NO: 329088 - RNA, 16 nt, Bordetella pertussis
cggccgcccaggcgca

SEQ ID NO: 329089 - RNA, 17 nt, Bordetella pertussis
cggccgcccccagcgcg

SEQ ID NO: 329090 - RNA, 19 nt, Bordetella pertussis
cggccgcccccagcgcgcc

SEQ ID NO: 329091 - RNA, 16 nt, Bordetella pertussis
cggccgcccggcaugg

SEQ ID NO: 329092 - RNA, 12 nt, Bordetella pertussis
cggccgccgggc

SEQ ID NO: 329093 - RNA, 18 nt, Bordetella pertussis
cggccgccgggccgcgac

SEQ ID NO: 329094 - RNA, 19 nt, Bordetella pertussis
cggccgccgggccgcgacc

SEQ ID NO: 329095 - RNA, 21 nt, Bordetella pertussis
cggccgccguaaucggcgucg

SEQ ID NO: 329096 - RNA, 21 nt, Bordetella pertussis
cggccgccuccaggcggcggu

SEQ ID NO: 329097 - RNA, 14 nt, Bordetella pertussis
cggccgccugcgcc

SEQ ID NO: 329098 - RNA, 15 nt, Bordetella pertussis
cggccgccugcgccg

SEQ ID NO: 329099 - RNA, 20 nt, Bordetella pertussis
cggccgcgcgcaucacgcug

SEQ ID NO: 329100 - RNA, 22 nt, Bordetella pertussis
cggccgcgcgcgccaugucgac

SEQ ID NO: 329101 - RNA, 21 nt, Bordetella pertussis
cggccgcgcgcuucaggcgcc

SEQ ID NO: 329102 - RNA, 16 nt, Bordetella pertussis
cggccgcgcgggcggc

SEQ ID NO: 329103 - RNA, 15 nt, Bordetella pertussis
cggccgcgcuggcgc

SEQ ID NO: 329104 - RNA, 20 nt, Bordetella pertussis
cggccgcgcuggcgcuggcc

SEQ ID NO: 329105 - RNA, 18 nt, Bordetella pertussis
cggccgcggccggcacgc

SEQ ID NO: 329106 - RNA, 22 nt, Bordetella pertussis
cggccgcggcguugcggcagcg

SEQ ID NO: 329107 - RNA, 17 nt, Bordetella pertussis
cggccgcgggcagcaau

SEQ ID NO: 329108 - RNA, 17 nt, Bordetella pertussis
cggccgcuccgccaugg

SEQ ID NO: 329109 - RNA, 15 nt, Bordetella pertussis
cggccgcugccgcgc

SEQ ID NO: 329110 - RNA, 16 nt, Bordetella pertussis
cggccgcugccgcgcg

SEQ ID NO: 329111 - RNA, 22 nt, Bordetella pertussis
cggccgcuugucgaugacgcgc

SEQ ID NO: 329112 - RNA, 13 nt, Bordetella pertussis
cggccggaccgcu

SEQ ID NO: 329113 - RNA, 20 nt, Bordetella pertussis
cggccggaccgcugugcgcg

SEQ ID NO: 329114 - RNA, 14 nt, Bordetella pertussis
cggccggcagcgcc

SEQ ID NO: 329115 - RNA, 15 nt, Bordetella pertussis
cggccggcagcgcga

SEQ ID NO: 329116 - RNA, 16 nt, Bordetella pertussis
cggccggcagcgcgac

SEQ ID NO: 329117 - RNA, 17 nt, Bordetella pertussis
cggccggcagcgcgacc

SEQ ID NO: 329118 - RNA, 18 nt, Bordetella pertussis
cggccggcagcgcgaccg

SEQ ID NO: 329119 - RNA, 17 nt, Bordetella pertussis
cggccggcagcggcgcc

SEQ ID NO: 329120 - RNA, 18 nt, Bordetella pertussis
cggccggcagcggcgcca

SEQ ID NO: 329121 - RNA, 14 nt, Bordetella pertussis
cggccggcaggccg

SEQ ID NO: 329122 - RNA, 15 nt, Bordetella pertussis
cggccggcaggccgg

SEQ ID NO: 329123 - RNA, 16 nt, Bordetella pertussis
cggccggcaggccggc

SEQ ID NO: 329124 - RNA, 18 nt, Bordetella pertussis
cggccggcaggccggcca

SEQ ID NO: 329125 - RNA, 13 nt, Bordetella pertussis
cggccggccagcc

SEQ ID NO: 329126 - RNA, 16 nt, Bordetella pertussis
cggccggccaggcgcc

SEQ ID NO: 329127 - RNA, 17 nt, Bordetella pertussis
cggccggccaggcgccg

SEQ ID NO: 329128 - RNA, 16 nt, Bordetella pertussis
cggccggccaguacgu

SEQ ID NO: 329129 - RNA, 21 nt, Bordetella pertussis
cggccggcacggccggccagg

SEQ ID NO: 329130 - RNA, 12 nt, Bordetella pertussis
cggccggcgcgc

SEQ ID NO: 329131 - RNA, 13 nt, Bordetella pertussis
cggccggcgcgcc

SEQ ID NO: 329132 - RNA, 14 nt, Bordetella pertussis
cggccggcgcgccg

SEQ ID NO: 329133 - RNA, 21 nt, Bordetella pertussis
cggccggcgcgucgccggcga

SEQ ID NO: 329134 - RNA, 15 nt, Bordetella pertussis
cggccggcgcgugcu

SEQ ID NO: 329135 - RNA, 17 nt, Bordetella pertussis
cggccggcggucgcgcu

SEQ ID NO: 329136 - RNA, 20 nt, Bordetella pertussis
cggccggcugcaccagcgcg

SEQ ID NO: 329137 - RNA, 22 nt, Bordetella pertussis
cggccgggaccuuggcggcugg

SEQ ID NO: 329138 - RNA, 15 nt, Bordetella pertussis
cggccgugccgcccg

SEQ ID NO: 329139 - RNA, 16 nt, Bordetella pertussis
cggccgugccgcccgg

SEQ ID NO: 329140 - RNA, 15 nt, Bordetella pertussis
cggccgugcgccagc

SEQ ID NO: 329141 - RNA, 21 nt, Bordetella pertussis
cggccguggccgggcccggcg

SEQ ID NO: 329142 - RNA, 13 nt, Bordetella pertussis
cggccggcugcgc

SEQ ID NO: 329143 - RNA, 22 nt, Bordetella pertussis
cggccggcuugcgcaagccggc

SEQ ID NO: 329144 - RNA, 22 nt, Bordetella pertussis
cggccguguucgagcaggcgcg

SEQ ID NO: 329145 - RNA, 15 nt, Bordetella pertussis
cggccguuggcgaug

SEQ ID NO: 329146 - RNA, 17 nt, Bordetella pertussis
cggccguuggcgauggc

SEQ ID NO: 329147 - RNA, 17 nt, Bordetella pertussis
cggccguuggcgugcag

SEQ ID NO: 329148 - RNA, 19 nt, Bordetella pertussis
cggccguuggcgugcagcc

SEQ ID NO: 329149 - RNA, 23 nt, Bordetella pertussis
cggccguuucaggccugcggcgc

SEQ ID NO: 329150 - RNA, 20 nt, Bordetella pertussis
cggccguuugccccucggcg

SEQ ID NO: 329151 - RNA, 21 nt, Bordetella pertussis
cggccguuugccccucggcgg

SEQ ID NO: 329152 - RNA, 22 nt, Bordetella pertussis
cggccguuugccccucggcggg

SEQ ID NO: 329153 - RNA, 16 nt, Bordetella pertussis
cggccuaugugcaggc

SEQ ID NO: 329154 - RNA, 18 nt, Bordetella pertussis
cggccuaugugcaggcca

SEQ ID NO: 329155 - RNA, 23 nt, Bordetella pertussis
cggccuauuuggcggccuggccg

SEQ ID NO: 329156 - RNA, 13 nt, Bordetella pertussis
cggccucagcggc

SEQ ID NO: 329157 - RNA, 17 nt, Bordetella pertussis
cggccucagcggccgcu

SEQ ID NO: 329158 - RNA, 16 nt, Bordetella pertussis
cggccucaucgagcgc

SEQ ID NO: 329159 - RNA, 13 nt, Bordetella pertussis
cggccucccgccg

SEQ ID NO: 329160 - RNA, 18 nt, Bordetella pertussis
cggccucccgccgcccgg

SEQ ID NO: 329161 - RNA, 14 nt, Bordetella pertussis
cggccucccggacc

SEQ ID NO: 329162 - RNA, 16 nt, Bordetella pertussis
cggccuccgcgcacag

SEQ ID NO: 329163 - RNA, 13 nt, Bordetella pertussis
cggccuccgcgcc

SEQ ID NO: 329164 - RNA, 17 nt, Bordetella pertussis
cggccucgacggccgcc

SEQ ID NO: 329165 - RNA, 14 nt, Bordetella pertussis
cggccuccggcagg

SEQ ID NO: 329166 - RNA, 11 nt, Bordetella pertussis
cggccucgccc

SEQ ID NO: 329167 - RNA, 19 nt, Bordetella pertussis
cggccucgcccaugcgggc

SEQ ID NO: 329168 - RNA, 20 nt, Bordetella pertussis
cggccucgcccaugcgggcg

SEQ ID NO: 329169 - RNA, 16 nt, Bordetella pertussis
cggccucgccggccug

SEQ ID NO: 329170 - RNA, 16 nt, Bordetella pertussis
cggccucuucgucgcc

SEQ ID NO: 329171 - RNA, 19 nt, Bordetella pertussis
cggccucuucgucgccggc

SEQ ID NO: 329172 - RNA, 19 nt, Bordetella pertussis
cggccugaaccaggccgcc

SEQ ID NO: 329173 - RNA, 23 nt, Bordetella pertussis
cggccugaaccaggccgccaggg

SEQ ID NO: 329174 - RNA, 15 nt, Bordetella pertussis
cggccugacgggccu

SEQ ID NO: 329175 - RNA, 14 nt, Bordetella pertussis
cggccugcaaugcg

SEQ ID NO: 329176 - RNA, 18 nt, Bordetella pertussis
cggccugcaaugcggcca

SEQ ID NO: 329177 - RNA, 19 nt, Bordetella pertussis
cggccugcaaugcggccag

SEQ ID NO: 329178 - RNA, 20 nt, Bordetella pertussis
cggccugcaaugcggccagg

SEQ ID NO: 329179 - RNA, 14 nt, Bordetella pertussis
cggccugcaggccc

SEQ ID NO: 329180 - RNA, 15 nt, Bordetella pertussis
cggccugcaggccca

SEQ ID NO: 329181 - RNA, 17 nt, Bordetella pertussis
cggccugcaggcccagc

SEQ ID NO: 329182 - RNA, 18 nt, Bordetella pertussis
cggccugcaggcccagca

SEQ ID NO: 329183 - RNA, 23 nt, Bordetella pertussis
cggccugcaggcccagcacgcgc

SEQ ID NO: 329184 - RNA, 20 nt, Bordetella pertussis
cggccugcaggccguuccag

SEQ ID NO: 329185 - RNA, 16 nt, Bordetella pertussis
cggccugcaggugccg

SEQ ID NO: 329186 - RNA, 21 nt, Bordetella pertussis
cggccugcaggugccgccggc

SEQ ID NO: 329187 - RNA, 12 nt, Bordetella pertussis
cggccugcaugu

SEQ ID NO: 329188 - RNA, 16 nt, Bordetella pertussis
cggccugccaccagcg

SEQ ID NO: 329189 - RNA, 21 nt, Bordetella pertussis
cggccugccaccagcgcgcca

SEQ ID NO: 329190 - RNA, 22 nt, Bordetella pertussis
cggccugccaccagcgcgccag

SEQ ID NO: 329191 - RNA, 13 nt, Bordetella pertussis
cggccugccagcc

SEQ ID NO: 329192 - RNA, 15 nt, Bordetella pertussis
cggccugcccgggcg

SEQ ID NO: 329193 - RNA, 13 nt, Bordetella pertussis
cggccugccggcg

SEQ ID NO: 329194 - RNA, 22 nt, Bordetella pertussis
cggccugcucgcaggccugcug

SEQ ID NO: 329195 - RNA, 18 nt, Bordetella pertussis
cggccugcucgccggcca

SEQ ID NO: 329196 - RNA, 23 nt, Bordetella pertussis
cggccugcucgccggccagcgcg

SEQ ID NO: 329197 - RNA, 14 nt, Bordetella pertussis
cggccugcuggugc

SEQ ID NO: 329198 - RNA, 19 nt, Bordetella pertussis
cggccuggaacauggcccg

SEQ ID NO: 329199 - RNA, 18 nt, Bordetella pertussis
cggccuggaccugagcca

SEQ ID NO: 329200 - RNA, 20 nt, Bordetella pertussis
cggccuggaccugagccagg

SEQ ID NO: 329201 - RNA, 15 nt, Bordetella pertussis
cggccuggaggccga

SEQ ID NO: 329202 - RNA, 19 nt, Bordetella pertussis
cggccuggaggccgagcgc

SEQ ID NO: 329203 - RNA, 21 nt, Bordetella pertussis
cggccuggccgcgcgccugcu

SEQ ID NO: 329204 - RNA, 16 nt, Bordetella pertussis
cggccuggccccaggc

SEQ ID NO: 329205 - RNA, 14 nt, Bordetella pertussis
cggccuggccccgc

SEQ ID NO: 329206 - RNA, 15 nt, Bordetella pertussis
cggccuggccccgcg

SEQ ID NO: 329207 - RNA, 13 nt, Bordetella pertussis
cggccuggcgcgc

SEQ ID NO: 329208 - RNA, 16 nt, Bordetella pertussis
cggccuggcgcgcggc

SEQ ID NO: 329209 - RNA, 18 nt, Bordetella pertussis
cggccuugggcgcggcgg

SEQ ID NO: 329210 - RNA, 19 nt, Bordetella pertussis
cggccuugggcgcggcggc

SEQ ID NO: 329211 - RNA, 23 nt, Bordetella pertussis
cggccuugggcgcggcggccugg

SEQ ID NO: 329212 - RNA, 14 nt, Bordetella pertussis
cggccuugucgcgc

SEQ ID NO: 329213 - RNA, 15 nt, Bordetella pertussis
cggccuugucgcgcc

SEQ ID NO: 329214 - RNA, 17 nt, Bordetella pertussis
cggccuugucgcgcccg

SEQ ID NO: 329215 - RNA, 14 nt, Bordetella pertussis
cggccuuugcgcgc

SEQ ID NO: 329216 - RNA, 23 nt, Bordetella pertussis
cggccuuuuuuugcggcacggcu

SEQ ID NO: 329217 - RNA, 19 nt, Bordetella pertussis
cggcgaaccgcucagcccu

SEQ ID NO: 329218 - RNA, 23 nt, Bordetella pertussis
cggcgaacgacagaccguagcgc

SEQ ID NO: 329219 - RNA, 22 nt, Bordetella pertussis
cggcgaacugggcgucguccug

SEQ ID NO: 329220 - RNA, 17 nt, Bordetella pertussis
cggcgaagagccguacu

SEQ ID NO: 329221 - RNA, 22 nt, Bordetella pertussis
cggcgaagccgcagcggcagcg

SEQ ID NO: 329222 - RNA, 23 nt, Bordetella pertussis
cggcgaagccgcagcggcagcgc

SEQ ID NO: 329223 - RNA, 16 nt, Bordetella pertussis
cggcgaagccuugcgc

SEQ ID NO: 329224 - RNA, 13 nt, Bordetella pertussis
cggcgaaugccgg

SEQ ID NO: 329225 - RNA, 14 nt, Bordetella pertussis
cggcgaaugccggc

SEQ ID NO: 329226 - RNA, 17 nt, Bordetella pertussis
cggcgacacccccaggg

SEQ ID NO: 329227 - RNA, 22 nt, Bordetella pertussis
cggcgacacccccagggcgcgc

SEQ ID NO: 329228 - RNA, 17 nt, Bordetella pertussis
cggcgaccgccggccgg

SEQ ID NO: 329229 - RNA, 13 nt, Bordetella pertussis
cggcgaccgccgg

SEQ ID NO: 329230 - RNA, 14 nt, Bordetella pertussis
cggcgaccggcgcc

SEQ ID NO: 329231 - RNA, 20 nt, Bordetella pertussis
cggcgaccggcgccggcucc

SEQ ID NO: 329232 - RNA, 18 nt, Bordetella pertussis
cggcgacgaacccgggcg

SEQ ID NO: 329233 - RNA, 15 nt, Bordetella pertussis
cggcgacugccccag

SEQ ID NO: 329234 - RNA, 18 nt, Bordetella pertussis
cggcgacuucggcggcca

SEQ ID NO: 329235 - RNA, 21 nt, Bordetella pertussis
cggcgacuucggcggccugcu

SEQ ID NO: 329236 - RNA, 15 nt, Bordetella pertussis
cggcgagacgucggc

SEQ ID NO: 329237 - RNA, 20 nt, Bordetella pertussis
cggcgagaacgcggccgcga

SEQ ID NO: 329238 - RNA, 17 nt, Bordetella pertussis
cggcgagcacggccugc

SEQ ID NO: 329239 - RNA, 13 nt, Bordetella pertussis
cggcgagcauggc

SEQ ID NO: 329240 - RNA, 14 nt, Bordetella pertussis
cggcgagcauggcg

SEQ ID NO: 329241 - RNA, 22 nt, Bordetella pertussis
cggcgagcauggcgguggccag

SEQ ID NO: 329242 - RNA, 13 nt, Bordetella pertussis
cggcgagccgggc

SEQ ID NO: 329243 - RNA, 17 nt, Bordetella pertussis
cggcgagccgggcaccg

SEQ ID NO: 329244 - RNA, 23 nt, Bordetella pertussis
cggcgagccgggcaccgagccgc

SEQ ID NO: 329245 - RNA, 18 nt, Bordetella pertussis
cggcgagcgccucgcgcu

SEQ ID NO: 329246 - RNA, 20 nt, Bordetella pertussis
cggcgagcgccucgcgcucc

SEQ ID NO: 329247 - RNA, 14 nt, Bordetella pertussis
cggcgagcgcggcg

SEQ ID NO: 329248 - RNA, 15 nt, Bordetella pertussis
cggcgagcgcggcgc

SEQ ID NO: 329249 - RNA, 13 nt, Bordetella pertussis
cggcgagcucggc

SEQ ID NO: 329250 - RNA, 16 nt, Bordetella pertussis
cggcgagcucggcaug

SEQ ID NO: 329251 - RNA, 18 nt, Bordetella pertussis
cggcgagcucggcauggc

SEQ ID NO: 329252 - RNA, 21 nt, Bordetella pertussis
cggcgagcucggcauggcgau

SEQ ID NO: 329253 - RNA, 14 nt, Bordetella pertussis
cggcgagcuggccc

SEQ ID NO: 329254 - RNA, 14 nt, Bordetella pertussis
cggcgagggcgucg

SEQ ID NO: 329255 - RNA, 15 nt, Bordetella pertussis
cggcgagggcgucgu

SEQ ID NO: 329256 - RNA, 20 nt, Bordetella pertussis
cggcgauacgcgccgccugg

SEQ ID NO: 329257 - RNA, 15 nt, Bordetella pertussis
cggcgauauggccag

SEQ ID NO: 329258 - RNA, 18 nt, Bordetella pertussis
cggcgaucaacgugcgcc

SEQ ID NO: 329259 - RNA, 21 nt, Bordetella pertussis
cggcgaucaacgugcgccagg

SEQ ID NO: 329260 - RNA, 24 nt, Bordetella pertussis
cggcgaucaacgugcgccaggcaa

SEQ ID NO: 329261 - RNA, 16 nt, Bordetella pertussis
cggcgaucgccuguau

SEQ ID NO: 329262 - RNA, 23 nt, Bordetella pertussis
cggcgaucgccuguaucugcgcc

SEQ ID NO: 329263 - RNA, 14 nt, Bordetella pertussis
cggcgaucggcccg

SEQ ID NO: 329264 - RNA, 14 nt, Bordetella pertussis
cggcgaucucgcgc

SEQ ID NO: 329265 - RNA, 15 nt, Bordetella pertussis
cggcgaucucgcgcg

SEQ ID NO: 329266 - RNA, 17 nt, Bordetella pertussis
cggcgaucucgcgcgcg

SEQ ID NO: 329267 - RNA, 20 nt, Bordetella pertussis
cggcgaugcacccaggcgcc

SEQ ID NO: 329268 - RNA, 21 nt, Bordetella pertussis
cggcgaugcacccaggcgccg

SEQ ID NO: 329269 - RNA, 20 nt, Bordetella pertussis
cggcgaugccgcuggcgaug

SEQ ID NO: 329270 - RNA, 16 nt, Bordetella pertussis
cggcgaugccggcgcu

SEQ ID NO: 329271 - RNA, 14 nt, Bordetella pertussis
cggcgaugccguac

SEQ ID NO: 329272 - RNA, 17 nt, Bordetella pertussis
cggcgaugccguacuug

SEQ ID NO: 329273 - RNA, 23 nt, Bordetella pertussis
cggcgaugccguacuuggcgaug

SEQ ID NO: 329274 - RNA, 13 nt, Bordetella pertussis
cggcgaugccggc

SEQ ID NO: 329275 - RNA, 17 nt, Bordetella pertussis
cggcgaugccggccagc

SEQ ID NO: 329276 - RNA, 19 nt, Bordetella pertussis
cggcgaugccggccagcag

SEQ ID NO: 329277 - RNA, 12 nt, Bordetella pertussis
cggcgaugcgcg

SEQ ID NO: 329278 - RNA, 17 nt, Bordetella pertussis
cggcgauugcgccagcg

SEQ ID NO: 329279 - RNA, 18 nt, Bordetella pertussis
cggcgauugcgccagcgc

SEQ ID NO: 329280 - RNA, 20 nt, Bordetella pertussis
cggcgauugcgccagcgcug

SEQ ID NO: 329281 - RNA, 17 nt, Bordetella pertussis
cggcgauugcggcccgc

SEQ ID NO: 329282 - RNA, 14 nt, Bordetella pertussis
cggcgcacgccccg

SEQ ID NO: 329283 - RNA, 18 nt, Bordetella pertussis
cggcgcacgccccgacgc

SEQ ID NO: 329284 - RNA, 14 nt, Bordetella pertussis
cggcgcacgccgga

SEQ ID NO: 329285 - RNA, 19 nt, Bordetella pertussis
cggcgcagauccucgaaca

SEQ ID NO: 329286 - RNA, 15 nt, Bordetella pertussis
cggcgcagauggcgg

SEQ ID NO: 329287 - RNA, 18 nt, Bordetella pertussis
cggcgcaggaugcgcugg

SEQ ID NO: 329288 - RNA, 23 nt, Bordetella pertussis
cggcgcaggaugcgcuggccggc

SEQ ID NO: 329289 - RNA, 15 nt, Bordetella pertussis
cggcgcaggccagcg

SEQ ID NO: 329290 - RNA, 16 nt, Bordetella pertussis
cggcgcaggccagcgc

SEQ ID NO: 329291 - RNA, 18 nt, Bordetella pertussis
cggcgcaggccagcgccg

SEQ ID NO: 329292 - RNA, 12 nt, Bordetella pertussis
cggcgcaggccg

SEQ ID NO: 329293 - RNA, 16 nt, Bordetella pertussis
cggcgcaggccgcgcc

SEQ ID NO: 329294 - RNA, 20 nt, Bordetella pertussis
cggcgcaggccgcgccggcu

SEQ ID NO: 329295 - RNA, 22 nt, Bordetella pertussis
cggcgcaggccgcgccggcucc

SEQ ID NO: 329296 - RNA, 17 nt, Bordetella pertussis
cggcgcaggccugcggc

SEQ ID NO: 329297 - RNA, 19 nt, Bordetella pertussis
cggcgcagguccaccgcca

SEQ ID NO: 329298 - RNA, 20 nt, Bordetella pertussis
cggcgcaguuccggcgggcc

SEQ ID NO: 329299 - RNA, 22 nt, Bordetella pertussis
cggcgcaucccagacagccacg

SEQ ID NO: 329300 - RNA, 16 nt, Bordetella pertussis
cggcgcaucggcgcca

SEQ ID NO: 329301 - RNA, 16 nt, Bordetella pertussis
cggcgcaugagccggc

SEQ ID NO: 329302 - RNA, 15 nt, Bordetella pertussis
cggcgcaugauggcc

SEQ ID NO: 329303 - RNA, 17 nt, Bordetella pertussis
cggcgcaugauggccgg

SEQ ID NO: 329304 - RNA, 18 nt, Bordetella pertussis
cggcgcaugauggccggc

SEQ ID NO: 329305 - RNA, 19 nt, Bordetella pertussis
cggcgcaugauggccggcc

SEQ ID NO: 329306 - RNA, 13 nt, Bordetella pertussis
cggcgcaugcugc

SEQ ID NO: 329307 - RNA, 14 nt, Bordetella pertussis
cggcgcaugcugcg

SEQ ID NO: 329308 - RNA, 15 nt, Bordetella pertussis
cggcgcaugcugcgc

SEQ ID NO: 329309 - RNA, 23 nt, Bordetella pertussis
cggcgccaaagcacaggauggcg

SEQ ID NO: 329310 - RNA, 14 nt, Bordetella pertussis
cggcgccaagcggc

SEQ ID NO: 329311 - RNA, 17 nt, Bordetella pertussis
cggcgccaagcggcagg

SEQ ID NO: 329312 - RNA, 22 nt, Bordetella pertussis
cggcgccaagcggcaggcggca

SEQ ID NO: 329313 - RNA, 16 nt, Bordetella pertussis
cggcgccacaggugcg

SEQ ID NO: 329314 - RNA, 14 nt, Bordetella pertussis
cggcgccagcgccc

SEQ ID NO: 329315 - RNA, 16 nt, Bordetella pertussis
cggcgccagcgccgcg

SEQ ID NO: 329316 - RNA, 13 nt, Bordetella pertussis
cggcgccagcgcu

SEQ ID NO: 329317 - RNA, 15 nt, Bordetella pertussis
cggcgccagcgccgc

SEQ ID NO: 329318 - RNA, 13 nt, Bordetella pertussis
cggcgccagcugg

SEQ ID NO: 329319 - RNA, 15 nt, Bordetella pertussis
cggcgccaguagcgc

SEQ ID NO: 329320 - RNA, 18 nt, Bordetella pertussis
cggcgccaguagcgccgg

SEQ ID NO: 329321 - RNA, 20 nt, Bordetella pertussis
cggcgccaguagcgccggcu

SEQ ID NO: 329322 - RNA, 12 nt, Bordetella pertussis
cggcgcggcugg

SEQ ID NO: 329323 - RNA, 18 nt, Bordetella pertussis
cggcgcggcuuucgccgg

SEQ ID NO: 329324 - RNA, 16 nt, Bordetella pertussis
cggcgcgggcacucgg

SEQ ID NO: 329325 - RNA, 17 nt, Bordetella pertussis
cggcgcgggcacucggc

SEQ ID NO: 329326 - RNA, 13 nt, Bordetella pertussis
cggcgcgggcgca

SEQ ID NO: 329327 - RNA, 14 nt, Bordetella pertussis
cggcgcgggcggcu

SEQ ID NO: 329328 - RNA, 24 nt, Bordetella pertussis
cggcgcgggcggcuaggcgcagca

SEQ ID NO: 329329 - RNA, 19 nt, Bordetella pertussis
cggcgcgguauggccgccc

SEQ ID NO: 329330 - RNA, 20 nt, Bordetella pertussis
cggcgcgguauggccgccca

SEQ ID NO: 329331 - RNA, 22 nt, Bordetella pertussis
cggcgcgguauggccgcccagc

SEQ ID NO: 329332 - RNA, 19 nt, Bordetella pertussis
cggcgcgguauucgcgcug

SEQ ID NO: 329333 - RNA, 15 nt, Bordetella pertussis
cggcgcggugccugu

SEQ ID NO: 329334 - RNA, 17 nt, Bordetella pertussis
cggcgcggugaggcggc

SEQ ID NO: 329335 - RNA, 13 nt, Bordetella pertussis
cggcgcgggcggc

SEQ ID NO: 329336 - RNA, 15 nt, Bordetella pertussis
cggcgcgguggccau

SEQ ID NO: 329337 - RNA, 13 nt, Bordetella pertussis
cggcgcguccacg

SEQ ID NO: 329338 - RNA, 17 nt, Bordetella pertussis
cggcgcgucgccggcga

SEQ ID NO: 329339 - RNA, 14 nt, Bordetella pertussis
cggcgcgucgcgcg

SEQ ID NO: 329340 - RNA, 19 nt, Bordetella pertussis
cggcgcgucgcgcgccagg

SEQ ID NO: 329341 - RNA, 16 nt, Bordetella pertussis
cggcgcgucgcgcggc

SEQ ID NO: 329342 - RNA, 15 nt, Bordetella pertussis
cggcgcgugccagca

SEQ ID NO: 329343 - RNA, 16 nt, Bordetella pertussis
cggcgcgugccagcag

SEQ ID NO: 329344 - RNA, 23 nt, Bordetella pertussis
cggcgcgugccagcaggucgcgc

SEQ ID NO: 329345 - RNA, 17 nt, Bordetella pertussis
cggcgcguucagcagca

SEQ ID NO: 329346 - RNA, 18 nt, Bordetella pertussis
cggcgcguucagcagcag

SEQ ID NO: 329347 - RNA, 21 nt, Bordetella pertussis
cggcgcgugcggaugcagcag

SEQ ID NO: 329348 - RNA, 21 nt, Bordetella pertussis
cggcgcguucgccgcagccgu

SEQ ID NO: 329349 - RNA, 19 nt, Bordetella pertussis
cggcgcguucucagccgcc

SEQ ID NO: 329350 - RNA, 15 nt, Bordetella pertussis
cggcgcuacgccgcc

SEQ ID NO: 329351 - RNA, 21 nt, Bordetella pertussis
cggcgcuacagggugccgcgc

SEQ ID NO: 329352 - RNA, 14 nt, Bordetella pertussis
cggcgcucagagcc

SEQ ID NO: 329353 - RNA, 19 nt, Bordetella pertussis
cggcgcucagagccccagg

SEQ ID NO: 329354 - RNA, 15 nt, Bordetella pertussis
cggcgcucagcgacg

SEQ ID NO: 329355 - RNA, 22 nt, Bordetella pertussis
cggcgcucagcgacgcgcgccg

SEQ ID NO: 329356 - RNA, 18 nt, Bordetella pertussis
cggcgcucagcgcgccga

SEQ ID NO: 329357 - RNA, 21 nt, Bordetella pertussis
cggcgcucaggaaccagcggc

SEQ ID NO: 329358 - RNA, 21 nt, Bordetella pertussis
cggcgcucaucaucgcgcugg

SEQ ID NO: 329359 - RNA, 17 nt, Bordetella pertussis
cggcgcucgaaggcgcc

SEQ ID NO: 329360 - RNA, 19 nt, Bordetella pertussis
cggcgcucgaaggcgccga

SEQ ID NO: 329361 - RNA, 23 nt, Bordetella pertussis
cggcgcucgaaggcgccgacggc

SEQ ID NO: 329362 - RNA, 17 nt, Bordetella pertussis
cggcgcucgccccggcg

SEQ ID NO: 329363 - RNA, 15 nt, Bordetella pertussis
cggcgcucggccucg

SEQ ID NO: 329364 - RNA, 16 nt, Bordetella pertussis
cggcgcugcacgcggc

SEQ ID NO: 329365 - RNA, 18 nt, Bordetella pertussis
cggcgcugcacgcggccg

SEQ ID NO: 329366 - RNA, 21 nt, Bordetella pertussis
cggcgcugcacgcggccgcgc

SEQ ID NO: 329367 - RNA, 22 nt, Bordetella pertussis
cggcgcugcacgcggccgcgca

SEQ ID NO: 329368 - RNA, 13 nt, Bordetella pertussis
cggcgcugcagcg

SEQ ID NO: 329369 - RNA, 14 nt, Bordetella pertussis
cggcgcugcagcgc

SEQ ID NO: 329370 - RNA, 15 nt, Bordetella pertussis
cggcgcugcagcgca

SEQ ID NO: 329371 - RNA, 18 nt, Bordetella pertussis
cggcgcugcagcgcagga

SEQ ID NO: 329372 - RNA, 16 nt, Bordetella pertussis
cggcgcugccgggguc

SEQ ID NO: 329373 - RNA, 17 nt, Bordetella pertussis
cggcgcugccggggucc

SEQ ID NO: 329374 - RNA, 21 nt, Bordetella pertussis
cggcgcugccgggguccuugg

SEQ ID NO: 329375 - RNA, 15 nt, Bordetella pertussis
cggcgcugcgcagca

SEQ ID NO: 329376 - RNA, 16 nt, Bordetella pertussis
cggcgcugcgcagcag

SEQ ID NO: 329377 - RNA, 22 nt, Bordetella pertussis
cggcgcugcgcagcagggcggc

SEQ ID NO: 329378 - RNA, 14 nt, Bordetella pertussis
cggcgcugcuggcc

SEQ ID NO: 329379 - RNA, 15 nt, Bordetella pertussis
cggcgcugcuggccg

SEQ ID NO: 329380 - RNA, 16 nt, Bordetella pertussis
cggcgcugcuggccgg

SEQ ID NO: 329381 - RNA, 17 nt, Bordetella pertussis
cggcgcugcuggccggc

SEQ ID NO: 329382 - RNA, 18 nt, Bordetella pertussis
cggcgcugcuggccggcc

SEQ ID NO: 329383 - RNA, 14 nt, Bordetella pertussis
cggcgcugcugucg

SEQ ID NO: 329384 - RNA, 18 nt, Bordetella pertussis
cggcgcugcugucgcgcg

SEQ ID NO: 329385 - RNA, 23 nt, Bordetella pertussis
cggcgcugcugucgcgcgacugg

SEQ ID NO: 329386 - RNA, 13 nt, Bordetella pertussis
cggcgcuggccau

SEQ ID NO: 329387 - RNA, 13 nt, Bordetella pertussis
cggcgcuggccgc

SEQ ID NO: 329388 - RNA, 14 nt, Bordetella pertussis
cggcgcuggccgcc

SEQ ID NO: 329389 - RNA, 15 nt, Bordetella pertussis
cggcgcuggccugcc

SEQ ID NO: 329390 - RNA, 21 nt, Bordetella pertussis
cggcgcuggccugccgcgccg

SEQ ID NO: 329391 - RNA, 19 nt, Bordetella pertussis
cggcgcuggccuggccgcc

SEQ ID NO: 329392 - RNA, 21 nt, Bordetella pertussis
cggcgcuggccuggccgccgg

SEQ ID NO: 329393 - RNA, 12 nt, Bordetella pertussis
cggcgcuggcga

SEQ ID NO: 329394 - RNA, 12 nt, Bordetella pertussis
cggcgcuggcgc

SEQ ID NO: 329395 - RNA, 17 nt, Bordetella pertussis
cggcgcuggcgccgcgc

SEQ ID NO: 329396 - RNA, 18 nt, Bordetella pertussis
cggcgcuggcgccgcgcg

SEQ ID NO: 329397 - RNA, 14 nt, Bordetella pertussis
cggcgcuggcguug

SEQ ID NO: 329398 - RNA, 11 nt, Bordetella pertussis
cggcgcuggcu

SEQ ID NO: 329399 - RNA, 19 nt, Bordetella pertussis
cggcgcuggcuggacgcgc

SEQ ID NO: 329400 - RNA, 17 nt, Bordetella pertussis
cggcgcugggcaggcug

SEQ ID NO: 329401 - RNA, 18 nt, Bordetella pertussis
cggcgcuggucaaccugg

SEQ ID NO: 329402 - RNA, 18 nt, Bordetella pertussis
cggcgcuuaccgcgccgg

SEQ ID NO: 329403 - RNA, 17 nt, Bordetella pertussis
cggcggaaugcggcgac

SEQ ID NO: 329404 - RNA, 16 nt, Bordetella pertussis
cggcggacugcgccgc

SEQ ID NO: 329405 - RNA, 12 nt, Bordetella pertussis
cggcggacuggc

SEQ ID NO: 329406 - RNA, 17 nt, Bordetella pertussis
cggcggacuggccgcgc

SEQ ID NO: 329407 - RNA, 22 nt, Bordetella pertussis
cggcggacuggccgcgccgcug

SEQ ID NO: 329408 - RNA, 14 nt, Bordetella pertussis
cggcggaucgaacg

SEQ ID NO: 329409 - RNA, 13 nt, Bordetella pertussis
cggcggaugcgaa

SEQ ID NO: 329410 - RNA, 14 nt, Bordetella pertussis
cggcggcaagcagc

SEQ ID NO: 329411 - RNA, 15 nt, Bordetella pertussis
cggcggcaagcagcc

SEQ ID NO: 329412 - RNA, 17 nt, Bordetella pertussis
cggcggcaagcagccgg

SEQ ID NO: 329413 - RNA, 18 nt, Bordetella pertussis
cggcggcaagcagccgga

SEQ ID NO: 329414 - RNA, 22 nt, Bordetella pertussis
cggcggcaagguagccgaugac

SEQ ID NO: 329415 - RNA, 21 nt, Bordetella pertussis
cggcggcaauaucggcacccg

SEQ ID NO: 329416 - RNA, 21 nt, Bordetella pertussis
cggcggcaccauugccggcgc

SEQ ID NO: 329417 - RNA, 16 nt, Bordetella pertussis
cggcggcaccgcgcag

SEQ ID NO: 329418 - RNA, 20 nt, Bordetella pertussis
cggcggcaccgcgcagcccg

SEQ ID NO: 329419 - RNA, 21 nt, Bordetella pertussis
cggcggcaccgcgcagcccgg

SEQ ID NO: 329420 - RNA, 14 nt, Bordetella pertussis
cggcggcacgcgcg

SEQ ID NO: 329421 - RNA, 17 nt, Bordetella pertussis
cggcggcacgcgcgccg

SEQ ID NO: 329422 - RNA, 19 nt, Bordetella pertussis
cggcggcacgcgcgccggc

SEQ ID NO: 329423 - RNA, 22 nt, Bordetella pertussis
cggcggcacgcgcgccggcagg

SEQ ID NO: 329424 - RNA, 19 nt, Bordetella pertussis
cggcggcacgcugcgcagg

SEQ ID NO: 329425 - RNA, 13 nt, Bordetella pertussis
cggcggcacggcc

SEQ ID NO: 329426 - RNA, 15 nt, Bordetella pertussis
cggcggcacggccgg

SEQ ID NO: 329427 - RNA, 14 nt, Bordetella pertussis
cggcggcagccggc

SEQ ID NO: 329428 - RNA, 23 nt, Bordetella pertussis
cggcggcagcuugaccgccucca

SEQ ID NO: 329429 - RNA, 13 nt, Bordetella pertussis
cggcggcaggccg

SEQ ID NO: 329430 - RNA, 16 nt, Bordetella pertussis
cggcggcaggccgcgc

SEQ ID NO: 329431 - RNA, 18 nt, Bordetella pertussis
cggcggcaggccgcgcca

SEQ ID NO: 329432 - RNA, 20 nt, Bordetella pertussis
cggcggcaggccgcgccaca

SEQ ID NO: 329433 - RNA, 21 nt, Bordetella pertussis
cggcggcaggccgcgccacag

SEQ ID NO: 329434 - RNA, 20 nt, Bordetella pertussis
cggcggcaggucggugcaca

SEQ ID NO: 329435 - RNA, 16 nt, Bordetella pertussis
cggcggcaugcgccag

SEQ ID NO: 329436 - RNA, 19 nt, Bordetella pertussis
cggcggcaugcgccagcca

SEQ ID NO: 329437 - RNA, 23 nt, Bordetella pertussis
cggcggcaugcgccagccagcgc

SEQ ID NO: 329438 - RNA, 17 nt, Bordetella pertussis
cggcggcaugcugguca

SEQ ID NO: 329439 - RNA, 14 nt, Bordetella pertussis
cggcggccacgacc

SEQ ID NO: 329440 - RNA, 16 nt, Bordetella pertussis
cggcggccacgaccgg

SEQ ID NO: 329441 - RNA, 21 nt, Bordetella pertussis
cggcggccacgaccggcucga

SEQ ID NO: 329442 - RNA, 18 nt, Bordetella pertussis
cggcggcauucagcgcug

SEQ ID NO: 329443 - RNA, 13 nt, Bordetella pertussis
cggcggccagcag

SEQ ID NO: 329444 - RNA, 16 nt, Bordetella pertussis
cggcggccagcagcgg

SEQ ID NO: 329445 - RNA, 15 nt, Bordetella pertussis
cggcggccagccggc

SEQ ID NO: 329446 - RNA, 17 nt, Bordetella pertussis
cggcggccagccggcgc

SEQ ID NO: 329447 - RNA, 15 nt, Bordetella pertussis
cggcggccagcgcgc

SEQ ID NO: 329448 - RNA, 12 nt, Bordetella pertussis
cggcggccaggc

SEQ ID NO: 329449 - RNA, 14 nt, Bordetella pertussis
cggcggccaggccc

SEQ ID NO: 329450 - RNA, 20 nt, Bordetella pertussis
cggcggccaggcccugcgcg

SEQ ID NO: 329451 - RNA, 15 nt, Bordetella pertussis
cggcggccaggccgg

SEQ ID NO: 329452 - RNA, 17 nt, Bordetella pertussis
cggcggccaggccggcg

SEQ ID NO: 329453 - RNA, 18 nt, Bordetella pertussis
cggcggccaggccggcga

SEQ ID NO: 329454 - RNA, 19 nt, Bordetella pertussis
cggcggccaggccggcgaa

SEQ ID NO: 329455 - RNA, 19 nt, Bordetella pertussis
cggcggccaggccggcgcg

SEQ ID NO: 329456 - RNA, 15 nt, Bordetella pertussis
cggcggccaggcgua

SEQ ID NO: 329457 - RNA, 17 nt, Bordetella pertussis
cggcggccaggcguacg

SEQ ID NO: 329458 - RNA, 23 nt, Bordetella pertussis
cggcggccagggaaggggcggcu

SEQ ID NO: 329459 - RNA, 21 nt, Bordetella pertussis
cggcggccaucuuggugcgcg

SEQ ID NO: 329460 - RNA, 24 nt, Bordetella pertussis
cggcggccaucuuggugcgcgcca

SEQ ID NO: 329461 - RNA, 19 nt, Bordetella pertussis
cggcggccaugacggccau

SEQ ID NO: 329462 - RNA, 20 nt, Bordetella pertussis
cggcggccaugcccaggccc

SEQ ID NO: 329463 - RNA, 21 nt, Bordetella pertussis
cggcggccaugcccaggccca

SEQ ID NO: 329464 - RNA, 11 nt, Bordetella pertussis
cggcggccagc

SEQ ID NO: 329465 - RNA, 22 nt, Bordetella pertussis
cggcggccaucgccauggccac

SEQ ID NO: 329466 - RNA, 18 nt, Bordetella pertussis
cggcggcccaucgugcgc

SEQ ID NO: 329467 - RNA, 18 nt, Bordetella pertussis
cggcggccgccugcgccg

SEQ ID NO: 329468 - RNA, 20 nt, Bordetella pertussis
cggcggccgccugcgccgag

SEQ ID NO: 329469 - RNA, 21 nt, Bordetella pertussis
cggcggccgccugcgccgagg

SEQ ID NO: 329470 - RNA, 12 nt, Bordetella pertussis
cggcggccgcgu

SEQ ID NO: 329471 - RNA, 21 nt, Bordetella pertussis
cggcggccgcguccagcgcgc

SEQ ID NO: 329472 - RNA, 22 nt, Bordetella pertussis
cggcggccgcgucgaucagcgc

SEQ ID NO: 329473 - RNA, 12 nt, Bordetella pertussis
cggcggccggcu

SEQ ID NO: 329474 - RNA, 14 nt, Bordetella pertussis
cggcggccggcucg

SEQ ID NO: 329475 - RNA, 16 nt, Bordetella pertussis
cggcggccggcucgua

SEQ ID NO: 329476 - RNA, 21 nt, Bordetella pertussis
cggcggccuaugugcaggcca

SEQ ID NO: 329477 - RNA, 16 nt, Bordetella pertussis
cggcggccuccgcgca

SEQ ID NO: 329478 - RNA, 17 nt, Bordetella pertussis
cggcggccuccgcgcac

SEQ ID NO: 329479 - RNA, 15 nt, Bordetella pertussis
cggcggccuccagca

SEQ ID NO: 329480 - RNA, 23 nt, Bordetella pertussis
cggcggccuggaccugagccagg

SEQ ID NO: 329481 - RNA, 15 nt, Bordetella pertussis
cggcggccugggcca

SEQ ID NO: 329482 - RNA, 14 nt, Bordetella pertussis
cggcggccugggcc

SEQ ID NO: 329483 - RNA, 15 nt, Bordetella pertussis
cggcggcgcgccgcc

SEQ ID NO: 329484 - RNA, 12 nt, Bordetella pertussis
cggcggcgcgcg

SEQ ID NO: 329485 - RNA, 18 nt, Bordetella pertussis
cggcggcgcggcgccaug

SEQ ID NO: 329486 - RNA, 13 nt, Bordetella pertussis
cggcggcgcggcg

SEQ ID NO: 329487 - RNA, 20 nt, Bordetella pertussis
cggcggcgcguucgccgcag

SEQ ID NO: 329488 - RNA, 23 nt, Bordetella pertussis
cggcggcgcguucgccgcagccg

SEQ ID NO: 329489 - RNA, 12 nt, Bordetella pertussis
cggcggcgcugg

SEQ ID NO: 329490 - RNA, 23 nt, Bordetella pertussis
cggcggcggaucgaacgccucgg

SEQ ID NO: 329491 - RNA, 15 nt, Bordetella pertussis
cggcggcgucgcgcu

SEQ ID NO: 329492 - RNA, 15 nt, Bordetella pertussis
cggcggcgucggcgc

SEQ ID NO: 329493 - RNA, 13 nt, Bordetella pertussis
cggcggcgucugg

SEQ ID NO: 329494 - RNA, 12 nt, Bordetella pertussis
cggcggcguuca

SEQ ID NO: 329495 - RNA, 19 nt, Bordetella pertussis
cggcggcguuccugggcac

SEQ ID NO: 329496 - RNA, 18 nt, Bordetella pertussis
cggcggcugugggccucg

SEQ ID NO: 329497 - RNA, 19 nt, Bordetella pertussis
cggcggcugugggccucgc

SEQ ID NO: 329498 - RNA, 15 nt, Bordetella pertussis
cggcgggcgcgcagg

SEQ ID NO: 329499 - RNA, 18 nt, Bordetella pertussis
cggcgggcgcuggcgcgc

SEQ ID NO: 329500 - RNA, 23 nt, Bordetella pertussis
cggcgggcgcuggcgcgcggcug

SEQ ID NO: 329501 - RNA, 15 nt, Bordetella pertussis
cggcgggcggccggc

SEQ ID NO: 329502 - RNA, 17 nt, Bordetella pertussis
cggcgggcggccggcgc

SEQ ID NO: 329503 - RNA, 14 nt, Bordetella pertussis
cggcgggcggcgcc

SEQ ID NO: 329504 - RNA, 17 nt, Bordetella pertussis
cggcgggcggcgccagc

SEQ ID NO: 329505 - RNA, 18 nt, Bordetella pertussis
cggcgggcggcgccagcg

SEQ ID NO: 329506 - RNA, 18 nt, Bordetella pertussis
cggcgggcggcgcggcca

SEQ ID NO: 329507 - RNA, 19 nt, Bordetella pertussis
cggcgggcgugaugccgac

SEQ ID NO: 329508 - RNA, 13 nt, Bordetella pertussis
cggcgggcucggc

SEQ ID NO: 329509 - RNA, 14 nt, Bordetella pertussis
cggcgggcucggcg

SEQ ID NO: 329510 - RNA, 15 nt, Bordetella pertussis
cggcgggcucggcgc

SEQ ID NO: 329511 - RNA, 22 nt, Bordetella pertussis
cggcgggcucggcgccggcggc

SEQ ID NO: 329512 - RNA, 14 nt, Bordetella pertussis
cggcggggacaggc

SEQ ID NO: 329513 - RNA, 16 nt, Bordetella pertussis
cggcggggacaggcgc

SEQ ID NO: 329514 - RNA, 21 nt, Bordetella pertussis
cggcgggucaaguccggcgcc

SEQ ID NO: 329515 - RNA, 23 nt, Bordetella pertussis
cggcgggucaaguccggcgccgc

SEQ ID NO: 329516 - RNA, 13 nt, Bordetella pertussis
cggcgucagcgcc

SEQ ID NO: 329517 - RNA, 18 nt, Bordetella pertussis
cggcgucagcgcccaauc

SEQ ID NO: 329518 - RNA, 13 nt, Bordetella pertussis
cggcgucaggccg

SEQ ID NO: 329519 - RNA, 17 nt, Bordetella pertussis
cggcgucaggccgucga

SEQ ID NO: 329520 - RNA, 23 nt, Bordetella pertussis
cggcgucaggccgucgagccggg

SEQ ID NO: 329521 - RNA, 13 nt, Bordetella pertussis
cggcguccacggc

SEQ ID NO: 329522 - RNA, 21 nt, Bordetella pertussis
cggcguccauuagggcccagc

SEQ ID NO: 329523 - RNA, 14 nt, Bordetella pertussis
cggcguccgcgccg

SEQ ID NO: 329524 - RNA, 15 nt, Bordetella pertussis
cggcguccgcgccga

SEQ ID NO: 329525 - RNA, 16 nt, Bordetella pertussis
cggcguccugccgcga

SEQ ID NO: 329526 - RNA, 17 nt, Bordetella pertussis
cggcguccugcggcggc

SEQ ID NO: 329527 - RNA, 20 nt, Bordetella pertussis
cggcguccugcggcggcagc

SEQ ID NO: 329528 - RNA, 13 nt, Bordetella pertussis
cggcgucgaacag

SEQ ID NO: 329529 - RNA, 16 nt, Bordetella pertussis
cggcgucgaaggccgc

SEQ ID NO: 329530 - RNA, 18 nt, Bordetella pertussis
cggcgucgacgcccgcgc

SEQ ID NO: 329531 - RNA, 19 nt, Bordetella pertussis
cggcgucgacgcccgcgcc

SEQ ID NO: 329532 - RNA, 18 nt, Bordetella pertussis
cggcgucgaucggcgcgc

SEQ ID NO: 329533 - RNA, 16 nt, Bordetella pertussis
cggcgucgaugcgcgc

SEQ ID NO: 329534 - RNA, 13 nt, Bordetella pertussis
cggcgucgccgcg

SEQ ID NO: 329535 - RNA, 16 nt, Bordetella pertussis
cggcgucgccggccag

SEQ ID NO: 329536 - RNA, 17 nt, Bordetella pertussis
cggcgucgcuggcagcc

SEQ ID NO: 329537 - RNA, 20 nt, Bordetella pertussis
cggcgucgcuggcagccuug

SEQ ID NO: 329538 - RNA, 14 nt, Bordetella pertussis
cggcgucggcgccc

SEQ ID NO: 329539 - RNA, 16 nt, Bordetella pertussis
cggcgucggcgcccgg

SEQ ID NO: 329540 - RNA, 21 nt, Bordetella pertussis
cggcgucggcgcccggcgccg

SEQ ID NO: 329541 - RNA, 17 nt, Bordetella pertussis
cggcgugaacgcgcauu

SEQ ID NO: 329542 - RNA, 18 nt, Bordetella pertussis
cggcgugaccgcgacgcg

SEQ ID NO: 329543 - RNA, 20 nt, Bordetella pertussis
cggcgugaccgcgacgcgcc

SEQ ID NO: 329544 - RNA, 19 nt, Bordetella pertussis
cggcgugacguugccgcgc

SEQ ID NO: 329545 - RNA, 22 nt, Bordetella pertussis
cggcgugacguugccgcgcgcg

SEQ ID NO: 329546 - RNA, 15 nt, Bordetella pertussis
cggcgugagcacgac

SEQ ID NO: 329547 - RNA, 16 nt, Bordetella pertussis
cggcgugaugcccagg

SEQ ID NO: 329548 - RNA, 18 nt, Bordetella pertussis
cggcgugcagcaagccca

SEQ ID NO: 329549 - RNA, 21 nt, Bordetella pertussis
cggcgugcagcaagcccaccg

SEQ ID NO: 329550 - RNA, 20 nt, Bordetella pertussis
cggcguguagagcugcggcg

SEQ ID NO: 329551 - RNA, 16 nt, Bordetella pertussis
cggcguguccagcggc

SEQ ID NO: 329552 - RNA, 17 nt, Bordetella pertussis
cggcguguccagcggcg

SEQ ID NO: 329553 - RNA, 18 nt, Bordetella pertussis
cggcguguccagcggcgc

SEQ ID NO: 329554 - RNA, 19 nt, Bordetella pertussis
cggcguguccagcggcgcc

SEQ ID NO: 329555 - RNA, 20 nt, Bordetella pertussis
cggcguguccagcggcgcca

SEQ ID NO: 329556 - RNA, 16 nt, Bordetella pertussis
cggcguguucagcgcg

SEQ ID NO: 329557 - RNA, 18 nt, Bordetella pertussis
cggcguucugcagcgcgg

SEQ ID NO: 329558 - RNA, 21 nt, Bordetella pertussis
cggcguucuggucagccgugu

SEQ ID NO: 329559 - RNA, 18 nt, Bordetella pertussis
cggcguucuucagcgcgc

SEQ ID NO: 329560 - RNA, 22 nt, Bordetella pertussis
cggcguugaccuggucgggcgu

SEQ ID NO: 329561 - RNA, 22 nt, Bordetella pertussis
cggcguugcuggcaaagcgcgc

SEQ ID NO: 329562 - RNA, 15 nt, Bordetella pertussis
cggcguugcggcgcc

SEQ ID NO: 329563 - RNA, 15 nt, Bordetella pertussis
cggcguugugccggc

SEQ ID NO: 329564 - RNA, 19 nt, Bordetella pertussis
cggcguugugccggcgcag

SEQ ID NO: 329565 - RNA, 15 nt, Bordetella pertussis
cggcguuggccgggu

SEQ ID NO: 329566 - RNA, 15 nt, Bordetella pertussis
cggcuaggcgcagca

SEQ ID NO: 329567 - RNA, 21 nt, Bordetella pertussis
cggcuaggcgcagcaggccag

SEQ ID NO: 329568 - RNA, 18 nt, Bordetella pertussis
cggcuccagcucagcagc

SEQ ID NO: 329569 - RNA, 17 nt, Bordetella pertussis
cggcuccaggccgccca

SEQ ID NO: 329570 - RNA, 16 nt, Bordetella pertussis
cggcuccagucccgca

SEQ ID NO: 329571 - RNA, 17 nt, Bordetella pertussis
cggcucccgcgccauug

SEQ ID NO: 329572 - RNA, 15 nt, Bordetella pertussis
cggcucccgcgcugc

SEQ ID NO: 329573 - RNA, 21 nt, Bordetella pertussis
cggcucggugaugauggccag

SEQ ID NO: 329574 - RNA, 22 nt, Bordetella pertussis
cggcucggugaugauggccagg

SEQ ID NO: 329575 - RNA, 18 nt, Bordetella pertussis
cggcugaagaagcccggc

SEQ ID NO: 329576 - RNA, 21 nt, Bordetella pertussis
cggcugaauuggcgcccaucg

SEQ ID NO: 329577 - RNA, 18 nt, Bordetella pertussis
cggcugcaccagcgcgcc

SEQ ID NO: 329578 - RNA, 19 nt, Bordetella pertussis
cggcugcaccagcgcgccg

SEQ ID NO: 329579 - RNA, 22 nt, Bordetella pertussis
cggcugcaccagcgcgccgcgc

SEQ ID NO: 329580 - RNA, 22 nt, Bordetella pertussis
cggcugcaccaguuugccguug

SEQ ID NO: 329581 - RNA, 18 nt, Bordetella pertussis
cggcugcaugcgcgaacg

SEQ ID NO: 329582 - RNA, 15 nt, Bordetella pertussis
cggcugccagggccg

SEQ ID NO: 329583 - RNA, 20 nt, Bordetella pertussis
cggcugccagugguccauca

SEQ ID NO: 329584 - RNA, 14 nt, Bordetella pertussis
cggcugcccgggcu

SEQ ID NO: 329585 - RNA, 22 nt, Bordetella pertussis
cggcugcccgggcugcugcacg

SEQ ID NO: 329586 - RNA, 19 nt, Bordetella pertussis
cggcugccgauacgggcgc

SEQ ID NO: 329587 - RNA, 20 nt, Bordetella pertussis
cggcugccgauacgggcgcg

SEQ ID NO: 329588 - RNA, 14 nt, Bordetella pertussis
cggcugcgcgacga

SEQ ID NO: 329589 - RNA, 14 nt, Bordetella pertussis
cggcugcgcgccga

SEQ ID NO: 329590 - RNA, 18 nt, Bordetella pertussis
cggcugcgcgccgaccac

SEQ ID NO: 329591 - RNA, 14 nt, Bordetella pertussis
cggcugcgcgcgca

SEQ ID NO: 329592 - RNA, 14 nt, Bordetella pertussis
cggcugcgggccgg

SEQ ID NO: 329593 - RNA, 18 nt, Bordetella pertussis
cggcugcgggccggcgcc

SEQ ID NO: 329594 - RNA, 22 nt, Bordetella pertussis
cggcugcgggcgcaagccagca

SEQ ID NO: 329595 - RNA, 21 nt, Bordetella pertussis
cggcugcucguucugcgcgcc

SEQ ID NO: 329596 - RNA, 23 nt, Bordetella pertussis
cggcugcucguucugcgcgcccg

SEQ ID NO: 329597 - RNA, 13 nt, Bordetella pertussis
cggcugcuggccc

SEQ ID NO: 329598 - RNA, 22 nt, Bordetella pertussis
cggcuggagauacuggccgaug

SEQ ID NO: 329599 - RNA, 17 nt, Bordetella pertussis
cggcuggauggugccgc

SEQ ID NO: 329600 - RNA, 15 nt, Bordetella pertussis
cggcuggcaugcggc

SEQ ID NO: 329601 - RNA, 16 nt, Bordetella pertussis
cggcuggcaugcggcg

SEQ ID NO: 329602 - RNA, 18 nt, Bordetella pertussis
cggcuggccacuggccgc

SEQ ID NO: 329603 - RNA, 20 nt, Bordetella pertussis
cggcuggccacuggccgcgc

SEQ ID NO: 329604 - RNA, 15 nt, Bordetella pertussis
cggcuggcgcacgau

SEQ ID NO: 329605 - RNA, 14 nt, Bordetella pertussis
cggcuggcgcacgu

SEQ ID NO: 329606 - RNA, 15 nt, Bordetella pertussis
cggcuggcgcggccg

SEQ ID NO: 329607 - RNA, 22 nt, Bordetella pertussis
cggcuggcggugcgugcgccca

SEQ ID NO: 329608 - RNA, 17 nt, Bordetella pertussis
cggcuggcugggcgcgc

SEQ ID NO: 329609 - RNA, 19 nt, Bordetella pertussis
cggcuggcugggcgcgccg

SEQ ID NO: 329610 - RNA, 20 nt, Bordetella pertussis
cggcuggcugggcgcgccgc

SEQ ID NO: 329611 - RNA, 23 nt, Bordetella pertussis
cggcuggcugggcgcgccgcugc

SEQ ID NO: 329612 - RNA, 22 nt, Bordetella pertussis
cggcuggggcugcugggccggc

SEQ ID NO: 329613 - RNA, 12 nt, Bordetella pertussis
cggcugggugcg

SEQ ID NO: 329614 - RNA, 19 nt, Bordetella pertussis
cggcuggucaacucgcccg

SEQ ID NO: 329615 - RNA, 17 nt, Bordetella pertussis
cggcuggugccgacggc

SEQ ID NO: 329616 - RNA, 19 nt, Bordetella pertussis
cggcuggugccgacggcgc

SEQ ID NO: 329617 - RNA, 20 nt, Bordetella pertussis
cggcuggugccgacggcgcg

SEQ ID NO: 329618 - RNA, 21 nt, Bordetella pertussis
cggcuguagucgccgcugccg

SEQ ID NO: 329619 - RNA, 22 nt, Bordetella pertussis
cggcuguccaccugcaccguca

SEQ ID NO: 329620 - RNA, 18 nt, Bordetella pertussis
cggcuucagccgcaagcu

SEQ ID NO: 329621 - RNA, 17 nt, Bordetella pertussis
cggcuuccagcagcaug

SEQ ID NO: 329622 - RNA, 22 nt, Bordetella pertussis
cggcuuccagcagcaugccgcg

SEQ ID NO: 329623 - RNA, 16 nt, Bordetella pertussis
cggcuuccugccgcac

SEQ ID NO: 329624 - RNA, 18 nt, Bordetella pertussis
cggcuucgaccacgcggc

SEQ ID NO: 329625 - RNA, 20 nt, Bordetella pertussis
cggcuucgcccagcgcuugc

SEQ ID NO: 329626 - RNA, 15 nt, Bordetella pertussis
cggcuucgcccggau

SEQ ID NO: 329627 - RNA, 16 nt, Bordetella pertussis
cggcuugggcccggcg

SEQ ID NO: 329628 - RNA, 17 nt, Bordetella pertussis
cggcuuggggcgcgccg

SEQ ID NO: 329629 - RNA, 21 nt, Bordetella pertussis
cggcuugguugucgcgcaccg

SEQ ID NO: 329630 - RNA, 19 nt, Bordetella pertussis
cggcuuucagcgccgagcg

SEQ ID NO: 329631 - RNA, 14 nt, Bordetella pertussis
cggcuuucaugggc

SEQ ID NO: 329632 - RNA, 22 nt, Bordetella pertussis
cggcuuucaugggccugggcgc

SEQ ID NO: 329633 - RNA, 23 nt, Bordetella pertussis
cggcuuuuucucggccucgcggc

SEQ ID NO: 329634 - RNA, 13 nt, Bordetella pertussis
cgggaaacaggcc

SEQ ID NO: 329635 - RNA, 15 nt, Bordetella pertussis
cgggaaacaggccca

SEQ ID NO: 329636 - RNA, 19 nt, Bordetella pertussis
cgggaagcgcucgcgcagg

SEQ ID NO: 329637 - RNA, 19 nt, Bordetella pertussis
cgggcacaacccgcccggg

SEQ ID NO: 329638 - RNA, 20 nt, Bordetella pertussis
cgggcacaccgucacgcgca

SEQ ID NO: 329639 - RNA, 17 nt, Bordetella pertussis
cgggcaccagguccugg

SEQ ID NO: 329640 - RNA, 20 nt, Bordetella pertussis
cgggcaccagguccuggcgg

SEQ ID NO: 329641 - RNA, 21 nt, Bordetella pertussis
cgggcacgauggccgcgccca

SEQ ID NO: 329642 - RNA, 15 nt, Bordetella pertussis
cgggcacggccagca

SEQ ID NO: 329643 - RNA, 21 nt, Bordetella pertussis
cgggcacggccagcaccaugg

SEQ ID NO: 329644 - RNA, 16 nt, Bordetella pertussis
cgggcacucggccaug

SEQ ID NO: 329645 - RNA, 14 nt, Bordetella pertussis
cgggcagacgccau

SEQ ID NO: 329646 - RNA, 20 nt, Bordetella pertussis
cgggcagcaauucgaccggc

SEQ ID NO: 329647 - RNA, 14 nt, Bordetella pertussis
cgggcagcgcggcg

SEQ ID NO: 329648 - RNA, 15 nt, Bordetella pertussis
cgggcagcgcggcgg

SEQ ID NO: 329649 - RNA, 16 nt, Bordetella pertussis
cgggcagcgcggcggc

SEQ ID NO: 329650 - RNA, 13 nt, Bordetella pertussis
cgggcagcggcga

SEQ ID NO: 329651 - RNA, 16 nt, Bordetella pertussis
cgggcagcggcgacgg

SEQ ID NO: 329652 - RNA, 19 nt, Bordetella pertussis
cgggcagcggcgacggcgc

SEQ ID NO: 329653 - RNA, 16 nt, Bordetella pertussis
cgggcagcgggccgca

SEQ ID NO: 329654 - RNA, 15 nt, Bordetella pertussis
cgggcagcucgcgcg

SEQ ID NO: 329655 - RNA, 17 nt, Bordetella pertussis
cgggcagcuuggcgcgc

SEQ ID NO: 329656 - RNA, 19 nt, Bordetella pertussis
cgggcagcuuggcgcgccg

SEQ ID NO: 329657 - RNA, 20 nt, Bordetella pertussis
cgggcagcuuggcgcgccgg

SEQ ID NO: 329658 - RNA, 14 nt, Bordetella pertussis
cgggcaggauggcc

SEQ ID NO: 329659 - RNA, 17 nt, Bordetella pertussis
cgggcaggauggccaug

SEQ ID NO: 329660 - RNA, 12 nt, Bordetella pertussis
cgggcaggccca

SEQ ID NO: 329661 - RNA, 17 nt, Bordetella pertussis
cgggcaggcucagcccg

SEQ ID NO: 329662 - RNA, 19 nt, Bordetella pertussis
cgggcaggcucagcccggc

SEQ ID NO: 329663 - RNA, 18 nt, Bordetella pertussis
cgggcaugacgaccgcga

SEQ ID NO: 329664 - RNA, 16 nt, Bordetella pertussis
cgggcaugcgccugcg

SEQ ID NO: 329665 - RNA, 20 nt, Bordetella pertussis
cgggcauggcccggcucgcc

SEQ ID NO: 329666 - RNA, 22 nt, Bordetella pertussis
cgggcaugggccccaagagggc

SEQ ID NO: 329667 - RNA, 18 nt, Bordetella pertussis
cgggcauugggcagcgga

SEQ ID NO: 329668 - RNA, 13 nt, Bordetella pertussis
cgggccacccgcc

SEQ ID NO: 329669 - RNA, 17 nt, Bordetella pertussis
cgggccacccgccgccg

SEQ ID NO: 329670 - RNA, 18 nt, Bordetella pertussis
cgggccacccgccgccgg

SEQ ID NO: 329671 - RNA, 14 nt, Bordetella pertussis
cgggcccgacagcg

SEQ ID NO: 329672 - RNA, 17 nt, Bordetella pertussis
cgggcccgacagcgccc

SEQ ID NO: 329673 - RNA, 12 nt, Bordetella pertussis
cgggcccgcgca

SEQ ID NO: 329674 - RNA, 13 nt, Bordetella pertussis
cgggccgaccagg

SEQ ID NO: 329675 - RNA, 16 nt, Bordetella pertussis
cgggccgaccaggccg

SEQ ID NO: 329676 - RNA, 17 nt, Bordetella pertussis
cgggccgaccaggccgg

SEQ ID NO: 329677 - RNA, 16 nt, Bordetella pertussis
cgggccgcagcauggc

SEQ ID NO: 329678 - RNA, 19 nt, Bordetella pertussis
cgggccgcagcauggcgcc

SEQ ID NO: 329679 - RNA, 20 nt, Bordetella pertussis
cgggccgcagcauggcgcca

SEQ ID NO: 329680 - RNA, 13 nt, Bordetella pertussis
cgggccgcgcugg

SEQ ID NO: 329681 - RNA, 21 nt, Bordetella pertussis
cgggccgcggacgaagccuag

SEQ ID NO: 329682 - RNA, 14 nt, Bordetella pertussis
cgggccgcuggccc

SEQ ID NO: 329683 - RNA, 15 nt, Bordetella pertussis
cgggccgcugguggc

SEQ ID NO: 329684 - RNA, 14 nt, Bordetella pertussis
cgggccggauggcc

SEQ ID NO: 329685 - RNA, 22 nt, Bordetella pertussis
cgggccggcgaugaagucgcgg

SEQ ID NO: 329686 - RNA, 13 nt, Bordetella pertussis
cgggccggcgccg

SEQ ID NO: 329687 - RNA, 12 nt, Bordetella pertussis
cgggccggcggc

SEQ ID NO: 329688 - RNA, 21 nt, Bordetella pertussis
cgggccggcggcagccggcca

SEQ ID NO: 329689 - RNA, 22 nt, Bordetella pertussis
cgggccggcgggcaugacgacc

SEQ ID NO: 329690 - RNA, 15 nt, Bordetella pertussis
cgggccggcgggcgu

SEQ ID NO: 329691 - RNA, 21 nt, Bordetella pertussis
cgggccggcuacagcucgccg

SEQ ID NO: 329692 - RNA, 22 nt, Bordetella pertussis
cgggccggcuacagcucgccgg

SEQ ID NO: 329693 - RNA, 14 nt, Bordetella pertussis
cgggccggcucggc

SEQ ID NO: 329694 - RNA, 17 nt, Bordetella pertussis
cgggccggcucggcggc

SEQ ID NO: 329695 - RNA, 22 nt, Bordetella pertussis
cgggccggcucggcggcaucgu

SEQ ID NO: 329696 - RNA, 21 nt, Bordetella pertussis
cgggccggcugggcggccuug

SEQ ID NO: 329697 - RNA, 17 nt, Bordetella pertussis
cgggccgggcaggccgc

SEQ ID NO: 329698 - RNA, 15 nt, Bordetella pertussis
cgggccggucgcgau

SEQ ID NO: 329699 - RNA, 21 nt, Bordetella pertussis
cgggccgguuucggccugcag

SEQ ID NO: 329700 - RNA, 16 nt, Bordetella pertussis
cgggcgaaccgguggc

SEQ ID NO: 329701 - RNA, 20 nt, Bordetella pertussis
cgggcgaaccgguggccaug

SEQ ID NO: 329702 - RNA, 12 nt, Bordetella pertussis
cgggcgaaguca

SEQ ID NO: 329703 - RNA, 14 nt, Bordetella pertussis
cgggcgacaggcgc

SEQ ID NO: 329704 - RNA, 19 nt, Bordetella pertussis
cgggcgacaggcgcgcccg

SEQ ID NO: 329705 - RNA, 18 nt, Bordetella pertussis
cgggcgagaucagccacc

SEQ ID NO: 329706 - RNA, 18 nt, Bordetella pertussis
cgggcgagauggcgugca

SEQ ID NO: 329707 - RNA, 24 nt, Bordetella pertussis
cgggcgaggacuacgcgguguuca

SEQ ID NO: 329708 - RNA, 16 nt, Bordetella pertussis
cgggcgagggcugccc

SEQ ID NO: 329709 - RNA, 16 nt, Bordetella pertussis
cgggcgaggucagccc

SEQ ID NO: 329710 - RNA, 22 nt, Bordetella pertussis
cgggcgaggucagcccggcggc

SEQ ID NO: 329711 - RNA, 18 nt, Bordetella pertussis
cgggcgauauccaucggc

SEQ ID NO: 329712 - RNA, 20 nt, Bordetella pertussis
cgggcgauauccaucggcgc

SEQ ID NO: 329713 - RNA, 22 nt, Bordetella pertussis
cgggcgauauccaucggcgcgc

SEQ ID NO: 329714 - RNA, 16 nt, Bordetella pertussis
cgggcgauggccacgc

SEQ ID NO: 329715 - RNA, 16 nt, Bordetella pertussis
cgggcgauugcucgac

SEQ ID NO: 329716 - RNA, 19 nt, Bordetella pertussis
cgggcgauuugccgcagcc

SEQ ID NO: 329717 - RNA, 16 nt, Bordetella pertussis
cgggcgcaagcgcgcc

SEQ ID NO: 329718 - RNA, 21 nt, Bordetella pertussis
cgggcgcaaguguggcgcacc

SEQ ID NO: 329719 - RNA, 16 nt, Bordetella pertussis
cgggcgcagcgccgcu

SEQ ID NO: 329720 - RNA, 17 nt, Bordetella pertussis
cgggcgcaggcguuucg

SEQ ID NO: 329721 - RNA, 10 nt, Bordetella pertussis
cgggcgccag

SEQ ID NO: 329722 - RNA, 14 nt, Bordetella pertussis
cgggcgccaggcug

SEQ ID NO: 329723 - RNA, 17 nt, Bordetella pertussis
cgggcgccaucgcggua

SEQ ID NO: 329724 - RNA, 17 nt, Bordetella pertussis
cgggcgccccgaucggc

SEQ ID NO: 329725 - RNA, 14 nt, Bordetella pertussis
cgggcgcccgcgcg

SEQ ID NO: 329726 - RNA, 19 nt, Bordetella pertussis
cgggcgccgauccagccca

SEQ ID NO: 329727 - RNA, 13 nt, Bordetella pertussis
cgggcgccgcgca

SEQ ID NO: 329728 - RNA, 14 nt, Bordetella pertussis
cgggcgccgcgcac

SEQ ID NO: 329729 - RNA, 18 nt, Bordetella pertussis
cgggcgccgcgcacgcac

SEQ ID NO: 329730 - RNA, 14 nt, Bordetella pertussis
cgggcgccggcggc

SEQ ID NO: 329731 - RNA, 15 nt, Bordetella pertussis
cgggcgccucguccu

SEQ ID NO: 329732 - RNA, 15 nt, Bordetella pertussis
cgggcgccugcggca

SEQ ID NO: 329733 - RNA, 16 nt, Bordetella pertussis
cgggcgccugcggcag

SEQ ID NO: 329734 - RNA, 20 nt, Bordetella pertussis
cgggcgccugcggcaggccg

SEQ ID NO: 329735 - RNA, 24 nt, Bordetella pertussis
cgggcgccugcggcaggccgcagc

SEQ ID NO: 329736 - RNA, 21 nt, Bordetella pertussis
cgggcgccuguccccgcagga

SEQ ID NO: 329737 - RNA, 14 nt, Bordetella pertussis
cgggcgcgcagcgc

SEQ ID NO: 329738 - RNA, 15 nt, Bordetella pertussis
cgggcgcgcagcgcg

SEQ ID NO: 329739 - RNA, 15 nt, Bordetella pertussis
cgggcgcgcccggcg

SEQ ID NO: 329740 - RNA, 13 nt, Bordetella pertussis
cgggcgcgcgccg

SEQ ID NO: 329741 - RNA, 12 nt, Bordetella pertussis
cgggcgcgcgcc

SEQ ID NO: 329742 - RNA, 23 nt, Bordetella pertussis
cgggcgcgcgccggcggccugca

SEQ ID NO: 329743 - RNA, 17 nt, Bordetella pertussis
cgggcgcggccaggcgc

SEQ ID NO: 329744 - RNA, 18 nt, Bordetella pertussis
cgggcgcggccaggcgcu

SEQ ID NO: 329745 - RNA, 15 nt, Bordetella pertussis
cgggcgcggcccggc

SEQ ID NO: 329746 - RNA, 19 nt, Bordetella pertussis
cgggcgcggcccggcgucg

SEQ ID NO: 329747 - RNA, 14 nt, Bordetella pertussis
cgggcgcggccgcc

SEQ ID NO: 329748 - RNA, 15 nt, Bordetella pertussis
cgggcgcggccgccg

SEQ ID NO: 329749 - RNA, 14 nt, Bordetella pertussis
cgggcgcggcgccc

SEQ ID NO: 329750 - RNA, 17 nt, Bordetella pertussis
cgggcgcggcaggcggu

SEQ ID NO: 329751 - RNA, 13 nt, Bordetella pertussis
cgggcgcgcugcc

SEQ ID NO: 329752 - RNA, 19 nt, Bordetella pertussis
cgggcgcgggagcccgcac

SEQ ID NO: 329753 - RNA, 22 nt, Bordetella pertussis
cgggcgcgguauucgcugcugg

SEQ ID NO: 329754 - RNA, 20 nt, Bordetella pertussis
cgggcgcggugcgcaccagg

SEQ ID NO: 329755 - RNA, 20 nt, Bordetella pertussis
cgggcgcguggcccgcgccg

SEQ ID NO: 329756 - RNA, 14 nt, Bordetella pertussis
cgggcgcugcgccg

SEQ ID NO: 329757 - RNA, 19 nt, Bordetella pertussis
cgggcgcugcgccggcggc

SEQ ID NO: 329758 - RNA, 19 nt, Bordetella pertussis
cgggcgcugcacgcagcgc

SEQ ID NO: 329759 - RNA, 14 nt, Bordetella pertussis
cgggcgcuggcgcg

SEQ ID NO: 329760 - RNA, 15 nt, Bordetella pertussis
cgggcgcuggcgcgc

SEQ ID NO: 329761 - RNA, 14 nt, Bordetella pertussis
cgggcgcuucgucg

SEQ ID NO: 329762 - RNA, 21 nt, Bordetella pertussis
cgggcggcaggugcgccagca

SEQ ID NO: 329763 - RNA, 12 nt, Bordetella pertussis
cgggcggccacg

SEQ ID NO: 329764 - RNA, 16 nt, Bordetella pertussis
cgggcggccacggcgg

SEQ ID NO: 329765 - RNA, 13 nt, Bordetella pertussis
cgggcggccgacg

SEQ ID NO: 329766 - RNA, 14 nt, Bordetella pertussis
cgggcggccgacgg

SEQ ID NO: 329767 - RNA, 13 nt, Bordetella pertussis
cgggcggcccggc

SEQ ID NO: 329768 - RNA, 12 nt, Bordetella pertussis
cgggcggccggc

SEQ ID NO: 329769 - RNA, 18 nt, Bordetella pertussis
cgggcggccuaucaccug

SEQ ID NO: 329770 - RNA, 12 nt, Bordetella pertussis
cgggcggcgcca

SEQ ID NO: 329771 - RNA, 14 nt, Bordetella pertussis
cgggcggcgccugg

SEQ ID NO: 329772 - RNA, 15 nt, Bordetella pertussis
cgggcggcgcgccca

SEQ ID NO: 329773 - RNA, 14 nt, Bordetella pertussis
cgggcggcgcggcc

SEQ ID NO: 329774 - RNA, 15 nt, Bordetella pertussis
cgggcggcgcggcca

SEQ ID NO: 329775 - RNA, 13 nt, Bordetella pertussis
cgggcggcggcgc

SEQ ID NO: 329776 - RNA, 18 nt, Bordetella pertussis
cgggcggcggcgcguucg

SEQ ID NO: 329777 - RNA, 19 nt, Bordetella pertussis
cgggcggcggcguggcggc

SEQ ID NO: 329778 - RNA, 15 nt, Bordetella pertussis
cgggcggcgucgccg

SEQ ID NO: 329779 - RNA, 19 nt, Bordetella pertussis
cgggcggcgucgccgcgca

SEQ ID NO: 329780 - RNA, 12 nt, Bordetella pertussis
cgggcggcgucg

SEQ ID NO: 329781 - RNA, 17 nt, Bordetella pertussis
cgggcggcuaggcgcag

SEQ ID NO: 329782 - RNA, 22 nt, Bordetella pertussis
cgggcggcuaggcgcagcaggc

SEQ ID NO: 329783 - RNA, 13 nt, Bordetella pertussis
cgggcggcugccc

SEQ ID NO: 329784 - RNA, 17 nt, Bordetella pertussis
cgggcggcugcccgggc

SEQ ID NO: 329785 - RNA, 20 nt, Bordetella pertussis
cgggcgggaaguggaaccgc

SEQ ID NO: 329786 - RNA, 20 nt, Bordetella pertussis
cgggcggggugaucugcgcc

SEQ ID NO: 329787 - RNA, 14 nt, Bordetella pertussis
cgggcgggccgcgg

SEQ ID NO: 329788 - RNA, 13 nt, Bordetella pertussis
cgggcgggucggc

SEQ ID NO: 329789 - RNA, 22 nt, Bordetella pertussis
cgggcgggucggcgaacagcgc

SEQ ID NO: 329790 - RNA, 18 nt, Bordetella pertussis
cgggcggguucguggcuu

SEQ ID NO: 329791 - RNA, 21 nt, Bordetella pertussis
cgggcggucggcgcggcgccg

SEQ ID NO: 329792 - RNA, 18 nt, Bordetella pertussis
cgggcgguuuuuucuugc

SEQ ID NO: 329793 - RNA, 21 nt, Bordetella pertussis
cgggcguacguacugccaugg

SEQ ID NO: 329794 - RNA, 17 nt, Bordetella pertussis
cgggcguagaaagccag

SEQ ID NO: 329795 - RNA, 16 nt, Bordetella pertussis
cgggcgugaccagcug

SEQ ID NO: 329796 - RNA, 19 nt, Bordetella pertussis
cgggcgugaccagcugcac

SEQ ID NO: 329797 - RNA, 16 nt, Bordetella pertussis
cgggcgugaugccgac

SEQ ID NO: 329798 - RNA, 19 nt, Bordetella pertussis
cgggcgugaugccgaccag

SEQ ID NO: 329799 - RNA, 11 nt, Bordetella pertussis
cgggcgugcgg

SEQ ID NO: 329800 - RNA, 15 nt, Bordetella pertussis
cgggcgugcuggcac

SEQ ID NO: 329801 - RNA, 21 nt, Bordetella pertussis
cgggcucaggcugcgcgucgg

SEQ ID NO: 329802 - RNA, 12 nt, Bordetella pertussis
cgggcucgaagu

SEQ ID NO: 329803 - RNA, 21 nt, Bordetella pertussis
cgggcucgaaguacagcuuga

SEQ ID NO: 329804 - RNA, 13 nt, Bordetella pertussis
cgggcucgagcug

SEQ ID NO: 329805 - RNA, 19 nt, Bordetella pertussis
cgggcugauccgcaccggc

SEQ ID NO: 329806 - RNA, 22 nt, Bordetella pertussis
cgggcugauccgcaccggcgug

SEQ ID NO: 329807 - RNA, 16 nt, Bordetella pertussis
cgggcugaugcaggcc

SEQ ID NO: 329808 - RNA, 20 nt, Bordetella pertussis
cgggcugaugcaggccugca

SEQ ID NO: 329809 - RNA, 12 nt, Bordetella pertussis
cgggcugcggcu

SEQ ID NO: 329810 - RNA, 18 nt, Bordetella pertussis
cgggcugcgacaggcgca

SEQ ID NO: 329811 - RNA, 21 nt, Bordetella pertussis
cgggcugcgacaggcgcagcu

SEQ ID NO: 329812 - RNA, 18 nt, Bordetella pertussis
cgggcugcugcacgcgcg

SEQ ID NO: 329813 - RNA, 22 nt, Bordetella pertussis
cgggcugcugcccgaagcgcag

SEQ ID NO: 329814 - RNA, 21 nt, Bordetella pertussis
cgggcuggagaacgagccggc

SEQ ID NO: 329815 - RNA, 17 nt, Bordetella pertussis
cgggcuggauccggcgc

SEQ ID NO: 329816 - RNA, 18 nt, Bordetella pertussis
cgggcuggauccggcgcu

SEQ ID NO: 329817 - RNA, 20 nt, Bordetella pertussis
cgggcuggauccggcgcugg

SEQ ID NO: 329818 - RNA, 15 nt, Bordetella pertussis
cggggccgguccgcu

SEQ ID NO: 329819 - RNA, 21 nt, Bordetella pertussis
cggggcggucaaugcggcggc

SEQ ID NO: 329820 - RNA, 23 nt, Bordetella pertussis
cggggcggucaaugcggcggcgc

SEQ ID NO: 329821 - RNA, 17 nt, Bordetella pertussis
cggggcgucgcugcugg

SEQ ID NO: 329822 - RNA, 18 nt, Bordetella pertussis
cggggcgucgcugcuggc

SEQ ID NO: 329823 - RNA, 21 nt, Bordetella pertussis
cggggcgucgcugcuggcggc

SEQ ID NO: 329824 - RNA, 17 nt, Bordetella pertussis
cggggcguccaccgccg

SEQ ID NO: 329825 - RNA, 18 nt, Bordetella pertussis
cggggcguccaccgccga

SEQ ID NO: 329826 - RNA, 23 nt, Bordetella pertussis
cggggcgucgucgcgguccagca

SEQ ID NO: 329827 - RNA, 18 nt, Bordetella pertussis
cggggcgugagcaggcgc

SEQ ID NO: 329828 - RNA, 18 nt, Bordetella pertussis
cggggcuggccagcuggc

SEQ ID NO: 329829 - RNA, 16 nt, Bordetella pertussis
cggggguuccugccca

SEQ ID NO: 329830 - RNA, 18 nt, Bordetella pertussis
cggggucggggcaggccu

SEQ ID NO: 329831 - RNA, 21 nt, Bordetella pertussis
cgggguggucuuccaggcgca

SEQ ID NO: 329832 - RNA, 23 nt, Bordetella pertussis
cgggguggucuuccaggcgcagg

SEQ ID NO: 329833 - RNA, 16 nt, Bordetella pertussis
cgggguuccacagcgc

SEQ ID NO: 329834 - RNA, 19 nt, Bordetella pertussis
cgggguucuguccggcgcu

SEQ ID NO: 329835 - RNA, 21 nt, Bordetella pertussis
cgggguucuguccggcgcugg

SEQ ID NO: 329836 - RNA, 14 nt, Bordetella pertussis
cggguacguggccc

SEQ ID NO: 329837 - RNA, 17 nt, Bordetella pertussis
cggguacuggccgacgg

SEQ ID NO: 329838 - RNA, 20 nt, Bordetella pertussis
cggguaggcaaagcgcagca

SEQ ID NO: 329839 - RNA, 18 nt, Bordetella pertussis
cggguaucgucgaccugg

SEQ ID NO: 329840 - RNA, 17 nt, Bordetella pertussis
cgggucaaguccggcgc

SEQ ID NO: 329841 - RNA, 15 nt, Bordetella pertussis
cggguccagcacgcc

SEQ ID NO: 329842 - RNA, 19 nt, Bordetella pertussis
cgggucccaaccagggccg

SEQ ID NO: 329843 - RNA, 13 nt, Bordetella pertussis
cgggucgcgcagc

SEQ ID NO: 329844 - RNA, 14 nt, Bordetella pertussis
cgggucgcgcagca

SEQ ID NO: 329845 - RNA, 17 nt, Bordetella pertussis
cgggucgcgcagcaggg

SEQ ID NO: 329846 - RNA, 14 nt, Bordetella pertussis
cgggucggccugcc

SEQ ID NO: 329847 - RNA, 21 nt, Bordetella pertussis
cgggucggccugccaccagcg

SEQ ID NO: 329848 - RNA, 21 nt, Bordetella pertussis
cgggucguucgaacugguaca

SEQ ID NO: 329849 - RNA, 19 nt, Bordetella pertussis
cgggucuccacgaagucga

SEQ ID NO: 329850 - RNA, 18 nt, Bordetella pertussis
cgggucuugagcggcccg

SEQ ID NO: 329851 - RNA, 14 nt, Bordetella pertussis
cgggugggccggcu

SEQ ID NO: 329852 - RNA, 15 nt, Bordetella pertussis
cgggugggcgcgccg

SEQ ID NO: 329853 - RNA, 17 nt, Bordetella pertussis
cgggugggcgcgccgcg

SEQ ID NO: 329854 - RNA, 19 nt, Bordetella pertussis
cgggugggcgcgccgcgac

SEQ ID NO: 329855 - RNA, 12 nt, Bordetella pertussis
cggguggguucg

SEQ ID NO: 329856 - RNA, 19 nt, Bordetella pertussis
cgggugggcauccagcggc

SEQ ID NO: 329857 - RNA, 16 nt, Bordetella pertussis
cggguggucgcgcccg

SEQ ID NO: 329858 - RNA, 14 nt, Bordetella pertussis
cggguggugcugcu

SEQ ID NO: 329859 - RNA, 15 nt, Bordetella pertussis
cggguucgacgccgg

SEQ ID NO: 329860 - RNA, 20 nt, Bordetella pertussis
cggguucgacgccggcagcg

SEQ ID NO: 329861 - RNA, 19 nt, Bordetella pertussis
cggguucggcgguuccagc

SEQ ID NO: 329862 - RNA, 19 nt, Bordetella pertussis
cggguugcaggaugcgcgg

SEQ ID NO: 329863 - RNA, 13 nt, Bordetella pertussis
cggguugccgcug

SEQ ID NO: 329864 - RNA, 16 nt, Bordetella pertussis
cggguugccgcugcau

SEQ ID NO: 329865 - RNA, 15 nt, Bordetella pertussis
cggguugcgcgccag

SEQ ID NO: 329866 - RNA, 16 nt, Bordetella pertussis
cggguugcgcgccagc

SEQ ID NO: 329867 - RNA, 17 nt, Bordetella pertussis
cggguugcgcgccagcu

SEQ ID NO: 329868 - RNA, 18 nt, Bordetella pertussis
cggguugcgcgccagcuc

SEQ ID NO: 329869 - RNA, 23 nt, Bordetella pertussis
cggguuggcgaugcucacgccca

SEQ ID NO: 329870 - RNA, 13 nt, Bordetella pertussis
cggguuggcgucc

SEQ ID NO: 329871 - RNA, 23 nt, Bordetella pertussis
cggguuggcguccaggcgcgcca

SEQ ID NO: 329872 - RNA, 15 nt, Bordetella pertussis
cgguacgcaccgccg

SEQ ID NO: 329873 - RNA, 19 nt, Bordetella pertussis
cgguacgccugcaccgccg

SEQ ID NO: 329874 - RNA, 17 nt, Bordetella pertussis
cgguacuccuugacgcg

SEQ ID NO: 329875 - RNA, 19 nt, Bordetella pertussis
cgguacuccuugacgcgcg

SEQ ID NO: 329876 - RNA, 21 nt, Bordetella pertussis
cgguacuccuugacgcgcgcg

SEQ ID NO: 329877 - RNA, 18 nt, Bordetella pertussis
cgguacugcggcgccugg

SEQ ID NO: 329878 - RNA, 14 nt, Bordetella pertussis
cgguagacgccggg

SEQ ID NO: 329879 - RNA, 12 nt, Bordetella pertussis
cgguaggcgccc

SEQ ID NO: 329880 - RNA, 15 nt, Bordetella pertussis
cgguagguagcgcgc

SEQ ID NO: 329881 - RNA, 21 nt, Bordetella pertussis
cgguagguaugguuggccacg

SEQ ID NO: 329882 - RNA, 20 nt, Bordetella pertussis
cgguaucccaccugcagcca

SEQ ID NO: 329883 - RNA, 15 nt, Bordetella pertussis
cgguaucgacgcgcg

SEQ ID NO: 329884 - RNA, 17 nt, Bordetella pertussis
cgguaucgacgcgcguc

SEQ ID NO: 329885 - RNA, 20 nt, Bordetella pertussis
cgguaucgacgcgcgucgug

SEQ ID NO: 329886 - RNA, 13 nt, Bordetella pertussis
cgguaucgcggcg

SEQ ID NO: 329887 - RNA, 17 nt, Bordetella pertussis
cgguaucgcggcgcagg

SEQ ID NO: 329888 - RNA, 18 nt, Bordetella pertussis
cgguaucgcggcgcaggc

SEQ ID NO: 329889 - RNA, 24 nt, Bordetella pertussis
cgguaucucagcgcgccgcgccgg

SEQ ID NO: 329890 - RNA, 18 nt, Bordetella pertussis
cgguaucugucccggcgg

SEQ ID NO: 329891 - RNA, 13 nt, Bordetella pertussis
cgguaugccugcc

SEQ ID NO: 329892 - RNA, 14 nt, Bordetella pertussis
cgguaugcggcgcc

SEQ ID NO: 329893 - RNA, 15 nt, Bordetella pertussis
cgguaugcggcgccc

SEQ ID NO: 329894 - RNA, 18 nt, Bordetella pertussis
cgguauggccgcccagca

SEQ ID NO: 329895 - RNA, 18 nt, Bordetella pertussis
cgguauggcggcaacgug

SEQ ID NO: 329896 - RNA, 22 nt, Bordetella pertussis
cgguauucgcgcuggcgcgaga

SEQ ID NO: 329897 - RNA, 14 nt, Bordetella pertussis
cgguauugcgccac

SEQ ID NO: 329898 - RNA, 18 nt, Bordetella pertussis
cggucaacgccugcgggc

SEQ ID NO: 329899 - RNA, 23 nt, Bordetella pertussis
cggucaaucuauacaacgcggug

SEQ ID NO: 329900 - RNA, 14 nt, Bordetella pertussis
cggucaaugcggcg

SEQ ID NO: 329901 - RNA, 21 nt, Bordetella pertussis
cggucaauguauuuggcggcu

SEQ ID NO: 329902 - RNA, 16 nt, Bordetella pertussis
cggucacacugggcgg

SEQ ID NO: 329903 - RNA, 22 nt, Bordetella pertussis
cggucaccgagcugagcaccag

SEQ ID NO: 329904 - RNA, 15 nt, Bordetella pertussis
cggucaccgcgccca

SEQ ID NO: 329905 - RNA, 22 nt, Bordetella pertussis
cggucacgaucuggccgauggc

SEQ ID NO: 329906 - RNA, 20 nt, Bordetella pertussis
cggucacgcugguggccacc

SEQ ID NO: 329907 - RNA, 21 nt, Bordetella pertussis
cggucacguacucgccgucga

SEQ ID NO: 329908 - RNA, 20 nt, Bordetella pertussis
cggucacguucagcgccggc

SEQ ID NO: 329909 - RNA, 21 nt, Bordetella pertussis
cggucacguucagcgccggca

SEQ ID NO: 329910 - RNA, 20 nt, Bordetella pertussis
cggugacgcccugccauucg

SEQ ID NO: 329911 - RNA, 15 nt, Bordetella pertussis
cggugagauccagcg

SEQ ID NO: 329912 - RNA, 18 nt, Bordetella pertussis
cggugagauccagcgaga

SEQ ID NO: 329913 - RNA, 20 nt, Bordetella pertussis
cggugagcggcacgacgucg

SEQ ID NO: 329914 - RNA, 21 nt, Bordetella pertussis
cggugauaugcgccaggcccu

SEQ ID NO: 329915 - RNA, 15 nt, Bordetella pertussis
cggugaucagcaggc

SEQ ID NO: 329916 - RNA, 18 nt, Bordetella pertussis
cggugaucagcaggccca

SEQ ID NO: 329917 - RNA, 19 nt, Bordetella pertussis
cggugaucaucgugccggg

SEQ ID NO: 329918 - RNA, 20 nt, Bordetella pertussis
cggugauccacugcagcagu

SEQ ID NO: 329919 - RNA, 23 nt, Bordetella pertussis
cggugauccacugcagcaguucg

SEQ ID NO: 329920 - RNA, 21 nt, Bordetella pertussis
cggugaucgaguaggccggca

SEQ ID NO: 329921 - RNA, 21 nt, Bordetella pertussis
cggugaucuugccgaugcggc

SEQ ID NO: 329922 - RNA, 17 nt, Bordetella pertussis
cggugaugacgucgucg

SEQ ID NO: 329923 - RNA, 18 nt, Bordetella pertussis
cggugaugcggcgcgccg

SEQ ID NO: 329924 - RNA, 20 nt, Bordetella pertussis
cggugaugcggcgcgccgcg

SEQ ID NO: 329925 - RNA, 23 nt, Bordetella pertussis
cggugauguacgcaucggcgccg

SEQ ID NO: 329926 - RNA, 14 nt, Bordetella pertussis
cggugaugucgccg

SEQ ID NO: 329927 - RNA, 13 nt, Bordetella pertussis
cggugcaagcggc

SEQ ID NO: 329928 - RNA, 14 nt, Bordetella pertussis
cggugcaagcggcc

SEQ ID NO: 329929 - RNA, 16 nt, Bordetella pertussis
cggugcaagcggccgg

SEQ ID NO: 329930 - RNA, 17 nt, Bordetella pertussis
cggugcaagcggccggc

SEQ ID NO: 329931 - RNA, 17 nt, Bordetella pertussis
cggugcacacgccuucg

SEQ ID NO: 329932 - RNA, 15 nt, Bordetella pertussis
cggugcaccaggcca

SEQ ID NO: 329933 - RNA, 12 nt, Bordetella pertussis
cggugcagccca

SEQ ID NO: 329934 - RNA, 18 nt, Bordetella pertussis
cggugcagcccagcacca

SEQ ID NO: 329935 - RNA, 13 nt, Bordetella pertussis
cggugcagccgcc

SEQ ID NO: 329936 - RNA, 18 nt, Bordetella pertussis
cggugcaggggccgcacg

SEQ ID NO: 329937 - RNA, 20 nt, Bordetella pertussis
cggugcaggucaucgcgcug

SEQ ID NO: 329938 - RNA, 14 nt, Bordetella pertussis
cggugcaucggccg

SEQ ID NO: 329939 - RNA, 15 nt, Bordetella pertussis
cggugcaucggccgg

SEQ ID NO: 329940 - RNA, 18 nt, Bordetella pertussis
cggugcaucggccggcgg

SEQ ID NO: 329941 - RNA, 21 nt, Bordetella pertussis
cggugcaucggccggcggucg

SEQ ID NO: 329942 - RNA, 15 nt, Bordetella pertussis
cggugcaucucggca

SEQ ID NO: 329943 - RNA, 18 nt, Bordetella pertussis
cggugcaucucggcaucg

SEQ ID NO: 329944 - RNA, 20 nt, Bordetella pertussis
cggugcaucucggcaucggc

SEQ ID NO: 329945 - RNA, 21 nt, Bordetella pertussis
cggugccaguccccaugcggc

SEQ ID NO: 329946 - RNA, 21 nt, Bordetella pertussis
cggugccccggccucgcggcg

SEQ ID NO: 329947 - RNA, 22 nt, Bordetella pertussis
cggugcccuugcucccaguucu

SEQ ID NO: 329948 - RNA, 14 nt, Bordetella pertussis
cggugccgcccacc

SEQ ID NO: 329949 - RNA, 17 nt, Bordetella pertussis
cggugccgcccaccgug

SEQ ID NO: 329950 - RNA, 22 nt, Bordetella pertussis
cggugccgcccaccgugaccag

SEQ ID NO: 329951 - RNA, 15 nt, Bordetella pertussis
cggugccgccgagca

SEQ ID NO: 329952 - RNA, 19 nt, Bordetella pertussis
cggugccgccuggccagau

SEQ ID NO: 329953 - RNA, 11 nt, Bordetella pertussis
cggugccgcgc

SEQ ID NO: 329954 - RNA, 15 nt, Bordetella pertussis
cggugccgcgcaccc

SEQ ID NO: 329955 - RNA, 22 nt, Bordetella pertussis
cggugccgcgcacccaggccca

SEQ ID NO: 329956 - RNA, 13 nt, Bordetella pertussis
cggugccgcgcgc

SEQ ID NO: 329957 - RNA, 14 nt, Bordetella pertussis
cggugccgcgcgcg

SEQ ID NO: 329958 - RNA, 21 nt, Bordetella pertussis
cggugccgcgcgcggccggca

SEQ ID NO: 329959 - RNA, 14 nt, Bordetella pertussis
cggugccgcgcgcu

SEQ ID NO: 329960 - RNA, 17 nt, Bordetella pertussis
cggugccguccagcgcg

SEQ ID NO: 329961 - RNA, 17 nt, Bordetella pertussis
cggugccuugcggcgcc

SEQ ID NO: 329962 - RNA, 18 nt, Bordetella pertussis
cggugccuugcggcgccg

SEQ ID NO: 329963 - RNA, 16 nt, Bordetella pertussis
cggugcgauagcgccg

SEQ ID NO: 329964 - RNA, 17 nt, Bordetella pertussis
cggugcgauagcgccgc

SEQ ID NO: 329965 - RNA, 23 nt, Bordetella pertussis
cggugcgauagcgccgcgcaucg

SEQ ID NO: 329966 - RNA, 14 nt, Bordetella pertussis
cggugcgacugcag

SEQ ID NO: 329967 - RNA, 18 nt, Bordetella pertussis
cggugcgcaccaggccca

SEQ ID NO: 329968 - RNA, 24 nt, Bordetella pertussis
cggugcgcacgauggggccgucgc

SEQ ID NO: 329969 - RNA, 14 nt, Bordetella pertussis
cggugcgcacaugg

SEQ ID NO: 329970 - RNA, 18 nt, Bordetella pertussis
cggugcgcacauggcgga

SEQ ID NO: 329971 - RNA, 20 nt, Bordetella pertussis
cggugcgcagcggcaggcgg

SEQ ID NO: 329972 - RNA, 18 nt, Bordetella pertussis
cggugcgccgcaugcggc

SEQ ID NO: 329973 - RNA, 18 nt, Bordetella pertussis
cggugcgcgcagggcggc

SEQ ID NO: 329974 - RNA, 23 nt, Bordetella pertussis
cggugcgcgcagggcggccggca

SEQ ID NO: 329975 - RNA, 15 nt, Bordetella pertussis
cggugcgcgcggccg

SEQ ID NO: 329976 - RNA, 12 nt, Bordetella pertussis
cggugcgcggcg

SEQ ID NO: 329977 - RNA, 18 nt, Bordetella pertussis
cggugcgcggcgcccccg

SEQ ID NO: 329978 - RNA, 14 nt, Bordetella pertussis
cggugcgcgugggc

SEQ ID NO: 329979 - RNA, 16 nt, Bordetella pertussis
cggugcgcucgaagcg

SEQ ID NO: 329980 - RNA, 20 nt, Bordetella pertussis
cggugcgcgccacggcgucg

SEQ ID NO: 329981 - RNA, 15 nt, Bordetella pertussis
cggugcggaggcggc

SEQ ID NO: 329982 - RNA, 20 nt, Bordetella pertussis
cggugcggaggcggccgcgg

SEQ ID NO: 329983 - RNA, 22 nt, Bordetella pertussis
cggugcggaucaagcggcccgc

SEQ ID NO: 329984 - RNA, 13 nt, Bordetella pertussis
cggugcggccucg

SEQ ID NO: 329985 - RNA, 16 nt, Bordetella pertussis
cggugcgggccggcgc

SEQ ID NO: 329986 - RNA, 15 nt, Bordetella pertussis
cggugcgggugggcg

SEQ ID NO: 329987 - RNA, 22 nt, Bordetella pertussis
cggugcgggugggcgcgccgcg

SEQ ID NO: 329988 - RNA, 17 nt, Bordetella pertussis
cggugcguaccagccca

SEQ ID NO: 329989 - RNA, 21 nt, Bordetella pertussis
cggugcucgaggugcacgugg

SEQ ID NO: 329990 - RNA, 18 nt, Bordetella pertussis
cggugcucggccagcgcg

SEQ ID NO: 329991 - RNA, 19 nt, Bordetella pertussis
cggugcucggccagcgcgc

SEQ ID NO: 329992 - RNA, 22 nt, Bordetella pertussis
cggugcucggccagcgcgcgcc

SEQ ID NO: 329993 - RNA, 13 nt, Bordetella pertussis
cggugcucggcga

SEQ ID NO: 329994 - RNA, 15 nt, Bordetella pertussis
cggugcucggcgaac

SEQ ID NO: 329995 - RNA, 17 nt, Bordetella pertussis
cggugcuggugcucaac

SEQ ID NO: 329996 - RNA, 17 nt, Bordetella pertussis
cggugcuugaugcccag

SEQ ID NO: 329997 - RNA, 16 nt, Bordetella pertussis
cgguggacggccagca

SEQ ID NO: 329998 - RNA, 23 nt, Bordetella pertussis
cgguggauucggacgccucgccg

SEQ ID NO: 329999 - RNA, 18 nt, Bordetella pertussis
cgguggccagccaggcgg

SEQ ID NO: 330000 - RNA, 15 nt, Bordetella pertussis
cgguggccagcgccu

SEQ ID NO: 330001 - RNA, 17 nt, Bordetella pertussis
cgguggccaugcugggc

SEQ ID NO: 330002 - RNA, 19 nt, Bordetella pertussis
cgguggccaugcugggcgg

SEQ ID NO: 330003 - RNA, 19 nt, Bordetella pertussis
cgguggccauggacagcac

SEQ ID NO: 330004 - RNA, 12 nt, Bordetella pertussis
cgguggccgccg

SEQ ID NO: 330005 - RNA, 13 nt, Bordetella pertussis
cgguggccgccgc

SEQ ID NO: 330006 - RNA, 19 nt, Bordetella pertussis
cgguggccgcuucggcggc

SEQ ID NO: 330007 - RNA, 16 nt, Bordetella pertussis
cgguggcgaaggccgc

SEQ ID NO: 330008 - RNA, 17 nt, Bordetella pertussis
cgguggcgaaggccgcc

SEQ ID NO: 330009 - RNA, 18 nt, Bordetella pertussis
cgguggcgaaggccgccg

SEQ ID NO: 330010 - RNA, 19 nt, Bordetella pertussis
cgguggcgaaggccgccgc

SEQ ID NO: 330011 - RNA, 20 nt, Bordetella pertussis
cgguggccuuguacaggcac

SEQ ID NO: 330012 - RNA, 17 nt, Bordetella pertussis
cgguggcgcccggcggc

SEQ ID NO: 330013 - RNA, 16 nt, Bordetella pertussis
cgguggcgggccagcu

SEQ ID NO: 330014 - RNA, 17 nt, Bordetella pertussis
cgguggcguguccgccg

SEQ ID NO: 330015 - RNA, 19 nt, Bordetella pertussis
cgguggcguuggccugcca

SEQ ID NO: 330016 - RNA, 14 nt, Bordetella pertussis
cgguggcuuggcgc

SEQ ID NO: 330017 - RNA, 20 nt, Bordetella pertussis
cggugggauaaggcgugccg

SEQ ID NO: 330018 - RNA, 14 nt, Bordetella pertussis
cggugggcagcagc

SEQ ID NO: 330019 - RNA, 18 nt, Bordetella pertussis
cggugggucucggcgucg

SEQ ID NO: 330020 - RNA, 13 nt, Bordetella pertussis
cggugguggccaa

SEQ ID NO: 330021 - RNA, 17 nt, Bordetella pertussis
cgguggugcugcugggc

SEQ ID NO: 330022 - RNA, 19 nt, Bordetella pertussis
cgguggugcugcugggcgc

SEQ ID NO: 330023 - RNA, 21 nt, Bordetella pertussis
cgguggugcugcugggcgcca

SEQ ID NO: 330024 - RNA, 14 nt, Bordetella pertussis
cgguggugcugggc

SEQ ID NO: 330025 - RNA, 17 nt, Bordetella pertussis
cgguggugcugggcggc

SEQ ID NO: 330026 - RNA, 17 nt, Bordetella pertussis
cgguggugucgaacagc

SEQ ID NO: 330027 - RNA, 18 nt, Bordetella pertussis
cgguggugucggcggcca

SEQ ID NO: 330028 - RNA, 15 nt, Bordetella pertussis
cggugucgccgccgc

SEQ ID NO: 330029 - RNA, 19 nt, Bordetella pertussis
cggugucgccgccgcgccg

SEQ ID NO: 330030 - RNA, 14 nt, Bordetella pertussis
cggugucgaugggc

SEQ ID NO: 330031 - RNA, 23 nt, Bordetella pertussis
cgguuccugcaaggccggcggca

SEQ ID NO: 330032 - RNA, 16 nt, Bordetella pertussis
cgguucgaugaccugg

SEQ ID NO: 330033 - RNA, 21 nt, Bordetella pertussis
cgguucgauguaguagccgcc

SEQ ID NO: 330034 - RNA, 22 nt, Bordetella pertussis
cgguucgcccaccaccagcggc

SEQ ID NO: 330035 - RNA, 15 nt, Bordetella pertussis
cgguucggcgcggcg

SEQ ID NO: 330036 - RNA, 15 nt, Bordetella pertussis
cgguucggucgacga

SEQ ID NO: 330037 - RNA, 19 nt, Bordetella pertussis
cgguucguccucgucggcc

SEQ ID NO: 330038 - RNA, 23 nt, Bordetella pertussis
cgguucguccucgucggccaugc

SEQ ID NO: 330039 - RNA, 13 nt, Bordetella pertussis
cgguucugcggcg

SEQ ID NO: 330040 - RNA, 14 nt, Bordetella pertussis
cgguuuccagguug

SEQ ID NO: 330041 - RNA, 14 nt, Bordetella pertussis
cgguuucggccugc

SEQ ID NO: 330042 - RNA, 21 nt, Bordetella pertussis
cgguuucggccugcaggccca

SEQ ID NO: 330043 - RNA, 13 nt, Bordetella pertussis
cgguuucggugcg

SEQ ID NO: 330044 - RNA, 15 nt, Bordetella pertussis
cgguuucucagcgcg

SEQ ID NO: 330045 - RNA, 23 nt, Bordetella pertussis
cgguuuuucuuuggccgcgcgcc

SEQ ID NO: 330046 - RNA, 17 nt, Bordetella pertussis
cgguuuuugaggacccc

SEQ ID NO: 330047 - RNA, 19 nt, Bordetella pertussis
cgguuuuuucuugccggcc

SEQ ID NO: 330048 - RNA, 20 nt, Bordetella pertussis
cgguuuuuucuugccggccc

SEQ ID NO: 330049 - RNA, 15 nt, Bordetella pertussis
cguaaacaucgcgca

SEQ ID NO: 330050 - RNA, 15 nt, Bordetella pertussis
cguaaucgagcuggc

SEQ ID NO: 330051 - RNA, 15 nt, Bordetella pertussis
cguacaaccgcgccg

SEQ ID NO: 330052 - RNA, 15 nt, Bordetella pertussis
cguacagccgggugu

SEQ ID NO: 330053 - RNA, 12 nt, Bordetella pertussis
cguacaggccgu

SEQ ID NO: 330054 - RNA, 22 nt, Bordetella pertussis
cguacaggccguuguccuggcg

SEQ ID NO: 330055 - RNA, 14 nt, Bordetella pertussis
cguacagggccgcg

SEQ ID NO: 330056 - RNA, 17 nt, Bordetella pertussis
cguaccaggcagccggc

SEQ ID NO: 330057 - RNA, 18 nt, Bordetella pertussis
cguaccaggcagccggcc

SEQ ID NO: 330058 - RNA, 21 nt, Bordetella pertussis
cguaccaggcagccggccccg

SEQ ID NO: 330059 - RNA, 23 nt, Bordetella pertussis
cguaccaggcagccggccccgca

SEQ ID NO: 330060 - RNA, 13 nt, Bordetella pertussis
cguaccaggugcg

SEQ ID NO: 330061 - RNA, 12 nt, Bordetella pertussis
cguacccgcgcc

SEQ ID NO: 330062 - RNA, 16 nt, Bordetella pertussis
cguacccgcgccgucg

SEQ ID NO: 330063 - RNA, 15 nt, Bordetella pertussis
cguacuggcgcggcg

SEQ ID NO: 330064 - RNA, 17 nt, Bordetella pertussis
cguacuggcgcggcggc

SEQ ID NO: 330065 - RNA, 19 nt, Bordetella pertussis
cguacuggcgcggcggcca

SEQ ID NO: 330066 - RNA, 20 nt, Bordetella pertussis
cguacuggcgcggcggccag

SEQ ID NO: 330067 - RNA, 21 nt, Bordetella pertussis
cguacuggcgcggcggccagg

SEQ ID NO: 330068 - RNA, 16 nt, Bordetella pertussis
cguacuucucgucgcg

SEQ ID NO: 330069 - RNA, 23 nt, Bordetella pertussis
cguacuugaucugcauguacucg

SEQ ID NO: 330070 - RNA, 17 nt, Bordetella pertussis
cguacuuggcgauggcc

SEQ ID NO: 330071 - RNA, 16 nt, Bordetella pertussis
cguagaccgccgcgcc

SEQ ID NO: 330072 - RNA, 19 nt, Bordetella pertussis
cguagaccgccgcgcccag

SEQ ID NO: 330073 - RNA, 21 nt, Bordetella pertussis
cguagaccgccgcgcccagca

SEQ ID NO: 330074 - RNA, 17 nt, Bordetella pertussis
cguagcccagguccagc

SEQ ID NO: 330075 - RNA, 17 nt, Bordetella pertussis
cguagcccucgcccagg

SEQ ID NO: 330076 - RNA, 20 nt, Bordetella pertussis
cguagcccuuguggccgccg

SEQ ID NO: 330077 - RNA, 14 nt, Bordetella pertussis
cguagccgcugccg

SEQ ID NO: 330078 - RNA, 18 nt, Bordetella pertussis
cguaggacagccccagca

SEQ ID NO: 330079 - RNA, 11 nt, Bordetella pertussis
cguaggcgccg

SEQ ID NO: 330080 - RNA, 17 nt, Bordetella pertussis
cguaggcgccggccuug

SEQ ID NO: 330081 - RNA, 20 nt, Bordetella pertussis
cguaggcgccggccuugccg

SEQ ID NO: 330082 - RNA, 17 nt, Bordetella pertussis
cguaguccagcagcagc

SEQ ID NO: 330083 - RNA, 20 nt, Bordetella pertussis
cguaguccagcagcagcgcc

SEQ ID NO: 330084 - RNA, 22 nt, Bordetella pertussis
cguaguccagcagcagcgccgc

SEQ ID NO: 330085 - RNA, 18 nt, Bordetella pertussis
cguagucgcgccagcggc

SEQ ID NO: 330086 - RNA, 23 nt, Bordetella pertussis
cguagucgcgccagcggccgucg

SEQ ID NO: 330087 - RNA, 16 nt, Bordetella pertussis
cguagucgagccaggu

SEQ ID NO: 330088 - RNA, 18 nt, Bordetella pertussis
cguagucgagccaggugg

SEQ ID NO: 330089 - RNA, 14 nt, Bordetella pertussis
cguagucggcgccc

SEQ ID NO: 330090 - RNA, 20 nt, Bordetella pertussis
cguagucgcacgcggcuucg

SEQ ID NO: 330091 - RNA, 20 nt, Bordetella pertussis
cguagucguugccggccagc

SEQ ID NO: 330092 - RNA, 15 nt, Bordetella pertussis
cguagugcgcgccgc

SEQ ID NO: 330093 - RNA, 15 nt, Bordetella pertussis
cguaguugucggcgc

SEQ ID NO: 330094 - RNA, 17 nt, Bordetella pertussis
cguaguugucggcgcag

SEQ ID NO: 330095 - RNA, 20 nt, Bordetella pertussis
cguaucaacuuccagcgccc

SEQ ID NO: 330096 - RNA, 16 nt, Bordetella pertussis
cguauccagcaucacc

SEQ ID NO: 330097 - RNA, 18 nt, Bordetella pertussis
cguauccucgaucagcga

SEQ ID NO: 330098 - RNA, 15 nt, Bordetella pertussis
cguaucgaauucgca

SEQ ID NO: 330099 - RNA, 17 nt, Bordetella pertussis
cguaucgccgccgccgg

SEQ ID NO: 330100 - RNA, 19 nt, Bordetella pertussis
cguaucgccgccgccggca

SEQ ID NO: 330101 - RNA, 13 nt, Bordetella pertussis
cguaucgcggccg

SEQ ID NO: 330102 - RNA, 19 nt, Bordetella pertussis
cguaucgcguggcgcgcca

SEQ ID NO: 330103 - RNA, 21 nt, Bordetella pertussis
cguaucgcguggcgcgccagc

SEQ ID NO: 330104 - RNA, 15 nt, Bordetella pertussis
cguaucgauagccga

SEQ ID NO: 330105 - RNA, 20 nt, Bordetella pertussis
cgucaagccagcggcgcggc

SEQ ID NO: 330106 - RNA, 17 nt, Bordetella pertussis
cgucaagcgucgauggc

SEQ ID NO: 330107 - RNA, 18 nt, Bordetella pertussis
cgucaagcgucgauggcg

SEQ ID NO: 330108 - RNA, 21 nt, Bordetella pertussis
cgucaagcguucauggcguau

SEQ ID NO: 330109 - RNA, 21 nt, Bordetella pertussis
cgucaaggggcuguaccuggc

SEQ ID NO: 330110 - RNA, 19 nt, Bordetella pertussis
cgucaauccgccgccagca

SEQ ID NO: 330111 - RNA, 17 nt, Bordetella pertussis
cgucaaugccagucgcc

SEQ ID NO: 330112 - RNA, 19 nt, Bordetella pertussis
cgucaccuugggaucgucc

SEQ ID NO: 330113 - RNA, 23 nt, Bordetella pertussis
cgucaccuugggaucgucccagg

SEQ ID NO: 330114 - RNA, 20 nt, Bordetella pertussis
cgucacgaaagcgcccaggc

SEQ ID NO: 330115 - RNA, 22 nt, Bordetella pertussis
cgucacgaaagcgcccaggccg

SEQ ID NO: 330116 - RNA, 16 nt, Bordetella pertussis
cgucacgauuucggcc

SEQ ID NO: 330117 - RNA, 23 nt, Bordetella pertussis
cgucagcgcccaaucgggcagca

SEQ ID NO: 330118 - RNA, 17 nt, Bordetella pertussis
cgucagcucgaucaggc

SEQ ID NO: 330119 - RNA, 22 nt, Bordetella pertussis
cgucagcugggcaugcacgaug

SEQ ID NO: 330120 - RNA, 18 nt, Bordetella pertussis
cgucaggaucaggccggc

SEQ ID NO: 330121 - RNA, 17 nt, Bordetella pertussis
cgucaggaagcccgagu

SEQ ID NO: 330122 - RNA, 17 nt, Bordetella pertussis
cgucaguccguggcgcg

SEQ ID NO: 330123 - RNA, 21 nt, Bordetella pertussis
cgucaguccguggcgcggcca

SEQ ID NO: 330124 - RNA, 15 nt, Bordetella pertussis
cgucaguugaagacg

SEQ ID NO: 330125 - RNA, 24 nt, Bordetella pertussis
cgucaguugaagacgccggucgac

SEQ ID NO: 330126 - RNA, 18 nt, Bordetella pertussis
cgucaguugggcgcgccc

SEQ ID NO: 330127 - RNA, 21 nt, Bordetella pertussis
cgucaguugggcgcgcccagc

SEQ ID NO: 330128 - RNA, 15 nt, Bordetella pertussis
cgucauacacggcgc

SEQ ID NO: 330129 - RNA, 16 nt, Bordetella pertussis
cgucauacgacgcggc

SEQ ID NO: 330130 - RNA, 17 nt, Bordetella pertussis
cgucaucaccaagggcg

SEQ ID NO: 330131 - RNA, 21 nt, Bordetella pertussis
cguccaucuggaccgcgcgcg

SEQ ID NO: 330132 - RNA, 14 nt, Bordetella pertussis
cguccaugccggcc

SEQ ID NO: 330133 - RNA, 15 nt, Bordetella pertussis
cguccaugccggcca

SEQ ID NO: 330134 - RNA, 17 nt, Bordetella pertussis
cguccaugccggccaug

SEQ ID NO: 330135 - RNA, 18 nt, Bordetella pertussis
cguccauggcgugccagg

SEQ ID NO: 330136 - RNA, 18 nt, Bordetella pertussis
cguccauggugggcaggu

SEQ ID NO: 330137 - RNA, 15 nt, Bordetella pertussis
cgucccagcgcacgc

SEQ ID NO: 330138 - RNA, 12 nt, Bordetella pertussis
cgucccaggcca

SEQ ID NO: 330139 - RNA, 17 nt, Bordetella pertussis
cgucccagucgccgcgc

SEQ ID NO: 330140 - RNA, 20 nt, Bordetella pertussis
cgucccagucgccgcgcccg

SEQ ID NO: 330141 - RNA, 18 nt, Bordetella pertussis
cguccgcucaugccggca

SEQ ID NO: 330142 - RNA, 12 nt, Bordetella pertussis
cguccggcgccc

SEQ ID NO: 330143 - RNA, 13 nt, Bordetella pertussis
cguccggcgggcc

SEQ ID NO: 330144 - RNA, 14 nt, Bordetella pertussis
cguccggcgggccg

SEQ ID NO: 330145 - RNA, 13 nt, Bordetella pertussis
cguccgggccggu

SEQ ID NO: 330146 - RNA, 14 nt, Bordetella pertussis
cguccucgaccagg

SEQ ID NO: 330147 - RNA, 16 nt, Bordetella pertussis
cguccucgaccaggau

SEQ ID NO: 330148 - RNA, 14 nt, Bordetella pertussis
cguccucggccacg

SEQ ID NO: 330149 - RNA, 13 nt, Bordetella pertussis
cguccucggccag

SEQ ID NO: 330150 - RNA, 16 nt, Bordetella pertussis
cguccucggccagccg

SEQ ID NO: 330151 - RNA, 13 nt, Bordetella pertussis
cguccucggccug

SEQ ID NO: 330152 - RNA, 14 nt, Bordetella pertussis
cguccucggccugg

SEQ ID NO: 330153 - RNA, 17 nt, Bordetella pertussis
cguccucggccuggccc

SEQ ID NO: 330154 - RNA, 22 nt, Bordetella pertussis
cguccucggccuggccccaggc

SEQ ID NO: 330155 - RNA, 17 nt, Bordetella pertussis
cguccucgucggccaug

SEQ ID NO: 330156 - RNA, 23 nt, Bordetella pertussis
cguccugaucgaggagcugcugu

SEQ ID NO: 330157 - RNA, 20 nt, Bordetella pertussis
cguccugccauugcgcggcc

SEQ ID NO: 330158 - RNA, 22 nt, Bordetella pertussis
cguccugccauugcgcggccug

SEQ ID NO: 330159 - RNA, 14 nt, Bordetella pertussis
cguccugcagcagg

SEQ ID NO: 330160 - RNA, 15 nt, Bordetella pertussis
cguccugcagcaggg

SEQ ID NO: 330161 - RNA, 14 nt, Bordetella pertussis
cguccugcaggaag

SEQ ID NO: 330162 - RNA, 19 nt, Bordetella pertussis
cguccugcaggaaggccgc

SEQ ID NO: 330163 - RNA, 15 nt, Bordetella pertussis
cguccugcaggcggc

SEQ ID NO: 330164 - RNA, 14 nt, Bordetella pertussis
cguccugcggcggc

SEQ ID NO: 330165 - RNA, 17 nt, Bordetella pertussis
cguccugcugcggcacg

SEQ ID NO: 330166 - RNA, 15 nt, Bordetella pertussis
cguccuggcgcgaga

SEQ ID NO: 330167 - RNA, 19 nt, Bordetella pertussis
cguccugggccgagcgcgc

SEQ ID NO: 330168 - RNA, 20 nt, Bordetella pertussis
cguccugggccgagcgcgcc

SEQ ID NO: 330169 - RNA, 21 nt, Bordetella pertussis
cguccugggccgagcgcgcca

SEQ ID NO: 330170 - RNA, 22 nt, Bordetella pertussis
cguccugggccgagcgcgccag

SEQ ID NO: 330171 - RNA, 14 nt, Bordetella pertussis
cguccuggccacug

SEQ ID NO: 330172 - RNA, 14 nt, Bordetella pertussis
cguccuggcgaccg

SEQ ID NO: 330173 - RNA, 19 nt, Bordetella pertussis
cguccugguggaccugccg

SEQ ID NO: 330174 - RNA, 17 nt, Bordetella pertussis
cguccuucgucggcggg

SEQ ID NO: 330175 - RNA, 15 nt, Bordetella pertussis
cguccuugagcgcca

SEQ ID NO: 330176 - RNA, 22 nt, Bordetella pertussis
cguccuugaggaacuggacggc

SEQ ID NO: 330177 - RNA, 14 nt, Bordetella pertussis
cguccuugagggcg

SEQ ID NO: 330178 - RNA, 14 nt, Bordetella pertussis
cguccuuggcgccg

SEQ ID NO: 330179 - RNA, 14 nt, Bordetella pertussis
cguccuuggcggcc

SEQ ID NO: 330180 - RNA, 14 nt, Bordetella pertussis
cguccuugugccag

SEQ ID NO: 330181 - RNA, 15 nt, Bordetella pertussis
cgucgaaacgcugcg

SEQ ID NO: 330182 - RNA, 18 nt, Bordetella pertussis
cgucgaaggccgcaacca

SEQ ID NO: 330183 - RNA, 16 nt, Bordetella pertussis
cgucgaaggccgccgg

SEQ ID NO: 330184 - RNA, 19 nt, Bordetella pertussis
cgucgaaggccgccggacg

SEQ ID NO: 330185 - RNA, 21 nt, Bordetella pertussis
cgucgaaggcgcgcuccagca

SEQ ID NO: 330186 - RNA, 13 nt, Bordetella pertussis
cgucgaaggcggc

SEQ ID NO: 330187 - RNA, 17 nt, Bordetella pertussis
cgucgaagcugccgugg

SEQ ID NO: 330188 - RNA, 15 nt, Bordetella pertussis
cgucgaccgccucga

SEQ ID NO: 330189 - RNA, 19 nt, Bordetella pertussis
cgucgaccgcgggcgcgcg

SEQ ID NO: 330190 - RNA, 14 nt, Bordetella pertussis
cgucgaccgacagc

SEQ ID NO: 330191 - RNA, 15 nt, Bordetella pertussis
cgucgaccgacagca

SEQ ID NO: 330192 - RNA, 15 nt, Bordetella pertussis
cgucgaccucgagca

SEQ ID NO: 330193 - RNA, 22 nt, Bordetella pertussis
cgucgaccuggaucacgugcca

SEQ ID NO: 330194 - RNA, 16 nt, Bordetella pertussis
cgucgacggugcgcgc

SEQ ID NO: 330195 - RNA, 14 nt, Bordetella pertussis
cgucgacguccugg

SEQ ID NO: 330196 - RNA, 17 nt, Bordetella pertussis
cgucgacguccuggugg

SEQ ID NO: 330197 - RNA, 18 nt, Bordetella pertussis
cgucgacgucggugacgg

SEQ ID NO: 330198 - RNA, 21 nt, Bordetella pertussis
cgucgacgucggugacggcgu

SEQ ID NO: 330199 - RNA, 20 nt, Bordetella pertussis
cgucgagaaugacgguggug

SEQ ID NO: 330200 - RNA, 14 nt, Bordetella pertussis
cgucgagccgggcg

SEQ ID NO: 330201 - RNA, 19 nt, Bordetella pertussis
cgucgagccgggcgccgau

SEQ ID NO: 330202 - RNA, 14 nt, Bordetella pertussis
cgucgagccggucc

SEQ ID NO: 330203 - RNA, 17 nt, Bordetella pertussis
cgucgagccgggccacg

SEQ ID NO: 330204 - RNA, 19 nt, Bordetella pertussis
cgucgagccgggccacgcg

SEQ ID NO: 330205 - RNA, 15 nt, Bordetella pertussis
cgucgagcgcggcca

SEQ ID NO: 330206 - RNA, 18 nt, Bordetella pertussis
cgucgagcgcggccaggc

SEQ ID NO: 330207 - RNA, 13 nt, Bordetella pertussis
cgucgaucggcgc

SEQ ID NO: 330208 - RNA, 17 nt, Bordetella pertussis
cgucgaucggcgcgccc

SEQ ID NO: 330209 - RNA, 23 nt, Bordetella pertussis
cgucgaucggcgcgcccgccacg

SEQ ID NO: 330210 - RNA, 14 nt, Bordetella pertussis
cgucgaugaccagc

SEQ ID NO: 330211 - RNA, 17 nt, Bordetella pertussis
cgucgaugaccagcgcc

SEQ ID NO: 330212 - RNA, 20 nt, Bordetella pertussis
cgucgaugaccagcgccggc

SEQ ID NO: 330213 - RNA, 22 nt, Bordetella pertussis
cgucgaugaccagcgccggcgc

SEQ ID NO: 330214 - RNA, 22 nt, Bordetella pertussis
cgucgaugaaauauugggcugg

SEQ ID NO: 330215 - RNA, 13 nt, Bordetella pertussis
cgucgaugccgac

SEQ ID NO: 330216 - RNA, 18 nt, Bordetella pertussis
cgucgaugccgaccaggc

SEQ ID NO: 330217 - RNA, 14 nt, Bordetella pertussis
cgucgaugaugacg

SEQ ID NO: 330218 - RNA, 21 nt, Bordetella pertussis
cgucgcacuggguggccagcg

SEQ ID NO: 330219 - RNA, 23 nt, Bordetella pertussis
cgucgcacuggguggccagcgcc

SEQ ID NO: 330220 - RNA, 12 nt, Bordetella pertussis
cgucgccaccgc

SEQ ID NO: 330221 - RNA, 15 nt, Bordetella pertussis
cgucgccaccgccca

SEQ ID NO: 330222 - RNA, 23 nt, Bordetella pertussis
cgucgccaccucgaucaccaccg

SEQ ID NO: 330223 - RNA, 13 nt, Bordetella pertussis
cgucgccagcgac

SEQ ID NO: 330224 - RNA, 14 nt, Bordetella pertussis
cgucgccagcgacg

SEQ ID NO: 330225 - RNA, 23 nt, Bordetella pertussis
cgucgccgaucggcuugccgcgc

SEQ ID NO: 330226 - RNA, 14 nt, Bordetella pertussis
cgucgccgcccacg

SEQ ID NO: 330227 - RNA, 13 nt, Bordetella pertussis
cgucgccgcccau

SEQ ID NO: 330228 - RNA, 12 nt, Bordetella pertussis
cgucgccgcccu

SEQ ID NO: 330229 - RNA, 23 nt, Bordetella pertussis
cgucgccucccauugcgcggcca

SEQ ID NO: 330230 - RNA, 20 nt, Bordetella pertussis
cgucgccugcccgcacgggc

SEQ ID NO: 330231 - RNA, 21 nt, Bordetella pertussis
cgucgccugcccgcacgggcc

SEQ ID NO: 330232 - RNA, 20 nt, Bordetella pertussis
cgucgccuggucgacgccgg

SEQ ID NO: 330233 - RNA, 21 nt, Bordetella pertussis
cgucgccuggucgacgccggc

SEQ ID NO: 330234 - RNA, 15 nt, Bordetella pertussis
cgucgccuucggcgg

SEQ ID NO: 330235 - RNA, 16 nt, Bordetella pertussis
cgucgccuucggcggc

SEQ ID NO: 330236 - RNA, 14 nt, Bordetella pertussis
cgucgcgcucggac

SEQ ID NO: 330237 - RNA, 12 nt, Bordetella pertussis
cgucgcgcugca

SEQ ID NO: 330238 - RNA, 22 nt, Bordetella pertussis
cgucgcgcugcaauugcgcggc

SEQ ID NO: 330239 - RNA, 18 nt, Bordetella pertussis
cgucgcgcugcaggcguc

SEQ ID NO: 330240 - RNA, 21 nt, Bordetella pertussis
cgucgcgcuguuccagccagu

SEQ ID NO: 330241 - RNA, 18 nt, Bordetella pertussis
cgucgcucugcgcggcau

SEQ ID NO: 330242 - RNA, 18 nt, Bordetella pertussis
cgucgcugccgcgcgauc

SEQ ID NO: 330243 - RNA, 13 nt, Bordetella pertussis
cgucgcugcggcc

SEQ ID NO: 330244 - RNA, 16 nt, Bordetella pertussis
cgucgcugcggccggu

SEQ ID NO: 330245 - RNA, 17 nt, Bordetella pertussis
cgucgcugcggccggug

SEQ ID NO: 330246 - RNA, 16 nt, Bordetella pertussis
cgucgcugcuggcggc

SEQ ID NO: 330247 - RNA, 14 nt, Bordetella pertussis
cgucgcugcgcggc

SEQ ID NO: 330248 - RNA, 13 nt, Bordetella pertussis
cgucgcuggcgcg

SEQ ID NO: 330249 - RNA, 15 nt, Bordetella pertussis
cgucgcugucggcga

SEQ ID NO: 330250 - RNA, 17 nt, Bordetella pertussis
cgucggacaacgccagg

SEQ ID NO: 330251 - RNA, 18 nt, Bordetella pertussis
cgucggacaacgccagga

SEQ ID NO: 330252 - RNA, 16 nt, Bordetella pertussis
cgucggacgcgcgccg

SEQ ID NO: 330253 - RNA, 17 nt, Bordetella pertussis
cgucggacgcgcgccgc

SEQ ID NO: 330254 - RNA, 16 nt, Bordetella pertussis
cgucggacguagccga

SEQ ID NO: 330255 - RNA, 21 nt, Bordetella pertussis
cgucggcaaccgucgccagcg

SEQ ID NO: 330256 - RNA, 21 nt, Bordetella pertussis
cgucggcaccuucgcgcagcg

SEQ ID NO: 330257 - RNA, 15 nt, Bordetella pertussis
cgucggccaaggccg

SEQ ID NO: 330258 - RNA, 16 nt, Bordetella pertussis
cgucggccaaggccgg

SEQ ID NO: 330259 - RNA, 19 nt, Bordetella pertussis
cgucggccaaggccggcgc

SEQ ID NO: 330260 - RNA, 13 nt, Bordetella pertussis
cgucggccacgcc

SEQ ID NO: 330261 - RNA, 12 nt, Bordetella pertussis
cgucggccacgu

SEQ ID NO: 330262 - RNA, 14 nt, Bordetella pertussis
cgucggccagcgcc

SEQ ID NO: 330263 - RNA, 15 nt, Bordetella pertussis
cgucggccagcgccg

SEQ ID NO: 330264 - RNA, 16 nt, Bordetella pertussis
cgucggccagcgccgc

SEQ ID NO: 330265 - RNA, 17 nt, Bordetella pertussis
cgucggccagcgccgcg

SEQ ID NO: 330266 - RNA, 18 nt, Bordetella pertussis
cgucggccagcuugccgc

SEQ ID NO: 330267 - RNA, 11 nt, Bordetella pertussis
cgucggccagg

SEQ ID NO: 330268 - RNA, 13 nt, Bordetella pertussis
cgucggccaggcc

SEQ ID NO: 330269 - RNA, 15 nt, Bordetella pertussis
cgucggccaggcgcc

SEQ ID NO: 330270 - RNA, 20 nt, Bordetella pertussis
cgucggccaggcgccagaug

SEQ ID NO: 330271 - RNA, 14 nt, Bordetella pertussis
cgucggccaggggc

SEQ ID NO: 330272 - RNA, 16 nt, Bordetella pertussis
cgucggccaugcgcgc

SEQ ID NO: 330273 - RNA, 21 nt, Bordetella pertussis
cgucggccaugcgcgccagca

SEQ ID NO: 330274 - RNA, 23 nt, Bordetella pertussis
cgucggccaugcgcgccagcaug

SEQ ID NO: 330275 - RNA, 15 nt, Bordetella pertussis
cgucggccgccguga

SEQ ID NO: 330276 - RNA, 15 nt, Bordetella pertussis
cgucggccgcgucga

SEQ ID NO: 330277 - RNA, 21 nt, Bordetella pertussis
cgucggccucgcgcagggcgg

SEQ ID NO: 330278 - RNA, 13 nt, Bordetella pertussis
cgucggccgcgcc

SEQ ID NO: 330279 - RNA, 15 nt, Bordetella pertussis
cgucggccgcgccca

SEQ ID NO: 330280 - RNA, 20 nt, Bordetella pertussis
cgucggccgucugggcguga

SEQ ID NO: 330281 - RNA, 19 nt, Bordetella pertussis
cgucggcgaagccuugcgc

SEQ ID NO: 330282 - RNA, 22 nt, Bordetella pertussis
cgucggcgaagccuugcgcggc

SEQ ID NO: 330283 - RNA, 22 nt, Bordetella pertussis
cgucggcgaucaccugcguggc

SEQ ID NO: 330284 - RNA, 15 nt, Bordetella pertussis
cgucggcgauggccc

SEQ ID NO: 330285 - RNA, 18 nt, Bordetella pertussis
cgucggcgauggcccggu

SEQ ID NO: 330286 - RNA, 16 nt, Bordetella pertussis
cgucggcgccaugcug

SEQ ID NO: 330287 - RNA, 23 nt, Bordetella pertussis
cgucggcgccaugcuggccgccg

SEQ ID NO: 330288 - RNA, 15 nt, Bordetella pertussis
cgucggcgcccggcg

SEQ ID NO: 330289 - RNA, 16 nt, Bordetella pertussis
cgucggcgcccggcgc

SEQ ID NO: 330290 - RNA, 17 nt, Bordetella pertussis
cgucggcgcccggcgcc

SEQ ID NO: 330291 - RNA, 13 nt, Bordetella pertussis
cgucggcgccgau

SEQ ID NO: 330292 - RNA, 19 nt, Bordetella pertussis
cgucggcgcgcgccaggcc

SEQ ID NO: 330293 - RNA, 14 nt, Bordetella pertussis
cgucggcgcgcgcg

SEQ ID NO: 330294 - RNA, 14 nt, Bordetella pertussis
cgucggcgcggucg

SEQ ID NO: 330295 - RNA, 16 nt, Bordetella pertussis
cgucggcgcugcagcg

SEQ ID NO: 330296 - RNA, 18 nt, Bordetella pertussis
cgucggcgcugcagcgca

SEQ ID NO: 330297 - RNA, 20 nt, Bordetella pertussis
cgucggcgcugcagcgcagg

SEQ ID NO: 330298 - RNA, 13 nt, Bordetella pertussis
cgucggcgcuggc

SEQ ID NO: 330299 - RNA, 14 nt, Bordetella pertussis
cgucggcggcaagc

SEQ ID NO: 330300 - RNA, 15 nt, Bordetella pertussis
cgucggcggcaagca

SEQ ID NO: 330301 - RNA, 12 nt, Bordetella pertussis
cgucggcgcucu

SEQ ID NO: 330302 - RNA, 17 nt, Bordetella pertussis
cgucggcgggacgcagg

SEQ ID NO: 330303 - RNA, 15 nt, Bordetella pertussis
cgucggcggccgccu

SEQ ID NO: 330304 - RNA, 15 nt, Bordetella pertussis
cgucgggaccgaaca

SEQ ID NO: 330305 - RNA, 17 nt, Bordetella pertussis
cgucgggcagcaggcgc

SEQ ID NO: 330306 - RNA, 16 nt, Bordetella pertussis
cgucgggcagcgcggc

SEQ ID NO: 330307 - RNA, 17 nt, Bordetella pertussis
cgucgggcagcgcggcg

SEQ ID NO: 330308 - RNA, 21 nt, Bordetella pertussis
cgucgggcaggauggccaugc

SEQ ID NO: 330309 - RNA, 18 nt, Bordetella pertussis
cgucgggcagggcgacgu

SEQ ID NO: 330310 - RNA, 16 nt, Bordetella pertussis
cgucgggcaggucggc

SEQ ID NO: 330311 - RNA, 21 nt, Bordetella pertussis
cgucgggcaguugcuggcggc

SEQ ID NO: 330312 - RNA, 19 nt, Bordetella pertussis
cgucgggcgccgcaacgcc

SEQ ID NO: 330313 - RNA, 23 nt, Bordetella pertussis
cgucggucaugcccaugccgcca

SEQ ID NO: 330314 - RNA, 20 nt, Bordetella pertussis
cgucggucgcuuccagcgca

SEQ ID NO: 330315 - RNA, 12 nt, Bordetella pertussis
cgucgguggcca

SEQ ID NO: 330316 - RNA, 21 nt, Bordetella pertussis
cgucggugggaaucggcaccu

SEQ ID NO: 330317 - RNA, 20 nt, Bordetella pertussis
cgucgguggugaccacggcg

SEQ ID NO: 330318 - RNA, 14 nt, Bordetella pertussis
cgucgucaucgcca

SEQ ID NO: 330319 - RNA, 13 nt, Bordetella pertussis
cgucguccacgcc

SEQ ID NO: 330320 - RNA, 23 nt, Bordetella pertussis
cgucguccacgcccggugccugc

SEQ ID NO: 330321 - RNA, 12 nt, Bordetella pertussis
cgucguccagcg

SEQ ID NO: 330322 - RNA, 14 nt, Bordetella pertussis
cgucguccagcguc

SEQ ID NO: 330323 - RNA, 15 nt, Bordetella pertussis
cgucguccagcguca

SEQ ID NO: 330324 - RNA, 18 nt, Bordetella pertussis
cgucguccagcguggcgc

SEQ ID NO: 330325 - RNA, 15 nt, Bordetella pertussis
cgucguccaggcgca

SEQ ID NO: 330326 - RNA, 15 nt, Bordetella pertussis
cgucguccguccugg

SEQ ID NO: 330327 - RNA, 23 nt, Bordetella pertussis
cgucguccguccuggccacugcc

SEQ ID NO: 330328 - RNA, 18 nt, Bordetella pertussis
cgucguccguggccggcg

SEQ ID NO: 330329 - RNA, 20 nt, Bordetella pertussis
cgucguccucggcacggcca

SEQ ID NO: 330330 - RNA, 16 nt, Bordetella pertussis
cgucguggggcgcggc

SEQ ID NO: 330331 - RNA, 22 nt, Bordetella pertussis
cgucguugacggggacgccggc

SEQ ID NO: 330332 - RNA, 13 nt, Bordetella pertussis
cgucuccagcgcc

SEQ ID NO: 330333 - RNA, 16 nt, Bordetella pertussis
cgucuccagcgccggc

SEQ ID NO: 330334 - RNA, 17 nt, Bordetella pertussis
cgucuccagcgccggca

SEQ ID NO: 330335 - RNA, 17 nt, Bordetella pertussis
cgucucgaacgccgcgu

SEQ ID NO: 330336 - RNA, 12 nt, Bordetella pertussis
cgucugagcgcc

SEQ ID NO: 330337 - RNA, 14 nt, Bordetella pertussis
cgucugagcgccgg

SEQ ID NO: 330338 - RNA, 13 nt, Bordetella pertussis
cgucugcccgcgg

SEQ ID NO: 330339 - RNA, 20 nt, Bordetella pertussis
cgucugcccgcgguccagca

SEQ ID NO: 330340 - RNA, 22 nt, Bordetella pertussis
cgucugcgcaucgaugcggccu

SEQ ID NO: 330341 - RNA, 18 nt, Bordetella pertussis
cgucugcgccgccgcgug

SEQ ID NO: 330342 - RNA, 20 nt, Bordetella pertussis
cgucugcuacaccgugcugg

SEQ ID NO: 330343 - RNA, 23 nt, Bordetella pertussis
cgucugcuacaccgugcuggccg

SEQ ID NO: 330344 - RNA, 13 nt, Bordetella pertussis
cgucugcucgccg

SEQ ID NO: 330345 - RNA, 17 nt, Bordetella pertussis
cgucuggagcggccugg

SEQ ID NO: 330346 - RNA, 15 nt, Bordetella pertussis
cgucuggcacgcuug

SEQ ID NO: 330347 - RNA, 22 nt, Bordetella pertussis
cgucuugaggauaucggccagg

SEQ ID NO: 330348 - RNA, 21 nt, Bordetella pertussis
cgucuugcccgccagcgcggc

SEQ ID NO: 330349 - RNA, 18 nt, Bordetella pertussis
cgucuugcgcccgcaucg

SEQ ID NO: 330350 - RNA, 21 nt, Bordetella pertussis
cgucuuggcgggcaccaugcg

SEQ ID NO: 330351 - RNA, 14 nt, Bordetella pertussis
cgucuuggccguca

SEQ ID NO: 330352 - RNA, 17 nt, Bordetella pertussis
cgugaaaggccagcggc

SEQ ID NO: 330353 - RNA, 15 nt, Bordetella pertussis
cgugaacgccccggc

SEQ ID NO: 330354 - RNA, 16 nt, Bordetella pertussis
cgugaacggcucgagc

SEQ ID NO: 330355 - RNA, 14 nt, Bordetella pertussis
cgugaagucggccg

SEQ ID NO: 330356 - RNA, 17 nt, Bordetella pertussis
cgugaagucggccggca

SEQ ID NO: 330357 - RNA, 18 nt, Bordetella pertussis
cgugacgcugacccuggc

SEQ ID NO: 330358 - RNA, 20 nt, Bordetella pertussis
cgugacgcugauggccgcca

SEQ ID NO: 330359 - RNA, 22 nt, Bordetella pertussis
cgugacgcuggagauggcgccg

SEQ ID NO: 330360 - RNA, 12 nt, Bordetella pertussis
cgugacggcggc

SEQ ID NO: 330361 - RNA, 21 nt, Bordetella pertussis
cgugauauagaccagcagcuc

SEQ ID NO: 330362 - RNA, 18 nt, Bordetella pertussis
cgugaucgaccgccagca

SEQ ID NO: 330363 - RNA, 13 nt, Bordetella pertussis
cgugaucgccagc

SEQ ID NO: 330364 - RNA, 17 nt, Bordetella pertussis
cgugaucgccagcgccg

SEQ ID NO: 330365 - RNA, 15 nt, Bordetella pertussis
cgugaucggcgcaac

SEQ ID NO: 330366 - RNA, 15 nt, Bordetella pertussis
cgugaugcaggcggu

SEQ ID NO: 330367 - RNA, 13 nt, Bordetella pertussis
cgugaugcccagg

SEQ ID NO: 330368 - RNA, 12 nt, Bordetella pertussis
cgugaugccgac

SEQ ID NO: 330369 - RNA, 16 nt, Bordetella pertussis
cgugaugccgaccagg

SEQ ID NO: 330370 - RNA, 17 nt, Bordetella pertussis
cgugaugccgaccaggc

SEQ ID NO: 330371 - RNA, 22 nt, Bordetella pertussis
cgugaugccgucgagcgcggcc

SEQ ID NO: 330372 - RNA, 19 nt, Bordetella pertussis
cgugaugcggucggccaca

SEQ ID NO: 330373 - RNA, 21 nt, Bordetella pertussis
cgugcagagcaccacggcgcg

SEQ ID NO: 330374 - RNA, 19 nt, Bordetella pertussis
cgugcagaucugcacgcug

SEQ ID NO: 330375 - RNA, 19 nt, Bordetella pertussis
cgugcagcaggggcugcca

SEQ ID NO: 330376 - RNA, 16 nt, Bordetella pertussis
cgugcagccagcggcc

SEQ ID NO: 330377 - RNA, 17 nt, Bordetella pertussis
cgugcagccagcggccg

SEQ ID NO: 330378 - RNA, 19 nt, Bordetella pertussis
cgugcagccauucggccag

SEQ ID NO: 330379 - RNA, 18 nt, Bordetella pertussis
cgugcagcgccgcgcgcu

SEQ ID NO: 330380 - RNA, 16 nt, Bordetella pertussis
cgugcagcgcgugggc

SEQ ID NO: 330381 - RNA, 17 nt, Bordetella pertussis
cgugcagcgcgugggcc

SEQ ID NO: 330382 - RNA, 21 nt, Bordetella pertussis
cgugcagcgcgugggccaguc

SEQ ID NO: 330383 - RNA, 14 nt, Bordetella pertussis
cgugcaggauggcg

SEQ ID NO: 330384 - RNA, 13 nt, Bordetella pertussis
cgugcaggccaac

SEQ ID NO: 330385 - RNA, 12 nt, Bordetella pertussis
cgugcaggcccg

SEQ ID NO: 330386 - RNA, 15 nt, Bordetella pertussis
cgugcaggcccgggc

SEQ ID NO: 330387 - RNA, 16 nt, Bordetella pertussis
cgugcaggcccgggcg

SEQ ID NO: 330388 - RNA, 19 nt, Bordetella pertussis
cgugcaggcccgggcgccu

SEQ ID NO: 330389 - RNA, 13 nt, Bordetella pertussis
cgugcaggccggc

SEQ ID NO: 330390 - RNA, 17 nt, Bordetella pertussis
cgugcaggccggcggcg

SEQ ID NO: 330391 - RNA, 15 nt, Bordetella pertussis
cgugcagggccaggu

SEQ ID NO: 330392 - RNA, 20 nt, Bordetella pertussis
cgugcagggucagggugucg

SEQ ID NO: 330393 - RNA, 13 nt, Bordetella pertussis
cgugccgcccagg

SEQ ID NO: 330394 - RNA, 16 nt, Bordetella pertussis
cgugccgcccgguucg

SEQ ID NO: 330395 - RNA, 14 nt, Bordetella pertussis
cgugccgccggcgc

SEQ ID NO: 330396 - RNA, 15 nt, Bordetella pertussis
cgugccgccggcgcg

SEQ ID NO: 330397 - RNA, 15 nt, Bordetella pertussis
cgugccgcgcugggc

SEQ ID NO: 330398 - RNA, 12 nt, Bordetella pertussis
cgugccggaugg

SEQ ID NO: 330399 - RNA, 20 nt, Bordetella pertussis
cgugccggcguauuccugca

SEQ ID NO: 330400 - RNA, 22 nt, Bordetella pertussis
cgugccgggaugcugcucggcc

SEQ ID NO: 330401 - RNA, 23 nt, Bordetella pertussis
cgugccgggaugcugcucggcca

SEQ ID NO: 330402 - RNA, 23 nt, Bordetella pertussis
cgugccgggccuggugcccgacg

SEQ ID NO: 330403 - RNA, 18 nt, Bordetella pertussis
cgugccucaacuggccgg

SEQ ID NO: 330404 - RNA, 18 nt, Bordetella pertussis
cgugccuguccccgcacg

SEQ ID NO: 330405 - RNA, 19 nt, Bordetella pertussis
cgugccuguccccgcacgg

SEQ ID NO: 330406 - RNA, 15 nt, Bordetella pertussis
cgugccuugccggcc

SEQ ID NO: 330407 - RNA, 13 nt, Bordetella pertussis
cgugcgacgcaug

SEQ ID NO: 330408 - RNA, 21 nt, Bordetella pertussis
cgugcgacgcaugucagcgcc

SEQ ID NO: 330409 - RNA, 15 nt, Bordetella pertussis
cgugcgacgugaccc

SEQ ID NO: 330410 - RNA, 14 nt, Bordetella pertussis
cgugcgaggccacg

SEQ ID NO: 330411 - RNA, 19 nt, Bordetella pertussis
cgugcgaggccacggcaau

SEQ ID NO: 330412 - RNA, 13 nt, Bordetella pertussis
cgugcgaggcgaa

SEQ ID NO: 330413 - RNA, 16 nt, Bordetella pertussis
cgugcgaggcgaacag

SEQ ID NO: 330414 - RNA, 22 nt, Bordetella pertussis
cgugcgaggcgaacaggcacag

SEQ ID NO: 330415 - RNA, 21 nt, Bordetella pertussis
cgugcgagcacggcguggcgc

SEQ ID NO: 330416 - RNA, 22 nt, Bordetella pertussis
cgugcgcacgcguucgggcggc

SEQ ID NO: 330417 - RNA, 13 nt, Bordetella pertussis
cgugcggcgcgca

SEQ ID NO: 330418 - RNA, 18 nt, Bordetella pertussis
cgugcggcgcgcacgggc

SEQ ID NO: 330419 - RNA, 21 nt, Bordetella pertussis
cgugcggcuguugggcaaggu

SEQ ID NO: 330420 - RNA, 16 nt, Bordetella pertussis
cgugcgggacggccag

SEQ ID NO: 330421 - RNA, 14 nt, Bordetella pertussis
cgugcgggccugca

SEQ ID NO: 330422 - RNA, 15 nt, Bordetella pertussis
cgugcgggccugcag

SEQ ID NO: 330423 - RNA, 22 nt, Bordetella pertussis
cgugcggggaccggcacccgcu

SEQ ID NO: 330424 - RNA, 21 nt, Bordetella pertussis
cgugcggggcggcaggucgcg

SEQ ID NO: 330425 - RNA, 15 nt, Bordetella pertussis
cgugcgggugccugu

SEQ ID NO: 330426 - RNA, 22 nt, Bordetella pertussis
cgugcgguucgucagggccgca

SEQ ID NO: 330427 - RNA, 21 nt, Bordetella pertussis
cgugcguauucgguggcgcgc

SEQ ID NO: 330428 - RNA, 16 nt, Bordetella pertussis
cgugcgugacgcugga

SEQ ID NO: 330429 - RNA, 13 nt, Bordetella pertussis
cgugcgugccgac

SEQ ID NO: 330430 - RNA, 16 nt, Bordetella pertussis
cgugcgugcgccuguc

SEQ ID NO: 330431 - RNA, 16 nt, Bordetella pertussis
cgugcgugugccuguc

SEQ ID NO: 330432 - RNA, 19 nt, Bordetella pertussis
cgugcucaucggcaggccg

SEQ ID NO: 330433 - RNA, 22 nt, Bordetella pertussis
cgugcucaucggcaggccggcg

SEQ ID NO: 330434 - RNA, 18 nt, Bordetella pertussis
cgugcuccagaacgcgcc

SEQ ID NO: 330435 - RNA, 18 nt, Bordetella pertussis
cgugcugggcggccaggc

SEQ ID NO: 330436 - RNA, 22 nt, Bordetella pertussis
cgugcuguaccucagccugcug

SEQ ID NO: 330437 - RNA, 13 nt, Bordetella pertussis
cgugcuugagggu

SEQ ID NO: 330438 - RNA, 14 nt, Bordetella pertussis
cgugcuugccgccg

SEQ ID NO: 330439 - RNA, 18 nt, Bordetella pertussis
cgugcuugccgccggacg

SEQ ID NO: 330440 - RNA, 14 nt, Bordetella pertussis
cguucccgccgggc

SEQ ID NO: 330441 - RNA, 15 nt, Bordetella pertussis
cguucccgccgggcu

SEQ ID NO: 330442 - RNA, 15 nt, Bordetella pertussis
cguuccggccgcgcc

SEQ ID NO: 330443 - RNA, 16 nt, Bordetella pertussis
cguuccugggcacgcc

SEQ ID NO: 330444 - RNA, 15 nt, Bordetella pertussis
cguucgaaguccgcg

SEQ ID NO: 330445 - RNA, 22 nt, Bordetella pertussis
cguucggggcgucgcugcuggc

SEQ ID NO: 330446 - RNA, 18 nt, Bordetella pertussis
cguucguauugcugcugc

SEQ ID NO: 330447 - RNA, 19 nt, Bordetella pertussis
cguucguauugcugcugcu

SEQ ID NO: 330448 - RNA, 14 nt, Bordetella pertussis
cguucgucgcgcag

SEQ ID NO: 330449 - RNA, 16 nt, Bordetella pertussis
cguucgucgcgcagca

SEQ ID NO: 330450 - RNA, 19 nt, Bordetella pertussis
cguucucagccgcccgccg

SEQ ID NO: 330451 - RNA, 22 nt, Bordetella pertussis
cguucucagccgcccgccgggc

SEQ ID NO: 330452 - RNA, 14 nt, Bordetella pertussis
cguucuccagcgcc

SEQ ID NO: 330453 - RNA, 23 nt, Bordetella pertussis
cguucucgacccgcucggccacg

SEQ ID NO: 330454 - RNA, 20 nt, Bordetella pertussis
cguugaccuggucgaucagc

SEQ ID NO: 330455 - RNA, 13 nt, Bordetella pertussis
cguugaccuugcc

SEQ ID NO: 330456 - RNA, 20 nt, Bordetella pertussis
cguugaccuugccgauccag

SEQ ID NO: 330457 - RNA, 15 nt, Bordetella pertussis
cguugacgccgacga

SEQ ID NO: 330458 - RNA, 13 nt, Bordetella pertussis
cguugacggccca

SEQ ID NO: 330459 - RNA, 17 nt, Bordetella pertussis
cguugaucaucggcccg

SEQ ID NO: 330460 - RNA, 14 nt, Bordetella pertussis
cguugauccagcgc

SEQ ID NO: 330461 - RNA, 17 nt, Bordetella pertussis
cguugaucucgcccagc

SEQ ID NO: 330462 - RNA, 17 nt, Bordetella pertussis
cguugauggggccgcgc

SEQ ID NO: 330463 - RNA, 19 nt, Bordetella pertussis
cguugauggggccgcgccg

SEQ ID NO: 330464 - RNA, 17 nt, Bordetella pertussis
cguugaugguccgcagg

SEQ ID NO: 330465 - RNA, 17 nt, Bordetella pertussis
cguugcagcccagcgcg

SEQ ID NO: 330466 - RNA, 19 nt, Bordetella pertussis
cguugcagccacaggccca

SEQ ID NO: 330467 - RNA, 13 nt, Bordetella pertussis
cguugccagccca

SEQ ID NO: 330468 - RNA, 15 nt, Bordetella pertussis
cguugccccgauccg

SEQ ID NO: 330469 - RNA, 21 nt, Bordetella pertussis
cguugccgcuguggcgcgcca

SEQ ID NO: 330470 - RNA, 15 nt, Bordetella pertussis
cguugccggccagca

SEQ ID NO: 330471 - RNA, 21 nt, Bordetella pertussis
cguugccggccagcacgggcg

SEQ ID NO: 330472 - RNA, 14 nt, Bordetella pertussis
cguugccggugcgc

SEQ ID NO: 330473 - RNA, 15 nt, Bordetella pertussis
cguugcgcaccaugu

SEQ ID NO: 330474 - RNA, 16 nt, Bordetella pertussis
cguugcgccagcggcg

SEQ ID NO: 330475 - RNA, 14 nt, Bordetella pertussis
cguugcgccugcca

SEQ ID NO: 330476 - RNA, 19 nt, Bordetella pertussis
cguugcgcgacaggcccgc

SEQ ID NO: 330477 - RNA, 16 nt, Bordetella pertussis
cguugcggcagcggcc

SEQ ID NO: 330478 - RNA, 18 nt, Bordetella pertussis
cguugcggcagcggccca

SEQ ID NO: 330479 - RNA, 15 nt, Bordetella pertussis
cguugcggcccgccg

SEQ ID NO: 330480 - RNA, 18 nt, Bordetella pertussis
cguugcggcccgccgacu

SEQ ID NO: 330481 - RNA, 13 nt, Bordetella pertussis
cguugcggcgccu

SEQ ID NO: 330482 - RNA, 22 nt, Bordetella pertussis
cguugcggcgccucgguccagc

SEQ ID NO: 330483 - RNA, 16 nt, Bordetella pertussis
cguugcggcgucgacg

SEQ ID NO: 330484 - RNA, 17 nt, Bordetella pertussis
cguugcggcgucgacgu

SEQ ID NO: 330485 - RNA, 15 nt, Bordetella pertussis
cguuggagcaagcgu

SEQ ID NO: 330486 - RNA, 23 nt, Bordetella pertussis
cguuggagccggagcagucgcgc

SEQ ID NO: 330487 - RNA, 14 nt, Bordetella pertussis
cguuggcaggccag

SEQ ID NO: 330488 - RNA, 16 nt, Bordetella pertussis
cguuggcaggccagca

SEQ ID NO: 330489 - RNA, 20 nt, Bordetella pertussis
cguuggcaggccagcauggc

SEQ ID NO: 330490 - RNA, 15 nt, Bordetella pertussis
cguuggccagcgccg

SEQ ID NO: 330491 - RNA, 23 nt, Bordetella pertussis
cguuggccgcgaaggcuucgucg

SEQ ID NO: 330492 - RNA, 19 nt, Bordetella pertussis
cguuggccgggucgcgcag

SEQ ID NO: 330493 - RNA, 21 nt, Bordetella pertussis
cguuggccgggucgcgcagca

SEQ ID NO: 330494 - RNA, 17 nt, Bordetella pertussis
cguuggccugaccggaa

SEQ ID NO: 330495 - RNA, 17 nt, Bordetella pertussis
cguuggcgcccagcgcc

SEQ ID NO: 330496 - RNA, 18 nt, Bordetella pertussis
cguuggcgcccagcgcca

SEQ ID NO: 330497 - RNA, 13 nt, Bordetella pertussis
cguuggcgcgccu

SEQ ID NO: 330498 - RNA, 18 nt, Bordetella pertussis
cguuggcggccggccagc

SEQ ID NO: 330499 - RNA, 14 nt, Bordetella pertussis
cguugggcaugccg

SEQ ID NO: 330500 - RNA, 20 nt, Bordetella pertussis
cguugggcaugccgaucagc

SEQ ID NO: 330501 - RNA, 18 nt, Bordetella pertussis
cguuggggaaccgcaccg

SEQ ID NO: 330502 - RNA, 22 nt, Bordetella pertussis
cguuggucaccacgccuucgag

SEQ ID NO: 330503 - RNA, 21 nt, Bordetella pertussis
cguuggucagcaccucggcgc

SEQ ID NO: 330504 - RNA, 15 nt, Bordetella pertussis
cguuggugacgaugg

SEQ ID NO: 330505 - RNA, 20 nt, Bordetella pertussis
cguuggugacgauggugcgc

SEQ ID NO: 330506 - RNA, 15 nt, Bordetella pertussis
cguuggugcccagcg

SEQ ID NO: 330507 - RNA, 17 nt, Bordetella pertussis
cguuggugucggcggcg

SEQ ID NO: 330508 - RNA, 22 nt, Bordetella pertussis
cguuggugucggcggcgagcug

SEQ ID NO: 330509 - RNA, 22 nt, Bordetella pertussis
cguugguguguaccguacccgc

SEQ ID NO: 330510 - RNA, 13 nt, Bordetella pertussis
cguuguccaggcc

SEQ ID NO: 330511 - RNA, 18 nt, Bordetella pertussis
cguuguccaggccgauca

SEQ ID NO: 330512 - RNA, 22 nt, Bordetella pertussis
cguuguccaggccgaucagcga

SEQ ID NO: 330513 - RNA, 15 nt, Bordetella pertussis
cguuguccuggcgcg

SEQ ID NO: 330514 - RNA, 20 nt, Bordetella pertussis
cguugucgagcaggccgccg

SEQ ID NO: 330515 - RNA, 13 nt, Bordetella pertussis
cguugucgcgccg

SEQ ID NO: 330516 - RNA, 15 nt, Bordetella pertussis
cguugucgcgccgcg

SEQ ID NO: 330517 - RNA, 13 nt, Bordetella pertussis
cguugucgcgcgu

SEQ ID NO: 330518 - RNA, 22 nt, Bordetella pertussis
cguuguggcaggcgucggccag

SEQ ID NO: 330519 - RNA, 18 nt, Bordetella pertussis
cguuguugccccauugcg

SEQ ID NO: 330520 - RNA, 18 nt, Bordetella pertussis
cguuucaccgcuggacga

SEQ ID NO: 330521 - RNA, 21 nt, Bordetella pertussis
cguuucaggccugcggcgcca

SEQ ID NO: 330522 - RNA, 17 nt, Bordetella pertussis
cguuuccaagcgcacgc

SEQ ID NO: 330523 - RNA, 15 nt, Bordetella pertussis
cguuuccagggcgcg

SEQ ID NO: 330524 - RNA, 19 nt, Bordetella pertussis
cguuuccagggcgcgccgc

SEQ ID NO: 330525 - RNA, 23 nt, Bordetella pertussis
cguuucgucggcgcgcgccaggc

SEQ ID NO: 330526 - RNA, 19 nt, Bordetella pertussis
cguuucucaacccgccggc

SEQ ID NO: 330527 - RNA, 17 nt, Bordetella pertussis
cuaagaugaaucgcaug

SEQ ID NO: 330528 - RNA, 21 nt, Bordetella pertussis
cuaagcacaagcgcguggccg

SEQ ID NO: 330529 - RNA, 16 nt, Bordetella pertussis
cuaccaggcgcgcgcg

SEQ ID NO: 330530 - RNA, 19 nt, Bordetella pertussis
cuaccaggcgcgcgcgcgg

SEQ ID NO: 330531 - RNA, 20 nt, Bordetella pertussis
cuaccaggcgcgcgcgcgga

SEQ ID NO: 330532 - RNA, 18 nt, Bordetella pertussis
cuaccaggugggcgcgcu

SEQ ID NO: 330533 - RNA, 20 nt, Bordetella pertussis
cuaccaggugggcgcgcuca

SEQ ID NO: 330534 - RNA, 15 nt, Bordetella pertussis
cuacccgccgggcgg

SEQ ID NO: 330535 - RNA, 12 nt, Bordetella pertussis
cuaccuggacgg

SEQ ID NO: 330536 - RNA, 23 nt, Bordetella pertussis
cuacgaauccccgcucaggucga

SEQ ID NO: 330537 - RNA, 16 nt, Bordetella pertussis
cuacgcgaaccccgcc

SEQ ID NO: 330538 - RNA, 15 nt, Bordetella pertussis
cuacgcgcgcgccgg

SEQ ID NO: 330539 - RNA, 16 nt, Bordetella pertussis
cuacgcgcgcgccggc

SEQ ID NO: 330540 - RNA, 19 nt, Bordetella pertussis
cuacggcggacuggccgcg

SEQ ID NO: 330541 - RNA, 20 nt, Bordetella pertussis
cuacggcggacuggccgcgc

SEQ ID NO: 330542 - RNA, 16 nt, Bordetella pertussis
cuacggcggcggccau

SEQ ID NO: 330543 - RNA, 18 nt, Bordetella pertussis
cuacggcggcggccaucg

SEQ ID NO: 330544 - RNA, 21 nt, Bordetella pertussis
cuacggcggcggccaucgcca

SEQ ID NO: 330545 - RNA, 17 nt, Bordetella pertussis
cuaggcgcagcaggcca

SEQ ID NO: 330546 - RNA, 14 nt, Bordetella pertussis
cuagggcguggcgc

SEQ ID NO: 330547 - RNA, 17 nt, Bordetella pertussis
cuaguagaacucgccag

SEQ ID NO: 330548 - RNA, 21 nt, Bordetella pertussis
cuauguaggcgccgcgcccgu

SEQ ID NO: 330549 - RNA, 16 nt, Bordetella pertussis
cuaugucgccggccag

SEQ ID NO: 330550 - RNA, 18 nt, Bordetella pertussis
cuauugcgacgccgccga

SEQ ID NO: 330551 - RNA, 19 nt, Bordetella pertussis
cucacgaugcgaucgucgc

SEQ ID NO: 330552 - RNA, 14 nt, Bordetella pertussis
cucacgcaaggccg

SEQ ID NO: 330553 - RNA, 21 nt, Bordetella pertussis
cucacgcaaggccgacuggau

SEQ ID NO: 330554 - RNA, 16 nt, Bordetella pertussis
cucagcccgcaccgcc

SEQ ID NO: 330555 - RNA, 19 nt, Bordetella pertussis
cucagcccgcaccgcccgc

SEQ ID NO: 330556 - RNA, 12 nt, Bordetella pertussis
cucagcccgccu

SEQ ID NO: 330557 - RNA, 21 nt, Bordetella pertussis
cucagcccgcguucaggcgcg

SEQ ID NO: 330558 - RNA, 23 nt, Bordetella pertussis
cucagcccgcguucaggcgcggc

SEQ ID NO: 330559 - RNA, 19 nt, Bordetella pertussis
cucagcguuuccagggcgc

SEQ ID NO: 330560 - RNA, 18 nt, Bordetella pertussis
cucaggcccgcggcgcca

SEQ ID NO: 330561 - RNA, 23 nt, Bordetella pertussis
cucaggccgaggcugcgcgcgcc

SEQ ID NO: 330562 - RNA, 15 nt, Bordetella pertussis
cucaggccggcgccu

SEQ ID NO: 330563 - RNA, 21 nt, Bordetella pertussis
cucauaggcaucgaccagcgc

SEQ ID NO: 330564 - RNA, 21 nt, Bordetella pertussis
cuccaccagcaccggcagcgu

SEQ ID NO: 330565 - RNA, 19 nt, Bordetella pertussis
cuccacgcacaccgcccga

SEQ ID NO: 330566 - RNA, 15 nt, Bordetella pertussis
cuccagaacgcgccg

SEQ ID NO: 330567 - RNA, 13 nt, Bordetella pertussis
cuccagagcgcgc

SEQ ID NO: 330568 - RNA, 14 nt, Bordetella pertussis
cuccagagcgcgca

SEQ ID NO: 330569 - RNA, 19 nt, Bordetella pertussis
cuccaggugccagauaucc

SEQ ID NO: 330570 - RNA, 16 nt, Bordetella pertussis
cuccagucccgcaccg

SEQ ID NO: 330571 - RNA, 18 nt, Bordetella pertussis
cuccauagcgccgcucga

SEQ ID NO: 330572 - RNA, 18 nt, Bordetella pertussis
cuccaucuguucggcgcc

SEQ ID NO: 330573 - RNA, 23 nt, Bordetella pertussis
cuccaucuguucggcgccgggcg

SEQ ID NO: 330574 - RNA, 19 nt, Bordetella pertussis
cuccaugcgauagcgggcc

SEQ ID NO: 330575 - RNA, 14 nt, Bordetella pertussis
cucccauugcgcgg

SEQ ID NO: 330576 - RNA, 20 nt, Bordetella pertussis
cucccauugcgcggccaggg

SEQ ID NO: 330577 - RNA, 18 nt, Bordetella pertussis
cuccccgcugaccuggug

SEQ ID NO: 330578 - RNA, 16 nt, Bordetella pertussis
cuccccgugcggggac

SEQ ID NO: 330579 - RNA, 15 nt, Bordetella pertussis
cucccgccgcccggc

SEQ ID NO: 330580 - RNA, 16 nt, Bordetella pertussis
cucccgccgcccggcc

SEQ ID NO: 330581 - RNA, 19 nt, Bordetella pertussis
cucccgccgcccggccggc

SEQ ID NO: 330582 - RNA, 17 nt, Bordetella pertussis
cuccgguacgccugcac

SEQ ID NO: 330583 - RNA, 20 nt, Bordetella pertussis
cuccguaaagaugcgcgccg

SEQ ID NO: 330584 - RNA, 16 nt, Bordetella pertussis
cuccgguucggcgcgg

SEQ ID NO: 330585 - RNA, 14 nt, Bordetella pertussis
cuccgucauggcgc

SEQ ID NO: 330586 - RNA, 16 nt, Bordetella pertussis
cuccgucauggcgccg

SEQ ID NO: 330587 - RNA, 19 nt, Bordetella pertussis
cuccgucauggcgccguga

SEQ ID NO: 330588 - RNA, 16 nt, Bordetella pertussis
cuccugcaacuggugc

SEQ ID NO: 330589 - RNA, 16 nt, Bordetella pertussis
cuccugccaggcgccg

SEQ ID NO: 330590 - RNA, 13 nt, Bordetella pertussis
cuccugccggcgg

SEQ ID NO: 330591 - RNA, 19 nt, Bordetella pertussis
cuccugcguccagccgagc

SEQ ID NO: 330592 - RNA, 15 nt, Bordetella pertussis
cuccugcuggcgcgu

SEQ ID NO: 330593 - RNA, 17 nt, Bordetella pertussis
cuccugcuggcgcgucg

SEQ ID NO: 330594 - RNA, 19 nt, Bordetella pertussis
cucgaauggcugcgcgccg

SEQ ID NO: 330595 - RNA, 14 nt, Bordetella pertussis
cucgacagcagccc

SEQ ID NO: 330596 - RNA, 15 nt, Bordetella pertussis
cucgaccacggcggc

SEQ ID NO: 330597 - RNA, 20 nt, Bordetella pertussis
cucgaccagcccggccgcca

SEQ ID NO: 330598 - RNA, 16 nt, Bordetella pertussis
cucgaccaggcgggca

SEQ ID NO: 330599 - RNA, 22 nt, Bordetella pertussis
cucgaccaggcgggcaucgccc

SEQ ID NO: 330600 - RNA, 18 nt, Bordetella pertussis
cucgaccaucauggccag

SEQ ID NO: 330601 - RNA, 16 nt, Bordetella pertussis
cucgaccagcgcgcgg

SEQ ID NO: 330602 - RNA, 13 nt, Bordetella pertussis
cucgacccgcgcc

SEQ ID NO: 330603 - RNA, 19 nt, Bordetella pertussis
cucgacccgcucggccacg

SEQ ID NO: 330604 - RNA, 12 nt, Bordetella pertussis
cucgaccgccgc

SEQ ID NO: 330605 - RNA, 17 nt, Bordetella pertussis
cucgacuucggccgaca

SEQ ID NO: 330606 - RNA, 18 nt, Bordetella pertussis
cucgagcaagggccagac

SEQ ID NO: 330607 - RNA, 15 nt, Bordetella pertussis
cucgagcaccuugac

SEQ ID NO: 330608 - RNA, 19 nt, Bordetella pertussis
cucgagguaggcgggacug

SEQ ID NO: 330609 - RNA, 17 nt, Bordetella pertussis
cucgaguuugcggucca

SEQ ID NO: 330610 - RNA, 20 nt, Bordetella pertussis
cucgaguuugcgguccaugu

SEQ ID NO: 330611 - RNA, 17 nt, Bordetella pertussis
cucgauaugcagcaccg

SEQ ID NO: 330612 - RNA, 18 nt, Bordetella pertussis
cucgauaugcagcaccgg

SEQ ID NO: 330613 - RNA, 16 nt, Bordetella pertussis
cucgaucaccaccggc

SEQ ID NO: 330614 - RNA, 23 nt, Bordetella pertussis
cucgaucagcgaaugcgacagcg

SEQ ID NO: 330615 - RNA, 18 nt, Bordetella pertussis
cucgaucgccaugacgcu

SEQ ID NO: 330616 - RNA, 13 nt, Bordetella pertussis
cucgaucgccgcc

SEQ ID NO: 330617 - RNA, 17 nt, Bordetella pertussis
cucgaucuucucgacgg

SEQ ID NO: 330618 - RNA, 20 nt, Bordetella pertussis
cucgaucuucucgacggcgc

SEQ ID NO: 330619 - RNA, 20 nt, Bordetella pertussis
cucgaugaaggugcgcagca

SEQ ID NO: 330620 - RNA, 13 nt, Bordetella pertussis
cucgaugcccagc

SEQ ID NO: 330621 - RNA, 22 nt, Bordetella pertussis
cucgaugcaauagcgcccgccu

SEQ ID NO: 330622 - RNA, 19 nt, Bordetella pertussis
cucgaugcgccaguccagc

SEQ ID NO: 330623 - RNA, 14 nt, Bordetella pertussis
cucgaugcgcgcca

SEQ ID NO: 330624 - RNA, 18 nt, Bordetella pertussis
cucgaugcggucggccgc

SEQ ID NO: 330625 - RNA, 16 nt, Bordetella pertussis
cucgaugggcgcgcgc

SEQ ID NO: 330626 - RNA, 21 nt, Bordetella pertussis
cucgaugggcgcgcgcaucgg

SEQ ID NO: 330627 - RNA, 14 nt, Bordetella pertussis
cucgaugguggcga

SEQ ID NO: 330628 - RNA, 15 nt, Bordetella pertussis
cucgauguggcgcug

SEQ ID NO: 330629 - RNA, 19 nt, Bordetella pertussis
cucgauguggcgcuggcgg

SEQ ID NO: 330630 - RNA, 15 nt, Bordetella pertussis
cucgaugucaucgcc

SEQ ID NO: 330631 - RNA, 13 nt, Bordetella pertussis
cucgccgucgacg

SEQ ID NO: 330632 - RNA, 23 nt, Bordetella pertussis
cucgccgugcugggcggccaggc

SEQ ID NO: 330633 - RNA, 16 nt, Bordetella pertussis
cucgccguugucgacg

SEQ ID NO: 330634 - RNA, 20 nt, Bordetella pertussis
cucgcgcaccgcaugggcca

SEQ ID NO: 330635 - RNA, 13 nt, Bordetella pertussis
cucgcgcagcagg

SEQ ID NO: 330636 - RNA, 22 nt, Bordetella pertussis
cucgcgcagcgugaccgacagg

SEQ ID NO: 330637 - RNA, 17 nt, Bordetella pertussis
cucgcgcagcguggcgg

SEQ ID NO: 330638 - RNA, 14 nt, Bordetella pertussis
cucgcgcgccagca

SEQ ID NO: 330639 - RNA, 13 nt, Bordetella pertussis
cucgcgcgggucc

SEQ ID NO: 330640 - RNA, 17 nt, Bordetella pertussis
cucgcgcggguccuugc

SEQ ID NO: 330641 - RNA, 20 nt, Bordetella pertussis
cucgcgcgcgaugcgcaggc

SEQ ID NO: 330642 - RNA, 20 nt, Bordetella pertussis
cucgcgcgcgcgggcgcgca

SEQ ID NO: 330643 - RNA, 13 nt, Bordetella pertussis
cucgcgcuccagc

SEQ ID NO: 330644 - RNA, 14 nt, Bordetella pertussis
cucgcgcuccagca

SEQ ID NO: 330645 - RNA, 18 nt, Bordetella pertussis
cucgcgcuccaugggcgu

SEQ ID NO: 330646 - RNA, 15 nt, Bordetella pertussis
cucgcgcucgcccgg

SEQ ID NO: 330647 - RNA, 16 nt, Bordetella pertussis
cucgcgcucgcccggc

SEQ ID NO: 330648 - RNA, 13 nt, Bordetella pertussis
cucgcgcucgcgc

SEQ ID NO: 330649 - RNA, 17 nt, Bordetella pertussis
cucgcgcucggccagca

SEQ ID NO: 330650 - RNA, 14 nt, Bordetella pertussis
cucgcgcucggcga

SEQ ID NO: 330651 - RNA, 14 nt, Bordetella pertussis
cucgcgcugcagca

SEQ ID NO: 330652 - RNA, 21 nt, Bordetella pertussis
cucgcgcugcaggaucgcggc

SEQ ID NO: 330653 - RNA, 22 nt, Bordetella pertussis
cucgcggaaauccgggcgcugc

SEQ ID NO: 330654 - RNA, 23 nt, Bordetella pertussis
cucgcggauuugcuucaggucgc

SEQ ID NO: 330655 - RNA, 14 nt, Bordetella pertussis
cucgcggcgcagca

SEQ ID NO: 330656 - RNA, 18 nt, Bordetella pertussis
cucgcgguugcgucucgg

SEQ ID NO: 330657 - RNA, 23 nt, Bordetella pertussis
cucgcucacggggcugucgcgcg

SEQ ID NO: 330658 - RNA, 22 nt, Bordetella pertussis
cucggacaggucggcgcccacg

SEQ ID NO: 330659 - RNA, 21 nt, Bordetella pertussis
cucggacgccuggcgcggccc

SEQ ID NO: 330660 - RNA, 23 nt, Bordetella pertussis
cucggacggauagugguucaugc

SEQ ID NO: 330661 - RNA, 17 nt, Bordetella pertussis
cucggaggauacggcca

SEQ ID NO: 330662 - RNA, 15 nt, Bordetella pertussis
cucggccaccaugcg

SEQ ID NO: 330663 - RNA, 17 nt, Bordetella pertussis
cucggccaccuggcgca

SEQ ID NO: 330664 - RNA, 14 nt, Bordetella pertussis
cucggccacgcgca

SEQ ID NO: 330665 - RNA, 16 nt, Bordetella pertussis
cucggccacgcucacg

SEQ ID NO: 330666 - RNA, 17 nt, Bordetella pertussis
cucggccacgcucacgc

SEQ ID NO: 330667 - RNA, 17 nt, Bordetella pertussis
cucggccacgucggcgg

SEQ ID NO: 330668 - RNA, 23 nt, Bordetella pertussis
cucggccacuucgcggccgaugu

SEQ ID NO: 330669 - RNA, 17 nt, Bordetella pertussis
cucggccagcagcuuga

SEQ ID NO: 330670 - RNA, 16 nt, Bordetella pertussis
cucggccagcgaggcc

SEQ ID NO: 330671 - RNA, 12 nt, Bordetella pertussis
cucggccagcgc

SEQ ID NO: 330672 - RNA, 13 nt, Bordetella pertussis
cucggccagcgcc

SEQ ID NO: 330673 - RNA, 15 nt, Bordetella pertussis
cucggccagcgccga

SEQ ID NO: 330674 - RNA, 14 nt, Bordetella pertussis
cucggccagcgccg

SEQ ID NO: 330675 - RNA, 20 nt, Bordetella pertussis
cucggcgaagccgcagcggc

SEQ ID NO: 330676 - RNA, 19 nt, Bordetella pertussis
cucggcgaagugcccgcug

SEQ ID NO: 330677 - RNA, 16 nt, Bordetella pertussis
cucggcgaugcgccau

SEQ ID NO: 330678 - RNA, 14 nt, Bordetella pertussis
cucggcgcccagcu

SEQ ID NO: 330679 - RNA, 15 nt, Bordetella pertussis
cucggcgccggcggc

SEQ ID NO: 330680 - RNA, 13 nt, Bordetella pertussis
cucggcggccagc

SEQ ID NO: 330681 - RNA, 18 nt, Bordetella pertussis
cucggcggccagcgcgcc

SEQ ID NO: 330682 - RNA, 14 nt, Bordetella pertussis
cucggcggccgccu

SEQ ID NO: 330683 - RNA, 14 nt, Bordetella pertussis
cucggcggccuccg

SEQ ID NO: 330684 - RNA, 18 nt, Bordetella pertussis
cucggcggccuccggcag

SEQ ID NO: 330685 - RNA, 16 nt, Bordetella pertussis
cucggcgggcggcgcc

SEQ ID NO: 330686 - RNA, 17 nt, Bordetella pertussis
cucggcgggcggcgcca

SEQ ID NO: 330687 - RNA, 14 nt, Bordetella pertussis
cucggcggucagcg

SEQ ID NO: 330688 - RNA, 21 nt, Bordetella pertussis
cucggcggucagcgcggcgcc

SEQ ID NO: 330689 - RNA, 16 nt, Bordetella pertussis
cucggcuuccugccgc

SEQ ID NO: 330690 - RNA, 21 nt, Bordetella pertussis
cucgggaaacaggcccacggc

SEQ ID NO: 330691 - RNA, 15 nt, Bordetella pertussis
cucgggacgcaggcc

SEQ ID NO: 330692 - RNA, 20 nt, Bordetella pertussis
cucgggauaggccucggcca

SEQ ID NO: 330693 - RNA, 16 nt, Bordetella pertussis
cucgggcacggccagc

SEQ ID NO: 330694 - RNA, 19 nt, Bordetella pertussis
cucgggcagcagcagggcc

SEQ ID NO: 330695 - RNA, 20 nt, Bordetella pertussis
cucgggcagcagcagggcca

SEQ ID NO: 330696 - RNA, 23 nt, Bordetella pertussis
cucgggcagcagcagggccaggc

SEQ ID NO: 330697 - RNA, 20 nt, Bordetella pertussis
cucgggcaggucggccagcg

SEQ ID NO: 330698 - RNA, 16 nt, Bordetella pertussis
cucgggcaugcgccug

SEQ ID NO: 330699 - RNA, 21 nt, Bordetella pertussis
cucgggcaugcgccugcgcca

SEQ ID NO: 330700 - RNA, 21 nt, Bordetella pertussis
cucgggcgaggucagcccggc

SEQ ID NO: 330701 - RNA, 14 nt, Bordetella pertussis
cucgggcgucaugc

SEQ ID NO: 330702 - RNA, 23 nt, Bordetella pertussis
cucgggcgucaugcgcuugucgc

SEQ ID NO: 330703 - RNA, 20 nt, Bordetella pertussis
cucggggaaauugacggcgc

SEQ ID NO: 330704 - RNA, 22 nt, Bordetella pertussis
cucgguaucgucggacaacgcc

SEQ ID NO: 330705 - RNA, 14 nt, Bordetella pertussis
cucggucagcgcca

SEQ ID NO: 330706 - RNA, 16 nt, Bordetella pertussis
cucggucagcgccagg

SEQ ID NO: 330707 - RNA, 22 nt, Bordetella pertussis
cucggucgucagcacgcccugg

SEQ ID NO: 330708 - RNA, 23 nt, Bordetella pertussis
cucggucgucagcacgcccuggc

SEQ ID NO: 330709 - RNA, 17 nt, Bordetella pertussis
cucggucauguccagcg

SEQ ID NO: 330710 - RNA, 22 nt, Bordetella pertussis
cucggucauguccagcgccagg

SEQ ID NO: 330711 - RNA, 16 nt, Bordetella pertussis
cucggugcagcccagc

SEQ ID NO: 330712 - RNA, 19 nt, Bordetella pertussis
cucggugcagcccagcacc

SEQ ID NO: 330713 - RNA, 20 nt, Bordetella pertussis
cucguaggcgagguccaggc

SEQ ID NO: 330714 - RNA, 20 nt, Bordetella pertussis
cucgugcugcugcaggcgcg

SEQ ID NO: 330715 - RNA, 14 nt, Bordetella pertussis
cucgugcuggccgg

SEQ ID NO: 330716 - RNA, 14 nt, Bordetella pertussis
cucgugcugggcau

SEQ ID NO: 330717 - RNA, 13 nt, Bordetella pertussis
cucguggcccagc

SEQ ID NO: 330718 - RNA, 18 nt, Bordetella pertussis
cucguggcccagcaccgc

SEQ ID NO: 330719 - RNA, 20 nt, Bordetella pertussis
cucucgaagaagcagccgcg

SEQ ID NO: 330720 - RNA, 15 nt, Bordetella pertussis
cucuggcacaccagc

SEQ ID NO: 330721 - RNA, 19 nt, Bordetella pertussis
cucuggcacaccagcgcca

SEQ ID NO: 330722 - RNA, 15 nt, Bordetella pertussis
cucuggcccgccuca

SEQ ID NO: 330723 - RNA, 14 nt, Bordetella pertussis
cucugguccaggcg

SEQ ID NO: 330724 - RNA, 16 nt, Bordetella pertussis
cucugguccaggcggu

SEQ ID NO: 330725 - RNA, 14 nt, Bordetella pertussis
cucuucagcccggc

SEQ ID NO: 330726 - RNA, 17 nt, Bordetella pertussis
cucuucagcccggcgcg

SEQ ID NO: 330727 - RNA, 17 nt, Bordetella pertussis
cucuucgacagcgcgca

SEQ ID NO: 330728 - RNA, 16 nt, Bordetella pertussis
cucuucgagcgcggcg

SEQ ID NO: 330729 - RNA, 19 nt, Bordetella pertussis
cucuucgagcgcggcgcgc

SEQ ID NO: 330730 - RNA, 22 nt, Bordetella pertussis
cucuucgaugaugagcgcgccg

SEQ ID NO: 330731 - RNA, 18 nt, Bordetella pertussis
cucuucgucgccggcgcu

SEQ ID NO: 330732 - RNA, 20 nt, Bordetella pertussis
cucuucguugucgcgcgcgc

SEQ ID NO: 330733 - RNA, 22 nt, Bordetella pertussis
cucuugaacgccuugcccgggc

SEQ ID NO: 330734 - RNA, 17 nt, Bordetella pertussis
cugaacaagggccgacu

SEQ ID NO: 330735 - RNA, 16 nt, Bordetella pertussis
cugaacaccggcgcgc

SEQ ID NO: 330736 - RNA, 18 nt, Bordetella pertussis
cugaacaccggcgcgccu

SEQ ID NO: 330737 - RNA, 17 nt, Bordetella pertussis
cugaccguccauggcgu

SEQ ID NO: 330738 - RNA, 15 nt, Bordetella pertussis
cugaccgugcauccc

SEQ ID NO: 330739 - RNA, 16 nt, Bordetella pertussis
cugaccgugcauccca

SEQ ID NO: 330740 - RNA, 14 nt, Bordetella pertussis
cugaccucgcccag

SEQ ID NO: 330741 - RNA, 21 nt, Bordetella pertussis
cugaccucgcccaggccgggc

SEQ ID NO: 330742 - RNA, 16 nt, Bordetella pertussis
cugacgaaacgcgcgu

SEQ ID NO: 330743 - RNA, 18 nt, Bordetella pertussis
cugacgauguucaggcca

SEQ ID NO: 330744 - RNA, 15 nt, Bordetella pertussis
cugacgccugcgccg

SEQ ID NO: 330745 - RNA, 19 nt, Bordetella pertussis
cugagaucguccagcgacu

SEQ ID NO: 330746 - RNA, 19 nt, Bordetella pertussis
cugagcacaugcccggcca

SEQ ID NO: 330747 - RNA, 15 nt, Bordetella pertussis
cugagcaggccgaua

SEQ ID NO: 330748 - RNA, 16 nt, Bordetella pertussis
cugaggcccgauggcg

SEQ ID NO: 330749 - RNA, 18 nt, Bordetella pertussis
cugaugcccuucggcaug

SEQ ID NO: 330750 - RNA, 21 nt, Bordetella pertussis
cugaugcccagcccggcuucg

SEQ ID NO: 330751 - RNA, 13 nt, Bordetella pertussis
cugaugcgcggcg

SEQ ID NO: 330752 - RNA, 14 nt, Bordetella pertussis
cugaugcuggucag

SEQ ID NO: 330753 - RNA, 22 nt, Bordetella pertussis
cugauggccgccagcggcuggc

SEQ ID NO: 330754 - RNA, 16 nt, Bordetella pertussis
cugauucacaggcccg

SEQ ID NO: 330755 - RNA, 19 nt, Bordetella pertussis
cugauucacaggcccgcgc

SEQ ID NO: 330756 - RNA, 14 nt, Bordetella pertussis
cugauucccaggcc

SEQ ID NO: 330757 - RNA, 18 nt, Bordetella pertussis
cugauucccaggcccggc

SEQ ID NO: 330758 - RNA, 13 nt, Bordetella pertussis
cugcaaggcccgc

SEQ ID NO: 330759 - RNA, 15 nt, Bordetella pertussis
cugcaaggccggcgg

SEQ ID NO: 330760 - RNA, 14 nt, Bordetella pertussis
cugcaaggccugcu

SEQ ID NO: 330761 - RNA, 16 nt, Bordetella pertussis
cugcaaggccugcugc

SEQ ID NO: 330762 - RNA, 19 nt, Bordetella pertussis
cugcaaguccagcguggug

SEQ ID NO: 330763 - RNA, 16 nt, Bordetella pertussis
cugcaaugcggccagg

SEQ ID NO: 330764 - RNA, 17 nt, Bordetella pertussis
cugcaaugcggccaggc

SEQ ID NO: 330765 - RNA, 13 nt, Bordetella pertussis
cugcaccggcgcc

SEQ ID NO: 330766 - RNA, 17 nt, Bordetella pertussis
cugcaccggcgccacgg

SEQ ID NO: 330767 - RNA, 17 nt, Bordetella pertussis
cugcaccuugggcgccu

SEQ ID NO: 330768 - RNA, 13 nt, Bordetella pertussis
cugcacgaagcgg

SEQ ID NO: 330769 - RNA, 15 nt, Bordetella pertussis
cugcacgauggcgcc

SEQ ID NO: 330770 - RNA, 21 nt, Bordetella pertussis
cugcacgauguugccgccggc

SEQ ID NO: 330771 - RNA, 14 nt, Bordetella pertussis
cugcacgcagcgca

SEQ ID NO: 330772 - RNA, 15 nt, Bordetella pertussis
cugcacgccgggcgc

SEQ ID NO: 330773 - RNA, 20 nt, Bordetella pertussis
cugcacgccgggcgcgcugc

SEQ ID NO: 330774 - RNA, 22 nt, Bordetella pertussis
cugcacgcgcgcgggcgcgccg

SEQ ID NO: 330775 - RNA, 15 nt, Bordetella pertussis
cugcgauucgcgcuu

SEQ ID NO: 330776 - RNA, 23 nt, Bordetella pertussis
cugcgcacccgccuggacggcga

SEQ ID NO: 330777 - RNA, 20 nt, Bordetella pertussis
cugcgcagcagcgcgguggc

SEQ ID NO: 330778 - RNA, 23 nt, Bordetella pertussis
cugcgcagcagcgcgguggccag

SEQ ID NO: 330779 - RNA, 17 nt, Bordetella pertussis
cugcgcagcagggcggc

SEQ ID NO: 330780 - RNA, 19 nt, Bordetella pertussis
cugcgcagcagggcggcgg

SEQ ID NO: 330781 - RNA, 13 nt, Bordetella pertussis
cugcgcaggcgcc

SEQ ID NO: 330782 - RNA, 14 nt, Bordetella pertussis
cugcgcaggcgcgc

SEQ ID NO: 330783 - RNA, 21 nt, Bordetella pertussis
cugcgcaucgaucagcgcgcc

SEQ ID NO: 330784 - RNA, 22 nt, Bordetella pertussis
cugcgcaucgaucagcgcgccg

SEQ ID NO: 330785 - RNA, 17 nt, Bordetella pertussis
cugcgcaucgaugcggc

SEQ ID NO: 330786 - RNA, 16 nt, Bordetella pertussis
cugcgcauggcgucaa

SEQ ID NO: 330787 - RNA, 22 nt, Bordetella pertussis
cugcgcaugggcgcaggccgcc

SEQ ID NO: 330788 - RNA, 23 nt, Bordetella pertussis
cugcgcaugggcgcaggccgcca

SEQ ID NO: 330789 - RNA, 15 nt, Bordetella pertussis
cugcgcauggucgcg

SEQ ID NO: 330790 - RNA, 17 nt, Bordetella pertussis
cugcgcauggucgcgau

SEQ ID NO: 330791 - RNA, 12 nt, Bordetella pertussis
cugcgccaccgc

SEQ ID NO: 330792 - RNA, 18 nt, Bordetella pertussis
cugcgccaccgcaugggg

SEQ ID NO: 330793 - RNA, 17 nt, Bordetella pertussis
cugcgccaccuggcgcc

SEQ ID NO: 330794 - RNA, 17 nt, Bordetella pertussis
cugcgccacguccagca

SEQ ID NO: 330795 - RNA, 21 nt, Bordetella pertussis
cugcgccacguccagcacggc

SEQ ID NO: 330796 - RNA, 13 nt, Bordetella pertussis
cugcgccagccgc

SEQ ID NO: 330797 - RNA, 14 nt, Bordetella pertussis
cugcgccagccgcg

SEQ ID NO: 330798 - RNA, 19 nt, Bordetella pertussis
cugcgccagccgcgccugc

SEQ ID NO: 330799 - RNA, 12 nt, Bordetella pertussis
cugcgccagcgc

SEQ ID NO: 330800 - RNA, 13 nt, Bordetella pertussis
cugcgccagcgcc

SEQ ID NO: 330801 - RNA, 14 nt, Bordetella pertussis
cugcgccagcgccu

SEQ ID NO: 330802 - RNA, 12 nt, Bordetella pertussis
cugcgccagcuc

SEQ ID NO: 330803 - RNA, 23 nt, Bordetella pertussis
cugcgccagcuccagccgcaggc

SEQ ID NO: 330804 - RNA, 20 nt, Bordetella pertussis
cugcgccagcuuggccaggc

SEQ ID NO: 330805 - RNA, 23 nt, Bordetella pertussis
cugcgccaguugcggggcgccca

SEQ ID NO: 330806 - RNA, 17 nt, Bordetella pertussis
cugcgccauggcgcgca

SEQ ID NO: 330807 - RNA, 15 nt, Bordetella pertussis
cugcgccgaggcggg

SEQ ID NO: 330808 - RNA, 20 nt, Bordetella pertussis
cugcgccgaggcgggcagca

SEQ ID NO: 330809 - RNA, 14 nt, Bordetella pertussis
cugcgccgggcgcg

SEQ ID NO: 330810 - RNA, 20 nt, Bordetella pertussis
cugcgccgggcgcggccagg

SEQ ID NO: 330811 - RNA, 22 nt, Bordetella pertussis
cugcgccgggcgcggccaggcg

SEQ ID NO: 330812 - RNA, 13 nt, Bordetella pertussis
cugcgccgggucc

SEQ ID NO: 330813 - RNA, 18 nt, Bordetella pertussis
cugcgccggguccggccg

SEQ ID NO: 330814 - RNA, 21 nt, Bordetella pertussis
cugcgccggguccggccgcgc

SEQ ID NO: 330815 - RNA, 22 nt, Bordetella pertussis
cugcgccgucugugcgccccgc

SEQ ID NO: 330816 - RNA, 13 nt, Bordetella pertussis
cugcgccuggccg

SEQ ID NO: 330817 - RNA, 17 nt, Bordetella pertussis
cugcgccugggcggcgc

SEQ ID NO: 330818 - RNA, 18 nt, Bordetella pertussis
cugcgccugggcggcgca

SEQ ID NO: 330819 - RNA, 20 nt, Bordetella pertussis
cugcgccuuccgggcgaccc

SEQ ID NO: 330820 - RNA, 17 nt, Bordetella pertussis
cugcgccuuggcgcgca

SEQ ID NO: 330821 - RNA, 19 nt, Bordetella pertussis
cugcgccuuggcgcgcaga

SEQ ID NO: 330822 - RNA, 14 nt, Bordetella pertussis
cugcgcgaaacggc

SEQ ID NO: 330823 - RNA, 16 nt, Bordetella pertussis
cugcgcgaaacggccg

SEQ ID NO: 330824 - RNA, 17 nt, Bordetella pertussis
cugcgcgaaacggccgg

SEQ ID NO: 330825 - RNA, 21 nt, Bordetella pertussis
cugcgcgaaacggccgggucc

SEQ ID NO: 330826 - RNA, 13 nt, Bordetella pertussis
cugcgcgaacgcg

SEQ ID NO: 330827 - RNA, 16 nt, Bordetella pertussis
cugcgcgaacgcggcc

SEQ ID NO: 330828 - RNA, 13 nt, Bordetella pertussis
cugcgcgaagcgc

SEQ ID NO: 330829 - RNA, 15 nt, Bordetella pertussis
cugcgcgaccgccgc

SEQ ID NO: 330830 - RNA, 22 nt, Bordetella pertussis
cugcgcgacaaccgcggcgaca

SEQ ID NO: 330831 - RNA, 13 nt, Bordetella pertussis
cugcgcgaugcgc

SEQ ID NO: 330832 - RNA, 12 nt, Bordetella pertussis
cugcgcgccgcc

SEQ ID NO: 330833 - RNA, 15 nt, Bordetella pertussis
cugcgcgccgccggu

SEQ ID NO: 330834 - RNA, 11 nt, Bordetella pertussis
cugcgcgccgg

SEQ ID NO: 330835 - RNA, 16 nt, Bordetella pertussis
cugcgcgccggcaugg

SEQ ID NO: 330836 - RNA, 14 nt, Bordetella pertussis
cugcgcgccggcgc

SEQ ID NO: 330837 - RNA, 13 nt, Bordetella pertussis
cugcgcgccgggu

SEQ ID NO: 330838 - RNA, 13 nt, Bordetella pertussis
cugcgcgccgugg

SEQ ID NO: 330839 - RNA, 15 nt, Bordetella pertussis
cugcgcgcgagcggc

SEQ ID NO: 330840 - RNA, 12 nt, Bordetella pertussis
cugcgcgcgcca

SEQ ID NO: 330841 - RNA, 20 nt, Bordetella pertussis
cugcgcgcgcuggggcagca

SEQ ID NO: 330842 - RNA, 15 nt, Bordetella pertussis
cugcgcgcggccugg

SEQ ID NO: 330843 - RNA, 16 nt, Bordetella pertussis
cugcgcgcggccuggc

SEQ ID NO: 330844 - RNA, 12 nt, Bordetella pertussis
cugcgcggcggu

SEQ ID NO: 330845 - RNA, 19 nt, Bordetella pertussis
cugcgcggcuuuuucucgg

SEQ ID NO: 330846 - RNA, 20 nt, Bordetella pertussis
cugcgcggcuuuuucucggc

SEQ ID NO: 330847 - RNA, 15 nt, Bordetella pertussis
cugcgcggguccggc

SEQ ID NO: 330848 - RNA, 16 nt, Bordetella pertussis
cugcgcguccuggcgc

SEQ ID NO: 330849 - RNA, 18 nt, Bordetella pertussis
cugcgcguccuggcgcga

SEQ ID NO: 330850 - RNA, 14 nt, Bordetella pertussis
cugcgcgugcacga

SEQ ID NO: 330851 - RNA, 22 nt, Bordetella pertussis
cugcgcguugagcagcaugugc

SEQ ID NO: 330852 - RNA, 19 nt, Bordetella pertussis
cugcgcuaugggggcgagc

SEQ ID NO: 330853 - RNA, 15 nt, Bordetella pertussis
cugcgcuggccgcga

SEQ ID NO: 330854 - RNA, 17 nt, Bordetella pertussis
cugcgcuugaccgccuc

SEQ ID NO: 330855 - RNA, 13 nt, Bordetella pertussis
cugcggaaacaga

SEQ ID NO: 330856 - RNA, 23 nt, Bordetella pertussis
cugcggacccaguucggccgcca

SEQ ID NO: 330857 - RNA, 17 nt, Bordetella pertussis
cugcggcaccucggccg

SEQ ID NO: 330858 - RNA, 15 nt, Bordetella pertussis
cugcggcacggccag

SEQ ID NO: 330859 - RNA, 21 nt, Bordetella pertussis
cugcggcacggccagcggcga

SEQ ID NO: 330860 - RNA, 15 nt, Bordetella pertussis
cugcggcccgagcca

SEQ ID NO: 330861 - RNA, 12 nt, Bordetella pertussis
cugcggcgccag

SEQ ID NO: 330862 - RNA, 15 nt, Bordetella pertussis
cugcggcgccagcgc

SEQ ID NO: 330863 - RNA, 16 nt, Bordetella pertussis
cugcggcgcggccgac

SEQ ID NO: 330864 - RNA, 23 nt, Bordetella pertussis
cugcggcgcggccgacguggacc

SEQ ID NO: 330865 - RNA, 17 nt, Bordetella pertussis
cugcggcgcggugucgg

SEQ ID NO: 330866 - RNA, 13 nt, Bordetella pertussis
cugcggcuccugc

SEQ ID NO: 330867 - RNA, 15 nt, Bordetella pertussis
cugcggcuccugcug

SEQ ID NO: 330868 - RNA, 19 nt, Bordetella pertussis
cugcggcuccugcuggcgc

SEQ ID NO: 330869 - RNA, 14 nt, Bordetella pertussis
cugcggcguggcgu

SEQ ID NO: 330870 - RNA, 20 nt, Bordetella pertussis
cugcggcugaucaccgccgg

SEQ ID NO: 330871 - RNA, 21 nt, Bordetella pertussis
cugcggcuugggcccggcgua

SEQ ID NO: 330872 - RNA, 17 nt, Bordetella pertussis
cugcgggcgcagcgccg

SEQ ID NO: 330873 - RNA, 18 nt, Bordetella pertussis
cugcgggcgccgcggggc

SEQ ID NO: 330874 - RNA, 15 nt, Bordetella pertussis
cugcgggccggcgcc

SEQ ID NO: 330875 - RNA, 15 nt, Bordetella pertussis
cugcgggcggccugg

SEQ ID NO: 330876 - RNA, 19 nt, Bordetella pertussis
cugcggggacaggcacccg

SEQ ID NO: 330877 - RNA, 21 nt, Bordetella pertussis
cugcggggacaggcacccggg

SEQ ID NO: 330878 - RNA, 21 nt, Bordetella pertussis
cugcggucgcgaucgucgacc

SEQ ID NO: 330879 - RNA, 23 nt, Bordetella pertussis
cugcguaucaacuuccagcgccc

SEQ ID NO: 330880 - RNA, 23 nt, Bordetella pertussis
cugcgucacgaaagcgcccaggc

SEQ ID NO: 330881 - RNA, 15 nt, Bordetella pertussis
cugcguccaccacca

SEQ ID NO: 330882 - RNA, 23 nt, Bordetella pertussis
cugcguccaccaccaggccggcc

SEQ ID NO: 330883 - RNA, 22 nt, Bordetella pertussis
cugcguccuugaggaacuggac

SEQ ID NO: 330884 - RNA, 14 nt, Bordetella pertussis
cugcgucgccaccu

SEQ ID NO: 330885 - RNA, 12 nt, Bordetella pertussis
cugcgugcgcgg

SEQ ID NO: 330886 - RNA, 13 nt, Bordetella pertussis
cugcgugcgcggc

SEQ ID NO: 330887 - RNA, 15 nt, Bordetella pertussis
cugcgugcgggacag

SEQ ID NO: 330888 - RNA, 22 nt, Bordetella pertussis
cugcgugcgggacaggcaucag

SEQ ID NO: 330889 - RNA, 15 nt, Bordetella pertussis
cugcguggcggcguc

SEQ ID NO: 330890 - RNA, 16 nt, Bordetella pertussis
cugcguggcggcgucg

SEQ ID NO: 330891 - RNA, 14 nt, Bordetella pertussis
cugcgugugccgcc

SEQ ID NO: 330892 - RNA, 22 nt, Bordetella pertussis
cugcuaguacaccgucgcgcgc

SEQ ID NO: 330893 - RNA, 16 nt, Bordetella pertussis
cugcucaacggccacc

SEQ ID NO: 330894 - RNA, 17 nt, Bordetella pertussis
cugcucaacggccacca

SEQ ID NO: 330895 - RNA, 15 nt, Bordetella pertussis
cugcucacgccccgc

SEQ ID NO: 330896 - RNA, 20 nt, Bordetella pertussis
cugcuaugccguggacgugc

SEQ ID NO: 330897 - RNA, 16 nt, Bordetella pertussis
cugcuccacgugcggc

SEQ ID NO: 330898 - RNA, 13 nt, Bordetella pertussis
cugcucgagcggc

SEQ ID NO: 330899 - RNA, 18 nt, Bordetella pertussis
cugcucgaucugguuggc

SEQ ID NO: 330900 - RNA, 23 nt, Bordetella pertussis
cugcucgcccacauagcggccgg

SEQ ID NO: 330901 - RNA, 17 nt, Bordetella pertussis
cugcucgcaggccugcu

SEQ ID NO: 330902 - RNA, 13 nt, Bordetella pertussis
cugcucgccgcgc

SEQ ID NO: 330903 - RNA, 17 nt, Bordetella pertussis
cugcucgccgcgcgaca

SEQ ID NO: 330904 - RNA, 17 nt, Bordetella pertussis
cugcucgccggccagcg

SEQ ID NO: 330905 - RNA, 19 nt, Bordetella pertussis
cugcucggugcucuggccc

SEQ ID NO: 330906 - RNA, 17 nt, Bordetella pertussis
cugcucguucugcgcgc

SEQ ID NO: 330907 - RNA, 21 nt, Bordetella pertussis
cugcucguucugcgcgcccgu

SEQ ID NO: 330908 - RNA, 18 nt, Bordetella pertussis
cugcucuuggcgccggac

SEQ ID NO: 330909 - RNA, 18 nt, Bordetella pertussis
cugcugacaggcgucugc

SEQ ID NO: 330910 - RNA, 15 nt, Bordetella pertussis
cugcugaccgacggc

SEQ ID NO: 330911 - RNA, 19 nt, Bordetella pertussis
cugcugaccgacggccugg

SEQ ID NO: 330912 - RNA, 17 nt, Bordetella pertussis
cugcugacugugcagcc

SEQ ID NO: 330913 - RNA, 14 nt, Bordetella pertussis
cugcugcaaggaca

SEQ ID NO: 330914 - RNA, 21 nt, Bordetella pertussis
cugcugcacgugaugcaggcg

SEQ ID NO: 330915 - RNA, 13 nt, Bordetella pertussis
cugcugcagccac

SEQ ID NO: 330916 - RNA, 17 nt, Bordetella pertussis
cugcugcaggccggcgc

SEQ ID NO: 330917 - RNA, 20 nt, Bordetella pertussis
cugcugcccgaagcgcagca

SEQ ID NO: 330918 - RNA, 16 nt, Bordetella pertussis
cugcugcccgccgccg

SEQ ID NO: 330919 - RNA, 20 nt, Bordetella pertussis
cugcugcccgccgccgccca

SEQ ID NO: 330920 - RNA, 22 nt, Bordetella pertussis
cugcugcccgccgccgcccacg

SEQ ID NO: 330921 - RNA, 22 nt, Bordetella pertussis
cugcugccggauuggcgcugca

SEQ ID NO: 330922 - RNA, 22 nt, Bordetella pertussis
cugcugcgagacgcgcucgcgc

SEQ ID NO: 330923 - RNA, 14 nt, Bordetella pertussis
cugcugcgccgucu

SEQ ID NO: 330924 - RNA, 22 nt, Bordetella pertussis
cugcugcgccuggccgcgcuga

SEQ ID NO: 330925 - RNA, 13 nt, Bordetella pertussis
cugcugcggcacg

SEQ ID NO: 330926 - RNA, 20 nt, Bordetella pertussis
cugcugcggcacggccagcg

SEQ ID NO: 330927 - RNA, 12 nt, Bordetella pertussis
cugcugcuggcu

SEQ ID NO: 330928 - RNA, 18 nt, Bordetella pertussis
cugcuggaacaccaugcc

SEQ ID NO: 330929 - RNA, 17 nt, Bordetella pertussis
cugcuggagaucgccga

SEQ ID NO: 330930 - RNA, 15 nt, Bordetella pertussis
cugcuggaggccggc

SEQ ID NO: 330931 - RNA, 18 nt, Bordetella pertussis
cugcuggaggccggcgug

SEQ ID NO: 330932 - RNA, 14 nt, Bordetella pertussis
cugcuggccaagcg

SEQ ID NO: 330933 - RNA, 17 nt, Bordetella pertussis
cugcuggccaccgucgc

SEQ ID NO: 330934 - RNA, 16 nt, Bordetella pertussis
cugcuggccgccggcg

SEQ ID NO: 330935 - RNA, 13 nt, Bordetella pertussis
cugcuggccggcc

SEQ ID NO: 330936 - RNA, 16 nt, Bordetella pertussis
cugcuggccggccagc

SEQ ID NO: 330937 - RNA, 16 nt, Bordetella pertussis
cugcuggccggcccca

SEQ ID NO: 330938 - RNA, 23 nt, Bordetella pertussis
cugcuggcgcgcaccaucgccga

SEQ ID NO: 330939 - RNA, 18 nt, Bordetella pertussis
cugcuggcgcgucggcgc

SEQ ID NO: 330940 - RNA, 16 nt, Bordetella pertussis
cugcuggcugcccugg

SEQ ID NO: 330941 - RNA, 19 nt, Bordetella pertussis
cugcuggcuucggcgcugg

SEQ ID NO: 330942 - RNA, 18 nt, Bordetella pertussis
cugcugggccgcgcucga

SEQ ID NO: 330943 - RNA, 20 nt, Bordetella pertussis
cugcugggccggcgcgcgca

SEQ ID NO: 330944 - RNA, 14 nt, Bordetella pertussis
cugcugggcgccau

SEQ ID NO: 330945 - RNA, 23 nt, Bordetella pertussis
cugcugggcgccaugcgcccggc

SEQ ID NO: 330946 - RNA, 20 nt, Bordetella pertussis
cugcugggguggagcgcggc

SEQ ID NO: 330947 - RNA, 22 nt, Bordetella pertussis
cugcugggguggagcgcggcgc

SEQ ID NO: 330948 - RNA, 20 nt, Bordetella pertussis
cugcugguacagccccagcg

SEQ ID NO: 330949 - RNA, 17 nt, Bordetella pertussis
cugcuggugcuggugcu

SEQ ID NO: 330950 - RNA, 15 nt, Bordetella pertussis
cugcuugaggccgcg

SEQ ID NO: 330951 - RNA, 18 nt, Bordetella pertussis
cugcuugaggccgcgcgc

SEQ ID NO: 330952 - RNA, 20 nt, Bordetella pertussis
cugcuugaggccgcgcgccu

SEQ ID NO: 330953 - RNA, 20 nt, Bordetella pertussis
cugcuugaagacgcccaggu

SEQ ID NO: 330954 - RNA, 14 nt, Bordetella pertussis
cugcuugcccagca

SEQ ID NO: 330955 - RNA, 14 nt, Bordetella pertussis
cugcuugcccagcg

SEQ ID NO: 330956 - RNA, 18 nt, Bordetella pertussis
cugcuugcccaggccggc

SEQ ID NO: 330957 - RNA, 19 nt, Bordetella pertussis
cugcuugcccaggccggcg

SEQ ID NO: 330958 - RNA, 14 nt, Bordetella pertussis
cuggaacggugcga

SEQ ID NO: 330959 - RNA, 20 nt, Bordetella pertussis
cuggaagauguaccagccca

SEQ ID NO: 330960 - RNA, 16 nt, Bordetella pertussis
cuggaagcgcgccagg

SEQ ID NO: 330961 - RNA, 19 nt, Bordetella pertussis
cuggaagcgcgccaggcgc

SEQ ID NO: 330962 - RNA, 21 nt, Bordetella pertussis
cuggaagcgcgccaggcgcau

SEQ ID NO: 330963 - RNA, 16 nt, Bordetella pertussis
cuggaagcugcggccg

SEQ ID NO: 330964 - RNA, 20 nt, Bordetella pertussis
cuggaccccuugcggccgcc

SEQ ID NO: 330965 - RNA, 16 nt, Bordetella pertussis
cuggacccgcucgacc

SEQ ID NO: 330966 - RNA, 12 nt, Bordetella pertussis
cuggaccgcgcc

SEQ ID NO: 330967 - RNA, 14 nt, Bordetella pertussis
cuggaccgcgccug

SEQ ID NO: 330968 - RNA, 14 nt, Bordetella pertussis
cuggaccgcgcgcg

SEQ ID NO: 330969 - RNA, 22 nt, Bordetella pertussis
cuggaccgcgcgcgacgacagc

SEQ ID NO: 330970 - RNA, 20 nt, Bordetella pertussis
cuggaccugagccaggcgcc

SEQ ID NO: 330971 - RNA, 14 nt, Bordetella pertussis
cuggaccuggacga

SEQ ID NO: 330972 - RNA, 20 nt, Bordetella pertussis
cuggaccuggccaccaacga

SEQ ID NO: 330973 - RNA, 18 nt, Bordetella pertussis
cuggaugugcgcgggcgc

SEQ ID NO: 330974 - RNA, 20 nt, Bordetella pertussis
cuggaugugcgcgggcgcgg

SEQ ID NO: 330975 - RNA, 21 nt, Bordetella pertussis
cuggcaacgggucgcgcagca

SEQ ID NO: 330976 - RNA, 20 nt, Bordetella pertussis
cuggcaacguugcugcagcg

SEQ ID NO: 330977 - RNA, 15 nt, Bordetella pertussis
cuggcaaucggggug

SEQ ID NO: 330978 - RNA, 14 nt, Bordetella pertussis
cuggcacaccagcg

SEQ ID NO: 330979 - RNA, 17 nt, Bordetella pertussis
cuggcacaccagcgcca

SEQ ID NO: 330980 - RNA, 18 nt, Bordetella pertussis
cuggcacaccagcgccag

SEQ ID NO: 330981 - RNA, 19 nt, Bordetella pertussis
cuggcaaugcguggccggc

SEQ ID NO: 330982 - RNA, 13 nt, Bordetella pertussis
cuggcacaucggc

SEQ ID NO: 330983 - RNA, 12 nt, Bordetella pertussis
cuggcacccgca

SEQ ID NO: 330984 - RNA, 12 nt, Bordetella pertussis
cuggcacccgcc

SEQ ID NO: 330985 - RNA, 16 nt, Bordetella pertussis
cuggcaccggccaagc

SEQ ID NO: 330986 - RNA, 15 nt, Bordetella pertussis
cuggcaccggccgac

SEQ ID NO: 330987 - RNA, 16 nt, Bordetella pertussis
cuggcaccggccgacc

SEQ ID NO: 330988 - RNA, 16 nt, Bordetella pertussis
cuggcaucgucgcgcu

SEQ ID NO: 330989 - RNA, 18 nt, Bordetella pertussis
cuggcaucgucgcgcugc

SEQ ID NO: 330990 - RNA, 20 nt, Bordetella pertussis
cuggcaugugccaccgccca

SEQ ID NO: 330991 - RNA, 16 nt, Bordetella pertussis
cuggccaagcgcgccg

SEQ ID NO: 330992 - RNA, 13 nt, Bordetella pertussis
cuggccacaagcg

SEQ ID NO: 330993 - RNA, 16 nt, Bordetella pertussis
cuggccauagggcgac

SEQ ID NO: 330994 - RNA, 17 nt, Bordetella pertussis
cuggccaugccgucgcg

SEQ ID NO: 330995 - RNA, 20 nt, Bordetella pertussis
cuggcccacaucgucgcgcu

SEQ ID NO: 330996 - RNA, 13 nt, Bordetella pertussis
cuggcccagcgca

SEQ ID NO: 330997 - RNA, 16 nt, Bordetella pertussis
cuggcccagcuccagc

SEQ ID NO: 330998 - RNA, 17 nt, Bordetella pertussis
cuggcccagcuccagcu

SEQ ID NO: 330999 - RNA, 21 nt, Bordetella pertussis
cuggcccagcuccagcuggcg

SEQ ID NO: 331000 - RNA, 15 nt, Bordetella pertussis
cuggcccagcugggc

SEQ ID NO: 331001 - RNA, 13 nt, Bordetella pertussis
cuggcccaggccg

SEQ ID NO: 331002 - RNA, 15 nt, Bordetella pertussis
cuggcccaggccgaa

SEQ ID NO: 331003 - RNA, 22 nt, Bordetella pertussis
cuggcccacucggugcgcgcgc

SEQ ID NO: 331004 - RNA, 14 nt, Bordetella pertussis
cuggcccacgcgca

SEQ ID NO: 331005 - RNA, 16 nt, Bordetella pertussis
cuggcccacgcgcacg

SEQ ID NO: 331006 - RNA, 15 nt, Bordetella pertussis
cuggccccaggcgcc

SEQ ID NO: 331007 - RNA, 15 nt, Bordetella pertussis
cuggccgacgggugg

SEQ ID NO: 331008 - RNA, 15 nt, Bordetella pertussis
cuggccgagcgcggc

SEQ ID NO: 331009 - RNA, 22 nt, Bordetella pertussis
cuggccgagcgcggcaugcgca

SEQ ID NO: 331010 - RNA, 15 nt, Bordetella pertussis
cuggccgaucaccug

SEQ ID NO: 331011 - RNA, 17 nt, Bordetella pertussis
cuggccgaucaccugca

SEQ ID NO: 331012 - RNA, 21 nt, Bordetella pertussis
cuggccgaucaccugcaggcc

SEQ ID NO: 331013 - RNA, 19 nt, Bordetella pertussis
cuggccgaucugcugggcc

SEQ ID NO: 331014 - RNA, 17 nt, Bordetella pertussis
cuggccgauggccucgc

SEQ ID NO: 331015 - RNA, 17 nt, Bordetella pertussis
cuggccgauggucagca

SEQ ID NO: 331016 - RNA, 21 nt, Bordetella pertussis
cuggccgaugucgccgccugc

SEQ ID NO: 331017 - RNA, 20 nt, Bordetella pertussis
cuggccgauuucgcgcgcca

SEQ ID NO: 331018 - RNA, 15 nt, Bordetella pertussis
cuggccgccauggcg

SEQ ID NO: 331019 - RNA, 21 nt, Bordetella pertussis
cuggccgccauggcgcuggca

SEQ ID NO: 331020 - RNA, 14 nt, Bordetella pertussis
cuggccgcccgcgg

SEQ ID NO: 331021 - RNA, 18 nt, Bordetella pertussis
cuggccgccgcgcucacc

SEQ ID NO: 331022 - RNA, 18 nt, Bordetella pertussis
cuggccgccgcgggcgcc

SEQ ID NO: 331023 - RNA, 19 nt, Bordetella pertussis
cuggccgccgcgggcgccg

SEQ ID NO: 331024 - RNA, 19 nt, Bordetella pertussis
cuggccgcccagcgccugc

SEQ ID NO: 331025 - RNA, 13 nt, Bordetella pertussis
cuggccgcgccgc

SEQ ID NO: 331026 - RNA, 19 nt, Bordetella pertussis
cuggccgcgccgcuggcgg

SEQ ID NO: 331027 - RNA, 16 nt, Bordetella pertussis
cuggccgcgccguucg

SEQ ID NO: 331028 - RNA, 22 nt, Bordetella pertussis
cuggccgcgcccgccgcgccau

SEQ ID NO: 331029 - RNA, 13 nt, Bordetella pertussis
cuggccgcgcgcc

SEQ ID NO: 331030 - RNA, 17 nt, Bordetella pertussis
cuggccgcgcgccugcu

SEQ ID NO: 331031 - RNA, 15 nt, Bordetella pertussis
cuggccgcgcucagg

SEQ ID NO: 331032 - RNA, 19 nt, Bordetella pertussis
cuggccgcgcucaggccgc

SEQ ID NO: 331033 - RNA, 21 nt, Bordetella pertussis
cuggccggccaacagcucgcg

SEQ ID NO: 331034 - RNA, 13 nt, Bordetella pertussis
cuggccggccagc

SEQ ID NO: 331035 - RNA, 15 nt, Bordetella pertussis
cuggccggccuggcg

SEQ ID NO: 331036 - RNA, 12 nt, Bordetella pertussis
cuggccggcgcc

SEQ ID NO: 331037 - RNA, 13 nt, Bordetella pertussis
cuggccggcgccg

SEQ ID NO: 331038 - RNA, 19 nt, Bordetella pertussis
cuggccggcguggccugcc

SEQ ID NO: 331039 - RNA, 20 nt, Bordetella pertussis
cuggccggcuugcauggugc

SEQ ID NO: 331040 - RNA, 20 nt, Bordetella pertussis
cuggccggggaagccgccgg

SEQ ID NO: 331041 - RNA, 18 nt, Bordetella pertussis
cuggccguacauggccag

SEQ ID NO: 331042 - RNA, 22 nt, Bordetella pertussis
cuggccgucgaacuccucgacg

SEQ ID NO: 331043 - RNA, 23 nt, Bordetella pertussis
cuggcgcggcgccugcgcgcgcu

SEQ ID NO: 331044 - RNA, 18 nt, Bordetella pertussis
cuggcgcggcggccaggc

SEQ ID NO: 331045 - RNA, 23 nt, Bordetella pertussis
cuggcgcggcuggcgauggugga

SEQ ID NO: 331046 - RNA, 19 nt, Bordetella pertussis
cuggcgcgggcggccuauc

SEQ ID NO: 331047 - RNA, 18 nt, Bordetella pertussis
cuggcgcgguccacgcgg

SEQ ID NO: 331048 - RNA, 22 nt, Bordetella pertussis
cuggcgcgguccacgcgggcau

SEQ ID NO: 331049 - RNA, 15 nt, Bordetella pertussis
cuggcgcgucaggcc

SEQ ID NO: 331050 - RNA, 16 nt, Bordetella pertussis
cuggcgcgucggcgcg

SEQ ID NO: 331051 - RNA, 16 nt, Bordetella pertussis
cuggcgcguggccgcc

SEQ ID NO: 331052 - RNA, 23 nt, Bordetella pertussis
cuggcgcguggccgccacgccuu

SEQ ID NO: 331053 - RNA, 16 nt, Bordetella pertussis
cuggcgcuccucgcgc

SEQ ID NO: 331054 - RNA, 22 nt, Bordetella pertussis
cuggcgcuccucgcgcgcggac

SEQ ID NO: 331055 - RNA, 14 nt, Bordetella pertussis
cuggcgcugcagcg

SEQ ID NO: 331056 - RNA, 16 nt, Bordetella pertussis
cuggcgcugccgacca

SEQ ID NO: 331057 - RNA, 19 nt, Bordetella pertussis
cuggcgcugccgaccagca

SEQ ID NO: 331058 - RNA, 21 nt, Bordetella pertussis
cuggcgcuguuucccuuccug

SEQ ID NO: 331059 - RNA, 17 nt, Bordetella pertussis
cuggcgcuugcccgugc

SEQ ID NO: 331060 - RNA, 18 nt, Bordetella pertussis
cuggcgcuugcccgugcg

SEQ ID NO: 331061 - RNA, 14 nt, Bordetella pertussis
cuggcgcuuggcca

SEQ ID NO: 331062 - RNA, 23 nt, Bordetella pertussis
cuggcgcuuggccagcuggcgcg

SEQ ID NO: 331063 - RNA, 20 nt, Bordetella pertussis
cuggcggaucucggccagca

SEQ ID NO: 331064 - RNA, 17 nt, Bordetella pertussis
cuggcggccgcgggcgu

SEQ ID NO: 331065 - RNA, 13 nt, Bordetella pertussis
cuggcggcccugc

SEQ ID NO: 331066 - RNA, 17 nt, Bordetella pertussis
cuggcggcgcagcacca

SEQ ID NO: 331067 - RNA, 19 nt, Bordetella pertussis
cuggcggcgcagcaccagg

SEQ ID NO: 331068 - RNA, 23 nt, Bordetella pertussis
cuggcggcgcaggccgcgccggc

SEQ ID NO: 331069 - RNA, 13 nt, Bordetella pertussis
cuggcggcgcgcu

SEQ ID NO: 331070 - RNA, 20 nt, Bordetella pertussis
cuggcguaugcccacucccg

SEQ ID NO: 331071 - RNA, 16 nt, Bordetella pertussis
cuggcguggccguucg

SEQ ID NO: 331072 - RNA, 16 nt, Bordetella pertussis
cuggcguggcgcgcgc

SEQ ID NO: 331073 - RNA, 18 nt, Bordetella pertussis
cuggcguggcgcgcgccg

SEQ ID NO: 331074 - RNA, 19 nt, Bordetella pertussis
cuggcguggcgcgcgccga

SEQ ID NO: 331075 - RNA, 18 nt, Bordetella pertussis
cuggcguucagcgggcgc

SEQ ID NO: 331076 - RNA, 16 nt, Bordetella pertussis
cuggcucaggccugca

SEQ ID NO: 331077 - RNA, 14 nt, Bordetella pertussis
cuggcuccccgggc

SEQ ID NO: 331078 - RNA, 15 nt, Bordetella pertussis
cuggcucccaccggu

SEQ ID NO: 331079 - RNA, 21 nt, Bordetella pertussis
cuggcucguucgcucggcguc

SEQ ID NO: 331080 - RNA, 17 nt, Bordetella pertussis
cuggcucugaucgcgcu

SEQ ID NO: 331081 - RNA, 14 nt, Bordetella pertussis
cuggcugcccuggc

SEQ ID NO: 331082 - RNA, 14 nt, Bordetella pertussis
cuggcugcgcgccu

SEQ ID NO: 331083 - RNA, 15 nt, Bordetella pertussis
cuggcugcgcgccug

SEQ ID NO: 331084 - RNA, 14 nt, Bordetella pertussis
cuggcuggacgcgc

SEQ ID NO: 331085 - RNA, 22 nt, Bordetella pertussis
cuggcugggccugcugucgcug

SEQ ID NO: 331086 - RNA, 15 nt, Bordetella pertussis
cuggcugggcgcgcc

SEQ ID NO: 331087 - RNA, 16 nt, Bordetella pertussis
cuggcugggcgcgccg

SEQ ID NO: 331088 - RNA, 17 nt, Bordetella pertussis
cugggccggcgcgcgca

SEQ ID NO: 331089 - RNA, 14 nt, Bordetella pertussis
cugggccucggcca

SEQ ID NO: 331090 - RNA, 16 nt, Bordetella pertussis
cugggccucggccagc

SEQ ID NO: 331091 - RNA, 17 nt, Bordetella pertussis
cugggccucggccagcu

SEQ ID NO: 331092 - RNA, 22 nt, Bordetella pertussis
cugggccugcggcgucaggccg

SEQ ID NO: 331093 - RNA, 19 nt, Bordetella pertussis
cugggccugcugucgcugg

SEQ ID NO: 331094 - RNA, 19 nt, Bordetella pertussis
cugggccugguacaggccg

SEQ ID NO: 331095 - RNA, 17 nt, Bordetella pertussis
cugggcgaaacggccag

SEQ ID NO: 331096 - RNA, 18 nt, Bordetella pertussis
cugggcgaauccaccggc

SEQ ID NO: 331097 - RNA, 16 nt, Bordetella pertussis
cugggcgaggcgcugg

SEQ ID NO: 331098 - RNA, 20 nt, Bordetella pertussis
cugggcgagguagggcgcgg

SEQ ID NO: 331099 - RNA, 13 nt, Bordetella pertussis
cugggcgccagca

SEQ ID NO: 331100 - RNA, 22 nt, Bordetella pertussis
cugggcgccagcagcacgucgu

SEQ ID NO: 331101 - RNA, 13 nt, Bordetella pertussis
cugggcgccggcg

SEQ ID NO: 331102 - RNA, 15 nt, Bordetella pertussis
cugggcgccggcggc

SEQ ID NO: 331103 - RNA, 20 nt, Bordetella pertussis
cugggcgcgaugggccugcc

SEQ ID NO: 331104 - RNA, 22 nt, Bordetella pertussis
cugggcgcgaugggccugccca

SEQ ID NO: 331105 - RNA, 21 nt, Bordetella pertussis
cugggcgcgcacaagcgcgaa

SEQ ID NO: 331106 - RNA, 18 nt, Bordetella pertussis
cugggcgcggcgguggcg

SEQ ID NO: 331107 - RNA, 17 nt, Bordetella pertussis
cugggcgcgguccagca

SEQ ID NO: 331108 - RNA, 18 nt, Bordetella pertussis
cugggcgcgucguacugg

SEQ ID NO: 331109 - RNA, 19 nt, Bordetella pertussis
cugggcggauuggacagca

SEQ ID NO: 331110 - RNA, 16 nt, Bordetella pertussis
cugggcggccuuggcc

SEQ ID NO: 331111 - RNA, 17 nt, Bordetella pertussis
cugggcggccuuggccg

SEQ ID NO: 331112 - RNA, 19 nt, Bordetella pertussis
cugggcggccuuggccgca

SEQ ID NO: 331113 - RNA, 20 nt, Bordetella pertussis
cugggcggccuuggccgcag

SEQ ID NO: 331114 - RNA, 12 nt, Bordetella pertussis
cugggcggcggc

SEQ ID NO: 331115 - RNA, 12 nt, Bordetella pertussis
cuggggccgcgg

SEQ ID NO: 331116 - RNA, 20 nt, Bordetella pertussis
cuggggccgcggcgcgcgcg

SEQ ID NO: 331117 - RNA, 22 nt, Bordetella pertussis
cuggggcgggcgcugcgcgaac

SEQ ID NO: 331118 - RNA, 17 nt, Bordetella pertussis
cuggggcgggcgggcgc

SEQ ID NO: 331119 - RNA, 19 nt, Bordetella pertussis
cuggggcgggcgggcgcaa

SEQ ID NO: 331120 - RNA, 14 nt, Bordetella pertussis
cuggggcugcuggg

SEQ ID NO: 331121 - RNA, 15 nt, Bordetella pertussis
cuggggggucaacca

SEQ ID NO: 331122 - RNA, 22 nt, Bordetella pertussis
cuggggugccuguccccgcagg

SEQ ID NO: 331123 - RNA, 17 nt, Bordetella pertussis
cugggucaucagcacga

SEQ ID NO: 331124 - RNA, 15 nt, Bordetella pertussis
cugguagugcaggcc

SEQ ID NO: 331125 - RNA, 20 nt, Bordetella pertussis
cuggucaagggcggccaugc

SEQ ID NO: 331126 - RNA, 16 nt, Bordetella pertussis
cuggucacccggcgca

SEQ ID NO: 331127 - RNA, 17 nt, Bordetella pertussis
cuggucaccgccccgac

SEQ ID NO: 331128 - RNA, 16 nt, Bordetella pertussis
cuggucagccuggggc

SEQ ID NO: 331129 - RNA, 16 nt, Bordetella pertussis
cuggucagcgccgacg

SEQ ID NO: 331130 - RNA, 20 nt, Bordetella pertussis
cuggucagguugcgccggcu

SEQ ID NO: 331131 - RNA, 14 nt, Bordetella pertussis
cuggucaucgccau

SEQ ID NO: 331132 - RNA, 22 nt, Bordetella pertussis
cuggucaucgccaugcugccaa

SEQ ID NO: 331133 - RNA, 19 nt, Bordetella pertussis
cuggucaucuacagcgccu

SEQ ID NO: 331134 - RNA, 18 nt, Bordetella pertussis
cuggucaugacgggcggc

SEQ ID NO: 331135 - RNA, 14 nt, Bordetella pertussis
cugguccacggcgg

SEQ ID NO: 331136 - RNA, 14 nt, Bordetella pertussis
cugguccgccgccg

SEQ ID NO: 331137 - RNA, 15 nt, Bordetella pertussis
cugguccugcgugau

SEQ ID NO: 331138 - RNA, 13 nt, Bordetella pertussis
cugguccugggcc

SEQ ID NO: 331139 - RNA, 14 nt, Bordetella pertussis
cugguccugggccg

SEQ ID NO: 331140 - RNA, 18 nt, Bordetella pertussis
cuggucgaacguggcggc

SEQ ID NO: 331141 - RNA, 23 nt, Bordetella pertussis
cuggucgaacucgaacacgccga

SEQ ID NO: 331142 - RNA, 17 nt, Bordetella pertussis
cuggucgaccaggccgg

SEQ ID NO: 331143 - RNA, 23 nt, Bordetella pertussis
cuggucgacccacuugagcagcg

SEQ ID NO: 331144 - RNA, 15 nt, Bordetella pertussis
cuguaucugcgccgu

SEQ ID NO: 331145 - RNA, 16 nt, Bordetella pertussis
cuguaucuggccuguc

SEQ ID NO: 331146 - RNA, 16 nt, Bordetella pertussis
cuguccggcgcuggcu

SEQ ID NO: 331147 - RNA, 16 nt, Bordetella pertussis
cuguccuucguggcgc

SEQ ID NO: 331148 - RNA, 21 nt, Bordetella pertussis
cuguccugauucacaggcccg

SEQ ID NO: 331149 - RNA, 20 nt, Bordetella pertussis
cugucguucguauugcugcu

SEQ ID NO: 331150 - RNA, 23 nt, Bordetella pertussis
cugugcagccacgccuggccgcg

SEQ ID NO: 331151 - RNA, 16 nt, Bordetella pertussis
cuguggacgccgccgg

SEQ ID NO: 331152 - RNA, 15 nt, Bordetella pertussis
cuguggcgcacccug

SEQ ID NO: 331153 - RNA, 17 nt, Bordetella pertussis
cugugggggacaggcac

SEQ ID NO: 331154 - RNA, 21 nt, Bordetella pertussis
cugugggggacaggcacgccg

SEQ ID NO: 331155 - RNA, 18 nt, Bordetella pertussis
cugugggggcgcggcggc

SEQ ID NO: 331156 - RNA, 14 nt, Bordetella pertussis
cuguuggccggcgc

SEQ ID NO: 331157 - RNA, 18 nt, Bordetella pertussis
cuguuggccgucgccagc

SEQ ID NO: 331158 - RNA, 19 nt, Bordetella pertussis
cuguuggccgucgccagcg

SEQ ID NO: 331159 - RNA, 17 nt, Bordetella pertussis
cuuaccgcgccggcucg

SEQ ID NO: 331160 - RNA, 20 nt, Bordetella pertussis
cuuacggauaauugggcggc

SEQ ID NO: 331161 - RNA, 17 nt, Bordetella pertussis
cuuaucgcggcgcggcg

SEQ ID NO: 331162 - RNA, 16 nt, Bordetella pertussis
cuucacauagcccggc

SEQ ID NO: 331163 - RNA, 16 nt, Bordetella pertussis
cuuccagcagcaugcc

SEQ ID NO: 331164 - RNA, 16 nt, Bordetella pertussis
cuuccagcagggcggc

SEQ ID NO: 331165 - RNA, 20 nt, Bordetella pertussis
cuuccagcagggcggcgucg

SEQ ID NO: 331166 - RNA, 23 nt, Bordetella pertussis
cuuccagcgcauuggugagcacg

SEQ ID NO: 331167 - RNA, 16 nt, Bordetella pertussis
cuuccggcagcggcca

SEQ ID NO: 331168 - RNA, 14 nt, Bordetella pertussis
cuuccggccgggcc

SEQ ID NO: 331169 - RNA, 17 nt, Bordetella pertussis
cuuccgguacgcgcagu

SEQ ID NO: 331170 - RNA, 22 nt, Bordetella pertussis
cuuccgguacgcgcaguccgca

SEQ ID NO: 331171 - RNA, 20 nt, Bordetella pertussis
cuuccgggcccgcgccgacg

SEQ ID NO: 331172 - RNA, 17 nt, Bordetella pertussis
cuucgacagcgcgcagg

SEQ ID NO: 331173 - RNA, 19 nt, Bordetella pertussis
cuucgacgcggcggccggu

SEQ ID NO: 331174 - RNA, 12 nt, Bordetella pertussis
cuucgagcacca

SEQ ID NO: 331175 - RNA, 15 nt, Bordetella pertussis
cuucgagcaccaugc

SEQ ID NO: 331176 - RNA, 15 nt, Bordetella pertussis
cuucgagccgguaca

SEQ ID NO: 331177 - RNA, 18 nt, Bordetella pertussis
cuucgagcgcgacgaacu

SEQ ID NO: 331178 - RNA, 14 nt, Bordetella pertussis
cuucgcccagcgcu

SEQ ID NO: 331179 - RNA, 22 nt, Bordetella pertussis
cuucgcccagcgcuugcacgcc

SEQ ID NO: 331180 - RNA, 20 nt, Bordetella pertussis
cuucgccgaucgagcaggcc

SEQ ID NO: 331181 - RNA, 21 nt, Bordetella pertussis
cuucgccgaucgagcaggccg

SEQ ID NO: 331182 - RNA, 16 nt, Bordetella pertussis
cuucgccgaugaccag

SEQ ID NO: 331183 - RNA, 18 nt, Bordetella pertussis
cuucgccgaugaccagca

SEQ ID NO: 331184 - RNA, 20 nt, Bordetella pertussis
cuucgccgaccagcucgacg

SEQ ID NO: 331185 - RNA, 22 nt, Bordetella pertussis
cuucgccggugaacaccagggu

SEQ ID NO: 331186 - RNA, 18 nt, Bordetella pertussis
cuucgggauuucgcuggc

SEQ ID NO: 331187 - RNA, 20 nt, Bordetella pertussis
cuucggucacguucagcgcc

SEQ ID NO: 331188 - RNA, 18 nt, Bordetella pertussis
cuucggucagcuugccgc

SEQ ID NO: 331189 - RNA, 14 nt, Bordetella pertussis
cuucucgaccaggc

SEQ ID NO: 331190 - RNA, 18 nt, Bordetella pertussis
cuucucgacggcgcgcgc

SEQ ID NO: 331191 - RNA, 13 nt, Bordetella pertussis
cuucucgccgcgc

SEQ ID NO: 331192 - RNA, 14 nt, Bordetella pertussis
cuucugcaucggca

SEQ ID NO: 331193 - RNA, 18 nt, Bordetella pertussis
cuucugccagacggccag

SEQ ID NO: 331194 - RNA, 21 nt, Bordetella pertussis
cuucugccagacggccagcgc

SEQ ID NO: 331195 - RNA, 22 nt, Bordetella pertussis
cuucugccagacggccagcgcg

SEQ ID NO: 331196 - RNA, 15 nt, Bordetella pertussis
cuucugccgccaggc

SEQ ID NO: 331197 - RNA, 21 nt, Bordetella pertussis
cuucuggaucaccgccggcgg

SEQ ID NO: 331198 - RNA, 17 nt, Bordetella pertussis
cuucuucagcuugguca

SEQ ID NO: 331199 - RNA, 19 nt, Bordetella pertussis
cuucuuccaggcgcccgcc

SEQ ID NO: 331200 - RNA, 20 nt, Bordetella pertussis
cuucuuccuugcgaugccag

SEQ ID NO: 331201 - RNA, 20 nt, Bordetella pertussis
cuucuucuuugcccuggcca

SEQ ID NO: 331202 - RNA, 19 nt, Bordetella pertussis
cuucuugaacucggccagc

SEQ ID NO: 331203 - RNA, 22 nt, Bordetella pertussis
cuucuuggcgaccaggcccacg

SEQ ID NO: 331204 - RNA, 21 nt, Bordetella pertussis
cuugaaaaaucgggugcugcg

SEQ ID NO: 331205 - RNA, 15 nt, Bordetella pertussis
cuugaacggcgcggc

SEQ ID NO: 331206 - RNA, 16 nt, Bordetella pertussis
cuugaagacgcccagg

SEQ ID NO: 331207 - RNA, 14 nt, Bordetella pertussis
cuugaccacggcca

SEQ ID NO: 331208 - RNA, 16 nt, Bordetella pertussis
cuugaccacggccagc

SEQ ID NO: 331209 - RNA, 17 nt, Bordetella pertussis
cuugaccacggccagca

SEQ ID NO: 331210 - RNA, 20 nt, Bordetella pertussis
cuugaccacggccagcagca

SEQ ID NO: 331211 - RNA, 13 nt, Bordetella pertussis
cuugaccaguucg

SEQ ID NO: 331212 - RNA, 14 nt, Bordetella pertussis
cuugaccgcaugcu

SEQ ID NO: 331213 - RNA, 23 nt, Bordetella pertussis
cuugaccuuggcuugcagcgccu

SEQ ID NO: 331214 - RNA, 17 nt, Bordetella pertussis
cuugaccuugagcacgc

SEQ ID NO: 331215 - RNA, 14 nt, Bordetella pertussis
cuugacggccagga

SEQ ID NO: 331216 - RNA, 16 nt, Bordetella pertussis
cuugacgguggccgcg

SEQ ID NO: 331217 - RNA, 22 nt, Bordetella pertussis
cuugacguagcggaucgcggcg

SEQ ID NO: 331218 - RNA, 14 nt, Bordetella pertussis
cuugagcagcgccu

SEQ ID NO: 331219 - RNA, 17 nt, Bordetella pertussis
cuugagcacguccagcg

SEQ ID NO: 331220 - RNA, 14 nt, Bordetella pertussis
cuugagcgccagcu

SEQ ID NO: 331221 - RNA, 19 nt, Bordetella pertussis
cuugaggaacuggacggcg

SEQ ID NO: 331222 - RNA, 20 nt, Bordetella pertussis
cuugagggcgcgggccagcu

SEQ ID NO: 331223 - RNA, 19 nt, Bordetella pertussis
cuugaguuuggcgaaggcg

SEQ ID NO: 331224 - RNA, 16 nt, Bordetella pertussis
cuugaucagcggcggc

SEQ ID NO: 331225 - RNA, 17 nt, Bordetella pertussis
cuugaucagcggcggca

SEQ ID NO: 331226 - RNA, 16 nt, Bordetella pertussis
cuugaugccgcccagc

SEQ ID NO: 331227 - RNA, 17 nt, Bordetella pertussis
cuugaugccgcccagca

SEQ ID NO: 331228 - RNA, 17 nt, Bordetella pertussis
cuugauggccucggcgg

SEQ ID NO: 331229 - RNA, 20 nt, Bordetella pertussis
cuugaugggcgaggcgaugc

SEQ ID NO: 331230 - RNA, 13 nt, Bordetella pertussis
cuugcaggccgcg

SEQ ID NO: 331231 - RNA, 17 nt, Bordetella pertussis
cuugcaggccgcgaaca

SEQ ID NO: 331232 - RNA, 15 nt, Bordetella pertussis
cuugcaugcgccgca

SEQ ID NO: 331233 - RNA, 15 nt, Bordetella pertussis
cuugccagcucgacg

SEQ ID NO: 331234 - RNA, 23 nt, Bordetella pertussis
cuugccagcucgacgcgcugauc

SEQ ID NO: 331235 - RNA, 16 nt, Bordetella pertussis
cuugccagggccuggc

SEQ ID NO: 331236 - RNA, 17 nt, Bordetella pertussis
cuugccagggccuggca

SEQ ID NO: 331237 - RNA, 17 nt, Bordetella pertussis
cuugccauaggccagcg

SEQ ID NO: 331238 - RNA, 18 nt, Bordetella pertussis
cuugccauaggccagcgc

SEQ ID NO: 331239 - RNA, 18 nt, Bordetella pertussis
cuugccauccagccaggc

SEQ ID NO: 331240 - RNA, 17 nt, Bordetella pertussis
cuugccgcagcggccau

SEQ ID NO: 331241 - RNA, 18 nt, Bordetella pertussis
cuugccgcagcggggaca

SEQ ID NO: 331242 - RNA, 19 nt, Bordetella pertussis
cuugccgcagcggggacag

SEQ ID NO: 331243 - RNA, 22 nt, Bordetella pertussis
cuugccgcccacugccaggcga

SEQ ID NO: 331244 - RNA, 13 nt, Bordetella pertussis
cuugccgcccagg

SEQ ID NO: 331245 - RNA, 17 nt, Bordetella pertussis
cuugccgccgccgcgcg

SEQ ID NO: 331246 - RNA, 21 nt, Bordetella pertussis
cuugccgccgccgcgcgcggc

SEQ ID NO: 331247 - RNA, 13 nt, Bordetella pertussis
cuugccgccgcgc

SEQ ID NO: 331248 - RNA, 16 nt, Bordetella pertussis
cuugccgccgcgcagg

SEQ ID NO: 331249 - RNA, 13 nt, Bordetella pertussis
cuugccgccggac

SEQ ID NO: 331250 - RNA, 21 nt, Bordetella pertussis
cuugccgccggacggcgccuu

SEQ ID NO: 331251 - RNA, 18 nt, Bordetella pertussis
cuugccgccgugcgagca

SEQ ID NO: 331252 - RNA, 18 nt, Bordetella pertussis
cuugccgccuucccaggc

SEQ ID NO: 331253 - RNA, 14 nt, Bordetella pertussis
cuugccgcgcagcg

SEQ ID NO: 331254 - RNA, 15 nt, Bordetella pertussis
cuugccgcgcagcgu

SEQ ID NO: 331255 - RNA, 14 nt, Bordetella pertussis
cuugccggcccggu

SEQ ID NO: 331256 - RNA, 14 nt, Bordetella pertussis
cuugccggccgccc

SEQ ID NO: 331257 - RNA, 20 nt, Bordetella pertussis
cuugccggcgcucagcgacg

SEQ ID NO: 331258 - RNA, 14 nt, Bordetella pertussis
cuugccggccuggc

SEQ ID NO: 331259 - RNA, 15 nt, Bordetella pertussis
cuugccgggcucgau

SEQ ID NO: 331260 - RNA, 21 nt, Bordetella pertussis
cuugccggugcucggccagcg

SEQ ID NO: 331261 - RNA, 18 nt, Bordetella pertussis
cuugccgguggacggcca

SEQ ID NO: 331262 - RNA, 21 nt, Bordetella pertussis
cuugccgguggacggccagca

SEQ ID NO: 331263 - RNA, 23 nt, Bordetella pertussis
cuugccguagcgcguggccagca

SEQ ID NO: 331264 - RNA, 21 nt, Bordetella pertussis
cuugcggcgaugcacccaggc

SEQ ID NO: 331265 - RNA, 20 nt, Bordetella pertussis
cuugcggcgcuggcuggacg

SEQ ID NO: 331266 - RNA, 15 nt, Bordetella pertussis
cuugcggguccagca

SEQ ID NO: 331267 - RNA, 20 nt, Bordetella pertussis
cuugcgguccguacgccacu

SEQ ID NO: 331268 - RNA, 19 nt, Bordetella pertussis
cuugcgguugaaggcgaac

SEQ ID NO: 331269 - RNA, 24 nt, Bordetella pertussis
cuuggacgcgcuguaggcgccggc

SEQ ID NO: 331270 - RNA, 15 nt, Bordetella pertussis
cuuggaguucuucuu

SEQ ID NO: 331271 - RNA, 21 nt, Bordetella pertussis
cuuggaguucuucuuggccag

SEQ ID NO: 331272 - RNA, 16 nt, Bordetella pertussis
cuuggcaaccucgccg

SEQ ID NO: 331273 - RNA, 16 nt, Bordetella pertussis
cuuggccugggccgac

SEQ ID NO: 331274 - RNA, 23 nt, Bordetella pertussis
cuuggccugggcgcgguccagca

SEQ ID NO: 331275 - RNA, 13 nt, Bordetella pertussis
cuuggcgaccagg

SEQ ID NO: 331276 - RNA, 20 nt, Bordetella pertussis
cuuggcgaucucguccugca

SEQ ID NO: 331277 - RNA, 21 nt, Bordetella pertussis
cuuggcgaucucguccugcag

SEQ ID NO: 331278 - RNA, 22 nt, Bordetella pertussis
cuuggcgcaggaacucagcgca

SEQ ID NO: 331279 - RNA, 15 nt, Bordetella pertussis
cuuggcgccggcgau

SEQ ID NO: 331280 - RNA, 16 nt, Bordetella pertussis
cuuggcgcgcagcagc

SEQ ID NO: 331281 - RNA, 17 nt, Bordetella pertussis
cuuggcgugcuugccgc

SEQ ID NO: 331282 - RNA, 18 nt, Bordetella pertussis
cuugggcaggccuucgcg

SEQ ID NO: 331283 - RNA, 18 nt, Bordetella pertussis
cuugggcauuucccagcc

SEQ ID NO: 331284 - RNA, 20 nt, Bordetella pertussis
cuugggcuugauggccagcg

SEQ ID NO: 331285 - RNA, 22 nt, Bordetella pertussis
cuuggggcggcccggcggcaaa

SEQ ID NO: 331286 - RNA, 17 nt, Bordetella pertussis
cuugucgcgcagcgccg

SEQ ID NO: 331287 - RNA, 14 nt, Bordetella pertussis
cuugucgcgggcag

SEQ ID NO: 331288 - RNA, 20 nt, Bordetella pertussis
cuuucagcgccgagcgccag

SEQ ID NO: 331289 - RNA, 16 nt, Bordetella pertussis
cuuucgaccagcgaca

SEQ ID NO: 331290 - RNA, 22 nt, Bordetella pertussis
cuuucgcacagccggggcgagc

SEQ ID NO: 331291 - RNA, 15 nt, Bordetella pertussis
cuuucgccgcgcgcu

SEQ ID NO: 331292 - RNA, 19 nt, Bordetella pertussis
cuuucugcuugccggcccg

SEQ ID NO: 331293 - RNA, 14 nt, Bordetella pertussis
cuuugcgggcgcgc

SEQ ID NO: 331294 - RNA, 15 nt, Bordetella pertussis
cuuugcgggcgcgcu

SEQ ID NO: 331295 - RNA, 22 nt, Bordetella pertussis
cuuuggacaggcgugcgcagcu

SEQ ID NO: 331296 - RNA, 17 nt, Bordetella pertussis
cuuuggccgcgcgccgg

SEQ ID NO: 331297 - RNA, 20 nt, Bordetella pertussis
cuuuggccgcgcgccggcgc

SEQ ID NO: 331298 - RNA, 22 nt, Bordetella pertussis
cuuugucguugauggggccgcg

SEQ ID NO: 331299 - RNA, 16 nt, Bordetella pertussis
gaaaaagcugccggca

SEQ ID NO: 331300 - RNA, 20 nt, Bordetella pertussis
gaaaaccaggcugcccuggc

SEQ ID NO: 331301 - RNA, 14 nt, Bordetella pertussis
gaaaacagcaccag

SEQ ID NO: 331302 - RNA, 21 nt, Bordetella pertussis
gaaacagguucacgccccgca

SEQ ID NO: 331303 - RNA, 22 nt, Bordetella pertussis
gaaaccgccacagcgccgcggc

SEQ ID NO: 331304 - RNA, 14 nt, Bordetella pertussis
gaaaccggcgacca

SEQ ID NO: 331305 - RNA, 17 nt, Bordetella pertussis
gaaaccggcgaccaccg

SEQ ID NO: 331306 - RNA, 18 nt, Bordetella pertussis
gaaaccggcgcgcgcggc

SEQ ID NO: 331307 - RNA, 18 nt, Bordetella pertussis
gaaaccggugaucagcag

SEQ ID NO: 331308 - RNA, 12 nt, Bordetella pertussis
gaaaccggcgcg

SEQ ID NO: 331309 - RNA, 15 nt, Bordetella pertussis
gaaaccuggcccggc

SEQ ID NO: 331310 - RNA, 14 nt, Bordetella pertussis
gaaacgcgacgcgc

SEQ ID NO: 331311 - RNA, 16 nt, Bordetella pertussis
gaaacgcgcgcgcccu

SEQ ID NO: 331312 - RNA, 17 nt, Bordetella pertussis
gaaacgcugcgcgaugc

SEQ ID NO: 331313 - RNA, 22 nt, Bordetella pertussis
gaaacggccaagcagcgccugc

SEQ ID NO: 331314 - RNA, 13 nt, Bordetella pertussis
gaaacggccgggu

SEQ ID NO: 331315 - RNA, 18 nt, Bordetella pertussis
gaaacgggcggcgucgcc

SEQ ID NO: 331316 - RNA, 16 nt, Bordetella pertussis
gaacgacgguacaccu

SEQ ID NO: 331317 - RNA, 22 nt, Bordetella pertussis
gaacgacucgucgaccaccagc

SEQ ID NO: 331318 - RNA, 18 nt, Bordetella pertussis
gaacgacuugggcaguuc

SEQ ID NO: 331319 - RNA, 13 nt, Bordetella pertussis
gaacgaggcgcgg

SEQ ID NO: 331320 - RNA, 23 nt, Bordetella pertussis
gaacgauucuuuccuggccggcg

SEQ ID NO: 331321 - RNA, 17 nt, Bordetella pertussis
gaacgcaauugcguggu

SEQ ID NO: 331322 - RNA, 22 nt, Bordetella pertussis
gaacgcaauugcgugguggccu

SEQ ID NO: 331323 - RNA, 21 nt, Bordetella pertussis
gaacgcaugcgugcgcaucag

SEQ ID NO: 331324 - RNA, 17 nt, Bordetella pertussis
gaacgccaccaggccga

SEQ ID NO: 331325 - RNA, 14 nt, Bordetella pertussis
gaacgccagcagca

SEQ ID NO: 331326 - RNA, 15 nt, Bordetella pertussis
gaacgccacgcccgu

SEQ ID NO: 331327 - RNA, 14 nt, Bordetella pertussis
gaacgccccggccg

SEQ ID NO: 331328 - RNA, 21 nt, Bordetella pertussis
gaacgcguaggucaggcccac

SEQ ID NO: 331329 - RNA, 19 nt, Bordetella pertussis
gaacgcguucaagucgccc

SEQ ID NO: 331330 - RNA, 14 nt, Bordetella pertussis
gaacggcgcggccu

SEQ ID NO: 331331 - RNA, 16 nt, Bordetella pertussis
gaacggcuuggcgugc

SEQ ID NO: 331332 - RNA, 20 nt, Bordetella pertussis
gaacggcuuggcgugcgcga

SEQ ID NO: 331333 - RNA, 13 nt, Bordetella pertussis
gaacgggcagccg

SEQ ID NO: 331334 - RNA, 20 nt, Bordetella pertussis
gaacggggccgccucggcgg

SEQ ID NO: 331335 - RNA, 21 nt, Bordetella pertussis
gaacggggccgccucggcggc

SEQ ID NO: 331336 - RNA, 16 nt, Bordetella pertussis
gaacgggguggccggc

SEQ ID NO: 331337 - RNA, 17 nt, Bordetella pertussis
gaacgggguggccggcg

SEQ ID NO: 331338 - RNA, 20 nt, Bordetella pertussis
gaacgggguggccggcgcgc

SEQ ID NO: 331339 - RNA, 22 nt, Bordetella pertussis
gaacgggguggccggcgcgcgg

SEQ ID NO: 331340 - RNA, 19 nt, Bordetella pertussis
gaacgucaccccgcccugc

SEQ ID NO: 331341 - RNA, 22 nt, Bordetella pertussis
gaacgugccgucgggcgccgca

SEQ ID NO: 331342 - RNA, 13 nt, Bordetella pertussis
gaacguggccugc

SEQ ID NO: 331343 - RNA, 14 nt, Bordetella pertussis
gaacguggcggcga

SEQ ID NO: 331344 - RNA, 18 nt, Bordetella pertussis
gaacguuugcggacgggc

SEQ ID NO: 331345 - RNA, 14 nt, Bordetella pertussis
gaacuggacggcgc

SEQ ID NO: 331346 - RNA, 18 nt, Bordetella pertussis
gaacugggcgccggccag

SEQ ID NO: 331347 - RNA, 18 nt, Bordetella pertussis
gaagaaauagcccgcggc

SEQ ID NO: 331348 - RNA, 20 nt, Bordetella pertussis
gaagaaauagcccgcggcca

SEQ ID NO: 331349 - RNA, 21 nt, Bordetella pertussis
gaagaaauuuuuccgucgcua

SEQ ID NO: 331350 - RNA, 15 nt, Bordetella pertussis
gaagacauggcgcgc

SEQ ID NO: 331351 - RNA, 17 nt, Bordetella pertussis
gaagacauggcgcgcgc

SEQ ID NO: 331352 - RNA, 19 nt, Bordetella pertussis
gaagacauggcgcgcgcca

SEQ ID NO: 331353 - RNA, 21 nt, Bordetella pertussis
gaagacauggcgcgcgccagc

SEQ ID NO: 331354 - RNA, 20 nt, Bordetella pertussis
gaagaccacguggaugaugg

SEQ ID NO: 331355 - RNA, 14 nt, Bordetella pertussis
gaagacgauggcga

SEQ ID NO: 331356 - RNA, 12 nt, Bordetella pertussis
gaagacgcgcuc

SEQ ID NO: 331357 - RNA, 21 nt, Bordetella pertussis
gaagacggaaagagccagggg

SEQ ID NO: 331358 - RNA, 16 nt, Bordetella pertussis
gaagacguggcccgcg

SEQ ID NO: 331359 - RNA, 22 nt, Bordetella pertussis
gaagacuucgucaacgcccuga

SEQ ID NO: 331360 - RNA, 15 nt, Bordetella pertussis
gaagagggcggggcg

SEQ ID NO: 331361 - RNA, 20 nt, Bordetella pertussis
gaagaucacauaggccggca

SEQ ID NO: 331362 - RNA, 21 nt, Bordetella pertussis
gaagaucaacaaggcgacggu

SEQ ID NO: 331363 - RNA, 22 nt, Bordetella pertussis
gaagauccgccauaugcgcgaa

SEQ ID NO: 331364 - RNA, 16 nt, Bordetella pertussis
gaagaucggcccggcg

SEQ ID NO: 331365 - RNA, 16 nt, Bordetella pertussis
gaagauguggucggcg

SEQ ID NO: 331366 - RNA, 14 nt, Bordetella pertussis
gaagauucccgcgc

SEQ ID NO: 331367 - RNA, 15 nt, Bordetella pertussis
gaagcaaugcagcgc

SEQ ID NO: 331368 - RNA, 15 nt, Bordetella pertussis
gaagcagccgcgcuc

SEQ ID NO: 331369 - RNA, 17 nt, Bordetella pertussis
gaagcaggugaugcgcg

SEQ ID NO: 331370 - RNA, 13 nt, Bordetella pertussis
gaagcccauggcg

SEQ ID NO: 331371 - RNA, 16 nt, Bordetella pertussis
gaagcccccgcgcugc

SEQ ID NO: 331372 - RNA, 14 nt, Bordetella pertussis
gaagcccgagcggc

SEQ ID NO: 331373 - RNA, 13 nt, Bordetella pertussis
gaagccgaugcgc

SEQ ID NO: 331374 - RNA, 14 nt, Bordetella pertussis
gaagccgaugcgcc

SEQ ID NO: 331375 - RNA, 19 nt, Bordetella pertussis
gaagcccucgucgcggccg

SEQ ID NO: 331376 - RNA, 14 nt, Bordetella pertussis
gaagccgcagcggc

SEQ ID NO: 331377 - RNA, 13 nt, Bordetella pertussis
gaagccgccggcg

SEQ ID NO: 331378 - RNA, 14 nt, Bordetella pertussis
gaagccggcgccau

SEQ ID NO: 331379 - RNA, 13 nt, Bordetella pertussis
gaagccggcccgu

SEQ ID NO: 331380 - RNA, 23 nt, Bordetella pertussis
gaagccggcccguuggcaggcca

SEQ ID NO: 331381 - RNA, 22 nt, Bordetella pertussis
gaagccguccuugagggcgcgg

SEQ ID NO: 331382 - RNA, 21 nt, Bordetella pertussis
gaagccuaggcugcagccagu

SEQ ID NO: 331383 - RNA, 14 nt, Bordetella pertussis
gaagcgcagcacca

SEQ ID NO: 331384 - RNA, 16 nt, Bordetella pertussis
gaagcgcagcaccagg

SEQ ID NO: 331385 - RNA, 20 nt, Bordetella pertussis
gaagcgcagcagauugccgc

SEQ ID NO: 331386 - RNA, 13 nt, Bordetella pertussis
gaagcgcaggccu

SEQ ID NO: 331387 - RNA, 15 nt, Bordetella pertussis
gaagcgccauggcag

SEQ ID NO: 331388 - RNA, 22 nt, Bordetella pertussis
gaagcgcccuggcguggcgcgc

SEQ ID NO: 331389 - RNA, 15 nt, Bordetella pertussis
gaagcgcgccaggcg

SEQ ID NO: 331390 - RNA, 13 nt, Bordetella pertussis
gaagcgcgccgcg

SEQ ID NO: 331391 - RNA, 23 nt, Bordetella pertussis
gaagcgcgccucgugcgaggcca

SEQ ID NO: 331392 - RNA, 22 nt, Bordetella pertussis
gaagcgcgugucccagccggcg

SEQ ID NO: 331393 - RNA, 17 nt, Bordetella pertussis
gaagcgcucgcgcaggc

SEQ ID NO: 331394 - RNA, 20 nt, Bordetella pertussis
gaagcggaugcgccgcccca

SEQ ID NO: 331395 - RNA, 17 nt, Bordetella pertussis
gaagcggauguccggcg

SEQ ID NO: 331396 - RNA, 22 nt, Bordetella pertussis
gaagcggcccgggugggcggca

SEQ ID NO: 331397 - RNA, 15 nt, Bordetella pertussis
gaagcggcgcaccag

SEQ ID NO: 331398 - RNA, 13 nt, Bordetella pertussis
gaagcgggccugc

SEQ ID NO: 331399 - RNA, 15 nt, Bordetella pertussis
gaagcgggccugccg

SEQ ID NO: 331400 - RNA, 20 nt, Bordetella pertussis
gaagcggucgauguccagcg

SEQ ID NO: 331401 - RNA, 15 nt, Bordetella pertussis
gaagcggugcgcugg

SEQ ID NO: 331402 - RNA, 15 nt, Bordetella pertussis
gaagcgucggccugc

SEQ ID NO: 331403 - RNA, 23 nt, Bordetella pertussis
gaagcugacgaaacgcgcguccu

SEQ ID NO: 331404 - RNA, 14 nt, Bordetella pertussis
gaagcugcccagca

SEQ ID NO: 331405 - RNA, 22 nt, Bordetella pertussis
gaagcugccgugguacguggac

SEQ ID NO: 331406 - RNA, 14 nt, Bordetella pertussis
gaagcuggccagcg

SEQ ID NO: 331407 - RNA, 15 nt, Bordetella pertussis
gaagcuggcgccggu

SEQ ID NO: 331408 - RNA, 18 nt, Bordetella pertussis
gaagcuguagcgguagcc

SEQ ID NO: 331409 - RNA, 14 nt, Bordetella pertussis
gaagcugucggcgc

SEQ ID NO: 331410 - RNA, 18 nt, Bordetella pertussis
gaagcugucggcgcuggc

SEQ ID NO: 331411 - RNA, 20 nt, Bordetella pertussis
gaagcuguccuucguggcgc

SEQ ID NO: 331412 - RNA, 21 nt, Bordetella pertussis
gaaggaccucgcgccggucac

SEQ ID NO: 331413 - RNA, 15 nt, Bordetella pertussis
gaaggcagcaccgcc

SEQ ID NO: 331414 - RNA, 14 nt, Bordetella pertussis
gaaggcagcggcac

SEQ ID NO: 331415 - RNA, 17 nt, Bordetella pertussis
gaaggccuuggccuggg

SEQ ID NO: 331416 - RNA, 18 nt, Bordetella pertussis
gaaggccuuggccugggc

SEQ ID NO: 331417 - RNA, 17 nt, Bordetella pertussis
gaaggcgagcgcggcau

SEQ ID NO: 331418 - RNA, 14 nt, Bordetella pertussis
gaaggcgaucugcg

SEQ ID NO: 331419 - RNA, 21 nt, Bordetella pertussis
gaaggcgaucugcggcguggc

SEQ ID NO: 331420 - RNA, 14 nt, Bordetella pertussis
gaaggcgcccgggc

SEQ ID NO: 331421 - RNA, 13 nt, Bordetella pertussis
gaaggcgccgacg

SEQ ID NO: 331422 - RNA, 14 nt, Bordetella pertussis
gaaggcgccggcca

SEQ ID NO: 331423 - RNA, 17 nt, Bordetella pertussis
gaaggcgccggccaggc

SEQ ID NO: 331424 - RNA, 13 nt, Bordetella pertussis
gaaggcgcggccg

SEQ ID NO: 331425 - RNA, 14 nt, Bordetella pertussis
gaaggcggccggca

SEQ ID NO: 331426 - RNA, 15 nt, Bordetella pertussis
gaaggcggccggcag

SEQ ID NO: 331427 - RNA, 13 nt, Bordetella pertussis
gaaggcgucggcc

SEQ ID NO: 331428 - RNA, 20 nt, Bordetella pertussis
gaaggcgugcgugacgcugg

SEQ ID NO: 331429 - RNA, 21 nt, Bordetella pertussis
gaaggcgugcugaacgcgcgu

SEQ ID NO: 331430 - RNA, 16 nt, Bordetella pertussis
gaagggauagcgccgu

SEQ ID NO: 331431 - RNA, 20 nt, Bordetella pertussis
gaagggcaccgugaugucgc

SEQ ID NO: 331432 - RNA, 16 nt, Bordetella pertussis
gaagggcuggccggcc

SEQ ID NO: 331433 - RNA, 17 nt, Bordetella pertussis
gaagggcuggccggcca

SEQ ID NO: 331434 - RNA, 19 nt, Bordetella pertussis
gaagggcuugaccagggcg

SEQ ID NO: 331435 - RNA, 22 nt, Bordetella pertussis
gaaggggacguguugccaggcg

SEQ ID NO: 331436 - RNA, 16 nt, Bordetella pertussis
gaagggugcggcgcca

SEQ ID NO: 331437 - RNA, 22 nt, Bordetella pertussis
gaaggguugcaguucgccggcg

SEQ ID NO: 331438 - RNA, 17 nt, Bordetella pertussis
gaaggucgcuucggugg

SEQ ID NO: 331439 - RNA, 16 nt, Bordetella pertussis
gaaggugcggaucacg

SEQ ID NO: 331440 - RNA, 18 nt, Bordetella pertussis
gaagguuucgcugcgcac

SEQ ID NO: 331441 - RNA, 22 nt, Bordetella pertussis
gaagguuucguagccgccgacg

SEQ ID NO: 331442 - RNA, 17 nt, Bordetella pertussis
gaaguaaucgcccggcg

SEQ ID NO: 331443 - RNA, 19 nt, Bordetella pertussis
gaagguguugaccacgccc

SEQ ID NO: 331444 - RNA, 20 nt, Bordetella pertussis
gaaguaggcggccaggccga

SEQ ID NO: 331445 - RNA, 19 nt, Bordetella pertussis
gaaguccggaucccaggcc

SEQ ID NO: 331446 - RNA, 20 nt, Bordetella pertussis
gaaguccggaucccaggccg

SEQ ID NO: 331447 - RNA, 18 nt, Bordetella pertussis
gaagucggcucgucgaac

SEQ ID NO: 331448 - RNA, 18 nt, Bordetella pertussis
gaagugaugccgccggcg

SEQ ID NO: 331449 - RNA, 16 nt, Bordetella pertussis
gaagugccuguccccg

SEQ ID NO: 331450 - RNA, 15 nt, Bordetella pertussis
gaagugcccgcuggc

SEQ ID NO: 331451 - RNA, 18 nt, Bordetella pertussis
gaaucgcguucacguaga

SEQ ID NO: 331452 - RNA, 12 nt, Bordetella pertussis
gaaucgguggaa

SEQ ID NO: 331453 - RNA, 16 nt, Bordetella pertussis
gaaugagcgcgcugcu

SEQ ID NO: 331454 - RNA, 21 nt, Bordetella pertussis
gaaugcgacagcgacagccag

SEQ ID NO: 331455 - RNA, 13 nt, Bordetella pertussis
gaaugcgccuggc

SEQ ID NO: 331456 - RNA, 14 nt, Bordetella pertussis
gaaugcgccuggcg

SEQ ID NO: 331457 - RNA, 19 nt, Bordetella pertussis
gaauguugauccggucgcc

SEQ ID NO: 331458 - RNA, 21 nt, Bordetella pertussis
gaauuccagccaggccucggc

SEQ ID NO: 331459 - RNA, 16 nt, Bordetella pertussis
gaauuccagcucugcu

SEQ ID NO: 331460 - RNA, 19 nt, Bordetella pertussis
gaauuccucgccgcccagc

SEQ ID NO: 331461 - RNA, 15 nt, Bordetella pertussis
gaauuccucgcggcu

SEQ ID NO: 331462 - RNA, 16 nt, Bordetella pertussis
gaauugccgccgcugc

SEQ ID NO: 331463 - RNA, 20 nt, Bordetella pertussis
gaauugcgccacgcccacuu

SEQ ID NO: 331464 - RNA, 16 nt, Bordetella pertussis
gaauugcgggccggcg

SEQ ID NO: 331465 - RNA, 20 nt, Bordetella pertussis
gacaacaagccgggcgccgg

SEQ ID NO: 331466 - RNA, 16 nt, Bordetella pertussis
gacaacagcuugcccg

SEQ ID NO: 331467 - RNA, 23 nt, Bordetella pertussis
gacaacaggucguggcccagccg

SEQ ID NO: 331468 - RNA, 20 nt, Bordetella pertussis
gacaccgucaggaagcccga

SEQ ID NO: 331469 - RNA, 17 nt, Bordetella pertussis
gacaccgugaaggugcc

SEQ ID NO: 331470 - RNA, 19 nt, Bordetella pertussis
gacaccgugaaggugccgg

SEQ ID NO: 331471 - RNA, 20 nt, Bordetella pertussis
gacaccgugaaggugccgga

SEQ ID NO: 331472 - RNA, 17 nt, Bordetella pertussis
gacaccguuuuggcagg

SEQ ID NO: 331473 - RNA, 22 nt, Bordetella pertussis
gacaccguuuuggcaggcuggc

SEQ ID NO: 331474 - RNA, 24 nt, Bordetella pertussis
gacaccuacauccuggaugugcgc

SEQ ID NO: 331475 - RNA, 17 nt, Bordetella pertussis
gacacgcagcugaacga

SEQ ID NO: 331476 - RNA, 15 nt, Bordetella pertussis
gacacgcaugcaggu

SEQ ID NO: 331477 - RNA, 15 nt, Bordetella pertussis
gacacgcccagcagg

SEQ ID NO: 331478 - RNA, 15 nt, Bordetella pertussis
gacacgccgcgcgau

SEQ ID NO: 331479 - RNA, 18 nt, Bordetella pertussis
gacacgccgcgcgaucgc

SEQ ID NO: 331480 - RNA, 24 nt, Bordetella pertussis
gacacgccgcgcgaucgccgcaug

SEQ ID NO: 331481 - RNA, 17 nt, Bordetella pertussis
gacacgcccuggccgua

SEQ ID NO: 331482 - RNA, 19 nt, Bordetella pertussis
gacacgcuagggcguggcg

SEQ ID NO: 331483 - RNA, 15 nt, Bordetella pertussis
gacacgcuggcggac

SEQ ID NO: 331484 - RNA, 19 nt, Bordetella pertussis
gacacggggcaaccggccu

SEQ ID NO: 331485 - RNA, 22 nt, Bordetella pertussis
gacacuucggucgcguaguccg

SEQ ID NO: 331486 - RNA, 19 nt, Bordetella pertussis
gacagaguuauuuuccgga

SEQ ID NO: 331487 - RNA, 12 nt, Bordetella pertussis
gacagauggcgc

SEQ ID NO: 331488 - RNA, 20 nt, Bordetella pertussis
gacagauggcgcuugugcgu

SEQ ID NO: 331489 - RNA, 21 nt, Bordetella pertussis
gacagauccagcgcggccacg

SEQ ID NO: 331490 - RNA, 19 nt, Bordetella pertussis
gacagcaagaaucggggcg

SEQ ID NO: 331491 - RNA, 21 nt, Bordetella pertussis
gacagcaaugacgacgccggc

SEQ ID NO: 331492 - RNA, 19 nt, Bordetella pertussis
gacagccaggccagcgcca

SEQ ID NO: 331493 - RNA, 20 nt, Bordetella pertussis
gacagccaggccagcgccag

SEQ ID NO: 331494 - RNA, 17 nt, Bordetella pertussis
gacagccccagcagcac

SEQ ID NO: 331495 - RNA, 20 nt, Bordetella pertussis
gacagccccagcagcacgcc

SEQ ID NO: 331496 - RNA, 22 nt, Bordetella pertussis
gacagccccagcagcacgccca

SEQ ID NO: 331497 - RNA, 14 nt, Bordetella pertussis
gacagccacgcgcg

SEQ ID NO: 331498 - RNA, 23 nt, Bordetella pertussis
gacagccacgcgcgauccgcgcc

SEQ ID NO: 331499 - RNA, 15 nt, Bordetella pertussis
gacagcccgcgcugg

SEQ ID NO: 331500 - RNA, 16 nt, Bordetella pertussis
gacagcccgcgcuggc

SEQ ID NO: 331501 - RNA, 18 nt, Bordetella pertussis
gacagcccgcgcuggcgc

SEQ ID NO: 331502 - RNA, 20 nt, Bordetella pertussis
gacagcccgcgcuggcgcag

SEQ ID NO: 331503 - RNA, 22 nt, Bordetella pertussis
gacagcccgcgcuggcgcagca

SEQ ID NO: 331504 - RNA, 13 nt, Bordetella pertussis
gacagccgcgcca

SEQ ID NO: 331505 - RNA, 14 nt, Bordetella pertussis
gacagccgcgccag

SEQ ID NO: 331506 - RNA, 16 nt, Bordetella pertussis
gacagccgcgccagcg

SEQ ID NO: 331507 - RNA, 16 nt, Bordetella pertussis
gacagcuugcgcuggc

SEQ ID NO: 331508 - RNA, 18 nt, Bordetella pertussis
gacagcuugcgcuggcgc

SEQ ID NO: 331509 - RNA, 17 nt, Bordetella pertussis
gacaggaugaagaccac

SEQ ID NO: 331510 - RNA, 15 nt, Bordetella pertussis
gacaggcaccccagc

SEQ ID NO: 331511 - RNA, 18 nt, Bordetella pertussis
gacaggcacccccgaccg

SEQ ID NO: 331512 - RNA, 19 nt, Bordetella pertussis
gacaggcaccccggcgccg

SEQ ID NO: 331513 - RNA, 21 nt, Bordetella pertussis
gacaggcaccccggcgccgcg

SEQ ID NO: 331514 - RNA, 19 nt, Bordetella pertussis
gacaggcaccccgucgucc

SEQ ID NO: 331515 - RNA, 20 nt, Bordetella pertussis
gacaggcaccccgucguccg

SEQ ID NO: 331516 - RNA, 20 nt, Bordetella pertussis
gacaggcacccgcgcgcagc

SEQ ID NO: 331517 - RNA, 21 nt, Bordetella pertussis
gacaggcacccgcgcgcagcg

SEQ ID NO: 331518 - RNA, 18 nt, Bordetella pertussis
gacaggcacccuugccgc

SEQ ID NO: 331519 - RNA, 19 nt, Bordetella pertussis
gacagugcccugacccgcu

SEQ ID NO: 331520 - RNA, 21 nt, Bordetella pertussis
gacagugcccugacccgcugg

SEQ ID NO: 331521 - RNA, 21 nt, Bordetella pertussis
gacauagagauuguccagcgg

SEQ ID NO: 331522 - RNA, 15 nt, Bordetella pertussis
gacaugagcugcgcg

SEQ ID NO: 331523 - RNA, 15 nt, Bordetella pertussis
gacaugcccgccggc

SEQ ID NO: 331524 - RNA, 19 nt, Bordetella pertussis
gacaugccgccccaggcgu

SEQ ID NO: 331525 - RNA, 20 nt, Bordetella pertussis
gacaugcucgaugccggccu

SEQ ID NO: 331526 - RNA, 14 nt, Bordetella pertussis
gacaugcuggccca

SEQ ID NO: 331527 - RNA, 12 nt, Bordetella pertussis
gacauggcgcgc

SEQ ID NO: 331528 - RNA, 14 nt, Bordetella pertussis
gacauggcgcgcgc

SEQ ID NO: 331529 - RNA, 16 nt, Bordetella pertussis
gacauggcgcgcgcca

SEQ ID NO: 331530 - RNA, 20 nt, Bordetella pertussis
gacauugucaagcagcgccg

SEQ ID NO: 331531 - RNA, 22 nt, Bordetella pertussis
gacauugucaagcagcgccggc

SEQ ID NO: 331532 - RNA, 13 nt, Bordetella pertussis
gaccaagcgccac

SEQ ID NO: 331533 - RNA, 20 nt, Bordetella pertussis
gaccaagcgccacagcgcca

SEQ ID NO: 331534 - RNA, 15 nt, Bordetella pertussis
gaccaccccgagaua

SEQ ID NO: 331535 - RNA, 14 nt, Bordetella pertussis
gaccacccgcgcca

SEQ ID NO: 331536 - RNA, 20 nt, Bordetella pertussis
gaccaugcggccgucgccgc

SEQ ID NO: 331537 - RNA, 17 nt, Bordetella pertussis
gaccauguccgcgccca

SEQ ID NO: 331538 - RNA, 20 nt, Bordetella pertussis
gaccauguggcagauggcgg

SEQ ID NO: 331539 - RNA, 22 nt, Bordetella pertussis
gacccacagguuggccgcgacg

SEQ ID NO: 331540 - RNA, 18 nt, Bordetella pertussis
gacccacuugagcagcgc

SEQ ID NO: 331541 - RNA, 18 nt, Bordetella pertussis
gacccaggccggcgccag

SEQ ID NO: 331542 - RNA, 19 nt, Bordetella pertussis
gacccaggccggcgccagc

SEQ ID NO: 331543 - RNA, 22 nt, Bordetella pertussis
gacccagucgcaguucggccuc

SEQ ID NO: 331544 - RNA, 23 nt, Bordetella pertussis
gacccauaguugcaugaugucgc

SEQ ID NO: 331545 - RNA, 21 nt, Bordetella pertussis
gacccauaccagcccggcgcg

SEQ ID NO: 331546 - RNA, 21 nt, Bordetella pertussis
gacccccgaacugggcgcguc

SEQ ID NO: 331547 - RNA, 16 nt, Bordetella pertussis
gaccccgccgugccgg

SEQ ID NO: 331548 - RNA, 23 nt, Bordetella pertussis
gaccccgccgugccgggccuggu

SEQ ID NO: 331549 - RNA, 15 nt, Bordetella pertussis
gacccgcgccucggc

SEQ ID NO: 331550 - RNA, 19 nt, Bordetella pertussis
gacccgcggcccuugcgcg

SEQ ID NO: 331551 - RNA, 15 nt, Bordetella pertussis
gacccgcuggcuggc

SEQ ID NO: 331552 - RNA, 21 nt, Bordetella pertussis
gacccgcuggcuggcagcgac

SEQ ID NO: 331553 - RNA, 13 nt, Bordetella pertussis
gacccguggcccg

SEQ ID NO: 331554 - RNA, 16 nt, Bordetella pertussis
gacccguuugcgcagc

SEQ ID NO: 331555 - RNA, 17 nt, Bordetella pertussis
gacccguuugcgcagcu

SEQ ID NO: 331556 - RNA, 22 nt, Bordetella pertussis
gacccuccucgcuuuaccagcu

SEQ ID NO: 331557 - RNA, 23 nt, Bordetella pertussis
gacccuccucgcuuuaccagcug

SEQ ID NO: 331558 - RNA, 23 nt, Bordetella pertussis
gacccugcacgauuccgccuacu

SEQ ID NO: 331559 - RNA, 12 nt, Bordetella pertussis
gacccugcccgg

SEQ ID NO: 331560 - RNA, 23 nt, Bordetella pertussis
gacccugcccggcagggugacgg

SEQ ID NO: 331561 - RNA, 12 nt, Bordetella pertussis
gacccugcgcac

SEQ ID NO: 331562 - RNA, 19 nt, Bordetella pertussis
gacccugcgcacccgccug

SEQ ID NO: 331563 - RNA, 21 nt, Bordetella pertussis
gacccugcgcacccgccugga

SEQ ID NO: 331564 - RNA, 19 nt, Bordetella pertussis
gacccuggccgaacgccgc

SEQ ID NO: 331565 - RNA, 12 nt, Bordetella pertussis
gacccuggcgcg

SEQ ID NO: 331566 - RNA, 13 nt, Bordetella pertussis
gacccuggcgcgc

SEQ ID NO: 331567 - RNA, 20 nt, Bordetella pertussis
gacccuguacaagcgcacgc

SEQ ID NO: 331568 - RNA, 21 nt, Bordetella pertussis
gacccuuucauuucggcgccg

SEQ ID NO: 331569 - RNA, 22 nt, Bordetella pertussis
gacccuuucauuucggcgccgc

SEQ ID NO: 331570 - RNA, 20 nt, Bordetella pertussis
gaccgaacaccaccgagggc

SEQ ID NO: 331571 - RNA, 23 nt, Bordetella pertussis
gaccgccaugcgcauggccagcg

SEQ ID NO: 331572 - RNA, 13 nt, Bordetella pertussis
gaccgccgccacg

SEQ ID NO: 331573 - RNA, 19 nt, Bordetella pertussis
gaccgccgccacgcgcacg

SEQ ID NO: 331574 - RNA, 14 nt, Bordetella pertussis
gaccgccgccagca

SEQ ID NO: 331575 - RNA, 20 nt, Bordetella pertussis
gaccgccgccagcagcgccg

SEQ ID NO: 331576 - RNA, 17 nt, Bordetella pertussis
gaccgccggccggugca

SEQ ID NO: 331577 - RNA, 17 nt, Bordetella pertussis
gaccgccuccagcgcgg

SEQ ID NO: 331578 - RNA, 18 nt, Bordetella pertussis
gaccgccuccagcgcggc

SEQ ID NO: 331579 - RNA, 21 nt, Bordetella pertussis
gaccgccuccaggaugagcgc

SEQ ID NO: 331580 - RNA, 17 nt, Bordetella pertussis
gaccgccucgacgcccg

SEQ ID NO: 331581 - RNA, 22 nt, Bordetella pertussis
gaccgccucgacgcccgggcgg

SEQ ID NO: 331582 - RNA, 12 nt, Bordetella pertussis
gaccgccucgau

SEQ ID NO: 331583 - RNA, 15 nt, Bordetella pertussis
gaccgccucgaucgc

SEQ ID NO: 331584 - RNA, 17 nt, Bordetella pertussis
gaccgccucgaugcccu

SEQ ID NO: 331585 - RNA, 17 nt, Bordetella pertussis
gaccgcgaaccggugcu

SEQ ID NO: 331586 - RNA, 19 nt, Bordetella pertussis
gaccgcgaaccggugcugg

SEQ ID NO: 331587 - RNA, 17 nt, Bordetella pertussis
gaccgcgaagccgcccg

SEQ ID NO: 331588 - RNA, 16 nt, Bordetella pertussis
gaccgcgaagcgcgcc

SEQ ID NO: 331589 - RNA, 17 nt, Bordetella pertussis
gaccgcgaagcgcgcca

SEQ ID NO: 331590 - RNA, 14 nt, Bordetella pertussis
gaccgcgacccgau

SEQ ID NO: 331591 - RNA, 16 nt, Bordetella pertussis
gaccgcgacgcgccug

SEQ ID NO: 331592 - RNA, 16 nt, Bordetella pertussis
gaccgcgaugcugcgc

SEQ ID NO: 331593 - RNA, 17 nt, Bordetella pertussis
gaccgcgaugcugcgca

SEQ ID NO: 331594 - RNA, 18 nt, Bordetella pertussis
gaccgcgaugcugcgcaa

SEQ ID NO: 331595 - RNA, 14 nt, Bordetella pertussis
gaccgcgcgcacca

SEQ ID NO: 331596 - RNA, 22 nt, Bordetella pertussis
gaccgcguaguugucggcgcag

SEQ ID NO: 331597 - RNA, 20 nt, Bordetella pertussis
gaccgcguugaccggcuggc

SEQ ID NO: 331598 - RNA, 22 nt, Bordetella pertussis
gaccggaaucaccgccgcgacc

SEQ ID NO: 331599 - RNA, 16 nt, Bordetella pertussis
gaccggcaagcgcucg

SEQ ID NO: 331600 - RNA, 17 nt, Bordetella pertussis
gaccggcaagcgcucgc

SEQ ID NO: 331601 - RNA, 23 nt, Bordetella pertussis
gaccggcaagcgcucgccggcgc

SEQ ID NO: 331602 - RNA, 21 nt, Bordetella pertussis
gaccggcacccgcuaccccgg

SEQ ID NO: 331603 - RNA, 17 nt, Bordetella pertussis
gaccggcagggugccca

SEQ ID NO: 331604 - RNA, 15 nt, Bordetella pertussis
gaccggccaggcgcg

SEQ ID NO: 331605 - RNA, 16 nt, Bordetella pertussis
gaccggccaggcgcgg

SEQ ID NO: 331606 - RNA, 19 nt, Bordetella pertussis
gaccguccauggcgugcca

SEQ ID NO: 331607 - RNA, 19 nt, Bordetella pertussis
gaccuccaggcccaggcga

SEQ ID NO: 331608 - RNA, 14 nt, Bordetella pertussis
gaccuccugguccg

SEQ ID NO: 331609 - RNA, 13 nt, Bordetella pertussis
gaccucgcccagg

SEQ ID NO: 331610 - RNA, 14 nt, Bordetella pertussis
gaccucgcccaggc

SEQ ID NO: 331611 - RNA, 15 nt, Bordetella pertussis
gaccucgcccaggcc

SEQ ID NO: 331612 - RNA, 23 nt, Bordetella pertussis
gaccucgcgccggucacgcuggu

SEQ ID NO: 331613 - RNA, 13 nt, Bordetella pertussis
gaccucgcgcugc

SEQ ID NO: 331614 - RNA, 17 nt, Bordetella pertussis
gaccugaucgcgcagcg

SEQ ID NO: 331615 - RNA, 20 nt, Bordetella pertussis
gaccugaucgcgcagcgccu

SEQ ID NO: 331616 - RNA, 18 nt, Bordetella pertussis
gaccugcaaccccaccgg

SEQ ID NO: 331617 - RNA, 19 nt, Bordetella pertussis
gaccugcacgauggcgccg

SEQ ID NO: 331618 - RNA, 21 nt, Bordetella pertussis
gaccugcacgauggcgccggc

SEQ ID NO: 331619 - RNA, 20 nt, Bordetella pertussis
gaccugcccgagaccgcccg

SEQ ID NO: 331620 - RNA, 18 nt, Bordetella pertussis
gaccugccgcccgagcug

SEQ ID NO: 331621 - RNA, 22 nt, Bordetella pertussis
gaccugccgcccgagcuggccg

SEQ ID NO: 331622 - RNA, 18 nt, Bordetella pertussis
gaccugcgcaccggccgg

SEQ ID NO: 331623 - RNA, 20 nt, Bordetella pertussis
gaccugcgcaccggccggcc

SEQ ID NO: 331624 - RNA, 14 nt, Bordetella pertussis
gaccugcgccaggu

SEQ ID NO: 331625 - RNA, 19 nt, Bordetella pertussis
gaccugccguucgcgcugc

SEQ ID NO: 331626 - RNA, 16 nt, Bordetella pertussis
gaccugcgcgaagcgc

SEQ ID NO: 331627 - RNA, 20 nt, Bordetella pertussis
gaccugcgcgaagcgcuggg

SEQ ID NO: 331628 - RNA, 15 nt, Bordetella pertussis
gaccugcgcgccggc

SEQ ID NO: 331629 - RNA, 13 nt, Bordetella pertussis
gaccugcgggcgc

SEQ ID NO: 331630 - RNA, 22 nt, Bordetella pertussis
gaccugcgggcgcagcgccgcu

SEQ ID NO: 331631 - RNA, 15 nt, Bordetella pertussis
gaccugcucgagcgg

SEQ ID NO: 331632 - RNA, 20 nt, Bordetella pertussis
gaccuggucgaucagccccu

SEQ ID NO: 331633 - RNA, 17 nt, Bordetella pertussis
gaccuggucggccuuca

SEQ ID NO: 331634 - RNA, 15 nt, Bordetella pertussis
gaccuguggcgcacc

SEQ ID NO: 331635 - RNA, 19 nt, Bordetella pertussis
gacgaacugaucggcaagg

SEQ ID NO: 331636 - RNA, 19 nt, Bordetella pertussis
gacgaagccggaaccgcga

SEQ ID NO: 331637 - RNA, 14 nt, Bordetella pertussis
gacgacagcggcga

SEQ ID NO: 331638 - RNA, 21 nt, Bordetella pertussis
gacgaccaaccugaccgccuu

SEQ ID NO: 331639 - RNA, 15 nt, Bordetella pertussis
gacgaccgaaaagcc

SEQ ID NO: 331640 - RNA, 17 nt, Bordetella pertussis
gacgaccuugcggccgc

SEQ ID NO: 331641 - RNA, 19 nt, Bordetella pertussis
gacgaccuugcggccgcgc

SEQ ID NO: 331642 - RNA, 20 nt, Bordetella pertussis
gacgaccuugcggccgcgca

SEQ ID NO: 331643 - RNA, 16 nt, Bordetella pertussis
gacgaccuugcuggac

SEQ ID NO: 331644 - RNA, 23 nt, Bordetella pertussis
gacgacgaaacccgggccgucgc

SEQ ID NO: 331645 - RNA, 13 nt, Bordetella pertussis
gacgacgcagcgu

SEQ ID NO: 331646 - RNA, 22 nt, Bordetella pertussis
gacgacgcguuguucgggccgg

SEQ ID NO: 331647 - RNA, 13 nt, Bordetella pertussis
gacgacgccggcu

SEQ ID NO: 331648 - RNA, 15 nt, Bordetella pertussis
gacgacuacgcgcug

SEQ ID NO: 331649 - RNA, 18 nt, Bordetella pertussis
gacgacuacgcgcuggcg

SEQ ID NO: 331650 - RNA, 16 nt, Bordetella pertussis
gacgacuucgacggca

SEQ ID NO: 331651 - RNA, 16 nt, Bordetella pertussis
gacgagaaugcgccgu

SEQ ID NO: 331652 - RNA, 13 nt, Bordetella pertussis
gacgagacaggcg

SEQ ID NO: 331653 - RNA, 14 nt, Bordetella pertussis
gacgagacaggcgc

SEQ ID NO: 331654 - RNA, 15 nt, Bordetella pertussis
gacgagacaggcgcg

SEQ ID NO: 331655 - RNA, 17 nt, Bordetella pertussis
gacgagacaggcgcgcc

SEQ ID NO: 331656 - RNA, 18 nt, Bordetella pertussis
gacgagacaggcgcgcca

SEQ ID NO: 331657 - RNA, 18 nt, Bordetella pertussis
gacgagaguuucggcgac

SEQ ID NO: 331658 - RNA, 13 nt, Bordetella pertussis
gacgagaucgcgc

SEQ ID NO: 331659 - RNA, 18 nt, Bordetella pertussis
gacgagaucgcgccuacc

SEQ ID NO: 331660 - RNA, 13 nt, Bordetella pertussis
gacgagcgcacca

SEQ ID NO: 331661 - RNA, 19 nt, Bordetella pertussis
gacgagcgcaccauggcgc

SEQ ID NO: 331662 - RNA, 16 nt, Bordetella pertussis
gacgaggagccggcgg

SEQ ID NO: 331663 - RNA, 14 nt, Bordetella pertussis
gacgagggccgcgg

SEQ ID NO: 331664 - RNA, 15 nt, Bordetella pertussis
gacgagggccggcgc

SEQ ID NO: 331665 - RNA, 12 nt, Bordetella pertussis
gacgagggcgcc

SEQ ID NO: 331666 - RNA, 15 nt, Bordetella pertussis
gacgagggcgccaug

SEQ ID NO: 331667 - RNA, 18 nt, Bordetella pertussis
gacgaucauccaggccgu

SEQ ID NO: 331668 - RNA, 19 nt, Bordetella pertussis
gacgaucccggccacggga

SEQ ID NO: 331669 - RNA, 16 nt, Bordetella pertussis
gacgauccggcgaccg

SEQ ID NO: 331670 - RNA, 22 nt, Bordetella pertussis
gacgaucggccugaaccaggcc

SEQ ID NO: 331671 - RNA, 17 nt, Bordetella pertussis
gacgaucucgcccugcu

SEQ ID NO: 331672 - RNA, 19 nt, Bordetella pertussis
gacgaucucggcguugacc

SEQ ID NO: 331673 - RNA, 22 nt, Bordetella pertussis
gacgaucucgcggcugguggug

SEQ ID NO: 331674 - RNA, 15 nt, Bordetella pertussis
gacgaugcccaggcc

SEQ ID NO: 331675 - RNA, 17 nt, Bordetella pertussis
gacgaugcccaggucgu

SEQ ID NO: 331676 - RNA, 22 nt, Bordetella pertussis
gacgaugcccugcgccagcgcc

SEQ ID NO: 331677 - RNA, 11 nt, Bordetella pertussis
gacgaugccgc

SEQ ID NO: 331678 - RNA, 18 nt, Bordetella pertussis
gacgaugccgcccacgcc

SEQ ID NO: 331679 - RNA, 14 nt, Bordetella pertussis
gacgaugccgccgc

SEQ ID NO: 331680 - RNA, 23 nt, Bordetella pertussis
gacgauggaaaugccguccagga

SEQ ID NO: 331681 - RNA, 15 nt, Bordetella pertussis
gacgauggccggggc

SEQ ID NO: 331682 - RNA, 18 nt, Bordetella pertussis
gacgauggccugugcggc

SEQ ID NO: 331683 - RNA, 11 nt, Bordetella pertussis
gacgauggcgg

SEQ ID NO: 331684 - RNA, 19 nt, Bordetella pertussis
gacgauggcgggguuggcc

SEQ ID NO: 331685 - RNA, 17 nt, Bordetella pertussis
gacgauggucuugccgc

SEQ ID NO: 331686 - RNA, 16 nt, Bordetella pertussis
gacgauggugccggcc

SEQ ID NO: 331687 - RNA, 19 nt, Bordetella pertussis
gacgauggugccggccguc

SEQ ID NO: 331688 - RNA, 17 nt, Bordetella pertussis
gacgaugucgccgccgc

SEQ ID NO: 331689 - RNA, 17 nt, Bordetella pertussis
gacgcaaaaacgcccgg

SEQ ID NO: 331690 - RNA, 18 nt, Bordetella pertussis
gacgcaaaaacgcccggc

SEQ ID NO: 331691 - RNA, 22 nt, Bordetella pertussis
gacgcaaaaacgcccggcgcgg

SEQ ID NO: 331692 - RNA, 21 nt, Bordetella pertussis
gacgcaacagacccgggccgc

SEQ ID NO: 331693 - RNA, 16 nt, Bordetella pertussis
gacgcaaccggucggc

SEQ ID NO: 331694 - RNA, 16 nt, Bordetella pertussis
gacgcaaucggcgaag

SEQ ID NO: 331695 - RNA, 19 nt, Bordetella pertussis
gacgcaccuuucugcugcu

SEQ ID NO: 331696 - RNA, 15 nt, Bordetella pertussis
gacgcagaccacgcc

SEQ ID NO: 331697 - RNA, 14 nt, Bordetella pertussis
gacgccaagaccgc

SEQ ID NO: 331698 - RNA, 17 nt, Bordetella pertussis
gacgccaagaccgcggc

SEQ ID NO: 331699 - RNA, 18 nt, Bordetella pertussis
gacgccaagaccgcggcc

SEQ ID NO: 331700 - RNA, 19 nt, Bordetella pertussis
gacgccaagaccgcggccg

SEQ ID NO: 331701 - RNA, 20 nt, Bordetella pertussis
gacgccaagaccgcggccgc

SEQ ID NO: 331702 - RNA, 20 nt, Bordetella pertussis
gacgccaccagugcgccggc

SEQ ID NO: 331703 - RNA, 23 nt, Bordetella pertussis
gacgccagcccgccggcgcgcgc

SEQ ID NO: 331704 - RNA, 16 nt, Bordetella pertussis
gacgccagcgcgccau

SEQ ID NO: 331705 - RNA, 21 nt, Bordetella pertussis
gacgccgccacgcuggccgcg

SEQ ID NO: 331706 - RNA, 19 nt, Bordetella pertussis
gacgccgccgaacggggcc

SEQ ID NO: 331707 - RNA, 18 nt, Bordetella pertussis
gacgccgccgauggcgcc

SEQ ID NO: 331708 - RNA, 14 nt, Bordetella pertussis
gacgccgccggccc

SEQ ID NO: 331709 - RNA, 16 nt, Bordetella pertussis
gacgccgccggcccag

SEQ ID NO: 331710 - RNA, 21 nt, Bordetella pertussis
gacgccgcgacacaaggcggc

SEQ ID NO: 331711 - RNA, 16 nt, Bordetella pertussis
gacgccgcgcgcgacg

SEQ ID NO: 331712 - RNA, 17 nt, Bordetella pertussis
gacgccgucgcggaccu

SEQ ID NO: 331713 - RNA, 13 nt, Bordetella pertussis
gacgccgucgacc

SEQ ID NO: 331714 - RNA, 16 nt, Bordetella pertussis
gacgccgugcugaucg

SEQ ID NO: 331715 - RNA, 23 nt, Bordetella pertussis
gacgccgugguggucacguucga

SEQ ID NO: 331716 - RNA, 13 nt, Bordetella pertussis
gacgccuggaccg

SEQ ID NO: 331717 - RNA, 16 nt, Bordetella pertussis
gacgcgaagaucccgc

SEQ ID NO: 331718 - RNA, 18 nt, Bordetella pertussis
gacgcgaagaucccgccg

SEQ ID NO: 331719 - RNA, 22 nt, Bordetella pertussis
gacgcgaaccaggccaccgcgg

SEQ ID NO: 331720 - RNA, 14 nt, Bordetella pertussis
gacgcgacgcgacg

SEQ ID NO: 331721 - RNA, 17 nt, Bordetella pertussis
gacgcgacgcgggcggc

SEQ ID NO: 331722 - RNA, 23 nt, Bordetella pertussis
gacgcgagaccaugacgucgacg

SEQ ID NO: 331723 - RNA, 22 nt, Bordetella pertussis
gacgcgaggcagaaguggucgc

SEQ ID NO: 331724 - RNA, 19 nt, Bordetella pertussis
gacgcgauguccagcucca

SEQ ID NO: 331725 - RNA, 20 nt, Bordetella pertussis
gacgcgcccucaguccagcu

SEQ ID NO: 331726 - RNA, 22 nt, Bordetella pertussis
gacgcgccgaacaccagcucgg

SEQ ID NO: 331727 - RNA, 15 nt, Bordetella pertussis
gacgcgccggaugcg

SEQ ID NO: 331728 - RNA, 21 nt, Bordetella pertussis
gacgcgccggaugcgcguggc

SEQ ID NO: 331729 - RNA, 14 nt, Bordetella pertussis
gacgcgccugcgcg

SEQ ID NO: 331730 - RNA, 15 nt, Bordetella pertussis
gacgcgccugcgcgc

SEQ ID NO: 331731 - RNA, 16 nt, Bordetella pertussis
gacgcgccugcgcgcg

SEQ ID NO: 331732 - RNA, 13 nt, Bordetella pertussis
gacgcgcgccgca

SEQ ID NO: 331733 - RNA, 13 nt, Bordetella pertussis
gacgcgcgccggc

SEQ ID NO: 331734 - RNA, 17 nt, Bordetella pertussis
gacgcgcgcggcgaccg

SEQ ID NO: 331735 - RNA, 19 nt, Bordetella pertussis
gacgcgcgcggcgaccgcg

SEQ ID NO: 331736 - RNA, 20 nt, Bordetella pertussis
gacgcgcggguccaggcccg

SEQ ID NO: 331737 - RNA, 21 nt, Bordetella pertussis
gacgcgcggguccaggcccga

SEQ ID NO: 331738 - RNA, 15 nt, Bordetella pertussis
gacgcgccgggccac

SEQ ID NO: 331739 - RNA, 16 nt, Bordetella pertussis
gacgcgcucgcgcgcg

SEQ ID NO: 331740 - RNA, 17 nt, Bordetella pertussis
gacgcgcucgcgcgcgu

SEQ ID NO: 331741 - RNA, 15 nt, Bordetella pertussis
gacgcgcuggccgac

SEQ ID NO: 331742 - RNA, 17 nt, Bordetella pertussis
gacgcgcuguaggcgcc

SEQ ID NO: 331743 - RNA, 18 nt, Bordetella pertussis
gacgcgcuguaggcgccg

SEQ ID NO: 331744 - RNA, 20 nt, Bordetella pertussis
gacgcgcuguaggcgccggc

SEQ ID NO: 331745 - RNA, 22 nt, Bordetella pertussis
gacgcgcuguaggcgccggcgc

SEQ ID NO: 331746 - RNA, 20 nt, Bordetella pertussis
gacgcgcuugacguccagcg

SEQ ID NO: 331747 - RNA, 15 nt, Bordetella pertussis
gacgcgcucgucgaa

SEQ ID NO: 331748 - RNA, 15 nt, Bordetella pertussis
gacgcgcugaugcgc

SEQ ID NO: 331749 - RNA, 19 nt, Bordetella pertussis
gacgcgcugaugcgcggcg

SEQ ID NO: 331750 - RNA, 20 nt, Bordetella pertussis
gacgcgcugaugcgcggcgg

SEQ ID NO: 331751 - RNA, 17 nt, Bordetella pertussis
gacgcgcucgccgucga

SEQ ID NO: 331752 - RNA, 22 nt, Bordetella pertussis
gacgcgcuuuuccccgcccagc

SEQ ID NO: 331753 - RNA, 23 nt, Bordetella pertussis
gacgcgcuuuuccccgcccagcg

SEQ ID NO: 331754 - RNA, 15 nt, Bordetella pertussis
gacgcggcagggcca

SEQ ID NO: 331755 - RNA, 16 nt, Bordetella pertussis
gacgcggccagcggcg

SEQ ID NO: 331756 - RNA, 12 nt, Bordetella pertussis
gacgcggccggc

SEQ ID NO: 331757 - RNA, 13 nt, Bordetella pertussis
gacgcggccggca

SEQ ID NO: 331758 - RNA, 13 nt, Bordetella pertussis
gacgcggccagcg

SEQ ID NO: 331759 - RNA, 13 nt, Bordetella pertussis
gacgcggcggccg

SEQ ID NO: 331760 - RNA, 19 nt, Bordetella pertussis
gacgcggcguacuggcgcg

SEQ ID NO: 331761 - RNA, 16 nt, Bordetella pertussis
gacgcguccucggcca

SEQ ID NO: 331762 - RNA, 19 nt, Bordetella pertussis
gacgcguccucggccagcc

SEQ ID NO: 331763 - RNA, 20 nt, Bordetella pertussis
gacgcguuguucgggccggc

SEQ ID NO: 331764 - RNA, 21 nt, Bordetella pertussis
gacgcguuguucgggccggcu

SEQ ID NO: 331765 - RNA, 14 nt, Bordetella pertussis
gacggcagcaccgc

SEQ ID NO: 331766 - RNA, 15 nt, Bordetella pertussis
gacggcagcaccgcc

SEQ ID NO: 331767 - RNA, 16 nt, Bordetella pertussis
gacggcagcaccgcca

SEQ ID NO: 331768 - RNA, 13 nt, Bordetella pertussis
gacggcaucuguc

SEQ ID NO: 331769 - RNA, 19 nt, Bordetella pertussis
gacggcauggcggccagcu

SEQ ID NO: 331770 - RNA, 18 nt, Bordetella pertussis
gacggccaagacgguauc

SEQ ID NO: 331771 - RNA, 16 nt, Bordetella pertussis
gacggccagcgcgacg

SEQ ID NO: 331772 - RNA, 14 nt, Bordetella pertussis
gacggccagcgcgc

SEQ ID NO: 331773 - RNA, 15 nt, Bordetella pertussis
gacggccagcgcgcg

SEQ ID NO: 331774 - RNA, 16 nt, Bordetella pertussis
gacggccagcgcgcgu

SEQ ID NO: 331775 - RNA, 18 nt, Bordetella pertussis
gacggccagcgcgcgugc

SEQ ID NO: 331776 - RNA, 14 nt, Bordetella pertussis
gacggccaggacgg

SEQ ID NO: 331777 - RNA, 12 nt, Bordetella pertussis
gacggccagggg

SEQ ID NO: 331778 - RNA, 16 nt, Bordetella pertussis
gacggccauccggcca

SEQ ID NO: 331779 - RNA, 18 nt, Bordetella pertussis
gacggccauccggccacg

SEQ ID NO: 331780 - RNA, 15 nt, Bordetella pertussis
gacggccccagcgcc

SEQ ID NO: 331781 - RNA, 16 nt, Bordetella pertussis
gacggccccagcgccg

SEQ ID NO: 331782 - RNA, 22 nt, Bordetella pertussis
gacggccauucagaccggguug

SEQ ID NO: 331783 - RNA, 15 nt, Bordetella pertussis
gacggccgccacgcc

SEQ ID NO: 331784 - RNA, 14 nt, Bordetella pertussis
gacggccgccgacg

SEQ ID NO: 331785 - RNA, 18 nt, Bordetella pertussis
gacggccgccgacgccgc

SEQ ID NO: 331786 - RNA, 21 nt, Bordetella pertussis
gacggccgccgacgccgccac

SEQ ID NO: 331787 - RNA, 13 nt, Bordetella pertussis
gacggccggcgcg

SEQ ID NO: 331788 - RNA, 20 nt, Bordetella pertussis
gacggccggcgcgugcuggc

SEQ ID NO: 331789 - RNA, 18 nt, Bordetella pertussis
gacggccucccgccgccc

SEQ ID NO: 331790 - RNA, 17 nt, Bordetella pertussis
gacggccucggccagga

SEQ ID NO: 331791 - RNA, 19 nt, Bordetella pertussis
gacggcgcacccgcggcgc

SEQ ID NO: 331792 - RNA, 22 nt, Bordetella pertussis
gacggcgcacccgcggcgcaug

SEQ ID NO: 331793 - RNA, 16 nt, Bordetella pertussis
gacggcgccgauccgg

SEQ ID NO: 331794 - RNA, 17 nt, Bordetella pertussis
gacggcgccgauccggc

SEQ ID NO: 331795 - RNA, 13 nt, Bordetella pertussis
gacggcgccuggc

SEQ ID NO: 331796 - RNA, 18 nt, Bordetella pertussis
gacggcgccuggcgcaug

SEQ ID NO: 331797 - RNA, 13 nt, Bordetella pertussis
gacggcgcgcccg

SEQ ID NO: 331798 - RNA, 18 nt, Bordetella pertussis
gacggcgcggaucgugcg

SEQ ID NO: 331799 - RNA, 20 nt, Bordetella pertussis
gacggcgcggaucgugcgcc

SEQ ID NO: 331800 - RNA, 22 nt, Bordetella pertussis
gacggcgcggaucgugcgccac

SEQ ID NO: 331801 - RNA, 21 nt, Bordetella pertussis
gacggcgcggcgaucggcccg

SEQ ID NO: 331802 - RNA, 13 nt, Bordetella pertussis
gacggcgcgggca

SEQ ID NO: 331803 - RNA, 21 nt, Bordetella pertussis
gacggcuggagauacuggccg

SEQ ID NO: 331804 - RNA, 14 nt, Bordetella pertussis
gacggcgcuggcga

SEQ ID NO: 331805 - RNA, 19 nt, Bordetella pertussis
gacggcgcuggggaagcgc

SEQ ID NO: 331806 - RNA, 16 nt, Bordetella pertussis
gacggcuucgaccacg

SEQ ID NO: 331807 - RNA, 17 nt, Bordetella pertussis
gacggcuucgaccacgc

SEQ ID NO: 331808 - RNA, 15 nt, Bordetella pertussis
gacggcuugaccacg

SEQ ID NO: 331809 - RNA, 17 nt, Bordetella pertussis
gacggcuugaccacggc

SEQ ID NO: 331810 - RNA, 18 nt, Bordetella pertussis
gacggcuugaccacggcc

SEQ ID NO: 331811 - RNA, 19 nt, Bordetella pertussis
gacggcuugaccacggcca

SEQ ID NO: 331812 - RNA, 21 nt, Bordetella pertussis
gacggcuugaccacggccagc

SEQ ID NO: 331813 - RNA, 22 nt, Bordetella pertussis
gacggcuugaccacggccagca

SEQ ID NO: 331814 - RNA, 15 nt, Bordetella pertussis
gacgggaaagcggcg

SEQ ID NO: 331815 - RNA, 14 nt, Bordetella pertussis
gacgggaauccgcu

SEQ ID NO: 331816 - RNA, 18 nt, Bordetella pertussis
gacgggaauccgcugcgc

SEQ ID NO: 331817 - RNA, 21 nt, Bordetella pertussis
gacgggaauccgcugcgccga

SEQ ID NO: 331818 - RNA, 21 nt, Bordetella pertussis
gacgggcaccgacacgcuggc

SEQ ID NO: 331819 - RNA, 23 nt, Bordetella pertussis
gacgggcaccgacacgcuggcgg

SEQ ID NO: 331820 - RNA, 15 nt, Bordetella pertussis
gacgggcaggcccag

SEQ ID NO: 331821 - RNA, 17 nt, Bordetella pertussis
gacgggcaggcccagcc

SEQ ID NO: 331822 - RNA, 21 nt, Bordetella pertussis
gacgggcaggcccagccagcg

SEQ ID NO: 331823 - RNA, 18 nt, Bordetella pertussis
gacgggccagccccggcg

SEQ ID NO: 331824 - RNA, 21 nt, Bordetella pertussis
gacgggccagccccggcgcgc

SEQ ID NO: 331825 - RNA, 22 nt, Bordetella pertussis
gacgggccagccccggcgcgcc

SEQ ID NO: 331826 - RNA, 12 nt, Bordetella pertussis
gacgggccaggc

SEQ ID NO: 331827 - RNA, 15 nt, Bordetella pertussis
gacgggccaggccga

SEQ ID NO: 331828 - RNA, 17 nt, Bordetella pertussis
gacgggcggcggcgcgc

SEQ ID NO: 331829 - RNA, 22 nt, Bordetella pertussis
gacgggcggcggcgcgcgcgcc

SEQ ID NO: 331830 - RNA, 23 nt, Bordetella pertussis
gacgggcggcggcgcgcgcgccg

SEQ ID NO: 331831 - RNA, 14 nt, Bordetella pertussis
gacgggcggcugcu

SEQ ID NO: 331832 - RNA, 20 nt, Bordetella pertussis
gacgggcggcugcuggccca

SEQ ID NO: 331833 - RNA, 13 nt, Bordetella pertussis
gacgggcgcacag

SEQ ID NO: 331834 - RNA, 12 nt, Bordetella pertussis
gacgggcgcccg

SEQ ID NO: 331835 - RNA, 23 nt, Bordetella pertussis
gacgggcuggagaacgagccggc

SEQ ID NO: 331836 - RNA, 13 nt, Bordetella pertussis
gacgggcugggcc

SEQ ID NO: 331837 - RNA, 23 nt, Bordetella pertussis
gacgggcugggccgaggcgccgc

SEQ ID NO: 331838 - RNA, 15 nt, Bordetella pertussis
gacggggaacaggcg

SEQ ID NO: 331839 - RNA, 20 nt, Bordetella pertussis
gacggggaacaggcgcgcca

SEQ ID NO: 331840 - RNA, 21 nt, Bordetella pertussis
gacggggaacaggcgcgccag

SEQ ID NO: 331841 - RNA, 15 nt, Bordetella pertussis
gacggggacgccggc

SEQ ID NO: 331842 - RNA, 14 nt, Bordetella pertussis
gacggugccggcca

SEQ ID NO: 331843 - RNA, 19 nt, Bordetella pertussis
gacggugccggccagccug

SEQ ID NO: 331844 - RNA, 20 nt, Bordetella pertussis
gacggugccggccagccugc

SEQ ID NO: 331845 - RNA, 14 nt, Bordetella pertussis
gacggugcgcgcca

SEQ ID NO: 331846 - RNA, 18 nt, Bordetella pertussis
gacguagcggaucgcggc

SEQ ID NO: 331847 - RNA, 20 nt, Bordetella pertussis
gacguagcggaucgcggcgc

SEQ ID NO: 331848 - RNA, 23 nt, Bordetella pertussis
gacguagcggaucgcggcgcggc

SEQ ID NO: 331849 - RNA, 18 nt, Bordetella pertussis
gacguagucgcacgcggc

SEQ ID NO: 331850 - RNA, 18 nt, Bordetella pertussis
gacguagucgcgccagcg

SEQ ID NO: 331851 - RNA, 14 nt, Bordetella pertussis
gacguccagcccgu

SEQ ID NO: 331852 - RNA, 18 nt, Bordetella pertussis
gacguccagcccgugggc

SEQ ID NO: 331853 - RNA, 13 nt, Bordetella pertussis
gacguccagcgcc

SEQ ID NO: 331854 - RNA, 14 nt, Bordetella pertussis
gacguccagcgcca

SEQ ID NO: 331855 - RNA, 17 nt, Bordetella pertussis
gacguccagcgccacca

SEQ ID NO: 331856 - RNA, 12 nt, Bordetella pertussis
gacguccaggcc

SEQ ID NO: 331857 - RNA, 22 nt, Bordetella pertussis
gacguccaugauuuccaucgac

SEQ ID NO: 331858 - RNA, 15 nt, Bordetella pertussis
gacgucccaggccga

SEQ ID NO: 331859 - RNA, 14 nt, Bordetella pertussis
gacguccggcgggc

SEQ ID NO: 331860 - RNA, 20 nt, Bordetella pertussis
gagcagccacugcgucacga

SEQ ID NO: 331861 - RNA, 20 nt, Bordetella pertussis
gagcagcguugcggcgucga

SEQ ID NO: 331862 - RNA, 19 nt, Bordetella pertussis
gagcaggccgcccagcgca

SEQ ID NO: 331863 - RNA, 16 nt, Bordetella pertussis
gagcaggccgccgccg

SEQ ID NO: 331864 - RNA, 18 nt, Bordetella pertussis
gagcaggccgccgccggu

SEQ ID NO: 331865 - RNA, 18 nt, Bordetella pertussis
gagcaggcgcaggccgcg

SEQ ID NO: 331866 - RNA, 18 nt, Bordetella pertussis
gagcagguuggagaucau

SEQ ID NO: 331867 - RNA, 16 nt, Bordetella pertussis
gagcaucauggcgcgc

SEQ ID NO: 331868 - RNA, 14 nt, Bordetella pertussis
gagcaucugcggca

SEQ ID NO: 331869 - RNA, 14 nt, Bordetella pertussis
gagcaugcgggcca

SEQ ID NO: 331870 - RNA, 14 nt, Bordetella pertussis
gagcauggcggugg

SEQ ID NO: 331871 - RNA, 20 nt, Bordetella pertussis
gagcauggcgguggccagcg

SEQ ID NO: 331872 - RNA, 22 nt, Bordetella pertussis
gagcauggcgguggccagcgcc

SEQ ID NO: 331873 - RNA, 13 nt, Bordetella pertussis
gagccaggcgccc

SEQ ID NO: 331874 - RNA, 15 nt, Bordetella pertussis
gagccaggcgcccgg

SEQ ID NO: 331875 - RNA, 13 nt, Bordetella pertussis
gagccaggcggcg

SEQ ID NO: 331876 - RNA, 17 nt, Bordetella pertussis
gagccagguggacagcg

SEQ ID NO: 331877 - RNA, 21 nt, Bordetella pertussis
gagccaugccgucuggcggca

SEQ ID NO: 331878 - RNA, 17 nt, Bordetella pertussis
gagccauuccggcuggu

SEQ ID NO: 331879 - RNA, 16 nt, Bordetella pertussis
gagcccgaugccgcca

SEQ ID NO: 331880 - RNA, 20 nt, Bordetella pertussis
gagcccgcgucagacgcgcu

SEQ ID NO: 331881 - RNA, 21 nt, Bordetella pertussis
gagcccgcgucggcgcgguau

SEQ ID NO: 331882 - RNA, 14 nt, Bordetella pertussis
gagcccgggcgugc

SEQ ID NO: 331883 - RNA, 16 nt, Bordetella pertussis
gagcccgggcgugccu

SEQ ID NO: 331884 - RNA, 14 nt, Bordetella pertussis
gagcccuggcuugg

SEQ ID NO: 331885 - RNA, 17 nt, Bordetella pertussis
gagccgauacaggcgcu

SEQ ID NO: 331886 - RNA, 22 nt, Bordetella pertussis
gagccgauacaggcgcucgcgc

SEQ ID NO: 331887 - RNA, 17 nt, Bordetella pertussis
gagccgccccggcgcgg

SEQ ID NO: 331888 - RNA, 17 nt, Bordetella pertussis
gagccgcgcacacaugg

SEQ ID NO: 331889 - RNA, 22 nt, Bordetella pertussis
gagccgcgcacacauggcgcau

SEQ ID NO: 331890 - RNA, 13 nt, Bordetella pertussis
gagccgcugucgc

SEQ ID NO: 331891 - RNA, 15 nt, Bordetella pertussis
gagccgcugucgcag

SEQ ID NO: 331892 - RNA, 15 nt, Bordetella pertussis
gagccggacgugggc

SEQ ID NO: 331893 - RNA, 16 nt, Bordetella pertussis
gagccggacgugggcg

SEQ ID NO: 331894 - RNA, 18 nt, Bordetella pertussis
gagccggacgugggcgcc

SEQ ID NO: 331895 - RNA, 21 nt, Bordetella pertussis
gagccggacgugggcgccuac

SEQ ID NO: 331896 - RNA, 20 nt, Bordetella pertussis
gagccggagcagucgcgcag

SEQ ID NO: 331897 - RNA, 17 nt, Bordetella pertussis
gagccggcaagccaggg

SEQ ID NO: 331898 - RNA, 20 nt, Bordetella pertussis
gagccggcagaucggcgcug

SEQ ID NO: 331899 - RNA, 13 nt, Bordetella pertussis
gagccggccagcg

SEQ ID NO: 331900 - RNA, 15 nt, Bordetella pertussis
gagccggccagcgcc

SEQ ID NO: 331901 - RNA, 19 nt, Bordetella pertussis
gagccggccagcgccuggg

SEQ ID NO: 331902 - RNA, 22 nt, Bordetella pertussis
gagccggccagcgccugggcgc

SEQ ID NO: 331903 - RNA, 17 nt, Bordetella pertussis
gagccggccgcgcccga

SEQ ID NO: 331904 - RNA, 14 nt, Bordetella pertussis
gagccggcgggcgg

SEQ ID NO: 331905 - RNA, 13 nt, Bordetella pertussis
gagccggcuccag

SEQ ID NO: 331906 - RNA, 15 nt, Bordetella pertussis
gagccgggcaccgag

SEQ ID NO: 331907 - RNA, 13 nt, Bordetella pertussis
gagccgggcgccg

SEQ ID NO: 331908 - RNA, 16 nt, Bordetella pertussis
gagccgguacagccag

SEQ ID NO: 331909 - RNA, 20 nt, Bordetella pertussis
gagccgguacagccaggcca

SEQ ID NO: 331910 - RNA, 20 nt, Bordetella pertussis
gagccguacucgaucgccau

SEQ ID NO: 331911 - RNA, 14 nt, Bordetella pertussis
gagccucuggaaga

SEQ ID NO: 331912 - RNA, 16 nt, Bordetella pertussis
gagccuguccccgccg

SEQ ID NO: 331913 - RNA, 20 nt, Bordetella pertussis
gagccuguccccgcggggac

SEQ ID NO: 331914 - RNA, 20 nt, Bordetella pertussis
gagccugucccgacggggac

SEQ ID NO: 331915 - RNA, 19 nt, Bordetella pertussis
gagccugucccugcgggga

SEQ ID NO: 331916 - RNA, 16 nt, Bordetella pertussis
gagccugggcgcgcgc

SEQ ID NO: 331917 - RNA, 15 nt, Bordetella pertussis
gagccuucggccggc

SEQ ID NO: 331918 - RNA, 17 nt, Bordetella pertussis
gagcgaaauggcggccu

SEQ ID NO: 331919 - RNA, 20 nt, Bordetella pertussis
gagcgaaauggcggccucgg

SEQ ID NO: 331920 - RNA, 18 nt, Bordetella pertussis
gagcgaaugcgcguaguc

SEQ ID NO: 331921 - RNA, 18 nt, Bordetella pertussis
gagcgacccguggcccgg

SEQ ID NO: 331922 - RNA, 16 nt, Bordetella pertussis
gagcgcacaggcggcg

SEQ ID NO: 331923 - RNA, 16 nt, Bordetella pertussis
gagcgcaccauggcgc

SEQ ID NO: 331924 - RNA, 17 nt, Bordetella pertussis
gagcgcaccauggcgcc

SEQ ID NO: 331925 - RNA, 13 nt, Bordetella pertussis
gagcgcaccccgg

SEQ ID NO: 331926 - RNA, 19 nt, Bordetella pertussis
gagcgcaccccggccgacg

SEQ ID NO: 331927 - RNA, 21 nt, Bordetella pertussis
gagcgcacugauagaccgauu

SEQ ID NO: 331928 - RNA, 20 nt, Bordetella pertussis
gagcgcagcaagcugcugcu

SEQ ID NO: 331929 - RNA, 14 nt, Bordetella pertussis
gagcgccacgccag

SEQ ID NO: 331930 - RNA, 15 nt, Bordetella pertussis
gagcgccacgccagc

SEQ ID NO: 331931 - RNA, 20 nt, Bordetella pertussis
gagcgccacgccagcggcga

SEQ ID NO: 331932 - RNA, 13 nt, Bordetella pertussis
gagcgccacgccg

SEQ ID NO: 331933 - RNA, 13 nt, Bordetella pertussis
gagcgccagggcc

SEQ ID NO: 331934 - RNA, 12 nt, Bordetella pertussis
gagcgccgaacc

SEQ ID NO: 331935 - RNA, 16 nt, Bordetella pertussis
gagcgccgccgccaug

SEQ ID NO: 331936 - RNA, 12 nt, Bordetella pertussis
gagcgccgcgcu

SEQ ID NO: 331937 - RNA, 15 nt, Bordetella pertussis
gagcgccgcgcucca

SEQ ID NO: 331938 - RNA, 14 nt, Bordetella pertussis
gagcgccgcguggu

SEQ ID NO: 331939 - RNA, 22 nt, Bordetella pertussis
gagcgccgggcgccgcgcccca

SEQ ID NO: 331940 - RNA, 17 nt, Bordetella pertussis
gagcgccggggcguggc

SEQ ID NO: 331941 - RNA, 19 nt, Bordetella pertussis
gagcgccggggcguggccg

SEQ ID NO: 331942 - RNA, 12 nt, Bordetella pertussis
gagcgccugcag

SEQ ID NO: 331943 - RNA, 14 nt, Bordetella pertussis
gagcgccugggcgg

SEQ ID NO: 331944 - RNA, 19 nt, Bordetella pertussis
gagcgccugggcggccacg

SEQ ID NO: 331945 - RNA, 20 nt, Bordetella pertussis
gagcgccugggcggccacgu

SEQ ID NO: 331946 - RNA, 14 nt, Bordetella pertussis
gagcgcgacgcgcu

SEQ ID NO: 331947 - RNA, 16 nt, Bordetella pertussis
gagcgcgccagcacgg

SEQ ID NO: 331948 - RNA, 22 nt, Bordetella pertussis
gagcgcgcccgcuugggccgcg

SEQ ID NO: 331949 - RNA, 13 nt, Bordetella pertussis
gagcgcgccgccg

SEQ ID NO: 331950 - RNA, 15 nt, Bordetella pertussis
gagcgcgccgccgua

SEQ ID NO: 331951 - RNA, 14 nt, Bordetella pertussis
gagcgcggccaggc

SEQ ID NO: 331952 - RNA, 15 nt, Bordetella pertussis
gagcgcggccaggcg

SEQ ID NO: 331953 - RNA, 14 nt, Bordetella pertussis
gagcgcggccucgc

SEQ ID NO: 331954 - RNA, 15 nt, Bordetella pertussis
gagcgcggcgcgcga

SEQ ID NO: 331955 - RNA, 15 nt, Bordetella pertussis
gagcgcggcgcuggc

SEQ ID NO: 331956 - RNA, 17 nt, Bordetella pertussis
gagcgcggcgcuggcgu

SEQ ID NO: 331957 - RNA, 12 nt, Bordetella pertussis
gagcgcgggccg

SEQ ID NO: 331958 - RNA, 15 nt, Bordetella pertussis
gagcgcgggccgccg

SEQ ID NO: 331959 - RNA, 18 nt, Bordetella pertussis
gagcgcggcaugcgcaug

SEQ ID NO: 331960 - RNA, 20 nt, Bordetella pertussis
gagcgcguggaaccgccgcu

SEQ ID NO: 331961 - RNA, 23 nt, Bordetella pertussis
gagcggccagcaagcgcgccaug

SEQ ID NO: 331962 - RNA, 18 nt, Bordetella pertussis
gagcggccagccugccgc

SEQ ID NO: 331963 - RNA, 13 nt, Bordetella pertussis
gagcggccuggcc

SEQ ID NO: 331964 - RNA, 15 nt, Bordetella pertussis
gagcggccuggcccc

SEQ ID NO: 331965 - RNA, 21 nt, Bordetella pertussis
gagcggccuggccccgcgcga

SEQ ID NO: 331966 - RNA, 20 nt, Bordetella pertussis
gagcggcgugcgcgugcaug

SEQ ID NO: 331967 - RNA, 13 nt, Bordetella pertussis
gagcggggccgcg

SEQ ID NO: 331968 - RNA, 22 nt, Bordetella pertussis
gagcggucgaagaaggccuugg

SEQ ID NO: 331969 - RNA, 18 nt, Bordetella pertussis
gagcuccagccgggucgg

SEQ ID NO: 331970 - RNA, 17 nt, Bordetella pertussis
gagcuccugcaggaugg

SEQ ID NO: 331971 - RNA, 19 nt, Bordetella pertussis
gagcuccugcucgauccgg

SEQ ID NO: 331972 - RNA, 13 nt, Bordetella pertussis
gagcucgauggcu

SEQ ID NO: 331973 - RNA, 19 nt, Bordetella pertussis
gagcucgggugggccggcu

SEQ ID NO: 331974 - RNA, 16 nt, Bordetella pertussis
gagcugagcaccagca

SEQ ID NO: 331975 - RNA, 18 nt, Bordetella pertussis
gagcugcagcccggccag

SEQ ID NO: 331976 - RNA, 12 nt, Bordetella pertussis
gagcugcgcgac

SEQ ID NO: 331977 - RNA, 14 nt, Bordetella pertussis
gagcugcggcgcgg

SEQ ID NO: 331978 - RNA, 16 nt, Bordetella pertussis
gagcugcggcgcggcg

SEQ ID NO: 331979 - RNA, 19 nt, Bordetella pertussis
gagcugcgucuugagcagg

SEQ ID NO: 331980 - RNA, 16 nt, Bordetella pertussis
gagcugcucaccucga

SEQ ID NO: 331981 - RNA, 13 nt, Bordetella pertussis
gagcuggccggcg

SEQ ID NO: 331982 - RNA, 11 nt, Bordetella pertussis
gagcuggcgcu

SEQ ID NO: 331983 - RNA, 17 nt, Bordetella pertussis
gagcuggggccgcgcgc

SEQ ID NO: 331984 - RNA, 19 nt, Bordetella pertussis
gagcuggggccgcgcgcca

SEQ ID NO: 331985 - RNA, 23 nt, Bordetella pertussis
gagcugguccaccaccuucaggg

SEQ ID NO: 331986 - RNA, 14 nt, Bordetella pertussis
gagcuuggccggug

SEQ ID NO: 331987 - RNA, 13 nt, Bordetella pertussis
gaggaaccagccg

SEQ ID NO: 331988 - RNA, 15 nt, Bordetella pertussis
gaggaacgccgcgcu

SEQ ID NO: 331989 - RNA, 23 nt, Bordetella pertussis
gaggaacgccgcgcucagcacca

SEQ ID NO: 331990 - RNA, 14 nt, Bordetella pertussis
gaggaacggcacca

SEQ ID NO: 331991 - RNA, 19 nt, Bordetella pertussis
gaggaacggcaccagccgg

SEQ ID NO: 331992 - RNA, 21 nt, Bordetella pertussis
gaggaacggcaccagccgggc

SEQ ID NO: 331993 - RNA, 17 nt, Bordetella pertussis
gaggaacuggacggcgc

SEQ ID NO: 331994 - RNA, 22 nt, Bordetella pertussis
gaggaacugggcgccggccagg

SEQ ID NO: 331995 - RNA, 21 nt, Bordetella pertussis
gaggacaggggccucaugacg

SEQ ID NO: 331996 - RNA, 13 nt, Bordetella pertussis
gaggaccgcgaug

SEQ ID NO: 331997 - RNA, 19 nt, Bordetella pertussis
gaggaccuguggcgcaccc

SEQ ID NO: 331998 - RNA, 15 nt, Bordetella pertussis
gaggagccggcgggc

SEQ ID NO: 331999 - RNA, 17 nt, Bordetella pertussis
gaggaggugcgccgcuc

SEQ ID NO: 332000 - RNA, 16 nt, Bordetella pertussis
gaggauacggccagcg

SEQ ID NO: 332001 - RNA, 17 nt, Bordetella pertussis
gaggauaucggccaggc

SEQ ID NO: 332002 - RNA, 17 nt, Bordetella pertussis
gaggaugcgcgcggcca

SEQ ID NO: 332003 - RNA, 21 nt, Bordetella pertussis
gaggauguucaugaccgccgc

SEQ ID NO: 332004 - RNA, 19 nt, Bordetella pertussis
gaggcaaucagccccaggc

SEQ ID NO: 332005 - RNA, 17 nt, Bordetella pertussis
gaggcgaacauggccga

SEQ ID NO: 332006 - RNA, 14 nt, Bordetella pertussis
gaggcgaugccccg

SEQ ID NO: 332007 - RNA, 14 nt, Bordetella pertussis
gaggcgcaggccga

SEQ ID NO: 332008 - RNA, 16 nt, Bordetella pertussis
gaggcgcaggccgacg

SEQ ID NO: 332009 - RNA, 22 nt, Bordetella pertussis
gaggcgcaggccgacgcgcugu

SEQ ID NO: 332010 - RNA, 15 nt, Bordetella pertussis
gaggcgcagcgcggc

SEQ ID NO: 332011 - RNA, 19 nt, Bordetella pertussis
gaggcgcagcgcggcacgc

SEQ ID NO: 332012 - RNA, 23 nt, Bordetella pertussis
gaggcuggcgcccacgcacauga

SEQ ID NO: 332013 - RNA, 22 nt, Bordetella pertussis
gaggcuuugucguugauggggc

SEQ ID NO: 332014 - RNA, 20 nt, Bordetella pertussis
gaggcuuuuuuucgccgggc

SEQ ID NO: 332015 - RNA, 15 nt, Bordetella pertussis
gagggaaaacagcgc

SEQ ID NO: 332016 - RNA, 12 nt, Bordetella pertussis
gaggggccagcc

SEQ ID NO: 332017 - RNA, 14 nt, Bordetella pertussis
gaggggggcguggg

SEQ ID NO: 332018 - RNA, 17 nt, Bordetella pertussis
gagggucuggcggccgg

SEQ ID NO: 332019 - RNA, 16 nt, Bordetella pertussis
gagggugucgacgcga

SEQ ID NO: 332020 - RNA, 15 nt, Bordetella pertussis
gaggguuucgacgcc

SEQ ID NO: 332021 - RNA, 15 nt, Bordetella pertussis
gaggucggcggucca

SEQ ID NO: 332022 - RNA, 23 nt, Bordetella pertussis
gaggucggcgguccacagcccgg

SEQ ID NO: 332023 - RNA, 14 nt, Bordetella pertussis
gaggucuugccgau

SEQ ID NO: 332024 - RNA, 23 nt, Bordetella pertussis
gaggugaucgguaaugagcccga

SEQ ID NO: 332025 - RNA, 15 nt, Bordetella pertussis
gaggugcacgugggc

SEQ ID NO: 332026 - RNA, 19 nt, Bordetella pertussis
gaggugcacgugggcacgc

SEQ ID NO: 332027 - RNA, 23 nt, Bordetella pertussis
gaguaguugucgucgcgcuggcc

SEQ ID NO: 332028 - RNA, 16 nt, Bordetella pertussis
gaguucgcgcgccggc

SEQ ID NO: 332029 - RNA, 17 nt, Bordetella pertussis
gaguucgcgcgccggca

SEQ ID NO: 332030 - RNA, 15 nt, Bordetella pertussis
gaguucggcgcggcc

SEQ ID NO: 332031 - RNA, 16 nt, Bordetella pertussis
gaguucggcgcggccu

SEQ ID NO: 332032 - RNA, 14 nt, Bordetella pertussis
gaguucggugucgg

SEQ ID NO: 332033 - RNA, 14 nt, Bordetella pertussis
gaguugcgggucgu

SEQ ID NO: 332034 - RNA, 14 nt, Bordetella pertussis
gauacgcgugcgcg

SEQ ID NO: 332035 - RNA, 15 nt, Bordetella pertussis
gauacgcgugcgcgg

SEQ ID NO: 332036 - RNA, 17 nt, Bordetella pertussis
gauacgcgugcgcggcc

SEQ ID NO: 332037 - RNA, 18 nt, Bordetella pertussis
gauacgcgugcgcggccg

SEQ ID NO: 332038 - RNA, 13 nt, Bordetella pertussis
gauacggccagcg

SEQ ID NO: 332039 - RNA, 14 nt, Bordetella pertussis
gauacgggcgcggc

SEQ ID NO: 332040 - RNA, 21 nt, Bordetella pertussis
gauagcgggccugcagcauga

SEQ ID NO: 332041 - RNA, 16 nt, Bordetella pertussis
gauaggcggccaggcu

SEQ ID NO: 332042 - RNA, 16 nt, Bordetella pertussis
gauaggugcgcagccg

SEQ ID NO: 332043 - RNA, 20 nt, Bordetella pertussis
gauagucgcggaugcgcgcc

SEQ ID NO: 332044 - RNA, 12 nt, Bordetella pertussis
gauauccacgcc

SEQ ID NO: 332045 - RNA, 20 nt, Bordetella pertussis
gauauccagguaggcggcgc

SEQ ID NO: 332046 - RNA, 21 nt, Bordetella pertussis
gauauccagguaggcggcgcg

SEQ ID NO: 332047 - RNA, 16 nt, Bordetella pertussis
gauaucgccauccagg

SEQ ID NO: 332048 - RNA, 22 nt, Bordetella pertussis
gauaucggccaggcgcugcgcg

SEQ ID NO: 332049 - RNA, 23 nt, Bordetella pertussis
gauauuggcgaacgugcgcgcca

SEQ ID NO: 332050 - RNA, 21 nt, Bordetella pertussis
gauauugggggucagcgccga

SEQ ID NO: 332051 - RNA, 16 nt, Bordetella pertussis
gaucaaaaucgugacg

SEQ ID NO: 332052 - RNA, 12 nt, Bordetella pertussis
gaucaagcggcc

SEQ ID NO: 332053 - RNA, 20 nt, Bordetella pertussis
gaucaagcggcccgcgcccu

SEQ ID NO: 332054 - RNA, 18 nt, Bordetella pertussis
gaucaccacgcccgcgcc

SEQ ID NO: 332055 - RNA, 13 nt, Bordetella pertussis
gaucacccacagc

SEQ ID NO: 332056 - RNA, 15 nt, Bordetella pertussis
gaucacccagcggcu

SEQ ID NO: 332057 - RNA, 18 nt, Bordetella pertussis
gaucacccagcggcuggc

SEQ ID NO: 332058 - RNA, 16 nt, Bordetella pertussis
gaucaccgacagcgcc

SEQ ID NO: 332059 - RNA, 20 nt, Bordetella pertussis
gaucaccgacagcgccagcg

SEQ ID NO: 332060 - RNA, 14 nt, Bordetella pertussis
gaucaccgccaugg

SEQ ID NO: 332061 - RNA, 15 nt, Bordetella pertussis
gaucaccgccauggc

SEQ ID NO: 332062 - RNA, 18 nt, Bordetella pertussis
gaucaccgccgcgccgcu

SEQ ID NO: 332063 - RNA, 12 nt, Bordetella pertussis
gaucaccgcaug

SEQ ID NO: 332064 - RNA, 20 nt, Bordetella pertussis
gaucaccgcauggaaccggu

SEQ ID NO: 332065 - RNA, 20 nt, Bordetella pertussis
gaucaccgccgcggcgaugc

SEQ ID NO: 332066 - RNA, 17 nt, Bordetella pertussis
gaucacgaacagcgcca

SEQ ID NO: 332067 - RNA, 22 nt, Bordetella pertussis
gaucacgaacagcgccaggcuc

SEQ ID NO: 332068 - RNA, 15 nt, Bordetella pertussis
gaucacgaagcccag

SEQ ID NO: 332069 - RNA, 22 nt, Bordetella pertussis
gaucacgcgcuccggcugcgcg

SEQ ID NO: 332070 - RNA, 12 nt, Bordetella pertussis
gaucacggcgcg

SEQ ID NO: 332071 - RNA, 19 nt, Bordetella pertussis
gaucacggcgcgcgccugc

SEQ ID NO: 332072 - RNA, 21 nt, Bordetella pertussis
gaucacgggcuguucgcgcag

SEQ ID NO: 332073 - RNA, 17 nt, Bordetella pertussis
gauccagggcgaucagc

SEQ ID NO: 332074 - RNA, 14 nt, Bordetella pertussis
gaucccaggccggc

SEQ ID NO: 332075 - RNA, 14 nt, Bordetella pertussis
gaucccaucgcgcg

SEQ ID NO: 332076 - RNA, 14 nt, Bordetella pertussis
gaucccaggcgcuc

SEQ ID NO: 332077 - RNA, 13 nt, Bordetella pertussis
gaucccggcgcca

SEQ ID NO: 332078 - RNA, 15 nt, Bordetella pertussis
gaucccggcgccagc

SEQ ID NO: 332079 - RNA, 15 nt, Bordetella pertussis
gaucccggcgcuggc

SEQ ID NO: 332080 - RNA, 16 nt, Bordetella pertussis
gaucccggcgcuggcc

SEQ ID NO: 332081 - RNA, 17 nt, Bordetella pertussis
gaucccggcgcuggccg

SEQ ID NO: 332082 - RNA, 24 nt, Bordetella pertussis
gaucccggcgcuggccgccauggc

SEQ ID NO: 332083 - RNA, 23 nt, Bordetella pertussis
gaucccgucauggcggcaggcgc

SEQ ID NO: 332084 - RNA, 23 nt, Bordetella pertussis
gauccgguaugccugccagccca

SEQ ID NO: 332085 - RNA, 12 nt, Bordetella pertussis
gauccgguugac

SEQ ID NO: 332086 - RNA, 14 nt, Bordetella pertussis
gauccgguugacga

SEQ ID NO: 332087 - RNA, 15 nt, Bordetella pertussis
gauccgugcggcgcg

SEQ ID NO: 332088 - RNA, 17 nt, Bordetella pertussis
gauccucgccagcggca

SEQ ID NO: 332089 - RNA, 18 nt, Bordetella pertussis
gauccucgcugccggcgc

SEQ ID NO: 332090 - RNA, 22 nt, Bordetella pertussis
gaucgacagccuuuccuccugc

SEQ ID NO: 332091 - RNA, 18 nt, Bordetella pertussis
gaucgacaugcuggccca

SEQ ID NO: 332092 - RNA, 14 nt, Bordetella pertussis
gaucgaccgccagc

SEQ ID NO: 332093 - RNA, 17 nt, Bordetella pertussis
gaucgaccgccagcagg

SEQ ID NO: 332094 - RNA, 23 nt, Bordetella pertussis
gaucgacgagaugccgaugaugg

SEQ ID NO: 332095 - RNA, 13 nt, Bordetella pertussis
gaucgacgcgaug

SEQ ID NO: 332096 - RNA, 19 nt, Bordetella pertussis
gaucgacgcgauguccagc

SEQ ID NO: 332097 - RNA, 20 nt, Bordetella pertussis
gaucgacgcgauguccagcu

SEQ ID NO: 332098 - RNA, 14 nt, Bordetella pertussis
gaucgccggcuacg

SEQ ID NO: 332099 - RNA, 19 nt, Bordetella pertussis
gaucgccgguagcgcuggg

SEQ ID NO: 332100 - RNA, 14 nt, Bordetella pertussis
gaucgccucggggc

SEQ ID NO: 332101 - RNA, 21 nt, Bordetella pertussis
gaucgccucggggcucguggu

SEQ ID NO: 332102 - RNA, 15 nt, Bordetella pertussis
gaucgccuggggcgg

SEQ ID NO: 332103 - RNA, 23 nt, Bordetella pertussis
gaucgccuggggggucaaccagg

SEQ ID NO: 332104 - RNA, 14 nt, Bordetella pertussis
gaucgcgcagcacc

SEQ ID NO: 332105 - RNA, 18 nt, Bordetella pertussis
gaucgcgcagcaccgcca

SEQ ID NO: 332106 - RNA, 22 nt, Bordetella pertussis
gaucgcgcagcaccgccagcgc

SEQ ID NO: 332107 - RNA, 16 nt, Bordetella pertussis
gaucgcgcacagcaug

SEQ ID NO: 332108 - RNA, 20 nt, Bordetella pertussis
gaucgcgcagcgccuggccg

SEQ ID NO: 332109 - RNA, 13 nt, Bordetella pertussis
gaucgcgccaggc

SEQ ID NO: 332110 - RNA, 16 nt, Bordetella pertussis
gaucgcgccaggcgua

SEQ ID NO: 332111 - RNA, 12 nt, Bordetella pertussis
gaucgcgccggc

SEQ ID NO: 332112 - RNA, 14 nt, Bordetella pertussis
gaucgcgccggccu

SEQ ID NO: 332113 - RNA, 18 nt, Bordetella pertussis
gaucgcgccggccugggc

SEQ ID NO: 332114 - RNA, 22 nt, Bordetella pertussis
gaucgcgccggccugggcggcg

SEQ ID NO: 332115 - RNA, 23 nt, Bordetella pertussis
gaucgcgccggccugggcggcgg

SEQ ID NO: 332116 - RNA, 14 nt, Bordetella pertussis
gaucgcgccguccg

SEQ ID NO: 332117 - RNA, 20 nt, Bordetella pertussis
gaucgcgccuaccggcgccg

SEQ ID NO: 332118 - RNA, 16 nt, Bordetella pertussis
gaucgcggccagcggc

SEQ ID NO: 332119 - RNA, 17 nt, Bordetella pertussis
gaucgcggccagcggca

SEQ ID NO: 332120 - RNA, 16 nt, Bordetella pertussis
gaucgcggccagccgg

SEQ ID NO: 332121 - RNA, 14 nt, Bordetella pertussis
gaucgcggccagcg

SEQ ID NO: 332122 - RNA, 18 nt, Bordetella pertussis
gaucggacgggccgauga

SEQ ID NO: 332123 - RNA, 18 nt, Bordetella pertussis
gaucggagaaaucgccgc

SEQ ID NO: 332124 - RNA, 12 nt, Bordetella pertussis
gaucggccaggc

SEQ ID NO: 332125 - RNA, 23 nt, Bordetella pertussis
gaucggccucggucucgugcgug

SEQ ID NO: 332126 - RNA, 19 nt, Bordetella pertussis
gaucggcgcaaccggcccg

SEQ ID NO: 332127 - RNA, 14 nt, Bordetella pertussis
gaucggcgccauga

SEQ ID NO: 332128 - RNA, 21 nt, Bordetella pertussis
gaucggcgccaugaucgccgg

SEQ ID NO: 332129 - RNA, 22 nt, Bordetella pertussis
gaucggcgccaugaucgccggc

SEQ ID NO: 332130 - RNA, 15 nt, Bordetella pertussis
gaucggcgccgcgcg

SEQ ID NO: 332131 - RNA, 18 nt, Bordetella pertussis
gaucggcgccgcgcgcgg

SEQ ID NO: 332132 - RNA, 19 nt, Bordetella pertussis
gaucgucuacgcgaacccc

SEQ ID NO: 332133 - RNA, 15 nt, Bordetella pertussis
gaucgugcacgcccg

SEQ ID NO: 332134 - RNA, 19 nt, Bordetella pertussis
gaucgugcccagcuggcac

SEQ ID NO: 332135 - RNA, 21 nt, Bordetella pertussis
gaucgugcccagcuggcaccg

SEQ ID NO: 332136 - RNA, 18 nt, Bordetella pertussis
gaucguggcgccgcgggc

SEQ ID NO: 332137 - RNA, 14 nt, Bordetella pertussis
gaucuacgcgcgcg

SEQ ID NO: 332138 - RNA, 19 nt, Bordetella pertussis
gaucuacgcgcgcgccggc

SEQ ID NO: 332139 - RNA, 20 nt, Bordetella pertussis
gaucuacgcgcgcgccggca

SEQ ID NO: 332140 - RNA, 15 nt, Bordetella pertussis
gaucuccacccccgg

SEQ ID NO: 332141 - RNA, 17 nt, Bordetella pertussis
gaucuccacccccgggc

SEQ ID NO: 332142 - RNA, 16 nt, Bordetella pertussis
gaucucgcccagcagg

SEQ ID NO: 332143 - RNA, 21 nt, Bordetella pertussis
gaucucgcccugcucgcgcag

SEQ ID NO: 332144 - RNA, 13 nt, Bordetella pertussis
gaucucgcgcacc

SEQ ID NO: 332145 - RNA, 14 nt, Bordetella pertussis
gaucucgcgcaccg

SEQ ID NO: 332146 - RNA, 17 nt, Bordetella pertussis
gaucucgcgcaccgaca

SEQ ID NO: 332147 - RNA, 16 nt, Bordetella pertussis
gaucucgcgcgcgcgg

SEQ ID NO: 332148 - RNA, 19 nt, Bordetella pertussis
gaucucgcgcgcgcggucc

SEQ ID NO: 332149 - RNA, 20 nt, Bordetella pertussis
gaucucgcgcgcgcggucca

SEQ ID NO: 332150 - RNA, 18 nt, Bordetella pertussis
gaucucgcggcugguggu

SEQ ID NO: 332151 - RNA, 16 nt, Bordetella pertussis
gaucucggccagcagc

SEQ ID NO: 332152 - RNA, 20 nt, Bordetella pertussis
gaucucggccagcagcgccu

SEQ ID NO: 332153 - RNA, 14 nt, Bordetella pertussis
gaucucgggcaggu

SEQ ID NO: 332154 - RNA, 23 nt, Bordetella pertussis
gaucucgggcgaggucagcccgg

SEQ ID NO: 332155 - RNA, 15 nt, Bordetella pertussis
gaucugcgcggcggu

SEQ ID NO: 332156 - RNA, 14 nt, Bordetella pertussis
gaucugcuggcucg

SEQ ID NO: 332157 - RNA, 13 nt, Bordetella pertussis
gaucugcugggcc

SEQ ID NO: 332158 - RNA, 11 nt, Bordetella pertussis
gaucugcuuga

SEQ ID NO: 332159 - RNA, 23 nt, Bordetella pertussis
gaucugcuugaggccgcgcgccu

SEQ ID NO: 332160 - RNA, 19 nt, Bordetella pertussis
gaucuggcgcgcgaccagg

SEQ ID NO: 332161 - RNA, 21 nt, Bordetella pertussis
gaucuggcgcgcgaccaggcu

SEQ ID NO: 332162 - RNA, 17 nt, Bordetella pertussis
gaucuggccggcgcugg

SEQ ID NO: 332163 - RNA, 20 nt, Bordetella pertussis
gaucuucucgacggcgcgcg

SEQ ID NO: 332164 - RNA, 17 nt, Bordetella pertussis
gaucuucucgccgcgcg

SEQ ID NO: 332165 - RNA, 15 nt, Bordetella pertussis
gaucuugccggccgu

SEQ ID NO: 332166 - RNA, 17 nt, Bordetella pertussis
gaucuugccggccuggc

SEQ ID NO: 332167 - RNA, 20 nt, Bordetella pertussis
gaucuugccgaugcggcgca

SEQ ID NO: 332168 - RNA, 17 nt, Bordetella pertussis
gaugaccucgcgcugca

SEQ ID NO: 332169 - RNA, 19 nt, Bordetella pertussis
gaugaccugcgccaggugc

SEQ ID NO: 332170 - RNA, 22 nt, Bordetella pertussis
gaugaccuggugcaccacgcgc

SEQ ID NO: 332171 - RNA, 14 nt, Bordetella pertussis
gaugacgcgccgcg

SEQ ID NO: 332172 - RNA, 18 nt, Bordetella pertussis
gaugacggggcggcgccu

SEQ ID NO: 332173 - RNA, 17 nt, Bordetella pertussis
gaugacguggcaguccu

SEQ ID NO: 332174 - RNA, 16 nt, Bordetella pertussis
gaugagcaggccgggu

SEQ ID NO: 332175 - RNA, 13 nt, Bordetella pertussis
gaugagcgcgccg

SEQ ID NO: 332176 - RNA, 14 nt, Bordetella pertussis
gaugaggccaggga

SEQ ID NO: 332177 - RNA, 15 nt, Bordetella pertussis
gaugaucgcgcagca

SEQ ID NO: 332178 - RNA, 16 nt, Bordetella pertussis
gaugaucuacgcgcgc

SEQ ID NO: 332179 - RNA, 22 nt, Bordetella pertussis
gaugaucuacgcgcgcgccggc

SEQ ID NO: 332180 - RNA, 15 nt, Bordetella pertussis
gaugauggccagguc

SEQ ID NO: 332181 - RNA, 17 nt, Bordetella pertussis
gaugauggcguccgcgu

SEQ ID NO: 332182 - RNA, 19 nt, Bordetella pertussis
gaugauggcguccgcgucg

SEQ ID NO: 332183 - RNA, 19 nt, Bordetella pertussis
gaugauggggucgccgggc

SEQ ID NO: 332184 - RNA, 16 nt, Bordetella pertussis
gaugcaauagcgcccg

SEQ ID NO: 332185 - RNA, 13 nt, Bordetella pertussis
gaugcacccaggc

SEQ ID NO: 332186 - RNA, 16 nt, Bordetella pertussis
gaugcacccaggcgcc

SEQ ID NO: 332187 - RNA, 18 nt, Bordetella pertussis
gaugcacggaacgugccg

SEQ ID NO: 332188 - RNA, 17 nt, Bordetella pertussis
gaugcagcacgucggcg

SEQ ID NO: 332189 - RNA, 21 nt, Bordetella pertussis
gaugcagcacgucggcgucgg

SEQ ID NO: 332190 - RNA, 16 nt, Bordetella pertussis
gaugcaggccugcacg

SEQ ID NO: 332191 - RNA, 15 nt, Bordetella pertussis
gaugccagcggcgca

SEQ ID NO: 332192 - RNA, 17 nt, Bordetella pertussis
gaugccagcggcgcagc

SEQ ID NO: 332193 - RNA, 23 nt, Bordetella pertussis
gaugccagugaaacgcgacgcgc

SEQ ID NO: 332194 - RNA, 20 nt, Bordetella pertussis
gaugccaguuguagcgguca

SEQ ID NO: 332195 - RNA, 12 nt, Bordetella pertussis
gaugcccaccag

SEQ ID NO: 332196 - RNA, 14 nt, Bordetella pertussis
gaugcccaccagcc

SEQ ID NO: 332197 - RNA, 16 nt, Bordetella pertussis
gaugcccagcaccgcc

SEQ ID NO: 332198 - RNA, 13 nt, Bordetella pertussis
gaugcccagcgcc

SEQ ID NO: 332199 - RNA, 14 nt, Bordetella pertussis
gaugcccagcgccg

SEQ ID NO: 332200 - RNA, 13 nt, Bordetella pertussis
gaugcccagcacc

SEQ ID NO: 332201 - RNA, 16 nt, Bordetella pertussis
gaugcccaggcccgcc

SEQ ID NO: 332202 - RNA, 13 nt, Bordetella pertussis
gaugcccagggcc

SEQ ID NO: 332203 - RNA, 16 nt, Bordetella pertussis
gaugcccagggccgcg

SEQ ID NO: 332204 - RNA, 16 nt, Bordetella pertussis
gaugcccaugcgcugc

SEQ ID NO: 332205 - RNA, 17 nt, Bordetella pertussis
gaugcccaugcgcugcg

SEQ ID NO: 332206 - RNA, 19 nt, Bordetella pertussis
gaugcccaugcgcugcgcc

SEQ ID NO: 332207 - RNA, 13 nt, Bordetella pertussis
gaugccccagguc

SEQ ID NO: 332208 - RNA, 22 nt, Bordetella pertussis
gaugccccaguccaggccggcc

SEQ ID NO: 332209 - RNA, 19 nt, Bordetella pertussis
gaugcccgaggcggcgcgg

SEQ ID NO: 332210 - RNA, 15 nt, Bordetella pertussis
gaugcccgcgcacca

SEQ ID NO: 332211 - RNA, 20 nt, Bordetella pertussis
gaugcccgcgcaccaggcgc

SEQ ID NO: 332212 - RNA, 17 nt, Bordetella pertussis
gaugcccugcgccagcg

SEQ ID NO: 332213 - RNA, 16 nt, Bordetella pertussis
gaugcccuggguggcg

SEQ ID NO: 332214 - RNA, 20 nt, Bordetella pertussis
gaugcccuggguggcggggc

SEQ ID NO: 332215 - RNA, 14 nt, Bordetella pertussis
gaugccgaacagcc

SEQ ID NO: 332216 - RNA, 20 nt, Bordetella pertussis
gaugccgaacagccagggca

SEQ ID NO: 332217 - RNA, 17 nt, Bordetella pertussis
gaugccgaaccagauca

SEQ ID NO: 332218 - RNA, 23 nt, Bordetella pertussis
gaugccgaaccagaucaggucga

SEQ ID NO: 332219 - RNA, 19 nt, Bordetella pertussis
gaugccgaacugucgcgcc

SEQ ID NO: 332220 - RNA, 21 nt, Bordetella pertussis
gaugccgaacugucgcgccac

SEQ ID NO: 332221 - RNA, 15 nt, Bordetella pertussis
gaugccgaccaggcc

SEQ ID NO: 332222 - RNA, 16 nt, Bordetella pertussis
gaugccgaccaggccc

SEQ ID NO: 332223 - RNA, 20 nt, Bordetella pertussis
gaugccgaccaggcugcgcg

SEQ ID NO: 332224 - RNA, 17 nt, Bordetella pertussis
gaugcccuuggcggcga

SEQ ID NO: 332225 - RNA, 20 nt, Bordetella pertussis
gaugcccuuggcggcgaucg

SEQ ID NO: 332226 - RNA, 18 nt, Bordetella pertussis
gaugccgaucgccgacag

SEQ ID NO: 332227 - RNA, 21 nt, Bordetella pertussis
gaugccgaugauggccauggc

SEQ ID NO: 332228 - RNA, 12 nt, Bordetella pertussis
gaugccgccaug

SEQ ID NO: 332229 - RNA, 13 nt, Bordetella pertussis
gaugccgccaugc

SEQ ID NO: 332230 - RNA, 23 nt, Bordetella pertussis
gaugccgccaugcgccagcagga

SEQ ID NO: 332231 - RNA, 23 nt, Bordetella pertussis
gaugccgcccagcaugcgcgcga

SEQ ID NO: 332232 - RNA, 16 nt, Bordetella pertussis
gaugccgcccacgcca

SEQ ID NO: 332233 - RNA, 19 nt, Bordetella pertussis
gaugccgccgaaccagcgc

SEQ ID NO: 332234 - RNA, 18 nt, Bordetella pertussis
gaugccggcgcugcgcag

SEQ ID NO: 332235 - RNA, 19 nt, Bordetella pertussis
gaugccggcguggcgcgca

SEQ ID NO: 332236 - RNA, 20 nt, Bordetella pertussis
gaugccggcguggcgcgcaa

SEQ ID NO: 332237 - RNA, 14 nt, Bordetella pertussis
gaugccgggcacgu

SEQ ID NO: 332238 - RNA, 22 nt, Bordetella pertussis
gaugccggucaggaugcgcgcc

SEQ ID NO: 332239 - RNA, 23 nt, Bordetella pertussis
gaugccggucaggaugcgcgcca

SEQ ID NO: 332240 - RNA, 20 nt, Bordetella pertussis
gaugccggucuccagcgcgu

SEQ ID NO: 332241 - RNA, 16 nt, Bordetella pertussis
gaugccguaccaggug

SEQ ID NO: 332242 - RNA, 15 nt, Bordetella pertussis
gaugccgucgaaggc

SEQ ID NO: 332243 - RNA, 18 nt, Bordetella pertussis
gaugccgucgaaggccgc

SEQ ID NO: 332244 - RNA, 14 nt, Bordetella pertussis
gaugccgucggccu

SEQ ID NO: 332245 - RNA, 17 nt, Bordetella pertussis
gaugccgucggccugga

SEQ ID NO: 332246 - RNA, 17 nt, Bordetella pertussis
gaugcgaucgucgcugc

SEQ ID NO: 332247 - RNA, 15 nt, Bordetella pertussis
gaugcgcaccggcca

SEQ ID NO: 332248 - RNA, 14 nt, Bordetella pertussis
gaugcgcacgccca

SEQ ID NO: 332249 - RNA, 23 nt, Bordetella pertussis
gaugcgcacgggcgagggcugcc

SEQ ID NO: 332250 - RNA, 13 nt, Bordetella pertussis
gaugcgcagcagg

SEQ ID NO: 332251 - RNA, 17 nt, Bordetella pertussis
gaugcgcagcaggcgcg

SEQ ID NO: 332252 - RNA, 18 nt, Bordetella pertussis
gaugcgccacaaagggcg

SEQ ID NO: 332253 - RNA, 19 nt, Bordetella pertussis
gaugcgcaggacggcgccg

SEQ ID NO: 332254 - RNA, 13 nt, Bordetella pertussis
gaugcgccaggcc

SEQ ID NO: 332255 - RNA, 13 nt, Bordetella pertussis
gaugcgcuggccg

SEQ ID NO: 332256 - RNA, 14 nt, Bordetella pertussis
gaugcgcugggcca

SEQ ID NO: 332257 - RNA, 22 nt, Bordetella pertussis
gaugcgcugggccaggccggcc

SEQ ID NO: 332258 - RNA, 16 nt, Bordetella pertussis
gaugcgcuugccgccc

SEQ ID NO: 332259 - RNA, 18 nt, Bordetella pertussis
gaugcgguacugcggcgc

SEQ ID NO: 332260 - RNA, 19 nt, Bordetella pertussis
gaugcgguacugcggcgcc

SEQ ID NO: 332261 - RNA, 22 nt, Bordetella pertussis
gaugcgguuguugccgcgucga

SEQ ID NO: 332262 - RNA, 18 nt, Bordetella pertussis
gaugcgguuuuugaggac

SEQ ID NO: 332263 - RNA, 21 nt, Bordetella pertussis
gaugcgucaggggcaugccgg

SEQ ID NO: 332264 - RNA, 23 nt, Bordetella pertussis
gaugcguccgucggguugccgcu

SEQ ID NO: 332265 - RNA, 20 nt, Bordetella pertussis
gaugcguucgaaagccagcg

SEQ ID NO: 332266 - RNA, 23 nt, Bordetella pertussis
gaugcguucgaaagccagcgccu

SEQ ID NO: 332267 - RNA, 23 nt, Bordetella pertussis
gaugcguucgacuucguccggcg

SEQ ID NO: 332268 - RNA, 17 nt, Bordetella pertussis
gaugcuggucagccugg

SEQ ID NO: 332269 - RNA, 19 nt, Bordetella pertussis
gaugcuggucagccugggc

SEQ ID NO: 332270 - RNA, 19 nt, Bordetella pertussis
gauggaaaugccguccagg

SEQ ID NO: 332271 - RNA, 22 nt, Bordetella pertussis
gauggaacucguuggccagcgc

SEQ ID NO: 332272 - RNA, 14 nt, Bordetella pertussis
gauggacuggccgc

SEQ ID NO: 332273 - RNA, 16 nt, Bordetella pertussis
gauggagagggccugg

SEQ ID NO: 332274 - RNA, 17 nt, Bordetella pertussis
gauggagagggccuggu

SEQ ID NO: 332275 - RNA, 14 nt, Bordetella pertussis
gauggccagcagcg

SEQ ID NO: 332276 - RNA, 18 nt, Bordetella pertussis
gauggccagcagcgccgc

SEQ ID NO: 332277 - RNA, 22 nt, Bordetella pertussis
gauggccagcagcgccgccagc

SEQ ID NO: 332278 - RNA, 13 nt, Bordetella pertussis
gauggccagcgcg

SEQ ID NO: 332279 - RNA, 20 nt, Bordetella pertussis
gauggccagguggcggcggc

SEQ ID NO: 332280 - RNA, 13 nt, Bordetella pertussis
gauggccaucgac

SEQ ID NO: 332281 - RNA, 14 nt, Bordetella pertussis
gauggcccagggca

SEQ ID NO: 332282 - RNA, 17 nt, Bordetella pertussis
gauggcccagggcagcg

SEQ ID NO: 332283 - RNA, 22 nt, Bordetella pertussis
gauggcccgguaggccacgcgc

SEQ ID NO: 332284 - RNA, 16 nt, Bordetella pertussis
gauggccgacaugucg

SEQ ID NO: 332285 - RNA, 17 nt, Bordetella pertussis
gauggccgacaugucgu

SEQ ID NO: 332286 - RNA, 17 nt, Bordetella pertussis
gauggcccuugcccagc

SEQ ID NO: 332287 - RNA, 18 nt, Bordetella pertussis
gauggcccuugcccagcg

SEQ ID NO: 332288 - RNA, 14 nt, Bordetella pertussis
gauggccgccagcg

SEQ ID NO: 332289 - RNA, 20 nt, Bordetella pertussis
gauggccgccagcggcuggc

SEQ ID NO: 332290 - RNA, 17 nt, Bordetella pertussis
gauggcggccgccagcg

SEQ ID NO: 332291 - RNA, 14 nt, Bordetella pertussis
gauggcggggaugg

SEQ ID NO: 332292 - RNA, 23 nt, Bordetella pertussis
gauggcgggguuggccgccagga

SEQ ID NO: 332293 - RNA, 21 nt, Bordetella pertussis
gauggcguacagcagggugcc

SEQ ID NO: 332294 - RNA, 16 nt, Bordetella pertussis
gauggcguccagcagc

SEQ ID NO: 332295 - RNA, 14 nt, Bordetella pertussis
gauguagcccaugu

SEQ ID NO: 332296 - RNA, 23 nt, Bordetella pertussis
gaugucaguccucaugcgggaca

SEQ ID NO: 332297 - RNA, 19 nt, Bordetella pertussis
gauguccggcgcgaacggc

SEQ ID NO: 332298 - RNA, 23 nt, Bordetella pertussis
gauguccugguugccgaggacgg

SEQ ID NO: 332299 - RNA, 20 nt, Bordetella pertussis
gaugucgaacagcugcagcg

SEQ ID NO: 332300 - RNA, 23 nt, Bordetella pertussis
gaugucgaacagcugcagcgacu

SEQ ID NO: 332301 - RNA, 17 nt, Bordetella pertussis
gaugucgccgccgcgca

SEQ ID NO: 332302 - RNA, 15 nt, Bordetella pertussis
gaugucgccgccugc

SEQ ID NO: 332303 - RNA, 19 nt, Bordetella pertussis
gaugucgcgcaccgccugc

SEQ ID NO: 332304 - RNA, 14 nt, Bordetella pertussis
gaugucgcgcgccu

SEQ ID NO: 332305 - RNA, 16 nt, Bordetella pertussis
gaugucgcgcgccugc

SEQ ID NO: 332306 - RNA, 18 nt, Bordetella pertussis
gaugucggugaaggccac

SEQ ID NO: 332307 - RNA, 18 nt, Bordetella pertussis
gaugucgugaucgccagc

SEQ ID NO: 332308 - RNA, 15 nt, Bordetella pertussis
gaugugcagcgcacg

SEQ ID NO: 332309 - RNA, 15 nt, Bordetella pertussis
gauguugcgcaggcu

SEQ ID NO: 332310 - RNA, 18 nt, Bordetella pertussis
gauguugcgcaggcuguc

SEQ ID NO: 332311 - RNA, 22 nt, Bordetella pertussis
gauucacaggcccgcgcggcca

SEQ ID NO: 332312 - RNA, 15 nt, Bordetella pertussis
gauucaugggcggcg

SEQ ID NO: 332313 - RNA, 15 nt, Bordetella pertussis
gauuccaccuugccg

SEQ ID NO: 332314 - RNA, 17 nt, Bordetella pertussis
gauucccaggcccggcc

SEQ ID NO: 332315 - RNA, 15 nt, Bordetella pertussis
gauugaccagcacca

SEQ ID NO: 332316 - RNA, 18 nt, Bordetella pertussis
gauugaccagcaccagcg

SEQ ID NO: 332317 - RNA, 17 nt, Bordetella pertussis
gauugaugcccaugcgc

SEQ ID NO: 332318 - RNA, 15 nt, Bordetella pertussis
gauugagcacgcaug

SEQ ID NO: 332319 - RNA, 23 nt, Bordetella pertussis
gauugcaucuccaggaugcgcga

SEQ ID NO: 332320 - RNA, 21 nt, Bordetella pertussis
gauugccgccgcgcagccgac

SEQ ID NO: 332321 - RNA, 14 nt, Bordetella pertussis
gauuggccaccagg

SEQ ID NO: 332322 - RNA, 21 nt, Bordetella pertussis
gauuggccgagcgcggaucga

SEQ ID NO: 332323 - RNA, 12 nt, Bordetella pertussis
gauuggcgcugc

SEQ ID NO: 332324 - RNA, 18 nt, Bordetella pertussis
gauuggcgaaaggcaccg

SEQ ID NO: 332325 - RNA, 14 nt, Bordetella pertussis
gcaaaacgcgcauu

SEQ ID NO: 332326 - RNA, 23 nt, Bordetella pertussis
gcaaaacggugccuugcggcgcc

SEQ ID NO: 332327 - RNA, 22 nt, Bordetella pertussis
gcaaaccgacgcggccagcggc

SEQ ID NO: 332328 - RNA, 16 nt, Bordetella pertussis
gcaaacggcggcaggc

SEQ ID NO: 332329 - RNA, 23 nt, Bordetella pertussis
gcaaacggcggcaggccgcgcca

SEQ ID NO: 332330 - RNA, 19 nt, Bordetella pertussis
gcaaacgggggcaggccgc

SEQ ID NO: 332331 - RNA, 15 nt, Bordetella pertussis
gcaauaccuucagcc

SEQ ID NO: 332332 - RNA, 17 nt, Bordetella pertussis
gcaauacgccgccggcg

SEQ ID NO: 332333 - RNA, 18 nt, Bordetella pertussis
gcaauacgucgcgaccgc

SEQ ID NO: 332334 - RNA, 14 nt, Bordetella pertussis
gcaauacgugcgcg

SEQ ID NO: 332335 - RNA, 16 nt, Bordetella pertussis
gcaauaggccgcgaug

SEQ ID NO: 332336 - RNA, 20 nt, Bordetella pertussis
gcaaucgacgaacaaggccg

SEQ ID NO: 332337 - RNA, 21 nt, Bordetella pertussis
gcaaucgaugaagaucaggcg

SEQ ID NO: 332338 - RNA, 22 nt, Bordetella pertussis
gcaaucggagguaugcacgacc

SEQ ID NO: 332339 - RNA, 17 nt, Bordetella pertussis
gcaaucgggguggcgcc

SEQ ID NO: 332340 - RNA, 14 nt, Bordetella pertussis
gcaaugcggccagg

SEQ ID NO: 332341 - RNA, 16 nt, Bordetella pertussis
gcaaugcggccaggcc

SEQ ID NO: 332342 - RNA, 20 nt, Bordetella pertussis
gcaauuuucgguauggcggc

SEQ ID NO: 332343 - RNA, 15 nt, Bordetella pertussis
gcacaacccgcccgg

SEQ ID NO: 332344 - RNA, 16 nt, Bordetella pertussis
gcacaaccuggcgcgc

SEQ ID NO: 332345 - RNA, 16 nt, Bordetella pertussis
gcacaccgugccgcag

SEQ ID NO: 332346 - RNA, 19 nt, Bordetella pertussis
gcacacgaccggcuugccg

SEQ ID NO: 332347 - RNA, 20 nt, Bordetella pertussis
gcacacgcauuugcagcggc

SEQ ID NO: 332348 - RNA, 21 nt, Bordetella pertussis
gcacacgcauuugcagcggcg

SEQ ID NO: 332349 - RNA, 18 nt, Bordetella pertussis
gcacacgccuucggcgac

SEQ ID NO: 332350 - RNA, 20 nt, Bordetella pertussis
gcacacgccuucggcgacuu

SEQ ID NO: 332351 - RNA, 14 nt, Bordetella pertussis
gcacacggucagca

SEQ ID NO: 332352 - RNA, 14 nt, Bordetella pertussis
gcacacucugucgc

SEQ ID NO: 332353 - RNA, 17 nt, Bordetella pertussis
gcacacucugucgcgga

SEQ ID NO: 332354 - RNA, 16 nt, Bordetella pertussis
gcacacuggccagcaa

SEQ ID NO: 332355 - RNA, 17 nt, Bordetella pertussis
gcacacuggccagcaag

SEQ ID NO: 332356 - RNA, 20 nt, Bordetella pertussis
gcacacuggccagcaagcgc

SEQ ID NO: 332357 - RNA, 12 nt, Bordetella pertussis
gcacagcacguc

SEQ ID NO: 332358 - RNA, 22 nt, Bordetella pertussis
gcacagcaugcgcuggucgcgc

SEQ ID NO: 332359 - RNA, 19 nt, Bordetella pertussis
gcacagcccgaucgacggc

SEQ ID NO: 332360 - RNA, 20 nt, Bordetella pertussis
gcacagcccgaucgacggcc

SEQ ID NO: 332361 - RNA, 17 nt, Bordetella pertussis
gcacagccggggcgagc

SEQ ID NO: 332362 - RNA, 22 nt, Bordetella pertussis
gcacagccggggcgagcgcagc

SEQ ID NO: 332363 - RNA, 19 nt, Bordetella pertussis
gcacagcgcgcaacuccag

SEQ ID NO: 332364 - RNA, 20 nt, Bordetella pertussis
gcacagcgcgcaacuccagc

SEQ ID NO: 332365 - RNA, 18 nt, Bordetella pertussis
gcacagcgcggcgaaggc

SEQ ID NO: 332366 - RNA, 15 nt, Bordetella pertussis
gcacagcgucccagc

SEQ ID NO: 332367 - RNA, 13 nt, Bordetella pertussis
gcacagcguggcg

SEQ ID NO: 332368 - RNA, 17 nt, Bordetella pertussis
gcacagcguggcgaagu

SEQ ID NO: 332369 - RNA, 17 nt, Bordetella pertussis
gcacaggccaucggcgc

SEQ ID NO: 332370 - RNA, 19 nt, Bordetella pertussis
gcacaggccaucggcgcca

SEQ ID NO: 332371 - RNA, 22 nt, Bordetella pertussis
gcacaggccaucggcgccaagc

SEQ ID NO: 332372 - RNA, 14 nt, Bordetella pertussis
gcacaggcgcucgc

SEQ ID NO: 332373 - RNA, 17 nt, Bordetella pertussis
gcacaggcggcgccggc

SEQ ID NO: 332374 - RNA, 19 nt, Bordetella pertussis
gcacaggcggcgccggcac

SEQ ID NO: 332375 - RNA, 18 nt, Bordetella pertussis
gcacaguacuuguugcgu

SEQ ID NO: 332376 - RNA, 19 nt, Bordetella pertussis
gcacaguucgugcaccagc

SEQ ID NO: 332377 - RNA, 21 nt, Bordetella pertussis
gcacauacagcggagccgcgc

SEQ ID NO: 332378 - RNA, 19 nt, Bordetella pertussis
gcacauagcgcaagcccgu

SEQ ID NO: 332379 - RNA, 18 nt, Bordetella pertussis
gcacaucagcgugccgcc

SEQ ID NO: 332380 - RNA, 19 nt, Bordetella pertussis
gcacaucaggucgaccugc

SEQ ID NO: 332381 - RNA, 14 nt, Bordetella pertussis
gcacaucgcccggc

SEQ ID NO: 332382 - RNA, 15 nt, Bordetella pertussis
gcacaucgcccggca

SEQ ID NO: 332383 - RNA, 16 nt, Bordetella pertussis
gcacaucgcccggcag

SEQ ID NO: 332384 - RNA, 17 nt, Bordetella pertussis
gcacaucgcccggcagg

SEQ ID NO: 332385 - RNA, 19 nt, Bordetella pertussis
gcacaucggaauuggcggc

SEQ ID NO: 332386 - RNA, 20 nt, Bordetella pertussis
gcacaucggaauuggcggcg

SEQ ID NO: 332387 - RNA, 13 nt, Bordetella pertussis
gcacaucggccac

SEQ ID NO: 332388 - RNA, 14 nt, Bordetella pertussis
gcacaucggccacc

SEQ ID NO: 332389 - RNA, 16 nt, Bordetella pertussis
gcacauccagccgaug

SEQ ID NO: 332390 - RNA, 16 nt, Bordetella pertussis
gcacauccagcgccag

SEQ ID NO: 332391 - RNA, 18 nt, Bordetella pertussis
gcacauccagcgccagca

SEQ ID NO: 332392 - RNA, 14 nt, Bordetella pertussis
gcacaugcccggcc

SEQ ID NO: 332393 - RNA, 17 nt, Bordetella pertussis
gcacaugcccggccacc

SEQ ID NO: 332394 - RNA, 21 nt, Bordetella pertussis
gcacaugcccggccaccagcg

SEQ ID NO: 332395 - RNA, 15 nt, Bordetella pertussis
gcacauggcgcgccg

SEQ ID NO: 332396 - RNA, 23 nt, Bordetella pertussis
gcacauggcgcgccggccggugg

SEQ ID NO: 332397 - RNA, 15 nt, Bordetella pertussis
gcacaugaugcccag

SEQ ID NO: 332398 - RNA, 21 nt, Bordetella pertussis
gcacaugaugcccagcgccag

SEQ ID NO: 332399 - RNA, 17 nt, Bordetella pertussis
gcacauugccguacgcc

SEQ ID NO: 332400 - RNA, 20 nt, Bordetella pertussis
gcaccaaucuugccaggccc

SEQ ID NO: 332401 - RNA, 21 nt, Bordetella pertussis
gcaccaaucuugccaggcccg

SEQ ID NO: 332402 - RNA, 22 nt, Bordetella pertussis
gcaccaaucuugccaggcccgg

SEQ ID NO: 332403 - RNA, 13 nt, Bordetella pertussis
gcaccacaucgcc

SEQ ID NO: 332404 - RNA, 16 nt, Bordetella pertussis
gcaccacaucgccggc

SEQ ID NO: 332405 - RNA, 17 nt, Bordetella pertussis
gcaccacaucgccggcg

SEQ ID NO: 332406 - RNA, 14 nt, Bordetella pertussis
gcaccaccaccgcc

SEQ ID NO: 332407 - RNA, 14 nt, Bordetella pertussis
gcaccacgcgcucc

SEQ ID NO: 332408 - RNA, 16 nt, Bordetella pertussis
gcaccacgcgcuccau

SEQ ID NO: 332409 - RNA, 19 nt, Bordetella pertussis
gcaccacggcaucggcgcc

SEQ ID NO: 332410 - RNA, 20 nt, Bordetella pertussis
gcaccacggcaucggcgccg

SEQ ID NO: 332411 - RNA, 19 nt, Bordetella pertussis
gcaccacgggcucgcugac

SEQ ID NO: 332412 - RNA, 15 nt, Bordetella pertussis
gcaccacggcggcca

SEQ ID NO: 332413 - RNA, 18 nt, Bordetella pertussis
gcaccacggcggccaggc

SEQ ID NO: 332414 - RNA, 19 nt, Bordetella pertussis
gcaccacggcggccaggcc

SEQ ID NO: 332415 - RNA, 17 nt, Bordetella pertussis
gcaccagcacaucgacg

SEQ ID NO: 332416 - RNA, 16 nt, Bordetella pertussis
gcaccagcagccccag

SEQ ID NO: 332417 - RNA, 17 nt, Bordetella pertussis
gcaccagcagccccagc

SEQ ID NO: 332418 - RNA, 14 nt, Bordetella pertussis
gcaccagcaggccg

SEQ ID NO: 332419 - RNA, 16 nt, Bordetella pertussis
gcaccagcaggccggu

SEQ ID NO: 332420 - RNA, 17 nt, Bordetella pertussis
gcaccagcaggccggug

SEQ ID NO: 332421 - RNA, 12 nt, Bordetella pertussis
gcaccagccggg

SEQ ID NO: 332422 - RNA, 14 nt, Bordetella pertussis
gcaccagcgaggcg

SEQ ID NO: 332423 - RNA, 16 nt, Bordetella pertussis
gcaccagcgaggcggc

SEQ ID NO: 332424 - RNA, 12 nt, Bordetella pertussis
gcaccagcaugu

SEQ ID NO: 332425 - RNA, 14 nt, Bordetella pertussis
gcaccagcgccacg

SEQ ID NO: 332426 - RNA, 19 nt, Bordetella pertussis
gcaccagcgccacgcccag

SEQ ID NO: 332427 - RNA, 15 nt, Bordetella pertussis
gcaccagcgccgacg

SEQ ID NO: 332428 - RNA, 16 nt, Bordetella pertussis
gcaccagcgccugccg

SEQ ID NO: 332429 - RNA, 13 nt, Bordetella pertussis
gcaccagcgcgcc

SEQ ID NO: 332430 - RNA, 14 nt, Bordetella pertussis
gcaccagcgcgccg

SEQ ID NO: 332431 - RNA, 17 nt, Bordetella pertussis
gcaccagcgcgccgauc

SEQ ID NO: 332432 - RNA, 15 nt, Bordetella pertussis
gcaccagcgcgccgc

SEQ ID NO: 332433 - RNA, 23 nt, Bordetella pertussis
gcaccagcgcgccgcgcgcggcg

SEQ ID NO: 332434 - RNA, 21 nt, Bordetella pertussis
gcaccagcuuggccugcggau

SEQ ID NO: 332435 - RNA, 20 nt, Bordetella pertussis
gcaccaggauccccagcaca

SEQ ID NO: 332436 - RNA, 23 nt, Bordetella pertussis
gcaccaggauuccugcgaggaca

SEQ ID NO: 332437 - RNA, 22 nt, Bordetella pertussis
gcaccaggccacccgccguacc

SEQ ID NO: 332438 - RNA, 14 nt, Bordetella pertussis
gcaccaggccgaac

SEQ ID NO: 332439 - RNA, 12 nt, Bordetella pertussis
gcaccaggccgc

SEQ ID NO: 332440 - RNA, 17 nt, Bordetella pertussis
gcaccaggccgccggcc

SEQ ID NO: 332441 - RNA, 21 nt, Bordetella pertussis
gcaccaggccgccggccagcg

SEQ ID NO: 332442 - RNA, 19 nt, Bordetella pertussis
gcaccaggccgcggcgccc

SEQ ID NO: 332443 - RNA, 13 nt, Bordetella pertussis
gcaccaggcgcgg

SEQ ID NO: 332444 - RNA, 18 nt, Bordetella pertussis
gcaccaggcgcggcguau

SEQ ID NO: 332445 - RNA, 14 nt, Bordetella pertussis
gcaccaggcgcucg

SEQ ID NO: 332446 - RNA, 16 nt, Bordetella pertussis
gcaccaggcgcucgcg

SEQ ID NO: 332447 - RNA, 22 nt, Bordetella pertussis
gcaccaggcccaugaaggcggc

SEQ ID NO: 332448 - RNA, 21 nt, Bordetella pertussis
gcaccaggcuuugcgcgccau

SEQ ID NO: 332449 - RNA, 15 nt, Bordetella pertussis
gcaccaggcgcacgg

SEQ ID NO: 332450 - RNA, 18 nt, Bordetella pertussis
gcaccagggcgcgcagca

SEQ ID NO: 332451 - RNA, 15 nt, Bordetella pertussis
gcaccagguccuggc

SEQ ID NO: 332452 - RNA, 16 nt, Bordetella pertussis
gcaccagguccuggcg

SEQ ID NO: 332453 - RNA, 19 nt, Bordetella pertussis
gcaccagguccuggcggcc

SEQ ID NO: 332454 - RNA, 18 nt, Bordetella pertussis
gcaccaggucgcggugcg

SEQ ID NO: 332455 - RNA, 22 nt, Bordetella pertussis
gcaccaggucgcggugcgccac

SEQ ID NO: 332456 - RNA, 22 nt, Bordetella pertussis
gcaccagguugcauccggcccg

SEQ ID NO: 332457 - RNA, 20 nt, Bordetella pertussis
gcaccagguuggcgauggcg

SEQ ID NO: 332458 - RNA, 19 nt, Bordetella pertussis
gcaccaguuucucggccac

SEQ ID NO: 332459 - RNA, 20 nt, Bordetella pertussis
gcaccaguuucucggccacu

SEQ ID NO: 332460 - RNA, 19 nt, Bordetella pertussis
gcaccaguuugccguugcc

SEQ ID NO: 332461 - RNA, 20 nt, Bordetella pertussis
gcaccaguuuucucauggcc

SEQ ID NO: 332462 - RNA, 15 nt, Bordetella pertussis
gcaccaucgccgccu

SEQ ID NO: 332463 - RNA, 16 nt, Bordetella pertussis
gcaccaucgccgccug

SEQ ID NO: 332464 - RNA, 18 nt, Bordetella pertussis
gcaccaucguugccuggg

SEQ ID NO: 332465 - RNA, 22 nt, Bordetella pertussis
gcaccaucucccgcaggcccac

SEQ ID NO: 332466 - RNA, 19 nt, Bordetella pertussis
gcaccaugccgauggcggu

SEQ ID NO: 332467 - RNA, 19 nt, Bordetella pertussis
gcaccaugcgcaccaggcg

SEQ ID NO: 332468 - RNA, 19 nt, Bordetella pertussis
gcaccaugcggugcgcccu

SEQ ID NO: 332469 - RNA, 12 nt, Bordetella pertussis
gcaccauggcgc

SEQ ID NO: 332470 - RNA, 19 nt, Bordetella pertussis
gcaccauggcgcccacggc

SEQ ID NO: 332471 - RNA, 23 nt, Bordetella pertussis
gcaccauucucgcccugcuggcg

SEQ ID NO: 332472 - RNA, 15 nt, Bordetella pertussis
gcaccauugccggcg

SEQ ID NO: 332473 - RNA, 18 nt, Bordetella pertussis
gcaccauugccggcgcgc

SEQ ID NO: 332474 - RNA, 19 nt, Bordetella pertussis
gcacccacacuuggccggc

SEQ ID NO: 332475 - RNA, 12 nt, Bordetella pertussis
gcacccaggcgc

SEQ ID NO: 332476 - RNA, 15 nt, Bordetella pertussis
gcacccaggcgccga

SEQ ID NO: 332477 - RNA, 16 nt, Bordetella pertussis
gcacccaggcgccgau

SEQ ID NO: 332478 - RNA, 17 nt, Bordetella pertussis
gcacccaggcgccgauc

SEQ ID NO: 332479 - RNA, 18 nt, Bordetella pertussis
gcacccaggcgggcuggc

SEQ ID NO: 332480 - RNA, 20 nt, Bordetella pertussis
gcacccaggcgggcuggcgu

SEQ ID NO: 332481 - RNA, 13 nt, Bordetella pertussis
gcacccagccgga

SEQ ID NO: 332482 - RNA, 19 nt, Bordetella pertussis
gcaccccggccgacggcaa

SEQ ID NO: 332483 - RNA, 16 nt, Bordetella pertussis
gcaccccggcgccgcg

SEQ ID NO: 332484 - RNA, 18 nt, Bordetella pertussis
gcaccccggugucgccgu

SEQ ID NO: 332485 - RNA, 13 nt, Bordetella pertussis
gcacccgaugacg

SEQ ID NO: 332486 - RNA, 23 nt, Bordetella pertussis
gcacccgcaagauuucauggcgu

SEQ ID NO: 332487 - RNA, 13 nt, Bordetella pertussis
gcacccgcaggcc

SEQ ID NO: 332488 - RNA, 14 nt, Bordetella pertussis
gcacccgcaggccg

SEQ ID NO: 332489 - RNA, 22 nt, Bordetella pertussis
gcacccgcaggccguuggccgc

SEQ ID NO: 332490 - RNA, 15 nt, Bordetella pertussis
gcacccgcaggcggc

SEQ ID NO: 332491 - RNA, 16 nt, Bordetella pertussis
gcacccgcaggcggcu

SEQ ID NO: 332492 - RNA, 19 nt, Bordetella pertussis
gcacccgcaggcggcuggu

SEQ ID NO: 332493 - RNA, 16 nt, Bordetella pertussis
gcacccgcaugguggc

SEQ ID NO: 332494 - RNA, 20 nt, Bordetella pertussis
gcacccgcaugguggcgcag

SEQ ID NO: 332495 - RNA, 22 nt, Bordetella pertussis
gcacccgcaugguggcgcaggc

SEQ ID NO: 332496 - RNA, 15 nt, Bordetella pertussis
gcacccgcgcgcagc

SEQ ID NO: 332497 - RNA, 16 nt, Bordetella pertussis
gcacccgcgcgcagcg

SEQ ID NO: 332498 - RNA, 18 nt, Bordetella pertussis
gcacccgcgcgcagcguu

SEQ ID NO: 332499 - RNA, 21 nt, Bordetella pertussis
gcacccgccuggacggcgagg

SEQ ID NO: 332500 - RNA, 14 nt, Bordetella pertussis
gcacccuugccgca

SEQ ID NO: 332501 - RNA, 19 nt, Bordetella pertussis
gcacccuugccgcagcggg

SEQ ID NO: 332502 - RNA, 16 nt, Bordetella pertussis
gcacccuuuugccgca

SEQ ID NO: 332503 - RNA, 15 nt, Bordetella pertussis
gcaccgaacgggcgu

SEQ ID NO: 332504 - RNA, 22 nt, Bordetella pertussis
gcaccgaauacgucagagcccu

SEQ ID NO: 332505 - RNA, 18 nt, Bordetella pertussis
gcaccgaccagcgcgcgc

SEQ ID NO: 332506 - RNA, 17 nt, Bordetella pertussis
gcaccgagaccgggcgg

SEQ ID NO: 332507 - RNA, 20 nt, Bordetella pertussis
gcaccgagccgcagguccag

SEQ ID NO: 332508 - RNA, 14 nt, Bordetella pertussis
gcaccgagcugccg

SEQ ID NO: 332509 - RNA, 15 nt, Bordetella pertussis
gcaccgccagcgcgu

SEQ ID NO: 332510 - RNA, 13 nt, Bordetella pertussis
gcaccgccaggca

SEQ ID NO: 332511 - RNA, 15 nt, Bordetella pertussis
gcaccgccgcacagc

SEQ ID NO: 332512 - RNA, 18 nt, Bordetella pertussis
gcaccgccgccggcccgg

SEQ ID NO: 332513 - RNA, 13 nt, Bordetella pertussis
gcaccgcggcggg

SEQ ID NO: 332514 - RNA, 11 nt, Bordetella pertussis
gcaccgcgucg

SEQ ID NO: 332515 - RNA, 17 nt, Bordetella pertussis
gcaccgcgucggccugc

SEQ ID NO: 332516 - RNA, 19 nt, Bordetella pertussis
gcaccgcugcuaugccgug

SEQ ID NO: 332517 - RNA, 13 nt, Bordetella pertussis
gcaccggcgccac

SEQ ID NO: 332518 - RNA, 12 nt, Bordetella pertussis
gcaccggcgcca

SEQ ID NO: 332519 - RNA, 21 nt, Bordetella pertussis
gcaccggcgugagcgccaccg

SEQ ID NO: 332520 - RNA, 18 nt, Bordetella pertussis
gcaccggcgugcgcuggc

SEQ ID NO: 332521 - RNA, 18 nt, Bordetella pertussis
gcaccggcugccagggcc

SEQ ID NO: 332522 - RNA, 20 nt, Bordetella pertussis
gcaccggcuuggggcgcgcc

SEQ ID NO: 332523 - RNA, 20 nt, Bordetella pertussis
gcaccggcuugucgaccagu

SEQ ID NO: 332524 - RNA, 22 nt, Bordetella pertussis
gcaccgggccgaacaugacguu

SEQ ID NO: 332525 - RNA, 17 nt, Bordetella pertussis
gcaccggggcagggcgg

SEQ ID NO: 332526 - RNA, 13 nt, Bordetella pertussis
gcaccgucacgcg

SEQ ID NO: 332527 - RNA, 14 nt, Bordetella pertussis
gcaccgucacgcgc

SEQ ID NO: 332528 - RNA, 16 nt, Bordetella pertussis
gcaccgucacgcgcug

SEQ ID NO: 332529 - RNA, 21 nt, Bordetella pertussis
gcaccguauccucgaucagcg

SEQ ID NO: 332530 - RNA, 18 nt, Bordetella pertussis
gcaccgucgccagggcga

SEQ ID NO: 332531 - RNA, 23 nt, Bordetella pertussis
gcaccgucgccagggcgaugacc

SEQ ID NO: 332532 - RNA, 12 nt, Bordetella pertussis
gcaccucggcgc

SEQ ID NO: 332533 - RNA, 13 nt, Bordetella pertussis
gcaccucggcgcc

SEQ ID NO: 332534 - RNA, 17 nt, Bordetella pertussis
gcaccucggcgcccagc

SEQ ID NO: 332535 - RNA, 21 nt, Bordetella pertussis
gcaccucggcgcccagcugcu

SEQ ID NO: 332536 - RNA, 16 nt, Bordetella pertussis
gcaccucggcgccgcg

SEQ ID NO: 332537 - RNA, 18 nt, Bordetella pertussis
gcaccucggcgccgcggc

SEQ ID NO: 332538 - RNA, 19 nt, Bordetella pertussis
gcaccucggcgccgcggcg

SEQ ID NO: 332539 - RNA, 14 nt, Bordetella pertussis
gcaccucggccggg

SEQ ID NO: 332540 - RNA, 22 nt, Bordetella pertussis
gcaccucggccggggcggucaa

SEQ ID NO: 332541 - RNA, 17 nt, Bordetella pertussis
gcaccucggggcgcggc

SEQ ID NO: 332542 - RNA, 15 nt, Bordetella pertussis
gcaccucggggugca

SEQ ID NO: 332543 - RNA, 20 nt, Bordetella pertussis
gcaccucguaaguggcggcg

SEQ ID NO: 332544 - RNA, 16 nt, Bordetella pertussis
gcaccugaacaccggc

SEQ ID NO: 332545 - RNA, 21 nt, Bordetella pertussis
gcaccugaacaccggcgcgcc

SEQ ID NO: 332546 - RNA, 20 nt, Bordetella pertussis
gcaccugggaggggccggcu

SEQ ID NO: 332547 - RNA, 13 nt, Bordetella pertussis
gcaccugguggcg

SEQ ID NO: 332548 - RNA, 16 nt, Bordetella pertussis
gcaccuguucggcggc

SEQ ID NO: 332549 - RNA, 14 nt, Bordetella pertussis
gcaccuucgaggaa

SEQ ID NO: 332550 - RNA, 13 nt, Bordetella pertussis
gcaccuucgcgca

SEQ ID NO: 332551 - RNA, 18 nt, Bordetella pertussis
gcaccuucgcgcagcggc

SEQ ID NO: 332552 - RNA, 20 nt, Bordetella pertussis
gcaccuucugccgccaggca

SEQ ID NO: 332553 - RNA, 14 nt, Bordetella pertussis
gcaccuugccugca

SEQ ID NO: 332554 - RNA, 13 nt, Bordetella pertussis
gcacgacgcgaac

SEQ ID NO: 332555 - RNA, 15 nt, Bordetella pertussis
gcacgacgcugaugc

SEQ ID NO: 332556 - RNA, 21 nt, Bordetella pertussis
gcacgacgcugaugcccagcc

SEQ ID NO: 332557 - RNA, 20 nt, Bordetella pertussis
gcacgacggccuccgcgccg

SEQ ID NO: 332558 - RNA, 14 nt, Bordetella pertussis
gcacgacgucgcgc

SEQ ID NO: 332559 - RNA, 15 nt, Bordetella pertussis
gcacgacgucgucgg

SEQ ID NO: 332560 - RNA, 22 nt, Bordetella pertussis
gcacgacgucgucgguggggca

SEQ ID NO: 332561 - RNA, 21 nt, Bordetella pertussis
gcacgacuacggcggacuggc

SEQ ID NO: 332562 - RNA, 15 nt, Bordetella pertussis
gcacgagaucgccug

SEQ ID NO: 332563 - RNA, 17 nt, Bordetella pertussis
gcacgauauuggcgucg

SEQ ID NO: 332564 - RNA, 21 nt, Bordetella pertussis
gcacgauauuggcgucggccg

SEQ ID NO: 332565 - RNA, 22 nt, Bordetella pertussis
gcacgauauuggcgucggccgc

SEQ ID NO: 332566 - RNA, 19 nt, Bordetella pertussis
gcacgaucaccgccgcggc

SEQ ID NO: 332567 - RNA, 15 nt, Bordetella pertussis
gcacgauccagccgu

SEQ ID NO: 332568 - RNA, 17 nt, Bordetella pertussis
gcacgaucgcgccggcc

SEQ ID NO: 332569 - RNA, 20 nt, Bordetella pertussis
gcacgaucgcgccggccugg

SEQ ID NO: 332570 - RNA, 14 nt, Bordetella pertussis
gcacgaucgcggcg

SEQ ID NO: 332571 - RNA, 19 nt, Bordetella pertussis
gcacgaucgcggcgcuggc

SEQ ID NO: 332572 - RNA, 24 nt, Bordetella pertussis
gcacgaucuggcgcgcgaccaggc

SEQ ID NO: 332573 - RNA, 15 nt, Bordetella pertussis
gcacgaugaggccga

SEQ ID NO: 332574 - RNA, 17 nt, Bordetella pertussis
gcacgaugcccagggcc

SEQ ID NO: 332575 - RNA, 18 nt, Bordetella pertussis
gcacgaugcccagggccg

SEQ ID NO: 332576 - RNA, 18 nt, Bordetella pertussis
gcacgaugccgucgccgc

SEQ ID NO: 332577 - RNA, 23 nt, Bordetella pertussis
gcacgauggaaucgucgaccagc

SEQ ID NO: 332578 - RNA, 15 nt, Bordetella pertussis
gcacgauggccgcgc

SEQ ID NO: 332579 - RNA, 17 nt, Bordetella pertussis
gcacgauggccgcgccc

SEQ ID NO: 332580 - RNA, 13 nt, Bordetella pertussis
gcacgauggcgcc

SEQ ID NO: 332581 - RNA, 15 nt, Bordetella pertussis
gcacgauggcgccca

SEQ ID NO: 332582 - RNA, 16 nt, Bordetella pertussis
gcacgauggcgcccac

SEQ ID NO: 332583 - RNA, 22 nt, Bordetella pertussis
gcacgauggcgcccacggccug

SEQ ID NO: 332584 - RNA, 14 nt, Bordetella pertussis
gcacgauggcgccg

SEQ ID NO: 332585 - RNA, 15 nt, Bordetella pertussis
gcacgauggcgccgg

SEQ ID NO: 332586 - RNA, 16 nt, Bordetella pertussis
gcacgauggcgccggc

SEQ ID NO: 332587 - RNA, 17 nt, Bordetella pertussis
gcacgauggcgccggcu

SEQ ID NO: 332588 - RNA, 19 nt, Bordetella pertussis
gcacgauggggcagccauc

SEQ ID NO: 332589 - RNA, 19 nt, Bordetella pertussis
gcacgaugguaucggccgg

SEQ ID NO: 332590 - RNA, 21 nt, Bordetella pertussis
gcacgaugguaucggccgggc

SEQ ID NO: 332591 - RNA, 15 nt, Bordetella pertussis
gcacgauggucagcg

SEQ ID NO: 332592 - RNA, 19 nt, Bordetella pertussis
gcacgauggucagcggcau

SEQ ID NO: 332593 - RNA, 20 nt, Bordetella pertussis
gcacgauguugccgccggcc

SEQ ID NO: 332594 - RNA, 21 nt, Bordetella pertussis
gcacgauguugccgccggcca

SEQ ID NO: 332595 - RNA, 20 nt, Bordetella pertussis
gcacgauuuccgcuaccagg

SEQ ID NO: 332596 - RNA, 22 nt, Bordetella pertussis
gcacgauuuccgcuaccaggcg

SEQ ID NO: 332597 - RNA, 15 nt, Bordetella pertussis
gcacgcacagcaugc

SEQ ID NO: 332598 - RNA, 14 nt, Bordetella pertussis
gcacgcaccaggcg

SEQ ID NO: 332599 - RNA, 23 nt, Bordetella pertussis
gcacgcaccaggcgcacggcggc

SEQ ID NO: 332600 - RNA, 18 nt, Bordetella pertussis
gcacgcaccgcgccagcg

SEQ ID NO: 332601 - RNA, 18 nt, Bordetella pertussis
gcacgcacugagcuucgc

SEQ ID NO: 332602 - RNA, 13 nt, Bordetella pertussis
gcacgcagcgcag

SEQ ID NO: 332603 - RNA, 15 nt, Bordetella pertussis
gcacgcagcgcucau

SEQ ID NO: 332604 - RNA, 23 nt, Bordetella pertussis
gcacgccauagcguucgguggcg

SEQ ID NO: 332605 - RNA, 15 nt, Bordetella pertussis
gcacgccgaccuggc

SEQ ID NO: 332606 - RNA, 21 nt, Bordetella pertussis
gcacgccgaccuggcgcccga

SEQ ID NO: 332607 - RNA, 22 nt, Bordetella pertussis
gcacgccgaucgcgcacagcau

SEQ ID NO: 332608 - RNA, 14 nt, Bordetella pertussis
gcacgccgcgccag

SEQ ID NO: 332609 - RNA, 21 nt, Bordetella pertussis
gcacgccgcgccggcgcgcga

SEQ ID NO: 332610 - RNA, 15 nt, Bordetella pertussis
gcacgccgcgcucgu

SEQ ID NO: 332611 - RNA, 19 nt, Bordetella pertussis
gcacgccgcgcucguugcg

SEQ ID NO: 332612 - RNA, 14 nt, Bordetella pertussis
gcacgccggccacg

SEQ ID NO: 332613 - RNA, 14 nt, Bordetella pertussis
gcacgccggccugc

SEQ ID NO: 332614 - RNA, 20 nt, Bordetella pertussis
gcacgccggccugcgccagc

SEQ ID NO: 332615 - RNA, 21 nt, Bordetella pertussis
gcacgccgggcgcgcugccca

SEQ ID NO: 332616 - RNA, 18 nt, Bordetella pertussis
gcacgccgggcgcggccg

SEQ ID NO: 332617 - RNA, 15 nt, Bordetella pertussis
gcacgccggcggcgc

SEQ ID NO: 332618 - RNA, 18 nt, Bordetella pertussis
gcacgccggcggcgcugg

SEQ ID NO: 332619 - RNA, 17 nt, Bordetella pertussis
gcacgccggucgccagc

SEQ ID NO: 332620 - RNA, 18 nt, Bordetella pertussis
gcacgccggucgccagcg

SEQ ID NO: 332621 - RNA, 15 nt, Bordetella pertussis
gcacgcgcgccggca

SEQ ID NO: 332622 - RNA, 17 nt, Bordetella pertussis
gcacgcgcgcggcgcgg

SEQ ID NO: 332623 - RNA, 17 nt, Bordetella pertussis
gcacgcgcgcgggcgcg

SEQ ID NO: 332624 - RNA, 13 nt, Bordetella pertussis
gcacgcgcgcgug

SEQ ID NO: 332625 - RNA, 16 nt, Bordetella pertussis
gcacgcgcggcagcgc

SEQ ID NO: 332626 - RNA, 19 nt, Bordetella pertussis
gcacgcgcggcagcgccgg

SEQ ID NO: 332627 - RNA, 21 nt, Bordetella pertussis
gcacgcgcggcagcgccgggu

SEQ ID NO: 332628 - RNA, 18 nt, Bordetella pertussis
gcacgcgcucgggcagcu

SEQ ID NO: 332629 - RNA, 22 nt, Bordetella pertussis
gcacgcgcugaauccggggugc

SEQ ID NO: 332630 - RNA, 15 nt, Bordetella pertussis
gcacgcgcuugaggc

SEQ ID NO: 332631 - RNA, 12 nt, Bordetella pertussis
gcacgcggccgc

SEQ ID NO: 332632 - RNA, 15 nt, Bordetella pertussis
gcacgcggccgcgca

SEQ ID NO: 332633 - RNA, 15 nt, Bordetella pertussis
gcacgcggcgcagca

SEQ ID NO: 332634 - RNA, 17 nt, Bordetella pertussis
gcacgcggcgcagcauc

SEQ ID NO: 332635 - RNA, 17 nt, Bordetella pertussis
gcacgcggcgcggcagg

SEQ ID NO: 332636 - RNA, 14 nt, Bordetella pertussis
gcacgcggcuucgc

SEQ ID NO: 332637 - RNA, 18 nt, Bordetella pertussis
gcacgcgggcgcugacgc

SEQ ID NO: 332638 - RNA, 16 nt, Bordetella pertussis
gcacgcgguccacgcc

SEQ ID NO: 332639 - RNA, 20 nt, Bordetella pertussis
gcacgcgguccacgccgggu

SEQ ID NO: 332640 - RNA, 15 nt, Bordetella pertussis
gcacgcucagcaugc

SEQ ID NO: 332641 - RNA, 16 nt, Bordetella pertussis
gcacgcuggcgcccgc

SEQ ID NO: 332642 - RNA, 15 nt, Bordetella pertussis
gcacgcuggcguuga

SEQ ID NO: 332643 - RNA, 17 nt, Bordetella pertussis
gcacgcuggcguugacg

SEQ ID NO: 332644 - RNA, 21 nt, Bordetella pertussis
gcacgcuggcguugacguggc

SEQ ID NO: 332645 - RNA, 21 nt, Bordetella pertussis
gcacgcugggcgaggcgcugg

SEQ ID NO: 332646 - RNA, 22 nt, Bordetella pertussis
gcacgcugggcgaggcgcuggc

SEQ ID NO: 332647 - RNA, 16 nt, Bordetella pertussis
gcacggcaaaacggug

SEQ ID NO: 332648 - RNA, 13 nt, Bordetella pertussis
gcacggcguggcg

SEQ ID NO: 332649 - RNA, 14 nt, Bordetella pertussis
gcacggcguggcgc

SEQ ID NO: 332650 - RNA, 17 nt, Bordetella pertussis
gcacggcguggcgcgca

SEQ ID NO: 332651 - RNA, 17 nt, Bordetella pertussis
gcacggcuugcgcgccu

SEQ ID NO: 332652 - RNA, 22 nt, Bordetella pertussis
gcacggcuugcgcgccugcugg

SEQ ID NO: 332653 - RNA, 18 nt, Bordetella pertussis
gcacgggcagacgccauc

SEQ ID NO: 332654 - RNA, 19 nt, Bordetella pertussis
gcacgggcagacgccaucu

SEQ ID NO: 332655 - RNA, 16 nt, Bordetella pertussis
gcacgggccgacggcc

SEQ ID NO: 332656 - RNA, 17 nt, Bordetella pertussis
gcacgggcgagggcugc

SEQ ID NO: 332657 - RNA, 12 nt, Bordetella pertussis
gcacggugccgc

SEQ ID NO: 332658 - RNA, 13 nt, Bordetella pertussis
gcacgguggcgcc

SEQ ID NO: 332659 - RNA, 17 nt, Bordetella pertussis
gcacgguggcgcccggc

SEQ ID NO: 332660 - RNA, 19 nt, Bordetella pertussis
gcacgguggcgcccggcgg

SEQ ID NO: 332661 - RNA, 17 nt, Bordetella pertussis
gcacgguggcgccgucg

SEQ ID NO: 332662 - RNA, 23 nt, Bordetella pertussis
gcacgguggcgccgucgcgcugu

SEQ ID NO: 332663 - RNA, 16 nt, Bordetella pertussis
gcacggugccgcgcgc

SEQ ID NO: 332664 - RNA, 22 nt, Bordetella pertussis
gcacggugggcagcagcacgcc

SEQ ID NO: 332665 - RNA, 24 nt, Bordetella pertussis
gcacggugggcagcagcacgccca

SEQ ID NO: 332666 - RNA, 21 nt, Bordetella pertussis
gcacgguguugaccaccacgc

SEQ ID NO: 332667 - RNA, 17 nt, Bordetella pertussis
gcacgguugccacggug

SEQ ID NO: 332668 - RNA, 20 nt, Bordetella pertussis
gcacguaaucgaagccgggc

SEQ ID NO: 332669 - RNA, 14 nt, Bordetella pertussis
gcacguaccaggcg

SEQ ID NO: 332670 - RNA, 18 nt, Bordetella pertussis
gcacguaccaggcgcuga

SEQ ID NO: 332671 - RNA, 19 nt, Bordetella pertussis
gcacguaccaggcgcugac

SEQ ID NO: 332672 - RNA, 13 nt, Bordetella pertussis
gcacguagcgcag

SEQ ID NO: 332673 - RNA, 15 nt, Bordetella pertussis
gcacguagcgcagca

SEQ ID NO: 332674 - RNA, 22 nt, Bordetella pertussis
gcacguagcgcagcaccggcag

SEQ ID NO: 332675 - RNA, 17 nt, Bordetella pertussis
gcacguaguacagcagc

SEQ ID NO: 332676 - RNA, 22 nt, Bordetella pertussis
gcacguccagagucugccuggc

SEQ ID NO: 332677 - RNA, 23 nt, Bordetella pertussis
gcacguccagagucugccuggcg

SEQ ID NO: 332678 - RNA, 15 nt, Bordetella pertussis
gcacgucauccuggg

SEQ ID NO: 332679 - RNA, 20 nt, Bordetella pertussis
gcacgucccagucgccgcgc

SEQ ID NO: 332680 - RNA, 22 nt, Bordetella pertussis
gcacguccgagaggaucaccgc

SEQ ID NO: 332681 - RNA, 13 nt, Bordetella pertussis
gcacgucgcgcaa

SEQ ID NO: 332682 - RNA, 18 nt, Bordetella pertussis
gcacgucgggcaggaugg

SEQ ID NO: 332683 - RNA, 16 nt, Bordetella pertussis
gcacgucggucgagua

SEQ ID NO: 332684 - RNA, 22 nt, Bordetella pertussis
gcacgucgguggugaccacggc

SEQ ID NO: 332685 - RNA, 16 nt, Bordetella pertussis
gcacgucguagcgcug

SEQ ID NO: 332686 - RNA, 14 nt, Bordetella pertussis
gcacgugacgccgg

SEQ ID NO: 332687 - RNA, 19 nt, Bordetella pertussis
gcacuccguaaagaugcgc

SEQ ID NO: 332688 - RNA, 16 nt, Bordetella pertussis
gcacuccgucauggcg

SEQ ID NO: 332689 - RNA, 20 nt, Bordetella pertussis
gcacucgguaucgucggaca

SEQ ID NO: 332690 - RNA, 22 nt, Bordetella pertussis
gcagagggagcgacacccgcgg

SEQ ID NO: 332691 - RNA, 20 nt, Bordetella pertussis
gcagagggcgacggcggcgu

SEQ ID NO: 332692 - RNA, 19 nt, Bordetella pertussis
gcagaucaucgagcaccgc

SEQ ID NO: 332693 - RNA, 17 nt, Bordetella pertussis
gcagaucaucggcgcca

SEQ ID NO: 332694 - RNA, 15 nt, Bordetella pertussis
gcagaucccaggcgc

SEQ ID NO: 332695 - RNA, 13 nt, Bordetella pertussis
gcagaucgcggcg

SEQ ID NO: 332696 - RNA, 14 nt, Bordetella pertussis
gcagaucgcggcgg

SEQ ID NO: 332697 - RNA, 14 nt, Bordetella pertussis
gcagaucggcgcug

SEQ ID NO: 332698 - RNA, 16 nt, Bordetella pertussis
gcagaucggcgcuggc

SEQ ID NO: 332699 - RNA, 21 nt, Bordetella pertussis
gcagaucggcgcuggccuggc

SEQ ID NO: 332700 - RNA, 22 nt, Bordetella pertussis
gcagaugaucuacgcgcgcgcc

SEQ ID NO: 332701 - RNA, 19 nt, Bordetella pertussis
gcagaugcgacuggcggcu

SEQ ID NO: 332702 - RNA, 14 nt, Bordetella pertussis
gcagaugcgcgcca

SEQ ID NO: 332703 - RNA, 21 nt, Bordetella pertussis
gcagcaauugccccagcacga

SEQ ID NO: 332704 - RNA, 20 nt, Bordetella pertussis
gcagcaccacaucgccggcg

SEQ ID NO: 332705 - RNA, 13 nt, Bordetella pertussis
gcagcaccagcau

SEQ ID NO: 332706 - RNA, 15 nt, Bordetella pertussis
gcagcaccagcaugu

SEQ ID NO: 332707 - RNA, 22 nt, Bordetella pertussis
gcagcaccaggcuuugcgcgcc

SEQ ID NO: 332708 - RNA, 15 nt, Bordetella pertussis
gcagcaccgccagcg

SEQ ID NO: 332709 - RNA, 16 nt, Bordetella pertussis
gcagcaccgccagcgc

SEQ ID NO: 332710 - RNA, 13 nt, Bordetella pertussis
gcagcaccgcgcg

SEQ ID NO: 332711 - RNA, 19 nt, Bordetella pertussis
gcagcaccggggcagggcg

SEQ ID NO: 332712 - RNA, 17 nt, Bordetella pertussis
gcagcacgucggcgucg

SEQ ID NO: 332713 - RNA, 23 nt, Bordetella pertussis
gcagcacgucguagcgcugcagc

SEQ ID NO: 332714 - RNA, 19 nt, Bordetella pertussis
gcagcagaauguauuggcc

SEQ ID NO: 332715 - RNA, 22 nt, Bordetella pertussis
gcagcagaauguauuggcccag

SEQ ID NO: 332716 - RNA, 13 nt, Bordetella pertussis
gcagcagaucggc

SEQ ID NO: 332717 - RNA, 18 nt, Bordetella pertussis
gcagcagaucggcggccu

SEQ ID NO: 332718 - RNA, 20 nt, Bordetella pertussis
gcagcagaucggcggccugg

SEQ ID NO: 332719 - RNA, 18 nt, Bordetella pertussis
gcagcagacgcuucaggc

SEQ ID NO: 332720 - RNA, 21 nt, Bordetella pertussis
gcagcagacgcuucaggccgu

SEQ ID NO: 332721 - RNA, 15 nt, Bordetella pertussis
gcagcaggccgcgcg

SEQ ID NO: 332722 - RNA, 18 nt, Bordetella pertussis
gcagcaggccgcgcgugc

SEQ ID NO: 332723 - RNA, 12 nt, Bordetella pertussis
gcagcaggccgg

SEQ ID NO: 332724 - RNA, 22 nt, Bordetella pertussis
gcagcaggccguaaccggccag

SEQ ID NO: 332725 - RNA, 15 nt, Bordetella pertussis
gcagcaggcgcacca

SEQ ID NO: 332726 - RNA, 16 nt, Bordetella pertussis
gcagcaggcgcaccag

SEQ ID NO: 332727 - RNA, 19 nt, Bordetella pertussis
gcagcaggcgcaccagcgc

SEQ ID NO: 332728 - RNA, 17 nt, Bordetella pertussis
gcagcaggcugccgccg

SEQ ID NO: 332729 - RNA, 20 nt, Bordetella pertussis
gcagcaggcugccgccggcg

SEQ ID NO: 332730 - RNA, 14 nt, Bordetella pertussis
gcagcaggcugggc

SEQ ID NO: 332731 - RNA, 14 nt, Bordetella pertussis
gcagcagggccacg

SEQ ID NO: 332732 - RNA, 16 nt, Bordetella pertussis
gcagcagggccacgcc

SEQ ID NO: 332733 - RNA, 20 nt, Bordetella pertussis
gcagcagggccacgcccagg

SEQ ID NO: 332734 - RNA, 15 nt, Bordetella pertussis
gcagcagggccuggc

SEQ ID NO: 332735 - RNA, 23 nt, Bordetella pertussis
gcagcagggccuggcagaugcgc

SEQ ID NO: 332736 - RNA, 16 nt, Bordetella pertussis
gcagcaggcgcgcggc

SEQ ID NO: 332737 - RNA, 15 nt, Bordetella pertussis
gcagcaggcgcgugc

SEQ ID NO: 332738 - RNA, 19 nt, Bordetella pertussis
gcagcaggguggccacgcc

SEQ ID NO: 332739 - RNA, 18 nt, Bordetella pertussis
gcagcaguucggcgucgg

SEQ ID NO: 332740 - RNA, 18 nt, Bordetella pertussis
gcagcaguugcagcauga

SEQ ID NO: 332741 - RNA, 16 nt, Bordetella pertussis
gcagcauauccgcgug

SEQ ID NO: 332742 - RNA, 21 nt, Bordetella pertussis
gcagcaucuugcgccgcugcg

SEQ ID NO: 332743 - RNA, 16 nt, Bordetella pertussis
gcagcaugagcugaug

SEQ ID NO: 332744 - RNA, 23 nt, Bordetella pertussis
gcagcaugccgcgguggcgggcg

SEQ ID NO: 332745 - RNA, 18 nt, Bordetella pertussis
gcagcaugaucuugccga

SEQ ID NO: 332746 - RNA, 19 nt, Bordetella pertussis
gcagcaugaucuugccgac

SEQ ID NO: 332747 - RNA, 13 nt, Bordetella pertussis
gcagcauggcgcc

SEQ ID NO: 332748 - RNA, 14 nt, Bordetella pertussis
gcagcauggcgcca

SEQ ID NO: 332749 - RNA, 13 nt, Bordetella pertussis
gcagcauggcggg

SEQ ID NO: 332750 - RNA, 16 nt, Bordetella pertussis
gcagcauggcgggcga

SEQ ID NO: 332751 - RNA, 18 nt, Bordetella pertussis
gcagcauuucgaugcgca

SEQ ID NO: 332752 - RNA, 19 nt, Bordetella pertussis
gcagcauuucgaugcgcac

SEQ ID NO: 332753 - RNA, 15 nt, Bordetella pertussis
gcagcauuucggcgc

SEQ ID NO: 332754 - RNA, 23 nt, Bordetella pertussis
gcagcauuucggcgccgccggcc

SEQ ID NO: 332755 - RNA, 22 nt, Bordetella pertussis
gcagccacaggcccaugccgcg

SEQ ID NO: 332756 - RNA, 23 nt, Bordetella pertussis
gcagccacaggcccaugccgcgg

SEQ ID NO: 332757 - RNA, 15 nt, Bordetella pertussis
gcagccacgccuggc

SEQ ID NO: 332758 - RNA, 20 nt, Bordetella pertussis
gcagccacgccuggccgcgc

SEQ ID NO: 332759 - RNA, 17 nt, Bordetella pertussis
gcagccacugcgucacg

SEQ ID NO: 332760 - RNA, 20 nt, Bordetella pertussis
gcagccauccucgcccagcg

SEQ ID NO: 332761 - RNA, 21 nt, Bordetella pertussis
gcagccaguugggccagggcc

SEQ ID NO: 332762 - RNA, 16 nt, Bordetella pertussis
gcagccgucgcgcugc

SEQ ID NO: 332763 - RNA, 18 nt, Bordetella pertussis
gcagcgacucgaacaccg

SEQ ID NO: 332764 - RNA, 24 nt, Bordetella pertussis
gcagcgacuugucgcgcccgaagc

SEQ ID NO: 332765 - RNA, 23 nt, Bordetella pertussis
gcagcgagaacagccacacgcug

SEQ ID NO: 332766 - RNA, 16 nt, Bordetella pertussis
gcagcgagagcgccac

SEQ ID NO: 332767 - RNA, 19 nt, Bordetella pertussis
gcagcgagagcgccacgcc

SEQ ID NO: 332768 - RNA, 16 nt, Bordetella pertussis
gcagcgaggcgcagcg

SEQ ID NO: 332769 - RNA, 17 nt, Bordetella pertussis
gcagcgaggcgcagcgc

SEQ ID NO: 332770 - RNA, 20 nt, Bordetella pertussis
gcagcgaggccucgugcugc

SEQ ID NO: 332771 - RNA, 22 nt, Bordetella pertussis
gcagcgaguagacgcagccgca

SEQ ID NO: 332772 - RNA, 14 nt, Bordetella pertussis
gcagcgcccaggcg

SEQ ID NO: 332773 - RNA, 13 nt, Bordetella pertussis
gcagcgcccgcgc

SEQ ID NO: 332774 - RNA, 14 nt, Bordetella pertussis
gcagcgccgccagc

SEQ ID NO: 332775 - RNA, 15 nt, Bordetella pertussis
gcagcgccgccagca

SEQ ID NO: 332776 - RNA, 14 nt, Bordetella pertussis
gcagcgccgccugg

SEQ ID NO: 332777 - RNA, 17 nt, Bordetella pertussis
gcagcgccgccugguag

SEQ ID NO: 332778 - RNA, 13 nt, Bordetella pertussis
gcagcgccggcag

SEQ ID NO: 332779 - RNA, 16 nt, Bordetella pertussis
gcagcgccggcaggcg

SEQ ID NO: 332780 - RNA, 22 nt, Bordetella pertussis
gcagcgccggcaggcgcgccag

SEQ ID NO: 332781 - RNA, 12 nt, Bordetella pertussis
gcagcgccggcu

SEQ ID NO: 332782 - RNA, 15 nt, Bordetella pertussis
gcagcgccggcuggg

SEQ ID NO: 332783 - RNA, 17 nt, Bordetella pertussis
gcagcgccgggaucggc

SEQ ID NO: 332784 - RNA, 14 nt, Bordetella pertussis
gcagcgcgccaggc

SEQ ID NO: 332785 - RNA, 21 nt, Bordetella pertussis
gcagcgcgccaggcgcugcgc

SEQ ID NO: 332786 - RNA, 14 nt, Bordetella pertussis
gcagcgcgccgccg

SEQ ID NO: 332787 - RNA, 15 nt, Bordetella pertussis
gcagcgcgccgccga

SEQ ID NO: 332788 - RNA, 16 nt, Bordetella pertussis
gcagcgcgccgccgau

SEQ ID NO: 332789 - RNA, 13 nt, Bordetella pertussis
gcagcgcgccggg

SEQ ID NO: 332790 - RNA, 15 nt, Bordetella pertussis
gcagcgcgccgggcg

SEQ ID NO: 332791 - RNA, 23 nt, Bordetella pertussis
gcagcgcgccgggcgggucggcg

SEQ ID NO: 332792 - RNA, 20 nt, Bordetella pertussis
gcagcgcgcgcgcgcgggcg

SEQ ID NO: 332793 - RNA, 17 nt, Bordetella pertussis
gcagcgcggcacgcugc

SEQ ID NO: 332794 - RNA, 19 nt, Bordetella pertussis
gcagcgcggcacgcugcug

SEQ ID NO: 332795 - RNA, 12 nt, Bordetella pertussis
gcagcgcggcac

SEQ ID NO: 332796 - RNA, 13 nt, Bordetella pertussis
gcagcggacggcg

SEQ ID NO: 332797 - RNA, 15 nt, Bordetella pertussis
gcagcggaugccgcc

SEQ ID NO: 332798 - RNA, 16 nt, Bordetella pertussis
gcagcggagcgacggc

SEQ ID NO: 332799 - RNA, 15 nt, Bordetella pertussis
gcagcggcaggcccu

SEQ ID NO: 332800 - RNA, 14 nt, Bordetella pertussis
gcagcggcaggcgg

SEQ ID NO: 332801 - RNA, 12 nt, Bordetella pertussis
gcagcggcaggu

SEQ ID NO: 332802 - RNA, 16 nt, Bordetella pertussis
gcagcggcaucacgcc

SEQ ID NO: 332803 - RNA, 17 nt, Bordetella pertussis
gcagcggcaucacgccg

SEQ ID NO: 332804 - RNA, 14 nt, Bordetella pertussis
gcagcggcagcagc

SEQ ID NO: 332805 - RNA, 18 nt, Bordetella pertussis
gcagcggcagcagcagcg

SEQ ID NO: 332806 - RNA, 13 nt, Bordetella pertussis
gcagcggcagcgc

SEQ ID NO: 332807 - RNA, 14 nt, Bordetella pertussis
gcagcggccagcgc

SEQ ID NO: 332808 - RNA, 18 nt, Bordetella pertussis
gcagcggccagcgcggcg

SEQ ID NO: 332809 - RNA, 13 nt, Bordetella pertussis
gcagcggccgcgc

SEQ ID NO: 332810 - RNA, 19 nt, Bordetella pertussis
gcagcggguugcgcgccag

SEQ ID NO: 332811 - RNA, 20 nt, Bordetella pertussis
gcagcggguugcgcgccagc

SEQ ID NO: 332812 - RNA, 21 nt, Bordetella pertussis
gcagcggguugcgcgccagcu

SEQ ID NO: 332813 - RNA, 15 nt, Bordetella pertussis
gcagcggccagucca

SEQ ID NO: 332814 - RNA, 18 nt, Bordetella pertussis
gcagcggccauggacgag

SEQ ID NO: 332815 - RNA, 19 nt, Bordetella pertussis
gcagcguaucgcccgcgcg

SEQ ID NO: 332816 - RNA, 20 nt, Bordetella pertussis
gcagcgucaauccgccgcca

SEQ ID NO: 332817 - RNA, 22 nt, Bordetella pertussis
gcagcgucaauccgccgccagc

SEQ ID NO: 332818 - RNA, 16 nt, Bordetella pertussis
gcagcgugggcucgau

SEQ ID NO: 332819 - RNA, 19 nt, Bordetella pertussis
gcagcgugggcucgaugcg

SEQ ID NO: 332820 - RNA, 17 nt, Bordetella pertussis
gcagcguuacgcgacca

SEQ ID NO: 332821 - RNA, 17 nt, Bordetella pertussis
gcagcguugcggcgucg

SEQ ID NO: 332822 - RNA, 18 nt, Bordetella pertussis
gcagcguuucaccgcugg

SEQ ID NO: 332823 - RNA, 21 nt, Bordetella pertussis
gcagcguuucaccgcuggacg

SEQ ID NO: 332824 - RNA, 22 nt, Bordetella pertussis
gcagcuccgggucgagcgccga

SEQ ID NO: 332825 - RNA, 12 nt, Bordetella pertussis
gcagcucgaccg

SEQ ID NO: 332826 - RNA, 15 nt, Bordetella pertussis
gcagcuccucggccu

SEQ ID NO: 332827 - RNA, 13 nt, Bordetella pertussis
gcagcucgcgcgc

SEQ ID NO: 332828 - RNA, 17 nt, Bordetella pertussis
gcagcucgcgcugcgcg

SEQ ID NO: 332829 - RNA, 21 nt, Bordetella pertussis
gcagcucggcgaccaggccca

SEQ ID NO: 332830 - RNA, 19 nt, Bordetella pertussis
gcagcucggcgaucugcgc

SEQ ID NO: 332831 - RNA, 16 nt, Bordetella pertussis
gcagcucggcgaagcc

SEQ ID NO: 332832 - RNA, 20 nt, Bordetella pertussis
gcagcucggcgaagccgcag

SEQ ID NO: 332833 - RNA, 21 nt, Bordetella pertussis
gcagcucggugcagcccagca

SEQ ID NO: 332834 - RNA, 20 nt, Bordetella pertussis
gcagcucguugaccugcugg

SEQ ID NO: 332835 - RNA, 15 nt, Bordetella pertussis
gcagcugcgccagcc

SEQ ID NO: 332836 - RNA, 15 nt, Bordetella pertussis
gcagcugcuugccca

SEQ ID NO: 332837 - RNA, 21 nt, Bordetella pertussis
gcagcugcuugcccaggccgg

SEQ ID NO: 332838 - RNA, 22 nt, Bordetella pertussis
gcagcugcuugcccaggccggc

SEQ ID NO: 332839 - RNA, 23 nt, Bordetella pertussis
gcagcugcuugcccaggccggcg

SEQ ID NO: 332840 - RNA, 12 nt, Bordetella pertussis
gcagcuggcgca

SEQ ID NO: 332841 - RNA, 15 nt, Bordetella pertussis
gcagcuggcgcagca

SEQ ID NO: 332842 - RNA, 12 nt, Bordetella pertussis
gcagcuggcgcg

SEQ ID NO: 332843 - RNA, 16 nt, Bordetella pertussis
gcagcuggcgcgggcg

SEQ ID NO: 332844 - RNA, 20 nt, Bordetella pertussis
gcagcuggcgcgggcggccu

SEQ ID NO: 332845 - RNA, 13 nt, Bordetella pertussis
gcagcuguagccc

SEQ ID NO: 332846 - RNA, 16 nt, Bordetella pertussis
gcagcuguagcccugg

SEQ ID NO: 332847 - RNA, 18 nt, Bordetella pertussis
gcagcuguagcccuggcg

SEQ ID NO: 332848 - RNA, 23 nt, Bordetella pertussis
gcagcuguagcccuggcgcugca

SEQ ID NO: 332849 - RNA, 19 nt, Bordetella pertussis
gcagcuucuaucugccgcg

SEQ ID NO: 332850 - RNA, 20 nt, Bordetella pertussis
gcagcuucuugaacucggcc

SEQ ID NO: 332851 - RNA, 22 nt, Bordetella pertussis
gcagcuucuugaacucggccag

SEQ ID NO: 332852 - RNA, 15 nt, Bordetella pertussis
gcagcuugcccgcgc

SEQ ID NO: 332853 - RNA, 21 nt, Bordetella pertussis
gcagcuugcccgcgcgcacgu

SEQ ID NO: 332854 - RNA, 15 nt, Bordetella pertussis
gcagcuugcgcgcca

SEQ ID NO: 332855 - RNA, 23 nt, Bordetella pertussis
gcagcuugcgcgcccccacgccg

SEQ ID NO: 332856 - RNA, 15 nt, Bordetella pertussis
gcagcuuggcgcgcc

SEQ ID NO: 332857 - RNA, 17 nt, Bordetella pertussis
gcagcuugucgaucgcc

SEQ ID NO: 332858 - RNA, 16 nt, Bordetella pertussis
gcaggaacucagcgca

SEQ ID NO: 332859 - RNA, 22 nt, Bordetella pertussis
gcaggaagccugcgcgcgagca

SEQ ID NO: 332860 - RNA, 16 nt, Bordetella pertussis
gcaggaagcgcaccag

SEQ ID NO: 332861 - RNA, 23 nt, Bordetella pertussis
gcaggaauccuggugccaguccc

SEQ ID NO: 332862 - RNA, 18 nt, Bordetella pertussis
gcaggacaaggcgcgcgc

SEQ ID NO: 332863 - RNA, 14 nt, Bordetella pertussis
gcaggacgccggcg

SEQ ID NO: 332864 - RNA, 18 nt, Bordetella pertussis
gcaggacgccggcgccgg

SEQ ID NO: 332865 - RNA, 24 nt, Bordetella pertussis
gcaggacggggaacaggcgcgcca

SEQ ID NO: 332866 - RNA, 17 nt, Bordetella pertussis
gcaggagcccgcugccg

SEQ ID NO: 332867 - RNA, 17 nt, Bordetella pertussis
gcaggagccuguccccg

SEQ ID NO: 332868 - RNA, 15 nt, Bordetella pertussis
gcaggaggcgcgggc

SEQ ID NO: 332869 - RNA, 14 nt, Bordetella pertussis
gcaggaucgcggcc

SEQ ID NO: 332870 - RNA, 18 nt, Bordetella pertussis
gcaggaucgcggccagcg

SEQ ID NO: 332871 - RNA, 20 nt, Bordetella pertussis
gcaggaucugguucuugguc

SEQ ID NO: 332872 - RNA, 17 nt, Bordetella pertussis
gcaggaugacguggcag

SEQ ID NO: 332873 - RNA, 15 nt, Bordetella pertussis
gcaggaugcgcggca

SEQ ID NO: 332874 - RNA, 16 nt, Bordetella pertussis
gcaggaugcgcggcac

SEQ ID NO: 332875 - RNA, 14 nt, Bordetella pertussis
gcaggaugcgcugg

SEQ ID NO: 332876 - RNA, 16 nt, Bordetella pertussis
gcaggaugcgcuggcc

SEQ ID NO: 332877 - RNA, 18 nt, Bordetella pertussis
gcaggauggaucccuggu

SEQ ID NO: 332878 - RNA, 16 nt, Bordetella pertussis
gcaggauggccaugcg

SEQ ID NO: 332879 - RNA, 14 nt, Bordetella pertussis
gcaggauggcgaac

SEQ ID NO: 332880 - RNA, 19 nt, Bordetella pertussis
gcaggcaagcugcuggcgc

SEQ ID NO: 332881 - RNA, 23 nt, Bordetella pertussis
gcaggcaagcugcuggcgcgcca

SEQ ID NO: 332882 - RNA, 16 nt, Bordetella pertussis
gcaggcaaagccugac

SEQ ID NO: 332883 - RNA, 13 nt, Bordetella pertussis
gcaggccaggcuc

SEQ ID NO: 332884 - RNA, 16 nt, Bordetella pertussis
gcaggccauugcuggc

SEQ ID NO: 332885 - RNA, 14 nt, Bordetella pertussis
gcaggcccaccggc

SEQ ID NO: 332886 - RNA, 20 nt, Bordetella pertussis
gcaggcccaccggcaugccg

SEQ ID NO: 332887 - RNA, 12 nt, Bordetella pertussis
gcaggcccagca

SEQ ID NO: 332888 - RNA, 21 nt, Bordetella pertussis
gcaggcccagcacgcgcgcca

SEQ ID NO: 332889 - RNA, 14 nt, Bordetella pertussis
gcaggcccaccagg

SEQ ID NO: 332890 - RNA, 17 nt, Bordetella pertussis
gcaggcccaccagggcc

SEQ ID NO: 332891 - RNA, 13 nt, Bordetella pertussis
gcaggcccagcca

SEQ ID NO: 332892 - RNA, 21 nt, Bordetella pertussis
gcaggcccagccagcccuggc

SEQ ID NO: 332893 - RNA, 15 nt, Bordetella pertussis
gcaggcccaugacga

SEQ ID NO: 332894 - RNA, 17 nt, Bordetella pertussis
gcaggcccaugacgccg

SEQ ID NO: 332895 - RNA, 20 nt, Bordetella pertussis
gcaggccccggcccggcggg

SEQ ID NO: 332896 - RNA, 11 nt, Bordetella pertussis
gcaggcccggc

SEQ ID NO: 332897 - RNA, 13 nt, Bordetella pertussis
gcaggcccggcgc

SEQ ID NO: 332898 - RNA, 18 nt, Bordetella pertussis
gcaggcccuccggcgcca

SEQ ID NO: 332899 - RNA, 21 nt, Bordetella pertussis
gcaggcccuccggcgccagca

SEQ ID NO: 332900 - RNA, 20 nt, Bordetella pertussis
gcaggccguuccaguccagc

SEQ ID NO: 332901 - RNA, 15 nt, Bordetella pertussis
gcaggccguugccgc

SEQ ID NO: 332902 - RNA, 12 nt, Bordetella pertussis
gcaggcgaaacg

SEQ ID NO: 332903 - RNA, 12 nt, Bordetella pertussis
gcaggcgcacca

SEQ ID NO: 332904 - RNA, 15 nt, Bordetella pertussis
gcaggcgcaccagcg

SEQ ID NO: 332905 - RNA, 17 nt, Bordetella pertussis
gcaggcgcaccagcgcg

SEQ ID NO: 332906 - RNA, 15 nt, Bordetella pertussis
gcaggcgcugcgcau

SEQ ID NO: 332907 - RNA, 18 nt, Bordetella pertussis
gcaggcgcuggucgucgc

SEQ ID NO: 332908 - RNA, 17 nt, Bordetella pertussis
gcaggcggcagaaggcg

SEQ ID NO: 332909 - RNA, 11 nt, Bordetella pertussis
gcaggcggcgg

SEQ ID NO: 332910 - RNA, 12 nt, Bordetella pertussis
gcaggcggcggc

SEQ ID NO: 332911 - RNA, 23 nt, Bordetella pertussis
gcaggcggcuuucaugggccugg

SEQ ID NO: 332912 - RNA, 13 nt, Bordetella pertussis
gcaggcgggccag

SEQ ID NO: 332913 - RNA, 17 nt, Bordetella pertussis
gcaggcgggccaggccg

SEQ ID NO: 332914 - RNA, 15 nt, Bordetella pertussis
gcaggcgggcccgca

SEQ ID NO: 332915 - RNA, 19 nt, Bordetella pertussis
gcaggcgggcccgcaucgc

SEQ ID NO: 332916 - RNA, 21 nt, Bordetella pertussis
gcaggcgggcccgcaucgcgc

SEQ ID NO: 332917 - RNA, 14 nt, Bordetella pertussis
gcaggcgggcgccg

SEQ ID NO: 332918 - RNA, 16 nt, Bordetella pertussis
gcaggcgggcgccgcg

SEQ ID NO: 332919 - RNA, 15 nt, Bordetella pertussis
gcaggcgguacagcg

SEQ ID NO: 332920 - RNA, 17 nt, Bordetella pertussis
gcaggcggucgaggcgc

SEQ ID NO: 332921 - RNA, 13 nt, Bordetella pertussis
gcaggcuggccac

SEQ ID NO: 332922 - RNA, 17 nt, Bordetella pertussis
gcaggcuggcgcggucc

SEQ ID NO: 332923 - RNA, 23 nt, Bordetella pertussis
gcaggcugggcgaaacggccagc

SEQ ID NO: 332924 - RNA, 18 nt, Bordetella pertussis
gcaggcuuucgcacagcc

SEQ ID NO: 332925 - RNA, 18 nt, Bordetella pertussis
gcaggcuuugcuggccau

SEQ ID NO: 332926 - RNA, 12 nt, Bordetella pertussis
gcagggacaggc

SEQ ID NO: 332927 - RNA, 23 nt, Bordetella pertussis
gcagggcaugggcccgggcgcgc

SEQ ID NO: 332928 - RNA, 17 nt, Bordetella pertussis
gcagggcaucaccaucg

SEQ ID NO: 332929 - RNA, 14 nt, Bordetella pertussis
gcagggccagcgcc

SEQ ID NO: 332930 - RNA, 18 nt, Bordetella pertussis
gcagggccagcgccagca

SEQ ID NO: 332931 - RNA, 19 nt, Bordetella pertussis
gcagggccaggcccacggc

SEQ ID NO: 332932 - RNA, 12 nt, Bordetella pertussis
gcagggcccgca

SEQ ID NO: 332933 - RNA, 16 nt, Bordetella pertussis
gcaggggguggcggcc

SEQ ID NO: 332934 - RNA, 17 nt, Bordetella pertussis
gcagggucagcccgcca

SEQ ID NO: 332935 - RNA, 15 nt, Bordetella pertussis
gcagggucagcggcc

SEQ ID NO: 332936 - RNA, 18 nt, Bordetella pertussis
gcagggucagcggccggc

SEQ ID NO: 332937 - RNA, 18 nt, Bordetella pertussis
gcagggucagggugucgc

SEQ ID NO: 332938 - RNA, 17 nt, Bordetella pertussis
gcagggucugcaggccg

SEQ ID NO: 332939 - RNA, 18 nt, Bordetella pertussis
gcagggugacgggcuggg

SEQ ID NO: 332940 - RNA, 19 nt, Bordetella pertussis
gcagggugacgggcugggc

SEQ ID NO: 332941 - RNA, 22 nt, Bordetella pertussis
gcagggugcccaguucgcggcc

SEQ ID NO: 332942 - RNA, 22 nt, Bordetella pertussis
gcagguuggagaucaugaccac

SEQ ID NO: 332943 - RNA, 15 nt, Bordetella pertussis
gcaguacaggcgcgu

SEQ ID NO: 332944 - RNA, 21 nt, Bordetella pertussis
gcaguacaggcgcguggcgcc

SEQ ID NO: 332945 - RNA, 18 nt, Bordetella pertussis
gcaguaucccggccaggc

SEQ ID NO: 332946 - RNA, 23 nt, Bordetella pertussis
gcaguaucccggccaggcgccgg

SEQ ID NO: 332947 - RNA, 20 nt, Bordetella pertussis
gcagucaaccguucauggcg

SEQ ID NO: 332948 - RNA, 20 nt, Bordetella pertussis
gcagucagccguucauggcg

SEQ ID NO: 332949 - RNA, 14 nt, Bordetella pertussis
gcaguccagcgugg

SEQ ID NO: 332950 - RNA, 17 nt, Bordetella pertussis
gcaguccugcgaucagu

SEQ ID NO: 332951 - RNA, 15 nt, Bordetella pertussis
gcagucgagcaccgc

SEQ ID NO: 332952 - RNA, 18 nt, Bordetella pertussis
gcagucgcgcacgaagcc

SEQ ID NO: 332953 - RNA, 19 nt, Bordetella pertussis
gcagucgcgcacgaagccg

SEQ ID NO: 332954 - RNA, 15 nt, Bordetella pertussis
gcagucgcgcagcca

SEQ ID NO: 332955 - RNA, 16 nt, Bordetella pertussis
gcagucgcgcagccac

SEQ ID NO: 332956 - RNA, 15 nt, Bordetella pertussis
gcagucggggccgca

SEQ ID NO: 332957 - RNA, 20 nt, Bordetella pertussis
gcagucggggccgcagcugg

SEQ ID NO: 332958 - RNA, 23 nt, Bordetella pertussis
gcagugggccaguucgcggcgca

SEQ ID NO: 332959 - RNA, 20 nt, Bordetella pertussis
gcagugguggugcagcggca

SEQ ID NO: 332960 - RNA, 22 nt, Bordetella pertussis
gcauacagggcggugcgcucga

SEQ ID NO: 332961 - RNA, 21 nt, Bordetella pertussis
gcauacaugaguucuggcauc

SEQ ID NO: 332962 - RNA, 16 nt, Bordetella pertussis
gcauacccugcgcgcc

SEQ ID NO: 332963 - RNA, 18 nt, Bordetella pertussis
gcauacccugcgcgccgc

SEQ ID NO: 332964 - RNA, 16 nt, Bordetella pertussis
gcauaccggccgcggg

SEQ ID NO: 332965 - RNA, 15 nt, Bordetella pertussis
gcauaccuuggcgcc

SEQ ID NO: 332966 - RNA, 19 nt, Bordetella pertussis
gcauacgccgauggcgcgg

SEQ ID NO: 332967 - RNA, 21 nt, Bordetella pertussis
gcauacgccgcugauggcggu

SEQ ID NO: 332968 - RNA, 20 nt, Bordetella pertussis
gcauacgcggguucgacgcc

SEQ ID NO: 332969 - RNA, 23 nt, Bordetella pertussis
gcauacgcggguucgacgccggc

SEQ ID NO: 332970 - RNA, 18 nt, Bordetella pertussis
gcauaccucgauggcggu

SEQ ID NO: 332971 - RNA, 19 nt, Bordetella pertussis
gcauacucgaugcccagca

SEQ ID NO: 332972 - RNA, 20 nt, Bordetella pertussis
gcauauccaggcggcgcucg

SEQ ID NO: 332973 - RNA, 21 nt, Bordetella pertussis
gcauaucgucgcugcggccgg

SEQ ID NO: 332974 - RNA, 18 nt, Bordetella pertussis
gcaucaacacgcuggacg

SEQ ID NO: 332975 - RNA, 13 nt, Bordetella pertussis
gcaucagcagacc

SEQ ID NO: 332976 - RNA, 17 nt, Bordetella pertussis
gcaucagcagacccugg

SEQ ID NO: 332977 - RNA, 21 nt, Bordetella pertussis
gcaucagcccuacccugauca

SEQ ID NO: 332978 - RNA, 20 nt, Bordetella pertussis
gcaucagcuuggccaccacg

SEQ ID NO: 332979 - RNA, 14 nt, Bordetella pertussis
gcaucaggcccgac

SEQ ID NO: 332980 - RNA, 20 nt, Bordetella pertussis
gcaucaggggcucggccagg

SEQ ID NO: 332981 - RNA, 15 nt, Bordetella pertussis
gcaucagggcgaucu

SEQ ID NO: 332982 - RNA, 14 nt, Bordetella pertussis
gcaucaguucaggc

SEQ ID NO: 332983 - RNA, 18 nt, Bordetella pertussis
gcaucaguucaggcuggc

SEQ ID NO: 332984 - RNA, 19 nt, Bordetella pertussis
gcaucaguucaggcuggcg

SEQ ID NO: 332985 - RNA, 19 nt, Bordetella pertussis
gcaucaucugggcgucgaa

SEQ ID NO: 332986 - RNA, 20 nt, Bordetella pertussis
gcauccagccgaucagccgg

SEQ ID NO: 332987 - RNA, 21 nt, Bordetella pertussis
gcauccaggucuacccgcgcg

SEQ ID NO: 332988 - RNA, 22 nt, Bordetella pertussis
gcaucccaauuggccgcccugg

SEQ ID NO: 332989 - RNA, 14 nt, Bordetella pertussis
gcauccggcccagc

SEQ ID NO: 332990 - RNA, 18 nt, Bordetella pertussis
gcauccggcccagcgcca

SEQ ID NO: 332991 - RNA, 19 nt, Bordetella pertussis
gcauccggcccagcgccau

SEQ ID NO: 332992 - RNA, 17 nt, Bordetella pertussis
gcauccgguggugcugg

SEQ ID NO: 332993 - RNA, 24 nt, Bordetella pertussis
gcauccuuuuuguuuuggcgcacg

SEQ ID NO: 332994 - RNA, 15 nt, Bordetella pertussis
gcaucgaacgugcug

SEQ ID NO: 332995 - RNA, 18 nt, Bordetella pertussis
gccaagaccgcggccgcg

SEQ ID NO: 332996 - RNA, 12 nt, Bordetella pertussis
gccaagacgcgg

SEQ ID NO: 332997 - RNA, 23 nt, Bordetella pertussis
gccaagacgguaucugucccggc

SEQ ID NO: 332998 - RNA, 12 nt, Bordetella pertussis
gccaagauggcc

SEQ ID NO: 332999 - RNA, 21 nt, Bordetella pertussis
gccaagcagcgccugccgcgu

SEQ ID NO: 333000 - RNA, 17 nt, Bordetella pertussis
gccaagcgccgcggcca

SEQ ID NO: 333001 - RNA, 19 nt, Bordetella pertussis
gccaagcgccgcggccacg

SEQ ID NO: 333002 - RNA, 13 nt, Bordetella pertussis
gccaagcggcagg

SEQ ID NO: 333003 - RNA, 16 nt, Bordetella pertussis
gccaagcggcaggcgg

SEQ ID NO: 333004 - RNA, 22 nt, Bordetella pertussis
gccaagcuggagaagcgccgcg

SEQ ID NO: 333005 - RNA, 17 nt, Bordetella pertussis
gccaaggagacacgcua

SEQ ID NO: 333006 - RNA, 17 nt, Bordetella pertussis
gccaaggcauuggcgcc

SEQ ID NO: 333007 - RNA, 20 nt, Bordetella pertussis
gccaaggcauuggcgccgcg

SEQ ID NO: 333008 - RNA, 22 nt, Bordetella pertussis
gccaaggcauuggcgccgcgcu

SEQ ID NO: 333009 - RNA, 24 nt, Bordetella pertussis
gccaaggcauuggcgccgcgcucg

SEQ ID NO: 333010 - RNA, 18 nt, Bordetella pertussis
gccaaggccggcgcgucg

SEQ ID NO: 333011 - RNA, 15 nt, Bordetella pertussis
gccaagggcgccgcg

SEQ ID NO: 333012 - RNA, 15 nt, Bordetella pertussis
gccaagggcgcgcca

SEQ ID NO: 333013 - RNA, 16 nt, Bordetella pertussis
gccaagggcgcgccag

SEQ ID NO: 333014 - RNA, 16 nt, Bordetella pertussis
gccaagggcgugcgcu

SEQ ID NO: 333015 - RNA, 22 nt, Bordetella pertussis
gccaaggugccuguccccgcgg

SEQ ID NO: 333016 - RNA, 21 nt, Bordetella pertussis
gccaauaacagaggaacgccg

SEQ ID NO: 333017 - RNA, 16 nt, Bordetella pertussis
gccaaucagauggcgc

SEQ ID NO: 333018 - RNA, 20 nt, Bordetella pertussis
gccaaucagauggcgcagcg

SEQ ID NO: 333019 - RNA, 19 nt, Bordetella pertussis
gccaaucaugcgcugcugg

SEQ ID NO: 333020 - RNA, 14 nt, Bordetella pertussis
gccaaucggccugc

SEQ ID NO: 333021 - RNA, 15 nt, Bordetella pertussis
gccaaucggcguuga

SEQ ID NO: 333022 - RNA, 13 nt, Bordetella pertussis
gccaaucugccgc

SEQ ID NO: 333023 - RNA, 16 nt, Bordetella pertussis
gccaaucugccgcuga

SEQ ID NO: 333024 - RNA, 14 nt, Bordetella pertussis
gccaaugccgcggu

SEQ ID NO: 333025 - RNA, 18 nt, Bordetella pertussis
gccaaugccgcgguugcg

SEQ ID NO: 333026 - RNA, 14 nt, Bordetella pertussis
gccaaugcgccgcg

SEQ ID NO: 333027 - RNA, 17 nt, Bordetella pertussis
gccaaugcgccgcgcca

SEQ ID NO: 333028 - RNA, 20 nt, Bordetella pertussis
gccaauugcuugccuguccc

SEQ ID NO: 333029 - RNA, 20 nt, Bordetella pertussis
gccacaccagguugucggcg

SEQ ID NO: 333030 - RNA, 23 nt, Bordetella pertussis
gccacaccgcugcgggaggugcc

SEQ ID NO: 333031 - RNA, 15 nt, Bordetella pertussis
gccacacgaggaccg

SEQ ID NO: 333032 - RNA, 19 nt, Bordetella pertussis
gccacacgaucagcgccca

SEQ ID NO: 333033 - RNA, 20 nt, Bordetella pertussis
gccacacgaucagcgcccag

SEQ ID NO: 333034 - RNA, 21 nt, Bordetella pertussis
gccacacgcugaagcgccgcc

SEQ ID NO: 333035 - RNA, 22 nt, Bordetella pertussis
gccacacgcugaagcgccgcca

SEQ ID NO: 333036 - RNA, 14 nt, Bordetella pertussis
gccacagcgccauc

SEQ ID NO: 333037 - RNA, 15 nt, Bordetella pertussis
gccacagcgccaucg

SEQ ID NO: 333038 - RNA, 18 nt, Bordetella pertussis
gccacagcgccaucgcgc

SEQ ID NO: 333039 - RNA, 18 nt, Bordetella pertussis
gccacagcgcguggccgg

SEQ ID NO: 333040 - RNA, 15 nt, Bordetella pertussis
gccacagcgugacgg

SEQ ID NO: 333041 - RNA, 19 nt, Bordetella pertussis
gccacagcgugacggcggc

SEQ ID NO: 333042 - RNA, 15 nt, Bordetella pertussis
gccacaggcgcuugc

SEQ ID NO: 333043 - RNA, 17 nt, Bordetella pertussis
gccacaggcgcuugcca

SEQ ID NO: 333044 - RNA, 15 nt, Bordetella pertussis
gccacaggcugacgc

SEQ ID NO: 333045 - RNA, 19 nt, Bordetella pertussis
gccacagggcgaaggccag

SEQ ID NO: 333046 - RNA, 23 nt, Bordetella pertussis
gccacaggugcgcggcgcgccgu

SEQ ID NO: 333047 - RNA, 15 nt, Bordetella pertussis
gccacaucacgccgg

SEQ ID NO: 333048 - RNA, 14 nt, Bordetella pertussis
gccacauccugcac

SEQ ID NO: 333049 - RNA, 22 nt, Bordetella pertussis
gccacaucgaauuugaacagcc

SEQ ID NO: 333050 - RNA, 22 nt, Bordetella pertussis
gccaccaaaaacggucugccgc

SEQ ID NO: 333051 - RNA, 22 nt, Bordetella pertussis
gccaccacaaggauggacuggc

SEQ ID NO: 333052 - RNA, 17 nt, Bordetella pertussis
gccaccaccaggcccag

SEQ ID NO: 333053 - RNA, 15 nt, Bordetella pertussis
gccaccaccucggcc

SEQ ID NO: 333054 - RNA, 18 nt, Bordetella pertussis
gccaccaccucggccucg

SEQ ID NO: 333055 - RNA, 21 nt, Bordetella pertussis
gccaccaccucggugccgugg

SEQ ID NO: 333056 - RNA, 14 nt, Bordetella pertussis
gccaccacgauggc

SEQ ID NO: 333057 - RNA, 15 nt, Bordetella pertussis
gccaccacgcgcacc

SEQ ID NO: 333058 - RNA, 19 nt, Bordetella pertussis
gccaccacgcgcaccagcu

SEQ ID NO: 333059 - RNA, 17 nt, Bordetella pertussis
gccaccacggcgcggau

SEQ ID NO: 333060 - RNA, 20 nt, Bordetella pertussis
gccaccacugcaaggcccgc

SEQ ID NO: 333061 - RNA, 14 nt, Bordetella pertussis
gccaccagcagcgc

SEQ ID NO: 333062 - RNA, 18 nt, Bordetella pertussis
gccaccagcagcgccagg

SEQ ID NO: 333063 - RNA, 19 nt, Bordetella pertussis
gccaccagcagcgccagga

SEQ ID NO: 333064 - RNA, 15 nt, Bordetella pertussis
gccaccagcgcgcca

SEQ ID NO: 333065 - RNA, 18 nt, Bordetella pertussis
gccaccagcgcgccagca

SEQ ID NO: 333066 - RNA, 14 nt, Bordetella pertussis
gccaccagcggcgu

SEQ ID NO: 333067 - RNA, 17 nt, Bordetella pertussis
gccaccaggaacgccag

SEQ ID NO: 333068 - RNA, 18 nt, Bordetella pertussis
gccaccaggaacgccagc

SEQ ID NO: 333069 - RNA, 19 nt, Bordetella pertussis
gccaccaggaacgccagca

SEQ ID NO: 333070 - RNA, 21 nt, Bordetella pertussis
gccaccaggaacgccagcagc

SEQ ID NO: 333071 - RNA, 16 nt, Bordetella pertussis
gccaccaggccgaugg

SEQ ID NO: 333072 - RNA, 21 nt, Bordetella pertussis
gccaccaggccgauggcgucc

SEQ ID NO: 333073 - RNA, 14 nt, Bordetella pertussis
gccaccaggccguc

SEQ ID NO: 333074 - RNA, 19 nt, Bordetella pertussis
gccaccaggccgucggcca

SEQ ID NO: 333075 - RNA, 22 nt, Bordetella pertussis
gccaccaggccgucggccaggg

SEQ ID NO: 333076 - RNA, 16 nt, Bordetella pertussis
gccaccaggcgcgcgc

SEQ ID NO: 333077 - RNA, 18 nt, Bordetella pertussis
gccaccaggcgcgcgcca

SEQ ID NO: 333078 - RNA, 19 nt, Bordetella pertussis
gccaccaggcgcgcgccau

SEQ ID NO: 333079 - RNA, 20 nt, Bordetella pertussis
gccaccaggcgcgcgccauc

SEQ ID NO: 333080 - RNA, 17 nt, Bordetella pertussis
gccaccagggcgcccgc

SEQ ID NO: 333081 - RNA, 23 nt, Bordetella pertussis
gccaccagggcgcccgccgacga

SEQ ID NO: 333082 - RNA, 19 nt, Bordetella pertussis
gccaccagguagggcagca

SEQ ID NO: 333083 - RNA, 17 nt, Bordetella pertussis
gccaccagugcgccggc

SEQ ID NO: 333084 - RNA, 18 nt, Bordetella pertussis
gccaccagugcgccggcg

SEQ ID NO: 333085 - RNA, 18 nt, Bordetella pertussis
gccaccaugccuugcgcg

SEQ ID NO: 333086 - RNA, 20 nt, Bordetella pertussis
gccaccaugucccuggccau

SEQ ID NO: 333087 - RNA, 15 nt, Bordetella pertussis
gccacccagcucagc

SEQ ID NO: 333088 - RNA, 13 nt, Bordetella pertussis
gccacccaggcgg

SEQ ID NO: 333089 - RNA, 14 nt, Bordetella pertussis
gccacccaggcggc

SEQ ID NO: 333090 - RNA, 15 nt, Bordetella pertussis
gccacccaggcggca

SEQ ID NO: 333091 - RNA, 22 nt, Bordetella pertussis
gccacccagggcuugacgcgcg

SEQ ID NO: 333092 - RNA, 16 nt, Bordetella pertussis
gccaccccgccgcuga

SEQ ID NO: 333093 - RNA, 20 nt, Bordetella pertussis
gccaccccguagcgcaucgc

SEQ ID NO: 333094 - RNA, 17 nt, Bordetella pertussis
gccaccccgucaucgcc

SEQ ID NO: 333095 - RNA, 19 nt, Bordetella pertussis
gccaccccguugcagccca

SEQ ID NO: 333096 - RNA, 15 nt, Bordetella pertussis
gccacccgccgccgg

SEQ ID NO: 333097 - RNA, 16 nt, Bordetella pertussis
gccacccgccgccggc

SEQ ID NO: 333098 - RNA, 18 nt, Bordetella pertussis
gccacccgccgccggcga

SEQ ID NO: 333099 - RNA, 21 nt, Bordetella pertussis
gccacccgccguaccgggcgg

SEQ ID NO: 333100 - RNA, 14 nt, Bordetella pertussis
gccaccgaagcggc

SEQ ID NO: 333101 - RNA, 20 nt, Bordetella pertussis
gccaccgaagcggcguucug

SEQ ID NO: 333102 - RNA, 16 nt, Bordetella pertussis
gccaccgacaagccgg

SEQ ID NO: 333103 - RNA, 18 nt, Bordetella pertussis
gccaccgacggcgcggcg

SEQ ID NO: 333104 - RNA, 14 nt, Bordetella pertussis
gccaccgcccaggc

SEQ ID NO: 333105 - RNA, 17 nt, Bordetella pertussis
gccaccgcccaggcgca

SEQ ID NO: 333106 - RNA, 18 nt, Bordetella pertussis
gccaccgcccaggcgcag

SEQ ID NO: 333107 - RNA, 20 nt, Bordetella pertussis
gccaccgcccaggcgcagcc

SEQ ID NO: 333108 - RNA, 19 nt, Bordetella pertussis
gccaccgcccccgccgcca

SEQ ID NO: 333109 - RNA, 21 nt, Bordetella pertussis
gccaccgcccccgccgccaug

SEQ ID NO: 333110 - RNA, 21 nt, Bordetella pertussis
gccaccgccugugccagcugg

SEQ ID NO: 333111 - RNA, 16 nt, Bordetella pertussis
gccaccgcgccgccca

SEQ ID NO: 333112 - RNA, 13 nt, Bordetella pertussis
gccaccgcggcgg

SEQ ID NO: 333113 - RNA, 20 nt, Bordetella pertussis
gccaccgcggugccgcgcgc

SEQ ID NO: 333114 - RNA, 19 nt, Bordetella pertussis
gccaccgcguugagcgccg

SEQ ID NO: 333115 - RNA, 21 nt, Bordetella pertussis
gccaccgcguugagcgccgac

SEQ ID NO: 333116 - RNA, 18 nt, Bordetella pertussis
gccaccggucgccgucca

SEQ ID NO: 333117 - RNA, 19 nt, Bordetella pertussis
gccaccgguugcagcgcgc

SEQ ID NO: 333118 - RNA, 21 nt, Bordetella pertussis
gccaccgguugcagcgcgcca

SEQ ID NO: 333119 - RNA, 17 nt, Bordetella pertussis
gccaccgucucgcccau

SEQ ID NO: 333120 - RNA, 15 nt, Bordetella pertussis
gccaccguggccacg

SEQ ID NO: 333121 - RNA, 16 nt, Bordetella pertussis
gccaccguggcgucca

SEQ ID NO: 333122 - RNA, 22 nt, Bordetella pertussis
gccaccucgaucaccaccggca

SEQ ID NO: 333123 - RNA, 23 nt, Bordetella pertussis
gccaccucuucagcccggcgcgc

SEQ ID NO: 333124 - RNA, 14 nt, Bordetella pertussis
gccaccuggcagcc

SEQ ID NO: 333125 - RNA, 15 nt, Bordetella pertussis
gccaccuggcagccg

SEQ ID NO: 333126 - RNA, 17 nt, Bordetella pertussis
gccaccuggcgcaaggc

SEQ ID NO: 333127 - RNA, 14 nt, Bordetella pertussis
gccaccugggccgc

SEQ ID NO: 333128 - RNA, 16 nt, Bordetella pertussis
gccaccugggccgccu

SEQ ID NO: 333129 - RNA, 17 nt, Bordetella pertussis
gccaccugggccgccug

SEQ ID NO: 333130 - RNA, 21 nt, Bordetella pertussis
gccaccugggccgccugcugg

SEQ ID NO: 333131 - RNA, 21 nt, Bordetella pertussis
gccaccuggucgucggccacg

SEQ ID NO: 333132 - RNA, 15 nt, Bordetella pertussis
gccaccuucgccgcg

SEQ ID NO: 333133 - RNA, 21 nt, Bordetella pertussis
gccacgaaacccacggcgaug

SEQ ID NO: 333134 - RNA, 21 nt, Bordetella pertussis
gccacgaagacgaagucccag

SEQ ID NO: 333135 - RNA, 12 nt, Bordetella pertussis
gccacgaccacc

SEQ ID NO: 333136 - RNA, 17 nt, Bordetella pertussis
gccacgaccaccagcgu

SEQ ID NO: 333137 - RNA, 17 nt, Bordetella pertussis
gccacgcccacgcgccg

SEQ ID NO: 333138 - RNA, 18 nt, Bordetella pertussis
gccacgcccacgcgccgc

SEQ ID NO: 333139 - RNA, 20 nt, Bordetella pertussis
gccacgcccacgcgccgcca

SEQ ID NO: 333140 - RNA, 14 nt, Bordetella pertussis
gccacgcccaggcc

SEQ ID NO: 333141 - RNA, 19 nt, Bordetella pertussis
gccacgcccaucugguuga

SEQ ID NO: 333142 - RNA, 22 nt, Bordetella pertussis
gccacgcccgucucgcgcgcca

SEQ ID NO: 333143 - RNA, 17 nt, Bordetella pertussis
gccacgcccuggcagcu

SEQ ID NO: 333144 - RNA, 20 nt, Bordetella pertussis
gccacgcccuggcagcuggc

SEQ ID NO: 333145 - RNA, 22 nt, Bordetella pertussis
gccacgcccuggcagcuggcgc

SEQ ID NO: 333146 - RNA, 16 nt, Bordetella pertussis
gccacgcuggccgcgc

SEQ ID NO: 333147 - RNA, 19 nt, Bordetella pertussis
gccacgcuggccgcgcugg

SEQ ID NO: 333148 - RNA, 19 nt, Bordetella pertussis
gccacgcugcccugcugcu

SEQ ID NO: 333149 - RNA, 19 nt, Bordetella pertussis
gccacgggcgucaccggcg

SEQ ID NO: 333150 - RNA, 18 nt, Bordetella pertussis
gccacggucgcgagcugc

SEQ ID NO: 333151 - RNA, 15 nt, Bordetella pertussis
gccacggucggcacg

SEQ ID NO: 333152 - RNA, 19 nt, Bordetella pertussis
gccacggucugcacgccgg

SEQ ID NO: 333153 - RNA, 20 nt, Bordetella pertussis
gccacggucugcacgccggg

SEQ ID NO: 333154 - RNA, 20 nt, Bordetella pertussis
gccacucgaugggcgcgcgc

SEQ ID NO: 333155 - RNA, 22 nt, Bordetella pertussis
gccacucgaugggcgcgcgcau

SEQ ID NO: 333156 - RNA, 18 nt, Bordetella pertussis
gccacugcaucgugcgcg

SEQ ID NO: 333157 - RNA, 21 nt, Bordetella pertussis
gccacugcaucgugcgcgagg

SEQ ID NO: 333158 - RNA, 18 nt, Bordetella pertussis
gccacugcgccugggcgg

SEQ ID NO: 333159 - RNA, 14 nt, Bordetella pertussis
gccacugcggcccg

SEQ ID NO: 333160 - RNA, 18 nt, Bordetella pertussis
gccacuuccagcgccugc

SEQ ID NO: 333161 - RNA, 15 nt, Bordetella pertussis
gccacuuccuggugg

SEQ ID NO: 333162 - RNA, 13 nt, Bordetella pertussis
gccacuuccuugc

SEQ ID NO: 333163 - RNA, 14 nt, Bordetella pertussis
gccacuucgccggu

SEQ ID NO: 333164 - RNA, 15 nt, Bordetella pertussis
gccacuugcaggccg

SEQ ID NO: 333165 - RNA, 19 nt, Bordetella pertussis
gccagagcgggauggucgc

SEQ ID NO: 333166 - RNA, 18 nt, Bordetella pertussis
gccagauaaaggccgcaa

SEQ ID NO: 333167 - RNA, 20 nt, Bordetella pertussis
gccagauaaaggccgcaacc

SEQ ID NO: 333168 - RNA, 22 nt, Bordetella pertussis
gccagauaaaggccgcaaccca

SEQ ID NO: 333169 - RNA, 21 nt, Bordetella pertussis
gccagauaccguccuugagcg

SEQ ID NO: 333170 - RNA, 14 nt, Bordetella pertussis
gccagauagucgcg

SEQ ID NO: 333171 - RNA, 13 nt, Bordetella pertussis
gccagauagccca

SEQ ID NO: 333172 - RNA, 17 nt, Bordetella pertussis
gccagauagcccaggcg

SEQ ID NO: 333173 - RNA, 18 nt, Bordetella pertussis
gccagauagcccaggcgg

SEQ ID NO: 333174 - RNA, 20 nt, Bordetella pertussis
gccagcaccggcacgcgcca

SEQ ID NO: 333175 - RNA, 17 nt, Bordetella pertussis
gccagcaccggcccgaa

SEQ ID NO: 333176 - RNA, 19 nt, Bordetella pertussis
gccagcaccggcccgaaga

SEQ ID NO: 333177 - RNA, 21 nt, Bordetella pertussis
gccagcaccggccgccgcaug

SEQ ID NO: 333178 - RNA, 13 nt, Bordetella pertussis
gccagcaccugcu

SEQ ID NO: 333179 - RNA, 20 nt, Bordetella pertussis
gccagcaccugcuugacgua

SEQ ID NO: 333180 - RNA, 13 nt, Bordetella pertussis
gccagcacgccau

SEQ ID NO: 333181 - RNA, 15 nt, Bordetella pertussis
gccagcacgccggcc

SEQ ID NO: 333182 - RNA, 17 nt, Bordetella pertussis
gccagcacgccggccag

SEQ ID NO: 333183 - RNA, 14 nt, Bordetella pertussis
gccagcacggcaug

SEQ ID NO: 333184 - RNA, 15 nt, Bordetella pertussis
gccagcacggcgcac

SEQ ID NO: 333185 - RNA, 16 nt, Bordetella pertussis
gccagcacggcgcaca

SEQ ID NO: 333186 - RNA, 18 nt, Bordetella pertussis
gccagcacggcgcacacc

SEQ ID NO: 333187 - RNA, 19 nt, Bordetella pertussis
gccagcacggcgcacacca

SEQ ID NO: 333188 - RNA, 22 nt, Bordetella pertussis
gccagcacggcgcacaccauca

SEQ ID NO: 333189 - RNA, 13 nt, Bordetella pertussis
gccagcacggugg

SEQ ID NO: 333190 - RNA, 20 nt, Bordetella pertussis
gccagcacgguggcgcccgg

SEQ ID NO: 333191 - RNA, 22 nt, Bordetella pertussis
gccagcacgguggcgcccggcg

SEQ ID NO: 333192 - RNA, 13 nt, Bordetella pertussis
gccagcagcaggc

SEQ ID NO: 333193 - RNA, 22 nt, Bordetella pertussis
gccagcagcgacggccccagcg

SEQ ID NO: 333194 - RNA, 16 nt, Bordetella pertussis
gccagcagcgcaucgc

SEQ ID NO: 333195 - RNA, 19 nt, Bordetella pertussis
gccagcagcgcaucgcgcg

SEQ ID NO: 333196 - RNA, 13 nt, Bordetella pertussis
gccagcagcgccg

SEQ ID NO: 333197 - RNA, 16 nt, Bordetella pertussis
gccagcagcgccgcca

SEQ ID NO: 333198 - RNA, 17 nt, Bordetella pertussis
gccagcagcgccgccag

SEQ ID NO: 333199 - RNA, 19 nt, Bordetella pertussis
gccagcagcgccgccagca

SEQ ID NO: 333200 - RNA, 15 nt, Bordetella pertussis
gccagcagcgccugg

SEQ ID NO: 333201 - RNA, 13 nt, Bordetella pertussis
gccagcagcgcgu

SEQ ID NO: 333202 - RNA, 20 nt, Bordetella pertussis
gccagcagcgcgugcagcca

SEQ ID NO: 333203 - RNA, 15 nt, Bordetella pertussis
gccagcagcgggcug

SEQ ID NO: 333204 - RNA, 16 nt, Bordetella pertussis
gccagcagcgggcugg

SEQ ID NO: 333205 - RNA, 16 nt, Bordetella pertussis
gccagcagcucggcca

SEQ ID NO: 333206 - RNA, 17 nt, Bordetella pertussis
gccagcagcucggccac

SEQ ID NO: 333207 - RNA, 18 nt, Bordetella pertussis
gccagcagcucggcgacc

SEQ ID NO: 333208 - RNA, 15 nt, Bordetella pertussis
gccagcagcuggcgc

SEQ ID NO: 333209 - RNA, 17 nt, Bordetella pertussis
gccagcagcuggcgcag

SEQ ID NO: 333210 - RNA, 19 nt, Bordetella pertussis
gccagcagcuugagcgaau

SEQ ID NO: 333211 - RNA, 17 nt, Bordetella pertussis
gccagcagcuuggccac

SEQ ID NO: 333212 - RNA, 21 nt, Bordetella pertussis
gccagcaggagcccgcugccg

SEQ ID NO: 333213 - RNA, 14 nt, Bordetella pertussis
gccagcaggcccug

SEQ ID NO: 333214 - RNA, 22 nt, Bordetella pertussis
gccagcaggcccugggccagca

SEQ ID NO: 333215 - RNA, 20 nt, Bordetella pertussis
gccagcaggcgaaacgccag

SEQ ID NO: 333216 - RNA, 15 nt, Bordetella pertussis
gccagcccgaggcac

SEQ ID NO: 333217 - RNA, 16 nt, Bordetella pertussis
gccagcccgcccgcga

SEQ ID NO: 333218 - RNA, 15 nt, Bordetella pertussis
gccagcccgccggcg

SEQ ID NO: 333219 - RNA, 15 nt, Bordetella pertussis
gccagcccuggccca

SEQ ID NO: 333220 - RNA, 18 nt, Bordetella pertussis
gccagcccugggugucga

SEQ ID NO: 333221 - RNA, 16 nt, Bordetella pertussis
gccagccggcgcgcca

SEQ ID NO: 333222 - RNA, 15 nt, Bordetella pertussis
gccagccggcggcca

SEQ ID NO: 333223 - RNA, 17 nt, Bordetella pertussis
gccagccggcggccagc

SEQ ID NO: 333224 - RNA, 18 nt, Bordetella pertussis
gccagccggcggccagcu

SEQ ID NO: 333225 - RNA, 17 nt, Bordetella pertussis
gccagccgggcgaucgc

SEQ ID NO: 333226 - RNA, 13 nt, Bordetella pertussis
gccagccgggugg

SEQ ID NO: 333227 - RNA, 23 nt, Bordetella pertussis
gccagccggguggucgcgcccgc

SEQ ID NO: 333228 - RNA, 23 nt, Bordetella pertussis
gccagcgcaaggguuguggccgu

SEQ ID NO: 333229 - RNA, 17 nt, Bordetella pertussis
gccagcgccaccaccgg

SEQ ID NO: 333230 - RNA, 12 nt, Bordetella pertussis
gccagcgccagc

SEQ ID NO: 333231 - RNA, 16 nt, Bordetella pertussis
gccagcgccagccgcu

SEQ ID NO: 333232 - RNA, 22 nt, Bordetella pertussis
gccagcgccaguccgcgcucgc

SEQ ID NO: 333233 - RNA, 12 nt, Bordetella pertussis
gccagcgccaug

SEQ ID NO: 333234 - RNA, 21 nt, Bordetella pertussis
gccagcgccaugaugucgcgc

SEQ ID NO: 333235 - RNA, 13 nt, Bordetella pertussis
gccagcgccgaaa

SEQ ID NO: 333236 - RNA, 12 nt, Bordetella pertussis
gccagcgccgca

SEQ ID NO: 333237 - RNA, 14 nt, Bordetella pertussis
gccagcgccgcagc

SEQ ID NO: 333238 - RNA, 14 nt, Bordetella pertussis
gccagcgccgccag

SEQ ID NO: 333239 - RNA, 16 nt, Bordetella pertussis
gccagcgccgccauca

SEQ ID NO: 333240 - RNA, 12 nt, Bordetella pertussis
gccagcgccgcg

SEQ ID NO: 333241 - RNA, 16 nt, Bordetella pertussis
gccagcgcgacggccu

SEQ ID NO: 333242 - RNA, 18 nt, Bordetella pertussis
gccagcgcgacggccucg

SEQ ID NO: 333243 - RNA, 19 nt, Bordetella pertussis
gccagcgcgaucucgcgca

SEQ ID NO: 333244 - RNA, 13 nt, Bordetella pertussis
gccagcgcgccau

SEQ ID NO: 333245 - RNA, 13 nt, Bordetella pertussis
gccagcgcgccgc

SEQ ID NO: 333246 - RNA, 15 nt, Bordetella pertussis
gccagcgcgccgcca

SEQ ID NO: 333247 - RNA, 19 nt, Bordetella pertussis
gccagcgcgccgcccacca

SEQ ID NO: 333248 - RNA, 23 nt, Bordetella pertussis
gccagcgcgccgcccaccaccag

SEQ ID NO: 333249 - RNA, 12 nt, Bordetella pertussis
gccagcgcgccu

SEQ ID NO: 333250 - RNA, 15 nt, Bordetella pertussis
gccagcgcgcggccg

SEQ ID NO: 333251 - RNA, 16 nt, Bordetella pertussis
gccagcgcgcggccgg

SEQ ID NO: 333252 - RNA, 14 nt, Bordetella pertussis
gccagcgcgcggcg

SEQ ID NO: 333253 - RNA, 15 nt, Bordetella pertussis
gccagcgcgcggcgc

SEQ ID NO: 333254 - RNA, 19 nt, Bordetella pertussis
gccagcgcgcggcgcagcg

SEQ ID NO: 333255 - RNA, 20 nt, Bordetella pertussis
gccagcgcgcggcgcagcgc

SEQ ID NO: 333256 - RNA, 15 nt, Bordetella pertussis
gccagcgcgcgccag

SEQ ID NO: 333257 - RNA, 14 nt, Bordetella pertussis
gccagcgcgcgcga

SEQ ID NO: 333258 - RNA, 22 nt, Bordetella pertussis
gccagcgcgcgcgaggcggcgg

SEQ ID NO: 333259 - RNA, 22 nt, Bordetella pertussis
gccagcgcgcggggcaggccga

SEQ ID NO: 333260 - RNA, 14 nt, Bordetella pertussis
gccagcgcggccag

SEQ ID NO: 333261 - RNA, 15 nt, Bordetella pertussis
gccagcgcggccagc

SEQ ID NO: 333262 - RNA, 19 nt, Bordetella pertussis
gccagcgcggccagcgcgu

SEQ ID NO: 333263 - RNA, 21 nt, Bordetella pertussis
gccagcgcggccagcgcgucg

SEQ ID NO: 333264 - RNA, 19 nt, Bordetella pertussis
gccagcgcggccaggucgg

SEQ ID NO: 333265 - RNA, 16 nt, Bordetella pertussis
gccagcgcggcaucgg

SEQ ID NO: 333266 - RNA, 18 nt, Bordetella pertussis
gccagcgcggcaucggcc

SEQ ID NO: 333267 - RNA, 15 nt, Bordetella pertussis
gccagcggcgcggcg

SEQ ID NO: 333268 - RNA, 16 nt, Bordetella pertussis
gccagcggcgcggcgc

SEQ ID NO: 333269 - RNA, 22 nt, Bordetella pertussis
gccagcggcugcuugagcagcc

SEQ ID NO: 333270 - RNA, 15 nt, Bordetella pertussis
gccagcggcuggcgc

SEQ ID NO: 333271 - RNA, 16 nt, Bordetella pertussis
gccagcggcuggcgcc

SEQ ID NO: 333272 - RNA, 17 nt, Bordetella pertussis
gccagcggcuggcgccg

SEQ ID NO: 333273 - RNA, 13 nt, Bordetella pertussis
gccagcggggccg

SEQ ID NO: 333274 - RNA, 13 nt, Bordetella pertussis
gccagcggugcgc

SEQ ID NO: 333275 - RNA, 21 nt, Bordetella pertussis
gccagcggugcgcggcgcagc

SEQ ID NO: 333276 - RNA, 15 nt, Bordetella pertussis
gccagcguucggcca

SEQ ID NO: 333277 - RNA, 19 nt, Bordetella pertussis
gccagcguucggccacccg

SEQ ID NO: 333278 - RNA, 22 nt, Bordetella pertussis
gccagcguucggccacccggcc

SEQ ID NO: 333279 - RNA, 22 nt, Bordetella pertussis
gccagcguggggacgcgggcca

SEQ ID NO: 333280 - RNA, 16 nt, Bordetella pertussis
gccagcuccaccgggc

SEQ ID NO: 333281 - RNA, 17 nt, Bordetella pertussis
gccagcuccagccgcag

SEQ ID NO: 333282 - RNA, 19 nt, Bordetella pertussis
gccagcuccagccgcaggc

SEQ ID NO: 333283 - RNA, 15 nt, Bordetella pertussis
gccagcuccccgggc

SEQ ID NO: 333284 - RNA, 17 nt, Bordetella pertussis
gccagcugcaugcgcac

SEQ ID NO: 333285 - RNA, 15 nt, Bordetella pertussis
gccagcugcgcagcg

SEQ ID NO: 333286 - RNA, 17 nt, Bordetella pertussis
gccagcugcguggcgac

SEQ ID NO: 333287 - RNA, 18 nt, Bordetella pertussis
gccagcugcguggcgacg

SEQ ID NO: 333288 - RNA, 18 nt, Bordetella pertussis
gccagcuggaccgccugg

SEQ ID NO: 333289 - RNA, 19 nt, Bordetella pertussis
gccagcuggcgcguggccg

SEQ ID NO: 333290 - RNA, 17 nt, Bordetella pertussis
gccagcuggcggcgcag

SEQ ID NO: 333291 - RNA, 16 nt, Bordetella pertussis
gccagcugggcgaucu

SEQ ID NO: 333292 - RNA, 15 nt, Bordetella pertussis
gccagcuugaccgcc

SEQ ID NO: 333293 - RNA, 17 nt, Bordetella pertussis
gccagcuugaccgccag

SEQ ID NO: 333294 - RNA, 19 nt, Bordetella pertussis
gccagcuugaccgccagca

SEQ ID NO: 333295 - RNA, 19 nt, Bordetella pertussis
gccagcuugagcaggcgcg

SEQ ID NO: 333296 - RNA, 16 nt, Bordetella pertussis
gccagcuucgggcccu

SEQ ID NO: 333297 - RNA, 16 nt, Bordetella pertussis
gccagcuugcgcgccu

SEQ ID NO: 333298 - RNA, 17 nt, Bordetella pertussis
gccagcuugcgcgccuu

SEQ ID NO: 333299 - RNA, 18 nt, Bordetella pertussis
gccagcuugcaggcgccu

SEQ ID NO: 333300 - RNA, 18 nt, Bordetella pertussis
gccagcuuguagcggcca

SEQ ID NO: 333301 - RNA, 21 nt, Bordetella pertussis
gccagcuuguagcggccaucg

SEQ ID NO: 333302 - RNA, 22 nt, Bordetella pertussis
gccagcuuguagcggccaucgg

SEQ ID NO: 333303 - RNA, 20 nt, Bordetella pertussis
gccaggaaaagccgccuucg

SEQ ID NO: 333304 - RNA, 16 nt, Bordetella pertussis
gccaggaaagccggcg

SEQ ID NO: 333305 - RNA, 18 nt, Bordetella pertussis
gccaggaaagccggcguc

SEQ ID NO: 333306 - RNA, 19 nt, Bordetella pertussis
gccaggaaagccggcguca

SEQ ID NO: 333307 - RNA, 22 nt, Bordetella pertussis
gccaggaacagcgccggcagcg

SEQ ID NO: 333308 - RNA, 16 nt, Bordetella pertussis
gccaggaagaucggcc

SEQ ID NO: 333309 - RNA, 19 nt, Bordetella pertussis
gccaggaagccgugcgcaa

SEQ ID NO: 333310 - RNA, 16 nt, Bordetella pertussis
gccaggaagcggcgca

SEQ ID NO: 333311 - RNA, 17 nt, Bordetella pertussis
gccaggaagcggcgcac

SEQ ID NO: 333312 - RNA, 18 nt, Bordetella pertussis
gccaggaagcggcgcacc

SEQ ID NO: 333313 - RNA, 19 nt, Bordetella pertussis
gccaggaagcggcgcacca

SEQ ID NO: 333314 - RNA, 15 nt, Bordetella pertussis
gccaggacgaucccg

SEQ ID NO: 333315 - RNA, 18 nt, Bordetella pertussis
gccaggacgaucccggcc

SEQ ID NO: 333316 - RNA, 16 nt, Bordetella pertussis
gccaggacggugucgc

SEQ ID NO: 333317 - RNA, 17 nt, Bordetella pertussis
gccaggacggugucgcu

SEQ ID NO: 333318 - RNA, 21 nt, Bordetella pertussis
gccaggacuucgucgaucaug

SEQ ID NO: 333319 - RNA, 18 nt, Bordetella pertussis
gccagguucgccuggcgg

SEQ ID NO: 333320 - RNA, 21 nt, Bordetella pertussis
gccagguugggugcgccgccg

SEQ ID NO: 333321 - RNA, 15 nt, Bordetella pertussis
gccagucgccgcggu

SEQ ID NO: 333322 - RNA, 18 nt, Bordetella pertussis
gccagucguucagcgucu

SEQ ID NO: 333323 - RNA, 22 nt, Bordetella pertussis
gccagucuccaggcucaggcgg

SEQ ID NO: 333324 - RNA, 22 nt, Bordetella pertussis
gccagugaaacgcgacgcgccg

SEQ ID NO: 333325 - RNA, 17 nt, Bordetella pertussis
gccagugccuggacgcg

SEQ ID NO: 333326 - RNA, 20 nt, Bordetella pertussis
gccagugccuggacgcgcug

SEQ ID NO: 333327 - RNA, 21 nt, Bordetella pertussis
gccagugccuggacgcgcugg

SEQ ID NO: 333328 - RNA, 15 nt, Bordetella pertussis
gccaguggcgcggcg

SEQ ID NO: 333329 - RNA, 16 nt, Bordetella pertussis
gccaguggcgcggcgu

SEQ ID NO: 333330 - RNA, 17 nt, Bordetella pertussis
gccagugguccaucagg

SEQ ID NO: 333331 - RNA, 15 nt, Bordetella pertussis
gccaguuccgugcgc

SEQ ID NO: 333332 - RNA, 15 nt, Bordetella pertussis
gccaguucgacgccc

SEQ ID NO: 333333 - RNA, 16 nt, Bordetella pertussis
gccaguucgacgccca

SEQ ID NO: 333334 - RNA, 17 nt, Bordetella pertussis
gccaguucgacgcccau

SEQ ID NO: 333335 - RNA, 17 nt, Bordetella pertussis
gccaguucgcggcgcag

SEQ ID NO: 333336 - RNA, 14 nt, Bordetella pertussis
gccaguucgcggcg

SEQ ID NO: 333337 - RNA, 23 nt, Bordetella pertussis
gccaguugaaccgcaacgccagc

SEQ ID NO: 333338 - RNA, 13 nt, Bordetella pertussis
gccaguugccgcc

SEQ ID NO: 333339 - RNA, 14 nt, Bordetella pertussis
gccaguugccgccg

SEQ ID NO: 333340 - RNA, 18 nt, Bordetella pertussis
gccaguugccgccgccgg

SEQ ID NO: 333341 - RNA, 23 nt, Bordetella pertussis
gccaguugccgccgccggcgcgg

SEQ ID NO: 333342 - RNA, 14 nt, Bordetella pertussis
gccaguugcgcacc

SEQ ID NO: 333343 - RNA, 22 nt, Bordetella pertussis
gccaguugcggggcgcccagcg

SEQ ID NO: 333344 - RNA, 21 nt, Bordetella pertussis
gccauacguccuuuggcgucg

SEQ ID NO: 333345 - RNA, 14 nt, Bordetella pertussis
gccauccggccacg

SEQ ID NO: 333346 - RNA, 15 nt, Bordetella pertussis
gccauccggccacgc

SEQ ID NO: 333347 - RNA, 19 nt, Bordetella pertussis
gccauccggccgcacgcgg

SEQ ID NO: 333348 - RNA, 20 nt, Bordetella pertussis
gccauccggccgcacgcggc

SEQ ID NO: 333349 - RNA, 22 nt, Bordetella pertussis
gccauccggccgcacgcggccg

SEQ ID NO: 333350 - RNA, 14 nt, Bordetella pertussis
gccauccggcgcau

SEQ ID NO: 333351 - RNA, 21 nt, Bordetella pertussis
gccauccggcgcaugauggcc

SEQ ID NO: 333352 - RNA, 17 nt, Bordetella pertussis
gccauccguccgccagg

SEQ ID NO: 333353 - RNA, 21 nt, Bordetella pertussis
gccauccguccgccaggacgg

SEQ ID NO: 333354 - RNA, 16 nt, Bordetella pertussis
gccauccucgcccagc

SEQ ID NO: 333355 - RNA, 21 nt, Bordetella pertussis
gccauccucgcccagcggcgc

SEQ ID NO: 333356 - RNA, 23 nt, Bordetella pertussis
gccauccucgcccagcggcgccg

SEQ ID NO: 333357 - RNA, 23 nt, Bordetella pertussis
gccauccucgucgcggaagcuga

SEQ ID NO: 333358 - RNA, 15 nt, Bordetella pertussis
gccauccuggccgcc

SEQ ID NO: 333359 - RNA, 15 nt, Bordetella pertussis
gccaucgacgcuugc

SEQ ID NO: 333360 - RNA, 21 nt, Bordetella pertussis
gccaucgacgcuugccggcga

SEQ ID NO: 333361 - RNA, 17 nt, Bordetella pertussis
gccaucgacgggcggcu

SEQ ID NO: 333362 - RNA, 20 nt, Bordetella pertussis
gccaucgacgggcggcugcc

SEQ ID NO: 333363 - RNA, 20 nt, Bordetella pertussis
gccaucgauaugggcggccu

SEQ ID NO: 333364 - RNA, 23 nt, Bordetella pertussis
gccaucgauaugggcggccucgg

SEQ ID NO: 333365 - RNA, 20 nt, Bordetella pertussis
gccaucgggauaccgcuggc

SEQ ID NO: 333366 - RNA, 20 nt, Bordetella pertussis
gccaucgggcugcggauacg

SEQ ID NO: 333367 - RNA, 20 nt, Bordetella pertussis
gccaucgucguagcgccagc

SEQ ID NO: 333368 - RNA, 21 nt, Bordetella pertussis
gccaucgucguagcgccagcg

SEQ ID NO: 333369 - RNA, 15 nt, Bordetella pertussis
gccaucucgcgcgcu

SEQ ID NO: 333370 - RNA, 14 nt, Bordetella pertussis
gccaugaucgccgg

SEQ ID NO: 333371 - RNA, 16 nt, Bordetella pertussis
gccaugaucgccggca

SEQ ID NO: 333372 - RNA, 18 nt, Bordetella pertussis
gccaugcaccagcacauc

SEQ ID NO: 333373 - RNA, 17 nt, Bordetella pertussis
gccaugaugucgcgcgc

SEQ ID NO: 333374 - RNA, 18 nt, Bordetella pertussis
gccaugaugucgcgcgcc

SEQ ID NO: 333375 - RNA, 21 nt, Bordetella pertussis
gccaugcagcuggauggccug

SEQ ID NO: 333376 - RNA, 16 nt, Bordetella pertussis
gccaugcccaggccca

SEQ ID NO: 333377 - RNA, 23 nt, Bordetella pertussis
gccaugcccaggcccaguucggc

SEQ ID NO: 333378 - RNA, 11 nt, Bordetella pertussis
gccaugccgcg

SEQ ID NO: 333379 - RNA, 13 nt, Bordetella pertussis
gccaugccgcgcc

SEQ ID NO: 333380 - RNA, 15 nt, Bordetella pertussis
gccaugccgcgcgcc

SEQ ID NO: 333381 - RNA, 17 nt, Bordetella pertussis
gccaugccgcgcgccuu

SEQ ID NO: 333382 - RNA, 14 nt, Bordetella pertussis
gccaugccggcccc

SEQ ID NO: 333383 - RNA, 15 nt, Bordetella pertussis
gccaugccggccccg

SEQ ID NO: 333384 - RNA, 18 nt, Bordetella pertussis
gccaugccgucaccggcu

SEQ ID NO: 333385 - RNA, 21 nt, Bordetella pertussis
gccaugccgucaccggcuacg

SEQ ID NO: 333386 - RNA, 15 nt, Bordetella pertussis
gccaugccgucgcgc

SEQ ID NO: 333387 - RNA, 18 nt, Bordetella pertussis
gccaugccgucgcgcacc

SEQ ID NO: 333388 - RNA, 19 nt, Bordetella pertussis
gccaugccgucgcgcacca

SEQ ID NO: 333389 - RNA, 18 nt, Bordetella pertussis
gccaugccgucuggcggc

SEQ ID NO: 333390 - RNA, 22 nt, Bordetella pertussis
gccaugccgucuggcggcagcu

SEQ ID NO: 333391 - RNA, 14 nt, Bordetella pertussis
gccaugccgggcaa

SEQ ID NO: 333392 - RNA, 20 nt, Bordetella pertussis
gccaugcgauacagcuuggc

SEQ ID NO: 333393 - RNA, 21 nt, Bordetella pertussis
gccaugcgauaggcgaagcgc

SEQ ID NO: 333394 - RNA, 22 nt, Bordetella pertussis
gccaugcgaugcugcagggccu

SEQ ID NO: 333395 - RNA, 18 nt, Bordetella pertussis
gccaugcgcacucgaccg

SEQ ID NO: 333396 - RNA, 13 nt, Bordetella pertussis
gccaugcgcaugg

SEQ ID NO: 333397 - RNA, 19 nt, Bordetella pertussis
gccaugcgcauggccagcg

SEQ ID NO: 333398 - RNA, 13 nt, Bordetella pertussis
gccaugcgccagc

SEQ ID NO: 333399 - RNA, 14 nt, Bordetella pertussis
gccaugcgccagca

SEQ ID NO: 333400 - RNA, 16 nt, Bordetella pertussis
gccaugcgccagcagg

SEQ ID NO: 333401 - RNA, 18 nt, Bordetella pertussis
gccaugcgcccggccacc

SEQ ID NO: 333402 - RNA, 13 nt, Bordetella pertussis
gccaugcgcgcca

SEQ ID NO: 333403 - RNA, 15 nt, Bordetella pertussis
gccaugcgcgccagc

SEQ ID NO: 333404 - RNA, 16 nt, Bordetella pertussis
gccaugcggacgccag

SEQ ID NO: 333405 - RNA, 18 nt, Bordetella pertussis
gccaugcggacgccagcc

SEQ ID NO: 333406 - RNA, 19 nt, Bordetella pertussis
gccaugcggacgccagccc

SEQ ID NO: 333407 - RNA, 20 nt, Bordetella pertussis
gccaugcggacgccagcccu

SEQ ID NO: 333408 - RNA, 22 nt, Bordetella pertussis
gccaugcggacgccagcccugg

SEQ ID NO: 333409 - RNA, 13 nt, Bordetella pertussis
gccaugcggcgcc

SEQ ID NO: 333410 - RNA, 14 nt, Bordetella pertussis
gccaugcggcgcca

SEQ ID NO: 333411 - RNA, 16 nt, Bordetella pertussis
gccaugcggcuggccg

SEQ ID NO: 333412 - RNA, 18 nt, Bordetella pertussis
gccaugcgggucaggccg

SEQ ID NO: 333413 - RNA, 19 nt, Bordetella pertussis
gccaugcgggucaggccgc

SEQ ID NO: 333414 - RNA, 21 nt, Bordetella pertussis
gccaugcgggucaggccgccg

SEQ ID NO: 333415 - RNA, 22 nt, Bordetella pertussis
gccaugcgggucaggccgccgu

SEQ ID NO: 333416 - RNA, 17 nt, Bordetella pertussis
gccaugcggugcgccgc

SEQ ID NO: 333417 - RNA, 21 nt, Bordetella pertussis
gccaugcggugcgccgcguca

SEQ ID NO: 333418 - RNA, 12 nt, Bordetella pertussis
gccaugcucagc

SEQ ID NO: 333419 - RNA, 23 nt, Bordetella pertussis
gccaugcucgcgcacagcgcgca

SEQ ID NO: 333420 - RNA, 17 nt, Bordetella pertussis
gccaugcucguccaucg

SEQ ID NO: 333421 - RNA, 22 nt, Bordetella pertussis
gccaugcucguccaucgccugc

SEQ ID NO: 333422 - RNA, 21 nt, Bordetella pertussis
gccaugcuggccgccgcgcuc

SEQ ID NO: 333423 - RNA, 14 nt, Bordetella pertussis
gccaugcugggcca

SEQ ID NO: 333424 - RNA, 14 nt, Bordetella pertussis
gccaugcugggcgg

SEQ ID NO: 333425 - RNA, 20 nt, Bordetella pertussis
gccaugcugggcgggcuggu

SEQ ID NO: 333426 - RNA, 14 nt, Bordetella pertussis
gccauggacagcac

SEQ ID NO: 333427 - RNA, 20 nt, Bordetella pertussis
gccauggacagcaccgacag

SEQ ID NO: 333428 - RNA, 22 nt, Bordetella pertussis
gccauggacgagggccggcgcc

SEQ ID NO: 333429 - RNA, 17 nt, Bordetella pertussis
gccauggacgccgaaca

SEQ ID NO: 333430 - RNA, 16 nt, Bordetella pertussis
gccauggacgccggua

SEQ ID NO: 333431 - RNA, 14 nt, Bordetella pertussis
gccauggaugcgcg

SEQ ID NO: 333432 - RNA, 15 nt, Bordetella pertussis
gccauggaugcgcgc

SEQ ID NO: 333433 - RNA, 14 nt, Bordetella pertussis
gccauggcacaggc

SEQ ID NO: 333434 - RNA, 19 nt, Bordetella pertussis
gccauggcacaggccaucg

SEQ ID NO: 333435 - RNA, 21 nt, Bordetella pertussis
gccauggcacaggccaucggc

SEQ ID NO: 333436 - RNA, 15 nt, Bordetella pertussis
gccauggcagggcgc

SEQ ID NO: 333437 - RNA, 17 nt, Bordetella pertussis
gccauggcagggcgccg

SEQ ID NO: 333438 - RNA, 19 nt, Bordetella pertussis
gccauggcaggguccgucg

SEQ ID NO: 333439 - RNA, 22 nt, Bordetella pertussis
gccauggcaguacguacgcccg

SEQ ID NO: 333440 - RNA, 18 nt, Bordetella pertussis
gccauggccagcuugacc

SEQ ID NO: 333441 - RNA, 17 nt, Bordetella pertussis
gccauggcccuugccgc

SEQ ID NO: 333442 - RNA, 23 nt, Bordetella pertussis
gccauggccgccacacgaggacc

SEQ ID NO: 333443 - RNA, 16 nt, Bordetella pertussis
gccauggccgcgcggc

SEQ ID NO: 333444 - RNA, 19 nt, Bordetella pertussis
gccauggccgcgcggcgcc

SEQ ID NO: 333445 - RNA, 12 nt, Bordetella pertussis
gccauggcgcgc

SEQ ID NO: 333446 - RNA, 13 nt, Bordetella pertussis
gccauggcgcgca

SEQ ID NO: 333447 - RNA, 13 nt, Bordetella pertussis
gccauggcgcugu

SEQ ID NO: 333448 - RNA, 20 nt, Bordetella pertussis
gccauggcgcuguuggccgg

SEQ ID NO: 333449 - RNA, 15 nt, Bordetella pertussis
gcccacaucgucgcg

SEQ ID NO: 333450 - RNA, 16 nt, Bordetella pertussis
gcccacaucgucgcgc

SEQ ID NO: 333451 - RNA, 17 nt, Bordetella pertussis
gcccacaucgucgcgcu

SEQ ID NO: 333452 - RNA, 19 nt, Bordetella pertussis
gcccacaucgucgcgcugg

SEQ ID NO: 333453 - RNA, 19 nt, Bordetella pertussis
gcccacauagaccggcugc

SEQ ID NO: 333454 - RNA, 16 nt, Bordetella pertussis
gcccacaugccgugcc

SEQ ID NO: 333455 - RNA, 13 nt, Bordetella pertussis
gcccacauggcgg

SEQ ID NO: 333456 - RNA, 14 nt, Bordetella pertussis
gcccacauggcggc

SEQ ID NO: 333457 - RNA, 15 nt, Bordetella pertussis
gcccaccaccagcgc

SEQ ID NO: 333458 - RNA, 17 nt, Bordetella pertussis
gcccaccaccagcgcgg

SEQ ID NO: 333459 - RNA, 14 nt, Bordetella pertussis
gcccaccaccagcg

SEQ ID NO: 333460 - RNA, 22 nt, Bordetella pertussis
gcccaccgacaugaccgcgucc

SEQ ID NO: 333461 - RNA, 14 nt, Bordetella pertussis
gcccaccgccagga

SEQ ID NO: 333462 - RNA, 14 nt, Bordetella pertussis
gcccaccgccgccc

SEQ ID NO: 333463 - RNA, 14 nt, Bordetella pertussis
gcccacccggcacg

SEQ ID NO: 333464 - RNA, 20 nt, Bordetella pertussis
gcccaccgagacgcugucgc

SEQ ID NO: 333465 - RNA, 17 nt, Bordetella pertussis
gcccaccgcaucgcgca

SEQ ID NO: 333466 - RNA, 17 nt, Bordetella pertussis
gcccaccggcaugccgu

SEQ ID NO: 333467 - RNA, 20 nt, Bordetella pertussis
gcccaccggcaugccgucca

SEQ ID NO: 333468 - RNA, 19 nt, Bordetella pertussis
gcccaccgggccggccugc

SEQ ID NO: 333469 - RNA, 17 nt, Bordetella pertussis
gcccaccgugaccagcg

SEQ ID NO: 333470 - RNA, 17 nt, Bordetella pertussis
gcccaccuuccugcugg

SEQ ID NO: 333471 - RNA, 16 nt, Bordetella pertussis
gcccacgaugcgggca

SEQ ID NO: 333472 - RNA, 19 nt, Bordetella pertussis
gcccacgaugcgggcaucg

SEQ ID NO: 333473 - RNA, 13 nt, Bordetella pertussis
gcccacgccgccg

SEQ ID NO: 333474 - RNA, 14 nt, Bordetella pertussis
gcccacgccgccga

SEQ ID NO: 333475 - RNA, 13 nt, Bordetella pertussis
gcccacgccgccu

SEQ ID NO: 333476 - RNA, 14 nt, Bordetella pertussis
gcccacgccgccug

SEQ ID NO: 333477 - RNA, 15 nt, Bordetella pertussis
gcccacgccgccugg

SEQ ID NO: 333478 - RNA, 16 nt, Bordetella pertussis
gcccacgccgccuggc

SEQ ID NO: 333479 - RNA, 16 nt, Bordetella pertussis
gcccacgccgcguucg

SEQ ID NO: 333480 - RNA, 15 nt, Bordetella pertussis
gcccacgcgccgcca

SEQ ID NO: 333481 - RNA, 12 nt, Bordetella pertussis
gcccacgcgcuc

SEQ ID NO: 333482 - RNA, 13 nt, Bordetella pertussis
gcccacgcgcucc

SEQ ID NO: 333483 - RNA, 17 nt, Bordetella pertussis
gcccacgcgcuccugcu

SEQ ID NO: 333484 - RNA, 15 nt, Bordetella pertussis
gcccacgcggcgcug

SEQ ID NO: 333485 - RNA, 16 nt, Bordetella pertussis
gcccacgcggcgcugc

SEQ ID NO: 333486 - RNA, 18 nt, Bordetella pertussis
gcccacgcggcgcugcug

SEQ ID NO: 333487 - RNA, 22 nt, Bordetella pertussis
gcccacgcggcgcugcuggccg

SEQ ID NO: 333488 - RNA, 16 nt, Bordetella pertussis
gcccacgcugucgggg

SEQ ID NO: 333489 - RNA, 20 nt, Bordetella pertussis
gcccacggcaaaagccgggg

SEQ ID NO: 333490 - RNA, 14 nt, Bordetella pertussis
gcccacggccagca

SEQ ID NO: 333491 - RNA, 16 nt, Bordetella pertussis
gcccacggccgcaugc

SEQ ID NO: 333492 - RNA, 13 nt, Bordetella pertussis
gcccacggcgcca

SEQ ID NO: 333493 - RNA, 17 nt, Bordetella pertussis
gcccacgggcgccuggu

SEQ ID NO: 333494 - RNA, 19 nt, Bordetella pertussis
gcccacucggugcgcgcgc

SEQ ID NO: 333495 - RNA, 23 nt, Bordetella pertussis
gcccacucggugcgcgcgcccac

SEQ ID NO: 333496 - RNA, 14 nt, Bordetella pertussis
gcccacugccaggc

SEQ ID NO: 333497 - RNA, 15 nt, Bordetella pertussis
gcccacugccaggcg

SEQ ID NO: 333498 - RNA, 21 nt, Bordetella pertussis
gcccacuggaucgccgaucgg

SEQ ID NO: 333499 - RNA, 22 nt, Bordetella pertussis
gcccacuggaucgccgaucggc

SEQ ID NO: 333500 - RNA, 17 nt, Bordetella pertussis
gcccacuuccucggcgc

SEQ ID NO: 333501 - RNA, 18 nt, Bordetella pertussis
gcccacuuccucggcgcg

SEQ ID NO: 333502 - RNA, 17 nt, Bordetella pertussis
gcccagacuggcguagu

SEQ ID NO: 333503 - RNA, 21 nt, Bordetella pertussis
gcccagcaaggguucgggcau

SEQ ID NO: 333504 - RNA, 20 nt, Bordetella pertussis
gcccagcaccacggcaucgg

SEQ ID NO: 333505 - RNA, 17 nt, Bordetella pertussis
gcccagcaccacgggcu

SEQ ID NO: 333506 - RNA, 20 nt, Bordetella pertussis
gcccagcaccacgggcucgc

SEQ ID NO: 333507 - RNA, 12 nt, Bordetella pertussis
gcccagcaccgc

SEQ ID NO: 333508 - RNA, 22 nt, Bordetella pertussis
gcccagcaccgccaccguggcg

SEQ ID NO: 333509 - RNA, 22 nt, Bordetella pertussis
gcccagcaccucgacgcagccu

SEQ ID NO: 333510 - RNA, 15 nt, Bordetella pertussis
gcccagcaccugcag

SEQ ID NO: 333511 - RNA, 22 nt, Bordetella pertussis
gcccagcaccugcaggccgccg

SEQ ID NO: 333512 - RNA, 16 nt, Bordetella pertussis
gcccagcaccuuggca

SEQ ID NO: 333513 - RNA, 22 nt, Bordetella pertussis
gcccagcacgacgaagaacacc

SEQ ID NO: 333514 - RNA, 12 nt, Bordetella pertussis
gcccagcacgcc

SEQ ID NO: 333515 - RNA, 15 nt, Bordetella pertussis
gcccagcacgccgcg

SEQ ID NO: 333516 - RNA, 18 nt, Bordetella pertussis
gcccagcacgccgcgcuc

SEQ ID NO: 333517 - RNA, 19 nt, Bordetella pertussis
gcccagcacgccgcgcucg

SEQ ID NO: 333518 - RNA, 14 nt, Bordetella pertussis
gcccagcacgcgcg

SEQ ID NO: 333519 - RNA, 19 nt, Bordetella pertussis
gcccagcacgcgcgccagc

SEQ ID NO: 333520 - RNA, 20 nt, Bordetella pertussis
gcccagcacgcgcgccagcu

SEQ ID NO: 333521 - RNA, 18 nt, Bordetella pertussis
gcccagcagauaccggca

SEQ ID NO: 333522 - RNA, 20 nt, Bordetella pertussis
gcccagcagauaccggcaug

SEQ ID NO: 333523 - RNA, 22 nt, Bordetella pertussis
gcccagcagauaccggcauggc

SEQ ID NO: 333524 - RNA, 14 nt, Bordetella pertussis
gcccagcagauggc

SEQ ID NO: 333525 - RNA, 15 nt, Bordetella pertussis
gcccagcagauggcu

SEQ ID NO: 333526 - RNA, 16 nt, Bordetella pertussis
gcccagcagcgccacc

SEQ ID NO: 333527 - RNA, 17 nt, Bordetella pertussis
gcccagcagcgccaccg

SEQ ID NO: 333528 - RNA, 17 nt, Bordetella pertussis
gcccagcaggcuuucgc

SEQ ID NO: 333529 - RNA, 12 nt, Bordetella pertussis
gcccagcagguc

SEQ ID NO: 333530 - RNA, 17 nt, Bordetella pertussis
gcccagcaucaggcccg

SEQ ID NO: 333531 - RNA, 18 nt, Bordetella pertussis
gcccagcaucaggcccga

SEQ ID NO: 333532 - RNA, 17 nt, Bordetella pertussis
gcccagcauggucggca

SEQ ID NO: 333533 - RNA, 23 nt, Bordetella pertussis
gcccagcauggucggcauggcca

SEQ ID NO: 333534 - RNA, 21 nt, Bordetella pertussis
gcccagcauuucgcgugcgug

SEQ ID NO: 333535 - RNA, 15 nt, Bordetella pertussis
gcccagccagcggug

SEQ ID NO: 333536 - RNA, 20 nt, Bordetella pertussis
gcccagccagcggugcgcgg

SEQ ID NO: 333537 - RNA, 12 nt, Bordetella pertussis
gcccagccaggc

SEQ ID NO: 333538 - RNA, 16 nt, Bordetella pertussis
gcccagccaggcgcca

SEQ ID NO: 333539 - RNA, 17 nt, Bordetella pertussis
gcccagccaggcgccag

SEQ ID NO: 333540 - RNA, 22 nt, Bordetella pertussis
gcccagccaggcgccagcggca

SEQ ID NO: 333541 - RNA, 17 nt, Bordetella pertussis
gcccagccacaccaggu

SEQ ID NO: 333542 - RNA, 19 nt, Bordetella pertussis
gcccagccccgcggccgcg

SEQ ID NO: 333543 - RNA, 23 nt, Bordetella pertussis
gcccagccccgcggccgcgguca

SEQ ID NO: 333544 - RNA, 21 nt, Bordetella pertussis
gcccagccgcagcaggcgcuc

SEQ ID NO: 333545 - RNA, 22 nt, Bordetella pertussis
gcccagccgcagcaggcgcucg

SEQ ID NO: 333546 - RNA, 23 nt, Bordetella pertussis
gcccagccgcagcaggcgcucgg

SEQ ID NO: 333547 - RNA, 19 nt, Bordetella pertussis
gcccagccgcaugccggcg

SEQ ID NO: 333548 - RNA, 20 nt, Bordetella pertussis
gcccagccgcaugccggcga

SEQ ID NO: 333549 - RNA, 22 nt, Bordetella pertussis
gcccagccgcaugccggcgaug

SEQ ID NO: 333550 - RNA, 14 nt, Bordetella pertussis
gcccagccgccuga

SEQ ID NO: 333551 - RNA, 16 nt, Bordetella pertussis
gcccagccgcgccagg

SEQ ID NO: 333552 - RNA, 20 nt, Bordetella pertussis
gcccagccgcgccagggcgc

SEQ ID NO: 333553 - RNA, 17 nt, Bordetella pertussis
gcccagccgcgccauca

SEQ ID NO: 333554 - RNA, 17 nt, Bordetella pertussis
gcccagccgcucggcca

SEQ ID NO: 333555 - RNA, 19 nt, Bordetella pertussis
gcccagccgcucggccacg

SEQ ID NO: 333556 - RNA, 13 nt, Bordetella pertussis
gcccagccggccg

SEQ ID NO: 333557 - RNA, 17 nt, Bordetella pertussis
gcccagccggugcgcgg

SEQ ID NO: 333558 - RNA, 12 nt, Bordetella pertussis
gcccagccggug

SEQ ID NO: 333559 - RNA, 20 nt, Bordetella pertussis
gcccagccugccggcggccu

SEQ ID NO: 333560 - RNA, 20 nt, Bordetella pertussis
gcccagcgacgagggcgcca

SEQ ID NO: 333561 - RNA, 19 nt, Bordetella pertussis
gcccagcgagccggccagc

SEQ ID NO: 333562 - RNA, 17 nt, Bordetella pertussis
gcccagcgagcugcgcu

SEQ ID NO: 333563 - RNA, 14 nt, Bordetella pertussis
gcccagcgagcugg

SEQ ID NO: 333564 - RNA, 13 nt, Bordetella pertussis
gcccagcgucagc

SEQ ID NO: 333565 - RNA, 18 nt, Bordetella pertussis
gcccagcgucagcugggc

SEQ ID NO: 333566 - RNA, 20 nt, Bordetella pertussis
gcccagcgucagcugggcau

SEQ ID NO: 333567 - RNA, 16 nt, Bordetella pertussis
gcccagcguggcggug

SEQ ID NO: 333568 - RNA, 18 nt, Bordetella pertussis
gcccagcguguaggcggc

SEQ ID NO: 333569 - RNA, 15 nt, Bordetella pertussis
gcccagcucauggca

SEQ ID NO: 333570 - RNA, 19 nt, Bordetella pertussis
gcccagcucauggcacagc

SEQ ID NO: 333571 - RNA, 17 nt, Bordetella pertussis
gcccagcuccagcuggc

SEQ ID NO: 333572 - RNA, 19 nt, Bordetella pertussis
gcccagcucugguccaggc

SEQ ID NO: 333573 - RNA, 20 nt, Bordetella pertussis
gcccagcuggcaccgcgacg

SEQ ID NO: 333574 - RNA, 17 nt, Bordetella pertussis
gcccaggcccagcauca

SEQ ID NO: 333575 - RNA, 14 nt, Bordetella pertussis
gcccaggcccagcg

SEQ ID NO: 333576 - RNA, 14 nt, Bordetella pertussis
gcccaggcccgcca

SEQ ID NO: 333577 - RNA, 19 nt, Bordetella pertussis
gcccaggcccgccagggcc

SEQ ID NO: 333578 - RNA, 22 nt, Bordetella pertussis
gcccaggcccuggcuggccagc

SEQ ID NO: 333579 - RNA, 20 nt, Bordetella pertussis
gcccaggccgaucagcggau

SEQ ID NO: 333580 - RNA, 18 nt, Bordetella pertussis
gcccaggcccagcgcgcc

SEQ ID NO: 333581 - RNA, 16 nt, Bordetella pertussis
gcccaggccgccggcg

SEQ ID NO: 333582 - RNA, 22 nt, Bordetella pertussis
gcccaggccgccggcggcgucg

SEQ ID NO: 333583 - RNA, 16 nt, Bordetella pertussis
gcccaggccgggcgag

SEQ ID NO: 333584 - RNA, 19 nt, Bordetella pertussis
gcccaggcgacccagcacc

SEQ ID NO: 333585 - RNA, 24 nt, Bordetella pertussis
gcccaggcgacccagcaccgagcu

SEQ ID NO: 333586 - RNA, 20 nt, Bordetella pertussis
gcccaggccguggcgcacca

SEQ ID NO: 333587 - RNA, 15 nt, Bordetella pertussis
gcccaggcgaugccc

SEQ ID NO: 333588 - RNA, 17 nt, Bordetella pertussis
gcccaggcgaugcccag

SEQ ID NO: 333589 - RNA, 14 nt, Bordetella pertussis
gcccaggcgcagcc

SEQ ID NO: 333590 - RNA, 23 nt, Bordetella pertussis
gcccagguacaucauccccagcg

SEQ ID NO: 333591 - RNA, 14 nt, Bordetella pertussis
gcccagguccagcg

SEQ ID NO: 333592 - RNA, 17 nt, Bordetella pertussis
gcccagguccagcgcca

SEQ ID NO: 333593 - RNA, 18 nt, Bordetella pertussis
gcccagguccagcgccac

SEQ ID NO: 333594 - RNA, 17 nt, Bordetella pertussis
gcccagguccugcgcca

SEQ ID NO: 333595 - RNA, 19 nt, Bordetella pertussis
gcccagguccugcgccagc

SEQ ID NO: 333596 - RNA, 15 nt, Bordetella pertussis
gcccaggucggacgc

SEQ ID NO: 333597 - RNA, 16 nt, Bordetella pertussis
gcccaggucggacgcg

SEQ ID NO: 333598 - RNA, 17 nt, Bordetella pertussis
gcccaggucggacgcgc

SEQ ID NO: 333599 - RNA, 18 nt, Bordetella pertussis
gcccaggucggacgcgcc

SEQ ID NO: 333600 - RNA, 19 nt, Bordetella pertussis
gcccaggucggacgcgccg

SEQ ID NO: 333601 - RNA, 22 nt, Bordetella pertussis
gcccaggucggacgcgccgggc

SEQ ID NO: 333602 - RNA, 16 nt, Bordetella pertussis
gcccaggucaucgcca

SEQ ID NO: 333603 - RNA, 17 nt, Bordetella pertussis
gcccaggucaucgccag

SEQ ID NO: 333604 - RNA, 22 nt, Bordetella pertussis
gcccaggucaucgccaggcgcg

SEQ ID NO: 333605 - RNA, 21 nt, Bordetella pertussis
gcccaggugcgggagccggca

SEQ ID NO: 333606 - RNA, 20 nt, Bordetella pertussis
gcccagguugaaggccgcga

SEQ ID NO: 333607 - RNA, 19 nt, Bordetella pertussis
gcccagguugcggccgcca

SEQ ID NO: 333608 - RNA, 20 nt, Bordetella pertussis
gcccaguacgaugccgucga

SEQ ID NO: 333609 - RNA, 17 nt, Bordetella pertussis
gcccaguucggcgacga

SEQ ID NO: 333610 - RNA, 19 nt, Bordetella pertussis
gcccaguugaaucggcgcg

SEQ ID NO: 333611 - RNA, 20 nt, Bordetella pertussis
gcccaguugaaucggcgcga

SEQ ID NO: 333612 - RNA, 18 nt, Bordetella pertussis
gcccaguugcuggcccag

SEQ ID NO: 333613 - RNA, 14 nt, Bordetella pertussis
gcccauagauggaa

SEQ ID NO: 333614 - RNA, 14 nt, Bordetella pertussis
gcccauaugccgcc

SEQ ID NO: 333615 - RNA, 24 nt, Bordetella pertussis
gcccaucaggugaaacagcagcgg

SEQ ID NO: 333616 - RNA, 21 nt, Bordetella pertussis
gcccaucaggugggccgagcc

SEQ ID NO: 333617 - RNA, 16 nt, Bordetella pertussis
gcccaucaggccgaug

SEQ ID NO: 333618 - RNA, 18 nt, Bordetella pertussis
gcccauccaucugguggu

SEQ ID NO: 333619 - RNA, 22 nt, Bordetella pertussis
gcccauccaucugguggugccg

SEQ ID NO: 333620 - RNA, 17 nt, Bordetella pertussis
gcccaucgcgcugacga

SEQ ID NO: 333621 - RNA, 20 nt, Bordetella pertussis
gcccaucgcggucaucggcg

SEQ ID NO: 333622 - RNA, 23 nt, Bordetella pertussis
gcccaucgugcgcgaucuugccg

SEQ ID NO: 333623 - RNA, 16 nt, Bordetella pertussis
gcccaucucggccgcg

SEQ ID NO: 333624 - RNA, 17 nt, Bordetella pertussis
gcccaucugguugagca

SEQ ID NO: 333625 - RNA, 22 nt, Bordetella pertussis
gcccaugaacaggcacgacgcg

SEQ ID NO: 333626 - RNA, 21 nt, Bordetella pertussis
gcccaugacgaccuugcggcc

SEQ ID NO: 333627 - RNA, 23 nt, Bordetella pertussis
gcccaugacgaccuugcggccgc

SEQ ID NO: 333628 - RNA, 18 nt, Bordetella pertussis
gcccaugaucagggccgu

SEQ ID NO: 333629 - RNA, 22 nt, Bordetella pertussis
gcccaugaucagggccgugccc

SEQ ID NO: 333630 - RNA, 16 nt, Bordetella pertussis
gcccaugaaggcggcc

SEQ ID NO: 333631 - RNA, 19 nt, Bordetella pertussis
gcccaugaaggcggccagc

SEQ ID NO: 333632 - RNA, 14 nt, Bordetella pertussis
gcccaugcgaucgg

SEQ ID NO: 333633 - RNA, 18 nt, Bordetella pertussis
gcccaugcgaucggccuc

SEQ ID NO: 333634 - RNA, 19 nt, Bordetella pertussis
gcccaugcgaucggccucg

SEQ ID NO: 333635 - RNA, 19 nt, Bordetella pertussis
gcccaugcgcauggccagc

SEQ ID NO: 333636 - RNA, 13 nt, Bordetella pertussis
gcccaugccgccg

SEQ ID NO: 333637 - RNA, 16 nt, Bordetella pertussis
gcccaugccgccgggc

SEQ ID NO: 333638 - RNA, 16 nt, Bordetella pertussis
gcccaugcgcugcgcc

SEQ ID NO: 333639 - RNA, 16 nt, Bordetella pertussis
gcccaugcgcuggcgc

SEQ ID NO: 333640 - RNA, 20 nt, Bordetella pertussis
gcccaugcugaauugcgggc

SEQ ID NO: 333641 - RNA, 13 nt, Bordetella pertussis
gcccauggcaagc

SEQ ID NO: 333642 - RNA, 13 nt, Bordetella pertussis
gcccauggcaucg

SEQ ID NO: 333643 - RNA, 14 nt, Bordetella pertussis
gcccauggcaucga

SEQ ID NO: 333644 - RNA, 14 nt, Bordetella pertussis
gccccacgccgacc

SEQ ID NO: 333645 - RNA, 16 nt, Bordetella pertussis
gccccacgccgaccuc

SEQ ID NO: 333646 - RNA, 17 nt, Bordetella pertussis
gccccacggguaccagg

SEQ ID NO: 333647 - RNA, 18 nt, Bordetella pertussis
gccccacggguaccaggc

SEQ ID NO: 333648 - RNA, 20 nt, Bordetella pertussis
gccccacggguaccaggcuc

SEQ ID NO: 333649 - RNA, 18 nt, Bordetella pertussis
gccccaccuugcccagca

SEQ ID NO: 333650 - RNA, 19 nt, Bordetella pertussis
gccccacuuggcgaucucg

SEQ ID NO: 333651 - RNA, 14 nt, Bordetella pertussis
gccccagaugccgg

SEQ ID NO: 333652 - RNA, 17 nt, Bordetella pertussis
gccccagaugccgguca

SEQ ID NO: 333653 - RNA, 20 nt, Bordetella pertussis
gccccaggcguacgaggacc

SEQ ID NO: 333654 - RNA, 19 nt, Bordetella pertussis
gccccaggcgugaacgccc

SEQ ID NO: 333655 - RNA, 22 nt, Bordetella pertussis
gccccaggcgugaacgccccgg

SEQ ID NO: 333656 - RNA, 16 nt, Bordetella pertussis
gccccagguccgccgg

SEQ ID NO: 333657 - RNA, 17 nt, Bordetella pertussis
gccccagguccgccggc

SEQ ID NO: 333658 - RNA, 18 nt, Bordetella pertussis
gccccagguccgccggca

SEQ ID NO: 333659 - RNA, 23 nt, Bordetella pertussis
gccccagguccgccggcacgcgc

SEQ ID NO: 333660 - RNA, 20 nt, Bordetella pertussis
gccccaguccaggccggccu

SEQ ID NO: 333661 - RNA, 16 nt, Bordetella pertussis
gccccaguugcgcguc

SEQ ID NO: 333662 - RNA, 21 nt, Bordetella pertussis
gccccaucaccauggccgaca

SEQ ID NO: 333663 - RNA, 18 nt, Bordetella pertussis
gccccccguaggcggccc

SEQ ID NO: 333664 - RNA, 16 nt, Bordetella pertussis
gcccccgccgccaugc

SEQ ID NO: 333665 - RNA, 14 nt, Bordetella pertussis
gcccccgcgcugcg

SEQ ID NO: 333666 - RNA, 22 nt, Bordetella pertussis
gcccccgcgcugcgcccgcuac

SEQ ID NO: 333667 - RNA, 15 nt, Bordetella pertussis
gcccccgcggcgccc

SEQ ID NO: 333668 - RNA, 16 nt, Bordetella pertussis
gcccccgcggcgcccc

SEQ ID NO: 333669 - RNA, 14 nt, Bordetella pertussis
gccccgacgcgcuu

SEQ ID NO: 333670 - RNA, 17 nt, Bordetella pertussis
gccccgacgcgcuucca

SEQ ID NO: 333671 - RNA, 16 nt, Bordetella pertussis
gccccgacgcggucgc

SEQ ID NO: 333672 - RNA, 21 nt, Bordetella pertussis
gccccgacgcggucgcccaac

SEQ ID NO: 333673 - RNA, 16 nt, Bordetella pertussis
gccccgaucggcgccg

SEQ ID NO: 333674 - RNA, 17 nt, Bordetella pertussis
gccccgaucggcgccgc

SEQ ID NO: 333675 - RNA, 18 nt, Bordetella pertussis
gccccgaucggcgccgcg

SEQ ID NO: 333676 - RNA, 17 nt, Bordetella pertussis
gccccgcacgaucagca

SEQ ID NO: 333677 - RNA, 18 nt, Bordetella pertussis
gccccgcacgaucagcau

SEQ ID NO: 333678 - RNA, 14 nt, Bordetella pertussis
gccccgcagggccc

SEQ ID NO: 333679 - RNA, 15 nt, Bordetella pertussis
gccccgccagggcgg

SEQ ID NO: 333680 - RNA, 16 nt, Bordetella pertussis
gccccgccaugcgcag

SEQ ID NO: 333681 - RNA, 22 nt, Bordetella pertussis
gccccgucaucgggugcggcgc

SEQ ID NO: 333682 - RNA, 13 nt, Bordetella pertussis
gccccgucggccg

SEQ ID NO: 333683 - RNA, 14 nt, Bordetella pertussis
gccccgucggccgu

SEQ ID NO: 333684 - RNA, 19 nt, Bordetella pertussis
gccccguccuuacuugcgc

SEQ ID NO: 333685 - RNA, 17 nt, Bordetella pertussis
gccccgugcaccaugcc

SEQ ID NO: 333686 - RNA, 21 nt, Bordetella pertussis
gccccucggcgggcuugucgc

SEQ ID NO: 333687 - RNA, 16 nt, Bordetella pertussis
gccccugcccugcggc

SEQ ID NO: 333688 - RNA, 19 nt, Bordetella pertussis
gccccugcggggacaggca

SEQ ID NO: 333689 - RNA, 17 nt, Bordetella pertussis
gcccgaccgcaugggcg

SEQ ID NO: 333690 - RNA, 16 nt, Bordetella pertussis
gcccgaccugcuggcg

SEQ ID NO: 333691 - RNA, 17 nt, Bordetella pertussis
gcccgaccugcuggcgc

SEQ ID NO: 333692 - RNA, 18 nt, Bordetella pertussis
gcccgaccugcuggcgcg

SEQ ID NO: 333693 - RNA, 18 nt, Bordetella pertussis
gcccgacgaggagccggc

SEQ ID NO: 333694 - RNA, 20 nt, Bordetella pertussis
gcccgacgcuguaacaacac

SEQ ID NO: 333695 - RNA, 13 nt, Bordetella pertussis
gcccgacggccag

SEQ ID NO: 333696 - RNA, 14 nt, Bordetella pertussis
gcccgacggcgccg

SEQ ID NO: 333697 - RNA, 16 nt, Bordetella pertussis
gcccgacggcgccgau

SEQ ID NO: 333698 - RNA, 13 nt, Bordetella pertussis
gcccgacggcgcg

SEQ ID NO: 333699 - RNA, 16 nt, Bordetella pertussis
gcccgagauggcgcag

SEQ ID NO: 333700 - RNA, 19 nt, Bordetella pertussis
gcccgagauggcgcaggcg

SEQ ID NO: 333701 - RNA, 18 nt, Bordetella pertussis
gcccgaucgacggccgca

SEQ ID NO: 333702 - RNA, 19 nt, Bordetella pertussis
gcccgaucgacggccgcaa

SEQ ID NO: 333703 - RNA, 15 nt, Bordetella pertussis
gcccgaucgccggug

SEQ ID NO: 333704 - RNA, 13 nt, Bordetella pertussis
gcccgauggcggg

SEQ ID NO: 333705 - RNA, 14 nt, Bordetella pertussis
gcccgauggcgggg

SEQ ID NO: 333706 - RNA, 16 nt, Bordetella pertussis
gcccgauggcggggau

SEQ ID NO: 333707 - RNA, 19 nt, Bordetella pertussis
gcccgauggcggggaugga

SEQ ID NO: 333708 - RNA, 23 nt, Bordetella pertussis
gcccgauggugcauucguccagg

SEQ ID NO: 333709 - RNA, 15 nt, Bordetella pertussis
gcccgcaacgccgcc

SEQ ID NO: 333710 - RNA, 19 nt, Bordetella pertussis
gcccgcaacgggccggccg

SEQ ID NO: 333711 - RNA, 22 nt, Bordetella pertussis
gcccgcaagcauuugcgcgacg

SEQ ID NO: 333712 - RNA, 19 nt, Bordetella pertussis
gcccgcaaggaccaugcgc

SEQ ID NO: 333713 - RNA, 21 nt, Bordetella pertussis
gcccgcaggcauugcgccagc

SEQ ID NO: 333714 - RNA, 22 nt, Bordetella pertussis
gcccgcaggcauugcgccagcc

SEQ ID NO: 333715 - RNA, 18 nt, Bordetella pertussis
gcccgcaggcggcggccu

SEQ ID NO: 333716 - RNA, 17 nt, Bordetella pertussis
gcccgcaucgcgcgccg

SEQ ID NO: 333717 - RNA, 22 nt, Bordetella pertussis
gcccgcaucggcguaccaggca

SEQ ID NO: 333718 - RNA, 19 nt, Bordetella pertussis
gcccgcaucggcuggcgca

SEQ ID NO: 333719 - RNA, 14 nt, Bordetella pertussis
gcccgccagcgcgg

SEQ ID NO: 333720 - RNA, 15 nt, Bordetella pertussis
gcccgccagcgcggc

SEQ ID NO: 333721 - RNA, 16 nt, Bordetella pertussis
gcccgccagcgcggcu

SEQ ID NO: 333722 - RNA, 15 nt, Bordetella pertussis
gcccgccaggaagcg

SEQ ID NO: 333723 - RNA, 20 nt, Bordetella pertussis
gcccgcauagacgccgaccg

SEQ ID NO: 333724 - RNA, 23 nt, Bordetella pertussis
gcccgccagggccauguggcgca

SEQ ID NO: 333725 - RNA, 15 nt, Bordetella pertussis
gcccgccaucgccag

SEQ ID NO: 333726 - RNA, 17 nt, Bordetella pertussis
gcccgccaucgccagga

SEQ ID NO: 333727 - RNA, 22 nt, Bordetella pertussis
gcccgccaucgccaggaccagg

SEQ ID NO: 333728 - RNA, 15 nt, Bordetella pertussis
gcccgccaucgcgca

SEQ ID NO: 333729 - RNA, 17 nt, Bordetella pertussis
gcccgccaucgcgcauu

SEQ ID NO: 333730 - RNA, 17 nt, Bordetella pertussis
gcccgccccacggcgag

SEQ ID NO: 333731 - RNA, 17 nt, Bordetella pertussis
gcccgccgagucggcga

SEQ ID NO: 333732 - RNA, 23 nt, Bordetella pertussis
gcccgccgagucggcgauggcgc

SEQ ID NO: 333733 - RNA, 22 nt, Bordetella pertussis
gcccgccgauccacucggccag

SEQ ID NO: 333734 - RNA, 24 nt, Bordetella pertussis
gcccgccgauccacucggccagcg

SEQ ID NO: 333735 - RNA, 14 nt, Bordetella pertussis
gcccgccgccgggc

SEQ ID NO: 333736 - RNA, 15 nt, Bordetella pertussis
gcccgccgccgggcg

SEQ ID NO: 333737 - RNA, 13 nt, Bordetella pertussis
gcccgccgccugc

SEQ ID NO: 333738 - RNA, 15 nt, Bordetella pertussis
gcccgccgccugcgc

SEQ ID NO: 333739 - RNA, 15 nt, Bordetella pertussis
gcccgccgcgccaug

SEQ ID NO: 333740 - RNA, 16 nt, Bordetella pertussis
gcccgccgcggcaggc

SEQ ID NO: 333741 - RNA, 14 nt, Bordetella pertussis
gcccgccgcugguc

SEQ ID NO: 333742 - RNA, 11 nt, Bordetella pertussis
gcccgccggca

SEQ ID NO: 333743 - RNA, 19 nt, Bordetella pertussis
gcccgccggcacccggcuc

SEQ ID NO: 333744 - RNA, 16 nt, Bordetella pertussis
gcccgccggcgcgcgc

SEQ ID NO: 333745 - RNA, 14 nt, Bordetella pertussis
gcccgccguggcca

SEQ ID NO: 333746 - RNA, 22 nt, Bordetella pertussis
gcccggucguggcugaccagca

SEQ ID NO: 333747 - RNA, 21 nt, Bordetella pertussis
gcccggucugccacacgcggu

SEQ ID NO: 333748 - RNA, 16 nt, Bordetella pertussis
gcccggugcgcgcagg

SEQ ID NO: 333749 - RNA, 18 nt, Bordetella pertussis
gcccggugcgcgcagggc

SEQ ID NO: 333750 - RNA, 18 nt, Bordetella pertussis
gcccggugcguaccagcc

SEQ ID NO: 333751 - RNA, 21 nt, Bordetella pertussis
gcccggugcagccgccgcagg

SEQ ID NO: 333752 - RNA, 15 nt, Bordetella pertussis
gcccgguucugcggc

SEQ ID NO: 333753 - RNA, 18 nt, Bordetella pertussis
gcccgguucugcggcgcg

SEQ ID NO: 333754 - RNA, 23 nt, Bordetella pertussis
gcccguagcuggaccccuugcgg

SEQ ID NO: 333755 - RNA, 16 nt, Bordetella pertussis
gcccgucucgcgcgcc

SEQ ID NO: 333756 - RNA, 19 nt, Bordetella pertussis
gcccgucucgcgcgccagg

SEQ ID NO: 333757 - RNA, 21 nt, Bordetella pertussis
gcccgucucgcgcgccaggug

SEQ ID NO: 333758 - RNA, 23 nt, Bordetella pertussis
gcccgugcagaagcugaccaccg

SEQ ID NO: 333759 - RNA, 14 nt, Bordetella pertussis
gcccgugccacggc

SEQ ID NO: 333760 - RNA, 22 nt, Bordetella pertussis
gcccgugccgcagaagaacacc

SEQ ID NO: 333761 - RNA, 14 nt, Bordetella pertussis
gcccgugccuugcc

SEQ ID NO: 333762 - RNA, 14 nt, Bordetella pertussis
gcccgugcgggccu

SEQ ID NO: 333763 - RNA, 21 nt, Bordetella pertussis
gcccgugcgugcgccuguccc

SEQ ID NO: 333764 - RNA, 21 nt, Bordetella pertussis
gcccgugcgugugccuguccc

SEQ ID NO: 333765 - RNA, 17 nt, Bordetella pertussis
gcccgugcgcaacgcgc

SEQ ID NO: 333766 - RNA, 13 nt, Bordetella pertussis
gcccguucacgcg

SEQ ID NO: 333767 - RNA, 15 nt, Bordetella pertussis
gcccguucacgcgca

SEQ ID NO: 333768 - RNA, 15 nt, Bordetella pertussis
gcccguugccgcgcg

SEQ ID NO: 333769 - RNA, 14 nt, Bordetella pertussis
gcccguugcggcgc

SEQ ID NO: 333770 - RNA, 16 nt, Bordetella pertussis
gcccguugcggcgccu

SEQ ID NO: 333771 - RNA, 17 nt, Bordetella pertussis
gcccguuggcaggccag

SEQ ID NO: 333772 - RNA, 18 nt, Bordetella pertussis
gcccguuggcaggccagc

SEQ ID NO: 333773 - RNA, 16 nt, Bordetella pertussis
gcccguuggcgucgag

SEQ ID NO: 333774 - RNA, 18 nt, Bordetella pertussis
gcccguuggcgucgagca

SEQ ID NO: 333775 - RNA, 20 nt, Bordetella pertussis
gcccguuggcgucgagcacc

SEQ ID NO: 333776 - RNA, 15 nt, Bordetella pertussis
gcccuccggcgccag

SEQ ID NO: 333777 - RNA, 16 nt, Bordetella pertussis
gcccuccggcgccagc

SEQ ID NO: 333778 - RNA, 14 nt, Bordetella pertussis
gcccuccucggcca

SEQ ID NO: 333779 - RNA, 15 nt, Bordetella pertussis
gcccuccucggccag

SEQ ID NO: 333780 - RNA, 23 nt, Bordetella pertussis
gcccuccucggccaggucgcgca

SEQ ID NO: 333781 - RNA, 13 nt, Bordetella pertussis
gcccucgcgcacg

SEQ ID NO: 333782 - RNA, 13 nt, Bordetella pertussis
gcccucgcggccg

SEQ ID NO: 333783 - RNA, 14 nt, Bordetella pertussis
gcccucgcggccgu

SEQ ID NO: 333784 - RNA, 16 nt, Bordetella pertussis
gcccucgcugcgcguc

SEQ ID NO: 333785 - RNA, 20 nt, Bordetella pertussis
gcccucgggcgacaggcgcg

SEQ ID NO: 333786 - RNA, 12 nt, Bordetella pertussis
gcccucggucag

SEQ ID NO: 333787 - RNA, 16 nt, Bordetella pertussis
gcccucggucagcgcc

SEQ ID NO: 333788 - RNA, 19 nt, Bordetella pertussis
gcccucggucagcgccagg

SEQ ID NO: 333789 - RNA, 22 nt, Bordetella pertussis
gcccucggucgucagcacgccc

SEQ ID NO: 333790 - RNA, 15 nt, Bordetella pertussis
gcccucgucgcggcc

SEQ ID NO: 333791 - RNA, 18 nt, Bordetella pertussis
gcccucguugacgccgac

SEQ ID NO: 333792 - RNA, 19 nt, Bordetella pertussis
gcccucguugacgccgacg

SEQ ID NO: 333793 - RNA, 20 nt, Bordetella pertussis
gcccucguugacgccgacga

SEQ ID NO: 333794 - RNA, 17 nt, Bordetella pertussis
gcccucuucggcggcca

SEQ ID NO: 333795 - RNA, 20 nt, Bordetella pertussis
gcccucuucggcggccagcc

SEQ ID NO: 333796 - RNA, 21 nt, Bordetella pertussis
gcccucuucggcggccagccg

SEQ ID NO: 333797 - RNA, 24 nt, Bordetella pertussis
gcccucuucggcguaaggcugcag

SEQ ID NO: 333798 - RNA, 19 nt, Bordetella pertussis
gcccugacccgcuggcugg

SEQ ID NO: 333799 - RNA, 21 nt, Bordetella pertussis
gcccugacgccugcgccgggu

SEQ ID NO: 333800 - RNA, 22 nt, Bordetella pertussis
gcccugcaccgucacgcgcugg

SEQ ID NO: 333801 - RNA, 16 nt, Bordetella pertussis
gcccugcacgcgcgcg

SEQ ID NO: 333802 - RNA, 20 nt, Bordetella pertussis
gcccugcagcggccagucca

SEQ ID NO: 333803 - RNA, 13 nt, Bordetella pertussis
gcccugcagggca

SEQ ID NO: 333804 - RNA, 23 nt, Bordetella pertussis
gcccugcagggcaugggcccggg

SEQ ID NO: 333805 - RNA, 15 nt, Bordetella pertussis
gcccugcaugaccgc

SEQ ID NO: 333806 - RNA, 20 nt, Bordetella pertussis
gcccugcaugaccgccgcca

SEQ ID NO: 333807 - RNA, 21 nt, Bordetella pertussis
gcccugcaugaccgccgccag

SEQ ID NO: 333808 - RNA, 22 nt, Bordetella pertussis
gcccugcaugaccgccgccagc

SEQ ID NO: 333809 - RNA, 16 nt, Bordetella pertussis
gcccugcccgcaccau

SEQ ID NO: 333810 - RNA, 14 nt, Bordetella pertussis
gcccugcccggcga

SEQ ID NO: 333811 - RNA, 15 nt, Bordetella pertussis
gcccugcccggcgag

SEQ ID NO: 333812 - RNA, 17 nt, Bordetella pertussis
gcccugcccggcgagca

SEQ ID NO: 333813 - RNA, 20 nt, Bordetella pertussis
gcccugccgccaagggcgcg

SEQ ID NO: 333814 - RNA, 22 nt, Bordetella pertussis
gcccugccgccaagggcgcgcc

SEQ ID NO: 333815 - RNA, 14 nt, Bordetella pertussis
gcccugcgaacccg

SEQ ID NO: 333816 - RNA, 19 nt, Bordetella pertussis
gcccugcgaacccgccgcg

SEQ ID NO: 333817 - RNA, 14 nt, Bordetella pertussis
gcccugcgcaucga

SEQ ID NO: 333818 - RNA, 16 nt, Bordetella pertussis
gcccugcgccagcgcc

SEQ ID NO: 333819 - RNA, 20 nt, Bordetella pertussis
gcccugcgccagcgccucgc

SEQ ID NO: 333820 - RNA, 17 nt, Bordetella pertussis
gcccugcgcguacgugg

SEQ ID NO: 333821 - RNA, 18 nt, Bordetella pertussis
gcccugcgcguacguggc

SEQ ID NO: 333822 - RNA, 20 nt, Bordetella pertussis
gcccugcgcguacguggcgc

SEQ ID NO: 333823 - RNA, 18 nt, Bordetella pertussis
gcccugcggcgcggccag

SEQ ID NO: 333824 - RNA, 20 nt, Bordetella pertussis
gcccugcggcgcggccagca

SEQ ID NO: 333825 - RNA, 22 nt, Bordetella pertussis
gcccugcggcuugggcccggcg

SEQ ID NO: 333826 - RNA, 15 nt, Bordetella pertussis
gcccugcguggcgca

SEQ ID NO: 333827 - RNA, 15 nt, Bordetella pertussis
gcccugcucgaucug

SEQ ID NO: 333828 - RNA, 16 nt, Bordetella pertussis
gcccugcucgcgcagc

SEQ ID NO: 333829 - RNA, 13 nt, Bordetella pertussis
gcccugcugcccg

SEQ ID NO: 333830 - RNA, 22 nt, Bordetella pertussis
gcccugcugcugcagccacugg

SEQ ID NO: 333831 - RNA, 13 nt, Bordetella pertussis
gcccugcuggcgc

SEQ ID NO: 333832 - RNA, 23 nt, Bordetella pertussis
gcccugcugggguggagcgcggc

SEQ ID NO: 333833 - RNA, 14 nt, Bordetella pertussis
gcccugcuggcgca

SEQ ID NO: 333834 - RNA, 20 nt, Bordetella pertussis
gcccuggagaucgccgccga

SEQ ID NO: 333835 - RNA, 16 nt, Bordetella pertussis
gcccuggauggccugg

SEQ ID NO: 333836 - RNA, 15 nt, Bordetella pertussis
gcccuggauggcggc

SEQ ID NO: 333837 - RNA, 17 nt, Bordetella pertussis
gcccuggauggcggccg

SEQ ID NO: 333838 - RNA, 23 nt, Bordetella pertussis
gcccuggauggcggccgccagcg

SEQ ID NO: 333839 - RNA, 17 nt, Bordetella pertussis
gcccuggcagcuggcgc

SEQ ID NO: 333840 - RNA, 18 nt, Bordetella pertussis
gcccuggcagcuggcgcg

SEQ ID NO: 333841 - RNA, 16 nt, Bordetella pertussis
gcccuggccacgcugc

SEQ ID NO: 333842 - RNA, 17 nt, Bordetella pertussis
gcccuggcccaggccga

SEQ ID NO: 333843 - RNA, 20 nt, Bordetella pertussis
gcccuggcccaggccgaacc

SEQ ID NO: 333844 - RNA, 13 nt, Bordetella pertussis
gcccuggcgcagg

SEQ ID NO: 333845 - RNA, 22 nt, Bordetella pertussis
gcccuggcgcaggccggcggcc

SEQ ID NO: 333846 - RNA, 16 nt, Bordetella pertussis
gcccuggcgcagggca

SEQ ID NO: 333847 - RNA, 19 nt, Bordetella pertussis
gcccuggcgccgcggccgg

SEQ ID NO: 333848 - RNA, 22 nt, Bordetella pertussis
gcccuggcgcgaggcggcgacg

SEQ ID NO: 333849 - RNA, 20 nt, Bordetella pertussis
gcccuggccuucgaccugcc

SEQ ID NO: 333850 - RNA, 21 nt, Bordetella pertussis
gcccuggcgcggcggcgucaa

SEQ ID NO: 333851 - RNA, 13 nt, Bordetella pertussis
gcccuggcgcugu

SEQ ID NO: 333852 - RNA, 20 nt, Bordetella pertussis
gcccuggcggcgcaguucgg

SEQ ID NO: 333853 - RNA, 13 nt, Bordetella pertussis
gcccuggcggcgg

SEQ ID NO: 333854 - RNA, 15 nt, Bordetella pertussis
gcccuggcgggccgg

SEQ ID NO: 333855 - RNA, 23 nt, Bordetella pertussis
gcccuggcguggcgcgcgccgau

SEQ ID NO: 333856 - RNA, 19 nt, Bordetella pertussis
gcccuggcguucgcgcgcg

SEQ ID NO: 333857 - RNA, 15 nt, Bordetella pertussis
gcccuggcugagcga

SEQ ID NO: 333858 - RNA, 17 nt, Bordetella pertussis
gcccuggcuggccagcc

SEQ ID NO: 333859 - RNA, 19 nt, Bordetella pertussis
gcccuggcuggccagccgg

SEQ ID NO: 333860 - RNA, 20 nt, Bordetella pertussis
gcccuggcuggccagccggc

SEQ ID NO: 333861 - RNA, 15 nt, Bordetella pertussis
gcccuggcuggcggc

SEQ ID NO: 333862 - RNA, 14 nt, Bordetella pertussis
gcccugggccagca

SEQ ID NO: 333863 - RNA, 17 nt, Bordetella pertussis
gcccugggccagcagcu

SEQ ID NO: 333864 - RNA, 19 nt, Bordetella pertussis
gcccugggccagcagcugg

SEQ ID NO: 333865 - RNA, 19 nt, Bordetella pertussis
gcccugggccagccagcgc

SEQ ID NO: 333866 - RNA, 21 nt, Bordetella pertussis
gcccugggccagccagcgccg

SEQ ID NO: 333867 - RNA, 22 nt, Bordetella pertussis
gcccugggcgagguagggcgcg

SEQ ID NO: 333868 - RNA, 15 nt, Bordetella pertussis
gcccugggcgcggcg

SEQ ID NO: 333869 - RNA, 19 nt, Bordetella pertussis
gcccugggcuuuggcuugg

SEQ ID NO: 333870 - RNA, 17 nt, Bordetella pertussis
gcccuggguggcggggc

SEQ ID NO: 333871 - RNA, 15 nt, Bordetella pertussis
gcccuggucaucgcc

SEQ ID NO: 333872 - RNA, 18 nt, Bordetella pertussis
gcccuggucaucgccaug

SEQ ID NO: 333873 - RNA, 19 nt, Bordetella pertussis
gcccuguguccacgaacgc

SEQ ID NO: 333874 - RNA, 23 nt, Bordetella pertussis
gcccugucggccgaaccgcgcag

SEQ ID NO: 333875 - RNA, 17 nt, Bordetella pertussis
gcccuguucgcgcggcc

SEQ ID NO: 333876 - RNA, 18 nt, Bordetella pertussis
gcccuguucgcgcggccc

SEQ ID NO: 333877 - RNA, 19 nt, Bordetella pertussis
gcccuguucgcgcggcccg

SEQ ID NO: 333878 - RNA, 13 nt, Bordetella pertussis
gcccuucgacgcg

SEQ ID NO: 333879 - RNA, 15 nt, Bordetella pertussis
gcccuucgacgcggc

SEQ ID NO: 333880 - RNA, 19 nt, Bordetella pertussis
gcccuucgacgcggcggcc

SEQ ID NO: 333881 - RNA, 13 nt, Bordetella pertussis
gcccuugaccgac

SEQ ID NO: 333882 - RNA, 18 nt, Bordetella pertussis
gcccuugagcacggcgcg

SEQ ID NO: 333883 - RNA, 16 nt, Bordetella pertussis
gcccuugaugccgucg

SEQ ID NO: 333884 - RNA, 12 nt, Bordetella pertussis
gcccuugauggc

SEQ ID NO: 333885 - RNA, 21 nt, Bordetella pertussis
gcccuugauggccucggcggc

SEQ ID NO: 333886 - RNA, 19 nt, Bordetella pertussis
gcccuugccagggccuggc

SEQ ID NO: 333887 - RNA, 12 nt, Bordetella pertussis
gcccuugccgcc

SEQ ID NO: 333888 - RNA, 20 nt, Bordetella pertussis
gcccuugccguugagcacgg

SEQ ID NO: 333889 - RNA, 12 nt, Bordetella pertussis
gcccuugcggcg

SEQ ID NO: 333890 - RNA, 14 nt, Bordetella pertussis
gcccuugcggcgag

SEQ ID NO: 333891 - RNA, 12 nt, Bordetella pertussis
gcccuuggcggc

SEQ ID NO: 333892 - RNA, 17 nt, Bordetella pertussis
gcccuuggcggcgaucg

SEQ ID NO: 333893 - RNA, 18 nt, Bordetella pertussis
gcccuugggggcccacau

SEQ ID NO: 333894 - RNA, 19 nt, Bordetella pertussis
gcccuugugcguuggcgcg

SEQ ID NO: 333895 - RNA, 20 nt, Bordetella pertussis
gcccuugugcugccaugccg

SEQ ID NO: 333896 - RNA, 14 nt, Bordetella pertussis
gccgaaacgcuggc

SEQ ID NO: 333897 - RNA, 20 nt, Bordetella pertussis
gccgaaauauggaccagccc

SEQ ID NO: 333898 - RNA, 16 nt, Bordetella pertussis
gccgaaauggcggcgg

SEQ ID NO: 333899 - RNA, 14 nt, Bordetella pertussis
gccgaaauuggcga

SEQ ID NO: 333900 - RNA, 23 nt, Bordetella pertussis
gccgaacaagguccaggcccggc

SEQ ID NO: 333901 - RNA, 14 nt, Bordetella pertussis
gccgaacacaucga

SEQ ID NO: 333902 - RNA, 15 nt, Bordetella pertussis
gccgaacaccagcuc

SEQ ID NO: 333903 - RNA, 11 nt, Bordetella pertussis
gccgaacagcc

SEQ ID NO: 333904 - RNA, 23 nt, Bordetella pertussis
gccgaacagccagggcagggcgc

SEQ ID NO: 333905 - RNA, 15 nt, Bordetella pertussis
gccgaaccacagcau

SEQ ID NO: 333906 - RNA, 17 nt, Bordetella pertussis
gccgaaccagcgcacca

SEQ ID NO: 333907 - RNA, 18 nt, Bordetella pertussis
gccgaaccgcgcagccgc

SEQ ID NO: 333908 - RNA, 16 nt, Bordetella pertussis
gccgaacgccgccgca

SEQ ID NO: 333909 - RNA, 16 nt, Bordetella pertussis
gccgaacgcgcagcga

SEQ ID NO: 333910 - RNA, 18 nt, Bordetella pertussis
gccgaacggcacgugaua

SEQ ID NO: 333911 - RNA, 14 nt, Bordetella pertussis
gccgaacggcagca

SEQ ID NO: 333912 - RNA, 18 nt, Bordetella pertussis
gccgaacggggccgccuc

SEQ ID NO: 333913 - RNA, 21 nt, Bordetella pertussis
gccgaacggggccgccucggc

SEQ ID NO: 333914 - RNA, 17 nt, Bordetella pertussis
gccgaacucgcgcucgg

SEQ ID NO: 333915 - RNA, 19 nt, Bordetella pertussis
gccgaacucgcgcucggcc

SEQ ID NO: 333916 - RNA, 15 nt, Bordetella pertussis
gccgaacugccggcg

SEQ ID NO: 333917 - RNA, 21 nt, Bordetella pertussis
gccgaacugccggcgcgggcg

SEQ ID NO: 333918 - RNA, 21 nt, Bordetella pertussis
gccgaacugggacaggcccag

SEQ ID NO: 333919 - RNA, 23 nt, Bordetella pertussis
gccgaacugggacaggcccagcc

SEQ ID NO: 333920 - RNA, 21 nt, Bordetella pertussis
gccgaacugggucugcaccgg

SEQ ID NO: 333921 - RNA, 23 nt, Bordetella pertussis
gccgaagaaauagcccgcggcca

SEQ ID NO: 333922 - RNA, 17 nt, Bordetella pertussis
gccgaagauucccgcgc

SEQ ID NO: 333923 - RNA, 14 nt, Bordetella pertussis
gccgaagccgccgc

SEQ ID NO: 333924 - RNA, 19 nt, Bordetella pertussis
gccgaagccgccgccguca

SEQ ID NO: 333925 - RNA, 23 nt, Bordetella pertussis
gccgaagcgcgcgugcagguagg

SEQ ID NO: 333926 - RNA, 14 nt, Bordetella pertussis
gccgaaggcggcgc

SEQ ID NO: 333927 - RNA, 22 nt, Bordetella pertussis
gccgaaggcgugcugaacgcgc

SEQ ID NO: 333928 - RNA, 16 nt, Bordetella pertussis
gccgaaggcggcgccg

SEQ ID NO: 333929 - RNA, 19 nt, Bordetella pertussis
gccgaaguacacggccagc

SEQ ID NO: 333930 - RNA, 20 nt, Bordetella pertussis
gccgaaguacacggccagca

SEQ ID NO: 333931 - RNA, 21 nt, Bordetella pertussis
gccgaaguacacggccagcac

SEQ ID NO: 333932 - RNA, 21 nt, Bordetella pertussis
gccgaaguaguuggucgagcg

SEQ ID NO: 333933 - RNA, 23 nt, Bordetella pertussis
gccgaagggcaccgugaugucgc

SEQ ID NO: 333934 - RNA, 17 nt, Bordetella pertussis
gccgaaguugcggccgu

SEQ ID NO: 333935 - RNA, 15 nt, Bordetella pertussis
gccgacaugccguac

SEQ ID NO: 333936 - RNA, 22 nt, Bordetella pertussis
gccgacaugucgugcuggcuga

SEQ ID NO: 333937 - RNA, 17 nt, Bordetella pertussis
gccgaccacccgcgcca

SEQ ID NO: 333938 - RNA, 19 nt, Bordetella pertussis
gccgaccacccgcgccagg

SEQ ID NO: 333939 - RNA, 20 nt, Bordetella pertussis
gccgaccacccgcgccagga

SEQ ID NO: 333940 - RNA, 15 nt, Bordetella pertussis
gccgaccacgcuggg

SEQ ID NO: 333941 - RNA, 22 nt, Bordetella pertussis
gccgaccacggcuuuggcguag

SEQ ID NO: 333942 - RNA, 14 nt, Bordetella pertussis
gccgacccgcaccg

SEQ ID NO: 333943 - RNA, 21 nt, Bordetella pertussis
gccgacccgcaccgacgggcu

SEQ ID NO: 333944 - RNA, 16 nt, Bordetella pertussis
gccgacccgggcgggc

SEQ ID NO: 333945 - RNA, 16 nt, Bordetella pertussis
gccgacccugcccggc

SEQ ID NO: 333946 - RNA, 17 nt, Bordetella pertussis
gccgacccugcccggca

SEQ ID NO: 333947 - RNA, 19 nt, Bordetella pertussis
gccgacccugcccggcagg

SEQ ID NO: 333948 - RNA, 23 nt, Bordetella pertussis
gccgaccgcuuccgccaccgcgc

SEQ ID NO: 333949 - RNA, 21 nt, Bordetella pertussis
gccgaccggccccaccuggcg

SEQ ID NO: 333950 - RNA, 15 nt, Bordetella pertussis
gccgaccggcgcgcg

SEQ ID NO: 333951 - RNA, 17 nt, Bordetella pertussis
gccgaccgggccgacca

SEQ ID NO: 333952 - RNA, 21 nt, Bordetella pertussis
gccgaccgggccgaccaggcc

SEQ ID NO: 333953 - RNA, 23 nt, Bordetella pertussis
gccgaccgggccgaccaggccgg

SEQ ID NO: 333954 - RNA, 16 nt, Bordetella pertussis
gccgaccuccaggccc

SEQ ID NO: 333955 - RNA, 17 nt, Bordetella pertussis
gccgaccuccaggccca

SEQ ID NO: 333956 - RNA, 18 nt, Bordetella pertussis
gccgaccuccaggcccag

SEQ ID NO: 333957 - RNA, 16 nt, Bordetella pertussis
gccgaccucggcaccg

SEQ ID NO: 333958 - RNA, 19 nt, Bordetella pertussis
gccgacgaugccgcccacg

SEQ ID NO: 333959 - RNA, 20 nt, Bordetella pertussis
gccgacgaugccgcccacgc

SEQ ID NO: 333960 - RNA, 21 nt, Bordetella pertussis
gccgacgaugccgccgccgac

SEQ ID NO: 333961 - RNA, 23 nt, Bordetella pertussis
gccgacgaugccggucuccagcg

SEQ ID NO: 333962 - RNA, 15 nt, Bordetella pertussis
gccgacgauggccgg

SEQ ID NO: 333963 - RNA, 14 nt, Bordetella pertussis
gccgacgaugucgc

SEQ ID NO: 333964 - RNA, 15 nt, Bordetella pertussis
gccgacgccgccacg

SEQ ID NO: 333965 - RNA, 13 nt, Bordetella pertussis
gccgacggccucg

SEQ ID NO: 333966 - RNA, 18 nt, Bordetella pertussis
gccgacggccucggccag

SEQ ID NO: 333967 - RNA, 20 nt, Bordetella pertussis
gccgacggccucggccagga

SEQ ID NO: 333968 - RNA, 21 nt, Bordetella pertussis
gccgacggccucggccaggaa

SEQ ID NO: 333969 - RNA, 13 nt, Bordetella pertussis
gccgacggcgccc

SEQ ID NO: 333970 - RNA, 14 nt, Bordetella pertussis
gccgacggcgcugg

SEQ ID NO: 333971 - RNA, 15 nt, Bordetella pertussis
gccgacggcgcuggc

SEQ ID NO: 333972 - RNA, 14 nt, Bordetella pertussis
gccgacggcggcgc

SEQ ID NO: 333973 - RNA, 19 nt, Bordetella pertussis
gccgacggcucgcgcucgc

SEQ ID NO: 333974 - RNA, 18 nt, Bordetella pertussis
gccgacgggcggcugcug

SEQ ID NO: 333975 - RNA, 17 nt, Bordetella pertussis
gccgacgggccggucaa

SEQ ID NO: 333976 - RNA, 23 nt, Bordetella pertussis
gccgacucgaaacgggcggcguc

SEQ ID NO: 333977 - RNA, 20 nt, Bordetella pertussis
gccgacugcuguacgacagc

SEQ ID NO: 333978 - RNA, 22 nt, Bordetella pertussis
gccgacugcuguacgacagcaa

SEQ ID NO: 333979 - RNA, 15 nt, Bordetella pertussis
gccgacuggaugaag

SEQ ID NO: 333980 - RNA, 19 nt, Bordetella pertussis
gccgacuuccugggugcgc

SEQ ID NO: 333981 - RNA, 20 nt, Bordetella pertussis
gccgacuucuggggugccug

SEQ ID NO: 333982 - RNA, 22 nt, Bordetella pertussis
gccgacugggcuugccggugcu

SEQ ID NO: 333983 - RNA, 19 nt, Bordetella pertussis
gccgagauggacgcguucu

SEQ ID NO: 333984 - RNA, 22 nt, Bordetella pertussis
gccgagaugugcggcguggcgg

SEQ ID NO: 333985 - RNA, 16 nt, Bordetella pertussis
gccgagccgcugucgc

SEQ ID NO: 333986 - RNA, 14 nt, Bordetella pertussis
gccgagccuggcgu

SEQ ID NO: 333987 - RNA, 17 nt, Bordetella pertussis
gccgagcggggccgcgc

SEQ ID NO: 333988 - RNA, 21 nt, Bordetella pertussis
gccgagcggggccgcgccggc

SEQ ID NO: 333989 - RNA, 22 nt, Bordetella pertussis
gccgagcggggccgcgccggcu

SEQ ID NO: 333990 - RNA, 14 nt, Bordetella pertussis
gccgagcgugccgg

SEQ ID NO: 333991 - RNA, 15 nt, Bordetella pertussis
gccgagcgugccggg

SEQ ID NO: 333992 - RNA, 23 nt, Bordetella pertussis
gccgagcgugccgggaugcugcu

SEQ ID NO: 333993 - RNA, 16 nt, Bordetella pertussis
gccgagcuccucgagc

SEQ ID NO: 333994 - RNA, 13 nt, Bordetella pertussis
gccgaggccagcg

SEQ ID NO: 333995 - RNA, 14 nt, Bordetella pertussis
gccgaggccagcgu

SEQ ID NO: 333996 - RNA, 15 nt, Bordetella pertussis
gccgaggccagcgug

SEQ ID NO: 333997 - RNA, 13 nt, Bordetella pertussis
gccgaggcgccgc

SEQ ID NO: 333998 - RNA, 13 nt, Bordetella pertussis
gccgaggcgggca

SEQ ID NO: 333999 - RNA, 16 nt, Bordetella pertussis
gccgaggcugcgcgcg

SEQ ID NO: 334000 - RNA, 16 nt, Bordetella pertussis
gccgaggugcccauca

SEQ ID NO: 334001 - RNA, 24 nt, Bordetella pertussis
gccgaggugucgcuucccgcacgg

SEQ ID NO: 334002 - RNA, 15 nt, Bordetella pertussis
gccgaguagcggcgc

SEQ ID NO: 334003 - RNA, 16 nt, Bordetella pertussis
gccgaguagcggcgca

SEQ ID NO: 334004 - RNA, 18 nt, Bordetella pertussis
gccgauacgggcgcggcg

SEQ ID NO: 334005 - RNA, 14 nt, Bordetella pertussis
gccgauacgucgca

SEQ ID NO: 334006 - RNA, 15 nt, Bordetella pertussis
gccgauacgucgcag

SEQ ID NO: 334007 - RNA, 21 nt, Bordetella pertussis
gccgauacgucgcagcacgcc

SEQ ID NO: 334008 - RNA, 16 nt, Bordetella pertussis
gccgauagccgcggcg

SEQ ID NO: 334009 - RNA, 22 nt, Bordetella pertussis
gccgauagccgugaccugcucg

SEQ ID NO: 334010 - RNA, 22 nt, Bordetella pertussis
gccgauaucguuggugcgcacc

SEQ ID NO: 334011 - RNA, 19 nt, Bordetella pertussis
gccgaucaccacgggcacg

SEQ ID NO: 334012 - RNA, 17 nt, Bordetella pertussis
gccgauccacucggcca

SEQ ID NO: 334013 - RNA, 18 nt, Bordetella pertussis
gccgauccacucggccag

SEQ ID NO: 334014 - RNA, 21 nt, Bordetella pertussis
gccgauccacucggccagcgc

SEQ ID NO: 334015 - RNA, 23 nt, Bordetella pertussis
gccgauccacucggccagcgcgc

SEQ ID NO: 334016 - RNA, 14 nt, Bordetella pertussis
gccgauccagcgcc

SEQ ID NO: 334017 - RNA, 16 nt, Bordetella pertussis
gccgauccagcgccug

SEQ ID NO: 334018 - RNA, 17 nt, Bordetella pertussis
gccgauccagcgccugg

SEQ ID NO: 334019 - RNA, 20 nt, Bordetella pertussis
gccgauccagggccgcagca

SEQ ID NO: 334020 - RNA, 15 nt, Bordetella pertussis
gccgauccggcgcag

SEQ ID NO: 334021 - RNA, 16 nt, Bordetella pertussis
gccgauccgguugacg

SEQ ID NO: 334022 - RNA, 13 nt, Bordetella pertussis
gccgaucgccgac

SEQ ID NO: 334023 - RNA, 14 nt, Bordetella pertussis
gccgaucgccgaca

SEQ ID NO: 334024 - RNA, 16 nt, Bordetella pertussis
gccgaucgcgcacagc

SEQ ID NO: 334025 - RNA, 21 nt, Bordetella pertussis
gccgaucuucuggacgcugac

SEQ ID NO: 334026 - RNA, 23 nt, Bordetella pertussis
gccgaucuucuggacgcugaccg

SEQ ID NO: 334027 - RNA, 17 nt, Bordetella pertussis
gccgaugaauugcgcca

SEQ ID NO: 334028 - RNA, 21 nt, Bordetella pertussis
gccgaugaauugcgccacgcc

SEQ ID NO: 334029 - RNA, 22 nt, Bordetella pertussis
gccgaugaauugcgccacgccc

SEQ ID NO: 334030 - RNA, 23 nt, Bordetella pertussis
gccgaugaauugcgccacgccca

SEQ ID NO: 334031 - RNA, 17 nt, Bordetella pertussis
gccgaugacaucgccgc

SEQ ID NO: 334032 - RNA, 21 nt, Bordetella pertussis
gccgaugacaucgccgcugcg

SEQ ID NO: 334033 - RNA, 22 nt, Bordetella pertussis
gccgaugacaucgccgcugcgc

SEQ ID NO: 334034 - RNA, 15 nt, Bordetella pertussis
gccgaugaccagcag

SEQ ID NO: 334035 - RNA, 21 nt, Bordetella pertussis
gccgaugaccagcagcgccgg

SEQ ID NO: 334036 - RNA, 23 nt, Bordetella pertussis
gccgaugaccagcagcgccgggg

SEQ ID NO: 334037 - RNA, 17 nt, Bordetella pertussis
gccgaugaccagggcgc

SEQ ID NO: 334038 - RNA, 18 nt, Bordetella pertussis
gccgaugaccagggcgcc

SEQ ID NO: 334039 - RNA, 20 nt, Bordetella pertussis
gccgaugaccagggcgccga

SEQ ID NO: 334040 - RNA, 21 nt, Bordetella pertussis
gccgaugaccagggcgccgac

SEQ ID NO: 334041 - RNA, 22 nt, Bordetella pertussis
gccgaugaccagggcgccgacc

SEQ ID NO: 334042 - RNA, 17 nt, Bordetella pertussis
gccgaugaagacgccgu

SEQ ID NO: 334043 - RNA, 14 nt, Bordetella pertussis
gccgaugcgcucgg

SEQ ID NO: 334044 - RNA, 21 nt, Bordetella pertussis
gccgaugcgcucgguccagac

SEQ ID NO: 334045 - RNA, 22 nt, Bordetella pertussis
gccgaugcgcucgguccagacg

SEQ ID NO: 334046 - RNA, 15 nt, Bordetella pertussis
gccgaugcggcgcau

SEQ ID NO: 334047 - RNA, 19 nt, Bordetella pertussis
gccgaugcggguacuggcc

SEQ ID NO: 334048 - RNA, 16 nt, Bordetella pertussis
gccgaugcgguaggcc

SEQ ID NO: 334049 - RNA, 19 nt, Bordetella pertussis
gccgaugcguccgccgugc

SEQ ID NO: 334050 - RNA, 17 nt, Bordetella pertussis
gccgaugcuggucgcca

SEQ ID NO: 334051 - RNA, 19 nt, Bordetella pertussis
gccgauggcaucgccccgg

SEQ ID NO: 334052 - RNA, 23 nt, Bordetella pertussis
gccgauggcauggggcaggcgca

SEQ ID NO: 334053 - RNA, 14 nt, Bordetella pertussis
gccgauggccucgc

SEQ ID NO: 334054 - RNA, 19 nt, Bordetella pertussis
gccgauggccucgcugcca

SEQ ID NO: 334055 - RNA, 22 nt, Bordetella pertussis
gccgauggccucgcugccaggg

SEQ ID NO: 334056 - RNA, 23 nt, Bordetella pertussis
gccgauggcgccgcugucgcuga

SEQ ID NO: 334057 - RNA, 14 nt, Bordetella pertussis
gccgauggcgcggc

SEQ ID NO: 334058 - RNA, 15 nt, Bordetella pertussis
gccgauggcgcggcc

SEQ ID NO: 334059 - RNA, 17 nt, Bordetella pertussis
gccgauggcguccagca

SEQ ID NO: 334060 - RNA, 15 nt, Bordetella pertussis
gccgaugucgccgcc

SEQ ID NO: 334061 - RNA, 16 nt, Bordetella pertussis
gccgaugucgccgccu

SEQ ID NO: 334062 - RNA, 21 nt, Bordetella pertussis
gccgaugucgccgccugcggc

SEQ ID NO: 334063 - RNA, 23 nt, Bordetella pertussis
gccgauguaugacuugaccgcau

SEQ ID NO: 334064 - RNA, 14 nt, Bordetella pertussis
gccgcaagcuggcg

SEQ ID NO: 334065 - RNA, 17 nt, Bordetella pertussis
gccgcaagcuggcggcg

SEQ ID NO: 334066 - RNA, 19 nt, Bordetella pertussis
gccgcaagcuggcggcgcg

SEQ ID NO: 334067 - RNA, 20 nt, Bordetella pertussis
gccgcaagcuggcggcgcgc

SEQ ID NO: 334068 - RNA, 22 nt, Bordetella pertussis
gccgaugucgaccauguccgcg

SEQ ID NO: 334069 - RNA, 19 nt, Bordetella pertussis
gccgcacgaucgcgccggc

SEQ ID NO: 334070 - RNA, 12 nt, Bordetella pertussis
gccgcacgcccg

SEQ ID NO: 334071 - RNA, 17 nt, Bordetella pertussis
gccgcacgcccgccugc

SEQ ID NO: 334072 - RNA, 13 nt, Bordetella pertussis
gccgcacgccggu

SEQ ID NO: 334073 - RNA, 21 nt, Bordetella pertussis
gccgcacgccggucgccagcg

SEQ ID NO: 334074 - RNA, 15 nt, Bordetella pertussis
gccgcacgggcgccu

SEQ ID NO: 334075 - RNA, 23 nt, Bordetella pertussis
gccgcagcaccacaucgccggcg

SEQ ID NO: 334076 - RNA, 15 nt, Bordetella pertussis
gccgcagcaggcgcu

SEQ ID NO: 334077 - RNA, 19 nt, Bordetella pertussis
gccgcagcaggcgcucggc

SEQ ID NO: 334078 - RNA, 22 nt, Bordetella pertussis
gccgcagcaggcgcucggccag

SEQ ID NO: 334079 - RNA, 23 nt, Bordetella pertussis
gccgcagcaggcgcucggccagc

SEQ ID NO: 334080 - RNA, 24 nt, Bordetella pertussis
gccgcagcaguucggucagcgcgg

SEQ ID NO: 334081 - RNA, 17 nt, Bordetella pertussis
gccgcagcauggcgcca

SEQ ID NO: 334082 - RNA, 18 nt, Bordetella pertussis
gccgcagcauggcgccag

SEQ ID NO: 334083 - RNA, 19 nt, Bordetella pertussis
gccgcagcauggcgccagc

SEQ ID NO: 334084 - RNA, 20 nt, Bordetella pertussis
gccgcagcccgcgcgccugc

SEQ ID NO: 334085 - RNA, 13 nt, Bordetella pertussis
gccgcagccgcca

SEQ ID NO: 334086 - RNA, 12 nt, Bordetella pertussis
gccgcagccggc

SEQ ID NO: 334087 - RNA, 14 nt, Bordetella pertussis
gccgcagccggcug

SEQ ID NO: 334088 - RNA, 21 nt, Bordetella pertussis
gccgcagcgaacggauggucg

SEQ ID NO: 334089 - RNA, 17 nt, Bordetella pertussis
gccgccagccgcuggcg

SEQ ID NO: 334090 - RNA, 13 nt, Bordetella pertussis
gccgccagccugc

SEQ ID NO: 334091 - RNA, 13 nt, Bordetella pertussis
gccgccagcgcca

SEQ ID NO: 334092 - RNA, 23 nt, Bordetella pertussis
gccgccagcgccaugaugucgcg

SEQ ID NO: 334093 - RNA, 15 nt, Bordetella pertussis
gccgccagcgcgcgc

SEQ ID NO: 334094 - RNA, 16 nt, Bordetella pertussis
gccgccagcggcuggc

SEQ ID NO: 334095 - RNA, 13 nt, Bordetella pertussis
gccgccagcggga

SEQ ID NO: 334096 - RNA, 16 nt, Bordetella pertussis
gccgccauaggcgcgc

SEQ ID NO: 334097 - RNA, 20 nt, Bordetella pertussis
gccgccauaggcgcgcacca

SEQ ID NO: 334098 - RNA, 22 nt, Bordetella pertussis
gccgccauaggcgcgcaccagc

SEQ ID NO: 334099 - RNA, 23 nt, Bordetella pertussis
gccgccauaggcgcgcaccagcc

SEQ ID NO: 334100 - RNA, 18 nt, Bordetella pertussis
gccgccaucauggcgucg

SEQ ID NO: 334101 - RNA, 22 nt, Bordetella pertussis
gccgccaucauggcgucggcca

SEQ ID NO: 334102 - RNA, 22 nt, Bordetella pertussis
gccgccaucgucguagcgccag

SEQ ID NO: 334103 - RNA, 12 nt, Bordetella pertussis
gccgcccaccgu

SEQ ID NO: 334104 - RNA, 19 nt, Bordetella pertussis
gccgcccaccgugaccagc

SEQ ID NO: 334105 - RNA, 13 nt, Bordetella pertussis
gccgcccacgcca

SEQ ID NO: 334106 - RNA, 17 nt, Bordetella pertussis
gccgcccacgccaugga

SEQ ID NO: 334107 - RNA, 13 nt, Bordetella pertussis
gccgcccacgccg

SEQ ID NO: 334108 - RNA, 12 nt, Bordetella pertussis
gccgcccacggc

SEQ ID NO: 334109 - RNA, 16 nt, Bordetella pertussis
gccgcccacggcgacu

SEQ ID NO: 334110 - RNA, 16 nt, Bordetella pertussis
gccgcccacgggcgcc

SEQ ID NO: 334111 - RNA, 19 nt, Bordetella pertussis
gccgcccacgccgccuggc

SEQ ID NO: 334112 - RNA, 23 nt, Bordetella pertussis
gccgcccacgccgcugucgaccu

SEQ ID NO: 334113 - RNA, 17 nt, Bordetella pertussis
gccgcccacugccaggc

SEQ ID NO: 334114 - RNA, 11 nt, Bordetella pertussis
gccgcccagca

SEQ ID NO: 334115 - RNA, 18 nt, Bordetella pertussis
gccgcccagcaugcgcgc

SEQ ID NO: 334116 - RNA, 19 nt, Bordetella pertussis
gccgcccagcaugcgcgcg

SEQ ID NO: 334117 - RNA, 11 nt, Bordetella pertussis
gccgcccagcc

SEQ ID NO: 334118 - RNA, 13 nt, Bordetella pertussis
gccgcccagcgcc

SEQ ID NO: 334119 - RNA, 14 nt, Bordetella pertussis
gccgcccagcgccu

SEQ ID NO: 334120 - RNA, 18 nt, Bordetella pertussis
gccgcccagcgccugcaa

SEQ ID NO: 334121 - RNA, 15 nt, Bordetella pertussis
gccgcccaggcgcag

SEQ ID NO: 334122 - RNA, 17 nt, Bordetella pertussis
gccgcccaggcgcagcc

SEQ ID NO: 334123 - RNA, 23 nt, Bordetella pertussis
gccgcccaggucggacgcgccgg

SEQ ID NO: 334124 - RNA, 13 nt, Bordetella pertussis
gccgcccggccgg

SEQ ID NO: 334125 - RNA, 14 nt, Bordetella pertussis
gccgcccggccggc

SEQ ID NO: 334126 - RNA, 17 nt, Bordetella pertussis
gccgcccggccggcccg

SEQ ID NO: 334127 - RNA, 15 nt, Bordetella pertussis
gccgcccgggccggc

SEQ ID NO: 334128 - RNA, 15 nt, Bordetella pertussis
gccgcccguccgggc

SEQ ID NO: 334129 - RNA, 20 nt, Bordetella pertussis
gccgcccguccgggcggcgu

SEQ ID NO: 334130 - RNA, 14 nt, Bordetella pertussis
gccgccgaaccagc

SEQ ID NO: 334131 - RNA, 17 nt, Bordetella pertussis
gccgccgaaccagcgca

SEQ ID NO: 334132 - RNA, 18 nt, Bordetella pertussis
gccgccgaaccagcgcac

SEQ ID NO: 334133 - RNA, 14 nt, Bordetella pertussis
gccgccgaacgagg

SEQ ID NO: 334134 - RNA, 23 nt, Bordetella pertussis
gccgccgaacgaggcgcggucgu

SEQ ID NO: 334135 - RNA, 12 nt, Bordetella pertussis
gccgccgaacgg

SEQ ID NO: 334136 - RNA, 16 nt, Bordetella pertussis
gccgccgaacggcacg

SEQ ID NO: 334137 - RNA, 17 nt, Bordetella pertussis
gccgccgaacggcagca

SEQ ID NO: 334138 - RNA, 14 nt, Bordetella pertussis
gccgccgaagccgc

SEQ ID NO: 334139 - RNA, 17 nt, Bordetella pertussis
gccgccgaagggcaccg

SEQ ID NO: 334140 - RNA, 14 nt, Bordetella pertussis
gccgccgaccucgu

SEQ ID NO: 334141 - RNA, 11 nt, Bordetella pertussis
gccgccgacga

SEQ ID NO: 334142 - RNA, 17 nt, Bordetella pertussis
gccgccgacggcauggc

SEQ ID NO: 334143 - RNA, 23 nt, Bordetella pertussis
gccgccgacggcauggcggccag

SEQ ID NO: 334144 - RNA, 16 nt, Bordetella pertussis
gccgccgacgccgcca

SEQ ID NO: 334145 - RNA, 13 nt, Bordetella pertussis
gccgccgagcagg

SEQ ID NO: 334146 - RNA, 14 nt, Bordetella pertussis
gccgccgcccacgc

SEQ ID NO: 334147 - RNA, 13 nt, Bordetella pertussis
gccgccgcccgca

SEQ ID NO: 334148 - RNA, 15 nt, Bordetella pertussis
gccgccgcccgcacg

SEQ ID NO: 334149 - RNA, 15 nt, Bordetella pertussis
gccgccgcccgcccg

SEQ ID NO: 334150 - RNA, 14 nt, Bordetella pertussis
gccgccgcccggca

SEQ ID NO: 334151 - RNA, 14 nt, Bordetella pertussis
gccgccgccggcaa

SEQ ID NO: 334152 - RNA, 15 nt, Bordetella pertussis
gccgccgccggcccg

SEQ ID NO: 334153 - RNA, 16 nt, Bordetella pertussis
gccgccgccgcgcgcg

SEQ ID NO: 334154 - RNA, 16 nt, Bordetella pertussis
gccgccgccggcgcgg

SEQ ID NO: 334155 - RNA, 14 nt, Bordetella pertussis
gccgccgccgggcu

SEQ ID NO: 334156 - RNA, 13 nt, Bordetella pertussis
gccgccgccgguc

SEQ ID NO: 334157 - RNA, 13 nt, Bordetella pertussis
gccgccgccguca

SEQ ID NO: 334158 - RNA, 13 nt, Bordetella pertussis
gccgccgcggccu

SEQ ID NO: 334159 - RNA, 14 nt, Bordetella pertussis
gccgccgcggccuc

SEQ ID NO: 334160 - RNA, 17 nt, Bordetella pertussis
gccgccgcggccucggc

SEQ ID NO: 334161 - RNA, 16 nt, Bordetella pertussis
gccgccgcggccuggc

SEQ ID NO: 334162 - RNA, 12 nt, Bordetella pertussis
gccgccgcgggc

SEQ ID NO: 334163 - RNA, 16 nt, Bordetella pertussis
gccgccgcgggcgccg

SEQ ID NO: 334164 - RNA, 17 nt, Bordetella pertussis
gccgccgcgggcgccgc

SEQ ID NO: 334165 - RNA, 16 nt, Bordetella pertussis
gccgccgcguggcggc

SEQ ID NO: 334166 - RNA, 23 nt, Bordetella pertussis
gccgccggccaccagcggcgccg

SEQ ID NO: 334167 - RNA, 14 nt, Bordetella pertussis
gccgccggccagcg

SEQ ID NO: 334168 - RNA, 17 nt, Bordetella pertussis
gccgccggccagcgcca

SEQ ID NO: 334169 - RNA, 18 nt, Bordetella pertussis
gccgccggccagcgccag

SEQ ID NO: 334170 - RNA, 17 nt, Bordetella pertussis
gccgccggccagcgcgg

SEQ ID NO: 334171 - RNA, 14 nt, Bordetella pertussis
gccgccggccagcu

SEQ ID NO: 334172 - RNA, 14 nt, Bordetella pertussis
gccgccggccauca

SEQ ID NO: 334173 - RNA, 19 nt, Bordetella pertussis
gccgccggcccaggauggc

SEQ ID NO: 334174 - RNA, 22 nt, Bordetella pertussis
gccgccggcccaggauggcgcc

SEQ ID NO: 334175 - RNA, 19 nt, Bordetella pertussis
gccgccgcugccggccgac

SEQ ID NO: 334176 - RNA, 12 nt, Bordetella pertussis
gccgccggcccg

SEQ ID NO: 334177 - RNA, 15 nt, Bordetella pertussis
gccgccggcccgcca

SEQ ID NO: 334178 - RNA, 14 nt, Bordetella pertussis
gccgccggccugcu

SEQ ID NO: 334179 - RNA, 21 nt, Bordetella pertussis
gccgccggccugcucgccggc

SEQ ID NO: 334180 - RNA, 15 nt, Bordetella pertussis
gccgccggccugcug

SEQ ID NO: 334181 - RNA, 16 nt, Bordetella pertussis
gccgccggcgcacccg

SEQ ID NO: 334182 - RNA, 12 nt, Bordetella pertussis
gccgccggcgag

SEQ ID NO: 334183 - RNA, 21 nt, Bordetella pertussis
gccgccgggcaugcaccaggc

SEQ ID NO: 334184 - RNA, 22 nt, Bordetella pertussis
gccgccgggcaugcaccaggcg

SEQ ID NO: 334185 - RNA, 23 nt, Bordetella pertussis
gccgccgggcauugccggagcag

SEQ ID NO: 334186 - RNA, 17 nt, Bordetella pertussis
gccgccgggccugcccg

SEQ ID NO: 334187 - RNA, 16 nt, Bordetella pertussis
gccgccgggcgcgcgc

SEQ ID NO: 334188 - RNA, 20 nt, Bordetella pertussis
gccgccgggccgcgaccacg

SEQ ID NO: 334189 - RNA, 22 nt, Bordetella pertussis
gccgccucgggcacggccagca

SEQ ID NO: 334190 - RNA, 15 nt, Bordetella pertussis
gccgccugagcacau

SEQ ID NO: 334191 - RNA, 14 nt, Bordetella pertussis
gccgccugcggcgc

SEQ ID NO: 334192 - RNA, 15 nt, Bordetella pertussis
gccgccugcggcgcg

SEQ ID NO: 334193 - RNA, 13 nt, Bordetella pertussis
gccgccugcugcg

SEQ ID NO: 334194 - RNA, 14 nt, Bordetella pertussis
gccgccugcugcgc

SEQ ID NO: 334195 - RNA, 17 nt, Bordetella pertussis
gccgccugcugcgccgu

SEQ ID NO: 334196 - RNA, 14 nt, Bordetella pertussis
gccgccugcgcgaa

SEQ ID NO: 334197 - RNA, 17 nt, Bordetella pertussis
gccgccugcgcgaaacc

SEQ ID NO: 334198 - RNA, 13 nt, Bordetella pertussis
gccgccuggccca

SEQ ID NO: 334199 - RNA, 14 nt, Bordetella pertussis
gccgccuggcccac

SEQ ID NO: 334200 - RNA, 13 nt, Bordetella pertussis
gccgccuggcccg

SEQ ID NO: 334201 - RNA, 16 nt, Bordetella pertussis
gccgccuggcgcggcg

SEQ ID NO: 334202 - RNA, 22 nt, Bordetella pertussis
gccgccuggcgcggcgccugcg

SEQ ID NO: 334203 - RNA, 22 nt, Bordetella pertussis
gccgccugguaguaaucgcgcg

SEQ ID NO: 334204 - RNA, 17 nt, Bordetella pertussis
gccgccuucccaggcga

SEQ ID NO: 334205 - RNA, 20 nt, Bordetella pertussis
gccgccuucaccggccccau

SEQ ID NO: 334206 - RNA, 17 nt, Bordetella pertussis
gccgccuucgagcuggu

SEQ ID NO: 334207 - RNA, 16 nt, Bordetella pertussis
gccgccuucgucgcgc

SEQ ID NO: 334208 - RNA, 20 nt, Bordetella pertussis
gccgccuucgucgcgcaccc

SEQ ID NO: 334209 - RNA, 22 nt, Bordetella pertussis
gccgccuugacgguggccgcgg

SEQ ID NO: 334210 - RNA, 16 nt, Bordetella pertussis
gccgccuuggacgcgc

SEQ ID NO: 334211 - RNA, 19 nt, Bordetella pertussis
gccgccuuggacgcgcugu

SEQ ID NO: 334212 - RNA, 16 nt, Bordetella pertussis
gccgcgaacgcgccgg

SEQ ID NO: 334213 - RNA, 17 nt, Bordetella pertussis
gccgcgaacgcgccggc

SEQ ID NO: 334214 - RNA, 18 nt, Bordetella pertussis
gccgcgaacgcgccggcc

SEQ ID NO: 334215 - RNA, 18 nt, Bordetella pertussis
gccgcgacauagcgcugg

SEQ ID NO: 334216 - RNA, 20 nt, Bordetella pertussis
gccgcgaucgaguggugcgc

SEQ ID NO: 334217 - RNA, 12 nt, Bordetella pertussis
gccgcgaucgag

SEQ ID NO: 334218 - RNA, 21 nt, Bordetella pertussis
gccgcgaugcaugaaccgcag

SEQ ID NO: 334219 - RNA, 23 nt, Bordetella pertussis
gccgcgaugcaugaaccgcagcg

SEQ ID NO: 334220 - RNA, 14 nt, Bordetella pertussis
gccgcgauggcgcc

SEQ ID NO: 334221 - RNA, 16 nt, Bordetella pertussis
gccgcgauggcgccgg

SEQ ID NO: 334222 - RNA, 22 nt, Bordetella pertussis
gccgcgauggcgccggccagcg

SEQ ID NO: 334223 - RNA, 13 nt, Bordetella pertussis
gccgcgaugucgc

SEQ ID NO: 334224 - RNA, 15 nt, Bordetella pertussis
gccgcgaugucgcgc

SEQ ID NO: 334225 - RNA, 18 nt, Bordetella pertussis
gccgcgaugucgcgcgcg

SEQ ID NO: 334226 - RNA, 14 nt, Bordetella pertussis
gccgcgcaaggccu

SEQ ID NO: 334227 - RNA, 19 nt, Bordetella pertussis
gccgcgcaaggccugcucg

SEQ ID NO: 334228 - RNA, 15 nt, Bordetella pertussis
gccgcgcaaggcggc

SEQ ID NO: 334229 - RNA, 21 nt, Bordetella pertussis
gccgcgcaaggcggcccggcc

SEQ ID NO: 334230 - RNA, 22 nt, Bordetella pertussis
gccgcgcaaggcggcccggccg

SEQ ID NO: 334231 - RNA, 23 nt, Bordetella pertussis
gccgcgcaaggcggcccggccgc

SEQ ID NO: 334232 - RNA, 19 nt, Bordetella pertussis
gccgcgcacacauggcgca

SEQ ID NO: 334233 - RNA, 20 nt, Bordetella pertussis
gccgcgcacacauggcgcau

SEQ ID NO: 334234 - RNA, 24 nt, Bordetella pertussis
gccgcgcacagcccgaucgacggc

SEQ ID NO: 334235 - RNA, 18 nt, Bordetella pertussis
gccgcgcacccaggccca

SEQ ID NO: 334236 - RNA, 18 nt, Bordetella pertussis
gccgcgcacgcacugagc

SEQ ID NO: 334237 - RNA, 14 nt, Bordetella pertussis
gccgcgcagcacgc

SEQ ID NO: 334238 - RNA, 22 nt, Bordetella pertussis
gccgcgcagccgacaggcgcgc

SEQ ID NO: 334239 - RNA, 20 nt, Bordetella pertussis
gccgcgcaggaugacguggc

SEQ ID NO: 334240 - RNA, 20 nt, Bordetella pertussis
gccgcgcagcgucugcgcau

SEQ ID NO: 334241 - RNA, 17 nt, Bordetella pertussis
gccgcgcaggucggcga

SEQ ID NO: 334242 - RNA, 22 nt, Bordetella pertussis
gccgcgcaggucggcgaugcgc

SEQ ID NO: 334243 - RNA, 13 nt, Bordetella pertussis
gccgcgcagggca

SEQ ID NO: 334244 - RNA, 14 nt, Bordetella pertussis
gccgcgcagggcau

SEQ ID NO: 334245 - RNA, 13 nt, Bordetella pertussis
gccgcgcaugcca

SEQ ID NO: 334246 - RNA, 23 nt, Bordetella pertussis
gccgcgcauuugccgcggcgaag

SEQ ID NO: 334247 - RNA, 14 nt, Bordetella pertussis
gccgcgccacaggc

SEQ ID NO: 334248 - RNA, 16 nt, Bordetella pertussis
gccgcgccagcugcgc

SEQ ID NO: 334249 - RNA, 18 nt, Bordetella pertussis
gccgcgccagcugcgcag

SEQ ID NO: 334250 - RNA, 20 nt, Bordetella pertussis
gccgcgccagcugcgcagcg

SEQ ID NO: 334251 - RNA, 23 nt, Bordetella pertussis
gccgcgccagcugcgcagcgacu

SEQ ID NO: 334252 - RNA, 14 nt, Bordetella pertussis
gccgcgccagcgcc

SEQ ID NO: 334253 - RNA, 15 nt, Bordetella pertussis
gccgcgccagcgccu

SEQ ID NO: 334254 - RNA, 16 nt, Bordetella pertussis
gccgcgccagggcgcg

SEQ ID NO: 334255 - RNA, 21 nt, Bordetella pertussis
gccgcgccagguaggccggcg

SEQ ID NO: 334256 - RNA, 18 nt, Bordetella pertussis
gccgcgccaugcucgcgc

SEQ ID NO: 334257 - RNA, 20 nt, Bordetella pertussis
gccgcgccaugcucgcgcac

SEQ ID NO: 334258 - RNA, 21 nt, Bordetella pertussis
gccgcgccaugcucgcgcaca

SEQ ID NO: 334259 - RNA, 14 nt, Bordetella pertussis
gccgcgcccagcag

SEQ ID NO: 334260 - RNA, 16 nt, Bordetella pertussis
gccgcgcccagcagcg

SEQ ID NO: 334261 - RNA, 15 nt, Bordetella pertussis
gccgcgcccagcaug

SEQ ID NO: 334262 - RNA, 21 nt, Bordetella pertussis
gccgcgcccagcauggucggc

SEQ ID NO: 334263 - RNA, 22 nt, Bordetella pertussis
gccgcgcccagcauggucggca

SEQ ID NO: 334264 - RNA, 16 nt, Bordetella pertussis
gccgcgcccagccgcg

SEQ ID NO: 334265 - RNA, 20 nt, Bordetella pertussis
gccgcgcccagccgcgccau

SEQ ID NO: 334266 - RNA, 13 nt, Bordetella pertussis
gccgcgcccagcg

SEQ ID NO: 334267 - RNA, 13 nt, Bordetella pertussis
gccgcgcccagca

SEQ ID NO: 334268 - RNA, 19 nt, Bordetella pertussis
gccgcgcccagcgcggccu

SEQ ID NO: 334269 - RNA, 15 nt, Bordetella pertussis
gccgcgcccagcgug

SEQ ID NO: 334270 - RNA, 16 nt, Bordetella pertussis
gccgcgcccagguccu

SEQ ID NO: 334271 - RNA, 20 nt, Bordetella pertussis
gccgcgcccaugcgcuggcg

SEQ ID NO: 334272 - RNA, 21 nt, Bordetella pertussis
gccgcgcccaugcgcuggcgc

SEQ ID NO: 334273 - RNA, 23 nt, Bordetella pertussis
gccgcgcccaugcgcuggcgcaa

SEQ ID NO: 334274 - RNA, 18 nt, Bordetella pertussis
gccgcgccccuagcgccg

SEQ ID NO: 334275 - RNA, 19 nt, Bordetella pertussis
gccgcgccccuagcgccgc

SEQ ID NO: 334276 - RNA, 12 nt, Bordetella pertussis
gccgcgcccgca

SEQ ID NO: 334277 - RNA, 18 nt, Bordetella pertussis
gccgcgcccgccgcgcca

SEQ ID NO: 334278 - RNA, 21 nt, Bordetella pertussis
gccgcgcccgccgcgccaugc

SEQ ID NO: 334279 - RNA, 22 nt, Bordetella pertussis
gccgcgcccgcuugcggccggc

SEQ ID NO: 334280 - RNA, 13 nt, Bordetella pertussis
gccgcgcccggcc

SEQ ID NO: 334281 - RNA, 17 nt, Bordetella pertussis
gccgcgcccggccggcc

SEQ ID NO: 334282 - RNA, 12 nt, Bordetella pertussis
gccgcgcccugg

SEQ ID NO: 334283 - RNA, 16 nt, Bordetella pertussis
gccgcgcccuggcgcg

SEQ ID NO: 334284 - RNA, 22 nt, Bordetella pertussis
gccgcgcccuggcgcggcggcg

SEQ ID NO: 334285 - RNA, 10 nt, Bordetella pertussis
gccgcgccgc

SEQ ID NO: 334286 - RNA, 13 nt, Bordetella pertussis
gccgcgccgcccg

SEQ ID NO: 334287 - RNA, 15 nt, Bordetella pertussis
gccgcgccgcccgcg

SEQ ID NO: 334288 - RNA, 13 nt, Bordetella pertussis
gccgcgccgccgc

SEQ ID NO: 334289 - RNA, 18 nt, Bordetella pertussis
gccgcgccgccgcccugg

SEQ ID NO: 334290 - RNA, 21 nt, Bordetella pertussis
gccgcgccgccgcccuggccg

SEQ ID NO: 334291 - RNA, 17 nt, Bordetella pertussis
gccgcgccgcgccgguc

SEQ ID NO: 334292 - RNA, 12 nt, Bordetella pertussis
gccgcgccgcgg

SEQ ID NO: 334293 - RNA, 16 nt, Bordetella pertussis
gccgcgccgcggcacg

SEQ ID NO: 334294 - RNA, 22 nt, Bordetella pertussis
gccgcgccgcggcacggggcau

SEQ ID NO: 334295 - RNA, 14 nt, Bordetella pertussis
gccgcgccgcuggc

SEQ ID NO: 334296 - RNA, 15 nt, Bordetella pertussis
gccgcgccgcuggcg

SEQ ID NO: 334297 - RNA, 16 nt, Bordetella pertussis
gccgcgccgcuggcgg

SEQ ID NO: 334298 - RNA, 13 nt, Bordetella pertussis
gccgcgccgcguu

SEQ ID NO: 334299 - RNA, 14 nt, Bordetella pertussis
gccgcgccggcgcg

SEQ ID NO: 334300 - RNA, 15 nt, Bordetella pertussis
gccgcgccggcgcgc

SEQ ID NO: 334301 - RNA, 17 nt, Bordetella pertussis
gccgcgccggcgcgcga

SEQ ID NO: 334302 - RNA, 22 nt, Bordetella pertussis
gccgcgccggcucccgcgcugc

SEQ ID NO: 334303 - RNA, 21 nt, Bordetella pertussis
gccgcgccgggcgcgccggcg

SEQ ID NO: 334304 - RNA, 17 nt, Bordetella pertussis
gccgcgccggggcggcg

SEQ ID NO: 334305 - RNA, 18 nt, Bordetella pertussis
gccgcgccggggcggcgc

SEQ ID NO: 334306 - RNA, 20 nt, Bordetella pertussis
gccgcgccggggcggcgcag

SEQ ID NO: 334307 - RNA, 12 nt, Bordetella pertussis
gccgcgccgggg

SEQ ID NO: 334308 - RNA, 16 nt, Bordetella pertussis
gccgcgccggucaggc

SEQ ID NO: 334309 - RNA, 18 nt, Bordetella pertussis
gccgcgccggucgccgcg

SEQ ID NO: 334310 - RNA, 23 nt, Bordetella pertussis
gccgcgccuauaucgacggcgcc

SEQ ID NO: 334311 - RNA, 20 nt, Bordetella pertussis
gccgcgccucggacgccugg

SEQ ID NO: 334312 - RNA, 22 nt, Bordetella pertussis
gccgcgccucggacgccuggcg

SEQ ID NO: 334313 - RNA, 23 nt, Bordetella pertussis
gccgcgccucggacgccuggcgc

SEQ ID NO: 334314 - RNA, 19 nt, Bordetella pertussis
gccgcgccgguggccagca

SEQ ID NO: 334315 - RNA, 22 nt, Bordetella pertussis
gccgcgccugcagcagcggcag

SEQ ID NO: 334316 - RNA, 18 nt, Bordetella pertussis
gccgcgcgauccuggggc

SEQ ID NO: 334317 - RNA, 14 nt, Bordetella pertussis
gccgcgcgaucgcc

SEQ ID NO: 334318 - RNA, 14 nt, Bordetella pertussis
gccgcgcgaugcgc

SEQ ID NO: 334319 - RNA, 15 nt, Bordetella pertussis
gccgcgcgaugcgcg

SEQ ID NO: 334320 - RNA, 19 nt, Bordetella pertussis
gccgcgccuugcccgucag

SEQ ID NO: 334321 - RNA, 16 nt, Bordetella pertussis
gccgcgcgcaccggcu

SEQ ID NO: 334322 - RNA, 13 nt, Bordetella pertussis
gccgcgcgcagcg

SEQ ID NO: 334323 - RNA, 14 nt, Bordetella pertussis
gccgcgcgcagcga

SEQ ID NO: 334324 - RNA, 15 nt, Bordetella pertussis
gccgcgcgcagcgag

SEQ ID NO: 334325 - RNA, 20 nt, Bordetella pertussis
gccgcgcgcagcgaggccuc

SEQ ID NO: 334326 - RNA, 12 nt, Bordetella pertussis
gccgcgcgcagg

SEQ ID NO: 334327 - RNA, 20 nt, Bordetella pertussis
gccgcgcgcaucacgcuggc

SEQ ID NO: 334328 - RNA, 21 nt, Bordetella pertussis
gccgcgcgcaucacgcuggcc

SEQ ID NO: 334329 - RNA, 14 nt, Bordetella pertussis
gccgcgcgcaucca

SEQ ID NO: 334330 - RNA, 12 nt, Bordetella pertussis
gccgcgcgccau

SEQ ID NO: 334331 - RNA, 13 nt, Bordetella pertussis
gccgcgcgccauc

SEQ ID NO: 334332 - RNA, 13 nt, Bordetella pertussis
gccgcgcgccgcg

SEQ ID NO: 334333 - RNA, 16 nt, Bordetella pertussis
gccgcgcgccgcgccu

SEQ ID NO: 334334 - RNA, 17 nt, Bordetella pertussis
gccgcgcgccggcgccg

SEQ ID NO: 334335 - RNA, 16 nt, Bordetella pertussis
gccgcgcgccucgaug

SEQ ID NO: 334336 - RNA, 20 nt, Bordetella pertussis
gccgcgcgccugcagcagcg

SEQ ID NO: 334337 - RNA, 16 nt, Bordetella pertussis
gccgcgcgccugcucg

SEQ ID NO: 334338 - RNA, 17 nt, Bordetella pertussis
gccgcgcgccugcucgu

SEQ ID NO: 334339 - RNA, 13 nt, Bordetella pertussis
gccgcgcugccag

SEQ ID NO: 334340 - RNA, 15 nt, Bordetella pertussis
gccgcgcugccagcc

SEQ ID NO: 334341 - RNA, 19 nt, Bordetella pertussis
gccgcgcugcugcaggccg

SEQ ID NO: 334342 - RNA, 23 nt, Bordetella pertussis
gccgcgcugcugcaggccggcgc

SEQ ID NO: 334343 - RNA, 23 nt, Bordetella pertussis
gccgcgcuggaagacguggcccg

SEQ ID NO: 334344 - RNA, 12 nt, Bordetella pertussis
gccgcgcuggcg

SEQ ID NO: 334345 - RNA, 21 nt, Bordetella pertussis
gccgcgcuggcggcgcaggcc

SEQ ID NO: 334346 - RNA, 22 nt, Bordetella pertussis
gccgcgcuggcggcgcaggccg

SEQ ID NO: 334347 - RNA, 17 nt, Bordetella pertussis
gccgcgcugggcgcugc

SEQ ID NO: 334348 - RNA, 23 nt, Bordetella pertussis
gccgcgcugggcgcugcugcugu

SEQ ID NO: 334349 - RNA, 17 nt, Bordetella pertussis
gccgcgcugugcgacga

SEQ ID NO: 334350 - RNA, 20 nt, Bordetella pertussis
gccgcgcuucgucggcgucg

SEQ ID NO: 334351 - RNA, 21 nt, Bordetella pertussis
gccgcggauugccguccuggc

SEQ ID NO: 334352 - RNA, 16 nt, Bordetella pertussis
gccgcggcaagccgcg

SEQ ID NO: 334353 - RNA, 19 nt, Bordetella pertussis
gccgcggcaggccccggcc

SEQ ID NO: 334354 - RNA, 21 nt, Bordetella pertussis
gccgcggcaggccccggcccg

SEQ ID NO: 334355 - RNA, 14 nt, Bordetella pertussis
gccgcggccacgcc

SEQ ID NO: 334356 - RNA, 18 nt, Bordetella pertussis
gccgcggccagcgccgcg

SEQ ID NO: 334357 - RNA, 19 nt, Bordetella pertussis
gccgcggccagcgccgcgc

SEQ ID NO: 334358 - RNA, 14 nt, Bordetella pertussis
gccgcggccaggcc

SEQ ID NO: 334359 - RNA, 15 nt, Bordetella pertussis
gccgcggccaggccc

SEQ ID NO: 334360 - RNA, 16 nt, Bordetella pertussis
gccgcggccaggccca

SEQ ID NO: 334361 - RNA, 14 nt, Bordetella pertussis
gccgcggcccagcg

SEQ ID NO: 334362 - RNA, 17 nt, Bordetella pertussis
gccgcggcccagcgcgg

SEQ ID NO: 334363 - RNA, 13 nt, Bordetella pertussis
gccgcggccgccc

SEQ ID NO: 334364 - RNA, 13 nt, Bordetella pertussis
gccgcggccgccg

SEQ ID NO: 334365 - RNA, 13 nt, Bordetella pertussis
gccgcggccggca

SEQ ID NO: 334366 - RNA, 14 nt, Bordetella pertussis
gccgcggccggcac

SEQ ID NO: 334367 - RNA, 15 nt, Bordetella pertussis
gccgcggccggcacg

SEQ ID NO: 334368 - RNA, 14 nt, Bordetella pertussis
gccgcggccgccgu

SEQ ID NO: 334369 - RNA, 14 nt, Bordetella pertussis
gccgcggccggcgc

SEQ ID NO: 334370 - RNA, 19 nt, Bordetella pertussis
gccgcggccggcggcgccg

SEQ ID NO: 334371 - RNA, 16 nt, Bordetella pertussis
gccgcggccggcgcag

SEQ ID NO: 334372 - RNA, 24 nt, Bordetella pertussis
gccgcgggauucugcugcaugccg

SEQ ID NO: 334373 - RNA, 22 nt, Bordetella pertussis
gccgcgggcaaagcccagcaag

SEQ ID NO: 334374 - RNA, 16 nt, Bordetella pertussis
gccgcgggccgcuggu

SEQ ID NO: 334375 - RNA, 18 nt, Bordetella pertussis
gccgcgggccgcuggucg

SEQ ID NO: 334376 - RNA, 23 nt, Bordetella pertussis
gccgcgggccuacuugccggcgc

SEQ ID NO: 334377 - RNA, 18 nt, Bordetella pertussis
gccgcgggccugcucggc

SEQ ID NO: 334378 - RNA, 14 nt, Bordetella pertussis
gccgcgggcgccgc

SEQ ID NO: 334379 - RNA, 16 nt, Bordetella pertussis
gccgcgggcggccacg

SEQ ID NO: 334380 - RNA, 18 nt, Bordetella pertussis
gccgcgggcggcgccggc

SEQ ID NO: 334381 - RNA, 17 nt, Bordetella pertussis
gccgcgggcggcgcgcc

SEQ ID NO: 334382 - RNA, 23 nt, Bordetella pertussis
gccgcgggcugcgacaggcgcag

SEQ ID NO: 334383 - RNA, 16 nt, Bordetella pertussis
gccgcggggcuggcca

SEQ ID NO: 334384 - RNA, 19 nt, Bordetella pertussis
gccgcggggcuggccagcu

SEQ ID NO: 334385 - RNA, 13 nt, Bordetella pertussis
gccgcggugcugg

SEQ ID NO: 334386 - RNA, 15 nt, Bordetella pertussis
gccgcggugcugggc

SEQ ID NO: 334387 - RNA, 22 nt, Bordetella pertussis
gccgcggugguccagauugcgc

SEQ ID NO: 334388 - RNA, 18 nt, Bordetella pertussis
gccgcgguggcgggcgug

SEQ ID NO: 334389 - RNA, 15 nt, Bordetella pertussis
gccgcguacaacgcc

SEQ ID NO: 334390 - RNA, 17 nt, Bordetella pertussis
gccgcguacaacgccgc

SEQ ID NO: 334391 - RNA, 18 nt, Bordetella pertussis
gccgcguacaacgccgcg

SEQ ID NO: 334392 - RNA, 13 nt, Bordetella pertussis
gccgcgucggccu

SEQ ID NO: 334393 - RNA, 20 nt, Bordetella pertussis
gccgcgucggccucaucgag

SEQ ID NO: 334394 - RNA, 14 nt, Bordetella pertussis
gccgcgucggcgcc

SEQ ID NO: 334395 - RNA, 16 nt, Bordetella pertussis
gccgcgucggcgccga

SEQ ID NO: 334396 - RNA, 17 nt, Bordetella pertussis
gccgcgucuucggcgcg

SEQ ID NO: 334397 - RNA, 18 nt, Bordetella pertussis
gccgcgucuucggcgcgg

SEQ ID NO: 334398 - RNA, 16 nt, Bordetella pertussis
gccgcgugcgccgggc

SEQ ID NO: 334399 - RNA, 15 nt, Bordetella pertussis
gccgcguggcggcgc

SEQ ID NO: 334400 - RNA, 16 nt, Bordetella pertussis
gccgcguggcggcgca

SEQ ID NO: 334401 - RNA, 17 nt, Bordetella pertussis
gccgcguggcggcgcag

SEQ ID NO: 334402 - RNA, 20 nt, Bordetella pertussis
gccgcguggcggcgcagcgc

SEQ ID NO: 334403 - RNA, 23 nt, Bordetella pertussis
gccgcguggcggcgcagcgccca

SEQ ID NO: 334404 - RNA, 15 nt, Bordetella pertussis
gccgcguggccgcgc

SEQ ID NO: 334405 - RNA, 16 nt, Bordetella pertussis
gccgcguggccgcgcu

SEQ ID NO: 334406 - RNA, 17 nt, Bordetella pertussis
gccgcguggccgcgcug

SEQ ID NO: 334407 - RNA, 18 nt, Bordetella pertussis
gccgcguggccgcgcugc

SEQ ID NO: 334408 - RNA, 19 nt, Bordetella pertussis
gccgcguggccgcgcugcu

SEQ ID NO: 334409 - RNA, 15 nt, Bordetella pertussis
gccgcgugguggcgc

SEQ ID NO: 334410 - RNA, 17 nt, Bordetella pertussis
gccgcgugguggcgcag

SEQ ID NO: 334411 - RNA, 22 nt, Bordetella pertussis
gccgcgugguggcgcagauggg

SEQ ID NO: 334412 - RNA, 18 nt, Bordetella pertussis
gccgcguucacgccggcg

SEQ ID NO: 334413 - RNA, 14 nt, Bordetella pertussis
gccgcucagcgcgg

SEQ ID NO: 334414 - RNA, 18 nt, Bordetella pertussis
gccgcucagcgcggcgcg

SEQ ID NO: 334415 - RNA, 21 nt, Bordetella pertussis
gccgcucagcgcggcgcggcc

SEQ ID NO: 334416 - RNA, 14 nt, Bordetella pertussis
gccgcucagguaga

SEQ ID NO: 334417 - RNA, 17 nt, Bordetella pertussis
gccgcucagguagacca

SEQ ID NO: 334418 - RNA, 13 nt, Bordetella pertussis
gccgcucgcgcga

SEQ ID NO: 334419 - RNA, 15 nt, Bordetella pertussis
gccgcucgcgcgacc

SEQ ID NO: 334420 - RNA, 14 nt, Bordetella pertussis
gccgcucggccacg

SEQ ID NO: 334421 - RNA, 15 nt, Bordetella pertussis
gccgcucggccacgc

SEQ ID NO: 334422 - RNA, 21 nt, Bordetella pertussis
gccgcucggccacgcgcugcu

SEQ ID NO: 334423 - RNA, 23 nt, Bordetella pertussis
gccgcucaguucuucgacgggga

SEQ ID NO: 334424 - RNA, 16 nt, Bordetella pertussis
gccgcugaugcuggca

SEQ ID NO: 334425 - RNA, 20 nt, Bordetella pertussis
gccgcugaugcuggcauuga

SEQ ID NO: 334426 - RNA, 21 nt, Bordetella pertussis
gccgcugcagaucaucggcgc

SEQ ID NO: 334427 - RNA, 15 nt, Bordetella pertussis
gccgcugcagcgacu

SEQ ID NO: 334428 - RNA, 14 nt, Bordetella pertussis
gccgcugcagcgcu

SEQ ID NO: 334429 - RNA, 17 nt, Bordetella pertussis
gccgcugcagcgcuggu

SEQ ID NO: 334430 - RNA, 14 nt, Bordetella pertussis
gccgcugcaggccc

SEQ ID NO: 334431 - RNA, 20 nt, Bordetella pertussis
gccgcugcaugggcggcccg

SEQ ID NO: 334432 - RNA, 14 nt, Bordetella pertussis
gccgcugcccagcg

SEQ ID NO: 334433 - RNA, 16 nt, Bordetella pertussis
gccgcugccgcgcgcc

SEQ ID NO: 334434 - RNA, 13 nt, Bordetella pertussis
gccgcuggccacg

SEQ ID NO: 334435 - RNA, 14 nt, Bordetella pertussis
gccgcuggccagcc

SEQ ID NO: 334436 - RNA, 13 nt, Bordetella pertussis
gccgcuggcccgg

SEQ ID NO: 334437 - RNA, 18 nt, Bordetella pertussis
gccgcuggauuucgccgc

SEQ ID NO: 334438 - RNA, 14 nt, Bordetella pertussis
gccgcuggcggccc

SEQ ID NO: 334439 - RNA, 16 nt, Bordetella pertussis
gccgcuggcggcccug

SEQ ID NO: 334440 - RNA, 17 nt, Bordetella pertussis
gccgcuggcggcccugc

SEQ ID NO: 334441 - RNA, 19 nt, Bordetella pertussis
gccgcuggcggcccugccg

SEQ ID NO: 334442 - RNA, 16 nt, Bordetella pertussis
gccgcuggcggccgcg

SEQ ID NO: 334443 - RNA, 13 nt, Bordetella pertussis
gccgcuggcgaug

SEQ ID NO: 334444 - RNA, 16 nt, Bordetella pertussis
gccgcuggcgauggcc

SEQ ID NO: 334445 - RNA, 17 nt, Bordetella pertussis
gccgcuggcgcgccgcc

SEQ ID NO: 334446 - RNA, 18 nt, Bordetella pertussis
gccgcuggcgcgccgccu

SEQ ID NO: 334447 - RNA, 20 nt, Bordetella pertussis
gccgcuggcgucgcgcuucu

SEQ ID NO: 334448 - RNA, 16 nt, Bordetella pertussis
gccgcugggcacaucc

SEQ ID NO: 334449 - RNA, 23 nt, Bordetella pertussis
gccgcugggcacauccagcgcca

SEQ ID NO: 334450 - RNA, 15 nt, Bordetella pertussis
gccgcugucgcaggc

SEQ ID NO: 334451 - RNA, 15 nt, Bordetella pertussis
gccgcugucgcagua

SEQ ID NO: 334452 - RNA, 21 nt, Bordetella pertussis
gccgcugucgcugaucugcuu

SEQ ID NO: 334453 - RNA, 18 nt, Bordetella pertussis
gccgcuggugcugagacg

SEQ ID NO: 334454 - RNA, 14 nt, Bordetella pertussis
gccgcugguggcca

SEQ ID NO: 334455 - RNA, 20 nt, Bordetella pertussis
gccgcuugaaguaaucgccc

SEQ ID NO: 334456 - RNA, 23 nt, Bordetella pertussis
gccgcuugaaguaaucgcccggc

SEQ ID NO: 334457 - RNA, 23 nt, Bordetella pertussis
gccgcuugcccgucaugcgccgc

SEQ ID NO: 334458 - RNA, 17 nt, Bordetella pertussis
gccgcuugcggccaggc

SEQ ID NO: 334459 - RNA, 20 nt, Bordetella pertussis
gccgcuugcguucaugccgg

SEQ ID NO: 334460 - RNA, 16 nt, Bordetella pertussis
gccgcuuggccugcgc

SEQ ID NO: 334461 - RNA, 20 nt, Bordetella pertussis
gccgcuuggccugcgccacc

SEQ ID NO: 334462 - RNA, 18 nt, Bordetella pertussis
gccgcuugucgaugacgc

SEQ ID NO: 334463 - RNA, 21 nt, Bordetella pertussis
gccgcuugucgaugacgcgcc

SEQ ID NO: 334464 - RNA, 22 nt, Bordetella pertussis
gccgcuugucgaugacgcgccg

SEQ ID NO: 334465 - RNA, 16 nt, Bordetella pertussis
gccgcuuucgaccagc

SEQ ID NO: 334466 - RNA, 17 nt, Bordetella pertussis
gccgcuuucgaccagcg

SEQ ID NO: 334467 - RNA, 18 nt, Bordetella pertussis
gccgcuuucgaccagcga

SEQ ID NO: 334468 - RNA, 15 nt, Bordetella pertussis
gccggacaucagcca

SEQ ID NO: 334469 - RNA, 15 nt, Bordetella pertussis
gccggacccgcgccg

SEQ ID NO: 334470 - RNA, 19 nt, Bordetella pertussis
gccggacccgcgccgcagg

SEQ ID NO: 334471 - RNA, 12 nt, Bordetella pertussis
gccggaccuggg

SEQ ID NO: 334472 - RNA, 21 nt, Bordetella pertussis
gccggaccuugcgaggcccgg

SEQ ID NO: 334473 - RNA, 22 nt, Bordetella pertussis
gccggaccuugcgaggcccggc

SEQ ID NO: 334474 - RNA, 14 nt, Bordetella pertussis
gccggacgccgacu

SEQ ID NO: 334475 - RNA, 14 nt, Bordetella pertussis
gccggacggcgccu

SEQ ID NO: 334476 - RNA, 21 nt, Bordetella pertussis
gccggacuugaaucccgacga

SEQ ID NO: 334477 - RNA, 16 nt, Bordetella pertussis
gccggacuggcgcgca

SEQ ID NO: 334478 - RNA, 20 nt, Bordetella pertussis
gccggacugggcgucgcucu

SEQ ID NO: 334479 - RNA, 19 nt, Bordetella pertussis
gccggaggcacuccgucau

SEQ ID NO: 334480 - RNA, 13 nt, Bordetella pertussis
gccggaggcgcgc

SEQ ID NO: 334481 - RNA, 14 nt, Bordetella pertussis
gccggaggcgcgca

SEQ ID NO: 334482 - RNA, 15 nt, Bordetella pertussis
gccggaggucggcgc

SEQ ID NO: 334483 - RNA, 14 nt, Bordetella pertussis
gccggaucggccgg

SEQ ID NO: 334484 - RNA, 19 nt, Bordetella pertussis
gccggaucggccggcagcg

SEQ ID NO: 334485 - RNA, 12 nt, Bordetella pertussis
gccggaugcgca

SEQ ID NO: 334486 - RNA, 23 nt, Bordetella pertussis
gccggaugcgcaggacggcgccg

SEQ ID NO: 334487 - RNA, 13 nt, Bordetella pertussis
gccggaugcgcgu

SEQ ID NO: 334488 - RNA, 17 nt, Bordetella pertussis
gccggcaagaugccggc

SEQ ID NO: 334489 - RNA, 18 nt, Bordetella pertussis
gccggcaagaugccggcc

SEQ ID NO: 334490 - RNA, 17 nt, Bordetella pertussis
gccggcaagcacgaaca

SEQ ID NO: 334491 - RNA, 15 nt, Bordetella pertussis
gccggcaaggggcca

SEQ ID NO: 334492 - RNA, 16 nt, Bordetella pertussis
gccggcaaggggccag

SEQ ID NO: 334493 - RNA, 18 nt, Bordetella pertussis
gccggcaaggggccagcc

SEQ ID NO: 334494 - RNA, 22 nt, Bordetella pertussis
gccggcaaggggccagccuggc

SEQ ID NO: 334495 - RNA, 13 nt, Bordetella pertussis
gccggcaagguca

SEQ ID NO: 334496 - RNA, 18 nt, Bordetella pertussis
gccggcaaggugaucgag

SEQ ID NO: 334497 - RNA, 12 nt, Bordetella pertussis
gccggcaccacg

SEQ ID NO: 334498 - RNA, 14 nt, Bordetella pertussis
gccggcaccacgac

SEQ ID NO: 334499 - RNA, 15 nt, Bordetella pertussis
gccggcaccacgacc

SEQ ID NO: 334500 - RNA, 13 nt, Bordetella pertussis
gccggcaccagcg

SEQ ID NO: 334501 - RNA, 21 nt, Bordetella pertussis
gccggcaccaggauccccagc

SEQ ID NO: 334502 - RNA, 17 nt, Bordetella pertussis
gccggcaccaucugcgu

SEQ ID NO: 334503 - RNA, 19 nt, Bordetella pertussis
gccggcaccaucugcgucg

SEQ ID NO: 334504 - RNA, 18 nt, Bordetella pertussis
gccggcacguaccaggcg

SEQ ID NO: 334505 - RNA, 15 nt, Bordetella pertussis
gccggcacguccggc

SEQ ID NO: 334506 - RNA, 18 nt, Bordetella pertussis
gccggcacguccggcacg

SEQ ID NO: 334507 - RNA, 23 nt, Bordetella pertussis
gccggcacguccggcacggcggc

SEQ ID NO: 334508 - RNA, 21 nt, Bordetella pertussis
gccggcagaucggcgcuggcc

SEQ ID NO: 334509 - RNA, 15 nt, Bordetella pertussis
gccggcagccccagc

SEQ ID NO: 334510 - RNA, 20 nt, Bordetella pertussis
gccggcagccccagcgccca

SEQ ID NO: 334511 - RNA, 21 nt, Bordetella pertussis
gccggcagccccagcgcccag

SEQ ID NO: 334512 - RNA, 15 nt, Bordetella pertussis
gccggcagcgcgacc

SEQ ID NO: 334513 - RNA, 20 nt, Bordetella pertussis
gccggcagcgcgaccggcgc

SEQ ID NO: 334514 - RNA, 13 nt, Bordetella pertussis
gccggcagcggcg

SEQ ID NO: 334515 - RNA, 19 nt, Bordetella pertussis
gccggcaugaagcgcagca

SEQ ID NO: 334516 - RNA, 16 nt, Bordetella pertussis
gccggcaugcgccggc

SEQ ID NO: 334517 - RNA, 19 nt, Bordetella pertussis
gccggcaugcgccggcccg

SEQ ID NO: 334518 - RNA, 22 nt, Bordetella pertussis
gccggcaugcgccggcccggca

SEQ ID NO: 334519 - RNA, 19 nt, Bordetella pertussis
gccggcauugcccaccacg

SEQ ID NO: 334520 - RNA, 21 nt, Bordetella pertussis
gccggcauugcccaccacggc

SEQ ID NO: 334521 - RNA, 21 nt, Bordetella pertussis
gccggcauguugccgcuggug

SEQ ID NO: 334522 - RNA, 18 nt, Bordetella pertussis
gccggcauuucgcugggc

SEQ ID NO: 334523 - RNA, 13 nt, Bordetella pertussis
gccggccagcaag

SEQ ID NO: 334524 - RNA, 14 nt, Bordetella pertussis
gccggccaacagcu

SEQ ID NO: 334525 - RNA, 17 nt, Bordetella pertussis
gccggccaacagcucgc

SEQ ID NO: 334526 - RNA, 19 nt, Bordetella pertussis
gccggccaacagcucgcgc

SEQ ID NO: 334527 - RNA, 20 nt, Bordetella pertussis
gccggccaacagcucgcgcc

SEQ ID NO: 334528 - RNA, 20 nt, Bordetella pertussis
gccggccagcagcgacggcc

SEQ ID NO: 334529 - RNA, 13 nt, Bordetella pertussis
gccggccagccau

SEQ ID NO: 334530 - RNA, 12 nt, Bordetella pertussis
gccggccagcgc

SEQ ID NO: 334531 - RNA, 15 nt, Bordetella pertussis
gccggccagcgccac

SEQ ID NO: 334532 - RNA, 15 nt, Bordetella pertussis
gccggccagcgccag

SEQ ID NO: 334533 - RNA, 18 nt, Bordetella pertussis
gccggccagcgccugggc

SEQ ID NO: 334534 - RNA, 13 nt, Bordetella pertussis
gccggccagcgcg

SEQ ID NO: 334535 - RNA, 15 nt, Bordetella pertussis
gccggccagcgcgcc

SEQ ID NO: 334536 - RNA, 16 nt, Bordetella pertussis
gccggccagcgcgccg

SEQ ID NO: 334537 - RNA, 16 nt, Bordetella pertussis
gccggccauggccgcc

SEQ ID NO: 334538 - RNA, 15 nt, Bordetella pertussis
gccggccauggcggc

SEQ ID NO: 334539 - RNA, 17 nt, Bordetella pertussis
gccggccauggcggccg

SEQ ID NO: 334540 - RNA, 22 nt, Bordetella pertussis
gccggccauggcggccggcguu

SEQ ID NO: 334541 - RNA, 14 nt, Bordetella pertussis
gccggcccaaggcc

SEQ ID NO: 334542 - RNA, 22 nt, Bordetella pertussis
gccggccagcgcggcaucggcc

SEQ ID NO: 334543 - RNA, 14 nt, Bordetella pertussis
gccggccagcggca

SEQ ID NO: 334544 - RNA, 22 nt, Bordetella pertussis
gccggcccaggauggcgccagc

SEQ ID NO: 334545 - RNA, 14 nt, Bordetella pertussis
gccggcccaggcgc

SEQ ID NO: 334546 - RNA, 15 nt, Bordetella pertussis
gccggcccaggcgcg

SEQ ID NO: 334547 - RNA, 22 nt, Bordetella pertussis
gccggcccaggcgcgcuggcgc

SEQ ID NO: 334548 - RNA, 22 nt, Bordetella pertussis
gccggcccaguccagggugucc

SEQ ID NO: 334549 - RNA, 18 nt, Bordetella pertussis
gccggcccaucuguacgg

SEQ ID NO: 334550 - RNA, 22 nt, Bordetella pertussis
gccggcccaucuguacggccgg

SEQ ID NO: 334551 - RNA, 16 nt, Bordetella pertussis
gccgggaugcugcucg

SEQ ID NO: 334552 - RNA, 20 nt, Bordetella pertussis
gccgggaugcugcucggcca

SEQ ID NO: 334553 - RNA, 22 nt, Bordetella pertussis
gccgggaugcugcucggccaug

SEQ ID NO: 334554 - RNA, 21 nt, Bordetella pertussis
gccgggcaagcagauggccau

SEQ ID NO: 334555 - RNA, 16 nt, Bordetella pertussis
gccgggcacaccguca

SEQ ID NO: 334556 - RNA, 23 nt, Bordetella pertussis
gccgggcacaccgucacgcgcaa

SEQ ID NO: 334557 - RNA, 21 nt, Bordetella pertussis
gccgggcagcaucacggugcc

SEQ ID NO: 334558 - RNA, 14 nt, Bordetella pertussis
gccgggcaggccgc

SEQ ID NO: 334559 - RNA, 15 nt, Bordetella pertussis
gccgggcaggccgcg

SEQ ID NO: 334560 - RNA, 16 nt, Bordetella pertussis
gccgggcaggccgcgc

SEQ ID NO: 334561 - RNA, 23 nt, Bordetella pertussis
gccgggcagcgggccgcagcaug

SEQ ID NO: 334562 - RNA, 19 nt, Bordetella pertussis
gccgggcaguucgggcacg

SEQ ID NO: 334563 - RNA, 20 nt, Bordetella pertussis
gccgggcaguucgggcacgc

SEQ ID NO: 334564 - RNA, 17 nt, Bordetella pertussis
gccgggcaugcaccagg

SEQ ID NO: 334565 - RNA, 20 nt, Bordetella pertussis
gccgggcauggcccggcucg

SEQ ID NO: 334566 - RNA, 15 nt, Bordetella pertussis
gccgggcauugccgg

SEQ ID NO: 334567 - RNA, 17 nt, Bordetella pertussis
gccgggcauugccggag

SEQ ID NO: 334568 - RNA, 23 nt, Bordetella pertussis
gccgggccagaccuggugaucgc

SEQ ID NO: 334569 - RNA, 16 nt, Bordetella pertussis
gccgggccacgcgcac

SEQ ID NO: 334570 - RNA, 12 nt, Bordetella pertussis
gccgggccagcg

SEQ ID NO: 334571 - RNA, 15 nt, Bordetella pertussis
gccgggccagcgcga

SEQ ID NO: 334572 - RNA, 17 nt, Bordetella pertussis
gccgggcccggccacgg

SEQ ID NO: 334573 - RNA, 14 nt, Bordetella pertussis
gccgggcccggcgc

SEQ ID NO: 334574 - RNA, 17 nt, Bordetella pertussis
gccgggccgcgaccacg

SEQ ID NO: 334575 - RNA, 19 nt, Bordetella pertussis
gccgggccgugcgccgggc

SEQ ID NO: 334576 - RNA, 20 nt, Bordetella pertussis
gccgggccgugcgccgggcg

SEQ ID NO: 334577 - RNA, 17 nt, Bordetella pertussis
gccgggccuagcccggc

SEQ ID NO: 334578 - RNA, 20 nt, Bordetella pertussis
gccgggccuagcccggcgcc

SEQ ID NO: 334579 - RNA, 22 nt, Bordetella pertussis
gccgggccucaaucgaugaugu

SEQ ID NO: 334580 - RNA, 23 nt, Bordetella pertussis
gccgggccucaaucgaugaugug

SEQ ID NO: 334581 - RNA, 15 nt, Bordetella pertussis
gccgggccggcgggc

SEQ ID NO: 334582 - RNA, 12 nt, Bordetella pertussis
gccgggccugcc

SEQ ID NO: 334583 - RNA, 18 nt, Bordetella pertussis
gccgggcgaaccgguggc

SEQ ID NO: 334584 - RNA, 19 nt, Bordetella pertussis
gccgggcgccgauccagcc

SEQ ID NO: 334585 - RNA, 12 nt, Bordetella pertussis
gccgggcgccgc

SEQ ID NO: 334586 - RNA, 15 nt, Bordetella pertussis
gccgggcgccgcgcc

SEQ ID NO: 334587 - RNA, 13 nt, Bordetella pertussis
gccgggcgccggc

SEQ ID NO: 334588 - RNA, 16 nt, Bordetella pertussis
gccgggcgccggcggc

SEQ ID NO: 334589 - RNA, 14 nt, Bordetella pertussis
gccgggcgcgcgcc

SEQ ID NO: 334590 - RNA, 16 nt, Bordetella pertussis
gccgggcgcgcugccc

SEQ ID NO: 334591 - RNA, 14 nt, Bordetella pertussis
gccgggcgcggcca

SEQ ID NO: 334592 - RNA, 15 nt, Bordetella pertussis
gccgggcgcggcccg

SEQ ID NO: 334593 - RNA, 13 nt, Bordetella pertussis
gccgggcgcggcg

SEQ ID NO: 334594 - RNA, 16 nt, Bordetella pertussis
gccgggcgcggcgccc

SEQ ID NO: 334595 - RNA, 14 nt, Bordetella pertussis
gccgggcgaucgcg

SEQ ID NO: 334596 - RNA, 16 nt, Bordetella pertussis
gccgggcgaucgcguc

SEQ ID NO: 334597 - RNA, 12 nt, Bordetella pertussis
gccgggcgccca

SEQ ID NO: 334598 - RNA, 15 nt, Bordetella pertussis
gccgggcgcccagcg

SEQ ID NO: 334599 - RNA, 21 nt, Bordetella pertussis
gccgggcgcccagcgucucga

SEQ ID NO: 334600 - RNA, 17 nt, Bordetella pertussis
gccgggcggccacggcg

SEQ ID NO: 334601 - RNA, 12 nt, Bordetella pertussis
gccgggcggcgc

SEQ ID NO: 334602 - RNA, 15 nt, Bordetella pertussis
gccgggcggcgccgu

SEQ ID NO: 334603 - RNA, 14 nt, Bordetella pertussis
gccgggcggcgcgg

SEQ ID NO: 334604 - RNA, 24 nt, Bordetella pertussis
gccgggcgggucggcgaacagcgc

SEQ ID NO: 334605 - RNA, 12 nt, Bordetella pertussis
gccgggcucgaa

SEQ ID NO: 334606 - RNA, 19 nt, Bordetella pertussis
gccgggcucgaaguacagc

SEQ ID NO: 334607 - RNA, 15 nt, Bordetella pertussis
gccgggcucgaugac

SEQ ID NO: 334608 - RNA, 19 nt, Bordetella pertussis
gccgggcucgaugaccagc

SEQ ID NO: 334609 - RNA, 16 nt, Bordetella pertussis
gccgggcucggccacc

SEQ ID NO: 334610 - RNA, 15 nt, Bordetella pertussis
gccgggcuccucgcc

SEQ ID NO: 334611 - RNA, 17 nt, Bordetella pertussis
gccgggcuggauccggc

SEQ ID NO: 334612 - RNA, 23 nt, Bordetella pertussis
gccgggcuggauccggcgcuggc

SEQ ID NO: 334613 - RNA, 19 nt, Bordetella pertussis
gccgggcuguccgccacca

SEQ ID NO: 334614 - RNA, 13 nt, Bordetella pertussis
gccgggcuggugc

SEQ ID NO: 334615 - RNA, 15 nt, Bordetella pertussis
gccgggcuggugcgc

SEQ ID NO: 334616 - RNA, 13 nt, Bordetella pertussis
gccgggcuugcgc

SEQ ID NO: 334617 - RNA, 19 nt, Bordetella pertussis
gccggggaaacggccaagc

SEQ ID NO: 334618 - RNA, 20 nt, Bordetella pertussis
gccggggaaacggccaagca

SEQ ID NO: 334619 - RNA, 18 nt, Bordetella pertussis
gccggggaagccgccggc

SEQ ID NO: 334620 - RNA, 20 nt, Bordetella pertussis
gccggggaagccgccggcgu

SEQ ID NO: 334621 - RNA, 16 nt, Bordetella pertussis
gccggggaggccucga

SEQ ID NO: 334622 - RNA, 15 nt, Bordetella pertussis
gccggggcccgcggg

SEQ ID NO: 334623 - RNA, 24 nt, Bordetella pertussis
gccggggcccgcgggcgcccggcc

SEQ ID NO: 334624 - RNA, 14 nt, Bordetella pertussis
gccggggccgccca

SEQ ID NO: 334625 - RNA, 16 nt, Bordetella pertussis
gccggggccgcccagc

SEQ ID NO: 334626 - RNA, 19 nt, Bordetella pertussis
gccggggcgagcgcagccg

SEQ ID NO: 334627 - RNA, 23 nt, Bordetella pertussis
gccggggcgagcgcagccgcucc

SEQ ID NO: 334628 - RNA, 14 nt, Bordetella pertussis
gccggggcgcaccg

SEQ ID NO: 334629 - RNA, 15 nt, Bordetella pertussis
gccggggcgcaccgg

SEQ ID NO: 334630 - RNA, 17 nt, Bordetella pertussis
gccggggcgcaccggca

SEQ ID NO: 334631 - RNA, 18 nt, Bordetella pertussis
gccggggcgcaccggcac

SEQ ID NO: 334632 - RNA, 15 nt, Bordetella pertussis
gccggggggcgcacg

SEQ ID NO: 334633 - RNA, 20 nt, Bordetella pertussis
gccggggggcgcacgccgcg

SEQ ID NO: 334634 - RNA, 16 nt, Bordetella pertussis
gccggggucagcgccg

SEQ ID NO: 334635 - RNA, 21 nt, Bordetella pertussis
gccggggucagcgccggcacg

SEQ ID NO: 334636 - RNA, 21 nt, Bordetella pertussis
gccggggucuugccgcgcagc

SEQ ID NO: 334637 - RNA, 22 nt, Bordetella pertussis
gccggggucuugccgcgcagcg

SEQ ID NO: 334638 - RNA, 23 nt, Bordetella pertussis
gccgggucaucgagguggcgggc

SEQ ID NO: 334639 - RNA, 15 nt, Bordetella pertussis
gccgggucccuggcc

SEQ ID NO: 334640 - RNA, 19 nt, Bordetella pertussis
gccggguccggccgcgcaa

SEQ ID NO: 334641 - RNA, 13 nt, Bordetella pertussis
gccgggucgccgg

SEQ ID NO: 334642 - RNA, 16 nt, Bordetella pertussis
gccgggucgccggugg

SEQ ID NO: 334643 - RNA, 22 nt, Bordetella pertussis
gccgggucgccgguggugucga

SEQ ID NO: 334644 - RNA, 16 nt, Bordetella pertussis
gccgggucgcgcagca

SEQ ID NO: 334645 - RNA, 22 nt, Bordetella pertussis
gccgggucggccugccaccagc

SEQ ID NO: 334646 - RNA, 15 nt, Bordetella pertussis
gccgggucuggccgg

SEQ ID NO: 334647 - RNA, 17 nt, Bordetella pertussis
gccgggucuggccggcc

SEQ ID NO: 334648 - RNA, 17 nt, Bordetella pertussis
gccggguggucgcgccc

SEQ ID NO: 334649 - RNA, 20 nt, Bordetella pertussis
gccggguggucgcgcccgcc

SEQ ID NO: 334650 - RNA, 22 nt, Bordetella pertussis
gccggguguggggggucaggcc

SEQ ID NO: 334651 - RNA, 20 nt, Bordetella pertussis
gccggguguuccggcgcgcg

SEQ ID NO: 334652 - RNA, 18 nt, Bordetella pertussis
gccggguugcaggaugcg

SEQ ID NO: 334653 - RNA, 14 nt, Bordetella pertussis
gccggguugucgcc

SEQ ID NO: 334654 - RNA, 18 nt, Bordetella pertussis
gccggguugucgcccacc

SEQ ID NO: 334655 - RNA, 24 nt, Bordetella pertussis
gccggguuuuccuuuugcgcggcc

SEQ ID NO: 334656 - RNA, 20 nt, Bordetella pertussis
gccggguuuuuacaugccgc

SEQ ID NO: 334657 - RNA, 17 nt, Bordetella pertussis
gccgguaaccgacgcag

SEQ ID NO: 334658 - RNA, 22 nt, Bordetella pertussis
gccgguaaccgacgcagcgcac

SEQ ID NO: 334659 - RNA, 23 nt, Bordetella pertussis
gccgguaaccgacgcagcgcacc

SEQ ID NO: 334660 - RNA, 19 nt, Bordetella pertussis
gccgguaaggcgcuugcgc

SEQ ID NO: 334661 - RNA, 21 nt, Bordetella pertussis
gccgguaaggcgcuugcgcag

SEQ ID NO: 334662 - RNA, 18 nt, Bordetella pertussis
gccgguacagccaggcca

SEQ ID NO: 334663 - RNA, 19 nt, Bordetella pertussis
gccgguacagccaggccag

SEQ ID NO: 334664 - RNA, 15 nt, Bordetella pertussis
gccgguagcgcuggg

SEQ ID NO: 334665 - RNA, 16 nt, Bordetella pertussis
gccgguagcgcugggc

SEQ ID NO: 334666 - RNA, 20 nt, Bordetella pertussis
gccgguagcgcugggcgcca

SEQ ID NO: 334667 - RNA, 23 nt, Bordetella pertussis
gccgguagcgcugggcgccagca

SEQ ID NO: 334668 - RNA, 16 nt, Bordetella pertussis
gccgguaucgacgcgc

SEQ ID NO: 334669 - RNA, 15 nt, Bordetella pertussis
gccgguaucgcggcg

SEQ ID NO: 334670 - RNA, 22 nt, Bordetella pertussis
gccgguaucgguguggugcugc

SEQ ID NO: 334671 - RNA, 15 nt, Bordetella pertussis
gccggucaccgccgc

SEQ ID NO: 334672 - RNA, 20 nt, Bordetella pertussis
gccggucaccgccgccgcca

SEQ ID NO: 334673 - RNA, 16 nt, Bordetella pertussis
gccggucacgcuggug

SEQ ID NO: 334674 - RNA, 15 nt, Bordetella pertussis
gccggucacugccga

SEQ ID NO: 334675 - RNA, 19 nt, Bordetella pertussis
gccggucacugccgaaacg

SEQ ID NO: 334676 - RNA, 17 nt, Bordetella pertussis
gccggucagcccaggcg

SEQ ID NO: 334677 - RNA, 19 nt, Bordetella pertussis
gccggucaggaaguccugg

SEQ ID NO: 334678 - RNA, 20 nt, Bordetella pertussis
gccggucaggaaguccuggu

SEQ ID NO: 334679 - RNA, 21 nt, Bordetella pertussis
gccggucagggaggcuguccc

SEQ ID NO: 334680 - RNA, 16 nt, Bordetella pertussis
gccggucaugaagucc

SEQ ID NO: 334681 - RNA, 14 nt, Bordetella pertussis
gccgguccagcgcc

SEQ ID NO: 334682 - RNA, 15 nt, Bordetella pertussis
gccgguccagcgccc

SEQ ID NO: 334683 - RNA, 22 nt, Bordetella pertussis
gccgguccgcucgaggccaggc

SEQ ID NO: 334684 - RNA, 24 nt, Bordetella pertussis
gccgguccgcucgaggccaggcug

SEQ ID NO: 334685 - RNA, 14 nt, Bordetella pertussis
gccggucgccgcgg

SEQ ID NO: 334686 - RNA, 16 nt, Bordetella pertussis
gccggucgccagcgau

SEQ ID NO: 334687 - RNA, 16 nt, Bordetella pertussis
gccggucggccgcucc

SEQ ID NO: 334688 - RNA, 20 nt, Bordetella pertussis
gccggucuaugucgaggacc

SEQ ID NO: 334689 - RNA, 15 nt, Bordetella pertussis
gccggucugggcgcg

SEQ ID NO: 334690 - RNA, 16 nt, Bordetella pertussis
gccggugaacaccagg

SEQ ID NO: 334691 - RNA, 13 nt, Bordetella pertussis
gccggugaccgca

SEQ ID NO: 334692 - RNA, 17 nt, Bordetella pertussis
gccggugaccgccagca

SEQ ID NO: 334693 - RNA, 18 nt, Bordetella pertussis
gccggugaccgccagcag

SEQ ID NO: 334694 - RNA, 12 nt, Bordetella pertussis
gccggugaccgc

SEQ ID NO: 334695 - RNA, 17 nt, Bordetella pertussis
gccggugaugcggcgcg

SEQ ID NO: 334696 - RNA, 20 nt, Bordetella pertussis
gccggugaugcggcgcgccg

SEQ ID NO: 334697 - RNA, 16 nt, Bordetella pertussis
gccggugcaccaggcc

SEQ ID NO: 334698 - RNA, 17 nt, Bordetella pertussis
gccggugcaucggccgg

SEQ ID NO: 334699 - RNA, 21 nt, Bordetella pertussis
gccggugcaucggccggcggu

SEQ ID NO: 334700 - RNA, 15 nt, Bordetella pertussis
gccggugccaguccc

SEQ ID NO: 334701 - RNA, 18 nt, Bordetella pertussis
gccggugcgcacauggcg

SEQ ID NO: 334702 - RNA, 14 nt, Bordetella pertussis
gccggugcgcagca

SEQ ID NO: 334703 - RNA, 19 nt, Bordetella pertussis
gccggugcgcagcaccagc

SEQ ID NO: 334704 - RNA, 21 nt, Bordetella pertussis
gccggugcgcagcaccagcau

SEQ ID NO: 334705 - RNA, 22 nt, Bordetella pertussis
gccggugcgcagcaccagcaug

SEQ ID NO: 334706 - RNA, 14 nt, Bordetella pertussis
gccggugcgcggcg

SEQ ID NO: 334707 - RNA, 17 nt, Bordetella pertussis
gccggugcgcggcgccc

SEQ ID NO: 334708 - RNA, 14 nt, Bordetella pertussis
gccggugcgcggcu

SEQ ID NO: 334709 - RNA, 19 nt, Bordetella pertussis
gccggugcgcgugggcacc

SEQ ID NO: 334710 - RNA, 22 nt, Bordetella pertussis
gccggugcguuccaugacgucc

SEQ ID NO: 334711 - RNA, 16 nt, Bordetella pertussis
gccggugcucggccag

SEQ ID NO: 334712 - RNA, 18 nt, Bordetella pertussis
gccggugcucggccagcg

SEQ ID NO: 334713 - RNA, 20 nt, Bordetella pertussis
gccggugcucggccagcgcg

SEQ ID NO: 334714 - RNA, 21 nt, Bordetella pertussis
gccggugcucggccagcgcgc

SEQ ID NO: 334715 - RNA, 20 nt, Bordetella pertussis
gccgguggaccagggcacgg

SEQ ID NO: 334716 - RNA, 15 nt, Bordetella pertussis
gccgguggccagcag

SEQ ID NO: 334717 - RNA, 13 nt, Bordetella pertussis
gccggugggcgag

SEQ ID NO: 334718 - RNA, 23 nt, Bordetella pertussis
gccgguggugcccaucgcgcuga

SEQ ID NO: 334719 - RNA, 15 nt, Bordetella pertussis
gccgguggugucgaa

SEQ ID NO: 334720 - RNA, 22 nt, Bordetella pertussis
gccgguggugucgaacagcgag

SEQ ID NO: 334721 - RNA, 16 nt, Bordetella pertussis
gccggugucggggccg

SEQ ID NO: 334722 - RNA, 20 nt, Bordetella pertussis
gccguauagcgguacucgcg

SEQ ID NO: 334723 - RNA, 20 nt, Bordetella pertussis
gccguaucgcguggcgcgcc

SEQ ID NO: 334724 - RNA, 16 nt, Bordetella pertussis
gccgucaacagcaugg

SEQ ID NO: 334725 - RNA, 13 nt, Bordetella pertussis
gccgucaacgccc

SEQ ID NO: 334726 - RNA, 21 nt, Bordetella pertussis
gccgucaagcguucauggcgc

SEQ ID NO: 334727 - RNA, 21 nt, Bordetella pertussis
gccgucaagcguucauggcgu

SEQ ID NO: 334728 - RNA, 14 nt, Bordetella pertussis
gccgucaccgccgc

SEQ ID NO: 334729 - RNA, 22 nt, Bordetella pertussis
gccgucaccggcuacgaccuga

SEQ ID NO: 334730 - RNA, 16 nt, Bordetella pertussis
gccgucacgcgugaau

SEQ ID NO: 334731 - RNA, 23 nt, Bordetella pertussis
gccgucacgcgugaauaccgcgc

SEQ ID NO: 334732 - RNA, 14 nt, Bordetella pertussis
gccgucagcagcag

SEQ ID NO: 334733 - RNA, 17 nt, Bordetella pertussis
gccgucagcagcaggcu

SEQ ID NO: 334734 - RNA, 19 nt, Bordetella pertussis
gccgucagcagcaggcugg

SEQ ID NO: 334735 - RNA, 22 nt, Bordetella pertussis
gccgucagcagcaggcuggcca

SEQ ID NO: 334736 - RNA, 18 nt, Bordetella pertussis
gccgucagcagcgcggcg

SEQ ID NO: 334737 - RNA, 21 nt, Bordetella pertussis
gccgucagcagcgcggcgccg

SEQ ID NO: 334738 - RNA, 15 nt, Bordetella pertussis
gccguccacgaaggc

SEQ ID NO: 334739 - RNA, 12 nt, Bordetella pertussis
gccguccacgcc

SEQ ID NO: 334740 - RNA, 15 nt, Bordetella pertussis
gccguccacgcccag

SEQ ID NO: 334741 - RNA, 17 nt, Bordetella pertussis
gccguccacgcccagcg

SEQ ID NO: 334742 - RNA, 22 nt, Bordetella pertussis
gccguccacgcccagcgccggc

SEQ ID NO: 334743 - RNA, 16 nt, Bordetella pertussis
gccguccacgccgcgc

SEQ ID NO: 334744 - RNA, 19 nt, Bordetella pertussis
gccguccacgccgcgcgcg

SEQ ID NO: 334745 - RNA, 15 nt, Bordetella pertussis
gccguccagcgcggc

SEQ ID NO: 334746 - RNA, 17 nt, Bordetella pertussis
gccguccagcgcggcau

SEQ ID NO: 334747 - RNA, 19 nt, Bordetella pertussis
gccguccagcgcggcaugc

SEQ ID NO: 334748 - RNA, 16 nt, Bordetella pertussis
gccguccagcgcggcg

SEQ ID NO: 334749 - RNA, 20 nt, Bordetella pertussis
gccguccagcgcggcgccau

SEQ ID NO: 334750 - RNA, 16 nt, Bordetella pertussis
gccguccgcaucgcgc

SEQ ID NO: 334751 - RNA, 17 nt, Bordetella pertussis
gccguccgcaucgcgca

SEQ ID NO: 334752 - RNA, 13 nt, Bordetella pertussis
gccguccgggccg

SEQ ID NO: 334753 - RNA, 14 nt, Bordetella pertussis
gccguccgggccgg

SEQ ID NO: 334754 - RNA, 15 nt, Bordetella pertussis
gccguccgggccggu

SEQ ID NO: 334755 - RNA, 16 nt, Bordetella pertussis
gccguccucaggcccg

SEQ ID NO: 334756 - RNA, 16 nt, Bordetella pertussis
gccguccucgcgggcc

SEQ ID NO: 334757 - RNA, 19 nt, Bordetella pertussis
gccguccucgcgggccugg

SEQ ID NO: 334758 - RNA, 16 nt, Bordetella pertussis
gccguccggccgugcc

SEQ ID NO: 334759 - RNA, 21 nt, Bordetella pertussis
gccguccgugagugcagcgcu

SEQ ID NO: 334760 - RNA, 14 nt, Bordetella pertussis
gccguccugcugcg

SEQ ID NO: 334761 - RNA, 18 nt, Bordetella pertussis
gccguccugcugcggcac

SEQ ID NO: 334762 - RNA, 16 nt, Bordetella pertussis
gccguccuggccguca

SEQ ID NO: 334763 - RNA, 21 nt, Bordetella pertussis
gccguccuggcgaccggcggc

SEQ ID NO: 334764 - RNA, 14 nt, Bordetella pertussis
gccguccuuggcgc

SEQ ID NO: 334765 - RNA, 16 nt, Bordetella pertussis
gccguccuuggcgccg

SEQ ID NO: 334766 - RNA, 22 nt, Bordetella pertussis
gccgucgaaacacgaugccucg

SEQ ID NO: 334767 - RNA, 13 nt, Bordetella pertussis
gccgucgaacucc

SEQ ID NO: 334768 - RNA, 17 nt, Bordetella pertussis
gccgucgaagccggcgc

SEQ ID NO: 334769 - RNA, 19 nt, Bordetella pertussis
gccgucgaagccggcgcca

SEQ ID NO: 334770 - RNA, 21 nt, Bordetella pertussis
gccgucgaagccggcgccauc

SEQ ID NO: 334771 - RNA, 22 nt, Bordetella pertussis
gccgucgaagccggcgccaucg

SEQ ID NO: 334772 - RNA, 16 nt, Bordetella pertussis
gccgucgaaggccgca

SEQ ID NO: 334773 - RNA, 19 nt, Bordetella pertussis
gccgucgaucccaucgcgc

SEQ ID NO: 334774 - RNA, 18 nt, Bordetella pertussis
gccgucgaugaugcgguu

SEQ ID NO: 334775 - RNA, 21 nt, Bordetella pertussis
gccgucgaugaugcgguugau

SEQ ID NO: 334776 - RNA, 12 nt, Bordetella pertussis
gccgucgcacug

SEQ ID NO: 334777 - RNA, 17 nt, Bordetella pertussis
gccgucgccagcgacga

SEQ ID NO: 334778 - RNA, 16 nt, Bordetella pertussis
gccgucgcccuggcgg

SEQ ID NO: 334779 - RNA, 17 nt, Bordetella pertussis
gccgucgcccuggcggc

SEQ ID NO: 334780 - RNA, 17 nt, Bordetella pertussis
gccgucgcgcucggacg

SEQ ID NO: 334781 - RNA, 21 nt, Bordetella pertussis
gccgucgcgcuguuccagcca

SEQ ID NO: 334782 - RNA, 12 nt, Bordetella pertussis
gccgucgcgcuc

SEQ ID NO: 334783 - RNA, 19 nt, Bordetella pertussis
gccgucgcggaccuccugg

SEQ ID NO: 334784 - RNA, 16 nt, Bordetella pertussis
gccgucggccacgucc

SEQ ID NO: 334785 - RNA, 12 nt, Bordetella pertussis
gccgucggccag

SEQ ID NO: 334786 - RNA, 17 nt, Bordetella pertussis
gccgucgucaucgccau

SEQ ID NO: 334787 - RNA, 19 nt, Bordetella pertussis
gccgucgucaucgccaucg

SEQ ID NO: 334788 - RNA, 17 nt, Bordetella pertussis
gccgucgugcgccuggc

SEQ ID NO: 334789 - RNA, 20 nt, Bordetella pertussis
gccgucgucguccaggcgca

SEQ ID NO: 334790 - RNA, 14 nt, Bordetella pertussis
gccgucgugcagcg

SEQ ID NO: 334791 - RNA, 19 nt, Bordetella pertussis
gccgucuacaggcccagcg

SEQ ID NO: 334792 - RNA, 18 nt, Bordetella pertussis
gccgucucgugccccgca

SEQ ID NO: 334793 - RNA, 21 nt, Bordetella pertussis
gccgucucgugccccgcaugc

SEQ ID NO: 334794 - RNA, 15 nt, Bordetella pertussis
gccgucugcgccgcc

SEQ ID NO: 334795 - RNA, 21 nt, Bordetella pertussis
gccgucugcgccgccgcgugg

SEQ ID NO: 334796 - RNA, 14 nt, Bordetella pertussis
gccgucuggcggca

SEQ ID NO: 334797 - RNA, 15 nt, Bordetella pertussis
gccgucugugcgccc

SEQ ID NO: 334798 - RNA, 21 nt, Bordetella pertussis
gccgucugugcgccccgcugg

SEQ ID NO: 334799 - RNA, 21 nt, Bordetella pertussis
gccgucuugaggauaucggcc

SEQ ID NO: 334800 - RNA, 23 nt, Bordetella pertussis
gccgucuugaggauaucggccag

SEQ ID NO: 334801 - RNA, 17 nt, Bordetella pertussis
gccgugaaugcgccugg

SEQ ID NO: 334802 - RNA, 19 nt, Bordetella pertussis
gccgugaaugcgccuggcg

SEQ ID NO: 334803 - RNA, 15 nt, Bordetella pertussis
gccgugaccugcucg

SEQ ID NO: 334804 - RNA, 19 nt, Bordetella pertussis
gccgugaccugcucgucgc

SEQ ID NO: 334805 - RNA, 21 nt, Bordetella pertussis
gccgugaccugcucgucgcca

SEQ ID NO: 334806 - RNA, 17 nt, Bordetella pertussis
gccgugacgcugauggc

SEQ ID NO: 334807 - RNA, 17 nt, Bordetella pertussis
gccgugacguugagcgc

SEQ ID NO: 334808 - RNA, 22 nt, Bordetella pertussis
gccgugacguugagcgccgggg

SEQ ID NO: 334809 - RNA, 21 nt, Bordetella pertussis
gccgugacuucggccgccagc

SEQ ID NO: 334810 - RNA, 23 nt, Bordetella pertussis
gccgugacuucggccgccagccg

SEQ ID NO: 334811 - RNA, 14 nt, Bordetella pertussis
gccgugagcgccgc

SEQ ID NO: 334812 - RNA, 20 nt, Bordetella pertussis
gccgugagcgccgccgccau

SEQ ID NO: 334813 - RNA, 21 nt, Bordetella pertussis
gccgugagcgccgccgccaug

SEQ ID NO: 334814 - RNA, 22 nt, Bordetella pertussis
gccgugagcgccgccgccaugg

SEQ ID NO: 334815 - RNA, 18 nt, Bordetella pertussis
gccgugaucuugaugccg

SEQ ID NO: 334816 - RNA, 16 nt, Bordetella pertussis
gccgugaugccgcccg

SEQ ID NO: 334817 - RNA, 14 nt, Bordetella pertussis
gccgugcagacggc

SEQ ID NO: 334818 - RNA, 13 nt, Bordetella pertussis
gccgugcagaugg

SEQ ID NO: 334819 - RNA, 15 nt, Bordetella pertussis
gccgugcagauggcg

SEQ ID NO: 334820 - RNA, 15 nt, Bordetella pertussis
gccgugcgccagcgc

SEQ ID NO: 334821 - RNA, 13 nt, Bordetella pertussis
gccgugcgcgggc

SEQ ID NO: 334822 - RNA, 18 nt, Bordetella pertussis
gccgugcugaucgacaug

SEQ ID NO: 334823 - RNA, 22 nt, Bordetella pertussis
gccguucuggcagugcgccugg

SEQ ID NO: 334824 - RNA, 14 nt, Bordetella pertussis
gccguucuggcugc

SEQ ID NO: 334825 - RNA, 17 nt, Bordetella pertussis
gccguucuucgaucgcc

SEQ ID NO: 334826 - RNA, 14 nt, Bordetella pertussis
gccguugaucuggu

SEQ ID NO: 334827 - RNA, 18 nt, Bordetella pertussis
gccguugaucugguucau

SEQ ID NO: 334828 - RNA, 13 nt, Bordetella pertussis
gccguugccgcug

SEQ ID NO: 334829 - RNA, 23 nt, Bordetella pertussis
gccguugccgcuguggcgcgcca

SEQ ID NO: 334830 - RNA, 15 nt, Bordetella pertussis
gccguugcgccagcg

SEQ ID NO: 334831 - RNA, 18 nt, Bordetella pertussis
gccguugcgccagcggcg

SEQ ID NO: 334832 - RNA, 14 nt, Bordetella pertussis
gccguugcuccagc

SEQ ID NO: 334833 - RNA, 18 nt, Bordetella pertussis
gccguugcucgcgcgcag

SEQ ID NO: 334834 - RNA, 19 nt, Bordetella pertussis
gccguuggccagcgccgcc

SEQ ID NO: 334835 - RNA, 15 nt, Bordetella pertussis
gccguuggcgauggc

SEQ ID NO: 334836 - RNA, 17 nt, Bordetella pertussis
gccguuggcgauggcgc

SEQ ID NO: 334837 - RNA, 14 nt, Bordetella pertussis
gccguuggcgccca

SEQ ID NO: 334838 - RNA, 17 nt, Bordetella pertussis
gccguuggcgcccagcg

SEQ ID NO: 334839 - RNA, 14 nt, Bordetella pertussis
gccguuggcgcgcc

SEQ ID NO: 334840 - RNA, 19 nt, Bordetella pertussis
gccguuggagccggagcag

SEQ ID NO: 334841 - RNA, 12 nt, Bordetella pertussis
gccguuggcgug

SEQ ID NO: 334842 - RNA, 18 nt, Bordetella pertussis
gccguuggcgugcagcca

SEQ ID NO: 334843 - RNA, 21 nt, Bordetella pertussis
gccguuguccgccugcggacg

SEQ ID NO: 334844 - RNA, 16 nt, Bordetella pertussis
gccguuguccuggcgc

SEQ ID NO: 334845 - RNA, 17 nt, Bordetella pertussis
gccguuguccuggcgcg

SEQ ID NO: 334846 - RNA, 15 nt, Bordetella pertussis
gccuacuugccggcg

SEQ ID NO: 334847 - RNA, 17 nt, Bordetella pertussis
gccuacuugccggcgcu

SEQ ID NO: 334848 - RNA, 21 nt, Bordetella pertussis
gccuacuugccggcgcucagc

SEQ ID NO: 334849 - RNA, 15 nt, Bordetella pertussis
gccuaggcugcagcc

SEQ ID NO: 334850 - RNA, 16 nt, Bordetella pertussis
gccuaggcugcagcca

SEQ ID NO: 334851 - RNA, 15 nt, Bordetella pertussis
gccuauaucgacggc

SEQ ID NO: 334852 - RNA, 20 nt, Bordetella pertussis
gccuaugaagacgcgcucgc

SEQ ID NO: 334853 - RNA, 17 nt, Bordetella pertussis
gccuauguaggcgccgc

SEQ ID NO: 334854 - RNA, 20 nt, Bordetella pertussis
gccuauuggcuguaucuggc

SEQ ID NO: 334855 - RNA, 23 nt, Bordetella pertussis
gccuauuggcuguaucuggccug

SEQ ID NO: 334856 - RNA, 16 nt, Bordetella pertussis
gccuauuuggcggccu

SEQ ID NO: 334857 - RNA, 14 nt, Bordetella pertussis
gccucaacuggccg

SEQ ID NO: 334858 - RNA, 21 nt, Bordetella pertussis
gccucaacuggccggccuggc

SEQ ID NO: 334859 - RNA, 20 nt, Bordetella pertussis
gccucacuccauagcgccgc

SEQ ID NO: 334860 - RNA, 22 nt, Bordetella pertussis
gccucagaccacgacggucugg

SEQ ID NO: 334861 - RNA, 13 nt, Bordetella pertussis
gccuccgcgcaca

SEQ ID NO: 334862 - RNA, 20 nt, Bordetella pertussis
gccuccgcgcacagcgcggc

SEQ ID NO: 334863 - RNA, 23 nt, Bordetella pertussis
gccuccgcgccgaccacgcuggg

SEQ ID NO: 334864 - RNA, 12 nt, Bordetella pertussis
gccuccggcagg

SEQ ID NO: 334865 - RNA, 14 nt, Bordetella pertussis
gccucgaacguccg

SEQ ID NO: 334866 - RNA, 15 nt, Bordetella pertussis
gccucgaacguccgc

SEQ ID NO: 334867 - RNA, 22 nt, Bordetella pertussis
gccucgaagcggcucaggcgcg

SEQ ID NO: 334868 - RNA, 22 nt, Bordetella pertussis
gccucgaagaccucggcgcuca

SEQ ID NO: 334869 - RNA, 12 nt, Bordetella pertussis
gccucgaccggc

SEQ ID NO: 334870 - RNA, 13 nt, Bordetella pertussis
gccucgaccggcg

SEQ ID NO: 334871 - RNA, 14 nt, Bordetella pertussis
gccucgacgauggc

SEQ ID NO: 334872 - RNA, 18 nt, Bordetella pertussis
gccucgagguauucgcgc

SEQ ID NO: 334873 - RNA, 22 nt, Bordetella pertussis
gccucgagguauucgcgcgauu

SEQ ID NO: 334874 - RNA, 15 nt, Bordetella pertussis
gccucgagguggcgc

SEQ ID NO: 334875 - RNA, 22 nt, Bordetella pertussis
gccucgaguuugcgguccaugu

SEQ ID NO: 334876 - RNA, 17 nt, Bordetella pertussis
gccucgaucgccagguc

SEQ ID NO: 334877 - RNA, 19 nt, Bordetella pertussis
gccucgaucgccaggucgg

SEQ ID NO: 334878 - RNA, 22 nt, Bordetella pertussis
gccucgaucgccaggucggcca

SEQ ID NO: 334879 - RNA, 16 nt, Bordetella pertussis
gccucgaugcccucgc

SEQ ID NO: 334880 - RNA, 21 nt, Bordetella pertussis
gccucgaugcccucgcgcacg

SEQ ID NO: 334881 - RNA, 18 nt, Bordetella pertussis
gccucgaugguggcgaug

SEQ ID NO: 334882 - RNA, 18 nt, Bordetella pertussis
gccucgaugucaucgccc

SEQ ID NO: 334883 - RNA, 12 nt, Bordetella pertussis
gccucgcaucgg

SEQ ID NO: 334884 - RNA, 18 nt, Bordetella pertussis
gccucgcaucggccugca

SEQ ID NO: 334885 - RNA, 20 nt, Bordetella pertussis
gccucgcaucggccugcacc

SEQ ID NO: 334886 - RNA, 16 nt, Bordetella pertussis
gccucgcccgaucggc

SEQ ID NO: 334887 - RNA, 19 nt, Bordetella pertussis
gccucgcccgaucggccgg

SEQ ID NO: 334888 - RNA, 21 nt, Bordetella pertussis
gccucgcgacggccucccgcc

SEQ ID NO: 334889 - RNA, 16 nt, Bordetella pertussis
gccucgcgcagggcgg

SEQ ID NO: 334890 - RNA, 15 nt, Bordetella pertussis
gccucgcgcuccagc

SEQ ID NO: 334891 - RNA, 16 nt, Bordetella pertussis
gccucgcgcuccagca

SEQ ID NO: 334892 - RNA, 14 nt, Bordetella pertussis
gccucgcgcuccau

SEQ ID NO: 334893 - RNA, 13 nt, Bordetella pertussis
gccucgcgcucga

SEQ ID NO: 334894 - RNA, 16 nt, Bordetella pertussis
gccucgcgcucgagcg

SEQ ID NO: 334895 - RNA, 19 nt, Bordetella pertussis
gccucgcgcucgagcgcgg

SEQ ID NO: 334896 - RNA, 21 nt, Bordetella pertussis
gccucgcgcucgagcgcggcg

SEQ ID NO: 334897 - RNA, 22 nt, Bordetella pertussis
gccucgcgcucgagcgcggcgc

SEQ ID NO: 334898 - RNA, 13 nt, Bordetella pertussis
gccucgcgcucgc

SEQ ID NO: 334899 - RNA, 15 nt, Bordetella pertussis
gccucgcgcucgcgc

SEQ ID NO: 334900 - RNA, 19 nt, Bordetella pertussis
gccucgcggcgcagcauga

SEQ ID NO: 334901 - RNA, 14 nt, Bordetella pertussis
gccucgcggcgcgu

SEQ ID NO: 334902 - RNA, 22 nt, Bordetella pertussis
gccucgcgggccuuggccagca

SEQ ID NO: 334903 - RNA, 14 nt, Bordetella pertussis
gccucgcugccagg

SEQ ID NO: 334904 - RNA, 16 nt, Bordetella pertussis
gccucgcugccagggu

SEQ ID NO: 334905 - RNA, 18 nt, Bordetella pertussis
gccucgcugcgggcggcc

SEQ ID NO: 334906 - RNA, 16 nt, Bordetella pertussis
gccugcccgucgggca

SEQ ID NO: 334907 - RNA, 17 nt, Bordetella pertussis
gccugcccgucgggcag

SEQ ID NO: 334908 - RNA, 23 nt, Bordetella pertussis
gccugcccgucgggcaggucggc

SEQ ID NO: 334909 - RNA, 19 nt, Bordetella pertussis
gccugcccguucacgcgca

SEQ ID NO: 334910 - RNA, 21 nt, Bordetella pertussis
gccugcccucgggcgacaggc

SEQ ID NO: 334911 - RNA, 14 nt, Bordetella pertussis
gccugccgagcgcu

SEQ ID NO: 334912 - RNA, 16 nt, Bordetella pertussis
gccugccgagcgcugc

SEQ ID NO: 334913 - RNA, 17 nt, Bordetella pertussis
gccugccgagcgcugcg

SEQ ID NO: 334914 - RNA, 16 nt, Bordetella pertussis
gccugccgaucgugca

SEQ ID NO: 334915 - RNA, 22 nt, Bordetella pertussis
gccugccgaucgugcacgcccg

SEQ ID NO: 334916 - RNA, 15 nt, Bordetella pertussis
gccugccgcgcccgg

SEQ ID NO: 334917 - RNA, 21 nt, Bordetella pertussis
gccugccgcgccgaccggccc

SEQ ID NO: 334918 - RNA, 13 nt, Bordetella pertussis
gccugccgcgcgu

SEQ ID NO: 334919 - RNA, 14 nt, Bordetella pertussis
gccugccgcggccg

SEQ ID NO: 334920 - RNA, 13 nt, Bordetella pertussis
gccugccggccgg

SEQ ID NO: 334921 - RNA, 14 nt, Bordetella pertussis
gccugccggccugg

SEQ ID NO: 334922 - RNA, 15 nt, Bordetella pertussis
gccugccggccuggc

SEQ ID NO: 334923 - RNA, 14 nt, Bordetella pertussis
gccugccggcgcac

SEQ ID NO: 334924 - RNA, 22 nt, Bordetella pertussis
gccugccggcgcacaaucugcg

SEQ ID NO: 334925 - RNA, 17 nt, Bordetella pertussis
gccugccggcgcgccca

SEQ ID NO: 334926 - RNA, 16 nt, Bordetella pertussis
gccugccggcgcgccu

SEQ ID NO: 334927 - RNA, 20 nt, Bordetella pertussis
gccugccggcggccuaugug

SEQ ID NO: 334928 - RNA, 15 nt, Bordetella pertussis
gccugccugauggcg

SEQ ID NO: 334929 - RNA, 16 nt, Bordetella pertussis
gccugccugauggcgc

SEQ ID NO: 334930 - RNA, 17 nt, Bordetella pertussis
gccugcgaacgcccggc

SEQ ID NO: 334931 - RNA, 18 nt, Bordetella pertussis
gccugcgaacgcccggcc

SEQ ID NO: 334932 - RNA, 19 nt, Bordetella pertussis
gccugcgaacgcccggccc

SEQ ID NO: 334933 - RNA, 21 nt, Bordetella pertussis
gccugcgaacgcccggcccag

SEQ ID NO: 334934 - RNA, 22 nt, Bordetella pertussis
gccugcgagagauagcccagca

SEQ ID NO: 334935 - RNA, 16 nt, Bordetella pertussis
gccugcgaugccggcg

SEQ ID NO: 334936 - RNA, 18 nt, Bordetella pertussis
gccugcgccaccuggcgc

SEQ ID NO: 334937 - RNA, 18 nt, Bordetella pertussis
gccugcgccacguccagc

SEQ ID NO: 334938 - RNA, 22 nt, Bordetella pertussis
gccugcgccacguccagcacgg

SEQ ID NO: 334939 - RNA, 13 nt, Bordetella pertussis
gccugcgccagcc

SEQ ID NO: 334940 - RNA, 21 nt, Bordetella pertussis
gccugcgccagccgcgccugc

SEQ ID NO: 334941 - RNA, 16 nt, Bordetella pertussis
gccugcgccaccagcu

SEQ ID NO: 334942 - RNA, 23 nt, Bordetella pertussis
gccugcgccaccagcuugcgcgc

SEQ ID NO: 334943 - RNA, 13 nt, Bordetella pertussis
gccugcgccagcu

SEQ ID NO: 334944 - RNA, 22 nt, Bordetella pertussis
gccugcgccagcuccagccgca

SEQ ID NO: 334945 - RNA, 19 nt, Bordetella pertussis
gccugcgccaggugggcca

SEQ ID NO: 334946 - RNA, 12 nt, Bordetella pertussis
gccugcgccaug

SEQ ID NO: 334947 - RNA, 16 nt, Bordetella pertussis
gccugcgccauggcgc

SEQ ID NO: 334948 - RNA, 13 nt, Bordetella pertussis
gccugcgccaugu

SEQ ID NO: 334949 - RNA, 14 nt, Bordetella pertussis
gccugcgccaugug

SEQ ID NO: 334950 - RNA, 15 nt, Bordetella pertussis
gccugcgccaugugg

SEQ ID NO: 334951 - RNA, 19 nt, Bordetella pertussis
gccugcgccauguggcgac

SEQ ID NO: 334952 - RNA, 15 nt, Bordetella pertussis
gccugcgccgccgcg

SEQ ID NO: 334953 - RNA, 22 nt, Bordetella pertussis
gccugcgccgccgcgcgcuggc

SEQ ID NO: 334954 - RNA, 12 nt, Bordetella pertussis
gccugcgccggc

SEQ ID NO: 334955 - RNA, 13 nt, Bordetella pertussis
gccugcgccgggc

SEQ ID NO: 334956 - RNA, 19 nt, Bordetella pertussis
gccugcgccgucugcgccg

SEQ ID NO: 334957 - RNA, 14 nt, Bordetella pertussis
gccugcgccggcau

SEQ ID NO: 334958 - RNA, 19 nt, Bordetella pertussis
gccugcgccggcauggcca

SEQ ID NO: 334959 - RNA, 15 nt, Bordetella pertussis
gccugcgcgaugcgc

SEQ ID NO: 334960 - RNA, 19 nt, Bordetella pertussis
gccugcgcgaugcgcgcgc

SEQ ID NO: 334961 - RNA, 13 nt, Bordetella pertussis
gccugcgcgccga

SEQ ID NO: 334962 - RNA, 14 nt, Bordetella pertussis
gccugcgcgccgac

SEQ ID NO: 334963 - RNA, 13 nt, Bordetella pertussis
gccugcgcgccgc

SEQ ID NO: 334964 - RNA, 14 nt, Bordetella pertussis
gccugcgcgccgcc

SEQ ID NO: 334965 - RNA, 18 nt, Bordetella pertussis
gccugcgcgcgagcaguc

SEQ ID NO: 334966 - RNA, 23 nt, Bordetella pertussis
gccugcgcgcgagcagucgacca

SEQ ID NO: 334967 - RNA, 13 nt, Bordetella pertussis
gccugcgcggccu

SEQ ID NO: 334968 - RNA, 22 nt, Bordetella pertussis
gccugcgcggccucguaggcca

SEQ ID NO: 334969 - RNA, 22 nt, Bordetella pertussis
gccugcggacggcgggcgcccc

SEQ ID NO: 334970 - RNA, 15 nt, Bordetella pertussis
gccugcggcaggccg

SEQ ID NO: 334971 - RNA, 16 nt, Bordetella pertussis
gccugcggcaggccgc

SEQ ID NO: 334972 - RNA, 17 nt, Bordetella pertussis
gccugcggcaggccgca

SEQ ID NO: 334973 - RNA, 22 nt, Bordetella pertussis
gccugcggaugcaggaucuggu

SEQ ID NO: 334974 - RNA, 20 nt, Bordetella pertussis
gccugcggcgcggccgacgu

SEQ ID NO: 334975 - RNA, 16 nt, Bordetella pertussis
gccugcucgcaggccu

SEQ ID NO: 334976 - RNA, 22 nt, Bordetella pertussis
gccugcucgcccacauagcggc

SEQ ID NO: 334977 - RNA, 15 nt, Bordetella pertussis
gccugcucgggcgcc

SEQ ID NO: 334978 - RNA, 18 nt, Bordetella pertussis
gccugcucguacagcggc

SEQ ID NO: 334979 - RNA, 20 nt, Bordetella pertussis
gccugcucguugcgcaagcc

SEQ ID NO: 334980 - RNA, 18 nt, Bordetella pertussis
gccugcugcagcacacgc

SEQ ID NO: 334981 - RNA, 14 nt, Bordetella pertussis
gccugcugcagcgu

SEQ ID NO: 334982 - RNA, 15 nt, Bordetella pertussis
gccugcugcagcgug

SEQ ID NO: 334983 - RNA, 17 nt, Bordetella pertussis
gccugcugcagcgugau

SEQ ID NO: 334984 - RNA, 12 nt, Bordetella pertussis
gccugcugcaug

SEQ ID NO: 334985 - RNA, 17 nt, Bordetella pertussis
gccugcugcgccuggcc

SEQ ID NO: 334986 - RNA, 16 nt, Bordetella pertussis
gccugcuggucggccu

SEQ ID NO: 334987 - RNA, 15 nt, Bordetella pertussis
gccugcuggugcugg

SEQ ID NO: 334988 - RNA, 17 nt, Bordetella pertussis
gccugcugucgcuggga

SEQ ID NO: 334989 - RNA, 19 nt, Bordetella pertussis
gccugcugugcgauggcac

SEQ ID NO: 334990 - RNA, 20 nt, Bordetella pertussis
gccugcugggccgcgcucga

SEQ ID NO: 334991 - RNA, 15 nt, Bordetella pertussis
gccuggccagauagc

SEQ ID NO: 334992 - RNA, 22 nt, Bordetella pertussis
gccuggccagauagcccaggcg

SEQ ID NO: 334993 - RNA, 18 nt, Bordetella pertussis
gccuggcccacaucgucg

SEQ ID NO: 334994 - RNA, 18 nt, Bordetella pertussis
gccuggccccaggcgccc

SEQ ID NO: 334995 - RNA, 19 nt, Bordetella pertussis
gccuggccccaggcgcccg

SEQ ID NO: 334996 - RNA, 20 nt, Bordetella pertussis
gccuggccccaggcgcccga

SEQ ID NO: 334997 - RNA, 19 nt, Bordetella pertussis
gccuggccccgcgcgagcg

SEQ ID NO: 334998 - RNA, 21 nt, Bordetella pertussis
gccuggccccgcgcgagcgca

SEQ ID NO: 334999 - RNA, 16 nt, Bordetella pertussis
gccuggccgagcgcgg

SEQ ID NO: 335000 - RNA, 17 nt, Bordetella pertussis
gccuggccgagcgcggc

SEQ ID NO: 335001 - RNA, 18 nt, Bordetella pertussis
gccuggccgagcgcggca

SEQ ID NO: 335002 - RNA, 13 nt, Bordetella pertussis
gccuggccgccca

SEQ ID NO: 335003 - RNA, 16 nt, Bordetella pertussis
gccuggccgcccagcg

SEQ ID NO: 335004 - RNA, 19 nt, Bordetella pertussis
gccuggccgcccagcgccu

SEQ ID NO: 335005 - RNA, 23 nt, Bordetella pertussis
gccuggccgcccagcgccugcaa

SEQ ID NO: 335006 - RNA, 13 nt, Bordetella pertussis
gccuggcccagcu

SEQ ID NO: 335007 - RNA, 22 nt, Bordetella pertussis
gccuggcccagcuccagcuggc

SEQ ID NO: 335008 - RNA, 15 nt, Bordetella pertussis
gccuggccgccggcg

SEQ ID NO: 335009 - RNA, 19 nt, Bordetella pertussis
gccuggccgccggcggcgc

SEQ ID NO: 335010 - RNA, 15 nt, Bordetella pertussis
gccuggccgcgcgcc

SEQ ID NO: 335011 - RNA, 16 nt, Bordetella pertussis
gccuggccgcgcgccu

SEQ ID NO: 335012 - RNA, 16 nt, Bordetella pertussis
gccuggccgcgcugau

SEQ ID NO: 335013 - RNA, 22 nt, Bordetella pertussis
gccuggccggggaagccgccgg

SEQ ID NO: 335014 - RNA, 14 nt, Bordetella pertussis
gccuggccuugcgc

SEQ ID NO: 335015 - RNA, 16 nt, Bordetella pertussis
gccuggccugcgccgc

SEQ ID NO: 335016 - RNA, 18 nt, Bordetella pertussis
gccuggccugcgccgccg

SEQ ID NO: 335017 - RNA, 16 nt, Bordetella pertussis
gccuggcgccgcgccc

SEQ ID NO: 335018 - RNA, 18 nt, Bordetella pertussis
gccuggcgcgacgccugc

SEQ ID NO: 335019 - RNA, 13 nt, Bordetella pertussis
gccuggcgcgccc

SEQ ID NO: 335020 - RNA, 14 nt, Bordetella pertussis
gccuggcgcgccca

SEQ ID NO: 335021 - RNA, 14 nt, Bordetella pertussis
gccuggcgcgcggc

SEQ ID NO: 335022 - RNA, 16 nt, Bordetella pertussis
gccuggcgcgcggccu

SEQ ID NO: 335023 - RNA, 21 nt, Bordetella pertussis
gccuggcgcgcggccugggcg

SEQ ID NO: 335024 - RNA, 14 nt, Bordetella pertussis
gccuggcgcggccc

SEQ ID NO: 335025 - RNA, 13 nt, Bordetella pertussis
gccuggcgcggcg

SEQ ID NO: 335026 - RNA, 16 nt, Bordetella pertussis
gccuggcgcggcgccu

SEQ ID NO: 335027 - RNA, 23 nt, Bordetella pertussis
gccuggcgcggcgccugcgcgcg

SEQ ID NO: 335028 - RNA, 13 nt, Bordetella pertussis
gccuggcggacga

SEQ ID NO: 335029 - RNA, 19 nt, Bordetella pertussis
gccuggcggaucucggcca

SEQ ID NO: 335030 - RNA, 20 nt, Bordetella pertussis
gccuggcggaucucggccag

SEQ ID NO: 335031 - RNA, 22 nt, Bordetella pertussis
gccuggcggaucucggccagca

SEQ ID NO: 335032 - RNA, 23 nt, Bordetella pertussis
gccuggcggaucucggccagcag

SEQ ID NO: 335033 - RNA, 18 nt, Bordetella pertussis
gccuggcgggccugggcg

SEQ ID NO: 335034 - RNA, 21 nt, Bordetella pertussis
gccuggcguucaaucgcgcuu

SEQ ID NO: 335035 - RNA, 12 nt, Bordetella pertussis
gccuggcguucg

SEQ ID NO: 335036 - RNA, 18 nt, Bordetella pertussis
gccuggcguucggcaccg

SEQ ID NO: 335037 - RNA, 20 nt, Bordetella pertussis
gccuggcguucggcaccggc

SEQ ID NO: 335038 - RNA, 15 nt, Bordetella pertussis
gccuggcucaggccu

SEQ ID NO: 335039 - RNA, 20 nt, Bordetella pertussis
gccuggcucaggccugcacg

SEQ ID NO: 335040 - RNA, 19 nt, Bordetella pertussis
gccuggcuccccgggcacc

SEQ ID NO: 335041 - RNA, 22 nt, Bordetella pertussis
gccuggcgguaugcggcgccca

SEQ ID NO: 335042 - RNA, 14 nt, Bordetella pertussis
gccuggugcccgac

SEQ ID NO: 335043 - RNA, 18 nt, Bordetella pertussis
gccugguuagagcagcgg

SEQ ID NO: 335044 - RNA, 16 nt, Bordetella pertussis
gccuguaucagcgccu

SEQ ID NO: 335045 - RNA, 20 nt, Bordetella pertussis
gccugucccaaccgggacag

SEQ ID NO: 335046 - RNA, 15 nt, Bordetella pertussis
gccuguccccaccgg

SEQ ID NO: 335047 - RNA, 18 nt, Bordetella pertussis
gccuguccccaccgggac

SEQ ID NO: 335048 - RNA, 19 nt, Bordetella pertussis
gccuguccccacggggaca

SEQ ID NO: 335049 - RNA, 20 nt, Bordetella pertussis
gccuguccccacggggacag

SEQ ID NO: 335050 - RNA, 19 nt, Bordetella pertussis
gccuguccccacguggaca

SEQ ID NO: 335051 - RNA, 20 nt, Bordetella pertussis
gccuguccccacguggacag

SEQ ID NO: 335052 - RNA, 22 nt, Bordetella pertussis
gccuguccccgcacggggacag

SEQ ID NO: 335053 - RNA, 19 nt, Bordetella pertussis
gccuguccccgcagggaca

SEQ ID NO: 335054 - RNA, 17 nt, Bordetella pertussis
gccuguccccgccgggg

SEQ ID NO: 335055 - RNA, 22 nt, Bordetella pertussis
gccuguccccgccggggcaggc

SEQ ID NO: 335056 - RNA, 15 nt, Bordetella pertussis
gccuguccccgcgga

SEQ ID NO: 335057 - RNA, 19 nt, Bordetella pertussis
gccuguccccgcggggaca

SEQ ID NO: 335058 - RNA, 20 nt, Bordetella pertussis
gccuguccccgcggggacag

SEQ ID NO: 335059 - RNA, 15 nt, Bordetella pertussis
gccuguccccgcugg

SEQ ID NO: 335060 - RNA, 20 nt, Bordetella pertussis
gccuguccccgcugggacag

SEQ ID NO: 335061 - RNA, 24 nt, Bordetella pertussis
gccuguccccgcugggacaggcac

SEQ ID NO: 335062 - RNA, 20 nt, Bordetella pertussis
gccuguccccgucgggacag

SEQ ID NO: 335063 - RNA, 19 nt, Bordetella pertussis
gccugucccgacggggaca

SEQ ID NO: 335064 - RNA, 19 nt, Bordetella pertussis
gccugucccggcugggaca

SEQ ID NO: 335065 - RNA, 18 nt, Bordetella pertussis
gccugucccugccgggac

SEQ ID NO: 335066 - RNA, 15 nt, Bordetella pertussis
gccugucccugcggg

SEQ ID NO: 335067 - RNA, 20 nt, Bordetella pertussis
gccugucuguuugcgcagug

SEQ ID NO: 335068 - RNA, 14 nt, Bordetella pertussis
gccugugccagcug

SEQ ID NO: 335069 - RNA, 16 nt, Bordetella pertussis
gccugugccagcuggc

SEQ ID NO: 335070 - RNA, 13 nt, Bordetella pertussis
gccugugcccgca

SEQ ID NO: 335071 - RNA, 17 nt, Bordetella pertussis
gccugugcccgcagagg

SEQ ID NO: 335072 - RNA, 17 nt, Bordetella pertussis
gccuguucccgccgggc

SEQ ID NO: 335073 - RNA, 16 nt, Bordetella pertussis
gccuucagcgggccgg

SEQ ID NO: 335074 - RNA, 17 nt, Bordetella pertussis
gccuucaugaucuggcc

SEQ ID NO: 335075 - RNA, 20 nt, Bordetella pertussis
gccuucuugaacagcucggc

SEQ ID NO: 335076 - RNA, 23 nt, Bordetella pertussis
gccuugaaagaggcauuggcggc

SEQ ID NO: 335077 - RNA, 20 nt, Bordetella pertussis
gccuugacgaucucggcguu

SEQ ID NO: 335078 - RNA, 13 nt, Bordetella pertussis
gccuugacggcgc

SEQ ID NO: 335079 - RNA, 19 nt, Bordetella pertussis
gccuugagcaucugcggca

SEQ ID NO: 335080 - RNA, 17 nt, Bordetella pertussis
gccuugccgccgccgcg

SEQ ID NO: 335081 - RNA, 22 nt, Bordetella pertussis
gccuugccgccgccgcgcgcgg

SEQ ID NO: 335082 - RNA, 21 nt, Bordetella pertussis
gccuugccgguggacggccag

SEQ ID NO: 335083 - RNA, 22 nt, Bordetella pertussis
gccuugccgguggacggccagc

SEQ ID NO: 335084 - RNA, 18 nt, Bordetella pertussis
gccuugccguaggguucg

SEQ ID NO: 335085 - RNA, 19 nt, Bordetella pertussis
gccuugccguaggguucgc

SEQ ID NO: 335086 - RNA, 18 nt, Bordetella pertussis
gccuugccuugcgcggcc

SEQ ID NO: 335087 - RNA, 15 nt, Bordetella pertussis
gccuuuuccaggcgu

SEQ ID NO: 335088 - RNA, 15 nt, Bordetella pertussis
gcgaaacagcagcgg

SEQ ID NO: 335089 - RNA, 21 nt, Bordetella pertussis
gcgaaaccggugaucagcagg

SEQ ID NO: 335090 - RNA, 23 nt, Bordetella pertussis
gcgaaacgccagcccgacggcca

SEQ ID NO: 335091 - RNA, 13 nt, Bordetella pertussis
gcgaaacggccag

SEQ ID NO: 335092 - RNA, 13 nt, Bordetella pertussis
gcgaaacggccgg

SEQ ID NO: 335093 - RNA, 22 nt, Bordetella pertussis
gcgaaacggcgggcgcgcaggc

SEQ ID NO: 335094 - RNA, 14 nt, Bordetella pertussis
gcgaaagccggccu

SEQ ID NO: 335095 - RNA, 12 nt, Bordetella pertussis
gcgaaagcggcc

SEQ ID NO: 335096 - RNA, 22 nt, Bordetella pertussis
gcgaaaucuucugcgccacggc

SEQ ID NO: 335097 - RNA, 14 nt, Bordetella pertussis
gcgaaaugccgaag

SEQ ID NO: 335098 - RNA, 16 nt, Bordetella pertussis
gcgaacaccagggugg

SEQ ID NO: 335099 - RNA, 13 nt, Bordetella pertussis
gcgaacaccggca

SEQ ID NO: 335100 - RNA, 18 nt, Bordetella pertussis
gcgaacaccggcaggccg

SEQ ID NO: 335101 - RNA, 18 nt, Bordetella pertussis
gcgaacacgucgcgggcg

SEQ ID NO: 335102 - RNA, 22 nt, Bordetella pertussis
gcgaacagauccacgcccgcgc

SEQ ID NO: 335103 - RNA, 13 nt, Bordetella pertussis
gcgaacagcgcgu

SEQ ID NO: 335104 - RNA, 17 nt, Bordetella pertussis
gcgaacagggcgcgacg

SEQ ID NO: 335105 - RNA, 16 nt, Bordetella pertussis
gcgaaccaggccugcg

SEQ ID NO: 335106 - RNA, 16 nt, Bordetella pertussis
gcgaacccgaucgcga

SEQ ID NO: 335107 - RNA, 19 nt, Bordetella pertussis
gcgaacccgccgcgaucag

SEQ ID NO: 335108 - RNA, 21 nt, Bordetella pertussis
gcgaaccgaaaugccgcagca

SEQ ID NO: 335109 - RNA, 21 nt, Bordetella pertussis
gcgaaccgaauuccggcucgg

SEQ ID NO: 335110 - RNA, 17 nt, Bordetella pertussis
gcgaaccgcggcgcagg

SEQ ID NO: 335111 - RNA, 15 nt, Bordetella pertussis
gcgaaccggugcugg

SEQ ID NO: 335112 - RNA, 12 nt, Bordetella pertussis
gcgaacgcccgg

SEQ ID NO: 335113 - RNA, 18 nt, Bordetella pertussis
gcgaacgcccggcccagg

SEQ ID NO: 335114 - RNA, 16 nt, Bordetella pertussis
gcgaacgcgccggccc

SEQ ID NO: 335115 - RNA, 17 nt, Bordetella pertussis
gcgaacgcgccggccca

SEQ ID NO: 335116 - RNA, 18 nt, Bordetella pertussis
gcgaacgcgccggcccag

SEQ ID NO: 335117 - RNA, 19 nt, Bordetella pertussis
gcgaacgcgccggcccagg

SEQ ID NO: 335118 - RNA, 20 nt, Bordetella pertussis
gcgaacgcgccggcccaggc

SEQ ID NO: 335119 - RNA, 18 nt, Bordetella pertussis
gcgaacgcgcgccggcca

SEQ ID NO: 335120 - RNA, 15 nt, Bordetella pertussis
gcgaacggccgcccg

SEQ ID NO: 335121 - RNA, 17 nt, Bordetella pertussis
gcgaacggccgcccggc

SEQ ID NO: 335122 - RNA, 19 nt, Bordetella pertussis
gcgaacgggguggccggcg

SEQ ID NO: 335123 - RNA, 22 nt, Bordetella pertussis
gcgaacgggguggccggcgcgc

SEQ ID NO: 335124 - RNA, 17 nt, Bordetella pertussis
gcgaacggcacgucgcg

SEQ ID NO: 335125 - RNA, 17 nt, Bordetella pertussis
gcgaacgugcgcgccag

SEQ ID NO: 335126 - RNA, 16 nt, Bordetella pertussis
gcgaagaacaccgccg

SEQ ID NO: 335127 - RNA, 23 nt, Bordetella pertussis
gcgaagaacaccgccgcgccgcc

SEQ ID NO: 335128 - RNA, 19 nt, Bordetella pertussis
gcgaagaccgugaucggcg

SEQ ID NO: 335129 - RNA, 20 nt, Bordetella pertussis
gcgaagaccgugaucggcgc

SEQ ID NO: 335130 - RNA, 14 nt, Bordetella pertussis
gcgaagaucccgcc

SEQ ID NO: 335131 - RNA, 13 nt, Bordetella pertussis
gcgaagcagccgg

SEQ ID NO: 335132 - RNA, 16 nt, Bordetella pertussis
gcgaagcagccggcca

SEQ ID NO: 335133 - RNA, 18 nt, Bordetella pertussis
gcgaagcagccggccaag

SEQ ID NO: 335134 - RNA, 16 nt, Bordetella pertussis
gcgaagccacggcccg

SEQ ID NO: 335135 - RNA, 21 nt, Bordetella pertussis
gcgaagccacggcccgccagg

SEQ ID NO: 335136 - RNA, 22 nt, Bordetella pertussis
gcgaagccggcacgccugccgc

SEQ ID NO: 335137 - RNA, 22 nt, Bordetella pertussis
gcgaagccuucuucugcaucgg

SEQ ID NO: 335138 - RNA, 14 nt, Bordetella pertussis
gcgaagccuugcgc

SEQ ID NO: 335139 - RNA, 14 nt, Bordetella pertussis
gcgaagcgcccugg

SEQ ID NO: 335140 - RNA, 17 nt, Bordetella pertussis
gcgaagcgcccuggcgu

SEQ ID NO: 335141 - RNA, 12 nt, Bordetella pertussis
gcgaagcgcgcc

SEQ ID NO: 335142 - RNA, 15 nt, Bordetella pertussis
gcgaagcgcgccagc

SEQ ID NO: 335143 - RNA, 19 nt, Bordetella pertussis
gcgaagcgcgggaagcgcu

SEQ ID NO: 335144 - RNA, 13 nt, Bordetella pertussis
gcgaagcggaccu

SEQ ID NO: 335145 - RNA, 20 nt, Bordetella pertussis
gcgaagcgggcgccggcgcc

SEQ ID NO: 335146 - RNA, 16 nt, Bordetella pertussis
gcgacacaaggcggcc

SEQ ID NO: 335147 - RNA, 14 nt, Bordetella pertussis
gcgacacccgcggc

SEQ ID NO: 335148 - RNA, 18 nt, Bordetella pertussis
gcgacacccgcggccagg

SEQ ID NO: 335149 - RNA, 19 nt, Bordetella pertussis
gcgacacccgcggccaggg

SEQ ID NO: 335150 - RNA, 16 nt, Bordetella pertussis
gcgacacccccagggc

SEQ ID NO: 335151 - RNA, 18 nt, Bordetella pertussis
gcgacacccccagggcgc

SEQ ID NO: 335152 - RNA, 19 nt, Bordetella pertussis
gcgacacccccagggcgcg

SEQ ID NO: 335153 - RNA, 22 nt, Bordetella pertussis
gcgacacccccagggcgcgccg

SEQ ID NO: 335154 - RNA, 15 nt, Bordetella pertussis
gcgacagcgacagcc

SEQ ID NO: 335155 - RNA, 14 nt, Bordetella pertussis
gcgacagcgcuggu

SEQ ID NO: 335156 - RNA, 18 nt, Bordetella pertussis
gcgacagcgcugguggcc

SEQ ID NO: 335157 - RNA, 23 nt, Bordetella pertussis
gcgacagcuugaugggcgaggcg

SEQ ID NO: 335158 - RNA, 14 nt, Bordetella pertussis
gcgacaggcgcagc

SEQ ID NO: 335159 - RNA, 14 nt, Bordetella pertussis
gcgacaggcgcgcc

SEQ ID NO: 335160 - RNA, 23 nt, Bordetella pertussis
gcgacaggcggugcgcgcggccg

SEQ ID NO: 335161 - RNA, 19 nt, Bordetella pertussis
gcgacaggcccgcggccgc

SEQ ID NO: 335162 - RNA, 23 nt, Bordetella pertussis
gcgacaguucgccccccgaggcc

SEQ ID NO: 335163 - RNA, 13 nt, Bordetella pertussis
gcgaccaccagca

SEQ ID NO: 335164 - RNA, 20 nt, Bordetella pertussis
gcgaccacgaccuuggcggc

SEQ ID NO: 335165 - RNA, 18 nt, Bordetella pertussis
gcgacccagcaccgagcu

SEQ ID NO: 335166 - RNA, 20 nt, Bordetella pertussis
gcgacccgauagccgcgcgc

SEQ ID NO: 335167 - RNA, 23 nt, Bordetella pertussis
gcgacccgcaaaaccgggcccgg

SEQ ID NO: 335168 - RNA, 14 nt, Bordetella pertussis
gcgacccguggccc

SEQ ID NO: 335169 - RNA, 16 nt, Bordetella pertussis
gcgacccguggcccgg

SEQ ID NO: 335170 - RNA, 19 nt, Bordetella pertussis
gcgaccgacggcaucguca

SEQ ID NO: 335171 - RNA, 14 nt, Bordetella pertussis
gcgaccgccgcggg

SEQ ID NO: 335172 - RNA, 11 nt, Bordetella pertussis
gcgaccgccgg

SEQ ID NO: 335173 - RNA, 15 nt, Bordetella pertussis
gcgaccgccggccgg

SEQ ID NO: 335174 - RNA, 15 nt, Bordetella pertussis
gcgacgaaucgguca

SEQ ID NO: 335175 - RNA, 17 nt, Bordetella pertussis
gcgacgaaucggucacg

SEQ ID NO: 335176 - RNA, 18 nt, Bordetella pertussis
gcgacgacuacgcgcugg

SEQ ID NO: 335177 - RNA, 21 nt, Bordetella pertussis
gcgacgacuacgcgcuggcgc

SEQ ID NO: 335178 - RNA, 16 nt, Bordetella pertussis
gcgacgauccggcgac

SEQ ID NO: 335179 - RNA, 17 nt, Bordetella pertussis
gcgacgauccggcgacc

SEQ ID NO: 335180 - RNA, 22 nt, Bordetella pertussis
gcgacgcaacagacccgggccg

SEQ ID NO: 335181 - RNA, 21 nt, Bordetella pertussis
gcgacgcagcacggcuugcgc

SEQ ID NO: 335182 - RNA, 20 nt, Bordetella pertussis
gcgacgcauauccaggcggc

SEQ ID NO: 335183 - RNA, 18 nt, Bordetella pertussis
gcgacgcaugucagcgcc

SEQ ID NO: 335184 - RNA, 22 nt, Bordetella pertussis
gcgacgcaugucagcgccuggc

SEQ ID NO: 335185 - RNA, 14 nt, Bordetella pertussis
gcgacgcccuggcc

SEQ ID NO: 335186 - RNA, 13 nt, Bordetella pertussis
gcgacgccgccga

SEQ ID NO: 335187 - RNA, 16 nt, Bordetella pertussis
gcgacgccgccgaugg

SEQ ID NO: 335188 - RNA, 15 nt, Bordetella pertussis
gcgacgccgcggugc

SEQ ID NO: 335189 - RNA, 19 nt, Bordetella pertussis
gcgacgccugcgccauggc

SEQ ID NO: 335190 - RNA, 13 nt, Bordetella pertussis
gcgacgcgacgcg

SEQ ID NO: 335191 - RNA, 22 nt, Bordetella pertussis
gcgacgcgcccucaguccagcu

SEQ ID NO: 335192 - RNA, 15 nt, Bordetella pertussis
gcgacgcgggcggcc

SEQ ID NO: 335193 - RNA, 18 nt, Bordetella pertussis
gcgacgcgggcggccgac

SEQ ID NO: 335194 - RNA, 20 nt, Bordetella pertussis
gcgacgcgggcggccgacgg

SEQ ID NO: 335195 - RNA, 12 nt, Bordetella pertussis
gcgacgcggcgu

SEQ ID NO: 335196 - RNA, 21 nt, Bordetella pertussis
gcgacgcuggcgaugcccacc

SEQ ID NO: 335197 - RNA, 18 nt, Bordetella pertussis
gcgacggcgauguccugg

SEQ ID NO: 335198 - RNA, 14 nt, Bordetella pertussis
gcgacggcgccggc

SEQ ID NO: 335199 - RNA, 15 nt, Bordetella pertussis
gcgacggcgccggcc

SEQ ID NO: 335200 - RNA, 16 nt, Bordetella pertussis
gcgacggcgccuggcg

SEQ ID NO: 335201 - RNA, 17 nt, Bordetella pertussis
gcgacggcgccuggcgc

SEQ ID NO: 335202 - RNA, 19 nt, Bordetella pertussis
gcgacggcggccuuugcgc

SEQ ID NO: 335203 - RNA, 17 nt, Bordetella pertussis
gcgacugccccagcggc

SEQ ID NO: 335204 - RNA, 23 nt, Bordetella pertussis
gcgacugccccagcggcuggcgc

SEQ ID NO: 335205 - RNA, 19 nt, Bordetella pertussis
gcgacuggcccaggcgggc

SEQ ID NO: 335206 - RNA, 15 nt, Bordetella pertussis
gcgacuggcggcugc

SEQ ID NO: 335207 - RNA, 21 nt, Bordetella pertussis
gcgacuguguaccccgaucgg

SEQ ID NO: 335208 - RNA, 20 nt, Bordetella pertussis
gcgacuuccgcuuccggccg

SEQ ID NO: 335209 - RNA, 21 nt, Bordetella pertussis
gcgagaaaaucggcgaucgcc

SEQ ID NO: 335210 - RNA, 16 nt, Bordetella pertussis
gcgagaaccaggccac

SEQ ID NO: 335211 - RNA, 14 nt, Bordetella pertussis
gcgagcaggcccgu

SEQ ID NO: 335212 - RNA, 14 nt, Bordetella pertussis
gcgagcaugcgcag

SEQ ID NO: 335213 - RNA, 15 nt, Bordetella pertussis
gcgagcaugcgcagc

SEQ ID NO: 335214 - RNA, 16 nt, Bordetella pertussis
gcgagcaugcgcagcg

SEQ ID NO: 335215 - RNA, 14 nt, Bordetella pertussis
gcgagcauggcggu

SEQ ID NO: 335216 - RNA, 17 nt, Bordetella pertussis
gcgagcagaugcaccgg

SEQ ID NO: 335217 - RNA, 15 nt, Bordetella pertussis
gcgagcccgccaucg

SEQ ID NO: 335218 - RNA, 20 nt, Bordetella pertussis
gcgagcccgcgucagacgcg

SEQ ID NO: 335219 - RNA, 18 nt, Bordetella pertussis
gcgagccgcccacgggcg

SEQ ID NO: 335220 - RNA, 15 nt, Bordetella pertussis
gcgagccggccagcg

SEQ ID NO: 335221 - RNA, 18 nt, Bordetella pertussis
gcgagccggccagcgcca

SEQ ID NO: 335222 - RNA, 12 nt, Bordetella pertussis
gcgagccgggca

SEQ ID NO: 335223 - RNA, 16 nt, Bordetella pertussis
gcgagccgggcaccga

SEQ ID NO: 335224 - RNA, 13 nt, Bordetella pertussis
gcgagccuucggc

SEQ ID NO: 335225 - RNA, 17 nt, Bordetella pertussis
gcgagccuucggccggc

SEQ ID NO: 335226 - RNA, 21 nt, Bordetella pertussis
gcgagcgaaagccgucggcca

SEQ ID NO: 335227 - RNA, 14 nt, Bordetella pertussis
gcgagcgcagccgc

SEQ ID NO: 335228 - RNA, 16 nt, Bordetella pertussis
gcgagcgaugcccugg

SEQ ID NO: 335229 - RNA, 22 nt, Bordetella pertussis
gcgagcgcaagcaccgccugcu

SEQ ID NO: 335230 - RNA, 20 nt, Bordetella pertussis
gcgagcgcacaggcggcgcc

SEQ ID NO: 335231 - RNA, 13 nt, Bordetella pertussis
gcgagcgccgcca

SEQ ID NO: 335232 - RNA, 12 nt, Bordetella pertussis
gcgagcgccgcg

SEQ ID NO: 335233 - RNA, 22 nt, Bordetella pertussis
gcgagcgccgcgcuccagggcg

SEQ ID NO: 335234 - RNA, 15 nt, Bordetella pertussis
gcgagcuggcccugg

SEQ ID NO: 335235 - RNA, 15 nt, Bordetella pertussis
gcgaggacacgcagc

SEQ ID NO: 335236 - RNA, 16 nt, Bordetella pertussis
gcgaggacacgcagcu

SEQ ID NO: 335237 - RNA, 18 nt, Bordetella pertussis
gcgaggaggugcgccgcu

SEQ ID NO: 335238 - RNA, 21 nt, Bordetella pertussis
gcgagguggcgcucgcgccca

SEQ ID NO: 335239 - RNA, 18 nt, Bordetella pertussis
gcgaguauucacgccgcg

SEQ ID NO: 335240 - RNA, 21 nt, Bordetella pertussis
gcgaguauucacgccgcgaca

SEQ ID NO: 335241 - RNA, 14 nt, Bordetella pertussis
gcgagugcgccccg

SEQ ID NO: 335242 - RNA, 20 nt, Bordetella pertussis
gcgaguuguccuggccggga

SEQ ID NO: 335243 - RNA, 19 nt, Bordetella pertussis
gcgauacagcuuggcgcgc

SEQ ID NO: 335244 - RNA, 22 nt, Bordetella pertussis
gcgauacgggacugagucguca

SEQ ID NO: 335245 - RNA, 15 nt, Bordetella pertussis
gcgauacgcgccgcc

SEQ ID NO: 335246 - RNA, 17 nt, Bordetella pertussis
gcgauagcgcuccagcg

SEQ ID NO: 335247 - RNA, 14 nt, Bordetella pertussis
gcgauaggugcgca

SEQ ID NO: 335248 - RNA, 15 nt, Bordetella pertussis
gcgauaggugcgcag

SEQ ID NO: 335249 - RNA, 17 nt, Bordetella pertussis
gcgauaggugcgcagcc

SEQ ID NO: 335250 - RNA, 19 nt, Bordetella pertussis
gcgauaggugcgcagccgg

SEQ ID NO: 335251 - RNA, 21 nt, Bordetella pertussis
gcgauauccagguaggcggcg

SEQ ID NO: 335252 - RNA, 21 nt, Bordetella pertussis
gcgaucaacgugcgccaggca

SEQ ID NO: 335253 - RNA, 15 nt, Bordetella pertussis
gcgaucaccgacagc

SEQ ID NO: 335254 - RNA, 18 nt, Bordetella pertussis
gcgaucaccgacagcgcc

SEQ ID NO: 335255 - RNA, 17 nt, Bordetella pertussis
gcgcaccaugcgcagca

SEQ ID NO: 335256 - RNA, 20 nt, Bordetella pertussis
gcgcaccauggcgcccacgg

SEQ ID NO: 335257 - RNA, 19 nt, Bordetella pertussis
gcgcaccaugggcgucguc

SEQ ID NO: 335258 - RNA, 20 nt, Bordetella pertussis
gcgcaccauucucgcccugc

SEQ ID NO: 335259 - RNA, 23 nt, Bordetella pertussis
gcgcaccauucucgcccugcugg

SEQ ID NO: 335260 - RNA, 22 nt, Bordetella pertussis
gcgcaccaguuucucggccacu

SEQ ID NO: 335261 - RNA, 13 nt, Bordetella pertussis
gcgcacccaggcc

SEQ ID NO: 335262 - RNA, 14 nt, Bordetella pertussis
gcgcacccgcaggc

SEQ ID NO: 335263 - RNA, 15 nt, Bordetella pertussis
gcgcacccgccugga

SEQ ID NO: 335264 - RNA, 20 nt, Bordetella pertussis
gcgcacccugcaggccgggc

SEQ ID NO: 335265 - RNA, 23 nt, Bordetella pertussis
gcgcacccugcaggccgggcagu

SEQ ID NO: 335266 - RNA, 12 nt, Bordetella pertussis
gcgcaccgacgg

SEQ ID NO: 335267 - RNA, 13 nt, Bordetella pertussis
gcgcaccgccugc

SEQ ID NO: 335268 - RNA, 13 nt, Bordetella pertussis
gcgcaccggccag

SEQ ID NO: 335269 - RNA, 15 nt, Bordetella pertussis
gcgcaccggccaggg

SEQ ID NO: 335270 - RNA, 16 nt, Bordetella pertussis
gcgcaccgcuucuucg

SEQ ID NO: 335271 - RNA, 12 nt, Bordetella pertussis
gcgcaccgucac

SEQ ID NO: 335272 - RNA, 23 nt, Bordetella pertussis
gcgcaccgucacgcgcuccagcg

SEQ ID NO: 335273 - RNA, 14 nt, Bordetella pertussis
gcgcaccgucgcca

SEQ ID NO: 335274 - RNA, 16 nt, Bordetella pertussis
gcgcaccgucgccagg

SEQ ID NO: 335275 - RNA, 17 nt, Bordetella pertussis
gcgcaccgucgccaggg

SEQ ID NO: 335276 - RNA, 15 nt, Bordetella pertussis
gcgcaccugcugcgg

SEQ ID NO: 335277 - RNA, 17 nt, Bordetella pertussis
gcgcaccugcugcggca

SEQ ID NO: 335278 - RNA, 19 nt, Bordetella pertussis
gcgcaccugguccauggcg

SEQ ID NO: 335279 - RNA, 17 nt, Bordetella pertussis
gcgcaccuugcccacgc

SEQ ID NO: 335280 - RNA, 19 nt, Bordetella pertussis
gcgcaccuugcccacgcca

SEQ ID NO: 335281 - RNA, 22 nt, Bordetella pertussis
gcgcaccuguucggcggcgccc

SEQ ID NO: 335282 - RNA, 17 nt, Bordetella pertussis
gcgcaccuugucgcgca

SEQ ID NO: 335283 - RNA, 14 nt, Bordetella pertussis
gcgcacgaagccga

SEQ ID NO: 335284 - RNA, 17 nt, Bordetella pertussis
gcgcacgaugaggccga

SEQ ID NO: 335285 - RNA, 13 nt, Bordetella pertussis
gcgcacgcaccgc

SEQ ID NO: 335286 - RNA, 18 nt, Bordetella pertussis
gcgcacgcaccgcgccag

SEQ ID NO: 335287 - RNA, 20 nt, Bordetella pertussis
gcgcacgcaccgcgccagcg

SEQ ID NO: 335288 - RNA, 16 nt, Bordetella pertussis
gcgcacgcacugagcu

SEQ ID NO: 335289 - RNA, 18 nt, Bordetella pertussis
gcgcacgcccagacuggc

SEQ ID NO: 335290 - RNA, 19 nt, Bordetella pertussis
gcgcacgccccgacgcggu

SEQ ID NO: 335291 - RNA, 12 nt, Bordetella pertussis
gcgcacgccgcc

SEQ ID NO: 335292 - RNA, 13 nt, Bordetella pertussis
gcgcacgccgggc

SEQ ID NO: 335293 - RNA, 19 nt, Bordetella pertussis
gcgcacgccgggcgcggcc

SEQ ID NO: 335294 - RNA, 21 nt, Bordetella pertussis
gcgcacgccgggcgcggccgc

SEQ ID NO: 335295 - RNA, 17 nt, Bordetella pertussis
gcgcacgcgcagcacgc

SEQ ID NO: 335296 - RNA, 23 nt, Bordetella pertussis
gcgcacgcgcagcacgcugcgcg

SEQ ID NO: 335297 - RNA, 13 nt, Bordetella pertussis
gcgcacgcgcucg

SEQ ID NO: 335298 - RNA, 22 nt, Bordetella pertussis
gcgcacgcucugcaccuugggc

SEQ ID NO: 335299 - RNA, 19 nt, Bordetella pertussis
gcgcacgcuggcaucgucg

SEQ ID NO: 335300 - RNA, 15 nt, Bordetella pertussis
gcgcacgcuggcgcc

SEQ ID NO: 335301 - RNA, 12 nt, Bordetella pertussis
gcgcacgcuggg

SEQ ID NO: 335302 - RNA, 14 nt, Bordetella pertussis
gcgcacggacagcc

SEQ ID NO: 335303 - RNA, 18 nt, Bordetella pertussis
gcgcacggacagcccgcg

SEQ ID NO: 335304 - RNA, 12 nt, Bordetella pertussis
gcgcacggcgcc

SEQ ID NO: 335305 - RNA, 18 nt, Bordetella pertussis
gcgcacggcgcccugcgc

SEQ ID NO: 335306 - RNA, 13 nt, Bordetella pertussis
gcgcacggccagc

SEQ ID NO: 335307 - RNA, 13 nt, Bordetella pertussis
gcgcacggcggca

SEQ ID NO: 335308 - RNA, 13 nt, Bordetella pertussis
gcgcacgggcgcc

SEQ ID NO: 335309 - RNA, 15 nt, Bordetella pertussis
gcgcacgguccaggc

SEQ ID NO: 335310 - RNA, 18 nt, Bordetella pertussis
gcgcacgguccaggcggc

SEQ ID NO: 335311 - RNA, 13 nt, Bordetella pertussis
gcgcacugaucgc

SEQ ID NO: 335312 - RNA, 16 nt, Bordetella pertussis
gcgcacugaucgccgc

SEQ ID NO: 335313 - RNA, 23 nt, Bordetella pertussis
gcgcacugagaaaggccgccacg

SEQ ID NO: 335314 - RNA, 22 nt, Bordetella pertussis
gcgcagauccucgaacaggcca

SEQ ID NO: 335315 - RNA, 16 nt, Bordetella pertussis
gcgcagauggcggcga

SEQ ID NO: 335316 - RNA, 17 nt, Bordetella pertussis
gcgcagaugggcggcga

SEQ ID NO: 335317 - RNA, 15 nt, Bordetella pertussis
gcgcagcaacccgcc

SEQ ID NO: 335318 - RNA, 17 nt, Bordetella pertussis
gcgcagcaagcugcugc

SEQ ID NO: 335319 - RNA, 13 nt, Bordetella pertussis
gcgcagcaaggcg

SEQ ID NO: 335320 - RNA, 18 nt, Bordetella pertussis
gcgcagcaaggcgcgcca

SEQ ID NO: 335321 - RNA, 22 nt, Bordetella pertussis
gcgcagcaauucaagccgcacc

SEQ ID NO: 335322 - RNA, 23 nt, Bordetella pertussis
gcgcagcaauucaagccgcacca

SEQ ID NO: 335323 - RNA, 14 nt, Bordetella pertussis
gcgcagcaccagca

SEQ ID NO: 335324 - RNA, 14 nt, Bordetella pertussis
gcgcagcaccgcca

SEQ ID NO: 335325 - RNA, 15 nt, Bordetella pertussis
gcgcagcaccgccag

SEQ ID NO: 335326 - RNA, 16 nt, Bordetella pertussis
gcgcagcaccgccagc

SEQ ID NO: 335327 - RNA, 17 nt, Bordetella pertussis
gcgcagcaccgccagcg

SEQ ID NO: 335328 - RNA, 20 nt, Bordetella pertussis
gcgcagcaccgcgcgcacga

SEQ ID NO: 335329 - RNA, 14 nt, Bordetella pertussis
gcgcagcaccggcg

SEQ ID NO: 335330 - RNA, 15 nt, Bordetella pertussis
gcgcagcaccggcgu

SEQ ID NO: 335331 - RNA, 21 nt, Bordetella pertussis
gcgcagcacgcccgcgcgcga

SEQ ID NO: 335332 - RNA, 23 nt, Bordetella pertussis
gcgcagcacgcccgcgcgcgagc

SEQ ID NO: 335333 - RNA, 15 nt, Bordetella pertussis
gcgcagcacgccgau

SEQ ID NO: 335334 - RNA, 18 nt, Bordetella pertussis
gcgcagcacgccgcgcca

SEQ ID NO: 335335 - RNA, 20 nt, Bordetella pertussis
gcgcagcagcagcgcaucga

SEQ ID NO: 335336 - RNA, 20 nt, Bordetella pertussis
gcgcagcagcgacaggacgu

SEQ ID NO: 335337 - RNA, 16 nt, Bordetella pertussis
gcgcagcagcgccggc

SEQ ID NO: 335338 - RNA, 17 nt, Bordetella pertussis
gcgcagcagcgccggca

SEQ ID NO: 335339 - RNA, 21 nt, Bordetella pertussis
gcgcagcagcgccggcaggcg

SEQ ID NO: 335340 - RNA, 22 nt, Bordetella pertussis
gcgcagcagcgcgguggccagc

SEQ ID NO: 335341 - RNA, 13 nt, Bordetella pertussis
gcgcagcaggccg

SEQ ID NO: 335342 - RNA, 14 nt, Bordetella pertussis
gcgcagcaggccgc

SEQ ID NO: 335343 - RNA, 15 nt, Bordetella pertussis
gcgcagcaggccgcg

SEQ ID NO: 335344 - RNA, 14 nt, Bordetella pertussis
gcgcagcaggccgu

SEQ ID NO: 335345 - RNA, 15 nt, Bordetella pertussis
gcgcagcaggcgcgu

SEQ ID NO: 335346 - RNA, 14 nt, Bordetella pertussis
gcgcagcagggccu

SEQ ID NO: 335347 - RNA, 16 nt, Bordetella pertussis
gcgcagcagggccugg

SEQ ID NO: 335348 - RNA, 14 nt, Bordetella pertussis
gcgcagcagggcgg

SEQ ID NO: 335349 - RNA, 20 nt, Bordetella pertussis
gcgcagcaggguggccacgc

SEQ ID NO: 335350 - RNA, 19 nt, Bordetella pertussis
gcgcagcauuucggcgccg

SEQ ID NO: 335351 - RNA, 15 nt, Bordetella pertussis
gcgcagccacagcgc

SEQ ID NO: 335352 - RNA, 22 nt, Bordetella pertussis
gcgcagccagguaagcuggcgc

SEQ ID NO: 335353 - RNA, 20 nt, Bordetella pertussis
gcgcagcccacucagggcgg

SEQ ID NO: 335354 - RNA, 13 nt, Bordetella pertussis
gcgcagcccggcg

SEQ ID NO: 335355 - RNA, 14 nt, Bordetella pertussis
gcgcagccgccaua

SEQ ID NO: 335356 - RNA, 20 nt, Bordetella pertussis
gcgcagccgccauaggcgcg

SEQ ID NO: 335357 - RNA, 21 nt, Bordetella pertussis
gcgcagccgccauaggcgcgc

SEQ ID NO: 335358 - RNA, 14 nt, Bordetella pertussis
gcgcagccgcgcca

SEQ ID NO: 335359 - RNA, 21 nt, Bordetella pertussis
gcgcagccgcgccaagggcgu

SEQ ID NO: 335360 - RNA, 17 nt, Bordetella pertussis
gcgcagccgcuccagcc

SEQ ID NO: 335361 - RNA, 23 nt, Bordetella pertussis
gcgcagccggccgguaaggcgcu

SEQ ID NO: 335362 - RNA, 13 nt, Bordetella pertussis
gcgcagccgggcu

SEQ ID NO: 335363 - RNA, 14 nt, Bordetella pertussis
gcgcagccgggcug

SEQ ID NO: 335364 - RNA, 17 nt, Bordetella pertussis
gcgcagcgaacggccca

SEQ ID NO: 335365 - RNA, 19 nt, Bordetella pertussis
gcgcagcgaacggcccacg

SEQ ID NO: 335366 - RNA, 22 nt, Bordetella pertussis
gcgcagcgaguagacgcagccg

SEQ ID NO: 335367 - RNA, 13 nt, Bordetella pertussis
gcgcagcgccacg

SEQ ID NO: 335368 - RNA, 16 nt, Bordetella pertussis
gcgcagcgcccaggcg

SEQ ID NO: 335369 - RNA, 16 nt, Bordetella pertussis
gcgcagcgccgcgauu

SEQ ID NO: 335370 - RNA, 13 nt, Bordetella pertussis
gcgcagcgccugc

SEQ ID NO: 335371 - RNA, 18 nt, Bordetella pertussis
gcgcagcgccugcaggcg

SEQ ID NO: 335372 - RNA, 15 nt, Bordetella pertussis
gcgcagcgccuggcc

SEQ ID NO: 335373 - RNA, 17 nt, Bordetella pertussis
gcgcagcgccuggccga

SEQ ID NO: 335374 - RNA, 13 nt, Bordetella pertussis
gcgcagcgccgcc

SEQ ID NO: 335375 - RNA, 13 nt, Bordetella pertussis
gcgcagcgcggca

SEQ ID NO: 335376 - RNA, 15 nt, Bordetella pertussis
gcgcagcgcggcacg

SEQ ID NO: 335377 - RNA, 13 nt, Bordetella pertussis
gcgcagcgcggcg

SEQ ID NO: 335378 - RNA, 15 nt, Bordetella pertussis
gcgcagcgcgccgga

SEQ ID NO: 335379 - RNA, 21 nt, Bordetella pertussis
gcgcagcggcaggcccugccg

SEQ ID NO: 335380 - RNA, 15 nt, Bordetella pertussis
gcgcagcggcggcgc

SEQ ID NO: 335381 - RNA, 19 nt, Bordetella pertussis
gcgcagcgucucgcccacc

SEQ ID NO: 335382 - RNA, 20 nt, Bordetella pertussis
gcgcagcgucugcgcaucga

SEQ ID NO: 335383 - RNA, 20 nt, Bordetella pertussis
gcgcagcgugcggaccagcg

SEQ ID NO: 335384 - RNA, 19 nt, Bordetella pertussis
gcgcagcguggcggcgacg

SEQ ID NO: 335385 - RNA, 14 nt, Bordetella pertussis
gcgcagcuccccca

SEQ ID NO: 335386 - RNA, 17 nt, Bordetella pertussis
gcgcagcucccccacgc

SEQ ID NO: 335387 - RNA, 18 nt, Bordetella pertussis
gcgcagcucccccacgcc

SEQ ID NO: 335388 - RNA, 22 nt, Bordetella pertussis
gcgcagcucccccacgccgccg

SEQ ID NO: 335389 - RNA, 15 nt, Bordetella pertussis
gcgcagcuccggguc

SEQ ID NO: 335390 - RNA, 20 nt, Bordetella pertussis
gcgcagcuccgggucgagcg

SEQ ID NO: 335391 - RNA, 23 nt, Bordetella pertussis
gcgcagcuccguauccuggucga

SEQ ID NO: 335392 - RNA, 19 nt, Bordetella pertussis
gcgcagcucguggcgcgcc

SEQ ID NO: 335393 - RNA, 22 nt, Bordetella pertussis
gcgcagcugccugagcaccgcc

SEQ ID NO: 335394 - RNA, 18 nt, Bordetella pertussis
gcgcagcuucuaucugcc

SEQ ID NO: 335395 - RNA, 23 nt, Bordetella pertussis
gcgcagcuucuaucugccgcgca

SEQ ID NO: 335396 - RNA, 17 nt, Bordetella pertussis
gcgcagcuugcccgcgc

SEQ ID NO: 335397 - RNA, 20 nt, Bordetella pertussis
gcgcagcuugcccgcgcgca

SEQ ID NO: 335398 - RNA, 23 nt, Bordetella pertussis
gcgcagcuugcccgcgcgcacgu

SEQ ID NO: 335399 - RNA, 15 nt, Bordetella pertussis
gcgcaggaugacgug

SEQ ID NO: 335400 - RNA, 17 nt, Bordetella pertussis
gcgcaggaugacguggc

SEQ ID NO: 335401 - RNA, 18 nt, Bordetella pertussis
gcgcaggaugacguggca

SEQ ID NO: 335402 - RNA, 19 nt, Bordetella pertussis
gcgcaggaugcgcuggccg

SEQ ID NO: 335403 - RNA, 19 nt, Bordetella pertussis
gcgcaggauuucaucgccc

SEQ ID NO: 335404 - RNA, 19 nt, Bordetella pertussis
gcgcaggcaaagccugacg

SEQ ID NO: 335405 - RNA, 21 nt, Bordetella pertussis
gcgcaggcaguuggcggcgca

SEQ ID NO: 335406 - RNA, 13 nt, Bordetella pertussis
gcgcaggccagcg

SEQ ID NO: 335407 - RNA, 14 nt, Bordetella pertussis
gcgcaggccagcgc

SEQ ID NO: 335408 - RNA, 14 nt, Bordetella pertussis
gcgcaggccgcgcc

SEQ ID NO: 335409 - RNA, 15 nt, Bordetella pertussis
gcgcaggccgcgccg

SEQ ID NO: 335410 - RNA, 16 nt, Bordetella pertussis
gcgcaggccgcgccgg

SEQ ID NO: 335411 - RNA, 17 nt, Bordetella pertussis
gcgcaggccggcggcca

SEQ ID NO: 335412 - RNA, 20 nt, Bordetella pertussis
gcgcaggccggcggccagcg

SEQ ID NO: 335413 - RNA, 11 nt, Bordetella pertussis
gcgcaggccgc

SEQ ID NO: 335414 - RNA, 13 nt, Bordetella pertussis
gcgcaggccucgc

SEQ ID NO: 335415 - RNA, 13 nt, Bordetella pertussis
gcgcaggcgccgc

SEQ ID NO: 335416 - RNA, 19 nt, Bordetella pertussis
gcgcaggcgcgcgccuucu

SEQ ID NO: 335417 - RNA, 14 nt, Bordetella pertussis
gcgcaggcgcuuga

SEQ ID NO: 335418 - RNA, 20 nt, Bordetella pertussis
gcgcaggcgcguggccacgg

SEQ ID NO: 335419 - RNA, 22 nt, Bordetella pertussis
gcgcaggcgugcgcgggcgcca

SEQ ID NO: 335420 - RNA, 14 nt, Bordetella pertussis
gcgcaggcugucga

SEQ ID NO: 335421 - RNA, 16 nt, Bordetella pertussis
gcgcagggcggccggc

SEQ ID NO: 335422 - RNA, 19 nt, Bordetella pertussis
gcgcagggcggccggcacg

SEQ ID NO: 335423 - RNA, 21 nt, Bordetella pertussis
gcgcagggcggccggcacgcc

SEQ ID NO: 335424 - RNA, 14 nt, Bordetella pertussis
gcgcagggcgggcg

SEQ ID NO: 335425 - RNA, 22 nt, Bordetella pertussis
gcgcaggggcucuucgacagcg

SEQ ID NO: 335426 - RNA, 20 nt, Bordetella pertussis
gcgcagguauuccgccguca

SEQ ID NO: 335427 - RNA, 15 nt, Bordetella pertussis
gcgcaggucggccag

SEQ ID NO: 335428 - RNA, 20 nt, Bordetella pertussis
gcgcaggucggccaggacgg

SEQ ID NO: 335429 - RNA, 23 nt, Bordetella pertussis
gcgcaggucggcgaugcgcgggg

SEQ ID NO: 335430 - RNA, 20 nt, Bordetella pertussis
gcgcagucgagcaccgcgcg

SEQ ID NO: 335431 - RNA, 23 nt, Bordetella pertussis
gcgcaguccaaggaaagcccggc

SEQ ID NO: 335432 - RNA, 23 nt, Bordetella pertussis
gcgcauacgcggguucgacgccg

SEQ ID NO: 335433 - RNA, 13 nt, Bordetella pertussis
gcgcauacagggc

SEQ ID NO: 335434 - RNA, 18 nt, Bordetella pertussis
gcgcauauggagccaggc

SEQ ID NO: 335435 - RNA, 22 nt, Bordetella pertussis
gcgcauauggagccaggcggcg

SEQ ID NO: 335436 - RNA, 17 nt, Bordetella pertussis
gcgcaucccagacagcc

SEQ ID NO: 335437 - RNA, 19 nt, Bordetella pertussis
gcgcauccgguggugcugg

SEQ ID NO: 335438 - RNA, 17 nt, Bordetella pertussis
gcgcaucgacagcgcgc

SEQ ID NO: 335439 - RNA, 17 nt, Bordetella pertussis
gcgcaucgagcuccugc

SEQ ID NO: 335440 - RNA, 18 nt, Bordetella pertussis
gcgcaucgaucagcgcgc

SEQ ID NO: 335441 - RNA, 19 nt, Bordetella pertussis
gcgcaucgaucagcgcgcc

SEQ ID NO: 335442 - RNA, 20 nt, Bordetella pertussis
gcgcaucgaucagcgcgccg

SEQ ID NO: 335443 - RNA, 15 nt, Bordetella pertussis
gcgcaucgaugcggc

SEQ ID NO: 335444 - RNA, 16 nt, Bordetella pertussis
gcgcaucgaugcggcc

SEQ ID NO: 335445 - RNA, 17 nt, Bordetella pertussis
gcgcaucgaugcggccu

SEQ ID NO: 335446 - RNA, 16 nt, Bordetella pertussis
gcgcaucgccgcaggc

SEQ ID NO: 335447 - RNA, 20 nt, Bordetella pertussis
gcgcaucgcgaccgccaagc

SEQ ID NO: 335448 - RNA, 14 nt, Bordetella pertussis
gcgcaucgcgaugc

SEQ ID NO: 335449 - RNA, 17 nt, Bordetella pertussis
gcgcaucgcgaugcgca

SEQ ID NO: 335450 - RNA, 23 nt, Bordetella pertussis
gcgcaucgcgaugcgcagcagca

SEQ ID NO: 335451 - RNA, 23 nt, Bordetella pertussis
gcgcaucgcgcacccguuccagc

SEQ ID NO: 335452 - RNA, 13 nt, Bordetella pertussis
gcgcaucggccgg

SEQ ID NO: 335453 - RNA, 13 nt, Bordetella pertussis
gcgcaucggcggc

SEQ ID NO: 335454 - RNA, 20 nt, Bordetella pertussis
gcgcaucggcggcaggucgg

SEQ ID NO: 335455 - RNA, 15 nt, Bordetella pertussis
gcgcaucgggauccg

SEQ ID NO: 335456 - RNA, 14 nt, Bordetella pertussis
gcgcaucggcgcca

SEQ ID NO: 335457 - RNA, 15 nt, Bordetella pertussis
gcgcaucggcgccag

SEQ ID NO: 335458 - RNA, 17 nt, Bordetella pertussis
gcgcaucgucaggcagg

SEQ ID NO: 335459 - RNA, 17 nt, Bordetella pertussis
gcgccacgcgagcccgc

SEQ ID NO: 335460 - RNA, 23 nt, Bordetella pertussis
gcgccacgcuguuuucggccgac

SEQ ID NO: 335461 - RNA, 14 nt, Bordetella pertussis
gcgccacggcgucg

SEQ ID NO: 335462 - RNA, 21 nt, Bordetella pertussis
gcgccacggcgucgccggcca

SEQ ID NO: 335463 - RNA, 22 nt, Bordetella pertussis
gcgccacggcgucgccggccag

SEQ ID NO: 335464 - RNA, 21 nt, Bordetella pertussis
gcgccacggcuucgcccagcg

SEQ ID NO: 335465 - RNA, 23 nt, Bordetella pertussis
gcgccacggcuucgcccagcgcu

SEQ ID NO: 335466 - RNA, 14 nt, Bordetella pertussis
gcgccacggcuugc

SEQ ID NO: 335467 - RNA, 12 nt, Bordetella pertussis
gcgccacggucu

SEQ ID NO: 335468 - RNA, 21 nt, Bordetella pertussis
gcgccacggucugcacgccgg

SEQ ID NO: 335469 - RNA, 14 nt, Bordetella pertussis
gcgccacguccagc

SEQ ID NO: 335470 - RNA, 15 nt, Bordetella pertussis
gcgccacguccagca

SEQ ID NO: 335471 - RNA, 17 nt, Bordetella pertussis
gcgccacguccagcacg

SEQ ID NO: 335472 - RNA, 15 nt, Bordetella pertussis
gcgccacugccaggc

SEQ ID NO: 335473 - RNA, 18 nt, Bordetella pertussis
gcgccagaaagcgcggcc

SEQ ID NO: 335474 - RNA, 19 nt, Bordetella pertussis
gcgccagaaagcgcggccg

SEQ ID NO: 335475 - RNA, 17 nt, Bordetella pertussis
gcgccagaacgacagcg

SEQ ID NO: 335476 - RNA, 17 nt, Bordetella pertussis
gcgccagcaccggcacg

SEQ ID NO: 335477 - RNA, 22 nt, Bordetella pertussis
gcgccagcaccggcacgcgcca

SEQ ID NO: 335478 - RNA, 23 nt, Bordetella pertussis
gcgccagcacgaucacgaacagc

SEQ ID NO: 335479 - RNA, 19 nt, Bordetella pertussis
gcgccagcacgguggcgcc

SEQ ID NO: 335480 - RNA, 16 nt, Bordetella pertussis
gcgccagcagcacguc

SEQ ID NO: 335481 - RNA, 12 nt, Bordetella pertussis
gcgccagccgcg

SEQ ID NO: 335482 - RNA, 23 nt, Bordetella pertussis
gcgccagccgcgccugcagcagc

SEQ ID NO: 335483 - RNA, 14 nt, Bordetella pertussis
gcgccagccgcgcg

SEQ ID NO: 335484 - RNA, 18 nt, Bordetella pertussis
gcgccagccgcgcgaccu

SEQ ID NO: 335485 - RNA, 12 nt, Bordetella pertussis
gcgccagccgcu

SEQ ID NO: 335486 - RNA, 13 nt, Bordetella pertussis
gcgccagccgcuc

SEQ ID NO: 335487 - RNA, 17 nt, Bordetella pertussis
gcgccagccgcuugccc

SEQ ID NO: 335488 - RNA, 23 nt, Bordetella pertussis
gcgccagccguugcgccagcggc

SEQ ID NO: 335489 - RNA, 12 nt, Bordetella pertussis
gcgccagcgcca

SEQ ID NO: 335490 - RNA, 15 nt, Bordetella pertussis
gcgccagcgccagcg

SEQ ID NO: 335491 - RNA, 18 nt, Bordetella pertussis
gcgccagcgccagcguca

SEQ ID NO: 335492 - RNA, 13 nt, Bordetella pertussis
gcgccagcgccag

SEQ ID NO: 335493 - RNA, 14 nt, Bordetella pertussis
gcgccagcgccgcg

SEQ ID NO: 335494 - RNA, 17 nt, Bordetella pertussis
gcgccagcgccgcgcgc

SEQ ID NO: 335495 - RNA, 16 nt, Bordetella pertussis
gcgccagcgccugggc

SEQ ID NO: 335496 - RNA, 13 nt, Bordetella pertussis
gcgccagcgcgcg

SEQ ID NO: 335497 - RNA, 14 nt, Bordetella pertussis
gcgccagcgcggcc

SEQ ID NO: 335498 - RNA, 15 nt, Bordetella pertussis
gcgccagcgcggcca

SEQ ID NO: 335499 - RNA, 16 nt, Bordetella pertussis
gcgccagcgcggccag

SEQ ID NO: 335500 - RNA, 22 nt, Bordetella pertussis
gcgccagcgcggccagcgcguc

SEQ ID NO: 335501 - RNA, 23 nt, Bordetella pertussis
gcgccagcgcggccagcgcgucg

SEQ ID NO: 335502 - RNA, 20 nt, Bordetella pertussis
gcgccagcgcuguccaggcc

SEQ ID NO: 335503 - RNA, 22 nt, Bordetella pertussis
gcgccagcgcuucgggcagcuc

SEQ ID NO: 335504 - RNA, 21 nt, Bordetella pertussis
gcgccagcggauggugcucgg

SEQ ID NO: 335505 - RNA, 21 nt, Bordetella pertussis
gcgccagcuggaccgccuggc

SEQ ID NO: 335506 - RNA, 16 nt, Bordetella pertussis
gcgccagcugggcguu

SEQ ID NO: 335507 - RNA, 18 nt, Bordetella pertussis
gcgccagcugggcguugu

SEQ ID NO: 335508 - RNA, 14 nt, Bordetella pertussis
gcgccagcuugcgc

SEQ ID NO: 335509 - RNA, 18 nt, Bordetella pertussis
gcgccagcuuggccaggc

SEQ ID NO: 335510 - RNA, 22 nt, Bordetella pertussis
gcgccaggaacagcgccggcag

SEQ ID NO: 335511 - RNA, 22 nt, Bordetella pertussis
gcgccaggaagcgcgccgcgcg

SEQ ID NO: 335512 - RNA, 12 nt, Bordetella pertussis
gcgccagcgcgg

SEQ ID NO: 335513 - RNA, 14 nt, Bordetella pertussis
gcgccaggauggcc

SEQ ID NO: 335514 - RNA, 16 nt, Bordetella pertussis
gcgccaggauggccac

SEQ ID NO: 335515 - RNA, 20 nt, Bordetella pertussis
gcgccaggcaaaggcccagg

SEQ ID NO: 335516 - RNA, 22 nt, Bordetella pertussis
gcgccaggcccagggccaggua

SEQ ID NO: 335517 - RNA, 21 nt, Bordetella pertussis
gcgccaguagcgccggcuugc

SEQ ID NO: 335518 - RNA, 14 nt, Bordetella pertussis
gcgccaguccagcg

SEQ ID NO: 335519 - RNA, 17 nt, Bordetella pertussis
gcgccaguccagcgcgc

SEQ ID NO: 335520 - RNA, 18 nt, Bordetella pertussis
gcgccaguccagcgcgcc

SEQ ID NO: 335521 - RNA, 13 nt, Bordetella pertussis
gcgccaguccgcg

SEQ ID NO: 335522 - RNA, 16 nt, Bordetella pertussis
gcgccaguccgcgcuc

SEQ ID NO: 335523 - RNA, 14 nt, Bordetella pertussis
gcgccagucgcgca

SEQ ID NO: 335524 - RNA, 23 nt, Bordetella pertussis
gcgccagucgcgcagcaccucgg

SEQ ID NO: 335525 - RNA, 20 nt, Bordetella pertussis
gcgccaguucaaggcgcgag

SEQ ID NO: 335526 - RNA, 16 nt, Bordetella pertussis
gcgccaguucgguuuc

SEQ ID NO: 335527 - RNA, 14 nt, Bordetella pertussis
gcgccaguugcgca

SEQ ID NO: 335528 - RNA, 16 nt, Bordetella pertussis
gcgccaguugcgcacc

SEQ ID NO: 335529 - RNA, 19 nt, Bordetella pertussis
gcgccaguugcgcaccgcu

SEQ ID NO: 335530 - RNA, 20 nt, Bordetella pertussis
gcgccaguugcggggcgccc

SEQ ID NO: 335531 - RNA, 24 nt, Bordetella pertussis
gcgccaguugcggggcgcccagcg

SEQ ID NO: 335532 - RNA, 23 nt, Bordetella pertussis
gcgccaguucgaguuccgcgacg

SEQ ID NO: 335533 - RNA, 16 nt, Bordetella pertussis
gcgccauacccggucg

SEQ ID NO: 335534 - RNA, 20 nt, Bordetella pertussis
gcgccauugccacggcgggc

SEQ ID NO: 335535 - RNA, 18 nt, Bordetella pertussis
gcgcccaauccgaucagc

SEQ ID NO: 335536 - RNA, 20 nt, Bordetella pertussis
gcgcccaauccgaucagcac

SEQ ID NO: 335537 - RNA, 18 nt, Bordetella pertussis
gcgcccaaucgggcagca

SEQ ID NO: 335538 - RNA, 21 nt, Bordetella pertussis
gcgcccaaucgggcagcacgc

SEQ ID NO: 335539 - RNA, 22 nt, Bordetella pertussis
gcgcccaaucgggcagcacgcg

SEQ ID NO: 335540 - RNA, 16 nt, Bordetella pertussis
gcgcccaccgagacgc

SEQ ID NO: 335541 - RNA, 14 nt, Bordetella pertussis
gcgcccacggccug

SEQ ID NO: 335542 - RNA, 21 nt, Bordetella pertussis
gcgcccacggccuguccggca

SEQ ID NO: 335543 - RNA, 14 nt, Bordetella pertussis
gcgcccagcagcgc

SEQ ID NO: 335544 - RNA, 17 nt, Bordetella pertussis
gcgcccagcagcgccac

SEQ ID NO: 335545 - RNA, 18 nt, Bordetella pertussis
gcgcccagcauggucggc

SEQ ID NO: 335546 - RNA, 23 nt, Bordetella pertussis
gcgcccagcauggucggcauggc

SEQ ID NO: 335547 - RNA, 13 nt, Bordetella pertussis
gcgcccagccccg

SEQ ID NO: 335548 - RNA, 17 nt, Bordetella pertussis
gcgcccagccgcgccau

SEQ ID NO: 335549 - RNA, 13 nt, Bordetella pertussis
gcgcccagcgagc

SEQ ID NO: 335550 - RNA, 16 nt, Bordetella pertussis
gcgcccagcgagcugc

SEQ ID NO: 335551 - RNA, 12 nt, Bordetella pertussis
gcgcccagcgcc

SEQ ID NO: 335552 - RNA, 13 nt, Bordetella pertussis
gcgcccagcgcca

SEQ ID NO: 335553 - RNA, 15 nt, Bordetella pertussis
gcgcccagcgccauc

SEQ ID NO: 335554 - RNA, 13 nt, Bordetella pertussis
gcgcccagcgucu

SEQ ID NO: 335555 - RNA, 13 nt, Bordetella pertussis
gcgcccagcugcu

SEQ ID NO: 335556 - RNA, 13 nt, Bordetella pertussis
gcgcccagcuggc

SEQ ID NO: 335557 - RNA, 16 nt, Bordetella pertussis
gcgcccagcuggcgcc

SEQ ID NO: 335558 - RNA, 21 nt, Bordetella pertussis
gcgcccagcgcgucggccagc

SEQ ID NO: 335559 - RNA, 16 nt, Bordetella pertussis
gcgcccaggccagcca

SEQ ID NO: 335560 - RNA, 20 nt, Bordetella pertussis
gcgcccaggcccagcgcgcc

SEQ ID NO: 335561 - RNA, 19 nt, Bordetella pertussis
gcgcccaggccgaucagcg

SEQ ID NO: 335562 - RNA, 16 nt, Bordetella pertussis
gcgcccaggggccggc

SEQ ID NO: 335563 - RNA, 20 nt, Bordetella pertussis
gcgcccaggggccggcgcgc

SEQ ID NO: 335564 - RNA, 21 nt, Bordetella pertussis
gcgcccagggugguggccucg

SEQ ID NO: 335565 - RNA, 21 nt, Bordetella pertussis
gcgcccagguccugcgccagc

SEQ ID NO: 335566 - RNA, 22 nt, Bordetella pertussis
gcgcccagguccugcgccagcu

SEQ ID NO: 335567 - RNA, 14 nt, Bordetella pertussis
gcgcccaggcgaug

SEQ ID NO: 335568 - RNA, 21 nt, Bordetella pertussis
gcgcccaggcgaugcccagcg

SEQ ID NO: 335569 - RNA, 20 nt, Bordetella pertussis
gcgcccaguuccacgcggcc

SEQ ID NO: 335570 - RNA, 15 nt, Bordetella pertussis
gcgcccaugcgcugg

SEQ ID NO: 335571 - RNA, 16 nt, Bordetella pertussis
gcgcccaugcgcuggc

SEQ ID NO: 335572 - RNA, 18 nt, Bordetella pertussis
gcgcccaugcgcuggcgc

SEQ ID NO: 335573 - RNA, 19 nt, Bordetella pertussis
gcgcccaugcgcuggcgca

SEQ ID NO: 335574 - RNA, 13 nt, Bordetella pertussis
gcgcccauggcgc

SEQ ID NO: 335575 - RNA, 17 nt, Bordetella pertussis
gcgcccauggcgcgcag

SEQ ID NO: 335576 - RNA, 17 nt, Bordetella pertussis
gcgccccaacgcggcca

SEQ ID NO: 335577 - RNA, 15 nt, Bordetella pertussis
gcgcccccagcagcg

SEQ ID NO: 335578 - RNA, 14 nt, Bordetella pertussis
gcgcccccagcgcc

SEQ ID NO: 335579 - RNA, 12 nt, Bordetella pertussis
gcgcccgacggc

SEQ ID NO: 335580 - RNA, 16 nt, Bordetella pertussis
gcgcccgacggcgcgc

SEQ ID NO: 335581 - RNA, 15 nt, Bordetella pertussis
gcgcccgagagcugc

SEQ ID NO: 335582 - RNA, 12 nt, Bordetella pertussis
gcgcccgagcgc

SEQ ID NO: 335583 - RNA, 14 nt, Bordetella pertussis
gcgcccgagcgcca

SEQ ID NO: 335584 - RNA, 15 nt, Bordetella pertussis
gcgcccgagcgccac

SEQ ID NO: 335585 - RNA, 13 nt, Bordetella pertussis
gcgcccgaugccc

SEQ ID NO: 335586 - RNA, 13 nt, Bordetella pertussis
gcgcccgaugccu

SEQ ID NO: 335587 - RNA, 19 nt, Bordetella pertussis
gcgcccgaugcucgccggc

SEQ ID NO: 335588 - RNA, 20 nt, Bordetella pertussis
gcgcccgaugcucgccggcg

SEQ ID NO: 335589 - RNA, 19 nt, Bordetella pertussis
gcgcccgcaacgggccggc

SEQ ID NO: 335590 - RNA, 21 nt, Bordetella pertussis
gcgcccgcaacgggccggccg

SEQ ID NO: 335591 - RNA, 15 nt, Bordetella pertussis
gcgcccgcaggcggc

SEQ ID NO: 335592 - RNA, 17 nt, Bordetella pertussis
gcgcccgcaggcggcgg

SEQ ID NO: 335593 - RNA, 18 nt, Bordetella pertussis
gcgcccgcaggcggcggc

SEQ ID NO: 335594 - RNA, 19 nt, Bordetella pertussis
gcgcccgcaggcggcggcc

SEQ ID NO: 335595 - RNA, 21 nt, Bordetella pertussis
gcgcccgcaggcggcggccuc

SEQ ID NO: 335596 - RNA, 13 nt, Bordetella pertussis
gcgcccgcaucgg

SEQ ID NO: 335597 - RNA, 20 nt, Bordetella pertussis
gcgcccgcaucggcuggcgc

SEQ ID NO: 335598 - RNA, 22 nt, Bordetella pertussis
gcgcccgcauggaccgccgccg

SEQ ID NO: 335599 - RNA, 21 nt, Bordetella pertussis
gcgcccgcggccugcgcgucc

SEQ ID NO: 335600 - RNA, 13 nt, Bordetella pertussis
gcgcccgcggccu

SEQ ID NO: 335601 - RNA, 14 nt, Bordetella pertussis
gcgcccgcugcguc

SEQ ID NO: 335602 - RNA, 15 nt, Bordetella pertussis
gcgcccgcugcgucc

SEQ ID NO: 335603 - RNA, 16 nt, Bordetella pertussis
gcgcccgcugcgucca

SEQ ID NO: 335604 - RNA, 19 nt, Bordetella pertussis
gcgcccgcuugcggccggc

SEQ ID NO: 335605 - RNA, 16 nt, Bordetella pertussis
gcgcccgcuugggccg

SEQ ID NO: 335606 - RNA, 12 nt, Bordetella pertussis
gcgcccggccac

SEQ ID NO: 335607 - RNA, 16 nt, Bordetella pertussis
gcgccgaaggcggcgc

SEQ ID NO: 335608 - RNA, 18 nt, Bordetella pertussis
gcgccgaaggcggcgccg

SEQ ID NO: 335609 - RNA, 21 nt, Bordetella pertussis
gcgccgaaggcggcgccggug

SEQ ID NO: 335610 - RNA, 17 nt, Bordetella pertussis
gcgccgaaguugcggcc

SEQ ID NO: 335611 - RNA, 18 nt, Bordetella pertussis
gcgccgaaguugcggccg

SEQ ID NO: 335612 - RNA, 19 nt, Bordetella pertussis
gcgccgaaguugcggccgu

SEQ ID NO: 335613 - RNA, 21 nt, Bordetella pertussis
gcgccgacaggaaggcgagcg

SEQ ID NO: 335614 - RNA, 18 nt, Bordetella pertussis
gcgccgacagguaggcgc

SEQ ID NO: 335615 - RNA, 19 nt, Bordetella pertussis
gcgccgaccacgcugggcc

SEQ ID NO: 335616 - RNA, 20 nt, Bordetella pertussis
gcgccgaccacgcugggcca

SEQ ID NO: 335617 - RNA, 22 nt, Bordetella pertussis
gcgccgaccacgcugggccaga

SEQ ID NO: 335618 - RNA, 20 nt, Bordetella pertussis
gcgccgaccagguaucgacc

SEQ ID NO: 335619 - RNA, 23 nt, Bordetella pertussis
gcgccgacccgagcccuggcuug

SEQ ID NO: 335620 - RNA, 16 nt, Bordetella pertussis
gcgccgacccugcccg

SEQ ID NO: 335621 - RNA, 14 nt, Bordetella pertussis
gcgccgaccgcacg

SEQ ID NO: 335622 - RNA, 13 nt, Bordetella pertussis
gcgccgaccggcc

SEQ ID NO: 335623 - RNA, 16 nt, Bordetella pertussis
gcgccgaccggcccca

SEQ ID NO: 335624 - RNA, 15 nt, Bordetella pertussis
gcgccgaccgggccg

SEQ ID NO: 335625 - RNA, 17 nt, Bordetella pertussis
gcgccgaccgggccgac

SEQ ID NO: 335626 - RNA, 19 nt, Bordetella pertussis
gcgccgaccgggccgacca

SEQ ID NO: 335627 - RNA, 19 nt, Bordetella pertussis
gcgccgagauggacgcguu

SEQ ID NO: 335628 - RNA, 18 nt, Bordetella pertussis
gcgccgagcagaucgcca

SEQ ID NO: 335629 - RNA, 21 nt, Bordetella pertussis
gcgccgagcagaucgccaacg

SEQ ID NO: 335630 - RNA, 14 nt, Bordetella pertussis
gcgccgagcggggc

SEQ ID NO: 335631 - RNA, 18 nt, Bordetella pertussis
gcgccgaggaucuggccg

SEQ ID NO: 335632 - RNA, 21 nt, Bordetella pertussis
gcgccgaggaucuggccggcg

SEQ ID NO: 335633 - RNA, 14 nt, Bordetella pertussis
gcgccgaggccugc

SEQ ID NO: 335634 - RNA, 15 nt, Bordetella pertussis
gcgccgaugcgccag

SEQ ID NO: 335635 - RNA, 17 nt, Bordetella pertussis
gcgccgaugcgccaggc

SEQ ID NO: 335636 - RNA, 18 nt, Bordetella pertussis
gcgccgaugcgccaggcu

SEQ ID NO: 335637 - RNA, 12 nt, Bordetella pertussis
gcgccgauggcg

SEQ ID NO: 335638 - RNA, 15 nt, Bordetella pertussis
gcgccgauggcgccg

SEQ ID NO: 335639 - RNA, 16 nt, Bordetella pertussis
gcgccgauggcgccgc

SEQ ID NO: 335640 - RNA, 18 nt, Bordetella pertussis
gcgccgauggcgccgcug

SEQ ID NO: 335641 - RNA, 21 nt, Bordetella pertussis
gcgccgauggcgccgcugucg

SEQ ID NO: 335642 - RNA, 18 nt, Bordetella pertussis
gcgccgaggcgggcagca

SEQ ID NO: 335643 - RNA, 22 nt, Bordetella pertussis
gcgccgcaacaggcagcugcgc

SEQ ID NO: 335644 - RNA, 23 nt, Bordetella pertussis
gcgccgcaacaggcagcugcgcg

SEQ ID NO: 335645 - RNA, 13 nt, Bordetella pertussis
gcgccgcagcguc

SEQ ID NO: 335646 - RNA, 19 nt, Bordetella pertussis
gcgccgcagcgucgcggcg

SEQ ID NO: 335647 - RNA, 14 nt, Bordetella pertussis
gcgccgcagcgugg

SEQ ID NO: 335648 - RNA, 20 nt, Bordetella pertussis
gcgccgcagcguggcguagg

SEQ ID NO: 335649 - RNA, 18 nt, Bordetella pertussis
gcgccgauuucgccgccg

SEQ ID NO: 335650 - RNA, 21 nt, Bordetella pertussis
gcgccgauuucgccgccgcca

SEQ ID NO: 335651 - RNA, 15 nt, Bordetella pertussis
gcgccgcaugcggcg

SEQ ID NO: 335652 - RNA, 17 nt, Bordetella pertussis
gcgccgcaugcggcggc

SEQ ID NO: 335653 - RNA, 22 nt, Bordetella pertussis
gcgccgcaugcggcggcugugg

SEQ ID NO: 335654 - RNA, 19 nt, Bordetella pertussis
gcgccgcauuuccucgacc

SEQ ID NO: 335655 - RNA, 23 nt, Bordetella pertussis
gcgccgcauuuccucgaccagcg

SEQ ID NO: 335656 - RNA, 12 nt, Bordetella pertussis
gcgccgccggcc

SEQ ID NO: 335657 - RNA, 13 nt, Bordetella pertussis
gcgccgccggcca

SEQ ID NO: 335658 - RNA, 17 nt, Bordetella pertussis
gcgccgccggccagccu

SEQ ID NO: 335659 - RNA, 23 nt, Bordetella pertussis
gcgccgccggccagccugugcgc

SEQ ID NO: 335660 - RNA, 14 nt, Bordetella pertussis
gcgccgccggccau

SEQ ID NO: 335661 - RNA, 16 nt, Bordetella pertussis
gcgccgccggccauca

SEQ ID NO: 335662 - RNA, 13 nt, Bordetella pertussis
gcgccgccggccu

SEQ ID NO: 335663 - RNA, 14 nt, Bordetella pertussis
gcgccgccggccug

SEQ ID NO: 335664 - RNA, 17 nt, Bordetella pertussis
gcgccgccggcggccug

SEQ ID NO: 335665 - RNA, 20 nt, Bordetella pertussis
gcgccgccggcggccuggac

SEQ ID NO: 335666 - RNA, 15 nt, Bordetella pertussis
gcgccgccgggccug

SEQ ID NO: 335667 - RNA, 12 nt, Bordetella pertussis
gcgccgccggug

SEQ ID NO: 335668 - RNA, 14 nt, Bordetella pertussis
gcgccgccggugca

SEQ ID NO: 335669 - RNA, 14 nt, Bordetella pertussis
gcgccgccgugcgc

SEQ ID NO: 335670 - RNA, 19 nt, Bordetella pertussis
gcgccgccucaggccggcg

SEQ ID NO: 335671 - RNA, 14 nt, Bordetella pertussis
gcgccgccucgacc

SEQ ID NO: 335672 - RNA, 16 nt, Bordetella pertussis
gcgccgccucgaccgg

SEQ ID NO: 335673 - RNA, 18 nt, Bordetella pertussis
gcgccgccucgaccggcg

SEQ ID NO: 335674 - RNA, 17 nt, Bordetella pertussis
gcgccgccuaccaggug

SEQ ID NO: 335675 - RNA, 21 nt, Bordetella pertussis
gcgccgccuaccaggugggcg

SEQ ID NO: 335676 - RNA, 22 nt, Bordetella pertussis
gcgccgccucgauugaccagca

SEQ ID NO: 335677 - RNA, 16 nt, Bordetella pertussis
gcgccgccucgcgcuc

SEQ ID NO: 335678 - RNA, 15 nt, Bordetella pertussis
gcgccgccucgggca

SEQ ID NO: 335679 - RNA, 12 nt, Bordetella pertussis
gcgccgccuggu

SEQ ID NO: 335680 - RNA, 23 nt, Bordetella pertussis
gcgccgccugguaguaaucgcgc

SEQ ID NO: 335681 - RNA, 17 nt, Bordetella pertussis
gcgccgccuucaccggc

SEQ ID NO: 335682 - RNA, 21 nt, Bordetella pertussis
gcgccgccuucaccggcccca

SEQ ID NO: 335683 - RNA, 18 nt, Bordetella pertussis
gcgccgcgaacuggcggu

SEQ ID NO: 335684 - RNA, 12 nt, Bordetella pertussis
gcgccgcgagcg

SEQ ID NO: 335685 - RNA, 13 nt, Bordetella pertussis
gcgccgcgagcgc

SEQ ID NO: 335686 - RNA, 15 nt, Bordetella pertussis
gcgccgcgagcgccg

SEQ ID NO: 335687 - RNA, 17 nt, Bordetella pertussis
gcgccgcgauggcgccg

SEQ ID NO: 335688 - RNA, 17 nt, Bordetella pertussis
gcgccgcgcacgcacug

SEQ ID NO: 335689 - RNA, 12 nt, Bordetella pertussis
gcgccgcgcaga

SEQ ID NO: 335690 - RNA, 13 nt, Bordetella pertussis
gcgccgcgcagca

SEQ ID NO: 335691 - RNA, 14 nt, Bordetella pertussis
gcgccgcgcagcag

SEQ ID NO: 335692 - RNA, 17 nt, Bordetella pertussis
gcgccgcgcaucgauca

SEQ ID NO: 335693 - RNA, 22 nt, Bordetella pertussis
gcgccgcgccagguaggccggc

SEQ ID NO: 335694 - RNA, 20 nt, Bordetella pertussis
gcgccgcgcccggccggccc

SEQ ID NO: 335695 - RNA, 21 nt, Bordetella pertussis
gcgccgcgccgaaggcgugcu

SEQ ID NO: 335696 - RNA, 15 nt, Bordetella pertussis
gcgccgcgccaacgc

SEQ ID NO: 335697 - RNA, 15 nt, Bordetella pertussis
gcgccgcgccgggcg

SEQ ID NO: 335698 - RNA, 15 nt, Bordetella pertussis
gcgccgcgccgguca

SEQ ID NO: 335699 - RNA, 16 nt, Bordetella pertussis
gcgccgcgccuugccc

SEQ ID NO: 335700 - RNA, 17 nt, Bordetella pertussis
gcgccgcgccuugcccg

SEQ ID NO: 335701 - RNA, 19 nt, Bordetella pertussis
gcgccgcgcgcggcggccu

SEQ ID NO: 335702 - RNA, 12 nt, Bordetella pertussis
gcgccgcgcgcu

SEQ ID NO: 335703 - RNA, 16 nt, Bordetella pertussis
gcgccgcgcucgcgcc

SEQ ID NO: 335704 - RNA, 21 nt, Bordetella pertussis
gcgccgcgcucgcgccaggcc

SEQ ID NO: 335705 - RNA, 22 nt, Bordetella pertussis
gcgccgcgcucgcgccaggccc

SEQ ID NO: 335706 - RNA, 12 nt, Bordetella pertussis
gcgccgcgcuga

SEQ ID NO: 335707 - RNA, 14 nt, Bordetella pertussis
gcgccgcgcugauc

SEQ ID NO: 335708 - RNA, 15 nt, Bordetella pertussis
gcgccgcgcugaucc

SEQ ID NO: 335709 - RNA, 16 nt, Bordetella pertussis
gcgccgcgcuucgucg

SEQ ID NO: 335710 - RNA, 12 nt, Bordetella pertussis
gcgccgcggccg

SEQ ID NO: 335711 - RNA, 14 nt, Bordetella pertussis
gcgccgcggccggc

SEQ ID NO: 335712 - RNA, 15 nt, Bordetella pertussis
gcgccgcggccuguc

SEQ ID NO: 335713 - RNA, 16 nt, Bordetella pertussis
gcgccgcggcgcugga

SEQ ID NO: 335714 - RNA, 13 nt, Bordetella pertussis
gcgccgcggcggc

SEQ ID NO: 335715 - RNA, 14 nt, Bordetella pertussis
gcgccgcggcgucc

SEQ ID NO: 335716 - RNA, 15 nt, Bordetella pertussis
gcgccgcgucgagcg

SEQ ID NO: 335717 - RNA, 19 nt, Bordetella pertussis
gcgccgcguucacgccggc

SEQ ID NO: 335718 - RNA, 20 nt, Bordetella pertussis
gcgccgcguucacgccggcg

SEQ ID NO: 335719 - RNA, 16 nt, Bordetella pertussis
gcgccgcuacagcguc

SEQ ID NO: 335720 - RNA, 24 nt, Bordetella pertussis
gcgccgcucagcgcggcgcggcca

SEQ ID NO: 335721 - RNA, 19 nt, Bordetella pertussis
gcgccgcucgacgucgccc

SEQ ID NO: 335722 - RNA, 17 nt, Bordetella pertussis
gcgccgcugcagcgcug

SEQ ID NO: 335723 - RNA, 14 nt, Bordetella pertussis
gcgccgcuggccac

SEQ ID NO: 335724 - RNA, 13 nt, Bordetella pertussis
gcgccgcuggcgg

SEQ ID NO: 335725 - RNA, 16 nt, Bordetella pertussis
gcgccgcuggcggccg

SEQ ID NO: 335726 - RNA, 19 nt, Bordetella pertussis
gcgccgcuggcggccgcgg

SEQ ID NO: 335727 - RNA, 14 nt, Bordetella pertussis
gcgccgcuggcguc

SEQ ID NO: 335728 - RNA, 17 nt, Bordetella pertussis
gcgccgcuggcguccag

SEQ ID NO: 335729 - RNA, 12 nt, Bordetella pertussis
gcgccgcugugg

SEQ ID NO: 335730 - RNA, 21 nt, Bordetella pertussis
gcgccgcuguugcccaccagc

SEQ ID NO: 335731 - RNA, 22 nt, Bordetella pertussis
gcgccgcuguugcccaccagcc

SEQ ID NO: 335732 - RNA, 18 nt, Bordetella pertussis
gcgccgcuuccaccgucu

SEQ ID NO: 335733 - RNA, 20 nt, Bordetella pertussis
gcgccgcuuccaccgucugg

SEQ ID NO: 335734 - RNA, 21 nt, Bordetella pertussis
gcgccgcuuccaccgucuggc

SEQ ID NO: 335735 - RNA, 14 nt, Bordetella pertussis
gcgccgcuuccggc

SEQ ID NO: 335736 - RNA, 15 nt, Bordetella pertussis
gcgccgcuuccggcc

SEQ ID NO: 335737 - RNA, 22 nt, Bordetella pertussis
gcgccgcuugcguucaugccgg

SEQ ID NO: 335738 - RNA, 23 nt, Bordetella pertussis
gcgccgcuugcguucaugccggu

SEQ ID NO: 335739 - RNA, 17 nt, Bordetella pertussis
gcgccggaacauggcgg

SEQ ID NO: 335740 - RNA, 22 nt, Bordetella pertussis
gcgccggacgcaaaaacgcccg

SEQ ID NO: 335741 - RNA, 17 nt, Bordetella pertussis
gcgccggacguagucgc

SEQ ID NO: 335742 - RNA, 15 nt, Bordetella pertussis
gcgccguggugcuga

SEQ ID NO: 335743 - RNA, 18 nt, Bordetella pertussis
gcgccguuccugcagcgu

SEQ ID NO: 335744 - RNA, 19 nt, Bordetella pertussis
gcgccguuccugcagcgug

SEQ ID NO: 335745 - RNA, 18 nt, Bordetella pertussis
gcgccguucgucgcgcag

SEQ ID NO: 335746 - RNA, 21 nt, Bordetella pertussis
gcgccguucgucgcgcagcag

SEQ ID NO: 335747 - RNA, 18 nt, Bordetella pertussis
gcgccguucucaggccga

SEQ ID NO: 335748 - RNA, 19 nt, Bordetella pertussis
gcgccguucucaggccgag

SEQ ID NO: 335749 - RNA, 16 nt, Bordetella pertussis
gcgccuacacgguggc

SEQ ID NO: 335750 - RNA, 20 nt, Bordetella pertussis
gcgccuacagcagcggcucg

SEQ ID NO: 335751 - RNA, 24 nt, Bordetella pertussis
gcgccuacagcagcggcucgagcg

SEQ ID NO: 335752 - RNA, 16 nt, Bordetella pertussis
gcgccuaccggcgccg

SEQ ID NO: 335753 - RNA, 20 nt, Bordetella pertussis
gcgccuaccggcgccgacgc

SEQ ID NO: 335754 - RNA, 22 nt, Bordetella pertussis
gcgccuaccggcgccgacgcgc

SEQ ID NO: 335755 - RNA, 16 nt, Bordetella pertussis
gcgccuacggcggcgg

SEQ ID NO: 335756 - RNA, 18 nt, Bordetella pertussis
gcgccuacggcggcggcc

SEQ ID NO: 335757 - RNA, 19 nt, Bordetella pertussis
gcgccuacggcggcggcca

SEQ ID NO: 335758 - RNA, 19 nt, Bordetella pertussis
gcgccuauaucgacggcgc

SEQ ID NO: 335759 - RNA, 20 nt, Bordetella pertussis
gcgccuauaucgacggcgcc

SEQ ID NO: 335760 - RNA, 17 nt, Bordetella pertussis
gcgccuaucaggccucg

SEQ ID NO: 335761 - RNA, 20 nt, Bordetella pertussis
gcgccuaucaggccucgaag

SEQ ID NO: 335762 - RNA, 22 nt, Bordetella pertussis
gcgccuccagcuccagcgcgcc

SEQ ID NO: 335763 - RNA, 22 nt, Bordetella pertussis
gcgccucgaacguccgccccau

SEQ ID NO: 335764 - RNA, 14 nt, Bordetella pertussis
gcgccucgaagauc

SEQ ID NO: 335765 - RNA, 17 nt, Bordetella pertussis
gcgccucgaugauggcg

SEQ ID NO: 335766 - RNA, 19 nt, Bordetella pertussis
gcgccucgaugauggcguc

SEQ ID NO: 335767 - RNA, 20 nt, Bordetella pertussis
gcgccucgaugauggcgucc

SEQ ID NO: 335768 - RNA, 13 nt, Bordetella pertussis
gcgccucgcgacg

SEQ ID NO: 335769 - RNA, 17 nt, Bordetella pertussis
gcgccucgcgcuccaug

SEQ ID NO: 335770 - RNA, 20 nt, Bordetella pertussis
gcgccucgcgcuccaugggc

SEQ ID NO: 335771 - RNA, 22 nt, Bordetella pertussis
gcgccucgcgcuccaugggcgu

SEQ ID NO: 335772 - RNA, 19 nt, Bordetella pertussis
gcgccucgcgcucgagcgc

SEQ ID NO: 335773 - RNA, 20 nt, Bordetella pertussis
gcgccucggacgccuggcgc

SEQ ID NO: 335774 - RNA, 21 nt, Bordetella pertussis
gcgccucggacgccuggcgcg

SEQ ID NO: 335775 - RNA, 18 nt, Bordetella pertussis
gcgccucggcgcgcgcgg

SEQ ID NO: 335776 - RNA, 21 nt, Bordetella pertussis
gcgccucguccugcaggcggc

SEQ ID NO: 335777 - RNA, 22 nt, Bordetella pertussis
gcgccucguccugcaggcggcg

SEQ ID NO: 335778 - RNA, 22 nt, Bordetella pertussis
gcgccuggggcgggcgggcgca

SEQ ID NO: 335779 - RNA, 23 nt, Bordetella pertussis
gcgccuggggcgugcccuugagc

SEQ ID NO: 335780 - RNA, 16 nt, Bordetella pertussis
gcgccugggggcugga

SEQ ID NO: 335781 - RNA, 15 nt, Bordetella pertussis
gcgccugguacgaca

SEQ ID NO: 335782 - RNA, 19 nt, Bordetella pertussis
gcgccugucccaggcgcuc

SEQ ID NO: 335783 - RNA, 13 nt, Bordetella pertussis
gcgccuuccggca

SEQ ID NO: 335784 - RNA, 18 nt, Bordetella pertussis
gcgccuuccggcagcggc

SEQ ID NO: 335785 - RNA, 23 nt, Bordetella pertussis
gcgccuuccggcagcggccagcg

SEQ ID NO: 335786 - RNA, 17 nt, Bordetella pertussis
gcgccuucgaggccggc

SEQ ID NO: 335787 - RNA, 17 nt, Bordetella pertussis
gcgccuucggcaggcgc

SEQ ID NO: 335788 - RNA, 15 nt, Bordetella pertussis
gcgccuucggcgcgc

SEQ ID NO: 335789 - RNA, 20 nt, Bordetella pertussis
gcgccuucggcgcggcgggc

SEQ ID NO: 335790 - RNA, 20 nt, Bordetella pertussis
gcgccuugcgcggcgagcgc

SEQ ID NO: 335791 - RNA, 16 nt, Bordetella pertussis
gcgccuugcggcgaug

SEQ ID NO: 335792 - RNA, 18 nt, Bordetella pertussis
gcgccuugcggcgaugca

SEQ ID NO: 335793 - RNA, 14 nt, Bordetella pertussis
gcgccuugcggcgc

SEQ ID NO: 335794 - RNA, 15 nt, Bordetella pertussis
gcgccuugcggcgcu

SEQ ID NO: 335795 - RNA, 13 nt, Bordetella pertussis
gcgccuuggcgcg

SEQ ID NO: 335796 - RNA, 15 nt, Bordetella pertussis
gcgccuuggcgcgca

SEQ ID NO: 335797 - RNA, 16 nt, Bordetella pertussis
gcgcgaccacuggcag

SEQ ID NO: 335798 - RNA, 18 nt, Bordetella pertussis
gcgcgaccacuggcagac

SEQ ID NO: 335799 - RNA, 13 nt, Bordetella pertussis
gcgcgaccgccuc

SEQ ID NO: 335800 - RNA, 18 nt, Bordetella pertussis
gcgcgaccgccuccagcg

SEQ ID NO: 335801 - RNA, 19 nt, Bordetella pertussis
gcgcgaccgccuccagcgc

SEQ ID NO: 335802 - RNA, 20 nt, Bordetella pertussis
gcgcgaccgccuccagcgcg

SEQ ID NO: 335803 - RNA, 16 nt, Bordetella pertussis
gcgcgaccgcgcggcg

SEQ ID NO: 335804 - RNA, 23 nt, Bordetella pertussis
gcgcgaccuccggcaacagcagg

SEQ ID NO: 335805 - RNA, 23 nt, Bordetella pertussis
gcgcgaccucgggacggcccugc

SEQ ID NO: 335806 - RNA, 20 nt, Bordetella pertussis
gcgcgaccugcgcgaccgcc

SEQ ID NO: 335807 - RNA, 19 nt, Bordetella pertussis
gcgcgaccuugucuucgau

SEQ ID NO: 335808 - RNA, 14 nt, Bordetella pertussis
gcgcgacgacagcg

SEQ ID NO: 335809 - RNA, 18 nt, Bordetella pertussis
gcgcgacgacagcggcga

SEQ ID NO: 335810 - RNA, 13 nt, Bordetella pertussis
gcgcgacgccagc

SEQ ID NO: 335811 - RNA, 21 nt, Bordetella pertussis
gcgcgacgccagcgcgccaug

SEQ ID NO: 335812 - RNA, 12 nt, Bordetella pertussis
gcgcgacgccgu

SEQ ID NO: 335813 - RNA, 15 nt, Bordetella pertussis
gcgcgacgccguggu

SEQ ID NO: 335814 - RNA, 13 nt, Bordetella pertussis
gcgcgacgcgcuu

SEQ ID NO: 335815 - RNA, 15 nt, Bordetella pertussis
gcgcgacggcgccgg

SEQ ID NO: 335816 - RNA, 15 nt, Bordetella pertussis
gcgcgacggcggccu

SEQ ID NO: 335817 - RNA, 13 nt, Bordetella pertussis
gcgcgacuggccc

SEQ ID NO: 335818 - RNA, 17 nt, Bordetella pertussis
gcgcgacuggcccaggc

SEQ ID NO: 335819 - RNA, 14 nt, Bordetella pertussis
gcgcgacuucaggu

SEQ ID NO: 335820 - RNA, 21 nt, Bordetella pertussis
gcgcgacuuccucgacccgcg

SEQ ID NO: 335821 - RNA, 16 nt, Bordetella pertussis
gcgcgagaaccaggcc

SEQ ID NO: 335822 - RNA, 19 nt, Bordetella pertussis
gcgcgagaaccaggccacg

SEQ ID NO: 335823 - RNA, 18 nt, Bordetella pertussis
gcgcgacuccaccggcgu

SEQ ID NO: 335824 - RNA, 20 nt, Bordetella pertussis
gcgcgacuccaccggcguca

SEQ ID NO: 335825 - RNA, 22 nt, Bordetella pertussis
gcgcgagaagucaucgauggcc

SEQ ID NO: 335826 - RNA, 17 nt, Bordetella pertussis
gcgcgagaauggcgcga

SEQ ID NO: 335827 - RNA, 23 nt, Bordetella pertussis
gcgcgagaccacgauggccggcg

SEQ ID NO: 335828 - RNA, 16 nt, Bordetella pertussis
gcgcgagaccagcgga

SEQ ID NO: 335829 - RNA, 17 nt, Bordetella pertussis
gcgcgagaccagcggau

SEQ ID NO: 335830 - RNA, 15 nt, Bordetella pertussis
gcgcgagcagggcau

SEQ ID NO: 335831 - RNA, 17 nt, Bordetella pertussis
gcgcgagcagggcauca

SEQ ID NO: 335832 - RNA, 13 nt, Bordetella pertussis
gcgcgagcccauc

SEQ ID NO: 335833 - RNA, 14 nt, Bordetella pertussis
gcgcgagccgccca

SEQ ID NO: 335834 - RNA, 21 nt, Bordetella pertussis
gcgcgagccgcccacgggcgc

SEQ ID NO: 335835 - RNA, 22 nt, Bordetella pertussis
gcgcgagccgcccacgggcgcc

SEQ ID NO: 335836 - RNA, 14 nt, Bordetella pertussis
gcgcgagcgcaagc

SEQ ID NO: 335837 - RNA, 15 nt, Bordetella pertussis
gcgcgagcgcacagg

SEQ ID NO: 335838 - RNA, 15 nt, Bordetella pertussis
gcgcgagcgccgggc

SEQ ID NO: 335839 - RNA, 17 nt, Bordetella pertussis
gcgcgagcgccgggcgc

SEQ ID NO: 335840 - RNA, 16 nt, Bordetella pertussis
gcgcgcaacuccagca

SEQ ID NO: 335841 - RNA, 18 nt, Bordetella pertussis
gcgcgcaacuccagcaua

SEQ ID NO: 335842 - RNA, 19 nt, Bordetella pertussis
gcgcgcaagccgccgcccu

SEQ ID NO: 335843 - RNA, 20 nt, Bordetella pertussis
gcgcgcaagguggcgguggu

SEQ ID NO: 335844 - RNA, 19 nt, Bordetella pertussis
gcgcgcacacuggccagca

SEQ ID NO: 335845 - RNA, 15 nt, Bordetella pertussis
gcgcgcaccaucgcc

SEQ ID NO: 335846 - RNA, 17 nt, Bordetella pertussis
gcgcgcaccaucgccga

SEQ ID NO: 335847 - RNA, 23 nt, Bordetella pertussis
gcgcgcaccauucucgcccugcu

SEQ ID NO: 335848 - RNA, 21 nt, Bordetella pertussis
gcgcgcaaugcgcggcgcuca

SEQ ID NO: 335849 - RNA, 19 nt, Bordetella pertussis
gcgcgcacgcgcucgggca

SEQ ID NO: 335850 - RNA, 14 nt, Bordetella pertussis
gcgcgcacggcgcc

SEQ ID NO: 335851 - RNA, 23 nt, Bordetella pertussis
gcgcgcacgggcgaggcggggcu

SEQ ID NO: 335852 - RNA, 13 nt, Bordetella pertussis
gcgcgcacgugga

SEQ ID NO: 335853 - RNA, 13 nt, Bordetella pertussis
gcgcgcaggccuc

SEQ ID NO: 335854 - RNA, 20 nt, Bordetella pertussis
gcgcgcaggccucgcccgau

SEQ ID NO: 335855 - RNA, 20 nt, Bordetella pertussis
gcgcgcagggcgaacguggc

SEQ ID NO: 335856 - RNA, 13 nt, Bordetella pertussis
gcgcgcagggcgg

SEQ ID NO: 335857 - RNA, 16 nt, Bordetella pertussis
gcgcgcagggcggccg

SEQ ID NO: 335858 - RNA, 18 nt, Bordetella pertussis
gcgcgcagggcggccggc

SEQ ID NO: 335859 - RNA, 19 nt, Bordetella pertussis
gcgcgcagggcggccggca

SEQ ID NO: 335860 - RNA, 14 nt, Bordetella pertussis
gcgcgcaggugugc

SEQ ID NO: 335861 - RNA, 20 nt, Bordetella pertussis
gcgcgcaggugugccagccg

SEQ ID NO: 335862 - RNA, 22 nt, Bordetella pertussis
gcgcgcaguugcgucuccagcg

SEQ ID NO: 335863 - RNA, 15 nt, Bordetella pertussis
gcgcgcaucgcgcgg

SEQ ID NO: 335864 - RNA, 13 nt, Bordetella pertussis
gcgcgcaucguca

SEQ ID NO: 335865 - RNA, 16 nt, Bordetella pertussis
gcgcgcaucgucaggc

SEQ ID NO: 335866 - RNA, 13 nt, Bordetella pertussis
gcgcgcaugcccg

SEQ ID NO: 335867 - RNA, 15 nt, Bordetella pertussis
gcgcgcaugcgcacg

SEQ ID NO: 335868 - RNA, 19 nt, Bordetella pertussis
gcgcgcaugcgcacgcgcg

SEQ ID NO: 335869 - RNA, 15 nt, Bordetella pertussis
gcgcgcaucggccgg

SEQ ID NO: 335870 - RNA, 19 nt, Bordetella pertussis
gcgcgccacauccugcacg

SEQ ID NO: 335871 - RNA, 20 nt, Bordetella pertussis
gcgcgccacauccugcacgg

SEQ ID NO: 335872 - RNA, 22 nt, Bordetella pertussis
gcgcgccaaucagauggcgcag

SEQ ID NO: 335873 - RNA, 13 nt, Bordetella pertussis
gcgcgcccgcacg

SEQ ID NO: 335874 - RNA, 14 nt, Bordetella pertussis
gcgcgcccgcaggc

SEQ ID NO: 335875 - RNA, 15 nt, Bordetella pertussis
gcgcgcccgcaggcg

SEQ ID NO: 335876 - RNA, 18 nt, Bordetella pertussis
gcgcgcccgcaggcggcg

SEQ ID NO: 335877 - RNA, 14 nt, Bordetella pertussis
gcgcgcccgccacg

SEQ ID NO: 335878 - RNA, 15 nt, Bordetella pertussis
gcgcgcccgccccgc

SEQ ID NO: 335879 - RNA, 12 nt, Bordetella pertussis
gcgcgcccgagg

SEQ ID NO: 335880 - RNA, 12 nt, Bordetella pertussis
gcgcgcccgcgu

SEQ ID NO: 335881 - RNA, 13 nt, Bordetella pertussis
gcgcgcccgcgua

SEQ ID NO: 335882 - RNA, 15 nt, Bordetella pertussis
gcgcgcccgcuugcg

SEQ ID NO: 335883 - RNA, 21 nt, Bordetella pertussis
gcgcgcccgcuugggccgcgc

SEQ ID NO: 335884 - RNA, 18 nt, Bordetella pertussis
gcgcgcccggcgcgccuu

SEQ ID NO: 335885 - RNA, 12 nt, Bordetella pertussis
gcgcgcccggcg

SEQ ID NO: 335886 - RNA, 21 nt, Bordetella pertussis
gcgcgcccucguugacgccga

SEQ ID NO: 335887 - RNA, 18 nt, Bordetella pertussis
gcgcgcccugcacgcgcg

SEQ ID NO: 335888 - RNA, 14 nt, Bordetella pertussis
gcgcgccgaagcgc

SEQ ID NO: 335889 - RNA, 16 nt, Bordetella pertussis
gcgcgccgaagcgcag

SEQ ID NO: 335890 - RNA, 18 nt, Bordetella pertussis
gcgcgccgaagcgcaggc

SEQ ID NO: 335891 - RNA, 22 nt, Bordetella pertussis
gcgcgccgaagcgcaggccuuc

SEQ ID NO: 335892 - RNA, 17 nt, Bordetella pertussis
gcgcgccgacgcuucgu

SEQ ID NO: 335893 - RNA, 14 nt, Bordetella pertussis
gcgcgccgaucacc

SEQ ID NO: 335894 - RNA, 10 nt, Bordetella pertussis
gcgcgccgca

SEQ ID NO: 335895 - RNA, 13 nt, Bordetella pertussis
gcgcgccgcagcg

SEQ ID NO: 335896 - RNA, 19 nt, Bordetella pertussis
gcgcgccgcagcguggcgu

SEQ ID NO: 335897 - RNA, 13 nt, Bordetella pertussis
gcgcgccgcauca

SEQ ID NO: 335898 - RNA, 14 nt, Bordetella pertussis
gcgcgccgccagcg

SEQ ID NO: 335899 - RNA, 14 nt, Bordetella pertussis
gcgcgccgcccacc

SEQ ID NO: 335900 - RNA, 15 nt, Bordetella pertussis
gcgcgccgcccacca

SEQ ID NO: 335901 - RNA, 13 nt, Bordetella pertussis
gcgcgccgccgcg

SEQ ID NO: 335902 - RNA, 13 nt, Bordetella pertussis
gcgcgccgccggc

SEQ ID NO: 335903 - RNA, 14 nt, Bordetella pertussis
gcgcgccgccggug

SEQ ID NO: 335904 - RNA, 23 nt, Bordetella pertussis
gcgcgccgccggugcaccaggcc

SEQ ID NO: 335905 - RNA, 23 nt, Bordetella pertussis
gcgcgccgccucgcgcuccagca

SEQ ID NO: 335906 - RNA, 10 nt, Bordetella pertussis
gcgcgccgcg

SEQ ID NO: 335907 - RNA, 15 nt, Bordetella pertussis
gcgcgccgcgauggc

SEQ ID NO: 335908 - RNA, 18 nt, Bordetella pertussis
gcgcgccgcgauggcgcc

SEQ ID NO: 335909 - RNA, 23 nt, Bordetella pertussis
gcgcgccgcgauggcgccggcca

SEQ ID NO: 335910 - RNA, 14 nt, Bordetella pertussis
gcgcgccgcgccgg

SEQ ID NO: 335911 - RNA, 16 nt, Bordetella pertussis
gcgcgccgcgccgggg

SEQ ID NO: 335912 - RNA, 15 nt, Bordetella pertussis
gcgcgccgcgcgcgg

SEQ ID NO: 335913 - RNA, 14 nt, Bordetella pertussis
gcgcgccgcggccu

SEQ ID NO: 335914 - RNA, 15 nt, Bordetella pertussis
gcgcgccgcggcggg

SEQ ID NO: 335915 - RNA, 20 nt, Bordetella pertussis
gcgcgccgcgucgguggcca

SEQ ID NO: 335916 - RNA, 23 nt, Bordetella pertussis
gcgcgccgcgucgguggccagcc

SEQ ID NO: 335917 - RNA, 15 nt, Bordetella pertussis
gcgcgccgcugcagc

SEQ ID NO: 335918 - RNA, 12 nt, Bordetella pertussis
gcgcgccgcugu

SEQ ID NO: 335919 - RNA, 17 nt, Bordetella pertussis
gcgcgccggaacauggc

SEQ ID NO: 335920 - RNA, 18 nt, Bordetella pertussis
gcgcgccggcagggcggc

SEQ ID NO: 335921 - RNA, 22 nt, Bordetella pertussis
gcgcgccggcagggcggccagg

SEQ ID NO: 335922 - RNA, 15 nt, Bordetella pertussis
gcgcgccggcauggu

SEQ ID NO: 335923 - RNA, 12 nt, Bordetella pertussis
gcgcgccggcca

SEQ ID NO: 335924 - RNA, 15 nt, Bordetella pertussis
gcgcgccggccagcg

SEQ ID NO: 335925 - RNA, 14 nt, Bordetella pertussis
gcgcgccggccagg

SEQ ID NO: 335926 - RNA, 17 nt, Bordetella pertussis
gcgcgccggccagggcc

SEQ ID NO: 335927 - RNA, 23 nt, Bordetella pertussis
gcgcgccggccagggccaccacg

SEQ ID NO: 335928 - RNA, 15 nt, Bordetella pertussis
gcgcgccggccgcca

SEQ ID NO: 335929 - RNA, 14 nt, Bordetella pertussis
gcgcgccggccgcg

SEQ ID NO: 335930 - RNA, 18 nt, Bordetella pertussis
gcgcgccggccgcggggc

SEQ ID NO: 335931 - RNA, 18 nt, Bordetella pertussis
gcgcgccggccugcgccg

SEQ ID NO: 335932 - RNA, 11 nt, Bordetella pertussis
gcgcgccggcg

SEQ ID NO: 335933 - RNA, 15 nt, Bordetella pertussis
gcgcgccggcgccgg

SEQ ID NO: 335934 - RNA, 16 nt, Bordetella pertussis
gcgcgccggcgccggc

SEQ ID NO: 335935 - RNA, 15 nt, Bordetella pertussis
gcgcgccggcggccu

SEQ ID NO: 335936 - RNA, 13 nt, Bordetella pertussis
gcgcgccgggcca

SEQ ID NO: 335937 - RNA, 21 nt, Bordetella pertussis
gcgcgccgggcccggccacgg

SEQ ID NO: 335938 - RNA, 13 nt, Bordetella pertussis
gcgcgccgggccg

SEQ ID NO: 335939 - RNA, 14 nt, Bordetella pertussis
gcgcgccgggccgg

SEQ ID NO: 335940 - RNA, 19 nt, Bordetella pertussis
gcgcgccggcucgaacagg

SEQ ID NO: 335941 - RNA, 12 nt, Bordetella pertussis
gcgcgccguaca

SEQ ID NO: 335942 - RNA, 13 nt, Bordetella pertussis
gcgcgccguacag

SEQ ID NO: 335943 - RNA, 17 nt, Bordetella pertussis
gcgcgccguccgggccg

SEQ ID NO: 335944 - RNA, 13 nt, Bordetella pertussis
gcgcgccguggcu

SEQ ID NO: 335945 - RNA, 15 nt, Bordetella pertussis
gcgcgccuccagcuc

SEQ ID NO: 335946 - RNA, 20 nt, Bordetella pertussis
gcgcgccuccagcuccagcg

SEQ ID NO: 335947 - RNA, 18 nt, Bordetella pertussis
gcgcgccucgaugauggc

SEQ ID NO: 335948 - RNA, 21 nt, Bordetella pertussis
gcgcgccucgugcgaggccac

SEQ ID NO: 335949 - RNA, 22 nt, Bordetella pertussis
gcgcgccucgugcgaggccacg

SEQ ID NO: 335950 - RNA, 12 nt, Bordetella pertussis
gcgcgccugcag

SEQ ID NO: 335951 - RNA, 12 nt, Bordetella pertussis
gcgcgccugccc

SEQ ID NO: 335952 - RNA, 18 nt, Bordetella pertussis
gcgcgccugcccaggcca

SEQ ID NO: 335953 - RNA, 21 nt, Bordetella pertussis
gcgcgccugccccgccugcgc

SEQ ID NO: 335954 - RNA, 23 nt, Bordetella pertussis
gcgcgccugccccgccugcgcca

SEQ ID NO: 335955 - RNA, 16 nt, Bordetella pertussis
gcgcgccugcgcgccg

SEQ ID NO: 335956 - RNA, 13 nt, Bordetella pertussis
gcgcgccuggcgc

SEQ ID NO: 335957 - RNA, 18 nt, Bordetella pertussis
gcgcgccuggcgcgccca

SEQ ID NO: 335958 - RNA, 13 nt, Bordetella pertussis
gcgcgccugcucg

SEQ ID NO: 335959 - RNA, 16 nt, Bordetella pertussis
gcgcgccuggcacgac

SEQ ID NO: 335960 - RNA, 13 nt, Bordetella pertussis
gcgcgccuuacgc

SEQ ID NO: 335961 - RNA, 17 nt, Bordetella pertussis
gcgcgccuuacgcggcg

SEQ ID NO: 335962 - RNA, 18 nt, Bordetella pertussis
gcgcgccuuacgcggcgc

SEQ ID NO: 335963 - RNA, 22 nt, Bordetella pertussis
gcgcgccuuacgcggcgcgcgc

SEQ ID NO: 335964 - RNA, 19 nt, Bordetella pertussis
gcgcgccuuccugggcgcc

SEQ ID NO: 335965 - RNA, 22 nt, Bordetella pertussis
gcgcgccuuccugggcgccggc

SEQ ID NO: 335966 - RNA, 17 nt, Bordetella pertussis
gcgcgccuucggcaggc

SEQ ID NO: 335967 - RNA, 13 nt, Bordetella pertussis
gcgcgccuugcgc

SEQ ID NO: 335968 - RNA, 17 nt, Bordetella pertussis
gcgcgccuugcgcggcg

SEQ ID NO: 335969 - RNA, 16 nt, Bordetella pertussis
gcgcgcgacgacagcg

SEQ ID NO: 335970 - RNA, 19 nt, Bordetella pertussis
gcgcgcgacgacagcggcg

SEQ ID NO: 335971 - RNA, 14 nt, Bordetella pertussis
gcgcgcgagcggcg

SEQ ID NO: 335972 - RNA, 13 nt, Bordetella pertussis
gcgcgcgagcugc

SEQ ID NO: 335973 - RNA, 16 nt, Bordetella pertussis
gcgcgcgagcugcgcg

SEQ ID NO: 335974 - RNA, 19 nt, Bordetella pertussis
gcgcgcgagcugcgcggcu

SEQ ID NO: 335975 - RNA, 15 nt, Bordetella pertussis
gcgcgcgaggcggcg

SEQ ID NO: 335976 - RNA, 16 nt, Bordetella pertussis
gcgcgcgaucgccagc

SEQ ID NO: 335977 - RNA, 19 nt, Bordetella pertussis
gcgcgcgaucgccagcagg

SEQ ID NO: 335978 - RNA, 23 nt, Bordetella pertussis
gcgcgcgaucgccagcaggcgcu

SEQ ID NO: 335979 - RNA, 17 nt, Bordetella pertussis
gcgcgcgacggcgccgg

SEQ ID NO: 335980 - RNA, 18 nt, Bordetella pertussis
gcgcgcgacggcgccggc

SEQ ID NO: 335981 - RNA, 14 nt, Bordetella pertussis
gcgcgcgaugcgca

SEQ ID NO: 335982 - RNA, 17 nt, Bordetella pertussis
gcgcgcgaugcgcaggc

SEQ ID NO: 335983 - RNA, 13 nt, Bordetella pertussis
gcgcgcgcagccg

SEQ ID NO: 335984 - RNA, 18 nt, Bordetella pertussis
gcgcgcgcagccgcgcca

SEQ ID NO: 335985 - RNA, 14 nt, Bordetella pertussis
gcgcgcgcaggcgc

SEQ ID NO: 335986 - RNA, 13 nt, Bordetella pertussis
gcgcgcgccagcg

SEQ ID NO: 335987 - RNA, 16 nt, Bordetella pertussis
gcgcgcgccagcggcu

SEQ ID NO: 335988 - RNA, 14 nt, Bordetella pertussis
gcgcgcgccaggcc

SEQ ID NO: 335989 - RNA, 16 nt, Bordetella pertussis
gcgcgcgccaggccca

SEQ ID NO: 335990 - RNA, 13 nt, Bordetella pertussis
gcgcgcgccaggg

SEQ ID NO: 335991 - RNA, 13 nt, Bordetella pertussis
gcgcgcgccaucg

SEQ ID NO: 335992 - RNA, 12 nt, Bordetella pertussis
gcgcgcgccaug

SEQ ID NO: 335993 - RNA, 15 nt, Bordetella pertussis
gcgcgcgccauggug

SEQ ID NO: 335994 - RNA, 13 nt, Bordetella pertussis
gcgcgcgccaugu

SEQ ID NO: 335995 - RNA, 13 nt, Bordetella pertussis
gcgcgcgcccacc

SEQ ID NO: 335996 - RNA, 13 nt, Bordetella pertussis
gcgcgcgccccca

SEQ ID NO: 335997 - RNA, 14 nt, Bordetella pertussis
gcgcgcgccgccgg

SEQ ID NO: 335998 - RNA, 12 nt, Bordetella pertussis
gcgcgcgccgcg

SEQ ID NO: 335999 - RNA, 12 nt, Bordetella pertussis
gcgcgcgccggc

SEQ ID NO: 336000 - RNA, 13 nt, Bordetella pertussis
gcgcgcgccggca

SEQ ID NO: 336001 - RNA, 17 nt, Bordetella pertussis
gcgcgcgccggcaucgg

SEQ ID NO: 336002 - RNA, 13 nt, Bordetella pertussis
gcgcgcgccggcc

SEQ ID NO: 336003 - RNA, 14 nt, Bordetella pertussis
gcgcgcgccggccg

SEQ ID NO: 336004 - RNA, 13 nt, Bordetella pertussis
gcgcgcgccggcu

SEQ ID NO: 336005 - RNA, 13 nt, Bordetella pertussis
gcgcgcgcacagg

SEQ ID NO: 336006 - RNA, 15 nt, Bordetella pertussis
gcgcgcgcacaggcg

SEQ ID NO: 336007 - RNA, 15 nt, Bordetella pertussis
gcgcgcgccugcucg

SEQ ID NO: 336008 - RNA, 15 nt, Bordetella pertussis
gcgcgcgcgaccacg

SEQ ID NO: 336009 - RNA, 14 nt, Bordetella pertussis
gcgcgcgcgcagca

SEQ ID NO: 336010 - RNA, 14 nt, Bordetella pertussis
gcgcgcgcgcgcgg

SEQ ID NO: 336011 - RNA, 14 nt, Bordetella pertussis
gcgcgcgcgcggau

SEQ ID NO: 336012 - RNA, 12 nt, Bordetella pertussis
gcgcgcgcggcc

SEQ ID NO: 336013 - RNA, 15 nt, Bordetella pertussis
gcgcgcgcgguccau

SEQ ID NO: 336014 - RNA, 14 nt, Bordetella pertussis
gcgcgcgcguagcg

SEQ ID NO: 336015 - RNA, 14 nt, Bordetella pertussis
gcgcgcgcguugau

SEQ ID NO: 336016 - RNA, 14 nt, Bordetella pertussis
gcgcgcgcugcacg

SEQ ID NO: 336017 - RNA, 12 nt, Bordetella pertussis
gcgcgcgcuggg

SEQ ID NO: 336018 - RNA, 13 nt, Bordetella pertussis
gcgcgcggacugc

SEQ ID NO: 336019 - RNA, 14 nt, Bordetella pertussis
gcgcgcggacugcc

SEQ ID NO: 336020 - RNA, 16 nt, Bordetella pertussis
gcgcgcggauccagcc

SEQ ID NO: 336021 - RNA, 20 nt, Bordetella pertussis
gcgcgcggaucgaaaccggc

SEQ ID NO: 336022 - RNA, 18 nt, Bordetella pertussis
gcgcgcggaugaucgcgc

SEQ ID NO: 336023 - RNA, 20 nt, Bordetella pertussis
gcgcgcggaugaucgcgcag

SEQ ID NO: 336024 - RNA, 13 nt, Bordetella pertussis
gcgcgcggccagc

SEQ ID NO: 336025 - RNA, 14 nt, Bordetella pertussis
gcgcgcggccggca

SEQ ID NO: 336026 - RNA, 15 nt, Bordetella pertussis
gcgcgcggccggccg

SEQ ID NO: 336027 - RNA, 14 nt, Bordetella pertussis
gcgcgcggccggcg

SEQ ID NO: 336028 - RNA, 13 nt, Bordetella pertussis
gcgcgcggccucg

SEQ ID NO: 336029 - RNA, 15 nt, Bordetella pertussis
gcgcgcggccucgac

SEQ ID NO: 336030 - RNA, 15 nt, Bordetella pertussis
gcgcgcggcgcagcg

SEQ ID NO: 336031 - RNA, 16 nt, Bordetella pertussis
gcgcgcggcgcagcgc

SEQ ID NO: 336032 - RNA, 20 nt, Bordetella pertussis
gcgcgcggcgcagcgcacga

SEQ ID NO: 336033 - RNA, 16 nt, Bordetella pertussis
gcgcgcggcgccgcgc

SEQ ID NO: 336034 - RNA, 24 nt, Bordetella pertussis
gcgcgcggcgcgccagcgcggcca

SEQ ID NO: 336035 - RNA, 19 nt, Bordetella pertussis
gcgcgcggcgcggcuggcg

SEQ ID NO: 336036 - RNA, 13 nt, Bordetella pertussis
gcgcgcggcuggc

SEQ ID NO: 336037 - RNA, 16 nt, Bordetella pertussis
gcgcgcggcuggcugu

SEQ ID NO: 336038 - RNA, 19 nt, Bordetella pertussis
gcgcgcggcugggucggcg

SEQ ID NO: 336039 - RNA, 12 nt, Bordetella pertussis
gcgcgcgggcca

SEQ ID NO: 336040 - RNA, 21 nt, Bordetella pertussis
gcgcgcgggcgauggccacgc

SEQ ID NO: 336041 - RNA, 12 nt, Bordetella pertussis
gcgcgcgggcgc

SEQ ID NO: 336042 - RNA, 17 nt, Bordetella pertussis
gcgcgcgggcgcccgcg

SEQ ID NO: 336043 - RNA, 18 nt, Bordetella pertussis
gcgcgcgggcgcccgcgc

SEQ ID NO: 336044 - RNA, 17 nt, Bordetella pertussis
gcgcgcggggcaggccg

SEQ ID NO: 336045 - RNA, 18 nt, Bordetella pertussis
gcgcgcgguccaugguga

SEQ ID NO: 336046 - RNA, 13 nt, Bordetella pertussis
gcgcgcggugacg

SEQ ID NO: 336047 - RNA, 21 nt, Bordetella pertussis
gcgcgcggugccgccuggcca

SEQ ID NO: 336048 - RNA, 18 nt, Bordetella pertussis
gcgcgcgguugagcgcca

SEQ ID NO: 336049 - RNA, 20 nt, Bordetella pertussis
gcgcgcgguugagcgccagg

SEQ ID NO: 336050 - RNA, 14 nt, Bordetella pertussis
gcgcgcguauggcg

SEQ ID NO: 336051 - RNA, 21 nt, Bordetella pertussis
gcgcgcguauggcggcgccga

SEQ ID NO: 336052 - RNA, 16 nt, Bordetella pertussis
gcgcgcgguguucgag

SEQ ID NO: 336053 - RNA, 15 nt, Bordetella pertussis
gcgcgcguccugcgc

SEQ ID NO: 336054 - RNA, 13 nt, Bordetella pertussis
gcgcgcgucgccg

SEQ ID NO: 336055 - RNA, 18 nt, Bordetella pertussis
gcgcgcgucgccgcuggc

SEQ ID NO: 336056 - RNA, 20 nt, Bordetella pertussis
gcgcgcgucgccgcuggcca

SEQ ID NO: 336057 - RNA, 21 nt, Bordetella pertussis
gcgcgcgugcagguaggacgg

SEQ ID NO: 336058 - RNA, 19 nt, Bordetella pertussis
gcgcgcgugccgcaggcca

SEQ ID NO: 336059 - RNA, 23 nt, Bordetella pertussis
gcgcgcgugcugggccaugcgua

SEQ ID NO: 336060 - RNA, 17 nt, Bordetella pertussis
gcgcgcuaagcacaagc

SEQ ID NO: 336061 - RNA, 18 nt, Bordetella pertussis
gcgcgcuaagcacaagcg

SEQ ID NO: 336062 - RNA, 21 nt, Bordetella pertussis
gcgcgcuaagcacaagcgcgu

SEQ ID NO: 336063 - RNA, 13 nt, Bordetella pertussis
gcgcgcucagcgc

SEQ ID NO: 336064 - RNA, 17 nt, Bordetella pertussis
gcgcgcucagcgccauc

SEQ ID NO: 336065 - RNA, 18 nt, Bordetella pertussis
gcgcgcucagcgccauca

SEQ ID NO: 336066 - RNA, 21 nt, Bordetella pertussis
gcgcgcucaggccgccggcgc

SEQ ID NO: 336067 - RNA, 23 nt, Bordetella pertussis
gcgcgcucauggcgcaugacgag

SEQ ID NO: 336068 - RNA, 13 nt, Bordetella pertussis
gcgcgcuccagca

SEQ ID NO: 336069 - RNA, 21 nt, Bordetella pertussis
gcgcgcuccuucgugguggcg

SEQ ID NO: 336070 - RNA, 15 nt, Bordetella pertussis
gcgcgcucgcugccg

SEQ ID NO: 336071 - RNA, 18 nt, Bordetella pertussis
gcgcgcucgcugccggcg

SEQ ID NO: 336072 - RNA, 22 nt, Bordetella pertussis
gcgcgcucggagggcuccaggc

SEQ ID NO: 336073 - RNA, 16 nt, Bordetella pertussis
gcgcgcucggcgccgg

SEQ ID NO: 336074 - RNA, 14 nt, Bordetella pertussis
gcgcgcugcccagc

SEQ ID NO: 336075 - RNA, 13 nt, Bordetella pertussis
gcgcgcuggcgcc

SEQ ID NO: 336076 - RNA, 14 nt, Bordetella pertussis
gcgcgcuggcgccc

SEQ ID NO: 336077 - RNA, 16 nt, Bordetella pertussis
gcgcgcuggcgcccgg

SEQ ID NO: 336078 - RNA, 17 nt, Bordetella pertussis
gcgcgcuggcgcccggc

SEQ ID NO: 336079 - RNA, 13 nt, Bordetella pertussis
gcgcgcuggcgcu

SEQ ID NO: 336080 - RNA, 18 nt, Bordetella pertussis
gcgcgcuggcgcucgggc

SEQ ID NO: 336081 - RNA, 12 nt, Bordetella pertussis
gcgcgcuggcug

SEQ ID NO: 336082 - RNA, 13 nt, Bordetella pertussis
gcgcgcuggcugu

SEQ ID NO: 336083 - RNA, 12 nt, Bordetella pertussis
gcgcgcuggcgc

SEQ ID NO: 336084 - RNA, 21 nt, Bordetella pertussis
gcgcgcuggggcugucgcgcu

SEQ ID NO: 336085 - RNA, 12 nt, Bordetella pertussis
gcgcgcuggucg

SEQ ID NO: 336086 - RNA, 13 nt, Bordetella pertussis
gcgcgcuguucau

SEQ ID NO: 336087 - RNA, 22 nt, Bordetella pertussis
gcgcgcuguucaucaacauguc

SEQ ID NO: 336088 - RNA, 13 nt, Bordetella pertussis
gcgcgcuucaggc

SEQ ID NO: 336089 - RNA, 17 nt, Bordetella pertussis
gcgcgcuucaggcgccg

SEQ ID NO: 336090 - RNA, 17 nt, Bordetella pertussis
gcgcgcuuccucgacca

SEQ ID NO: 336091 - RNA, 19 nt, Bordetella pertussis
gcgcgcuuccucgaccagg

SEQ ID NO: 336092 - RNA, 16 nt, Bordetella pertussis
gcgcgcuucgagccgg

SEQ ID NO: 336093 - RNA, 19 nt, Bordetella pertussis
gcgcgcuucgagccgguac

SEQ ID NO: 336094 - RNA, 19 nt, Bordetella pertussis
gcgcgcuucuuggcgacca

SEQ ID NO: 336095 - RNA, 21 nt, Bordetella pertussis
gcgcgcuucuuggcgaccagg

SEQ ID NO: 336096 - RNA, 23 nt, Bordetella pertussis
gcgcgcuucuuggcgaccaggcc

SEQ ID NO: 336097 - RNA, 18 nt, Bordetella pertussis
gcgcgcuugaacuccgcg

SEQ ID NO: 336098 - RNA, 16 nt, Bordetella pertussis
gcgcgcuuggucagca

SEQ ID NO: 336099 - RNA, 20 nt, Bordetella pertussis
gcgcggauauucgucggccg

SEQ ID NO: 336100 - RNA, 23 nt, Bordetella pertussis
gcgcggauauucgucggccgccg

SEQ ID NO: 336101 - RNA, 15 nt, Bordetella pertussis
gcgcggauccagcca

SEQ ID NO: 336102 - RNA, 18 nt, Bordetella pertussis
gcgcggauccagccaugg

SEQ ID NO: 336103 - RNA, 20 nt, Bordetella pertussis
gcgcggaucgaaaccggcgc

SEQ ID NO: 336104 - RNA, 13 nt, Bordetella pertussis
gcgcggaucggcc

SEQ ID NO: 336105 - RNA, 14 nt, Bordetella pertussis
gcgcggaucggcca

SEQ ID NO: 336106 - RNA, 17 nt, Bordetella pertussis
gcgcggaucggccacga

SEQ ID NO: 336107 - RNA, 17 nt, Bordetella pertussis
gcgcggaucgugcgcca

SEQ ID NO: 336108 - RNA, 16 nt, Bordetella pertussis
gcgcggaugaccugcg

SEQ ID NO: 336109 - RNA, 22 nt, Bordetella pertussis
gcgcggaugaccugcgccaggu

SEQ ID NO: 336110 - RNA, 15 nt, Bordetella pertussis
gcgcggaugaucgcg

SEQ ID NO: 336111 - RNA, 17 nt, Bordetella pertussis
gcgcggaugaucgcgca

SEQ ID NO: 336112 - RNA, 16 nt, Bordetella pertussis
gcgcggaugccgucca

SEQ ID NO: 336113 - RNA, 20 nt, Bordetella pertussis
gcgcggauugaugucgcgca

SEQ ID NO: 336114 - RNA, 17 nt, Bordetella pertussis
gcgcggcaaaaugccgc

SEQ ID NO: 336115 - RNA, 17 nt, Bordetella pertussis
gcgcggcacgcugcuga

SEQ ID NO: 336116 - RNA, 17 nt, Bordetella pertussis
gcgcggcagcgccgggu

SEQ ID NO: 336117 - RNA, 17 nt, Bordetella pertussis
gcgcggcagccuggggc

SEQ ID NO: 336118 - RNA, 14 nt, Bordetella pertussis
gcgcggcagggcgu

SEQ ID NO: 336119 - RNA, 17 nt, Bordetella pertussis
gcgcggcagggcgucgg

SEQ ID NO: 336120 - RNA, 22 nt, Bordetella pertussis
gcgcggcagggcgucggccgcg

SEQ ID NO: 336121 - RNA, 15 nt, Bordetella pertussis
gcgcggcugcugggc

SEQ ID NO: 336122 - RNA, 18 nt, Bordetella pertussis
gcgcggcugggucggcgu

SEQ ID NO: 336123 - RNA, 20 nt, Bordetella pertussis
gcgcggcugggucggcguga

SEQ ID NO: 336124 - RNA, 22 nt, Bordetella pertussis
gcgcggcuuuuucucggccucg

SEQ ID NO: 336125 - RNA, 22 nt, Bordetella pertussis
gcgcgggaagcgcucgcgcagg

SEQ ID NO: 336126 - RNA, 14 nt, Bordetella pertussis
gcgcgggccacugc

SEQ ID NO: 336127 - RNA, 22 nt, Bordetella pertussis
gcgcgggcacucggccauggug

SEQ ID NO: 336128 - RNA, 13 nt, Bordetella pertussis
gcgcgggggugcg

SEQ ID NO: 336129 - RNA, 17 nt, Bordetella pertussis
gcgcggguccaggcccg

SEQ ID NO: 336130 - RNA, 22 nt, Bordetella pertussis
gcgcggguccggcgugccaugg

SEQ ID NO: 336131 - RNA, 20 nt, Bordetella pertussis
gcgcggguccuugccgggcu

SEQ ID NO: 336132 - RNA, 22 nt, Bordetella pertussis
gcgcgggucuugagcggcccgg

SEQ ID NO: 336133 - RNA, 22 nt, Bordetella pertussis
gcgcggugacguaaucgagcug

SEQ ID NO: 336134 - RNA, 23 nt, Bordetella pertussis
gcgcggugacguaaucgagcugg

SEQ ID NO: 336135 - RNA, 20 nt, Bordetella pertussis
gcgcggugaggcggccgggc

SEQ ID NO: 336136 - RNA, 17 nt, Bordetella pertussis
gcgcggugccgccuggc

SEQ ID NO: 336137 - RNA, 18 nt, Bordetella pertussis
gcgcggugcgcaccaggc

SEQ ID NO: 336138 - RNA, 22 nt, Bordetella pertussis
gcgcggugcgggugaccuuggu

SEQ ID NO: 336139 - RNA, 22 nt, Bordetella pertussis
gcgcggugcgggugggcgcgcc

SEQ ID NO: 336140 - RNA, 15 nt, Bordetella pertussis
gcgcgguggcacgac

SEQ ID NO: 336141 - RNA, 15 nt, Bordetella pertussis
gcgcgguggccagcg

SEQ ID NO: 336142 - RNA, 16 nt, Bordetella pertussis
gcgcgguggccagcga

SEQ ID NO: 336143 - RNA, 13 nt, Bordetella pertussis
gcgcgguggccgc

SEQ ID NO: 336144 - RNA, 18 nt, Bordetella pertussis
gcgcgguggccgccgcgc

SEQ ID NO: 336145 - RNA, 23 nt, Bordetella pertussis
gcgcguaauaguggucgccggcg

SEQ ID NO: 336146 - RNA, 17 nt, Bordetella pertussis
gcgcguacagccgggug

SEQ ID NO: 336147 - RNA, 17 nt, Bordetella pertussis
gcgcguacgcggcgcgg

SEQ ID NO: 336148 - RNA, 14 nt, Bordetella pertussis
gcgcguacguggcg

SEQ ID NO: 336149 - RNA, 16 nt, Bordetella pertussis
gcgcguacguggcgcg

SEQ ID NO: 336150 - RNA, 15 nt, Bordetella pertussis
gcgcguagcgauccg

SEQ ID NO: 336151 - RNA, 22 nt, Bordetella pertussis
gcgcguagcgauccgaugcccg

SEQ ID NO: 336152 - RNA, 22 nt, Bordetella pertussis
gcgcguaggcgcgcgcaucggc

SEQ ID NO: 336153 - RNA, 16 nt, Bordetella pertussis
gcgcguaucggcgcga

SEQ ID NO: 336154 - RNA, 19 nt, Bordetella pertussis
gcgcguaucggcgcgagcg

SEQ ID NO: 336155 - RNA, 22 nt, Bordetella pertussis
gcgcguaucggcgcgagcgaug

SEQ ID NO: 336156 - RNA, 14 nt, Bordetella pertussis
gcgcguaugacgcg

SEQ ID NO: 336157 - RNA, 14 nt, Bordetella pertussis
gcgcguauggcggc

SEQ ID NO: 336158 - RNA, 15 nt, Bordetella pertussis
gcgcguauggcggcg

SEQ ID NO: 336159 - RNA, 16 nt, Bordetella pertussis
gcgcguauggcggcgc

SEQ ID NO: 336160 - RNA, 21 nt, Bordetella pertussis
gcgcgucccgguaggccuggu

SEQ ID NO: 336161 - RNA, 14 nt, Bordetella pertussis
gcgcguccugcacg

SEQ ID NO: 336162 - RNA, 17 nt, Bordetella pertussis
gcgcguccugccaguug

SEQ ID NO: 336163 - RNA, 18 nt, Bordetella pertussis
gcgcguccugccaguugc

SEQ ID NO: 336164 - RNA, 14 nt, Bordetella pertussis
gcgcguccugcgcc

SEQ ID NO: 336165 - RNA, 14 nt, Bordetella pertussis
gcgcguccuggcgc

SEQ ID NO: 336166 - RNA, 15 nt, Bordetella pertussis
gcgcguccuggcgcg

SEQ ID NO: 336167 - RNA, 23 nt, Bordetella pertussis
gcgcguccugggccgagcgcgcc

SEQ ID NO: 336168 - RNA, 13 nt, Bordetella pertussis
gcgcguccuuggc

SEQ ID NO: 336169 - RNA, 14 nt, Bordetella pertussis
gcgcguccuuggcg

SEQ ID NO: 336170 - RNA, 18 nt, Bordetella pertussis
gcgcguccuuggcggccu

SEQ ID NO: 336171 - RNA, 17 nt, Bordetella pertussis
gcgcgucgacgaagcgc

SEQ ID NO: 336172 - RNA, 12 nt, Bordetella pertussis
gcgcgucgagca

SEQ ID NO: 336173 - RNA, 18 nt, Bordetella pertussis
gcgcgucgagcagcgcau

SEQ ID NO: 336174 - RNA, 14 nt, Bordetella pertussis
gcgcgucgagcagg

SEQ ID NO: 336175 - RNA, 17 nt, Bordetella pertussis
gcgcgucgagcaggccg

SEQ ID NO: 336176 - RNA, 18 nt, Bordetella pertussis
gcgcgucgagcaggccgg

SEQ ID NO: 336177 - RNA, 13 nt, Bordetella pertussis
gcgcgucgaugga

SEQ ID NO: 336178 - RNA, 11 nt, Bordetella pertussis
gcgcgucgccg

SEQ ID NO: 336179 - RNA, 13 nt, Bordetella pertussis
gcgcgucgccgcc

SEQ ID NO: 336180 - RNA, 14 nt, Bordetella pertussis
gcgcgucgccgcca

SEQ ID NO: 336181 - RNA, 15 nt, Bordetella pertussis
gcgcgucgccgcugg

SEQ ID NO: 336182 - RNA, 17 nt, Bordetella pertussis
gcgcgucgccgcuggcc

SEQ ID NO: 336183 - RNA, 14 nt, Bordetella pertussis
gcgcgucgccggcg

SEQ ID NO: 336184 - RNA, 15 nt, Bordetella pertussis
gcgcgucgccggcga

SEQ ID NO: 336185 - RNA, 17 nt, Bordetella pertussis
gcgcgucgccggcgaug

SEQ ID NO: 336186 - RNA, 17 nt, Bordetella pertussis
gcgcgucgcgcgccagg

SEQ ID NO: 336187 - RNA, 15 nt, Bordetella pertussis
gcgcgucgcgcggcg

SEQ ID NO: 336188 - RNA, 17 nt, Bordetella pertussis
gcgcgucgcgguacagg

SEQ ID NO: 336189 - RNA, 14 nt, Bordetella pertussis
gcgcgucgcugcgc

SEQ ID NO: 336190 - RNA, 15 nt, Bordetella pertussis
gcgcgucgcugcgcg

SEQ ID NO: 336191 - RNA, 13 nt, Bordetella pertussis
gcgcgucgcugcg

SEQ ID NO: 336192 - RNA, 14 nt, Bordetella pertussis
gcgcgucggccagc

SEQ ID NO: 336193 - RNA, 15 nt, Bordetella pertussis
gcgcgucggccaggc

SEQ ID NO: 336194 - RNA, 17 nt, Bordetella pertussis
gcgcgucggccaggcgc

SEQ ID NO: 336195 - RNA, 19 nt, Bordetella pertussis
gcgcgucggccaggcgcca

SEQ ID NO: 336196 - RNA, 20 nt, Bordetella pertussis
gcgcgucggccaggcgccag

SEQ ID NO: 336197 - RNA, 15 nt, Bordetella pertussis
gcgcgucggccagcg

SEQ ID NO: 336198 - RNA, 16 nt, Bordetella pertussis
gcgcgucggccagcgc

SEQ ID NO: 336199 - RNA, 15 nt, Bordetella pertussis
gcgcgucggcgccga

SEQ ID NO: 336200 - RNA, 14 nt, Bordetella pertussis
gcgcgucguccagc

SEQ ID NO: 336201 - RNA, 21 nt, Bordetella pertussis
gcgcgucguccagcguggcgc

SEQ ID NO: 336202 - RNA, 23 nt, Bordetella pertussis
gcgcgucguccagcguggcgcag

SEQ ID NO: 336203 - RNA, 17 nt, Bordetella pertussis
gcgcgucgugcccgcca

SEQ ID NO: 336204 - RNA, 20 nt, Bordetella pertussis
gcgcgucuccagcgccggca

SEQ ID NO: 336205 - RNA, 20 nt, Bordetella pertussis
gcgcgucuggaggacgagcg

SEQ ID NO: 336206 - RNA, 19 nt, Bordetella pertussis
gcgcgucuucaguugacgc

SEQ ID NO: 336207 - RNA, 17 nt, Bordetella pertussis
gcgcgucuuuacgccga

SEQ ID NO: 336208 - RNA, 18 nt, Bordetella pertussis
gcgcgucuuuacgccgag

SEQ ID NO: 336209 - RNA, 23 nt, Bordetella pertussis
gcgcgugacgauauccaggcgcg

SEQ ID NO: 336210 - RNA, 22 nt, Bordetella pertussis
gcgcgugcacgaccugccacug

SEQ ID NO: 336211 - RNA, 16 nt, Bordetella pertussis
gcgcgugcagccagcg

SEQ ID NO: 336212 - RNA, 19 nt, Bordetella pertussis
gcgcgugcagccagcggcc

SEQ ID NO: 336213 - RNA, 21 nt, Bordetella pertussis
gcgcgugcagccagcggccga

SEQ ID NO: 336214 - RNA, 17 nt, Bordetella pertussis
gcgcgugcagcgccgcg

SEQ ID NO: 336215 - RNA, 14 nt, Bordetella pertussis
gcgcgugcaggccg

SEQ ID NO: 336216 - RNA, 20 nt, Bordetella pertussis
gcgcgugccagcaggucgcg

SEQ ID NO: 336217 - RNA, 15 nt, Bordetella pertussis
gcgcguugcgcaucg

SEQ ID NO: 336218 - RNA, 16 nt, Bordetella pertussis
gcgcguugcgcuugcg

SEQ ID NO: 336219 - RNA, 17 nt, Bordetella pertussis
gcgcguugcgcuugcgc

SEQ ID NO: 336220 - RNA, 14 nt, Bordetella pertussis
gcgcguuggcguug

SEQ ID NO: 336221 - RNA, 14 nt, Bordetella pertussis
gcgcguuggccuga

SEQ ID NO: 336222 - RNA, 19 nt, Bordetella pertussis
gcgcguuuucgcuggcgga

SEQ ID NO: 336223 - RNA, 20 nt, Bordetella pertussis
gcgcguuuucgcuggcggac

SEQ ID NO: 336224 - RNA, 15 nt, Bordetella pertussis
gcgcguuucggucag

SEQ ID NO: 336225 - RNA, 20 nt, Bordetella pertussis
gcgcguuucggucagggcga

SEQ ID NO: 336226 - RNA, 17 nt, Bordetella pertussis
gcgcucaagggccuguc

SEQ ID NO: 336227 - RNA, 22 nt, Bordetella pertussis
gcgcucacagggucaaggcgcg

SEQ ID NO: 336228 - RNA, 15 nt, Bordetella pertussis
gcgcucagcaccagg

SEQ ID NO: 336229 - RNA, 16 nt, Bordetella pertussis
gcgcucagcaccaggc

SEQ ID NO: 336230 - RNA, 19 nt, Bordetella pertussis
gcgcucagcaccaggccgc

SEQ ID NO: 336231 - RNA, 21 nt, Bordetella pertussis
gcgcucagcaccaggccgccg

SEQ ID NO: 336232 - RNA, 14 nt, Bordetella pertussis
gcgcucagccgugc

SEQ ID NO: 336233 - RNA, 17 nt, Bordetella pertussis
gcgcucagccuugucgc

SEQ ID NO: 336234 - RNA, 20 nt, Bordetella pertussis
gcgcucagcgacgcgcgccg

SEQ ID NO: 336235 - RNA, 21 nt, Bordetella pertussis
gcgcucagcgacgcgcgccgg

SEQ ID NO: 336236 - RNA, 21 nt, Bordetella pertussis
gcgcucagcgccaucaucgcg

SEQ ID NO: 336237 - RNA, 16 nt, Bordetella pertussis
gcgcucagcgcgccga

SEQ ID NO: 336238 - RNA, 19 nt, Bordetella pertussis
gcgcucagcgcgccgagga

SEQ ID NO: 336239 - RNA, 19 nt, Bordetella pertussis
gcgcuccagcaccugcacc

SEQ ID NO: 336240 - RNA, 22 nt, Bordetella pertussis
gcgcuccagcaccugcaccgaa

SEQ ID NO: 336241 - RNA, 13 nt, Bordetella pertussis
gcgcuccagcaug

SEQ ID NO: 336242 - RNA, 21 nt, Bordetella pertussis
gcgcuccagcaugucguggcg

SEQ ID NO: 336243 - RNA, 17 nt, Bordetella pertussis
gcgcuccagcccuucgc

SEQ ID NO: 336244 - RNA, 19 nt, Bordetella pertussis
gcgcuccagcgucauggcc

SEQ ID NO: 336245 - RNA, 21 nt, Bordetella pertussis
gcgcuccagcgucauggccug

SEQ ID NO: 336246 - RNA, 23 nt, Bordetella pertussis
gcgcuccagcgucauggccuggc

SEQ ID NO: 336247 - RNA, 21 nt, Bordetella pertussis
gcgcuccagggcgucggcgac

SEQ ID NO: 336248 - RNA, 22 nt, Bordetella pertussis
gcgcuccaugaucucgggcgag

SEQ ID NO: 336249 - RNA, 18 nt, Bordetella pertussis
gcgcuccauggcgccggc

SEQ ID NO: 336250 - RNA, 22 nt, Bordetella pertussis
gcgcuccauggcgccggcggcc

SEQ ID NO: 336251 - RNA, 15 nt, Bordetella pertussis
gcgcucccgccaaca

SEQ ID NO: 336252 - RNA, 16 nt, Bordetella pertussis
gcgcuccggcugcgcg

SEQ ID NO: 336253 - RNA, 17 nt, Bordetella pertussis
gcgcuccggcugcgcgc

SEQ ID NO: 336254 - RNA, 20 nt, Bordetella pertussis
gcgcuccggcugcgcgcgca

SEQ ID NO: 336255 - RNA, 21 nt, Bordetella pertussis
gcgcuccggcugcgcgcgcag

SEQ ID NO: 336256 - RNA, 20 nt, Bordetella pertussis
gcgcucgguguggauggcgg

SEQ ID NO: 336257 - RNA, 21 nt, Bordetella pertussis
gcgcucgguguggauggcggu

SEQ ID NO: 336258 - RNA, 20 nt, Bordetella pertussis
gcgcucguccaugccggcca

SEQ ID NO: 336259 - RNA, 15 nt, Bordetella pertussis
gcgcugaccugcacg

SEQ ID NO: 336260 - RNA, 18 nt, Bordetella pertussis
gcgcugauccuggcucug

SEQ ID NO: 336261 - RNA, 16 nt, Bordetella pertussis
gcgcugaugcgcggcg

SEQ ID NO: 336262 - RNA, 19 nt, Bordetella pertussis
gcgcugaugcgcggcgggc

SEQ ID NO: 336263 - RNA, 22 nt, Bordetella pertussis
gcgcugauucgcgucguugcgc

SEQ ID NO: 336264 - RNA, 19 nt, Bordetella pertussis
gcgcugcaauugcgcggcc

SEQ ID NO: 336265 - RNA, 20 nt, Bordetella pertussis
gcgcugcaauugcgcggcca

SEQ ID NO: 336266 - RNA, 22 nt, Bordetella pertussis
gcgcugcaauugcgcggccaug

SEQ ID NO: 336267 - RNA, 12 nt, Bordetella pertussis
gcgcugcacagg

SEQ ID NO: 336268 - RNA, 19 nt, Bordetella pertussis
gcgcugcacgcagcgcagg

SEQ ID NO: 336269 - RNA, 20 nt, Bordetella pertussis
gcgcugcacgcagcgcagga

SEQ ID NO: 336270 - RNA, 17 nt, Bordetella pertussis
gcgcugcacgcggccgc

SEQ ID NO: 336271 - RNA, 18 nt, Bordetella pertussis
gcgcugcacgcggccgcg

SEQ ID NO: 336272 - RNA, 22 nt, Bordetella pertussis
gcgcugcacgcggccgcgcagg

SEQ ID NO: 336273 - RNA, 13 nt, Bordetella pertussis
gcgcugcacggcc

SEQ ID NO: 336274 - RNA, 20 nt, Bordetella pertussis
gcgcugcagaucaucgagca

SEQ ID NO: 336275 - RNA, 21 nt, Bordetella pertussis
gcgcugccugaaaccgcaggc

SEQ ID NO: 336276 - RNA, 19 nt, Bordetella pertussis
gcgcugcgacagcagcaug

SEQ ID NO: 336277 - RNA, 14 nt, Bordetella pertussis
gcgcugcgagccgc

SEQ ID NO: 336278 - RNA, 16 nt, Bordetella pertussis
gcgcugcgagccgccg

SEQ ID NO: 336279 - RNA, 18 nt, Bordetella pertussis
gcgcugccugccggccgg

SEQ ID NO: 336280 - RNA, 20 nt, Bordetella pertussis
gcgcugccugccggccggcc

SEQ ID NO: 336281 - RNA, 21 nt, Bordetella pertussis
gcgcugcgcagcagggcggcg

SEQ ID NO: 336282 - RNA, 23 nt, Bordetella pertussis
gcgcugcgcccgcuacgcgggcu

SEQ ID NO: 336283 - RNA, 22 nt, Bordetella pertussis
gcgcugcgccuuggcgcgcaga

SEQ ID NO: 336284 - RNA, 21 nt, Bordetella pertussis
gcgcugcgcgaaacggccggg

SEQ ID NO: 336285 - RNA, 17 nt, Bordetella pertussis
gcgcugcgcgaacgcgg

SEQ ID NO: 336286 - RNA, 15 nt, Bordetella pertussis
gcgcugcgcgccgcc

SEQ ID NO: 336287 - RNA, 20 nt, Bordetella pertussis
gcgcugcgcgccgccgcgcu

SEQ ID NO: 336288 - RNA, 14 nt, Bordetella pertussis
gcgcugcgccggcg

SEQ ID NO: 336289 - RNA, 14 nt, Bordetella pertussis
gcgcugcgcggucu

SEQ ID NO: 336290 - RNA, 23 nt, Bordetella pertussis
gcgcuggacgcccuggcgcaggc

SEQ ID NO: 336291 - RNA, 15 nt, Bordetella pertussis
gcgcuggauggcucg

SEQ ID NO: 336292 - RNA, 21 nt, Bordetella pertussis
gcgcuggcccaguucgcgcag

SEQ ID NO: 336293 - RNA, 22 nt, Bordetella pertussis
gcgcuggcccgucaugggcggg

SEQ ID NO: 336294 - RNA, 13 nt, Bordetella pertussis
gcgcuggccgaca

SEQ ID NO: 336295 - RNA, 13 nt, Bordetella pertussis
gcgcuggccgcca

SEQ ID NO: 336296 - RNA, 13 nt, Bordetella pertussis
gcgcuggccgcga

SEQ ID NO: 336297 - RNA, 15 nt, Bordetella pertussis
gcgcuggccggccgc

SEQ ID NO: 336298 - RNA, 16 nt, Bordetella pertussis
gcgcuggccggccgcg

SEQ ID NO: 336299 - RNA, 14 nt, Bordetella pertussis
gcgcuggccugccg

SEQ ID NO: 336300 - RNA, 17 nt, Bordetella pertussis
gcgcuggccugccgcgc

SEQ ID NO: 336301 - RNA, 17 nt, Bordetella pertussis
gcgcuggccuggccgcc

SEQ ID NO: 336302 - RNA, 23 nt, Bordetella pertussis
gcgcuggcgaagaacaccgccgc

SEQ ID NO: 336303 - RNA, 15 nt, Bordetella pertussis
gcgcuggcgagcaug

SEQ ID NO: 336304 - RNA, 21 nt, Bordetella pertussis
gcgcuggcgagcauggcaucg

SEQ ID NO: 336305 - RNA, 13 nt, Bordetella pertussis
gcgcuggcgcagc

SEQ ID NO: 336306 - RNA, 15 nt, Bordetella pertussis
gcgcuggcgcagcag

SEQ ID NO: 336307 - RNA, 20 nt, Bordetella pertussis
gcgcuggcgcagcaggcgcg

SEQ ID NO: 336308 - RNA, 23 nt, Bordetella pertussis
gcgcuggcgcagcaggcgcgcgg

SEQ ID NO: 336309 - RNA, 20 nt, Bordetella pertussis
gcgcugggcgguugcgcugc

SEQ ID NO: 336310 - RNA, 18 nt, Bordetella pertussis
gcgcugggcguggcgcgc

SEQ ID NO: 336311 - RNA, 15 nt, Bordetella pertussis
gcgcuggggaagcgc

SEQ ID NO: 336312 - RNA, 14 nt, Bordetella pertussis
gcgcuggggcagca

SEQ ID NO: 336313 - RNA, 21 nt, Bordetella pertussis
gcgcuggggcaggacgccggc

SEQ ID NO: 336314 - RNA, 16 nt, Bordetella pertussis
gcgcuggggcugucgc

SEQ ID NO: 336315 - RNA, 17 nt, Bordetella pertussis
gcgcugggucaggucgc

SEQ ID NO: 336316 - RNA, 22 nt, Bordetella pertussis
gcgcuggguguagucgcggccg

SEQ ID NO: 336317 - RNA, 18 nt, Bordetella pertussis
gcgcugguaaagggcgcg

SEQ ID NO: 336318 - RNA, 20 nt, Bordetella pertussis
gcgcugguaaagggcgcgga

SEQ ID NO: 336319 - RNA, 23 nt, Bordetella pertussis
gcgcugguaaagggcgcggaugu

SEQ ID NO: 336320 - RNA, 16 nt, Bordetella pertussis
gcgcugguccgccgcc

SEQ ID NO: 336321 - RNA, 16 nt, Bordetella pertussis
gcgcuggugcuggccg

SEQ ID NO: 336322 - RNA, 17 nt, Bordetella pertussis
gcgcuggugcuggccga

SEQ ID NO: 336323 - RNA, 15 nt, Bordetella pertussis
gcgcuguaggcgccg

SEQ ID NO: 336324 - RNA, 20 nt, Bordetella pertussis
gcgcuguaggcgccggcgcc

SEQ ID NO: 336325 - RNA, 22 nt, Bordetella pertussis
gcgcuguaggcgccggcgccgg

SEQ ID NO: 336326 - RNA, 17 nt, Bordetella pertussis
gcgcuguccaggccggg

SEQ ID NO: 336327 - RNA, 14 nt, Bordetella pertussis
gcgcuguccggcgc

SEQ ID NO: 336328 - RNA, 14 nt, Bordetella pertussis
gcgcugugcgacga

SEQ ID NO: 336329 - RNA, 17 nt, Bordetella pertussis
gcgcuguuccagccagu

SEQ ID NO: 336330 - RNA, 23 nt, Bordetella pertussis
gcgcuguucgauacggccacgca

SEQ ID NO: 336331 - RNA, 16 nt, Bordetella pertussis
gcgcuguuggccggcg

SEQ ID NO: 336332 - RNA, 17 nt, Bordetella pertussis
gcgcuguuggccggcgc

SEQ ID NO: 336333 - RNA, 20 nt, Bordetella pertussis
gcgcuguuggccggcgcgcc

SEQ ID NO: 336334 - RNA, 22 nt, Bordetella pertussis
gcgcuguuggccggcgcgcccu

SEQ ID NO: 336335 - RNA, 16 nt, Bordetella pertussis
gcgcuguuggccgucg

SEQ ID NO: 336336 - RNA, 22 nt, Bordetella pertussis
gcgcuguucggcgaugcgggcg

SEQ ID NO: 336337 - RNA, 20 nt, Bordetella pertussis
gcgcuguugcuccaggccgg

SEQ ID NO: 336338 - RNA, 22 nt, Bordetella pertussis
gcgcuguugcuccaggccggca

SEQ ID NO: 336339 - RNA, 22 nt, Bordetella pertussis
gcgcuguuucccuuccuggcca

SEQ ID NO: 336340 - RNA, 19 nt, Bordetella pertussis
gcgcuguuuccgggccugg

SEQ ID NO: 336341 - RNA, 20 nt, Bordetella pertussis
gcgcuguuuccgggccuggc

SEQ ID NO: 336342 - RNA, 16 nt, Bordetella pertussis
gcgcuuaccgcgccgg

SEQ ID NO: 336343 - RNA, 17 nt, Bordetella pertussis
gcgcuuaccgcgccggc

SEQ ID NO: 336344 - RNA, 22 nt, Bordetella pertussis
gcgcuucacccuggaugccaug

SEQ ID NO: 336345 - RNA, 16 nt, Bordetella pertussis
gcgcuucaggcgccgc

SEQ ID NO: 336346 - RNA, 21 nt, Bordetella pertussis
gcgcuucagugcucgggcugc

SEQ ID NO: 336347 - RNA, 14 nt, Bordetella pertussis
gcgcuucgggcagc

SEQ ID NO: 336348 - RNA, 16 nt, Bordetella pertussis
gcgcuucucggugcgc

SEQ ID NO: 336349 - RNA, 21 nt, Bordetella pertussis
gcgcuucucggugcgccgccg

SEQ ID NO: 336350 - RNA, 20 nt, Bordetella pertussis
gcgcuucugccagacggcca

SEQ ID NO: 336351 - RNA, 21 nt, Bordetella pertussis
gcgcuucugccagacggccag

SEQ ID NO: 336352 - RNA, 22 nt, Bordetella pertussis
gcgcuucugccagacggccagc

SEQ ID NO: 336353 - RNA, 16 nt, Bordetella pertussis
gcgcuucuuggcgacc

SEQ ID NO: 336354 - RNA, 20 nt, Bordetella pertussis
gcgcuucuuggcgaccaggc

SEQ ID NO: 336355 - RNA, 21 nt, Bordetella pertussis
gcgcuugaaaugcguggcgug

SEQ ID NO: 336356 - RNA, 16 nt, Bordetella pertussis
gcgcuugagcggcucg

SEQ ID NO: 336357 - RNA, 18 nt, Bordetella pertussis
gcgcuugagcggcucgcc

SEQ ID NO: 336358 - RNA, 12 nt, Bordetella pertussis
gcgcuugccgcc

SEQ ID NO: 336359 - RNA, 14 nt, Bordetella pertussis
gcgcuugccugacg

SEQ ID NO: 336360 - RNA, 17 nt, Bordetella pertussis
gcgcuugccugacgugc

SEQ ID NO: 336361 - RNA, 13 nt, Bordetella pertussis
gcgcuugcgcagg

SEQ ID NO: 336362 - RNA, 15 nt, Bordetella pertussis
gcgcuugcgcagggc

SEQ ID NO: 336363 - RNA, 14 nt, Bordetella pertussis
gcgcuugcggccgu

SEQ ID NO: 336364 - RNA, 15 nt, Bordetella pertussis
gcgcuugcggccguc

SEQ ID NO: 336365 - RNA, 21 nt, Bordetella pertussis
gcgcuugcucggugcgggccg

SEQ ID NO: 336366 - RNA, 16 nt, Bordetella pertussis
gcgcuuggaccccgug

SEQ ID NO: 336367 - RNA, 17 nt, Bordetella pertussis
gcgcuuggccagcuggc

SEQ ID NO: 336368 - RNA, 20 nt, Bordetella pertussis
gcgcuuggccagcuggcgcg

SEQ ID NO: 336369 - RNA, 16 nt, Bordetella pertussis
gcgcuuggcccugcag

SEQ ID NO: 336370 - RNA, 15 nt, Bordetella pertussis
gcgcuuggcguagcc

SEQ ID NO: 336371 - RNA, 17 nt, Bordetella pertussis
gcgcuuggucagcauca

SEQ ID NO: 336372 - RNA, 20 nt, Bordetella pertussis
gcgcuugugcgucggcucgg

SEQ ID NO: 336373 - RNA, 15 nt, Bordetella pertussis
gcgcuuguggucggc

SEQ ID NO: 336374 - RNA, 14 nt, Bordetella pertussis
gcgcuugucgccgc

SEQ ID NO: 336375 - RNA, 20 nt, Bordetella pertussis
gcgcuuuuuucuccagcgcc

SEQ ID NO: 336376 - RNA, 21 nt, Bordetella pertussis
gcgcuuuuuucuccagcgcca

SEQ ID NO: 336377 - RNA, 18 nt, Bordetella pertussis
gcggaaacgcgcgcgccc

SEQ ID NO: 336378 - RNA, 21 nt, Bordetella pertussis
gcggaaauccguaguccagca

SEQ ID NO: 336379 - RNA, 18 nt, Bordetella pertussis
gcggcauagcccaggccg

SEQ ID NO: 336380 - RNA, 20 nt, Bordetella pertussis
gcggcauagcccaggccgcc

SEQ ID NO: 336381 - RNA, 22 nt, Bordetella pertussis
gcggcauagcccaggccgccgg

SEQ ID NO: 336382 - RNA, 21 nt, Bordetella pertussis
gcggcauacgccgauggcgcg

SEQ ID NO: 336383 - RNA, 16 nt, Bordetella pertussis
gcggcaucacgccggu

SEQ ID NO: 336384 - RNA, 21 nt, Bordetella pertussis
gcggcaucgacaugcccgccg

SEQ ID NO: 336385 - RNA, 23 nt, Bordetella pertussis
gcggcaucgacaugcccgccggc

SEQ ID NO: 336386 - RNA, 18 nt, Bordetella pertussis
gcggcaucggccauggcg

SEQ ID NO: 336387 - RNA, 22 nt, Bordetella pertussis
gcggcaucggccauggcgguga

SEQ ID NO: 336388 - RNA, 13 nt, Bordetella pertussis
gcggcaucguuca

SEQ ID NO: 336389 - RNA, 19 nt, Bordetella pertussis
gcggcaucguucaggcgca

SEQ ID NO: 336390 - RNA, 16 nt, Bordetella pertussis
gcggcaucucgcggcg

SEQ ID NO: 336391 - RNA, 16 nt, Bordetella pertussis
gcggcaugcgcaugcu

SEQ ID NO: 336392 - RNA, 18 nt, Bordetella pertussis
gcggcaugcgcaugcugg

SEQ ID NO: 336393 - RNA, 16 nt, Bordetella pertussis
gcggcaugcgccagcc

SEQ ID NO: 336394 - RNA, 20 nt, Bordetella pertussis
gcggcaugcgccagccagcg

SEQ ID NO: 336395 - RNA, 14 nt, Bordetella pertussis
gcggcaugcugguc

SEQ ID NO: 336396 - RNA, 19 nt, Bordetella pertussis
gcggcauggcgccgcgccg

SEQ ID NO: 336397 - RNA, 23 nt, Bordetella pertussis
gcggcaugggcacauacagcgga

SEQ ID NO: 336398 - RNA, 15 nt, Bordetella pertussis
gcggcauucagcgcu

SEQ ID NO: 336399 - RNA, 20 nt, Bordetella pertussis
gcggccaaccccgagggcgc

SEQ ID NO: 336400 - RNA, 12 nt, Bordetella pertussis
gcggccaccacc

SEQ ID NO: 336401 - RNA, 13 nt, Bordetella pertussis
gcggccaccacca

SEQ ID NO: 336402 - RNA, 14 nt, Bordetella pertussis
gcggccaccaccag

SEQ ID NO: 336403 - RNA, 13 nt, Bordetella pertussis
gcggccaccaggc

SEQ ID NO: 336404 - RNA, 14 nt, Bordetella pertussis
gcggccaccaggcu

SEQ ID NO: 336405 - RNA, 15 nt, Bordetella pertussis
gcggccaccaggcug

SEQ ID NO: 336406 - RNA, 15 nt, Bordetella pertussis
gcggccacccugccg

SEQ ID NO: 336407 - RNA, 12 nt, Bordetella pertussis
gcggccacgccc

SEQ ID NO: 336408 - RNA, 14 nt, Bordetella pertussis
gcggccacgcgccg

SEQ ID NO: 336409 - RNA, 15 nt, Bordetella pertussis
gcggccacggccugc

SEQ ID NO: 336410 - RNA, 19 nt, Bordetella pertussis
gcggccacggccugcccgg

SEQ ID NO: 336411 - RNA, 21 nt, Bordetella pertussis
gcggccacggccugcccgggc

SEQ ID NO: 336412 - RNA, 22 nt, Bordetella pertussis
gcggccacggcggugaccacca

SEQ ID NO: 336413 - RNA, 14 nt, Bordetella pertussis
gcggccagaucgga

SEQ ID NO: 336414 - RNA, 17 nt, Bordetella pertussis
gcggccagcaagcgcgc

SEQ ID NO: 336415 - RNA, 19 nt, Bordetella pertussis
gcggccagcaagcgcgcca

SEQ ID NO: 336416 - RNA, 20 nt, Bordetella pertussis
gcggccagcaagcgcgccau

SEQ ID NO: 336417 - RNA, 12 nt, Bordetella pertussis
gcggccagcacc

SEQ ID NO: 336418 - RNA, 13 nt, Bordetella pertussis
gcggccagcaccg

SEQ ID NO: 336419 - RNA, 14 nt, Bordetella pertussis
gcggccagcaccgg

SEQ ID NO: 336420 - RNA, 15 nt, Bordetella pertussis
gcggccagcaccggc

SEQ ID NO: 336421 - RNA, 22 nt, Bordetella pertussis
gcggccagcaccggccgccgca

SEQ ID NO: 336422 - RNA, 19 nt, Bordetella pertussis
gcggccagcagcgcgugca

SEQ ID NO: 336423 - RNA, 15 nt, Bordetella pertussis
gcggccagcagcggc

SEQ ID NO: 336424 - RNA, 16 nt, Bordetella pertussis
gcggccagcagcggca

SEQ ID NO: 336425 - RNA, 19 nt, Bordetella pertussis
gcggccagcagcggcaggu

SEQ ID NO: 336426 - RNA, 14 nt, Bordetella pertussis
gcggccagccacgc

SEQ ID NO: 336427 - RNA, 17 nt, Bordetella pertussis
gcggccagccacgccgg

SEQ ID NO: 336428 - RNA, 19 nt, Bordetella pertussis
gcggccagccacgccggcg

SEQ ID NO: 336429 - RNA, 22 nt, Bordetella pertussis
gcggccagccacgccggcgcgc

SEQ ID NO: 336430 - RNA, 13 nt, Bordetella pertussis
gcggccagccggc

SEQ ID NO: 336431 - RNA, 14 nt, Bordetella pertussis
gcggccagccggcg

SEQ ID NO: 336432 - RNA, 17 nt, Bordetella pertussis
gcggccagccggcgcgc

SEQ ID NO: 336433 - RNA, 19 nt, Bordetella pertussis
gcggccagccggcgcgcca

SEQ ID NO: 336434 - RNA, 20 nt, Bordetella pertussis
gcggccagccggcgcgccau

SEQ ID NO: 336435 - RNA, 19 nt, Bordetella pertussis
gcggccagcgccggcgcgc

SEQ ID NO: 336436 - RNA, 13 nt, Bordetella pertussis
gcggccagcgcgc

SEQ ID NO: 336437 - RNA, 14 nt, Bordetella pertussis
gcggccagcgcgca

SEQ ID NO: 336438 - RNA, 14 nt, Bordetella pertussis
gcggccagcgcgcc

SEQ ID NO: 336439 - RNA, 14 nt, Bordetella pertussis
gcggccagcgcggc

SEQ ID NO: 336440 - RNA, 13 nt, Bordetella pertussis
gcggccagcggca

SEQ ID NO: 336441 - RNA, 17 nt, Bordetella pertussis
gcggccagcgcggcggc

SEQ ID NO: 336442 - RNA, 24 nt, Bordetella pertussis
gcggccagcgcgucgagcagcgca

SEQ ID NO: 336443 - RNA, 21 nt, Bordetella pertussis
gcggccagcggaugaugcggc

SEQ ID NO: 336444 - RNA, 19 nt, Bordetella pertussis
gcggccaggaucgcggcca

SEQ ID NO: 336445 - RNA, 21 nt, Bordetella pertussis
gcggccaggaucgcggccagc

SEQ ID NO: 336446 - RNA, 12 nt, Bordetella pertussis
gcggccaggccc

SEQ ID NO: 336447 - RNA, 13 nt, Bordetella pertussis
gcggccaggcccu

SEQ ID NO: 336448 - RNA, 13 nt, Bordetella pertussis
gcggccaggccga

SEQ ID NO: 336449 - RNA, 13 nt, Bordetella pertussis
gcggccaggccgg

SEQ ID NO: 336450 - RNA, 15 nt, Bordetella pertussis
gcggccaggccggcg

SEQ ID NO: 336451 - RNA, 17 nt, Bordetella pertussis
gcggccaggcgcucagc

SEQ ID NO: 336452 - RNA, 15 nt, Bordetella pertussis
gcggccaggcggggu

SEQ ID NO: 336453 - RNA, 12 nt, Bordetella pertussis
gcggccaggcuc

SEQ ID NO: 336454 - RNA, 17 nt, Bordetella pertussis
gcggccaggcucugggc

SEQ ID NO: 336455 - RNA, 19 nt, Bordetella pertussis
gcggccaggcucugggcgg

SEQ ID NO: 336456 - RNA, 21 nt, Bordetella pertussis
gcggccaggcucugggcggag

SEQ ID NO: 336457 - RNA, 20 nt, Bordetella pertussis
gcggccaggccggcgcgccg

SEQ ID NO: 336458 - RNA, 16 nt, Bordetella pertussis
gcggccaggcgcgccg

SEQ ID NO: 336459 - RNA, 16 nt, Bordetella pertussis
gcggccagggccugcg

SEQ ID NO: 336460 - RNA, 20 nt, Bordetella pertussis
gcggccagggugccccgccg

SEQ ID NO: 336461 - RNA, 18 nt, Bordetella pertussis
gcggccaggucggcgucg

SEQ ID NO: 336462 - RNA, 22 nt, Bordetella pertussis
gcggccaguucgacgcccaugc

SEQ ID NO: 336463 - RNA, 17 nt, Bordetella pertussis
gcggccaucgccauggc

SEQ ID NO: 336464 - RNA, 14 nt, Bordetella pertussis
gcggccaucgccgc

SEQ ID NO: 336465 - RNA, 16 nt, Bordetella pertussis
gcggccaucgccgcca

SEQ ID NO: 336466 - RNA, 18 nt, Bordetella pertussis
gcggccaucgccgccacg

SEQ ID NO: 336467 - RNA, 13 nt, Bordetella pertussis
gcggccaucgggc

SEQ ID NO: 336468 - RNA, 18 nt, Bordetella pertussis
gcggccaucuuggugcgc

SEQ ID NO: 336469 - RNA, 23 nt, Bordetella pertussis
gcggccaucuuggugcgcgccag

SEQ ID NO: 336470 - RNA, 14 nt, Bordetella pertussis
gcggccaugacggc

SEQ ID NO: 336471 - RNA, 15 nt, Bordetella pertussis
gcggccaugacggcc

SEQ ID NO: 336472 - RNA, 16 nt, Bordetella pertussis
gcggccaugacggcca

SEQ ID NO: 336473 - RNA, 18 nt, Bordetella pertussis
gcggccaugcccaggccc

SEQ ID NO: 336474 - RNA, 14 nt, Bordetella pertussis
gcggccaugccgac

SEQ ID NO: 336475 - RNA, 15 nt, Bordetella pertussis
gcggccaugccguca

SEQ ID NO: 336476 - RNA, 16 nt, Bordetella pertussis
gcggccaugcgccgcu

SEQ ID NO: 336477 - RNA, 22 nt, Bordetella pertussis
gcggcccacccggcacgcgccg

SEQ ID NO: 336478 - RNA, 21 nt, Bordetella pertussis
gcggcccacagcgcccccagc

SEQ ID NO: 336479 - RNA, 16 nt, Bordetella pertussis
gcggcccacggccagc

SEQ ID NO: 336480 - RNA, 16 nt, Bordetella pertussis
gcggcccagccgcucg

SEQ ID NO: 336481 - RNA, 13 nt, Bordetella pertussis
gcggcccagcgcg

SEQ ID NO: 336482 - RNA, 16 nt, Bordetella pertussis
gcggcccagcgcggcg

SEQ ID NO: 336483 - RNA, 13 nt, Bordetella pertussis
gcggcccagcggc

SEQ ID NO: 336484 - RNA, 15 nt, Bordetella pertussis
gcggcccagcggcaa

SEQ ID NO: 336485 - RNA, 12 nt, Bordetella pertussis
gcggcccaggcg

SEQ ID NO: 336486 - RNA, 13 nt, Bordetella pertussis
gcggcccaggcgu

SEQ ID NO: 336487 - RNA, 16 nt, Bordetella pertussis
gcggcccaggcgucca

SEQ ID NO: 336488 - RNA, 14 nt, Bordetella pertussis
gcggcccagcgugg

SEQ ID NO: 336489 - RNA, 18 nt, Bordetella pertussis
gcggcccagcguggcggu

SEQ ID NO: 336490 - RNA, 21 nt, Bordetella pertussis
gcggcccaucgugcgcgaucu

SEQ ID NO: 336491 - RNA, 22 nt, Bordetella pertussis
gcggccccggcaccaucgccgc

SEQ ID NO: 336492 - RNA, 16 nt, Bordetella pertussis
gcggcccgccgacugg

SEQ ID NO: 336493 - RNA, 13 nt, Bordetella pertussis
gcggcccgccagg

SEQ ID NO: 336494 - RNA, 16 nt, Bordetella pertussis
gcggcccgccagggcg

SEQ ID NO: 336495 - RNA, 18 nt, Bordetella pertussis
gcggcccgccagggcguu

SEQ ID NO: 336496 - RNA, 14 nt, Bordetella pertussis
gcggcccgcccgcg

SEQ ID NO: 336497 - RNA, 17 nt, Bordetella pertussis
gcggcccgcgcccugcu

SEQ ID NO: 336498 - RNA, 14 nt, Bordetella pertussis
gcggcccgcggccu

SEQ ID NO: 336499 - RNA, 19 nt, Bordetella pertussis
gcggcccgcggccuugguc

SEQ ID NO: 336500 - RNA, 12 nt, Bordetella pertussis
gcggcccggcca

SEQ ID NO: 336501 - RNA, 14 nt, Bordetella pertussis
gcggcccggccgca

SEQ ID NO: 336502 - RNA, 15 nt, Bordetella pertussis
gcggcccggccgccg

SEQ ID NO: 336503 - RNA, 21 nt, Bordetella pertussis
gcggcccggccgccgccggca

SEQ ID NO: 336504 - RNA, 17 nt, Bordetella pertussis
gcggcccguagcuggac

SEQ ID NO: 336505 - RNA, 13 nt, Bordetella pertussis
gcggcccugggcc

SEQ ID NO: 336506 - RNA, 18 nt, Bordetella pertussis
gcggcccugggccagcca

SEQ ID NO: 336507 - RNA, 21 nt, Bordetella pertussis
gcggcccugggccagccagcg

SEQ ID NO: 336508 - RNA, 13 nt, Bordetella pertussis
gcggcccuugcgc

SEQ ID NO: 336509 - RNA, 19 nt, Bordetella pertussis
gcggcccuugcgcgaacgg

SEQ ID NO: 336510 - RNA, 19 nt, Bordetella pertussis
gcggcccuugcgcgaaggc

SEQ ID NO: 336511 - RNA, 21 nt, Bordetella pertussis
gcggccgaagcgcaagcccag

SEQ ID NO: 336512 - RNA, 13 nt, Bordetella pertussis
gcggccgaccagc

SEQ ID NO: 336513 - RNA, 18 nt, Bordetella pertussis
gcggccgaccagcacgau

SEQ ID NO: 336514 - RNA, 14 nt, Bordetella pertussis
gcggccgagcgggc

SEQ ID NO: 336515 - RNA, 16 nt, Bordetella pertussis
gcggccgagcgggcca

SEQ ID NO: 336516 - RNA, 17 nt, Bordetella pertussis
gcggccgagcgggccag

SEQ ID NO: 336517 - RNA, 19 nt, Bordetella pertussis
gcggccgagcgggccagcg

SEQ ID NO: 336518 - RNA, 21 nt, Bordetella pertussis
gcggccgagcgggccagcgcg

SEQ ID NO: 336519 - RNA, 16 nt, Bordetella pertussis
gcggccgaggccagcg

SEQ ID NO: 336520 - RNA, 19 nt, Bordetella pertussis
gcggccgaggccagcgugc

SEQ ID NO: 336521 - RNA, 15 nt, Bordetella pertussis
gcggccgaggucggc

SEQ ID NO: 336522 - RNA, 21 nt, Bordetella pertussis
gcggccgaggucggcggucca

SEQ ID NO: 336523 - RNA, 16 nt, Bordetella pertussis
gcggccgauagccgug

SEQ ID NO: 336524 - RNA, 17 nt, Bordetella pertussis
gcggccgauagccguga

SEQ ID NO: 336525 - RNA, 12 nt, Bordetella pertussis
gcggccgcagca

SEQ ID NO: 336526 - RNA, 16 nt, Bordetella pertussis
gcggccgccagcccga

SEQ ID NO: 336527 - RNA, 16 nt, Bordetella pertussis
gcggccgccagcgcca

SEQ ID NO: 336528 - RNA, 14 nt, Bordetella pertussis
gcggccgcccacgg

SEQ ID NO: 336529 - RNA, 14 nt, Bordetella pertussis
gcggccgcccagca

SEQ ID NO: 336530 - RNA, 20 nt, Bordetella pertussis
gcggccgcccagcagauggc

SEQ ID NO: 336531 - RNA, 22 nt, Bordetella pertussis
gcggccgcccccagcgcgccug

SEQ ID NO: 336532 - RNA, 20 nt, Bordetella pertussis
gcggccgccggcggcgccgg

SEQ ID NO: 336533 - RNA, 23 nt, Bordetella pertussis
gcggccgccggcggcgccggccu

SEQ ID NO: 336534 - RNA, 17 nt, Bordetella pertussis
gcggccgccugcgccga

SEQ ID NO: 336535 - RNA, 13 nt, Bordetella pertussis
gcggccgcgcacc

SEQ ID NO: 336536 - RNA, 14 nt, Bordetella pertussis
gcggccgcgcaccu

SEQ ID NO: 336537 - RNA, 12 nt, Bordetella pertussis
gcggccgcgcag

SEQ ID NO: 336538 - RNA, 13 nt, Bordetella pertussis
gcggccgcgcgcu

SEQ ID NO: 336539 - RNA, 20 nt, Bordetella pertussis
gcggccgcgcgggcggcccg

SEQ ID NO: 336540 - RNA, 13 nt, Bordetella pertussis
gcggccgcgcugg

SEQ ID NO: 336541 - RNA, 13 nt, Bordetella pertussis
gcggccgcgggca

SEQ ID NO: 336542 - RNA, 16 nt, Bordetella pertussis
gcggccgcgggcagca

SEQ ID NO: 336543 - RNA, 13 nt, Bordetella pertussis
gcggccgcgggcg

SEQ ID NO: 336544 - RNA, 19 nt, Bordetella pertussis
gcggccgcgggcggcgcgc

SEQ ID NO: 336545 - RNA, 23 nt, Bordetella pertussis
gcggccgcgggcggcgcgcccag

SEQ ID NO: 336546 - RNA, 24 nt, Bordetella pertussis
gcggccgcgggcgugcuggcacug

SEQ ID NO: 336547 - RNA, 22 nt, Bordetella pertussis
gcggccgcggucagccagagcg

SEQ ID NO: 336548 - RNA, 16 nt, Bordetella pertussis
gcggccgcguccagcg

SEQ ID NO: 336549 - RNA, 21 nt, Bordetella pertussis
gcggccgcguccagcgcgcgg

SEQ ID NO: 336550 - RNA, 13 nt, Bordetella pertussis
gcggccgcugccg

SEQ ID NO: 336551 - RNA, 15 nt, Bordetella pertussis
gcggccgcugccgcg

SEQ ID NO: 336552 - RNA, 22 nt, Bordetella pertussis
gcggccgcugccgcgcgccggc

SEQ ID NO: 336553 - RNA, 16 nt, Bordetella pertussis
gcggccggaggccgcc

SEQ ID NO: 336554 - RNA, 13 nt, Bordetella pertussis
gcggccggcacgc

SEQ ID NO: 336555 - RNA, 21 nt, Bordetella pertussis
gcggccggcacgcccagccgc

SEQ ID NO: 336556 - RNA, 16 nt, Bordetella pertussis
gcggccggcaggccgg

SEQ ID NO: 336557 - RNA, 19 nt, Bordetella pertussis
gcggccggcaggccggcca

SEQ ID NO: 336558 - RNA, 15 nt, Bordetella pertussis
gcggccggccagcca

SEQ ID NO: 336559 - RNA, 16 nt, Bordetella pertussis
gcggccggcaccaucu

SEQ ID NO: 336560 - RNA, 19 nt, Bordetella pertussis
gcggccggcccgugcgcaa

SEQ ID NO: 336561 - RNA, 12 nt, Bordetella pertussis
gcggccggccgg

SEQ ID NO: 336562 - RNA, 16 nt, Bordetella pertussis
gcggccggccggguug

SEQ ID NO: 336563 - RNA, 13 nt, Bordetella pertussis
gcggccggccugc

SEQ ID NO: 336564 - RNA, 14 nt, Bordetella pertussis
gcggccggccugcu

SEQ ID NO: 336565 - RNA, 15 nt, Bordetella pertussis
gcggccggcgcgccg

SEQ ID NO: 336566 - RNA, 19 nt, Bordetella pertussis
gcggccggcgcgccggccu

SEQ ID NO: 336567 - RNA, 15 nt, Bordetella pertussis
gcggccggcgcgcgc

SEQ ID NO: 336568 - RNA, 16 nt, Bordetella pertussis
gcggccggcggcgccg

SEQ ID NO: 336569 - RNA, 22 nt, Bordetella pertussis
gcggccggcugcaccagcgcgc

SEQ ID NO: 336570 - RNA, 16 nt, Bordetella pertussis
gcggccgggcacaccg

SEQ ID NO: 336571 - RNA, 14 nt, Bordetella pertussis
gcggccggggccgc

SEQ ID NO: 336572 - RNA, 17 nt, Bordetella pertussis
gcggccggggccgcccu

SEQ ID NO: 336573 - RNA, 18 nt, Bordetella pertussis
gcggccgguggcgaucag

SEQ ID NO: 336574 - RNA, 20 nt, Bordetella pertussis
gcggccgucgaccgacagca

SEQ ID NO: 336575 - RNA, 13 nt, Bordetella pertussis
gcggccgucggcg

SEQ ID NO: 336576 - RNA, 18 nt, Bordetella pertussis
gcggccgucggcgcuggc

SEQ ID NO: 336577 - RNA, 23 nt, Bordetella pertussis
gcggccgugccucaacuggccgg

SEQ ID NO: 336578 - RNA, 16 nt, Bordetella pertussis
gcggccgugcgccagc

SEQ ID NO: 336579 - RNA, 17 nt, Bordetella pertussis
gcggccgugcgccagcg

SEQ ID NO: 336580 - RNA, 19 nt, Bordetella pertussis
gcggccgugcgccagcgcc

SEQ ID NO: 336581 - RNA, 20 nt, Bordetella pertussis
gcggccgugcgccagcgcca

SEQ ID NO: 336582 - RNA, 15 nt, Bordetella pertussis
gcggccguggaggcg

SEQ ID NO: 336583 - RNA, 19 nt, Bordetella pertussis
gcggccguggaggcggcgg

SEQ ID NO: 336584 - RNA, 20 nt, Bordetella pertussis
gcggccguggaggcggcggc

SEQ ID NO: 336585 - RNA, 14 nt, Bordetella pertussis
gcggccgucgugca

SEQ ID NO: 336586 - RNA, 18 nt, Bordetella pertussis
gcggccgucgugcagcgu

SEQ ID NO: 336587 - RNA, 14 nt, Bordetella pertussis
gcggccguggcggc

SEQ ID NO: 336588 - RNA, 17 nt, Bordetella pertussis
gcggccguggcggccug

SEQ ID NO: 336589 - RNA, 18 nt, Bordetella pertussis
gcggccguggcggccugc

SEQ ID NO: 336590 - RNA, 22 nt, Bordetella pertussis
gcggccguguucgagcaggcgc

SEQ ID NO: 336591 - RNA, 17 nt, Bordetella pertussis
gcggccguugcuccagc

SEQ ID NO: 336592 - RNA, 18 nt, Bordetella pertussis
gcggccguugcuccagcc

SEQ ID NO: 336593 - RNA, 19 nt, Bordetella pertussis
gcggccguugcuccagcca

SEQ ID NO: 336594 - RNA, 22 nt, Bordetella pertussis
gcggccguugcuccagccaggc

SEQ ID NO: 336595 - RNA, 18 nt, Bordetella pertussis
gcggccguuggcgauggc

SEQ ID NO: 336596 - RNA, 21 nt, Bordetella pertussis
gcggccguuggcgauggcgcg

SEQ ID NO: 336597 - RNA, 17 nt, Bordetella pertussis
gcggccguuggcgugca

SEQ ID NO: 336598 - RNA, 20 nt, Bordetella pertussis
gcggccuaucaccugggcaa

SEQ ID NO: 336599 - RNA, 19 nt, Bordetella pertussis
gcggccuaugugcaggcca

SEQ ID NO: 336600 - RNA, 17 nt, Bordetella pertussis
gcggccuauuuggcggc

SEQ ID NO: 336601 - RNA, 18 nt, Bordetella pertussis
gcggccuauuuggcggcc

SEQ ID NO: 336602 - RNA, 21 nt, Bordetella pertussis
gcggccuauuuggcggccugg

SEQ ID NO: 336603 - RNA, 13 nt, Bordetella pertussis
gcggccuccagca

SEQ ID NO: 336604 - RNA, 16 nt, Bordetella pertussis
gcggccuccagcaggg

SEQ ID NO: 336605 - RNA, 17 nt, Bordetella pertussis
gcggccuccgcgcacag

SEQ ID NO: 336606 - RNA, 22 nt, Bordetella pertussis
gcggccuccgcgcacagcgcgg

SEQ ID NO: 336607 - RNA, 23 nt, Bordetella pertussis
gcggccuccgcgcacagcgcggc

SEQ ID NO: 336608 - RNA, 12 nt, Bordetella pertussis
gcggccuccggc

SEQ ID NO: 336609 - RNA, 18 nt, Bordetella pertussis
gcggccuccggcaggauc

SEQ ID NO: 336610 - RNA, 18 nt, Bordetella pertussis
gcggccucgacgauggcc

SEQ ID NO: 336611 - RNA, 22 nt, Bordetella pertussis
gcggccucgacgauggccgggg

SEQ ID NO: 336612 - RNA, 14 nt, Bordetella pertussis
gcggccucgccggc

SEQ ID NO: 336613 - RNA, 15 nt, Bordetella pertussis
gcggccucgccggcc

SEQ ID NO: 336614 - RNA, 17 nt, Bordetella pertussis
gcggccucgccggccug

SEQ ID NO: 336615 - RNA, 15 nt, Bordetella pertussis
gcggccucggccagc

SEQ ID NO: 336616 - RNA, 16 nt, Bordetella pertussis
gcggccucggccagcu

SEQ ID NO: 336617 - RNA, 17 nt, Bordetella pertussis
gcggccucggccagcug

SEQ ID NO: 336618 - RNA, 13 nt, Bordetella pertussis
gcggccucggccg

SEQ ID NO: 336619 - RNA, 15 nt, Bordetella pertussis
gcggccucggcgggc

SEQ ID NO: 336620 - RNA, 16 nt, Bordetella pertussis
gcggccugcaggccgu

SEQ ID NO: 336621 - RNA, 19 nt, Bordetella pertussis
gcggccugcagaccagcac

SEQ ID NO: 336622 - RNA, 20 nt, Bordetella pertussis
gcggccugcgccggcauggc

SEQ ID NO: 336623 - RNA, 18 nt, Bordetella pertussis
gcggccugcgcgucccgg

SEQ ID NO: 336624 - RNA, 21 nt, Bordetella pertussis
gcggccugcucgaaaugcgcg

SEQ ID NO: 336625 - RNA, 16 nt, Bordetella pertussis
gcggccugcuuggcag

SEQ ID NO: 336626 - RNA, 16 nt, Bordetella pertussis
gcggccuggaccugag

SEQ ID NO: 336627 - RNA, 17 nt, Bordetella pertussis
gcggccuggaccugagc

SEQ ID NO: 336628 - RNA, 15 nt, Bordetella pertussis
gcggccuggccccgc

SEQ ID NO: 336629 - RNA, 20 nt, Bordetella pertussis
gcggccuggccccgcgcgag

SEQ ID NO: 336630 - RNA, 21 nt, Bordetella pertussis
gcggccuggccccgcgcgagc

SEQ ID NO: 336631 - RNA, 17 nt, Bordetella pertussis
gcggccuggccgcgcgc

SEQ ID NO: 336632 - RNA, 22 nt, Bordetella pertussis
gcggccuggccgcgcgccugcu

SEQ ID NO: 336633 - RNA, 20 nt, Bordetella pertussis
gcggccuggcgguaugcggc

SEQ ID NO: 336634 - RNA, 14 nt, Bordetella pertussis
gcggccugggccau

SEQ ID NO: 336635 - RNA, 18 nt, Bordetella pertussis
gcggccugggcggcgcgc

SEQ ID NO: 336636 - RNA, 19 nt, Bordetella pertussis
gcggccugggcggcgcgcu

SEQ ID NO: 336637 - RNA, 23 nt, Bordetella pertussis
gcggccuucaugaucuggccgac

SEQ ID NO: 336638 - RNA, 17 nt, Bordetella pertussis
gcggccuucaccccgcc

SEQ ID NO: 336639 - RNA, 22 nt, Bordetella pertussis
gcggccuugccgguggacggcc

SEQ ID NO: 336640 - RNA, 18 nt, Bordetella pertussis
gcggccuugcgggccggc

SEQ ID NO: 336641 - RNA, 15 nt, Bordetella pertussis
gcggccuuggccgca

SEQ ID NO: 336642 - RNA, 21 nt, Bordetella pertussis
gcggccuuggccgcagccggc

SEQ ID NO: 336643 - RNA, 23 nt, Bordetella pertussis
gcggccuuggucgcgaccucggc

SEQ ID NO: 336644 - RNA, 22 nt, Bordetella pertussis
gcggccuugagcaucugcggca

SEQ ID NO: 336645 - RNA, 15 nt, Bordetella pertussis
gcggccuugccggcc

SEQ ID NO: 336646 - RNA, 18 nt, Bordetella pertussis
gcggccuugugcgccagc

SEQ ID NO: 336647 - RNA, 16 nt, Bordetella pertussis
gcggccuuugcgcgcu

SEQ ID NO: 336648 - RNA, 18 nt, Bordetella pertussis
gcggccuuuuuuugcggc

SEQ ID NO: 336649 - RNA, 19 nt, Bordetella pertussis
gcggccuuuuuuugcggca

SEQ ID NO: 336650 - RNA, 19 nt, Bordetella pertussis
gcggcgaaaugucgagcgc

SEQ ID NO: 336651 - RNA, 23 nt, Bordetella pertussis
gcggcgaaaugucgagcgcgaug

SEQ ID NO: 336652 - RNA, 15 nt, Bordetella pertussis
gcggcgauguggcgc

SEQ ID NO: 336653 - RNA, 17 nt, Bordetella pertussis
gcggcgauguggcgcgc

SEQ ID NO: 336654 - RNA, 17 nt, Bordetella pertussis
gcggcgcaacccggccu

SEQ ID NO: 336655 - RNA, 15 nt, Bordetella pertussis
gcggcgcaccagcga

SEQ ID NO: 336656 - RNA, 16 nt, Bordetella pertussis
gcggcgcaccagcgag

SEQ ID NO: 336657 - RNA, 13 nt, Bordetella pertussis
gcggcgcaccagc

SEQ ID NO: 336658 - RNA, 11 nt, Bordetella pertussis
gcggcgcaccg

SEQ ID NO: 336659 - RNA, 15 nt, Bordetella pertussis
gcggcgcaccgacag

SEQ ID NO: 336660 - RNA, 14 nt, Bordetella pertussis
gcggcgcagcacca

SEQ ID NO: 336661 - RNA, 18 nt, Bordetella pertussis
gcggcgcagcaccaggcu

SEQ ID NO: 336662 - RNA, 20 nt, Bordetella pertussis
gcggcgcagcaucuugcgcc

SEQ ID NO: 336663 - RNA, 18 nt, Bordetella pertussis
gcggcgcagcauuucggc

SEQ ID NO: 336664 - RNA, 18 nt, Bordetella pertussis
gcggcgcagcccagcgcg

SEQ ID NO: 336665 - RNA, 14 nt, Bordetella pertussis
gcggcgcagccgcc

SEQ ID NO: 336666 - RNA, 14 nt, Bordetella pertussis
gcggcgcagccggc

SEQ ID NO: 336667 - RNA, 16 nt, Bordetella pertussis
gcggcgcagccggccg

SEQ ID NO: 336668 - RNA, 17 nt, Bordetella pertussis
gcggcgccagcgccccg

SEQ ID NO: 336669 - RNA, 17 nt, Bordetella pertussis
gcggcgccagcggaugg

SEQ ID NO: 336670 - RNA, 14 nt, Bordetella pertussis
gcggcgccagcugg

SEQ ID NO: 336671 - RNA, 18 nt, Bordetella pertussis
gcggcgccagucgcgcag

SEQ ID NO: 336672 - RNA, 14 nt, Bordetella pertussis
gcggcgccaugcgc

SEQ ID NO: 336673 - RNA, 21 nt, Bordetella pertussis
gcggcgccaugcgcaccaccg

SEQ ID NO: 336674 - RNA, 12 nt, Bordetella pertussis
gcggcgcccagc

SEQ ID NO: 336675 - RNA, 15 nt, Bordetella pertussis
gcggcgcccagcugg

SEQ ID NO: 336676 - RNA, 22 nt, Bordetella pertussis
gcggcgcccagcuggcgccccu

SEQ ID NO: 336677 - RNA, 16 nt, Bordetella pertussis
gcggcgcccaggccca

SEQ ID NO: 336678 - RNA, 19 nt, Bordetella pertussis
gcggcgcccaggcccagcg

SEQ ID NO: 336679 - RNA, 21 nt, Bordetella pertussis
gcggcgcccaggcccagcgcg

SEQ ID NO: 336680 - RNA, 17 nt, Bordetella pertussis
gcggcgcccccgcggcg

SEQ ID NO: 336681 - RNA, 19 nt, Bordetella pertussis
gcggcgcccccgcggcgcc

SEQ ID NO: 336682 - RNA, 13 nt, Bordetella pertussis
gcggcgcccgcug

SEQ ID NO: 336683 - RNA, 14 nt, Bordetella pertussis
gcggcgcccgcugc

SEQ ID NO: 336684 - RNA, 20 nt, Bordetella pertussis
gcggcgcccgccugcguggc

SEQ ID NO: 336685 - RNA, 12 nt, Bordetella pertussis
gcggcgcgcacg

SEQ ID NO: 336686 - RNA, 14 nt, Bordetella pertussis
gcggcgcgccagcg

SEQ ID NO: 336687 - RNA, 20 nt, Bordetella pertussis
gcggcgcgccagcgcggcca

SEQ ID NO: 336688 - RNA, 21 nt, Bordetella pertussis
gcggcgcgccagcgcggccag

SEQ ID NO: 336689 - RNA, 15 nt, Bordetella pertussis
gcggcgcgcccagcg

SEQ ID NO: 336690 - RNA, 18 nt, Bordetella pertussis
gcggcgcgcccagcggca

SEQ ID NO: 336691 - RNA, 12 nt, Bordetella pertussis
gcggcgcgcccg

SEQ ID NO: 336692 - RNA, 14 nt, Bordetella pertussis
gcggcgcgccgucc

SEQ ID NO: 336693 - RNA, 14 nt, Bordetella pertussis
gcggcgcgcgccug

SEQ ID NO: 336694 - RNA, 15 nt, Bordetella pertussis
gcggcgcgcgcgccg

SEQ ID NO: 336695 - RNA, 17 nt, Bordetella pertussis
gcggcgcgcgcgcgcag

SEQ ID NO: 336696 - RNA, 19 nt, Bordetella pertussis
gcggcgcgcgcgcgcagca

SEQ ID NO: 336697 - RNA, 13 nt, Bordetella pertussis
gcggcgcgcggcu

SEQ ID NO: 336698 - RNA, 15 nt, Bordetella pertussis
gcggcgcgcggcugg

SEQ ID NO: 336699 - RNA, 11 nt, Bordetella pertussis
gcggcgcgcgc

SEQ ID NO: 336700 - RNA, 15 nt, Bordetella pertussis
gcggcgcgcuggacg

SEQ ID NO: 336701 - RNA, 15 nt, Bordetella pertussis
gcggcgcgcuugguc

SEQ ID NO: 336702 - RNA, 14 nt, Bordetella pertussis
gcggcgcggccagc

SEQ ID NO: 336703 - RNA, 17 nt, Bordetella pertussis
gcggcgcggccagcacg

SEQ ID NO: 336704 - RNA, 13 nt, Bordetella pertussis
gcggcgcggcccg

SEQ ID NO: 336705 - RNA, 14 nt, Bordetella pertussis
gcggcgcggcccgc

SEQ ID NO: 336706 - RNA, 20 nt, Bordetella pertussis
gcggcgcggcccgccacgca

SEQ ID NO: 336707 - RNA, 14 nt, Bordetella pertussis
gcggcgcggccgac

SEQ ID NO: 336708 - RNA, 18 nt, Bordetella pertussis
gcggcgcggcgcaggccu

SEQ ID NO: 336709 - RNA, 13 nt, Bordetella pertussis
gcggcgcggcgcg

SEQ ID NO: 336710 - RNA, 18 nt, Bordetella pertussis
gcggcgcggcgcgugcca

SEQ ID NO: 336711 - RNA, 16 nt, Bordetella pertussis
gcggcgcggcuggcga

SEQ ID NO: 336712 - RNA, 22 nt, Bordetella pertussis
gcggcgcguucagcagcaggcc

SEQ ID NO: 336713 - RNA, 17 nt, Bordetella pertussis
gcggcgcguucagggcg

SEQ ID NO: 336714 - RNA, 20 nt, Bordetella pertussis
gcggcggcacgcgcgccggc

SEQ ID NO: 336715 - RNA, 23 nt, Bordetella pertussis
gcggcgcuacgccgccgauggcg

SEQ ID NO: 336716 - RNA, 14 nt, Bordetella pertussis
gcggcggccgaagc

SEQ ID NO: 336717 - RNA, 19 nt, Bordetella pertussis
gcggcggccgcguccagcg

SEQ ID NO: 336718 - RNA, 21 nt, Bordetella pertussis
gcggcggccgcguccagcgcg

SEQ ID NO: 336719 - RNA, 22 nt, Bordetella pertussis
gcggcggccgcguccagcgcgc

SEQ ID NO: 336720 - RNA, 12 nt, Bordetella pertussis
gcggcggccggu

SEQ ID NO: 336721 - RNA, 15 nt, Bordetella pertussis
gcggcggccuugugc

SEQ ID NO: 336722 - RNA, 13 nt, Bordetella pertussis
gcggcggcgaccg

SEQ ID NO: 336723 - RNA, 16 nt, Bordetella pertussis
gcggcggcgaccggcg

SEQ ID NO: 336724 - RNA, 13 nt, Bordetella pertussis
gcggcggcgcccg

SEQ ID NO: 336725 - RNA, 14 nt, Bordetella pertussis
gcggcggcgcuggc

SEQ ID NO: 336726 - RNA, 15 nt, Bordetella pertussis
gcggcggcgcuggcc

SEQ ID NO: 336727 - RNA, 13 nt, Bordetella pertussis
gcggcggcggcca

SEQ ID NO: 336728 - RNA, 15 nt, Bordetella pertussis
gcggcggcgugaacg

SEQ ID NO: 336729 - RNA, 14 nt, Bordetella pertussis
gcggcggcguggcg

SEQ ID NO: 336730 - RNA, 21 nt, Bordetella pertussis
gcggcggcuucgcgcagcaag

SEQ ID NO: 336731 - RNA, 17 nt, Bordetella pertussis
gcggcgggaccgugccg

SEQ ID NO: 336732 - RNA, 18 nt, Bordetella pertussis
gcggcgggaccgugccgc

SEQ ID NO: 336733 - RNA, 22 nt, Bordetella pertussis
gcggcgggacuguaccgcgcga

SEQ ID NO: 336734 - RNA, 13 nt, Bordetella pertussis
gcggcgggcacga

SEQ ID NO: 336735 - RNA, 13 nt, Bordetella pertussis
gcggcgggcgcug

SEQ ID NO: 336736 - RNA, 14 nt, Bordetella pertussis
gcggcgggcgcugg

SEQ ID NO: 336737 - RNA, 15 nt, Bordetella pertussis
gcggcgggcgcuggc

SEQ ID NO: 336738 - RNA, 17 nt, Bordetella pertussis
gcggcgggcgcuggcgc

SEQ ID NO: 336739 - RNA, 17 nt, Bordetella pertussis
gcggcgggcggccggcg

SEQ ID NO: 336740 - RNA, 18 nt, Bordetella pertussis
gcggcgggcggccggcgc

SEQ ID NO: 336741 - RNA, 14 nt, Bordetella pertussis
gcggcgggcggcgc

SEQ ID NO: 336742 - RNA, 16 nt, Bordetella pertussis
gcggcgggcggcgcgg

SEQ ID NO: 336743 - RNA, 23 nt, Bordetella pertussis
gcggcgggcgggucgaugucgug

SEQ ID NO: 336744 - RNA, 13 nt, Bordetella pertussis
gcggcgggcucag

SEQ ID NO: 336745 - RNA, 23 nt, Bordetella pertussis
gcggcgggucaaguccggcgccg

SEQ ID NO: 336746 - RNA, 18 nt, Bordetella pertussis
gcggcgggcucggcgccg

SEQ ID NO: 336747 - RNA, 16 nt, Bordetella pertussis
gcggcggguggcggcg

SEQ ID NO: 336748 - RNA, 17 nt, Bordetella pertussis
gcggcgguaccaggccg

SEQ ID NO: 336749 - RNA, 18 nt, Bordetella pertussis
gcggcgguaccaggccga

SEQ ID NO: 336750 - RNA, 20 nt, Bordetella pertussis
gcggcggguucgcagggcgc

SEQ ID NO: 336751 - RNA, 16 nt, Bordetella pertussis
gcggcguaccggucca

SEQ ID NO: 336752 - RNA, 16 nt, Bordetella pertussis
gcggcguagagcgccg

SEQ ID NO: 336753 - RNA, 13 nt, Bordetella pertussis
gcggcguauggcg

SEQ ID NO: 336754 - RNA, 15 nt, Bordetella pertussis
gcggcguauggcgcg

SEQ ID NO: 336755 - RNA, 21 nt, Bordetella pertussis
gcggcguauguccgguacgag

SEQ ID NO: 336756 - RNA, 22 nt, Bordetella pertussis
gcggcgucaaugccagucgccg

SEQ ID NO: 336757 - RNA, 12 nt, Bordetella pertussis
gcggcguccgcg

SEQ ID NO: 336758 - RNA, 15 nt, Bordetella pertussis
gcggcguccgcgccg

SEQ ID NO: 336759 - RNA, 21 nt, Bordetella pertussis
gcggcgugaacgcgcauucgu

SEQ ID NO: 336760 - RNA, 18 nt, Bordetella pertussis
gcggcgugaugcccaggc

SEQ ID NO: 336761 - RNA, 15 nt, Bordetella pertussis
gcggcgugagcacga

SEQ ID NO: 336762 - RNA, 16 nt, Bordetella pertussis
gcggcgugcggcccag

SEQ ID NO: 336763 - RNA, 15 nt, Bordetella pertussis
gcggcguggccgugc

SEQ ID NO: 336764 - RNA, 19 nt, Bordetella pertussis
gcggcguggcggccaggcc

SEQ ID NO: 336765 - RNA, 19 nt, Bordetella pertussis
gcggcguggcggggcguuc

SEQ ID NO: 336766 - RNA, 16 nt, Bordetella pertussis
gcggcguggggccggc

SEQ ID NO: 336767 - RNA, 17 nt, Bordetella pertussis
gcggcguggggccggcc

SEQ ID NO: 336768 - RNA, 18 nt, Bordetella pertussis
gcggcguggggccggccg

SEQ ID NO: 336769 - RNA, 19 nt, Bordetella pertussis
gcggcguggggccggccgc

SEQ ID NO: 336770 - RNA, 16 nt, Bordetella pertussis
gcggcguguagagcug

SEQ ID NO: 336771 - RNA, 17 nt, Bordetella pertussis
gcggcgugugcccagca

SEQ ID NO: 336772 - RNA, 15 nt, Bordetella pertussis
gcggcguuccugggc

SEQ ID NO: 336773 - RNA, 17 nt, Bordetella pertussis
gcggcguuccugggcac

SEQ ID NO: 336774 - RNA, 13 nt, Bordetella pertussis
gcggcguugcggc

SEQ ID NO: 336775 - RNA, 18 nt, Bordetella pertussis
gcggcguugcggcgccau

SEQ ID NO: 336776 - RNA, 18 nt, Bordetella pertussis
gcggcguuguagccguag

SEQ ID NO: 336777 - RNA, 17 nt, Bordetella pertussis
gcggcucgccgcgcacg

SEQ ID NO: 336778 - RNA, 15 nt, Bordetella pertussis
gcggcucgccggccg

SEQ ID NO: 336779 - RNA, 15 nt, Bordetella pertussis
gcggcuccugcuggc

SEQ ID NO: 336780 - RNA, 15 nt, Bordetella pertussis
gcggcucgacgccgu

SEQ ID NO: 336781 - RNA, 19 nt, Bordetella pertussis
gcggcucgacgccguacug

SEQ ID NO: 336782 - RNA, 21 nt, Bordetella pertussis
gcggcucgagcggcagcagcg

SEQ ID NO: 336783 - RNA, 19 nt, Bordetella pertussis
gcggcucgaggaaccagcc

SEQ ID NO: 336784 - RNA, 13 nt, Bordetella pertussis
gcggcuucaggcg

SEQ ID NO: 336785 - RNA, 23 nt, Bordetella pertussis
gcggcuuccuggucacccggcgc

SEQ ID NO: 336786 - RNA, 14 nt, Bordetella pertussis
gcggcuucgcccgg

SEQ ID NO: 336787 - RNA, 15 nt, Bordetella pertussis
gcggcuucggccguc

SEQ ID NO: 336788 - RNA, 19 nt, Bordetella pertussis
gcggcuucggccgucagca

SEQ ID NO: 336789 - RNA, 21 nt, Bordetella pertussis
gcggcuugcagcggacggcgc

SEQ ID NO: 336790 - RNA, 15 nt, Bordetella pertussis
gcggcuugcgguccg

SEQ ID NO: 336791 - RNA, 18 nt, Bordetella pertussis
gcggcuugccgcggcgcg

SEQ ID NO: 336792 - RNA, 19 nt, Bordetella pertussis
gcggcuugccgcggcgcgg

SEQ ID NO: 336793 - RNA, 20 nt, Bordetella pertussis
gcggcuugggcccggcguag

SEQ ID NO: 336794 - RNA, 16 nt, Bordetella pertussis
gcggcuugguugucgc

SEQ ID NO: 336795 - RNA, 22 nt, Bordetella pertussis
gcgggaagcgcucgcgcaggcg

SEQ ID NO: 336796 - RNA, 18 nt, Bordetella pertussis
gcgggaaugauuccgcug

SEQ ID NO: 336797 - RNA, 21 nt, Bordetella pertussis
gcgggaaugauuccgcuggcg

SEQ ID NO: 336798 - RNA, 22 nt, Bordetella pertussis
gcgggaaugauuccgcuggcga

SEQ ID NO: 336799 - RNA, 15 nt, Bordetella pertussis
gcgggacaggcgcca

SEQ ID NO: 336800 - RNA, 14 nt, Bordetella pertussis
gcgggacgcaggcc

SEQ ID NO: 336801 - RNA, 14 nt, Bordetella pertussis
gcgggacggccagg

SEQ ID NO: 336802 - RNA, 15 nt, Bordetella pertussis
gcgggacggccaggg

SEQ ID NO: 336803 - RNA, 22 nt, Bordetella pertussis
gcgggacuguaccgcgcgaugu

SEQ ID NO: 336804 - RNA, 22 nt, Bordetella pertussis
gcgggacuugguuggccugggc

SEQ ID NO: 336805 - RNA, 23 nt, Bordetella pertussis
gcgggagaucuguaccgccgggu

SEQ ID NO: 336806 - RNA, 15 nt, Bordetella pertussis
gcgggagccuguccc

SEQ ID NO: 336807 - RNA, 17 nt, Bordetella pertussis
gcgggagccuguccccg

SEQ ID NO: 336808 - RNA, 17 nt, Bordetella pertussis
gcgggaggaagggugcg

SEQ ID NO: 336809 - RNA, 12 nt, Bordetella pertussis
gcgggaggugcc

SEQ ID NO: 336810 - RNA, 14 nt, Bordetella pertussis
gcgggaggugccgc

SEQ ID NO: 336811 - RNA, 15 nt, Bordetella pertussis
gcgggcagcauggcg

SEQ ID NO: 336812 - RNA, 16 nt, Bordetella pertussis
gcgggcagcauggcgc

SEQ ID NO: 336813 - RNA, 19 nt, Bordetella pertussis
gcgggcaggcgggccaggc

SEQ ID NO: 336814 - RNA, 14 nt, Bordetella pertussis
gcgggcagugcgcc

SEQ ID NO: 336815 - RNA, 18 nt, Bordetella pertussis
gcgggcagugcgccggac

SEQ ID NO: 336816 - RNA, 16 nt, Bordetella pertussis
gcgggcaucgcccacc

SEQ ID NO: 336817 - RNA, 17 nt, Bordetella pertussis
gcgggcaugacgaccgc

SEQ ID NO: 336818 - RNA, 16 nt, Bordetella pertussis
gcgggcauugggcagc

SEQ ID NO: 336819 - RNA, 20 nt, Bordetella pertussis
gcgggccccgcagggcccgc

SEQ ID NO: 336820 - RNA, 13 nt, Bordetella pertussis
gcgggcccgacag

SEQ ID NO: 336821 - RNA, 17 nt, Bordetella pertussis
gcgggcccgacagcgcc

SEQ ID NO: 336822 - RNA, 15 nt, Bordetella pertussis
gcgggcccgcaucgc

SEQ ID NO: 336823 - RNA, 17 nt, Bordetella pertussis
gcgggcccgcaucgcgc

SEQ ID NO: 336824 - RNA, 21 nt, Bordetella pertussis
gcgggcccgcaucgcgcgccg

SEQ ID NO: 336825 - RNA, 15 nt, Bordetella pertussis
gcgggcccgcucggc

SEQ ID NO: 336826 - RNA, 22 nt, Bordetella pertussis
gcgggcccuggcguucgcgcgc

SEQ ID NO: 336827 - RNA, 18 nt, Bordetella pertussis
gcgggcccuguguccacg

SEQ ID NO: 336828 - RNA, 20 nt, Bordetella pertussis
gcgggcccgucgcgccaggc

SEQ ID NO: 336829 - RNA, 22 nt, Bordetella pertussis
gcgggcccgucgcgccaggccg

SEQ ID NO: 336830 - RNA, 20 nt, Bordetella pertussis
gcgggccgcacuccguaaag

SEQ ID NO: 336831 - RNA, 20 nt, Bordetella pertussis
gcgggccgcgccccuagcgc

SEQ ID NO: 336832 - RNA, 16 nt, Bordetella pertussis
gcgggccggcaccacg

SEQ ID NO: 336833 - RNA, 14 nt, Bordetella pertussis
gcgggccggcucgg

SEQ ID NO: 336834 - RNA, 20 nt, Bordetella pertussis
gcgggccuacuugccggcgc

SEQ ID NO: 336835 - RNA, 16 nt, Bordetella pertussis
gcgggccugcagcaug

SEQ ID NO: 336836 - RNA, 23 nt, Bordetella pertussis
gcgggccugcaguucggccgcca

SEQ ID NO: 336837 - RNA, 12 nt, Bordetella pertussis
gcgggccugccg

SEQ ID NO: 336838 - RNA, 14 nt, Bordetella pertussis
gcgggccugccgcg

SEQ ID NO: 336839 - RNA, 14 nt, Bordetella pertussis
gcgggccuggcgga

SEQ ID NO: 336840 - RNA, 21 nt, Bordetella pertussis
gcgggccuggcggaucucggc

SEQ ID NO: 336841 - RNA, 23 nt, Bordetella pertussis
gcgggccuggcggaucucggcca

SEQ ID NO: 336842 - RNA, 20 nt, Bordetella pertussis
gcgggccugggcgucgagcg

SEQ ID NO: 336843 - RNA, 20 nt, Bordetella pertussis
gcgggccuuggccagcagcg

SEQ ID NO: 336844 - RNA, 21 nt, Bordetella pertussis
gcgggccuuggccagcagcgc

SEQ ID NO: 336845 - RNA, 15 nt, Bordetella pertussis
gcgggcgacauugcg

SEQ ID NO: 336846 - RNA, 20 nt, Bordetella pertussis
gcgggcgagaucagccaccg

SEQ ID NO: 336847 - RNA, 20 nt, Bordetella pertussis
gcgggcgauuucgucaucgg

SEQ ID NO: 336848 - RNA, 23 nt, Bordetella pertussis
gcgggcgcaaguguggcgcaccg

SEQ ID NO: 336849 - RNA, 12 nt, Bordetella pertussis
gcgggcgcaccu

SEQ ID NO: 336850 - RNA, 23 nt, Bordetella pertussis
gcgggcgcaccugguccauggcg

SEQ ID NO: 336851 - RNA, 15 nt, Bordetella pertussis
gcgggcgcagcgccg

SEQ ID NO: 336852 - RNA, 17 nt, Bordetella pertussis
gcgggcgcagcgccgcu

SEQ ID NO: 336853 - RNA, 15 nt, Bordetella pertussis
gcgggcgcccggccg

SEQ ID NO: 336854 - RNA, 19 nt, Bordetella pertussis
gcgggcgcccggccggccu

SEQ ID NO: 336855 - RNA, 14 nt, Bordetella pertussis
gcgggcgccgcgca

SEQ ID NO: 336856 - RNA, 15 nt, Bordetella pertussis
gcgggcgccgcgcac

SEQ ID NO: 336857 - RNA, 14 nt, Bordetella pertussis
gcgggcgccgcgcc

SEQ ID NO: 336858 - RNA, 17 nt, Bordetella pertussis
gcgggcgccgcgcccgg

SEQ ID NO: 336859 - RNA, 17 nt, Bordetella pertussis
gcgggcgccggcgcccg

SEQ ID NO: 336860 - RNA, 18 nt, Bordetella pertussis
gcgggcgccggcgcccgg

SEQ ID NO: 336861 - RNA, 15 nt, Bordetella pertussis
gcgggcgccaucgcg

SEQ ID NO: 336862 - RNA, 14 nt, Bordetella pertussis
gcgggcgcgcagcg

SEQ ID NO: 336863 - RNA, 12 nt, Bordetella pertussis
gcgggcgcgccc

SEQ ID NO: 336864 - RNA, 19 nt, Bordetella pertussis
gcgggcgcgccgucgcugg

SEQ ID NO: 336865 - RNA, 13 nt, Bordetella pertussis
gcgggcgcgcgcc

SEQ ID NO: 336866 - RNA, 24 nt, Bordetella pertussis
gcgggcgcggcauggcgccgcgcc

SEQ ID NO: 336867 - RNA, 21 nt, Bordetella pertussis
gcgggcgcgguauucgcugcu

SEQ ID NO: 336868 - RNA, 23 nt, Bordetella pertussis
gcgggcgcgguauucgcugcugg

SEQ ID NO: 336869 - RNA, 19 nt, Bordetella pertussis
gcgggcgcugcgcgaacgc

SEQ ID NO: 336870 - RNA, 19 nt, Bordetella pertussis
gcgggcgcuucgucggccg

SEQ ID NO: 336871 - RNA, 14 nt, Bordetella pertussis
gcgggcggccacgc

SEQ ID NO: 336872 - RNA, 20 nt, Bordetella pertussis
gcgggcggccacgcgccgcc

SEQ ID NO: 336873 - RNA, 16 nt, Bordetella pertussis
gcgggcggcgcgccca

SEQ ID NO: 336874 - RNA, 14 nt, Bordetella pertussis
gcgggcgggcgcaa

SEQ ID NO: 336875 - RNA, 16 nt, Bordetella pertussis
gcgggcggucggcgcg

SEQ ID NO: 336876 - RNA, 18 nt, Bordetella pertussis
gcgggcugaugcaggccu

SEQ ID NO: 336877 - RNA, 21 nt, Bordetella pertussis
gcgggcugaugcaggccugca

SEQ ID NO: 336878 - RNA, 12 nt, Bordetella pertussis
gcgggcuggcca

SEQ ID NO: 336879 - RNA, 14 nt, Bordetella pertussis
gcgggcuggggcag

SEQ ID NO: 336880 - RNA, 16 nt, Bordetella pertussis
gcgggcuggggcaggc

SEQ ID NO: 336881 - RNA, 15 nt, Bordetella pertussis
gcgggcuggccagcg

SEQ ID NO: 336882 - RNA, 12 nt, Bordetella pertussis
gcgggcuggcgu

SEQ ID NO: 336883 - RNA, 17 nt, Bordetella pertussis
gcggucaaugcggcggc

SEQ ID NO: 336884 - RNA, 21 nt, Bordetella pertussis
gcggucaauguauuuggcggc

SEQ ID NO: 336885 - RNA, 18 nt, Bordetella pertussis
gcggucacaucuguccug

SEQ ID NO: 336886 - RNA, 22 nt, Bordetella pertussis
gcggggacaggcacccaugaac

SEQ ID NO: 336887 - RNA, 23 nt, Bordetella pertussis
gcggggacaggcucccgcuggcg

SEQ ID NO: 336888 - RNA, 14 nt, Bordetella pertussis
gcggucacgccgau

SEQ ID NO: 336889 - RNA, 17 nt, Bordetella pertussis
gcggucagcuggaacgc

SEQ ID NO: 336890 - RNA, 23 nt, Bordetella pertussis
gcggucagcuggaacgcgccgcu

SEQ ID NO: 336891 - RNA, 15 nt, Bordetella pertussis
gcggucaucggcgac

SEQ ID NO: 336892 - RNA, 17 nt, Bordetella pertussis
gcggucaucggcgacga

SEQ ID NO: 336893 - RNA, 22 nt, Bordetella pertussis
gcgguccaccucgucguccagc

SEQ ID NO: 336894 - RNA, 21 nt, Bordetella pertussis
gcgguccacgcccuggcuggc

SEQ ID NO: 336895 - RNA, 22 nt, Bordetella pertussis
gcgguccgguucgcccaccacc

SEQ ID NO: 336896 - RNA, 19 nt, Bordetella pertussis
gcgguccggggcgggcgcg

SEQ ID NO: 336897 - RNA, 20 nt, Bordetella pertussis
gcgguccugaccggcggcgc

SEQ ID NO: 336898 - RNA, 21 nt, Bordetella pertussis
gcgguccugaccggcggcgcu

SEQ ID NO: 336899 - RNA, 23 nt, Bordetella pertussis
gcggucgacgaaauagccgacca

SEQ ID NO: 336900 - RNA, 13 nt, Bordetella pertussis
gcggucggccgcg

SEQ ID NO: 336901 - RNA, 14 nt, Bordetella pertussis
gcggucggccgcgc

SEQ ID NO: 336902 - RNA, 22 nt, Bordetella pertussis
gcggucggcgcggcgccgucca

SEQ ID NO: 336903 - RNA, 17 nt, Bordetella pertussis
gcggucgggaucauccu

SEQ ID NO: 336904 - RNA, 12 nt, Bordetella pertussis
gcggucggugca

SEQ ID NO: 336905 - RNA, 19 nt, Bordetella pertussis
gcggucuaccgaagccgag

SEQ ID NO: 336906 - RNA, 20 nt, Bordetella pertussis
gcggucuccgguucggcgcg

SEQ ID NO: 336907 - RNA, 21 nt, Bordetella pertussis
gcggucuccgguucggcgcgg

SEQ ID NO: 336908 - RNA, 20 nt, Bordetella pertussis
gcggugaggcggccgggcgu

SEQ ID NO: 336909 - RNA, 24 nt, Bordetella pertussis
gcggugaucugcucgccgcgcgac

SEQ ID NO: 336910 - RNA, 18 nt, Bordetella pertussis
gcggugaugacgucgucg

SEQ ID NO: 336911 - RNA, 17 nt, Bordetella pertussis
gcggugcaagcggccgg

SEQ ID NO: 336912 - RNA, 21 nt, Bordetella pertussis
gcggugcgacugcaggaugag

SEQ ID NO: 336913 - RNA, 15 nt, Bordetella pertussis
gcggugcgcgcggcc

SEQ ID NO: 336914 - RNA, 14 nt, Bordetella pertussis
gcggugcguccagg

SEQ ID NO: 336915 - RNA, 19 nt, Bordetella pertussis
gcggugcguccaggacgcg

SEQ ID NO: 336916 - RNA, 22 nt, Bordetella pertussis
gcggugcguccaggacgcgaag

SEQ ID NO: 336917 - RNA, 20 nt, Bordetella pertussis
gcggugcgggugggcgcgcc

SEQ ID NO: 336918 - RNA, 23 nt, Bordetella pertussis
gcggugcgggugggcgcgccgcg

SEQ ID NO: 336919 - RNA, 19 nt, Bordetella pertussis
gcggugcuugaugcccagc

SEQ ID NO: 336920 - RNA, 18 nt, Bordetella pertussis
gcgguggccucguccacg

SEQ ID NO: 336921 - RNA, 20 nt, Bordetella pertussis
gcgguggccgccgcgcgccg

SEQ ID NO: 336922 - RNA, 23 nt, Bordetella pertussis
gcgguggccgcgcaugccagcuu

SEQ ID NO: 336923 - RNA, 18 nt, Bordetella pertussis
gcgguguagaccaccagc

SEQ ID NO: 336924 - RNA, 19 nt, Bordetella pertussis
gcgguguagaccaccagca

SEQ ID NO: 336925 - RNA, 16 nt, Bordetella pertussis
gcgguugcgccagcuu

SEQ ID NO: 336926 - RNA, 17 nt, Bordetella pertussis
gcgguugcgccagcuug

SEQ ID NO: 336927 - RNA, 12 nt, Bordetella pertussis
gcguaagcccac

SEQ ID NO: 336928 - RNA, 20 nt, Bordetella pertussis
gcguacaacgccgcguccgc

SEQ ID NO: 336929 - RNA, 17 nt, Bordetella pertussis
gcguacagcagggugcc

SEQ ID NO: 336930 - RNA, 20 nt, Bordetella pertussis
gcguacagcagggugccugu

SEQ ID NO: 336931 - RNA, 12 nt, Bordetella pertussis
gcguacagccgg

SEQ ID NO: 336932 - RNA, 22 nt, Bordetella pertussis
gcguacagcccgaacagaaggc

SEQ ID NO: 336933 - RNA, 18 nt, Bordetella pertussis
gcguaccaggcagccggc

SEQ ID NO: 336934 - RNA, 19 nt, Bordetella pertussis
gcguaccaggcagccggcc

SEQ ID NO: 336935 - RNA, 20 nt, Bordetella pertussis
gcguacgauagcggaugaug

SEQ ID NO: 336936 - RNA, 20 nt, Bordetella pertussis
gcguacgacggggugccugu

SEQ ID NO: 336937 - RNA, 13 nt, Bordetella pertussis
gcguacgcugcug

SEQ ID NO: 336938 - RNA, 18 nt, Bordetella pertussis
gcguacgcuuaucgcggc

SEQ ID NO: 336939 - RNA, 17 nt, Bordetella pertussis
gcguacggcccuggucu

SEQ ID NO: 336940 - RNA, 14 nt, Bordetella pertussis
gcguacggcgcggu

SEQ ID NO: 336941 - RNA, 17 nt, Bordetella pertussis
gcguacguggcgcggcu

SEQ ID NO: 336942 - RNA, 17 nt, Bordetella pertussis
gcguacuggcgcggcgg

SEQ ID NO: 336943 - RNA, 19 nt, Bordetella pertussis
gcguacuggcgcggcggcc

SEQ ID NO: 336944 - RNA, 16 nt, Bordetella pertussis
gcguagauccaggcgg

SEQ ID NO: 336945 - RNA, 19 nt, Bordetella pertussis
gcguagauccaggcggcca

SEQ ID NO: 336946 - RNA, 21 nt, Bordetella pertussis
gcguagccggaaugcaccacg

SEQ ID NO: 336947 - RNA, 18 nt, Bordetella pertussis
gcguagccggugcgcagc

SEQ ID NO: 336948 - RNA, 13 nt, Bordetella pertussis
gcguagcucagcc

SEQ ID NO: 336949 - RNA, 13 nt, Bordetella pertussis
gcguaggccucgc

SEQ ID NO: 336950 - RNA, 17 nt, Bordetella pertussis
gcguaggcgcgcgcauc

SEQ ID NO: 336951 - RNA, 21 nt, Bordetella pertussis
gcguaggcgcgcgcaucggcc

SEQ ID NO: 336952 - RNA, 13 nt, Bordetella pertussis
gcguaggucaggc

SEQ ID NO: 336953 - RNA, 19 nt, Bordetella pertussis
gcguaggucaggcccacgc

SEQ ID NO: 336954 - RNA, 16 nt, Bordetella pertussis
gcguaguagcccaggc

SEQ ID NO: 336955 - RNA, 23 nt, Bordetella pertussis
gcguaguagcccaggcccacgcc

SEQ ID NO: 336956 - RNA, 17 nt, Bordetella pertussis
gcguaguugucggcgca

SEQ ID NO: 336957 - RNA, 19 nt, Bordetella pertussis
gcguaguugucggcgcaga

SEQ ID NO: 336958 - RNA, 19 nt, Bordetella pertussis
gcguagucguugccggcca

SEQ ID NO: 336959 - RNA, 16 nt, Bordetella pertussis
gcguauaggccacccc

SEQ ID NO: 336960 - RNA, 18 nt, Bordetella pertussis
gcguauccgccguugcuc

SEQ ID NO: 336961 - RNA, 18 nt, Bordetella pertussis
gcguaucgcccgcgcggu

SEQ ID NO: 336962 - RNA, 19 nt, Bordetella pertussis
gcguaucgccgccgccggc

SEQ ID NO: 336963 - RNA, 22 nt, Bordetella pertussis
gcguaucgggguucuguccggc

SEQ ID NO: 336964 - RNA, 20 nt, Bordetella pertussis
gcguaucugaucggacuggg

SEQ ID NO: 336965 - RNA, 23 nt, Bordetella pertussis
gcguaugacagggugccuguccc

SEQ ID NO: 336966 - RNA, 17 nt, Bordetella pertussis
gcguaugacgcgcugau

SEQ ID NO: 336967 - RNA, 23 nt, Bordetella pertussis
gcguaugcaccgggccgaacaug

SEQ ID NO: 336968 - RNA, 16 nt, Bordetella pertussis
gcguaugcccacuccc

SEQ ID NO: 336969 - RNA, 18 nt, Bordetella pertussis
gcguauuccggguccagc

SEQ ID NO: 336970 - RNA, 14 nt, Bordetella pertussis
gcguauggcggcgc

SEQ ID NO: 336971 - RNA, 19 nt, Bordetella pertussis
gcgucaacuacacgguggg

SEQ ID NO: 336972 - RNA, 14 nt, Bordetella pertussis
gcgucaagccagcg

SEQ ID NO: 336973 - RNA, 16 nt, Bordetella pertussis
gcgucaagccagcggc

SEQ ID NO: 336974 - RNA, 22 nt, Bordetella pertussis
gcgucaagccagcggcgcggcg

SEQ ID NO: 336975 - RNA, 17 nt, Bordetella pertussis
gcgucaauccgccgcca

SEQ ID NO: 336976 - RNA, 19 nt, Bordetella pertussis
gcgucaauccgccgccagc

SEQ ID NO: 336977 - RNA, 13 nt, Bordetella pertussis
gcgucaccagcag

SEQ ID NO: 336978 - RNA, 16 nt, Bordetella pertussis
gcgucaccagcaggcg

SEQ ID NO: 336979 - RNA, 14 nt, Bordetella pertussis
gcgucaccggcgag

SEQ ID NO: 336980 - RNA, 21 nt, Bordetella pertussis
gcgucacgaaagcgcccaggc

SEQ ID NO: 336981 - RNA, 22 nt, Bordetella pertussis
gcgucacgaaagcgcccaggcc

SEQ ID NO: 336982 - RNA, 19 nt, Bordetella pertussis
gcgucacgauuucggccau

SEQ ID NO: 336983 - RNA, 19 nt, Bordetella pertussis
gcgucacgcacagcaccug

SEQ ID NO: 336984 - RNA, 14 nt, Bordetella pertussis
gcgucacgcggccg

SEQ ID NO: 336985 - RNA, 17 nt, Bordetella pertussis
gcgucagcacaucgccc

SEQ ID NO: 336986 - RNA, 13 nt, Bordetella pertussis
gcgucaggagacg

SEQ ID NO: 336987 - RNA, 14 nt, Bordetella pertussis
gcgucaggccgggc

SEQ ID NO: 336988 - RNA, 14 nt, Bordetella pertussis
gcgucaggcgagcg

SEQ ID NO: 336989 - RNA, 20 nt, Bordetella pertussis
gcgucaggggcaugccggca

SEQ ID NO: 336990 - RNA, 21 nt, Bordetella pertussis
gcgucaguugggcgcgcccag

SEQ ID NO: 336991 - RNA, 17 nt, Bordetella pertussis
gcgucauacacggcgcg

SEQ ID NO: 336992 - RNA, 17 nt, Bordetella pertussis
gcgucaucggcgcgcag

SEQ ID NO: 336993 - RNA, 18 nt, Bordetella pertussis
gcgucauggccuggccca

SEQ ID NO: 336994 - RNA, 18 nt, Bordetella pertussis
gcgucaugugcugcggca

SEQ ID NO: 336995 - RNA, 15 nt, Bordetella pertussis
gcguccaccaccagg

SEQ ID NO: 336996 - RNA, 16 nt, Bordetella pertussis
gcguccaccaccaggc

SEQ ID NO: 336997 - RNA, 17 nt, Bordetella pertussis
gcguccaccaccaggcc

SEQ ID NO: 336998 - RNA, 22 nt, Bordetella pertussis
gcguccaccaccaggccggcca

SEQ ID NO: 336999 - RNA, 22 nt, Bordetella pertussis
gcguccaccgccgaugccgcca

SEQ ID NO: 337000 - RNA, 22 nt, Bordetella pertussis
gcguccagccccugcgggccgc

SEQ ID NO: 337001 - RNA, 23 nt, Bordetella pertussis
gcguccagccccugcgggccgcu

SEQ ID NO: 337002 - RNA, 19 nt, Bordetella pertussis
gcguccaggcgcgccagcc

SEQ ID NO: 337003 - RNA, 20 nt, Bordetella pertussis
gcguccaggcgcgccagccg

SEQ ID NO: 337004 - RNA, 12 nt, Bordetella pertussis
gcguccaggcgg

SEQ ID NO: 337005 - RNA, 16 nt, Bordetella pertussis
gcguccaggcggccau

SEQ ID NO: 337006 - RNA, 12 nt, Bordetella pertussis
gcguccaggcug

SEQ ID NO: 337007 - RNA, 14 nt, Bordetella pertussis
gcguccaggcugcc

SEQ ID NO: 337008 - RNA, 16 nt, Bordetella pertussis
gcguccaggcugccgg

SEQ ID NO: 337009 - RNA, 16 nt, Bordetella pertussis
gcguccaggcccagcg

SEQ ID NO: 337010 - RNA, 19 nt, Bordetella pertussis
gcguccaggcccagcgcgu

SEQ ID NO: 337011 - RNA, 18 nt, Bordetella pertussis
gcguccaggugcggcggc

SEQ ID NO: 337012 - RNA, 18 nt, Bordetella pertussis
gcguccauuagggcccag

SEQ ID NO: 337013 - RNA, 13 nt, Bordetella pertussis
gcgucccaggcca

SEQ ID NO: 337014 - RNA, 19 nt, Bordetella pertussis
gcgucccgguaggccuggu

SEQ ID NO: 337015 - RNA, 20 nt, Bordetella pertussis
gcgucccgguaggccugguc

SEQ ID NO: 337016 - RNA, 16 nt, Bordetella pertussis
gcgucccgugccggcc

SEQ ID NO: 337017 - RNA, 20 nt, Bordetella pertussis
gcguccgaauacgccacguu

SEQ ID NO: 337018 - RNA, 19 nt, Bordetella pertussis
gcgucgcccggggcggcgu

SEQ ID NO: 337019 - RNA, 21 nt, Bordetella pertussis
gcgucgcccuugauggccucg

SEQ ID NO: 337020 - RNA, 14 nt, Bordetella pertussis
gcgucgccgcuggc

SEQ ID NO: 337021 - RNA, 13 nt, Bordetella pertussis
gcgucgccggcca

SEQ ID NO: 337022 - RNA, 16 nt, Bordetella pertussis
gcgucgccggccaggc

SEQ ID NO: 337023 - RNA, 15 nt, Bordetella pertussis
gcgucgccgcgcacg

SEQ ID NO: 337024 - RNA, 16 nt, Bordetella pertussis
gcgucgccgcgcacga

SEQ ID NO: 337025 - RNA, 15 nt, Bordetella pertussis
gcgucgccgcgccgu

SEQ ID NO: 337026 - RNA, 16 nt, Bordetella pertussis
gcgucgccuggucgac

SEQ ID NO: 337027 - RNA, 22 nt, Bordetella pertussis
gcgucgccuggucgacgccggc

SEQ ID NO: 337028 - RNA, 14 nt, Bordetella pertussis
gcgucggacgcgcg

SEQ ID NO: 337029 - RNA, 18 nt, Bordetella pertussis
gcgucggacgcgcgccgc

SEQ ID NO: 337030 - RNA, 19 nt, Bordetella pertussis
gcgucggcaauaucgauca

SEQ ID NO: 337031 - RNA, 19 nt, Bordetella pertussis
gcgucgcgaugcgccaggc

SEQ ID NO: 337032 - RNA, 20 nt, Bordetella pertussis
gcgucggccaaggccggcgc

SEQ ID NO: 337033 - RNA, 14 nt, Bordetella pertussis
gcgucggccacguc

SEQ ID NO: 337034 - RNA, 19 nt, Bordetella pertussis
gcgucggccacgucgccca

SEQ ID NO: 337035 - RNA, 14 nt, Bordetella pertussis
gcgucggccagcgc

SEQ ID NO: 337036 - RNA, 13 nt, Bordetella pertussis
gcgucggccaggc

SEQ ID NO: 337037 - RNA, 15 nt, Bordetella pertussis
gcgucggccauggcg

SEQ ID NO: 337038 - RNA, 17 nt, Bordetella pertussis
gcgucggccauggcgcu

SEQ ID NO: 337039 - RNA, 16 nt, Bordetella pertussis
gcgucggccgcgccca

SEQ ID NO: 337040 - RNA, 13 nt, Bordetella pertussis
gcgucggccgcgu

SEQ ID NO: 337041 - RNA, 13 nt, Bordetella pertussis
gcgucggccagcg

SEQ ID NO: 337042 - RNA, 17 nt, Bordetella pertussis
gcgucggccugccagcc

SEQ ID NO: 337043 - RNA, 20 nt, Bordetella pertussis
gcgucgggucagccuugcuc

SEQ ID NO: 337044 - RNA, 17 nt, Bordetella pertussis
gcgucgggggcggccgg

SEQ ID NO: 337045 - RNA, 13 nt, Bordetella pertussis
gcgucgguggcca

SEQ ID NO: 337046 - RNA, 19 nt, Bordetella pertussis
gcgucgguggccagccagg

SEQ ID NO: 337047 - RNA, 20 nt, Bordetella pertussis
gcgucgguggccagccaggc

SEQ ID NO: 337048 - RNA, 22 nt, Bordetella pertussis
gcgucgguggccagccaggcgg

SEQ ID NO: 337049 - RNA, 13 nt, Bordetella pertussis
gcgucggugccgu

SEQ ID NO: 337050 - RNA, 12 nt, Bordetella pertussis
gcgucguagccc

SEQ ID NO: 337051 - RNA, 14 nt, Bordetella pertussis
gcgucguccagcgu

SEQ ID NO: 337052 - RNA, 24 nt, Bordetella pertussis
gcgucguccagcguggcgcagucg

SEQ ID NO: 337053 - RNA, 15 nt, Bordetella pertussis
gcgucguggggcgcg

SEQ ID NO: 337054 - RNA, 15 nt, Bordetella pertussis
gcgucguucaucgcc

SEQ ID NO: 337055 - RNA, 16 nt, Bordetella pertussis
gcgucguucaucgccc

SEQ ID NO: 337056 - RNA, 22 nt, Bordetella pertussis
gcgucguugcgccgaucgcggc

SEQ ID NO: 337057 - RNA, 23 nt, Bordetella pertussis
gcgucguugcgccgaucgcggcu

SEQ ID NO: 337058 - RNA, 20 nt, Bordetella pertussis
gcgucguuggccgcguagcc

SEQ ID NO: 337059 - RNA, 13 nt, Bordetella pertussis
gcgucuaccugga

SEQ ID NO: 337060 - RNA, 20 nt, Bordetella pertussis
gcgucuaccuggacgggcug

SEQ ID NO: 337061 - RNA, 15 nt, Bordetella pertussis
gcgucuggagcggcc

SEQ ID NO: 337062 - RNA, 15 nt, Bordetella pertussis
gcgucuucggcgcgg

SEQ ID NO: 337063 - RNA, 20 nt, Bordetella pertussis
gcgucuucggcgcggcgggc

SEQ ID NO: 337064 - RNA, 16 nt, Bordetella pertussis
gcgucuucgccgacca

SEQ ID NO: 337065 - RNA, 15 nt, Bordetella pertussis
gcgucuugagcaggu

SEQ ID NO: 337066 - RNA, 16 nt, Bordetella pertussis
gcgugaaaggccagcg

SEQ ID NO: 337067 - RNA, 19 nt, Bordetella pertussis
gcgugaaaggccagcggcg

SEQ ID NO: 337068 - RNA, 15 nt, Bordetella pertussis
gcgugaacgccccgg

SEQ ID NO: 337069 - RNA, 22 nt, Bordetella pertussis
gcgugaacuccugcaacuggug

SEQ ID NO: 337070 - RNA, 13 nt, Bordetella pertussis
gcgugaaggucgg

SEQ ID NO: 337071 - RNA, 14 nt, Bordetella pertussis
gcgugaaggucggc

SEQ ID NO: 337072 - RNA, 18 nt, Bordetella pertussis
gcgugaauaccgcgcaca

SEQ ID NO: 337073 - RNA, 20 nt, Bordetella pertussis
gcgugaauaccgcgcacagg

SEQ ID NO: 337074 - RNA, 14 nt, Bordetella pertussis
gcgugacacggcca

SEQ ID NO: 337075 - RNA, 19 nt, Bordetella pertussis
gcgugaccgcgacgcgccu

SEQ ID NO: 337076 - RNA, 20 nt, Bordetella pertussis
gcgugaccggacuguccacg

SEQ ID NO: 337077 - RNA, 21 nt, Bordetella pertussis
gcgugaccggacuguccacgc

SEQ ID NO: 337078 - RNA, 17 nt, Bordetella pertussis
gcgugaccacgaucaug

SEQ ID NO: 337079 - RNA, 13 nt, Bordetella pertussis
gcgugagcaggcg

SEQ ID NO: 337080 - RNA, 15 nt, Bordetella pertussis
gcgugagcgccaccg

SEQ ID NO: 337081 - RNA, 17 nt, Bordetella pertussis
gcgugagcgccucgagu

SEQ ID NO: 337082 - RNA, 18 nt, Bordetella pertussis
gcgugaugcccaggcccu

SEQ ID NO: 337083 - RNA, 18 nt, Bordetella pertussis
gcgugaugccgaccaggc

SEQ ID NO: 337084 - RNA, 17 nt, Bordetella pertussis
gcgugaugccgucgagc

SEQ ID NO: 337085 - RNA, 18 nt, Bordetella pertussis
gcgugaugccgucgagcg

SEQ ID NO: 337086 - RNA, 22 nt, Bordetella pertussis
gcgugaugccgucgagcgcggc

SEQ ID NO: 337087 - RNA, 19 nt, Bordetella pertussis
gcgugcccucgcugcgcgu

SEQ ID NO: 337088 - RNA, 20 nt, Bordetella pertussis
gcgugcccugcggcgcggcc

SEQ ID NO: 337089 - RNA, 21 nt, Bordetella pertussis
gcgugcccugcggcgcggcca

SEQ ID NO: 337090 - RNA, 15 nt, Bordetella pertussis
gcgugccgacgaugc

SEQ ID NO: 337091 - RNA, 13 nt, Bordetella pertussis
gcgugccgcagcg

SEQ ID NO: 337092 - RNA, 14 nt, Bordetella pertussis
gcgugccgcccagg

SEQ ID NO: 337093 - RNA, 13 nt, Bordetella pertussis
gcgugccgcgcag

SEQ ID NO: 337094 - RNA, 14 nt, Bordetella pertussis
gcgugccgcgcagg

SEQ ID NO: 337095 - RNA, 21 nt, Bordetella pertussis
gcgugccggagcccgucaggc

SEQ ID NO: 337096 - RNA, 21 nt, Bordetella pertussis
gcgugccgggaugcugcucgg

SEQ ID NO: 337097 - RNA, 14 nt, Bordetella pertussis
gcgugccggugacg

SEQ ID NO: 337098 - RNA, 13 nt, Bordetella pertussis
gcgugccuguccc

SEQ ID NO: 337099 - RNA, 15 nt, Bordetella pertussis
gcgugccuguccccg

SEQ ID NO: 337100 - RNA, 18 nt, Bordetella pertussis
gcgugcgcccauggcgcg

SEQ ID NO: 337101 - RNA, 22 nt, Bordetella pertussis
gcgugcgcccauggcgcgcagc

SEQ ID NO: 337102 - RNA, 15 nt, Bordetella pertussis
gcgugcgcaggcgcg

SEQ ID NO: 337103 - RNA, 13 nt, Bordetella pertussis
gcgugcgcggccg

SEQ ID NO: 337104 - RNA, 16 nt, Bordetella pertussis
gcgugcgcggccgcgc

SEQ ID NO: 337105 - RNA, 12 nt, Bordetella pertussis
gcgugcgcggcg

SEQ ID NO: 337106 - RNA, 16 nt, Bordetella pertussis
gcgugcgcgugcaugu

SEQ ID NO: 337107 - RNA, 15 nt, Bordetella pertussis
gcgugcgcuggcugg

SEQ ID NO: 337108 - RNA, 22 nt, Bordetella pertussis
gcgugcgcuggcugggccugcu

SEQ ID NO: 337109 - RNA, 15 nt, Bordetella pertussis
gcgugcggaccagcg

SEQ ID NO: 337110 - RNA, 16 nt, Bordetella pertussis
gcgugcggaccagcgg

SEQ ID NO: 337111 - RNA, 12 nt, Bordetella pertussis
gcgugcgcccau

SEQ ID NO: 337112 - RNA, 19 nt, Bordetella pertussis
gcgugcggaugcagcagcg

SEQ ID NO: 337113 - RNA, 15 nt, Bordetella pertussis
gcgugcggggcggca

SEQ ID NO: 337114 - RNA, 15 nt, Bordetella pertussis
gcgugcgggacaggc

SEQ ID NO: 337115 - RNA, 18 nt, Bordetella pertussis
gcgugcgggacggccagg

SEQ ID NO: 337116 - RNA, 16 nt, Bordetella pertussis
gcguggaagguccacg

SEQ ID NO: 337117 - RNA, 13 nt, Bordetella pertussis
gcguggagcugcu

SEQ ID NO: 337118 - RNA, 21 nt, Bordetella pertussis
gcguggagcugcucaccucga

SEQ ID NO: 337119 - RNA, 14 nt, Bordetella pertussis
gcguggccaccagg

SEQ ID NO: 337120 - RNA, 17 nt, Bordetella pertussis
gcguggccaccaggcgc

SEQ ID NO: 337121 - RNA, 19 nt, Bordetella pertussis
gcguggccaccaggcgcgc

SEQ ID NO: 337122 - RNA, 20 nt, Bordetella pertussis
gcguggccaccaggcgcgcg

SEQ ID NO: 337123 - RNA, 21 nt, Bordetella pertussis
gcguggccaccaggcgcgcgc

SEQ ID NO: 337124 - RNA, 22 nt, Bordetella pertussis
gcguggccaccaggcgcgcgcc

SEQ ID NO: 337125 - RNA, 14 nt, Bordetella pertussis
gcguggccagcacg

SEQ ID NO: 337126 - RNA, 21 nt, Bordetella pertussis
gcguggccagcacggcgcaca

SEQ ID NO: 337127 - RNA, 16 nt, Bordetella pertussis
gcgugucgaacaccag

SEQ ID NO: 337128 - RNA, 18 nt, Bordetella pertussis
gcgugucgaacaccaggu

SEQ ID NO: 337129 - RNA, 14 nt, Bordetella pertussis
gcgugucgccgacc

SEQ ID NO: 337130 - RNA, 17 nt, Bordetella pertussis
gcgugucgccgacccgg

SEQ ID NO: 337131 - RNA, 22 nt, Bordetella pertussis
gcgugugcaggacgaacaggcc

SEQ ID NO: 337132 - RNA, 23 nt, Bordetella pertussis
gcguguggugaaagccgccggcg

SEQ ID NO: 337133 - RNA, 17 nt, Bordetella pertussis
gcguguucagcgcgcgc

SEQ ID NO: 337134 - RNA, 19 nt, Bordetella pertussis
gcguguuccagcgccuggc

SEQ ID NO: 337135 - RNA, 19 nt, Bordetella pertussis
gcguucaagucgcccugcu

SEQ ID NO: 337136 - RNA, 18 nt, Bordetella pertussis
gcguucaaucgcgcuucu

SEQ ID NO: 337137 - RNA, 17 nt, Bordetella pertussis
gcguucgaaagccagcg

SEQ ID NO: 337138 - RNA, 20 nt, Bordetella pertussis
gcguucgaaagccagcgccu

SEQ ID NO: 337139 - RNA, 17 nt, Bordetella pertussis
gcguucgacgggcaggc

SEQ ID NO: 337140 - RNA, 19 nt, Bordetella pertussis
gcguucgacgggcaggccc

SEQ ID NO: 337141 - RNA, 16 nt, Bordetella pertussis
gcguucugcagcgcgg

SEQ ID NO: 337142 - RNA, 17 nt, Bordetella pertussis
gcguucuucagcgcgcu

SEQ ID NO: 337143 - RNA, 14 nt, Bordetella pertussis
gcguugaccggcug

SEQ ID NO: 337144 - RNA, 17 nt, Bordetella pertussis
gcguugaccggcuggcg

SEQ ID NO: 337145 - RNA, 13 nt, Bordetella pertussis
gcguugaccuggu

SEQ ID NO: 337146 - RNA, 20 nt, Bordetella pertussis
gcguugaccuggucgggcgu

SEQ ID NO: 337147 - RNA, 16 nt, Bordetella pertussis
gcguugacguggcuga

SEQ ID NO: 337148 - RNA, 15 nt, Bordetella pertussis
gcguugagcgccgac

SEQ ID NO: 337149 - RNA, 17 nt, Bordetella pertussis
gcguugagcgccgacgg

SEQ ID NO: 337150 - RNA, 12 nt, Bordetella pertussis
gcguugccggcc

SEQ ID NO: 337151 - RNA, 13 nt, Bordetella pertussis
gcguugccggccu

SEQ ID NO: 337152 - RNA, 17 nt, Bordetella pertussis
gcguugccggugcgcgu

SEQ ID NO: 337153 - RNA, 19 nt, Bordetella pertussis
gcguugcgcaucgcgcacc

SEQ ID NO: 337154 - RNA, 19 nt, Bordetella pertussis
gcguugcggcagcggccca

SEQ ID NO: 337155 - RNA, 13 nt, Bordetella pertussis
gcguuggcauggc

SEQ ID NO: 337156 - RNA, 14 nt, Bordetella pertussis
gcguuggcgcggcg

SEQ ID NO: 337157 - RNA, 17 nt, Bordetella pertussis
gcguuucggucagggcg

SEQ ID NO: 337158 - RNA, 17 nt, Bordetella pertussis
gcguuugcgcgcgcgcu

SEQ ID NO: 337159 - RNA, 15 nt, Bordetella pertussis
gcguuuucuggccuu

SEQ ID NO: 337160 - RNA, 15 nt, Bordetella pertussis
gcuaagcacaagcgc

SEQ ID NO: 337161 - RNA, 15 nt, Bordetella pertussis
gcuacaccgugcugg

SEQ ID NO: 337162 - RNA, 13 nt, Bordetella pertussis
gcuacagggugcc

SEQ ID NO: 337163 - RNA, 15 nt, Bordetella pertussis
gcuccauggcgccgg

SEQ ID NO: 337164 - RNA, 16 nt, Bordetella pertussis
gcuccauggcgccggc

SEQ ID NO: 337165 - RNA, 18 nt, Bordetella pertussis
gcucccacgaacgccacg

SEQ ID NO: 337166 - RNA, 19 nt, Bordetella pertussis
gcucccacgaacgccacgc

SEQ ID NO: 337167 - RNA, 23 nt, Bordetella pertussis
gcucccacgaacgccacgcccgu

SEQ ID NO: 337168 - RNA, 22 nt, Bordetella pertussis
gcucccaggaaaucaggcgcau

SEQ ID NO: 337169 - RNA, 20 nt, Bordetella pertussis
gcucccaguucugcagcgug

SEQ ID NO: 337170 - RNA, 21 nt, Bordetella pertussis
gcucccaguucugcagcgugc

SEQ ID NO: 337171 - RNA, 18 nt, Bordetella pertussis
gcucccgagggaucagcc

SEQ ID NO: 337172 - RNA, 17 nt, Bordetella pertussis
gcucccgcuggcggcac

SEQ ID NO: 337173 - RNA, 21 nt, Bordetella pertussis
gcuccgagggacaccgcaggu

SEQ ID NO: 337174 - RNA, 18 nt, Bordetella pertussis
gcuccgauagcggcgccg

SEQ ID NO: 337175 - RNA, 12 nt, Bordetella pertussis
gcuccgccaugg

SEQ ID NO: 337176 - RNA, 22 nt, Bordetella pertussis
gcuccgccauggaggcgcagcg

SEQ ID NO: 337177 - RNA, 13 nt, Bordetella pertussis
gcuccgccauugc

SEQ ID NO: 337178 - RNA, 15 nt, Bordetella pertussis
gcuccgccauugcgc

SEQ ID NO: 337179 - RNA, 19 nt, Bordetella pertussis
gcuccgccauugcgccguu

SEQ ID NO: 337180 - RNA, 18 nt, Bordetella pertussis
gcuccggcggcagcgcga

SEQ ID NO: 337181 - RNA, 20 nt, Bordetella pertussis
gcuccggcggcagcgcgaac

SEQ ID NO: 337182 - RNA, 22 nt, Bordetella pertussis
gcuccggcgugauggacgccgg

SEQ ID NO: 337183 - RNA, 23 nt, Bordetella pertussis
gcuccggcgugauggacgccggg

SEQ ID NO: 337184 - RNA, 20 nt, Bordetella pertussis
gcuccuccccaacggggacg

SEQ ID NO: 337185 - RNA, 19 nt, Bordetella pertussis
gcuccucgcccgaccugcu

SEQ ID NO: 337186 - RNA, 13 nt, Bordetella pertussis
gcuccucgcgcgc

SEQ ID NO: 337187 - RNA, 17 nt, Bordetella pertussis
gcuccucgaccuggguc

SEQ ID NO: 337188 - RNA, 15 nt, Bordetella pertussis
gcuccugccaggcgc

SEQ ID NO: 337189 - RNA, 19 nt, Bordetella pertussis
gcuccugccaggcgccgcg

SEQ ID NO: 337190 - RNA, 22 nt, Bordetella pertussis
gcuccugccaggcgccgcgucc

SEQ ID NO: 337191 - RNA, 17 nt, Bordetella pertussis
gcuccugcucgauccgg

SEQ ID NO: 337192 - RNA, 22 nt, Bordetella pertussis
gcuccugugggggcgcggcggc

SEQ ID NO: 337193 - RNA, 21 nt, Bordetella pertussis
gcucgaacaggcuggcaugga

SEQ ID NO: 337194 - RNA, 15 nt, Bordetella pertussis
gcucgaaggcgccga

SEQ ID NO: 337195 - RNA, 16 nt, Bordetella pertussis
gcucgaaguacagcuu

SEQ ID NO: 337196 - RNA, 21 nt, Bordetella pertussis
gcucgacagcagcccgcuggc

SEQ ID NO: 337197 - RNA, 17 nt, Bordetella pertussis
gcucgaccacggcggcu

SEQ ID NO: 337198 - RNA, 18 nt, Bordetella pertussis
gcucgaccacggcggcuu

SEQ ID NO: 337199 - RNA, 12 nt, Bordetella pertussis
gcucgaccgccg

SEQ ID NO: 337200 - RNA, 15 nt, Bordetella pertussis
gcucgaccgccgcca

SEQ ID NO: 337201 - RNA, 18 nt, Bordetella pertussis
gcucgaccgccgccacgc

SEQ ID NO: 337202 - RNA, 22 nt, Bordetella pertussis
gcucgaccgccgccacgcgcac

SEQ ID NO: 337203 - RNA, 23 nt, Bordetella pertussis
gcucgaccgccgccacgcgcacg

SEQ ID NO: 337204 - RNA, 16 nt, Bordetella pertussis
gcucgaccaucauggc

SEQ ID NO: 337205 - RNA, 21 nt, Bordetella pertussis
gcucgaccgucagcaugccgu

SEQ ID NO: 337206 - RNA, 13 nt, Bordetella pertussis
gcucgacgccgua

SEQ ID NO: 337207 - RNA, 13 nt, Bordetella pertussis
gcucgacgcgcug

SEQ ID NO: 337208 - RNA, 17 nt, Bordetella pertussis
gcucgacuucgucgggc

SEQ ID NO: 337209 - RNA, 21 nt, Bordetella pertussis
gcucgagcaugcgggccaugu

SEQ ID NO: 337210 - RNA, 19 nt, Bordetella pertussis
gcucgagcgccugcagcgu

SEQ ID NO: 337211 - RNA, 14 nt, Bordetella pertussis
gcucgagcgcggcg

SEQ ID NO: 337212 - RNA, 13 nt, Bordetella pertussis
gcucgagcggcgg

SEQ ID NO: 337213 - RNA, 16 nt, Bordetella pertussis
gcucgagcuggcuggc

SEQ ID NO: 337214 - RNA, 21 nt, Bordetella pertussis
gcucgagcuggcuggccagcg

SEQ ID NO: 337215 - RNA, 18 nt, Bordetella pertussis
gcucgaggaaccagccgu

SEQ ID NO: 337216 - RNA, 16 nt, Bordetella pertussis
gcucgaggcgcuggcg

SEQ ID NO: 337217 - RNA, 22 nt, Bordetella pertussis
gcucgaggcgcuggcguccagc

SEQ ID NO: 337218 - RNA, 15 nt, Bordetella pertussis
gcucgagguaggcgg

SEQ ID NO: 337219 - RNA, 23 nt, Bordetella pertussis
gcucgagguaggcgggacuggcg

SEQ ID NO: 337220 - RNA, 18 nt, Bordetella pertussis
gcucgauaugcagcaccg

SEQ ID NO: 337221 - RNA, 18 nt, Bordetella pertussis
gcucgaucaagggguggc

SEQ ID NO: 337222 - RNA, 16 nt, Bordetella pertussis
gcucgaucggauagcg

SEQ ID NO: 337223 - RNA, 15 nt, Bordetella pertussis
gcucgaugccggccu

SEQ ID NO: 337224 - RNA, 17 nt, Bordetella pertussis
gcucgaugccggccucg

SEQ ID NO: 337225 - RNA, 12 nt, Bordetella pertussis
gcucgaugcgcc

SEQ ID NO: 337226 - RNA, 15 nt, Bordetella pertussis
gcucgauggcuucgc

SEQ ID NO: 337227 - RNA, 19 nt, Bordetella pertussis
gcucgauggcuucgcgcac

SEQ ID NO: 337228 - RNA, 15 nt, Bordetella pertussis
gcucgcaggccugcu

SEQ ID NO: 337229 - RNA, 16 nt, Bordetella pertussis
gcucgcaggccugcug

SEQ ID NO: 337230 - RNA, 19 nt, Bordetella pertussis
gcucgcccacauagcggcc

SEQ ID NO: 337231 - RNA, 13 nt, Bordetella pertussis
gcucgcccagcac

SEQ ID NO: 337232 - RNA, 14 nt, Bordetella pertussis
gcucgcccagccgc

SEQ ID NO: 337233 - RNA, 21 nt, Bordetella pertussis
gcucgcccccgcgccgcgcag

SEQ ID NO: 337234 - RNA, 13 nt, Bordetella pertussis
gcucgccccggcg

SEQ ID NO: 337235 - RNA, 17 nt, Bordetella pertussis
gcucgccccggcgcgca

SEQ ID NO: 337236 - RNA, 19 nt, Bordetella pertussis
gcucgcccucgcgccacca

SEQ ID NO: 337237 - RNA, 21 nt, Bordetella pertussis
gcucgcccucgcgccaccaug

SEQ ID NO: 337238 - RNA, 17 nt, Bordetella pertussis
gcucgcccuugagcacg

SEQ ID NO: 337239 - RNA, 19 nt, Bordetella pertussis
gcucgcccuugagcacggc

SEQ ID NO: 337240 - RNA, 23 nt, Bordetella pertussis
gcucgcccuugagcacggcgcgg

SEQ ID NO: 337241 - RNA, 16 nt, Bordetella pertussis
gcucgccgagccgggc

SEQ ID NO: 337242 - RNA, 19 nt, Bordetella pertussis
gcucgccgagccgggccau

SEQ ID NO: 337243 - RNA, 23 nt, Bordetella pertussis
gcucgccgagccgggccaugcgg

SEQ ID NO: 337244 - RNA, 14 nt, Bordetella pertussis
gcucgccgcgcacg

SEQ ID NO: 337245 - RNA, 17 nt, Bordetella pertussis
gcucgccgcgcacgggc

SEQ ID NO: 337246 - RNA, 18 nt, Bordetella pertussis
gcucgccgcgcgacagcc

SEQ ID NO: 337247 - RNA, 20 nt, Bordetella pertussis
gcucgccgcgcgacagccgc

SEQ ID NO: 337248 - RNA, 16 nt, Bordetella pertussis
gcucgccgcuccggca

SEQ ID NO: 337249 - RNA, 18 nt, Bordetella pertussis
gcucgccgcuccggcaug

SEQ ID NO: 337250 - RNA, 13 nt, Bordetella pertussis
gcucgccggccag

SEQ ID NO: 337251 - RNA, 15 nt, Bordetella pertussis
gcucgccggccagcg

SEQ ID NO: 337252 - RNA, 18 nt, Bordetella pertussis
gcucgccggccagcgcgg

SEQ ID NO: 337253 - RNA, 22 nt, Bordetella pertussis
gcucgccggccgcgcccagcgu

SEQ ID NO: 337254 - RNA, 14 nt, Bordetella pertussis
gcucgccggcgaug

SEQ ID NO: 337255 - RNA, 14 nt, Bordetella pertussis
gcucgccggcgccg

SEQ ID NO: 337256 - RNA, 15 nt, Bordetella pertussis
gcucgccggcgccgc

SEQ ID NO: 337257 - RNA, 18 nt, Bordetella pertussis
gcucgccggcgccgcccc

SEQ ID NO: 337258 - RNA, 18 nt, Bordetella pertussis
gcucgccggcgcgcaggc

SEQ ID NO: 337259 - RNA, 16 nt, Bordetella pertussis
gcucgccuccccaggc

SEQ ID NO: 337260 - RNA, 19 nt, Bordetella pertussis
gcucgccuccccaggccag

SEQ ID NO: 337261 - RNA, 18 nt, Bordetella pertussis
gcucgccuucgcgaucca

SEQ ID NO: 337262 - RNA, 14 nt, Bordetella pertussis
gcucgcgcacagcg

SEQ ID NO: 337263 - RNA, 18 nt, Bordetella pertussis
gcucgcgcacagcgcgca

SEQ ID NO: 337264 - RNA, 16 nt, Bordetella pertussis
gcucgcgcagcaggcc

SEQ ID NO: 337265 - RNA, 17 nt, Bordetella pertussis
gcucgcgcagcaggccg

SEQ ID NO: 337266 - RNA, 21 nt, Bordetella pertussis
gcucgcgcagcguggcggcga

SEQ ID NO: 337267 - RNA, 20 nt, Bordetella pertussis
gcucgcgcaugcagcgagcg

SEQ ID NO: 337268 - RNA, 23 nt, Bordetella pertussis
gcucgcgcccaucucggccgcgg

SEQ ID NO: 337269 - RNA, 18 nt, Bordetella pertussis
gcucgcgcccgagcgcca

SEQ ID NO: 337270 - RNA, 23 nt, Bordetella pertussis
gcucgcgccaggccccgccgggc

SEQ ID NO: 337271 - RNA, 14 nt, Bordetella pertussis
gcucgcgcgccagc

SEQ ID NO: 337272 - RNA, 17 nt, Bordetella pertussis
gcucgcgcgccagcagu

SEQ ID NO: 337273 - RNA, 19 nt, Bordetella pertussis
gcucgcgcgcgcgggcgcg

SEQ ID NO: 337274 - RNA, 23 nt, Bordetella pertussis
gcucgcgcgcgcgggcgcgcagc

SEQ ID NO: 337275 - RNA, 23 nt, Bordetella pertussis
gcucgcgcgcgugcucgcgcaac

SEQ ID NO: 337276 - RNA, 17 nt, Bordetella pertussis
gcucgcgcucgcccggc

SEQ ID NO: 337277 - RNA, 18 nt, Bordetella pertussis
gcucgcgcucggccagca

SEQ ID NO: 337278 - RNA, 17 nt, Bordetella pertussis
gcucgcgcugcgcgccg

SEQ ID NO: 337279 - RNA, 23 nt, Bordetella pertussis
gcucgcgcugcgcgccgccgcgc

SEQ ID NO: 337280 - RNA, 15 nt, Bordetella pertussis
gcucgcggcccuggu

SEQ ID NO: 337281 - RNA, 16 nt, Bordetella pertussis
gcucgcgggugcgcag

SEQ ID NO: 337282 - RNA, 17 nt, Bordetella pertussis
gcucgcgucuaucagga

SEQ ID NO: 337283 - RNA, 23 nt, Bordetella pertussis
gcucgcguugcaccgcgucggcc

SEQ ID NO: 337284 - RNA, 17 nt, Bordetella pertussis
gcucgcugaccggcgua

SEQ ID NO: 337285 - RNA, 14 nt, Bordetella pertussis
gcucgcugccggcg

SEQ ID NO: 337286 - RNA, 15 nt, Bordetella pertussis
gcucgcugccggcgu

SEQ ID NO: 337287 - RNA, 16 nt, Bordetella pertussis
gcucggccacgcgcug

SEQ ID NO: 337288 - RNA, 18 nt, Bordetella pertussis
gcucggccacgcgcugcu

SEQ ID NO: 337289 - RNA, 14 nt, Bordetella pertussis
gcucggaccuggcc

SEQ ID NO: 337290 - RNA, 18 nt, Bordetella pertussis
gcucggaccuggccagcg

SEQ ID NO: 337291 - RNA, 13 nt, Bordetella pertussis
gcucggccagcag

SEQ ID NO: 337292 - RNA, 14 nt, Bordetella pertussis
gcucggccagcagu

SEQ ID NO: 337293 - RNA, 14 nt, Bordetella pertussis
gcucggccagcaug

SEQ ID NO: 337294 - RNA, 15 nt, Bordetella pertussis
gcucggccagcaugc

SEQ ID NO: 337295 - RNA, 13 nt, Bordetella pertussis
gcucggccagcgc

SEQ ID NO: 337296 - RNA, 17 nt, Bordetella pertussis
gcucggccagcgcgcgc

SEQ ID NO: 337297 - RNA, 12 nt, Bordetella pertussis
gcucggccaggu

SEQ ID NO: 337298 - RNA, 13 nt, Bordetella pertussis
gcucggccaggug

SEQ ID NO: 337299 - RNA, 14 nt, Bordetella pertussis
gcucggccaggugc

SEQ ID NO: 337300 - RNA, 20 nt, Bordetella pertussis
gcucggccaggugcgccaug

SEQ ID NO: 337301 - RNA, 22 nt, Bordetella pertussis
gcucggccaggugcgccaugcg

SEQ ID NO: 337302 - RNA, 13 nt, Bordetella pertussis
gcucggcccauug

SEQ ID NO: 337303 - RNA, 17 nt, Bordetella pertussis
gcucggcgaugcgccau

SEQ ID NO: 337304 - RNA, 18 nt, Bordetella pertussis
gcucggcgaugcgccaua

SEQ ID NO: 337305 - RNA, 16 nt, Bordetella pertussis
gcucggcgaugcgcga

SEQ ID NO: 337306 - RNA, 19 nt, Bordetella pertussis
gcucggcgaugcgcgagcg

SEQ ID NO: 337307 - RNA, 17 nt, Bordetella pertussis
gcucggcgccggcggcg

SEQ ID NO: 337308 - RNA, 18 nt, Bordetella pertussis
gcucggcgccggcggcgc

SEQ ID NO: 337309 - RNA, 14 nt, Bordetella pertussis
gcucggcgccgggc

SEQ ID NO: 337310 - RNA, 20 nt, Bordetella pertussis
gcucgucgggggggaugucg

SEQ ID NO: 337311 - RNA, 20 nt, Bordetella pertussis
gcucgucgggguggaugucg

SEQ ID NO: 337312 - RNA, 21 nt, Bordetella pertussis
gcucgugguggguuggccuug

SEQ ID NO: 337313 - RNA, 17 nt, Bordetella pertussis
gcucguguagggccugg

SEQ ID NO: 337314 - RNA, 15 nt, Bordetella pertussis
gcucguucugcgcgc

SEQ ID NO: 337315 - RNA, 22 nt, Bordetella pertussis
gcucguugaccugcuggggguu

SEQ ID NO: 337316 - RNA, 17 nt, Bordetella pertussis
gcucuacacggccgcca

SEQ ID NO: 337317 - RNA, 17 nt, Bordetella pertussis
gcucuaccaacccugcc

SEQ ID NO: 337318 - RNA, 21 nt, Bordetella pertussis
gcucucgaagaagcagccgcg

SEQ ID NO: 337319 - RNA, 13 nt, Bordetella pertussis
gcugaaugccgcc

SEQ ID NO: 337320 - RNA, 14 nt, Bordetella pertussis
gcugaaugccgccg

SEQ ID NO: 337321 - RNA, 17 nt, Bordetella pertussis
gcugaauugcgggccgg

SEQ ID NO: 337322 - RNA, 15 nt, Bordetella pertussis
gcugaauuggcgccc

SEQ ID NO: 337323 - RNA, 23 nt, Bordetella pertussis
gcugacaccguuuuggcaggcug

SEQ ID NO: 337324 - RNA, 22 nt, Bordetella pertussis
gcugaccaccgucuugcccgcc

SEQ ID NO: 337325 - RNA, 12 nt, Bordetella pertussis
gcugaccagcac

SEQ ID NO: 337326 - RNA, 18 nt, Bordetella pertussis
gcugaccagcacgauggu

SEQ ID NO: 337327 - RNA, 18 nt, Bordetella pertussis
gcugaccagcgcgucgca

SEQ ID NO: 337328 - RNA, 16 nt, Bordetella pertussis
gcugaccgacggccug

SEQ ID NO: 337329 - RNA, 16 nt, Bordetella pertussis
gcugaccgagggcgcg

SEQ ID NO: 337330 - RNA, 14 nt, Bordetella pertussis
gcugaccgaagcgg

SEQ ID NO: 337331 - RNA, 14 nt, Bordetella pertussis
gcugaccggcggca

SEQ ID NO: 337332 - RNA, 23 nt, Bordetella pertussis
gcugaccggcguauggcccgcca

SEQ ID NO: 337333 - RNA, 23 nt, Bordetella pertussis
gcugaccggcuucccguggcuga

SEQ ID NO: 337334 - RNA, 18 nt, Bordetella pertussis
gcugaccucgcccaggcc

SEQ ID NO: 337335 - RNA, 19 nt, Bordetella pertussis
gcugaccucgcccaggccg

SEQ ID NO: 337336 - RNA, 22 nt, Bordetella pertussis
gcugaccugcacgauggcgccg

SEQ ID NO: 337337 - RNA, 21 nt, Bordetella pertussis
gcugacuuccggggagccugc

SEQ ID NO: 337338 - RNA, 17 nt, Bordetella pertussis
gcugagaucguccagcg

SEQ ID NO: 337339 - RNA, 19 nt, Bordetella pertussis
gcugagaucguccagcgac

SEQ ID NO: 337340 - RNA, 14 nt, Bordetella pertussis
gcugagcaccagca

SEQ ID NO: 337341 - RNA, 15 nt, Bordetella pertussis
gcugagcaccagcag

SEQ ID NO: 337342 - RNA, 14 nt, Bordetella pertussis
gcugagcaggccga

SEQ ID NO: 337343 - RNA, 14 nt, Bordetella pertussis
gcugaugcaggccu

SEQ ID NO: 337344 - RNA, 15 nt, Bordetella pertussis
gcugaugcaggccug

SEQ ID NO: 337345 - RNA, 14 nt, Bordetella pertussis
gcugaugcccagcc

SEQ ID NO: 337346 - RNA, 12 nt, Bordetella pertussis
gcugaugcgcgg

SEQ ID NO: 337347 - RNA, 18 nt, Bordetella pertussis
gcugaugcgcgucaggcg

SEQ ID NO: 337348 - RNA, 23 nt, Bordetella pertussis
gcugauggccgccagcggcuggc

SEQ ID NO: 337349 - RNA, 17 nt, Bordetella pertussis
gcugcaagacgcccagg

SEQ ID NO: 337350 - RNA, 18 nt, Bordetella pertussis
gcugcaagacgcccaggc

SEQ ID NO: 337351 - RNA, 20 nt, Bordetella pertussis
gcugcaagacgcccaggccc

SEQ ID NO: 337352 - RNA, 22 nt, Bordetella pertussis
gcugcaaggacaccaugauggc

SEQ ID NO: 337353 - RNA, 20 nt, Bordetella pertussis
gcugcaauugcgcggccaug

SEQ ID NO: 337354 - RNA, 13 nt, Bordetella pertussis
gcugcaccagcgc

SEQ ID NO: 337355 - RNA, 15 nt, Bordetella pertussis
gcugcaccagcgcgc

SEQ ID NO: 337356 - RNA, 16 nt, Bordetella pertussis
gcugcaccagcgcgcc

SEQ ID NO: 337357 - RNA, 23 nt, Bordetella pertussis
gcugcacccacacuuggccggcg

SEQ ID NO: 337358 - RNA, 20 nt, Bordetella pertussis
gcugcagccaguugggccag

SEQ ID NO: 337359 - RNA, 14 nt, Bordetella pertussis
gcugcagcgcacca

SEQ ID NO: 337360 - RNA, 17 nt, Bordetella pertussis
gcugcagcgcaggaugg

SEQ ID NO: 337361 - RNA, 18 nt, Bordetella pertussis
gcugcagcgcaggauggg

SEQ ID NO: 337362 - RNA, 15 nt, Bordetella pertussis
gcugcagcgcugguu

SEQ ID NO: 337363 - RNA, 18 nt, Bordetella pertussis
gcugcagcgucuggcacg

SEQ ID NO: 337364 - RNA, 23 nt, Bordetella pertussis
gcugccagggugcaccagguggu

SEQ ID NO: 337365 - RNA, 15 nt, Bordetella pertussis
gcugccaugccgcgc

SEQ ID NO: 337366 - RNA, 17 nt, Bordetella pertussis
gcugccaugccgcgcgc

SEQ ID NO: 337367 - RNA, 19 nt, Bordetella pertussis
gcugccaugccgcgcgccu

SEQ ID NO: 337368 - RNA, 18 nt, Bordetella pertussis
gcugcccaccgccguggc

SEQ ID NO: 337369 - RNA, 23 nt, Bordetella pertussis
gcugcccaccgccguggccggca

SEQ ID NO: 337370 - RNA, 19 nt, Bordetella pertussis
gcugcccaccuugcgcgcg

SEQ ID NO: 337371 - RNA, 14 nt, Bordetella pertussis
gcugcccagcaugg

SEQ ID NO: 337372 - RNA, 19 nt, Bordetella pertussis
gcugcccagccacaccagg

SEQ ID NO: 337373 - RNA, 20 nt, Bordetella pertussis
gcugcccagccacaccaggu

SEQ ID NO: 337374 - RNA, 15 nt, Bordetella pertussis
gcugccgccggcgau

SEQ ID NO: 337375 - RNA, 15 nt, Bordetella pertussis
gcugccggcgcccuu

SEQ ID NO: 337376 - RNA, 14 nt, Bordetella pertussis
gcugccgggcauga

SEQ ID NO: 337377 - RNA, 17 nt, Bordetella pertussis
gcugccgggcucggcca

SEQ ID NO: 337378 - RNA, 18 nt, Bordetella pertussis
gcugccgggcucggccac

SEQ ID NO: 337379 - RNA, 18 nt, Bordetella pertussis
gcugccguagcccagguc

SEQ ID NO: 337380 - RNA, 20 nt, Bordetella pertussis
gcugccguagcccaggucca

SEQ ID NO: 337381 - RNA, 13 nt, Bordetella pertussis
gcugccgucgcca

SEQ ID NO: 337382 - RNA, 23 nt, Bordetella pertussis
gcugccgucgccaaagcgcagcg

SEQ ID NO: 337383 - RNA, 18 nt, Bordetella pertussis
gcugccgugaggcagccu

SEQ ID NO: 337384 - RNA, 12 nt, Bordetella pertussis
gcugccguggua

SEQ ID NO: 337385 - RNA, 22 nt, Bordetella pertussis
gcugccguccuugugccaggug

SEQ ID NO: 337386 - RNA, 17 nt, Bordetella pertussis
gcugccgucggccagcu

SEQ ID NO: 337387 - RNA, 16 nt, Bordetella pertussis
gcugccgucgucgucc

SEQ ID NO: 337388 - RNA, 20 nt, Bordetella pertussis
gcugccugagcaccgccgcg

SEQ ID NO: 337389 - RNA, 18 nt, Bordetella pertussis
gcugcgaaaaagcccgcg

SEQ ID NO: 337390 - RNA, 21 nt, Bordetella pertussis
gcugcgaaaaagcccgcgcca

SEQ ID NO: 337391 - RNA, 16 nt, Bordetella pertussis
gcugcgaaacagcagc

SEQ ID NO: 337392 - RNA, 15 nt, Bordetella pertussis
gcugcgaaagcgcgu

SEQ ID NO: 337393 - RNA, 17 nt, Bordetella pertussis
gcugcgaaagcgcgucg

SEQ ID NO: 337394 - RNA, 16 nt, Bordetella pertussis
gcugcgacaggcgcag

SEQ ID NO: 337395 - RNA, 22 nt, Bordetella pertussis
gcugcgacaggcgcagcucgac

SEQ ID NO: 337396 - RNA, 15 nt, Bordetella pertussis
gcugcgagacgcgcu

SEQ ID NO: 337397 - RNA, 18 nt, Bordetella pertussis
gcugcgagacgcgcucgc

SEQ ID NO: 337398 - RNA, 21 nt, Bordetella pertussis
gcugcgagacgcgcucgcgcg

SEQ ID NO: 337399 - RNA, 22 nt, Bordetella pertussis
gcugcgagacgcgcucgcgcgc

SEQ ID NO: 337400 - RNA, 14 nt, Bordetella pertussis
gcugcgaugcgggc

SEQ ID NO: 337401 - RNA, 14 nt, Bordetella pertussis
gcugcgcagcagcg

SEQ ID NO: 337402 - RNA, 15 nt, Bordetella pertussis
gcugcgcagcagcgc

SEQ ID NO: 337403 - RNA, 18 nt, Bordetella pertussis
gcugcgcagcagcgcggu

SEQ ID NO: 337404 - RNA, 19 nt, Bordetella pertussis
gcugcgcagcagggcggcg

SEQ ID NO: 337405 - RNA, 23 nt, Bordetella pertussis
gcugcgcagcgacucgaacaccg

SEQ ID NO: 337406 - RNA, 13 nt, Bordetella pertussis
gcugcgcaggcgc

SEQ ID NO: 337407 - RNA, 15 nt, Bordetella pertussis
gcugcgcaggcgcgc

SEQ ID NO: 337408 - RNA, 18 nt, Bordetella pertussis
gcugcgccaacggugcca

SEQ ID NO: 337409 - RNA, 21 nt, Bordetella pertussis
gcugcgcccgcuacgcgggcu

SEQ ID NO: 337410 - RNA, 21 nt, Bordetella pertussis
gcugcgcccgcuaugcgggcu

SEQ ID NO: 337411 - RNA, 16 nt, Bordetella pertussis
gcugcgccgcggcgcu

SEQ ID NO: 337412 - RNA, 18 nt, Bordetella pertussis
gcugcgccggcggcaccg

SEQ ID NO: 337413 - RNA, 14 nt, Bordetella pertussis
gcugcgccuggccg

SEQ ID NO: 337414 - RNA, 22 nt, Bordetella pertussis
gcugcgccuggccgcgcugauc

SEQ ID NO: 337415 - RNA, 13 nt, Bordetella pertussis
gcugcgccuggcg

SEQ ID NO: 337416 - RNA, 14 nt, Bordetella pertussis
gcugcgccuggcgg

SEQ ID NO: 337417 - RNA, 19 nt, Bordetella pertussis
gcugcgccuuggcgcgcag

SEQ ID NO: 337418 - RNA, 18 nt, Bordetella pertussis
gcugcgcgaacgcggcca

SEQ ID NO: 337419 - RNA, 18 nt, Bordetella pertussis
gcugcgcgccgccgcgcu

SEQ ID NO: 337420 - RNA, 14 nt, Bordetella pertussis
gcugcgcgccggcg

SEQ ID NO: 337421 - RNA, 17 nt, Bordetella pertussis
gcugcgcgccggcgccu

SEQ ID NO: 337422 - RNA, 14 nt, Bordetella pertussis
gcugcgcgccuggc

SEQ ID NO: 337423 - RNA, 13 nt, Bordetella pertussis
gcugcgcgcgcag

SEQ ID NO: 337424 - RNA, 18 nt, Bordetella pertussis
gcugcgcgcgccagcgcc

SEQ ID NO: 337425 - RNA, 21 nt, Bordetella pertussis
gcugcgcgccguggugcugac

SEQ ID NO: 337426 - RNA, 13 nt, Bordetella pertussis
gcugcgcgcggcc

SEQ ID NO: 337427 - RNA, 21 nt, Bordetella pertussis
gcugcgcggccgagcgggcca

SEQ ID NO: 337428 - RNA, 20 nt, Bordetella pertussis
gcugcgcgucgacagcauga

SEQ ID NO: 337429 - RNA, 14 nt, Bordetella pertussis
gcugcgcgucggca

SEQ ID NO: 337430 - RNA, 14 nt, Bordetella pertussis
gcugcgcguggcca

SEQ ID NO: 337431 - RNA, 19 nt, Bordetella pertussis
gcugcgcugcucguccacg

SEQ ID NO: 337432 - RNA, 23 nt, Bordetella pertussis
gcugcggauacgaaaccaggccg

SEQ ID NO: 337433 - RNA, 19 nt, Bordetella pertussis
gcugcggcacggccagcgg

SEQ ID NO: 337434 - RNA, 16 nt, Bordetella pertussis
gcugcggcagccaggu

SEQ ID NO: 337435 - RNA, 14 nt, Bordetella pertussis
gcugcggcguggcg

SEQ ID NO: 337436 - RNA, 21 nt, Bordetella pertussis
gcugcguaucaacuuccagcg

SEQ ID NO: 337437 - RNA, 22 nt, Bordetella pertussis
gcugcguaucaacuuccagcgc

SEQ ID NO: 337438 - RNA, 23 nt, Bordetella pertussis
gcugcguaucaacuuccagcgcc

SEQ ID NO: 337439 - RNA, 20 nt, Bordetella pertussis
gcugcguccaccaccaggcc

SEQ ID NO: 337440 - RNA, 20 nt, Bordetella pertussis
gcugcguggcgacgcgcugc

SEQ ID NO: 337441 - RNA, 16 nt, Bordetella pertussis
gcugcucaacggccac

SEQ ID NO: 337442 - RNA, 18 nt, Bordetella pertussis
gcugcucaccucgaucgc

SEQ ID NO: 337443 - RNA, 19 nt, Bordetella pertussis
gcugcucuuggcgccggac

SEQ ID NO: 337444 - RNA, 19 nt, Bordetella pertussis
gcugcugacugugcagcca

SEQ ID NO: 337445 - RNA, 20 nt, Bordetella pertussis
gcugcugauccucgccagcg

SEQ ID NO: 337446 - RNA, 14 nt, Bordetella pertussis
gcugcugcacgcgc

SEQ ID NO: 337447 - RNA, 22 nt, Bordetella pertussis
gcugcugcacgcgcgcgggcgc

SEQ ID NO: 337448 - RNA, 13 nt, Bordetella pertussis
gcugcugcacgug

SEQ ID NO: 337449 - RNA, 17 nt, Bordetella pertussis
gcugcugcaggccggcg

SEQ ID NO: 337450 - RNA, 19 nt, Bordetella pertussis
gcugcugcaggccggcgcg

SEQ ID NO: 337451 - RNA, 14 nt, Bordetella pertussis
gcugcugcaggcgc

SEQ ID NO: 337452 - RNA, 13 nt, Bordetella pertussis
gcugcugcccgaa

SEQ ID NO: 337453 - RNA, 18 nt, Bordetella pertussis
gcuggcgcgucggcgcgc

SEQ ID NO: 337454 - RNA, 18 nt, Bordetella pertussis
gcuggcgcguggccgcca

SEQ ID NO: 337455 - RNA, 22 nt, Bordetella pertussis
gcuggcgcguugcgcaucgcgc

SEQ ID NO: 337456 - RNA, 18 nt, Bordetella pertussis
gcugcuggaacggugcga

SEQ ID NO: 337457 - RNA, 17 nt, Bordetella pertussis
gcuggcgcucgggcgcg

SEQ ID NO: 337458 - RNA, 19 nt, Bordetella pertussis
gcuggcggacacgcccugg

SEQ ID NO: 337459 - RNA, 22 nt, Bordetella pertussis
gcuggcggaccgaacggccggu

SEQ ID NO: 337460 - RNA, 14 nt, Bordetella pertussis
gcuggcggcgcgcg

SEQ ID NO: 337461 - RNA, 14 nt, Bordetella pertussis
gcuggcggcgcgcu

SEQ ID NO: 337462 - RNA, 12 nt, Bordetella pertussis
gcuggcggcgca

SEQ ID NO: 337463 - RNA, 20 nt, Bordetella pertussis
gcuggcggcgcagcaccagg

SEQ ID NO: 337464 - RNA, 17 nt, Bordetella pertussis
gcuggcguucagcgggc

SEQ ID NO: 337465 - RNA, 22 nt, Bordetella pertussis
gcuggcguugacguggcugagc

SEQ ID NO: 337466 - RNA, 18 nt, Bordetella pertussis
gcuggcguuugcgcgcgc

SEQ ID NO: 337467 - RNA, 23 nt, Bordetella pertussis
gcuggcguugcgguagcgcaagc

SEQ ID NO: 337468 - RNA, 20 nt, Bordetella pertussis
gcuggcucguucgcucggcg

SEQ ID NO: 337469 - RNA, 17 nt, Bordetella pertussis
gcuggcugggcgcgccg

SEQ ID NO: 337470 - RNA, 20 nt, Bordetella pertussis
gcuggcugggcgcgccgcug

SEQ ID NO: 337471 - RNA, 14 nt, Bordetella pertussis
gcuggcuucggcgc

SEQ ID NO: 337472 - RNA, 16 nt, Bordetella pertussis
gcuggcuucggcgcug

SEQ ID NO: 337473 - RNA, 17 nt, Bordetella pertussis
gcuggcuucggcgcugg

SEQ ID NO: 337474 - RNA, 19 nt, Bordetella pertussis
gcuggcuucggcgcugggc

SEQ ID NO: 337475 - RNA, 23 nt, Bordetella pertussis
gcuggcuucggcgcugggcgcau

SEQ ID NO: 337476 - RNA, 18 nt, Bordetella pertussis
gcuggcuucgucgccggc

SEQ ID NO: 337477 - RNA, 21 nt, Bordetella pertussis
gcuggcuucgucgccggcguu

SEQ ID NO: 337478 - RNA, 19 nt, Bordetella pertussis
gcuggcugugcccgcccca

SEQ ID NO: 337479 - RNA, 17 nt, Bordetella pertussis
gcugggagagccggcca

SEQ ID NO: 337480 - RNA, 18 nt, Bordetella pertussis
gcugggagagccggccac

SEQ ID NO: 337481 - RNA, 19 nt, Bordetella pertussis
gcugggagagccggccacg

SEQ ID NO: 337482 - RNA, 21 nt, Bordetella pertussis
gcugggauggguacgccggcc

SEQ ID NO: 337483 - RNA, 22 nt, Bordetella pertussis
gcugggauggguacgccggccu

SEQ ID NO: 337484 - RNA, 20 nt, Bordetella pertussis
gcugggcacauccagcgcca

SEQ ID NO: 337485 - RNA, 22 nt, Bordetella pertussis
gcugggcaugggcggcccggcc

SEQ ID NO: 337486 - RNA, 21 nt, Bordetella pertussis
gcugggccagaccgcgcgcac

SEQ ID NO: 337487 - RNA, 12 nt, Bordetella pertussis
gcugggccagca

SEQ ID NO: 337488 - RNA, 18 nt, Bordetella pertussis
gcugggccagcaucggca

SEQ ID NO: 337489 - RNA, 21 nt, Bordetella pertussis
gcugggccagcaucggcaccc

SEQ ID NO: 337490 - RNA, 17 nt, Bordetella pertussis
gcugggugaagccaagc

SEQ ID NO: 337491 - RNA, 20 nt, Bordetella pertussis
gcuggguguagucgcggccg

SEQ ID NO: 337492 - RNA, 16 nt, Bordetella pertussis
gcugguaaagggcgcg

SEQ ID NO: 337493 - RNA, 19 nt, Bordetella pertussis
gcugguaaagggcgcggau

SEQ ID NO: 337494 - RNA, 14 nt, Bordetella pertussis
gcugguacagcccc

SEQ ID NO: 337495 - RNA, 21 nt, Bordetella pertussis
gcugguacagccccagcgcca

SEQ ID NO: 337496 - RNA, 14 nt, Bordetella pertussis
gcuggucaccgccc

SEQ ID NO: 337497 - RNA, 15 nt, Bordetella pertussis
gcuggucaccgcccc

SEQ ID NO: 337498 - RNA, 14 nt, Bordetella pertussis
gcuggucacgucca

SEQ ID NO: 337499 - RNA, 19 nt, Bordetella pertussis
gcuggucagccuggggcag

SEQ ID NO: 337500 - RNA, 18 nt, Bordetella pertussis
gcuggucauugaccugcu

SEQ ID NO: 337501 - RNA, 23 nt, Bordetella pertussis
gcugguccaccaccuucagggcg

SEQ ID NO: 337502 - RNA, 14 nt, Bordetella pertussis
gcugguccgccgcc

SEQ ID NO: 337503 - RNA, 16 nt, Bordetella pertussis
gcugguggccaccagc

SEQ ID NO: 337504 - RNA, 17 nt, Bordetella pertussis
gcugguggcgauguuca

SEQ ID NO: 337505 - RNA, 13 nt, Bordetella pertussis
gcugguucgaccu

SEQ ID NO: 337506 - RNA, 14 nt, Bordetella pertussis
gcuguacgacagca

SEQ ID NO: 337507 - RNA, 13 nt, Bordetella pertussis
gcuguagcccugg

SEQ ID NO: 337508 - RNA, 14 nt, Bordetella pertussis
gcuguagcccuggc

SEQ ID NO: 337509 - RNA, 16 nt, Bordetella pertussis
gcuguagcccuggcgc

SEQ ID NO: 337510 - RNA, 14 nt, Bordetella pertussis
gcuguccaggccgg

SEQ ID NO: 337511 - RNA, 16 nt, Bordetella pertussis
gcuguccaggccgggg

SEQ ID NO: 337512 - RNA, 20 nt, Bordetella pertussis
gcuguccaggccggggccgc

SEQ ID NO: 337513 - RNA, 21 nt, Bordetella pertussis
gcuguccagucuggauggcgu

SEQ ID NO: 337514 - RNA, 23 nt, Bordetella pertussis
gcuguccagucuggauggcguau

SEQ ID NO: 337515 - RNA, 15 nt, Bordetella pertussis
gcugucccagauggc

SEQ ID NO: 337516 - RNA, 19 nt, Bordetella pertussis
gcugucccagauggcgccu

SEQ ID NO: 337517 - RNA, 18 nt, Bordetella pertussis
gcuguccgaugcgcugcu

SEQ ID NO: 337518 - RNA, 20 nt, Bordetella pertussis
gcuguccuggcguggccguu

SEQ ID NO: 337519 - RNA, 18 nt, Bordetella pertussis
gcuguccuucguggcgcc

SEQ ID NO: 337520 - RNA, 18 nt, Bordetella pertussis
gcugucgcaggcgcugca

SEQ ID NO: 337521 - RNA, 19 nt, Bordetella pertussis
gcuguggacgccgccggcc

SEQ ID NO: 337522 - RNA, 14 nt, Bordetella pertussis
gcuguggccgcggc

SEQ ID NO: 337523 - RNA, 23 nt, Bordetella pertussis
gcuguucaccuucaacaucgccc

SEQ ID NO: 337524 - RNA, 21 nt, Bordetella pertussis
gcuguucaggcgcucgaucgg

SEQ ID NO: 337525 - RNA, 14 nt, Bordetella pertussis
gcuguucgggcgcg

SEQ ID NO: 337526 - RNA, 16 nt, Bordetella pertussis
gcuguucgggcgcggu

SEQ ID NO: 337527 - RNA, 21 nt, Bordetella pertussis
gcuguucgggcgcggugcgca

SEQ ID NO: 337528 - RNA, 14 nt, Bordetella pertussis
gcuguucggggcag

SEQ ID NO: 337529 - RNA, 19 nt, Bordetella pertussis
gcuguucggggcagggcgc

SEQ ID NO: 337530 - RNA, 21 nt, Bordetella pertussis
gcuguucggcgaccgccggcc

SEQ ID NO: 337531 - RNA, 19 nt, Bordetella pertussis
gcuguucggcgagccgggc

SEQ ID NO: 337532 - RNA, 23 nt, Bordetella pertussis
gcuguuuuucauuugccgccuga

SEQ ID NO: 337533 - RNA, 21 nt, Bordetella pertussis
gcuucacccuggaugccaugc

SEQ ID NO: 337534 - RNA, 16 nt, Bordetella pertussis
gcuucagccugggccu

SEQ ID NO: 337535 - RNA, 16 nt, Bordetella pertussis
gcuucaggcgccgcag

SEQ ID NO: 337536 - RNA, 13 nt, Bordetella pertussis
gcuucaggcgcgc

SEQ ID NO: 337537 - RNA, 14 nt, Bordetella pertussis
gcuucaggcgcgcg

SEQ ID NO: 337538 - RNA, 17 nt, Bordetella pertussis
gcuucaggcgcgcggca

SEQ ID NO: 337539 - RNA, 13 nt, Bordetella pertussis
gcuucaugcgcuc

SEQ ID NO: 337540 - RNA, 18 nt, Bordetella pertussis
gcuuccaccgucuggcgu

SEQ ID NO: 337541 - RNA, 19 nt, Bordetella pertussis
gcuuccagcagcaugccgc

SEQ ID NO: 337542 - RNA, 23 nt, Bordetella pertussis
gcuuccaggaguucccagcgcgc

SEQ ID NO: 337543 - RNA, 18 nt, Bordetella pertussis
gcuucccgguccaggccg

SEQ ID NO: 337544 - RNA, 15 nt, Bordetella pertussis
gcuucccguggcuga

SEQ ID NO: 337545 - RNA, 16 nt, Bordetella pertussis
gcuuccggccgggcca

SEQ ID NO: 337546 - RNA, 19 nt, Bordetella pertussis
gcuuccucgaccaggucca

SEQ ID NO: 337547 - RNA, 17 nt, Bordetella pertussis
gcuuccugcaccucagg

SEQ ID NO: 337548 - RNA, 12 nt, Bordetella pertussis
gcuuccugcggc

SEQ ID NO: 337549 - RNA, 22 nt, Bordetella pertussis
gcuucgaacgacuugggcaguu

SEQ ID NO: 337550 - RNA, 18 nt, Bordetella pertussis
gcuucgagauccgccggc

SEQ ID NO: 337551 - RNA, 17 nt, Bordetella pertussis
gcuucgagccgguacag

SEQ ID NO: 337552 - RNA, 17 nt, Bordetella pertussis
gcuucgaccacgcggcg

SEQ ID NO: 337553 - RNA, 17 nt, Bordetella pertussis
gcuucgaucaugcccgc

SEQ ID NO: 337554 - RNA, 16 nt, Bordetella pertussis
gcuucgauggcggcgg

SEQ ID NO: 337555 - RNA, 15 nt, Bordetella pertussis
gcuucgcccagcgcu

SEQ ID NO: 337556 - RNA, 18 nt, Bordetella pertussis
gcuucgcccgccaccacg

SEQ ID NO: 337557 - RNA, 22 nt, Bordetella pertussis
gcuucgcccgccaccacgcgca

SEQ ID NO: 337558 - RNA, 18 nt, Bordetella pertussis
gcuucgcgcacauccagc

SEQ ID NO: 337559 - RNA, 18 nt, Bordetella pertussis
gcuucgcgguaaccggcg

SEQ ID NO: 337560 - RNA, 16 nt, Bordetella pertussis
gcuucggccugcgcca

SEQ ID NO: 337561 - RNA, 17 nt, Bordetella pertussis
gcuucggcggccauggc

SEQ ID NO: 337562 - RNA, 18 nt, Bordetella pertussis
gcuucggcguacugcugc

SEQ ID NO: 337563 - RNA, 19 nt, Bordetella pertussis
gcuucgggcagcucgcgcg

SEQ ID NO: 337564 - RNA, 21 nt, Bordetella pertussis
gcuucgggcagcucgcgcgcu

SEQ ID NO: 337565 - RNA, 21 nt, Bordetella pertussis
gcuucgguggcgcgcaacacg

SEQ ID NO: 337566 - RNA, 19 nt, Bordetella pertussis
gcuucgucauggucgacca

SEQ ID NO: 337567 - RNA, 22 nt, Bordetella pertussis
gcuucgucauggucgaccagca

SEQ ID NO: 337568 - RNA, 13 nt, Bordetella pertussis
gcuucgucgacca

SEQ ID NO: 337569 - RNA, 13 nt, Bordetella pertussis
gcuucgucggccg

SEQ ID NO: 337570 - RNA, 14 nt, Bordetella pertussis
gcuucgucggccgc

SEQ ID NO: 337571 - RNA, 16 nt, Bordetella pertussis
gcuucgucggccgcca

SEQ ID NO: 337572 - RNA, 19 nt, Bordetella pertussis
gcuucgucgggcagcgcgg

SEQ ID NO: 337573 - RNA, 21 nt, Bordetella pertussis
gcuucgucgggcagcgcggcg

SEQ ID NO: 337574 - RNA, 16 nt, Bordetella pertussis
gcuucgugcagcgcgu

SEQ ID NO: 337575 - RNA, 22 nt, Bordetella pertussis
gcuucgugcagcgcgugggcca

SEQ ID NO: 337576 - RNA, 22 nt, Bordetella pertussis
gcuucguuggugucggcggcga

SEQ ID NO: 337577 - RNA, 18 nt, Bordetella pertussis
gcuucucacugcccgcgc

SEQ ID NO: 337578 - RNA, 19 nt, Bordetella pertussis
gcuucucgcaagugcuggc

SEQ ID NO: 337579 - RNA, 18 nt, Bordetella pertussis
gcuucucggugcgccgcc

SEQ ID NO: 337580 - RNA, 23 nt, Bordetella pertussis
gcuucugccagacggccagcgcg

SEQ ID NO: 337581 - RNA, 18 nt, Bordetella pertussis
gcuucugcgccugcuggu

SEQ ID NO: 337582 - RNA, 23 nt, Bordetella pertussis
gcuucuggaucaccgccggcggc

SEQ ID NO: 337583 - RNA, 23 nt, Bordetella pertussis
gcuugaagcggucgauguccagc

SEQ ID NO: 337584 - RNA, 23 nt, Bordetella pertussis
gcuugaaguaaucgcccggcgcc

SEQ ID NO: 337585 - RNA, 22 nt, Bordetella pertussis
gcuugucgaucgccaccagcgu

SEQ ID NO: 337586 - RNA, 17 nt, Bordetella pertussis
gcuugucgaugacgcgc

SEQ ID NO: 337587 - RNA, 18 nt, Bordetella pertussis
gcuugucgauuaugccgc

SEQ ID NO: 337588 - RNA, 19 nt, Bordetella pertussis
gcuugucgauuaugccgcc

SEQ ID NO: 337589 - RNA, 17 nt, Bordetella pertussis
gcuuguucgagcgcgcg

SEQ ID NO: 337590 - RNA, 17 nt, Bordetella pertussis
gcuuucgaagcgcucga

SEQ ID NO: 337591 - RNA, 20 nt, Bordetella pertussis
gcuuucgccggaggcgcgca

SEQ ID NO: 337592 - RNA, 15 nt, Bordetella pertussis
gcuuucucccgccgc

SEQ ID NO: 337593 - RNA, 18 nt, Bordetella pertussis
gcuuucugcuugccggcc

SEQ ID NO: 337594 - RNA, 23 nt, Bordetella pertussis
gcuuuggacaggcgugcgcagcu

SEQ ID NO: 337595 - RNA, 19 nt, Bordetella pertussis
ggaaacggaaacugccauc

SEQ ID NO: 337596 - RNA, 14 nt, Bordetella pertussis
ggaaacggccaagc

SEQ ID NO: 337597 - RNA, 22 nt, Bordetella pertussis
ggaaagcccggccccaggccgg

SEQ ID NO: 337598 - RNA, 14 nt, Bordetella pertussis
ggaaagcggccugu

SEQ ID NO: 337599 - RNA, 22 nt, Bordetella pertussis
ggaaaucaggcgcaucgacagc

SEQ ID NO: 337600 - RNA, 14 nt, Bordetella pertussis
ggaaaucgcggcgc

SEQ ID NO: 337601 - RNA, 18 nt, Bordetella pertussis
ggaaauggugcgguugcg

SEQ ID NO: 337602 - RNA, 15 nt, Bordetella pertussis
ggaaauugacggcgc

SEQ ID NO: 337603 - RNA, 20 nt, Bordetella pertussis
ggaacagcgccggcagcgca

SEQ ID NO: 337604 - RNA, 16 nt, Bordetella pertussis
ggaacagccugcccuc

SEQ ID NO: 337605 - RNA, 21 nt, Bordetella pertussis
ggaacaggcgcgccagccgcg

SEQ ID NO: 337606 - RNA, 15 nt, Bordetella pertussis
ggaacauggcccggu

SEQ ID NO: 337607 - RNA, 19 nt, Bordetella pertussis
ggaacauguccaccagccg

SEQ ID NO: 337608 - RNA, 16 nt, Bordetella pertussis
ggaaccagcggcuggc

SEQ ID NO: 337609 - RNA, 24 nt, Bordetella pertussis
ggaaccagcggcuggcggugcgug

SEQ ID NO: 337610 - RNA, 20 nt, Bordetella pertussis
ggaacugggcgccggccagg

SEQ ID NO: 337611 - RNA, 19 nt, Bordetella pertussis
ggaagacauggcgcgcgcc

SEQ ID NO: 337612 - RNA, 19 nt, Bordetella pertussis
ggaagacuucgucaacgcc

SEQ ID NO: 337613 - RNA, 20 nt, Bordetella pertussis
ggaagaucacauaggccggc

SEQ ID NO: 337614 - RNA, 19 nt, Bordetella pertussis
ggaagauguggucggcgcc

SEQ ID NO: 337615 - RNA, 20 nt, Bordetella pertussis
ggaagauguggucggcgccg

SEQ ID NO: 337616 - RNA, 21 nt, Bordetella pertussis
ggaagauguaccagcccagcc

SEQ ID NO: 337617 - RNA, 15 nt, Bordetella pertussis
ggaagcagcccagca

SEQ ID NO: 337618 - RNA, 19 nt, Bordetella pertussis
ggaagccgccggcgugccc

SEQ ID NO: 337619 - RNA, 12 nt, Bordetella pertussis
ggaagcgcacca

SEQ ID NO: 337620 - RNA, 19 nt, Bordetella pertussis
ggaagcgcucgucggggug

SEQ ID NO: 337621 - RNA, 14 nt, Bordetella pertussis
ggaagcgcuggccc

SEQ ID NO: 337622 - RNA, 19 nt, Bordetella pertussis
ggaaguggccgagcgcacc

SEQ ID NO: 337623 - RNA, 17 nt, Bordetella pertussis
ggaaguggaaccgcggu

SEQ ID NO: 337624 - RNA, 16 nt, Bordetella pertussis
ggaauuccucgcggcu

SEQ ID NO: 337625 - RNA, 14 nt, Bordetella pertussis
ggaauuggcggcga

SEQ ID NO: 337626 - RNA, 19 nt, Bordetella pertussis
ggaauugggcgagcccagg

SEQ ID NO: 337627 - RNA, 13 nt, Bordetella pertussis
ggacaggcgccac

SEQ ID NO: 337628 - RNA, 17 nt, Bordetella pertussis
ggacaggcgcccgugcg

SEQ ID NO: 337629 - RNA, 16 nt, Bordetella pertussis
ggacaggcgugcgcag

SEQ ID NO: 337630 - RNA, 18 nt, Bordetella pertussis
ggacaggcgugcgcagcu

SEQ ID NO: 337631 - RNA, 21 nt, Bordetella pertussis
ggacaggcucccgcuggcggc

SEQ ID NO: 337632 - RNA, 15 nt, Bordetella pertussis
ggacagggccccggc

SEQ ID NO: 337633 - RNA, 13 nt, Bordetella pertussis
ggacaggucggcg

SEQ ID NO: 337634 - RNA, 16 nt, Bordetella pertussis
ggacaggucggcgccc

SEQ ID NO: 337635 - RNA, 14 nt, Bordetella pertussis
ggaccagggcacgg

SEQ ID NO: 337636 - RNA, 15 nt, Bordetella pertussis
ggaccaugcgcuggg

SEQ ID NO: 337637 - RNA, 22 nt, Bordetella pertussis
ggaccaugcgcugggcaugggc

SEQ ID NO: 337638 - RNA, 23 nt, Bordetella pertussis
ggaccccguggucgccagcacgc

SEQ ID NO: 337639 - RNA, 12 nt, Bordetella pertussis
ggaccgcgcggu

SEQ ID NO: 337640 - RNA, 18 nt, Bordetella pertussis
ggaccgcgcugcggucag

SEQ ID NO: 337641 - RNA, 15 nt, Bordetella pertussis
ggaccggcgauggcg

SEQ ID NO: 337642 - RNA, 14 nt, Bordetella pertussis
ggaccgggaauggc

SEQ ID NO: 337643 - RNA, 13 nt, Bordetella pertussis
ggacgaugcgcga

SEQ ID NO: 337644 - RNA, 21 nt, Bordetella pertussis
ggacgcaaccggucggccggc

SEQ ID NO: 337645 - RNA, 20 nt, Bordetella pertussis
ggacgauguagaucuggcgc

SEQ ID NO: 337646 - RNA, 13 nt, Bordetella pertussis
ggacgcaggccca

SEQ ID NO: 337647 - RNA, 18 nt, Bordetella pertussis
ggacgcaggcccagccag

SEQ ID NO: 337648 - RNA, 18 nt, Bordetella pertussis
ggacgcaggucgucguca

SEQ ID NO: 337649 - RNA, 13 nt, Bordetella pertussis
ggacgccagcccg

SEQ ID NO: 337650 - RNA, 16 nt, Bordetella pertussis
ggacgccagcccgccg

SEQ ID NO: 337651 - RNA, 21 nt, Bordetella pertussis
ggacgccauggcggcggccac

SEQ ID NO: 337652 - RNA, 14 nt, Bordetella pertussis
ggacgcgcgcggcg

SEQ ID NO: 337653 - RNA, 18 nt, Bordetella pertussis
ggacgcgcgcggcgaccg

SEQ ID NO: 337654 - RNA, 22 nt, Bordetella pertussis
ggacgcgcuguaggcgccggcg

SEQ ID NO: 337655 - RNA, 16 nt, Bordetella pertussis
ggacgcguccucggcc

SEQ ID NO: 337656 - RNA, 20 nt, Bordetella pertussis
ggacgcguccucggccagcc

SEQ ID NO: 337657 - RNA, 14 nt, Bordetella pertussis
ggacggccaggggc

SEQ ID NO: 337658 - RNA, 19 nt, Bordetella pertussis
ggacggccauucagaccgg

SEQ ID NO: 337659 - RNA, 19 nt, Bordetella pertussis
ggacggcgcacccgcggcg

SEQ ID NO: 337660 - RNA, 13 nt, Bordetella pertussis
ggacggcgccguc

SEQ ID NO: 337661 - RNA, 14 nt, Bordetella pertussis
ggacgggccaggcc

SEQ ID NO: 337662 - RNA, 16 nt, Bordetella pertussis
ggacgggccaggccga

SEQ ID NO: 337663 - RNA, 17 nt, Bordetella pertussis
ggacgggccaggccgau

SEQ ID NO: 337664 - RNA, 15 nt, Bordetella pertussis
ggacggggaacaggc

SEQ ID NO: 337665 - RNA, 21 nt, Bordetella pertussis
ggacggggaacaggcgcgcca

SEQ ID NO: 337666 - RNA, 16 nt, Bordetella pertussis
ggacgguacauacgug

SEQ ID NO: 337667 - RNA, 20 nt, Bordetella pertussis
ggacgguagcgcacgcaccg

SEQ ID NO: 337668 - RNA, 22 nt, Bordetella pertussis
ggacgguagcgcacgcaccgcg

SEQ ID NO: 337669 - RNA, 14 nt, Bordetella pertussis
ggacguccaggccu

SEQ ID NO: 337670 - RNA, 13 nt, Bordetella pertussis
ggacgucggugug

SEQ ID NO: 337671 - RNA, 14 nt, Bordetella pertussis
ggacgugggcgccu

SEQ ID NO: 337672 - RNA, 17 nt, Bordetella pertussis
ggacguguugccaggcg

SEQ ID NO: 337673 - RNA, 16 nt, Bordetella pertussis
ggacucgauggcgcag

SEQ ID NO: 337674 - RNA, 21 nt, Bordetella pertussis
ggacucguccauggugggcag

SEQ ID NO: 337675 - RNA, 21 nt, Bordetella pertussis
ggacugaacgcguccaggccc

SEQ ID NO: 337676 - RNA, 19 nt, Bordetella pertussis
ggacuggauauggcgccgc

SEQ ID NO: 337677 - RNA, 14 nt, Bordetella pertussis
ggacuggcacccgc

SEQ ID NO: 337678 - RNA, 14 nt, Bordetella pertussis
ggacuggcaccggc

SEQ ID NO: 337679 - RNA, 15 nt, Bordetella pertussis
ggacuggcaccggcc

SEQ ID NO: 337680 - RNA, 13 nt, Bordetella pertussis
ggacuggccgcgc

SEQ ID NO: 337681 - RNA, 13 nt, Bordetella pertussis
ggacuucgcccgg

SEQ ID NO: 337682 - RNA, 21 nt, Bordetella pertussis
ggacuucgucgaucauggcgc

SEQ ID NO: 337683 - RNA, 14 nt, Bordetella pertussis
ggagaaaucgccgc

SEQ ID NO: 337684 - RNA, 19 nt, Bordetella pertussis
ggagaaaucgccgccggcg

SEQ ID NO: 337685 - RNA, 17 nt, Bordetella pertussis
ggagaacaggcggcuga

SEQ ID NO: 337686 - RNA, 13 nt, Bordetella pertussis
ggagaagcgccgc

SEQ ID NO: 337687 - RNA, 17 nt, Bordetella pertussis
ggagaagcgccgcgccg

SEQ ID NO: 337688 - RNA, 14 nt, Bordetella pertussis
ggagaccggcgccu

SEQ ID NO: 337689 - RNA, 19 nt, Bordetella pertussis
ggagaccggcgccugcggc

SEQ ID NO: 337690 - RNA, 19 nt, Bordetella pertussis
ggagaccggguugcccggc

SEQ ID NO: 337691 - RNA, 19 nt, Bordetella pertussis
ggagacuggcaccggccaa

SEQ ID NO: 337692 - RNA, 17 nt, Bordetella pertussis
ggagagccggccacgcg

SEQ ID NO: 337693 - RNA, 20 nt, Bordetella pertussis
ggauucgccggucggccgcu

SEQ ID NO: 337694 - RNA, 18 nt, Bordetella pertussis
ggauugaccagcgcggcc

SEQ ID NO: 337695 - RNA, 16 nt, Bordetella pertussis
ggauugccgccgcgca

SEQ ID NO: 337696 - RNA, 23 nt, Bordetella pertussis
ggauugaugucgcgcaccgccug

SEQ ID NO: 337697 - RNA, 13 nt, Bordetella pertussis
ggauuucauggca

SEQ ID NO: 337698 - RNA, 14 nt, Bordetella pertussis
ggcaaacccggcga

SEQ ID NO: 337699 - RNA, 23 nt, Bordetella pertussis
ggcaaacggauugccgccgcgca

SEQ ID NO: 337700 - RNA, 13 nt, Bordetella pertussis
ggcaaacggcggc

SEQ ID NO: 337701 - RNA, 14 nt, Bordetella pertussis
ggcaaacggcugga

SEQ ID NO: 337702 - RNA, 12 nt, Bordetella pertussis
ggcaaagcgcgc

SEQ ID NO: 337703 - RNA, 21 nt, Bordetella pertussis
ggcaaagcgcgcguccugcgc

SEQ ID NO: 337704 - RNA, 14 nt, Bordetella pertussis
ggcaaagcgcggcu

SEQ ID NO: 337705 - RNA, 23 nt, Bordetella pertussis
ggcaaagaucaccugggccaucg

SEQ ID NO: 337706 - RNA, 16 nt, Bordetella pertussis
ggcaacccgcccacgc

SEQ ID NO: 337707 - RNA, 13 nt, Bordetella pertussis
ggcaaccgccacg

SEQ ID NO: 337708 - RNA, 16 nt, Bordetella pertussis
ggcaaccucgccgcgc

SEQ ID NO: 337709 - RNA, 19 nt, Bordetella pertussis
ggcaaccucgccgcgccag

SEQ ID NO: 337710 - RNA, 20 nt, Bordetella pertussis
ggcaaccucgccgcgccagc

SEQ ID NO: 337711 - RNA, 18 nt, Bordetella pertussis
ggcaacgacgcaggcgcc

SEQ ID NO: 337712 - RNA, 16 nt, Bordetella pertussis
ggcaacgggucgcgca

SEQ ID NO: 337713 - RNA, 16 nt, Bordetella pertussis
ggcaacuucaccgucg

SEQ ID NO: 337714 - RNA, 14 nt, Bordetella pertussis
ggcaagaagauccg

SEQ ID NO: 337715 - RNA, 22 nt, Bordetella pertussis
ggcaagacggcgcucggccucg

SEQ ID NO: 337716 - RNA, 17 nt, Bordetella pertussis
ggcaagccagggcagga

SEQ ID NO: 337717 - RNA, 18 nt, Bordetella pertussis
ggcaagccgcccggccgg

SEQ ID NO: 337718 - RNA, 19 nt, Bordetella pertussis
ggcaagccuugcggcuugc

SEQ ID NO: 337719 - RNA, 12 nt, Bordetella pertussis
ggcaagcggcgu

SEQ ID NO: 337720 - RNA, 16 nt, Bordetella pertussis
ggcaagcggcguaucg

SEQ ID NO: 337721 - RNA, 14 nt, Bordetella pertussis
ggcaaggcccgccg

SEQ ID NO: 337722 - RNA, 13 nt, Bordetella pertussis
ggcaaggccgcga

SEQ ID NO: 337723 - RNA, 16 nt, Bordetella pertussis
ggcaaggggccagccu

SEQ ID NO: 337724 - RNA, 18 nt, Bordetella pertussis
ggcaaggggccagccugg

SEQ ID NO: 337725 - RNA, 13 nt, Bordetella pertussis
ggcaagucgacgc

SEQ ID NO: 337726 - RNA, 16 nt, Bordetella pertussis
ggcaaguucgcugccg

SEQ ID NO: 337727 - RNA, 21 nt, Bordetella pertussis
ggcaaucccggcgacaccgcg

SEQ ID NO: 337728 - RNA, 20 nt, Bordetella pertussis
ggcaaucgaaaagcccgccg

SEQ ID NO: 337729 - RNA, 20 nt, Bordetella pertussis
ggcaaucggagguaugcacg

SEQ ID NO: 337730 - RNA, 16 nt, Bordetella pertussis
ggcaaucgggguggcg

SEQ ID NO: 337731 - RNA, 13 nt, Bordetella pertussis
ggcaaugcgcagg

SEQ ID NO: 337732 - RNA, 20 nt, Bordetella pertussis
ggcaaugcgcaggcccgaca

SEQ ID NO: 337733 - RNA, 13 nt, Bordetella pertussis
ggcaaugcgcgcg

SEQ ID NO: 337734 - RNA, 16 nt, Bordetella pertussis
ggcaaugcgcgcgcgg

SEQ ID NO: 337735 - RNA, 15 nt, Bordetella pertussis
ggcaaugcguggccg

SEQ ID NO: 337736 - RNA, 12 nt, Bordetella pertussis
ggcaauguccgg

SEQ ID NO: 337737 - RNA, 13 nt, Bordetella pertussis
ggcaauguccggg

SEQ ID NO: 337738 - RNA, 14 nt, Bordetella pertussis
ggcacaaccuggcg

SEQ ID NO: 337739 - RNA, 15 nt, Bordetella pertussis
ggcacaccacgcgau

SEQ ID NO: 337740 - RNA, 12 nt, Bordetella pertussis
ggcacaccagcg

SEQ ID NO: 337741 - RNA, 13 nt, Bordetella pertussis
ggcacaccagcgc

SEQ ID NO: 337742 - RNA, 16 nt, Bordetella pertussis
ggcacaccagcgccag

SEQ ID NO: 337743 - RNA, 17 nt, Bordetella pertussis
ggcacaccagcgccagg

SEQ ID NO: 337744 - RNA, 20 nt, Bordetella pertussis
ggcacacccuccuacgccau

SEQ ID NO: 337745 - RNA, 22 nt, Bordetella pertussis
ggcacacccuccuacgccauga

SEQ ID NO: 337746 - RNA, 20 nt, Bordetella pertussis
ggcacaccggucuacgccau

SEQ ID NO: 337747 - RNA, 22 nt, Bordetella pertussis
ggcacaccggucuacgccauga

SEQ ID NO: 337748 - RNA, 14 nt, Bordetella pertussis
ggcacacgaccggc

SEQ ID NO: 337749 - RNA, 14 nt, Bordetella pertussis
ggcacagcgcggcg

SEQ ID NO: 337750 - RNA, 18 nt, Bordetella pertussis
ggcacaggaacagccugc

SEQ ID NO: 337751 - RNA, 23 nt, Bordetella pertussis
ggcacaggccaucggcgccaagc

SEQ ID NO: 337752 - RNA, 19 nt, Bordetella pertussis
ggcacauccagcgccagca

SEQ ID NO: 337753 - RNA, 22 nt, Bordetella pertussis
ggcacaucggaauuggcggcga

SEQ ID NO: 337754 - RNA, 16 nt, Bordetella pertussis
ggcaccaccaccgccc

SEQ ID NO: 337755 - RNA, 22 nt, Bordetella pertussis
ggcaccaccaccgcccgcaugu

SEQ ID NO: 337756 - RNA, 20 nt, Bordetella pertussis
ggcaccaggaacagcaacgc

SEQ ID NO: 337757 - RNA, 15 nt, Bordetella pertussis
ggcaccagguccugg

SEQ ID NO: 337758 - RNA, 16 nt, Bordetella pertussis
ggcaccagguccuggc

SEQ ID NO: 337759 - RNA, 17 nt, Bordetella pertussis
ggcaccagguccuggcg

SEQ ID NO: 337760 - RNA, 18 nt, Bordetella pertussis
ggcaccagguccuggcgg

SEQ ID NO: 337761 - RNA, 21 nt, Bordetella pertussis
ggcaccagguccuggcggccg

SEQ ID NO: 337762 - RNA, 14 nt, Bordetella pertussis
ggcaccagcgccac

SEQ ID NO: 337763 - RNA, 18 nt, Bordetella pertussis
ggcaccaucgccgccugc

SEQ ID NO: 337764 - RNA, 23 nt, Bordetella pertussis
ggcaccaucugcgucgcguuggu

SEQ ID NO: 337765 - RNA, 18 nt, Bordetella pertussis
ggcaccauugccggcgcg

SEQ ID NO: 337766 - RNA, 20 nt, Bordetella pertussis
ggcacccagccggacccgcg

SEQ ID NO: 337767 - RNA, 17 nt, Bordetella pertussis
ggcacccaggcgggcug

SEQ ID NO: 337768 - RNA, 15 nt, Bordetella pertussis
ggcaccccggcgccg

SEQ ID NO: 337769 - RNA, 17 nt, Bordetella pertussis
ggcacccgagggucagg

SEQ ID NO: 337770 - RNA, 15 nt, Bordetella pertussis
ggcacccgcacgggc

SEQ ID NO: 337771 - RNA, 23 nt, Bordetella pertussis
ggcacccgcuaccccggcagcgu

SEQ ID NO: 337772 - RNA, 12 nt, Bordetella pertussis
ggcacccggccg

SEQ ID NO: 337773 - RNA, 19 nt, Bordetella pertussis
ggcacccugccccauccca

SEQ ID NO: 337774 - RNA, 15 nt, Bordetella pertussis
ggcacccuugccgca

SEQ ID NO: 337775 - RNA, 24 nt, Bordetella pertussis
ggcacccuugccgcaggagucgcu

SEQ ID NO: 337776 - RNA, 18 nt, Bordetella pertussis
ggcacccuugccgcgggu

SEQ ID NO: 337777 - RNA, 20 nt, Bordetella pertussis
ggcacccugucauacgccau

SEQ ID NO: 337778 - RNA, 22 nt, Bordetella pertussis
ggcacccugucauacgccauga

SEQ ID NO: 337779 - RNA, 23 nt, Bordetella pertussis
ggcaccgaacgggcguggcgcag

SEQ ID NO: 337780 - RNA, 14 nt, Bordetella pertussis
ggcaccgaggccga

SEQ ID NO: 337781 - RNA, 12 nt, Bordetella pertussis
ggcaccgcgacg

SEQ ID NO: 337782 - RNA, 13 nt, Bordetella pertussis
ggcaccgcgacga

SEQ ID NO: 337783 - RNA, 20 nt, Bordetella pertussis
ggcaccgcgcagcccggcgu

SEQ ID NO: 337784 - RNA, 21 nt, Bordetella pertussis
ggcaccgcgcagcccggcgug

SEQ ID NO: 337785 - RNA, 20 nt, Bordetella pertussis
ggcaccgugaugcgcgccgc

SEQ ID NO: 337786 - RNA, 22 nt, Bordetella pertussis
ggcaccucgauuuccgaggccu

SEQ ID NO: 337787 - RNA, 18 nt, Bordetella pertussis
ggcaccugcgaccgagcc

SEQ ID NO: 337788 - RNA, 14 nt, Bordetella pertussis
ggcaccugcugcuu

SEQ ID NO: 337789 - RNA, 19 nt, Bordetella pertussis
ggcaccugcugcuugaccu

SEQ ID NO: 337790 - RNA, 16 nt, Bordetella pertussis
ggcaccugcuugagca

SEQ ID NO: 337791 - RNA, 19 nt, Bordetella pertussis
ggcaccucggcgccgcggc

SEQ ID NO: 337792 - RNA, 16 nt, Bordetella pertussis
ggcaccugggccuuca

SEQ ID NO: 337793 - RNA, 21 nt, Bordetella pertussis
ggcaccuucgcgcagcggcgc

SEQ ID NO: 337794 - RNA, 22 nt, Bordetella pertussis
ggcaccuucgcgcagcggcgcg

SEQ ID NO: 337795 - RNA, 22 nt, Bordetella pertussis
ggcacgaaaagccgcggccgcc

SEQ ID NO: 337796 - RNA, 14 nt, Bordetella pertussis
ggcacgacgucguc

SEQ ID NO: 337797 - RNA, 19 nt, Bordetella pertussis
ggcacgacgucgucggugg

SEQ ID NO: 337798 - RNA, 15 nt, Bordetella pertussis
ggcacgacggccucc

SEQ ID NO: 337799 - RNA, 16 nt, Bordetella pertussis
ggcacgaucaccgccg

SEQ ID NO: 337800 - RNA, 17 nt, Bordetella pertussis
ggcacgaucaccgccgc

SEQ ID NO: 337801 - RNA, 18 nt, Bordetella pertussis
ggcacgaucggcgccugg

SEQ ID NO: 337802 - RNA, 12 nt, Bordetella pertussis
ggcacgauggcc

SEQ ID NO: 337803 - RNA, 16 nt, Bordetella pertussis
ggcacgauggccgcgc

SEQ ID NO: 337804 - RNA, 19 nt, Bordetella pertussis
ggcacgauggccgcgccca

SEQ ID NO: 337805 - RNA, 18 nt, Bordetella pertussis
ggcacgcacagcaugcgc

SEQ ID NO: 337806 - RNA, 22 nt, Bordetella pertussis
ggcacgcacagcaugcgcuggu

SEQ ID NO: 337807 - RNA, 12 nt, Bordetella pertussis
ggcacgcccagc

SEQ ID NO: 337808 - RNA, 14 nt, Bordetella pertussis
ggcacgcccagccg

SEQ ID NO: 337809 - RNA, 21 nt, Bordetella pertussis
ggcacgccgaugaacgacagg

SEQ ID NO: 337810 - RNA, 15 nt, Bordetella pertussis
ggcacgccggcggcg

SEQ ID NO: 337811 - RNA, 13 nt, Bordetella pertussis
ggcacgcgccagg

SEQ ID NO: 337812 - RNA, 19 nt, Bordetella pertussis
ggcacgcgccaggcguuga

SEQ ID NO: 337813 - RNA, 16 nt, Bordetella pertussis
ggcacgcgcgccggca

SEQ ID NO: 337814 - RNA, 15 nt, Bordetella pertussis
ggcacgcgcgcggcg

SEQ ID NO: 337815 - RNA, 22 nt, Bordetella pertussis
ggcacgcugaucgccggcgccc

SEQ ID NO: 337816 - RNA, 13 nt, Bordetella pertussis
ggcacgcugcuga

SEQ ID NO: 337817 - RNA, 13 nt, Bordetella pertussis
ggcacgcuugccg

SEQ ID NO: 337818 - RNA, 17 nt, Bordetella pertussis
ggcacggaaacguugcg

SEQ ID NO: 337819 - RNA, 14 nt, Bordetella pertussis
ggcacggcacgccu

SEQ ID NO: 337820 - RNA, 16 nt, Bordetella pertussis
ggcacggcacgccucg

SEQ ID NO: 337821 - RNA, 15 nt, Bordetella pertussis
ggcacggccagcauu

SEQ ID NO: 337822 - RNA, 23 nt, Bordetella pertussis
ggcacggccggccaggcgccgcu

SEQ ID NO: 337823 - RNA, 16 nt, Bordetella pertussis
ggcacggccggccugc

SEQ ID NO: 337824 - RNA, 18 nt, Bordetella pertussis
ggcacggccggccugcag

SEQ ID NO: 337825 - RNA, 13 nt, Bordetella pertussis
ggcacgggucagg

SEQ ID NO: 337826 - RNA, 19 nt, Bordetella pertussis
ggcacguaccaggcgcuga

SEQ ID NO: 337827 - RNA, 16 nt, Bordetella pertussis
ggcacguaguacagca

SEQ ID NO: 337828 - RNA, 21 nt, Bordetella pertussis
ggcacguaguacagcagcagc

SEQ ID NO: 337829 - RNA, 18 nt, Bordetella pertussis
ggcacgguucagaacgcg

SEQ ID NO: 337830 - RNA, 16 nt, Bordetella pertussis
ggcacguccgagagga

SEQ ID NO: 337831 - RNA, 16 nt, Bordetella pertussis
ggcacguugucgagca

SEQ ID NO: 337832 - RNA, 16 nt, Bordetella pertussis
ggcacucggccauggu

SEQ ID NO: 337833 - RNA, 13 nt, Bordetella pertussis
ggcacucuugccg

SEQ ID NO: 337834 - RNA, 22 nt, Bordetella pertussis
ggcacucuugccgcugcgcggu

SEQ ID NO: 337835 - RNA, 13 nt, Bordetella pertussis
ggcacugucggcg

SEQ ID NO: 337836 - RNA, 20 nt, Bordetella pertussis
ggcacugucggcguuccugg

SEQ ID NO: 337837 - RNA, 21 nt, Bordetella pertussis
ggcagaacagcggaucgccgg

SEQ ID NO: 337838 - RNA, 20 nt, Bordetella pertussis
ggcagaacggaaacgcccag

SEQ ID NO: 337839 - RNA, 19 nt, Bordetella pertussis
ggcagcgcgaccggcgcga

SEQ ID NO: 337840 - RNA, 14 nt, Bordetella pertussis
ggcagcgcgcagga

SEQ ID NO: 337841 - RNA, 20 nt, Bordetella pertussis
ggcagcgcgcaggacaaggc

SEQ ID NO: 337842 - RNA, 15 nt, Bordetella pertussis
ggcagcgcgcgcgug

SEQ ID NO: 337843 - RNA, 14 nt, Bordetella pertussis
ggcagcgcggccgg

SEQ ID NO: 337844 - RNA, 15 nt, Bordetella pertussis
ggcagcgcggccggc

SEQ ID NO: 337845 - RNA, 12 nt, Bordetella pertussis
ggcagcgcggcg

SEQ ID NO: 337846 - RNA, 18 nt, Bordetella pertussis
ggcagcgcggcggcgacc

SEQ ID NO: 337847 - RNA, 19 nt, Bordetella pertussis
ggcagcgcggcggcgaccg

SEQ ID NO: 337848 - RNA, 20 nt, Bordetella pertussis
ggcagcggcaucacgccggu

SEQ ID NO: 337849 - RNA, 13 nt, Bordetella pertussis
ggcagcggccaga

SEQ ID NO: 337850 - RNA, 19 nt, Bordetella pertussis
ggcagcggccagcgcggcg

SEQ ID NO: 337851 - RNA, 14 nt, Bordetella pertussis
ggcagcggccgcgc

SEQ ID NO: 337852 - RNA, 13 nt, Bordetella pertussis
ggcagcggcgcca

SEQ ID NO: 337853 - RNA, 21 nt, Bordetella pertussis
ggcagcggcgccaugcgcacc

SEQ ID NO: 337854 - RNA, 22 nt, Bordetella pertussis
ggcagcggcgccaugcgcacca

SEQ ID NO: 337855 - RNA, 22 nt, Bordetella pertussis
ggcagcggcuccccuggucagg

SEQ ID NO: 337856 - RNA, 14 nt, Bordetella pertussis
ggcagcgggccgca

SEQ ID NO: 337857 - RNA, 19 nt, Bordetella pertussis
ggcagcguaucgcccgcgc

SEQ ID NO: 337858 - RNA, 22 nt, Bordetella pertussis
ggcagcguaucgcccgcgcggu

SEQ ID NO: 337859 - RNA, 22 nt, Bordetella pertussis
ggcagcgucaauccgccgccag

SEQ ID NO: 337860 - RNA, 24 nt, Bordetella pertussis
ggcagcgucaauccgccgccagca

SEQ ID NO: 337861 - RNA, 13 nt, Bordetella pertussis
ggcaggccgcgcc

SEQ ID NO: 337862 - RNA, 16 nt, Bordetella pertussis
ggcaggccgcgccaca

SEQ ID NO: 337863 - RNA, 22 nt, Bordetella pertussis
ggcaggccgcgccacaggcgcu

SEQ ID NO: 337864 - RNA, 13 nt, Bordetella pertussis
ggcaggccgcgcu

SEQ ID NO: 337865 - RNA, 16 nt, Bordetella pertussis
ggcaggccgcgcuggu

SEQ ID NO: 337866 - RNA, 16 nt, Bordetella pertussis
ggcaggccggccagca

SEQ ID NO: 337867 - RNA, 16 nt, Bordetella pertussis
ggcaggccgcgguggu

SEQ ID NO: 337868 - RNA, 13 nt, Bordetella pertussis
ggcaggcgcacgc

SEQ ID NO: 337869 - RNA, 21 nt, Bordetella pertussis
ggcaggcgccgccgcccggca

SEQ ID NO: 337870 - RNA, 14 nt, Bordetella pertussis
ggcaggcgccggcu

SEQ ID NO: 337871 - RNA, 13 nt, Bordetella pertussis
ggcaggcgccugc

SEQ ID NO: 337872 - RNA, 20 nt, Bordetella pertussis
ggcaggcgccugcccugcgu

SEQ ID NO: 337873 - RNA, 22 nt, Bordetella pertussis
ggcaggcgcgagguggcgcucg

SEQ ID NO: 337874 - RNA, 13 nt, Bordetella pertussis
ggcaggcgcgcca

SEQ ID NO: 337875 - RNA, 18 nt, Bordetella pertussis
ggcaggcgcgccgggccg

SEQ ID NO: 337876 - RNA, 19 nt, Bordetella pertussis
ggcaggcgggccaggccgg

SEQ ID NO: 337877 - RNA, 16 nt, Bordetella pertussis
ggcaggcucagcccgg

SEQ ID NO: 337878 - RNA, 13 nt, Bordetella pertussis
ggcaggcggugcg

SEQ ID NO: 337879 - RNA, 21 nt, Bordetella pertussis
ggcaggcgucuugccggaggu

SEQ ID NO: 337880 - RNA, 22 nt, Bordetella pertussis
ggcaggcuggcauugagggcgu

SEQ ID NO: 337881 - RNA, 16 nt, Bordetella pertussis
ggcaggcuggcgcggu

SEQ ID NO: 337882 - RNA, 13 nt, Bordetella pertussis
ggcagggccagcg

SEQ ID NO: 337883 - RNA, 14 nt, Bordetella pertussis
ggcagggcgccgcg

SEQ ID NO: 337884 - RNA, 12 nt, Bordetella pertussis
ggcagggcgccu

SEQ ID NO: 337885 - RNA, 16 nt, Bordetella pertussis
ggcagggcgucggccg

SEQ ID NO: 337886 - RNA, 15 nt, Bordetella pertussis
ggcagggugacgggc

SEQ ID NO: 337887 - RNA, 22 nt, Bordetella pertussis
ggcaggguuuuauacggcgcga

SEQ ID NO: 337888 - RNA, 14 nt, Bordetella pertussis
ggcaguacgagcgg

SEQ ID NO: 337889 - RNA, 15 nt, Bordetella pertussis
ggcaguacgagcggc

SEQ ID NO: 337890 - RNA, 22 nt, Bordetella pertussis
ggcagucaaccguucauggcgu

SEQ ID NO: 337891 - RNA, 22 nt, Bordetella pertussis
ggcagucagccguucauggcgu

SEQ ID NO: 337892 - RNA, 15 nt, Bordetella pertussis
ggcaucccgacaugc

SEQ ID NO: 337893 - RNA, 16 nt, Bordetella pertussis
ggcaucgacaugcccg

SEQ ID NO: 337894 - RNA, 21 nt, Bordetella pertussis
ggcaucgacaugcccgccggc

SEQ ID NO: 337895 - RNA, 14 nt, Bordetella pertussis
ggcaucgaccagcg

SEQ ID NO: 337896 - RNA, 17 nt, Bordetella pertussis
ggcaucgaccagcgcac

SEQ ID NO: 337897 - RNA, 20 nt, Bordetella pertussis
ggcaucgagaaaccagccgc

SEQ ID NO: 337898 - RNA, 22 nt, Bordetella pertussis
ggcaucgauuucucgcugcuga

SEQ ID NO: 337899 - RNA, 13 nt, Bordetella pertussis
ggcaucgcccacc

SEQ ID NO: 337900 - RNA, 13 nt, Bordetella pertussis
ggcaucgccccgg

SEQ ID NO: 337901 - RNA, 16 nt, Bordetella pertussis
ggcaucgccgcgggcg

SEQ ID NO: 337902 - RNA, 15 nt, Bordetella pertussis
ggcaucggccacgcu

SEQ ID NO: 337903 - RNA, 14 nt, Bordetella pertussis
ggcaucggccagca

SEQ ID NO: 337904 - RNA, 21 nt, Bordetella pertussis
ggcaucgcgcugacagcgcuc

SEQ ID NO: 337905 - RNA, 12 nt, Bordetella pertussis
ggcaucggcgcc

SEQ ID NO: 337906 - RNA, 13 nt, Bordetella pertussis
ggcaucggcgccg

SEQ ID NO: 337907 - RNA, 15 nt, Bordetella pertussis
ggcaucggcgccgcg

SEQ ID NO: 337908 - RNA, 17 nt, Bordetella pertussis
ggcaucggcgccgcgcg

SEQ ID NO: 337909 - RNA, 13 nt, Bordetella pertussis
ggcaucggcggcu

SEQ ID NO: 337910 - RNA, 21 nt, Bordetella pertussis
ggcaucgggguuccacagcgc

SEQ ID NO: 337911 - RNA, 21 nt, Bordetella pertussis
ggcaucguaguugggcgccuu

SEQ ID NO: 337912 - RNA, 23 nt, Bordetella pertussis
ggcaucguaguugggcgccuugc

SEQ ID NO: 337913 - RNA, 24 nt, Bordetella pertussis
ggcaucguuacacuggcccuggca

SEQ ID NO: 337914 - RNA, 20 nt, Bordetella pertussis
ggcaucguucaggcgcaugg

SEQ ID NO: 337915 - RNA, 18 nt, Bordetella pertussis
ggcaucuguccgcgccgg

SEQ ID NO: 337916 - RNA, 20 nt, Bordetella pertussis
ggcaugaaaaagggcgcacc

SEQ ID NO: 337917 - RNA, 18 nt, Bordetella pertussis
ggcaugaccgcggacgcc

SEQ ID NO: 337918 - RNA, 20 nt, Bordetella pertussis
ggcaugacgaucacgggcug

SEQ ID NO: 337919 - RNA, 17 nt, Bordetella pertussis
ggcaugccaugcgcacu

SEQ ID NO: 337920 - RNA, 12 nt, Bordetella pertussis
ggcaugccggca

SEQ ID NO: 337921 - RNA, 18 nt, Bordetella pertussis
ggcaugccguccacgccc

SEQ ID NO: 337922 - RNA, 21 nt, Bordetella pertussis
ggcaugcgaaagccggccucc

SEQ ID NO: 337923 - RNA, 24 nt, Bordetella pertussis
ggcaugcgaagaauuggccgucca

SEQ ID NO: 337924 - RNA, 16 nt, Bordetella pertussis
ggcaugcgccagcgcc

SEQ ID NO: 337925 - RNA, 12 nt, Bordetella pertussis
ggcaugcgccgg

SEQ ID NO: 337926 - RNA, 15 nt, Bordetella pertussis
ggcaugcgccugcgc

SEQ ID NO: 337927 - RNA, 16 nt, Bordetella pertussis
ggcaugcgccugcgcc

SEQ ID NO: 337928 - RNA, 21 nt, Bordetella pertussis
ggcauggaacgggcgggucgu

SEQ ID NO: 337929 - RNA, 16 nt, Bordetella pertussis
ggcauuucgcugggcg

SEQ ID NO: 337930 - RNA, 21 nt, Bordetella pertussis
ggccaaccccgagggcgcggc

SEQ ID NO: 337931 - RNA, 17 nt, Bordetella pertussis
ggccaccgaagcggcgu

SEQ ID NO: 337932 - RNA, 16 nt, Bordetella pertussis
ggccaccgacggcgcg

SEQ ID NO: 337933 - RNA, 23 nt, Bordetella pertussis
ggccaccgacggcgcggcgaucg

SEQ ID NO: 337934 - RNA, 14 nt, Bordetella pertussis
ggccaccgagaugu

SEQ ID NO: 337935 - RNA, 13 nt, Bordetella pertussis
ggccaccgccugu

SEQ ID NO: 337936 - RNA, 20 nt, Bordetella pertussis
ggccaccgccugugccagcu

SEQ ID NO: 337937 - RNA, 16 nt, Bordetella pertussis
ggccaccgcggugccg

SEQ ID NO: 337938 - RNA, 21 nt, Bordetella pertussis
ggccaccucuucagcccggcg

SEQ ID NO: 337939 - RNA, 20 nt, Bordetella pertussis
ggccaccuggcgcaaggcgu

SEQ ID NO: 337940 - RNA, 12 nt, Bordetella pertussis
ggccacgcgccg

SEQ ID NO: 337941 - RNA, 22 nt, Bordetella pertussis
ggccacgcgcuguugcuggcca

SEQ ID NO: 337942 - RNA, 14 nt, Bordetella pertussis
ggccacgcgggcgu

SEQ ID NO: 337943 - RNA, 17 nt, Bordetella pertussis
ggccacgcucacgcccg

SEQ ID NO: 337944 - RNA, 15 nt, Bordetella pertussis
ggccacgcugcccug

SEQ ID NO: 337945 - RNA, 17 nt, Bordetella pertussis
ggccacgcugcccugcu

SEQ ID NO: 337946 - RNA, 19 nt, Bordetella pertussis
ggccacgcugcccugcugc

SEQ ID NO: 337947 - RNA, 21 nt, Bordetella pertussis
ggccacgcugcccugcugcug

SEQ ID NO: 337948 - RNA, 13 nt, Bordetella pertussis
ggccacgcugcug

SEQ ID NO: 337949 - RNA, 15 nt, Bordetella pertussis
ggccacguaggccau

SEQ ID NO: 337950 - RNA, 19 nt, Bordetella pertussis
ggccacguccggguuggcg

SEQ ID NO: 337951 - RNA, 18 nt, Bordetella pertussis
ggccacguugauccagcg

SEQ ID NO: 337952 - RNA, 19 nt, Bordetella pertussis
ggccacguugauccagcgc

SEQ ID NO: 337953 - RNA, 23 nt, Bordetella pertussis
ggccacguugauccagcgcucgg

SEQ ID NO: 337954 - RNA, 22 nt, Bordetella pertussis
ggccacgucggcggccgccuug

SEQ ID NO: 337955 - RNA, 17 nt, Bordetella pertussis
ggccagcaagcgcucgg

SEQ ID NO: 337956 - RNA, 20 nt, Bordetella pertussis
ggccagcaagcgcucggcca

SEQ ID NO: 337957 - RNA, 20 nt, Bordetella pertussis
ggccagcaagggguccgugg

SEQ ID NO: 337958 - RNA, 19 nt, Bordetella pertussis
ggccagcacauacgccgcc

SEQ ID NO: 337959 - RNA, 21 nt, Bordetella pertussis
ggccagcacauacgccgccga

SEQ ID NO: 337960 - RNA, 17 nt, Bordetella pertussis
ggccagcaccggcccga

SEQ ID NO: 337961 - RNA, 14 nt, Bordetella pertussis
ggccagcacgccgg

SEQ ID NO: 337962 - RNA, 17 nt, Bordetella pertussis
ggccagcacgccggcca

SEQ ID NO: 337963 - RNA, 14 nt, Bordetella pertussis
ggccagcacggcgc

SEQ ID NO: 337964 - RNA, 18 nt, Bordetella pertussis
ggccagcagaaugccgcc

SEQ ID NO: 337965 - RNA, 23 nt, Bordetella pertussis
ggccagcagaaugccgcccacga

SEQ ID NO: 337966 - RNA, 22 nt, Bordetella pertussis
ggccagcaguguuucggccugc

SEQ ID NO: 337967 - RNA, 22 nt, Bordetella pertussis
ggccagcauacccugcgcgccg

SEQ ID NO: 337968 - RNA, 22 nt, Bordetella pertussis
ggccagcaucggcacccagccg

SEQ ID NO: 337969 - RNA, 22 nt, Bordetella pertussis
ggccagcaucguaucgggcguc

SEQ ID NO: 337970 - RNA, 13 nt, Bordetella pertussis
ggccagcauggcc

SEQ ID NO: 337971 - RNA, 21 nt, Bordetella pertussis
ggccagcauggccguggcgug

SEQ ID NO: 337972 - RNA, 14 nt, Bordetella pertussis
ggccagccacgccg

SEQ ID NO: 337973 - RNA, 15 nt, Bordetella pertussis
ggccagccacgccgg

SEQ ID NO: 337974 - RNA, 17 nt, Bordetella pertussis
ggccagccacgccggcg

SEQ ID NO: 337975 - RNA, 19 nt, Bordetella pertussis
ggccagccauugccgcacg

SEQ ID NO: 337976 - RNA, 23 nt, Bordetella pertussis
ggccagccccaccuugcccagca

SEQ ID NO: 337977 - RNA, 18 nt, Bordetella pertussis
ggccagcgccgcggccgg

SEQ ID NO: 337978 - RNA, 13 nt, Bordetella pertussis
ggccagcgccugg

SEQ ID NO: 337979 - RNA, 16 nt, Bordetella pertussis
ggccagcgccugggcg

SEQ ID NO: 337980 - RNA, 15 nt, Bordetella pertussis
ggccagcgcgacggc

SEQ ID NO: 337981 - RNA, 13 nt, Bordetella pertussis
ggccagcgcgccc

SEQ ID NO: 337982 - RNA, 22 nt, Bordetella pertussis
ggccagcgcgcccucguugacg

SEQ ID NO: 337983 - RNA, 23 nt, Bordetella pertussis
ggccagcgcgcaggugugccagc

SEQ ID NO: 337984 - RNA, 15 nt, Bordetella pertussis
ggccagcgcgccgcc

SEQ ID NO: 337985 - RNA, 17 nt, Bordetella pertussis
ggccagcgcgccgccag

SEQ ID NO: 337986 - RNA, 22 nt, Bordetella pertussis
ggccagcgcgccgccagcgcgc

SEQ ID NO: 337987 - RNA, 15 nt, Bordetella pertussis
ggccagcgcgccggc

SEQ ID NO: 337988 - RNA, 16 nt, Bordetella pertussis
ggccagcgcgccggcc

SEQ ID NO: 337989 - RNA, 14 nt, Bordetella pertussis
ggccagcgcgcgcc

SEQ ID NO: 337990 - RNA, 13 nt, Bordetella pertussis
ggccagcgcgcgg

SEQ ID NO: 337991 - RNA, 16 nt, Bordetella pertussis
ggccagcgcgcggccg

SEQ ID NO: 337992 - RNA, 17 nt, Bordetella pertussis
ggccagcgcgcggccgg

SEQ ID NO: 337993 - RNA, 18 nt, Bordetella pertussis
ggccagcgcgcggcgcag

SEQ ID NO: 337994 - RNA, 19 nt, Bordetella pertussis
ggccagcgcgcggcgcagc

SEQ ID NO: 337995 - RNA, 23 nt, Bordetella pertussis
ggccagcgcgcggcgcagcgcac

SEQ ID NO: 337996 - RNA, 21 nt, Bordetella pertussis
ggccagcgcggccaggucggc

SEQ ID NO: 337997 - RNA, 18 nt, Bordetella pertussis
ggccagcgcggcggcagc

SEQ ID NO: 337998 - RNA, 19 nt, Bordetella pertussis
ggccagcgcgucgagcagc

SEQ ID NO: 337999 - RNA, 19 nt, Bordetella pertussis
ggccagcggaugaugcggc

SEQ ID NO: 338000 - RNA, 23 nt, Bordetella pertussis
ggccagcggaugaugcggcgcca

SEQ ID NO: 338001 - RNA, 23 nt, Bordetella pertussis
ggccagcggcgaaaugucgagcg

SEQ ID NO: 338002 - RNA, 15 nt, Bordetella pertussis
ggccagcggcgcuua

SEQ ID NO: 338003 - RNA, 22 nt, Bordetella pertussis
ggccagcggcgguucguccucg

SEQ ID NO: 338004 - RNA, 13 nt, Bordetella pertussis
ggccagcgucagc

SEQ ID NO: 338005 - RNA, 17 nt, Bordetella pertussis
ggccagcgugcccagcg

SEQ ID NO: 338006 - RNA, 19 nt, Bordetella pertussis
ggccagcuccaccgggcug

SEQ ID NO: 338007 - RNA, 19 nt, Bordetella pertussis
ggccagcuccccgggcgug

SEQ ID NO: 338008 - RNA, 20 nt, Bordetella pertussis
ggccagcuccccgggcguga

SEQ ID NO: 338009 - RNA, 21 nt, Bordetella pertussis
ggccagcucggcggccgccug

SEQ ID NO: 338010 - RNA, 14 nt, Bordetella pertussis
ggccagcugcgccc

SEQ ID NO: 338011 - RNA, 19 nt, Bordetella pertussis
ggccagcugcguggcgacg

SEQ ID NO: 338012 - RNA, 22 nt, Bordetella pertussis
ggccagcugcguggcgacgcgc

SEQ ID NO: 338013 - RNA, 19 nt, Bordetella pertussis
ggccagcuggcgcguggcc

SEQ ID NO: 338014 - RNA, 14 nt, Bordetella pertussis
ggccagcuggcggc

SEQ ID NO: 338015 - RNA, 19 nt, Bordetella pertussis
ggccagcugggaggcgugc

SEQ ID NO: 338016 - RNA, 14 nt, Bordetella pertussis
ggccagcugcgugg

SEQ ID NO: 338017 - RNA, 20 nt, Bordetella pertussis
ggccagcuugaccgccagca

SEQ ID NO: 338018 - RNA, 22 nt, Bordetella pertussis
ggccagcuugaccgccagcauc

SEQ ID NO: 338019 - RNA, 23 nt, Bordetella pertussis
ggccagcuugaccgccagcaucc

SEQ ID NO: 338020 - RNA, 23 nt, Bordetella pertussis
ggccagcuugaccuugagcacgc

SEQ ID NO: 338021 - RNA, 22 nt, Bordetella pertussis
ggccagcuugacguccagccag

SEQ ID NO: 338022 - RNA, 17 nt, Bordetella pertussis
ggccagcuugagcaggc

SEQ ID NO: 338023 - RNA, 19 nt, Bordetella pertussis
ggccagcuuguagcggcca

SEQ ID NO: 338024 - RNA, 17 nt, Bordetella pertussis
ggccaggaaagccggcg

SEQ ID NO: 338025 - RNA, 18 nt, Bordetella pertussis
ggccaggaccgaggugcc

SEQ ID NO: 338026 - RNA, 17 nt, Bordetella pertussis
ggccaggacggugucgc

SEQ ID NO: 338027 - RNA, 23 nt, Bordetella pertussis
ggccaggauggcguugccggccu

SEQ ID NO: 338028 - RNA, 14 nt, Bordetella pertussis
ggccaggccauggc

SEQ ID NO: 338029 - RNA, 15 nt, Bordetella pertussis
ggccaggccauggcg

SEQ ID NO: 338030 - RNA, 18 nt, Bordetella pertussis
ggccaggccauggcgcga

SEQ ID NO: 338031 - RNA, 19 nt, Bordetella pertussis
ggccaggaucgcggccagc

SEQ ID NO: 338032 - RNA, 20 nt, Bordetella pertussis
ggccaggaucgcggccagcc

SEQ ID NO: 338033 - RNA, 19 nt, Bordetella pertussis
ggccaggcccacggcgcca

SEQ ID NO: 338034 - RNA, 17 nt, Bordetella pertussis
ggccaggcccaugccgc

SEQ ID NO: 338035 - RNA, 23 nt, Bordetella pertussis
ggccaggcccaugccgcccgcca

SEQ ID NO: 338036 - RNA, 14 nt, Bordetella pertussis
ggccaggccgccgc

SEQ ID NO: 338037 - RNA, 15 nt, Bordetella pertussis
ggccaggccgccgcc

SEQ ID NO: 338038 - RNA, 22 nt, Bordetella pertussis
ggccaggccggcccaguccagg

SEQ ID NO: 338039 - RNA, 17 nt, Bordetella pertussis
ggccaggccggccugca

SEQ ID NO: 338040 - RNA, 16 nt, Bordetella pertussis
ggccaggccggccuug

SEQ ID NO: 338041 - RNA, 18 nt, Bordetella pertussis
ggccaggccggcgcgccg

SEQ ID NO: 338042 - RNA, 20 nt, Bordetella pertussis
ggccaggccggcgcgccggc

SEQ ID NO: 338043 - RNA, 21 nt, Bordetella pertussis
ggccaggccggcgcgccggcc

SEQ ID NO: 338044 - RNA, 13 nt, Bordetella pertussis
ggccaggccggug

SEQ ID NO: 338045 - RNA, 23 nt, Bordetella pertussis
ggccaggccgauuucggccgccg

SEQ ID NO: 338046 - RNA, 13 nt, Bordetella pertussis
ggccaggcgcagu

SEQ ID NO: 338047 - RNA, 15 nt, Bordetella pertussis
ggccaggcgccggcg

SEQ ID NO: 338048 - RNA, 14 nt, Bordetella pertussis
ggccaggcgcgccg

SEQ ID NO: 338049 - RNA, 15 nt, Bordetella pertussis
ggccaggcgcucagc

SEQ ID NO: 338050 - RNA, 16 nt, Bordetella pertussis
ggccaggcgcuccagc

SEQ ID NO: 338051 - RNA, 17 nt, Bordetella pertussis
ggccaggcgcuccagca

SEQ ID NO: 338052 - RNA, 14 nt, Bordetella pertussis
ggccaggcggggug

SEQ ID NO: 338053 - RNA, 14 nt, Bordetella pertussis
ggcccagcgccagc

SEQ ID NO: 338054 - RNA, 13 nt, Bordetella pertussis
ggcccagcgccau

SEQ ID NO: 338055 - RNA, 14 nt, Bordetella pertussis
ggcccagcgccauc

SEQ ID NO: 338056 - RNA, 22 nt, Bordetella pertussis
ggcccagcgcggcggccaugcc

SEQ ID NO: 338057 - RNA, 14 nt, Bordetella pertussis
ggcccagcgcgucc

SEQ ID NO: 338058 - RNA, 12 nt, Bordetella pertussis
ggcccagcggca

SEQ ID NO: 338059 - RNA, 17 nt, Bordetella pertussis
ggcccagcuccagcugg

SEQ ID NO: 338060 - RNA, 12 nt, Bordetella pertussis
ggcccagcuggg

SEQ ID NO: 338061 - RNA, 14 nt, Bordetella pertussis
ggcccagcugggcg

SEQ ID NO: 338062 - RNA, 15 nt, Bordetella pertussis
ggcccagcugggcgg

SEQ ID NO: 338063 - RNA, 16 nt, Bordetella pertussis
ggcccagcugggcggc

SEQ ID NO: 338064 - RNA, 20 nt, Bordetella pertussis
ggcccaggaaaccggcgacc

SEQ ID NO: 338065 - RNA, 22 nt, Bordetella pertussis
ggcccaggaaaccggcgaccac

SEQ ID NO: 338066 - RNA, 20 nt, Bordetella pertussis
ggcccaggccgaaccacagc

SEQ ID NO: 338067 - RNA, 18 nt, Bordetella pertussis
ggcccaggcgacccagca

SEQ ID NO: 338068 - RNA, 14 nt, Bordetella pertussis
ggcccaggcgcgcu

SEQ ID NO: 338069 - RNA, 16 nt, Bordetella pertussis
ggcccaggcgggccag

SEQ ID NO: 338070 - RNA, 18 nt, Bordetella pertussis
ggcccaggcguccaggcu

SEQ ID NO: 338071 - RNA, 14 nt, Bordetella pertussis
ggcccagggccagg

SEQ ID NO: 338072 - RNA, 15 nt, Bordetella pertussis
ggcccaguacggccu

SEQ ID NO: 338073 - RNA, 17 nt, Bordetella pertussis
ggcccaguucggcgacg

SEQ ID NO: 338074 - RNA, 18 nt, Bordetella pertussis
ggcccaguucggcgacga

SEQ ID NO: 338075 - RNA, 16 nt, Bordetella pertussis
ggcccaguucggcgcg

SEQ ID NO: 338076 - RNA, 20 nt, Bordetella pertussis
ggcccaguugaaucggcgcg

SEQ ID NO: 338077 - RNA, 18 nt, Bordetella pertussis
ggcccaguugacgaugcc

SEQ ID NO: 338078 - RNA, 17 nt, Bordetella pertussis
ggcccaguucgcgcagc

SEQ ID NO: 338079 - RNA, 19 nt, Bordetella pertussis
ggcccauaugccgccggcc

SEQ ID NO: 338080 - RNA, 20 nt, Bordetella pertussis
ggcccauaugccgccggccu

SEQ ID NO: 338081 - RNA, 21 nt, Bordetella pertussis
ggcccauaugccgccggccug

SEQ ID NO: 338082 - RNA, 20 nt, Bordetella pertussis
ggcccauccaucugguggug

SEQ ID NO: 338083 - RNA, 23 nt, Bordetella pertussis
ggcccaugaacaggcacgacgcg

SEQ ID NO: 338084 - RNA, 19 nt, Bordetella pertussis
ggcccaugaaggcggccag

SEQ ID NO: 338085 - RNA, 20 nt, Bordetella pertussis
ggcccaugaaggcggccagc

SEQ ID NO: 338086 - RNA, 12 nt, Bordetella pertussis
ggcccaugacgc

SEQ ID NO: 338087 - RNA, 15 nt, Bordetella pertussis
ggcccaugacgccgg

SEQ ID NO: 338088 - RNA, 16 nt, Bordetella pertussis
ggcccaugccgcccgc

SEQ ID NO: 338089 - RNA, 13 nt, Bordetella pertussis
ggcccaugccgcg

SEQ ID NO: 338090 - RNA, 15 nt, Bordetella pertussis
ggcccaugccgcgga

SEQ ID NO: 338091 - RNA, 17 nt, Bordetella pertussis
ggcccauucgcgcaccg

SEQ ID NO: 338092 - RNA, 21 nt, Bordetella pertussis
ggcccauugcggcaccugcug

SEQ ID NO: 338093 - RNA, 13 nt, Bordetella pertussis
ggccccgccaggg

SEQ ID NO: 338094 - RNA, 14 nt, Bordetella pertussis
ggccccgcgcgagc

SEQ ID NO: 338095 - RNA, 15 nt, Bordetella pertussis
ggccccggcccggcg

SEQ ID NO: 338096 - RNA, 17 nt, Bordetella pertussis
ggcccgauggcggggau

SEQ ID NO: 338097 - RNA, 16 nt, Bordetella pertussis
ggcccgcaccgggcgg

SEQ ID NO: 338098 - RNA, 22 nt, Bordetella pertussis
ggcccgcaccugaacaccggcg

SEQ ID NO: 338099 - RNA, 17 nt, Bordetella pertussis
ggcccgcaccuugccug

SEQ ID NO: 338100 - RNA, 16 nt, Bordetella pertussis
ggcccgcgcgagcggc

SEQ ID NO: 338101 - RNA, 19 nt, Bordetella pertussis
ggcccgcgcgagcggcgug

SEQ ID NO: 338102 - RNA, 13 nt, Bordetella pertussis
ggcccgcgcgccu

SEQ ID NO: 338103 - RNA, 15 nt, Bordetella pertussis
ggcccgcgcggccag

SEQ ID NO: 338104 - RNA, 16 nt, Bordetella pertussis
ggcccgcgcggccagc

SEQ ID NO: 338105 - RNA, 20 nt, Bordetella pertussis
ggcccgcgcggccagcgccg

SEQ ID NO: 338106 - RNA, 15 nt, Bordetella pertussis
ggcccgcgcuguugc

SEQ ID NO: 338107 - RNA, 13 nt, Bordetella pertussis
ggcccgcgggcgc

SEQ ID NO: 338108 - RNA, 16 nt, Bordetella pertussis
ggcccgcggcgccagc

SEQ ID NO: 338109 - RNA, 21 nt, Bordetella pertussis
ggcccgcgucuuggcgggcac

SEQ ID NO: 338110 - RNA, 21 nt, Bordetella pertussis
ggcccgcgugacggccgccac

SEQ ID NO: 338111 - RNA, 13 nt, Bordetella pertussis
ggcccggcgggcc

SEQ ID NO: 338112 - RNA, 21 nt, Bordetella pertussis
ggcccgggcaggcucagcccg

SEQ ID NO: 338113 - RNA, 16 nt, Bordetella pertussis
ggcccgggcgagaugg

SEQ ID NO: 338114 - RNA, 13 nt, Bordetella pertussis
ggcccgggcgccu

SEQ ID NO: 338115 - RNA, 15 nt, Bordetella pertussis
ggcccgggcgccugc

SEQ ID NO: 338116 - RNA, 12 nt, Bordetella pertussis
ggcccgggcgcg

SEQ ID NO: 338117 - RNA, 13 nt, Bordetella pertussis
ggcccgggcgcgc

SEQ ID NO: 338118 - RNA, 16 nt, Bordetella pertussis
ggcccgggcgcgcugu

SEQ ID NO: 338119 - RNA, 18 nt, Bordetella pertussis
ggcccgggcguggcgucg

SEQ ID NO: 338120 - RNA, 18 nt, Bordetella pertussis
ggcccgggugggcggcau

SEQ ID NO: 338121 - RNA, 15 nt, Bordetella pertussis
ggcccggucguggcu

SEQ ID NO: 338122 - RNA, 19 nt, Bordetella pertussis
ggcccuggagaucgccgcc

SEQ ID NO: 338123 - RNA, 14 nt, Bordetella pertussis
ggcccuggcgggcc

SEQ ID NO: 338124 - RNA, 12 nt, Bordetella pertussis
ggcccuggcugg

SEQ ID NO: 338125 - RNA, 16 nt, Bordetella pertussis
ggcccuggcuggccag

SEQ ID NO: 338126 - RNA, 17 nt, Bordetella pertussis
ggcccuggcuggccagc

SEQ ID NO: 338127 - RNA, 18 nt, Bordetella pertussis
ggcccuggcuggccagcc

SEQ ID NO: 338128 - RNA, 19 nt, Bordetella pertussis
ggcccuggcuggccagccg

SEQ ID NO: 338129 - RNA, 16 nt, Bordetella pertussis
ggcccugggccagcca

SEQ ID NO: 338130 - RNA, 20 nt, Bordetella pertussis
ggcccuggcagacguacuug

SEQ ID NO: 338131 - RNA, 14 nt, Bordetella pertussis
ggcccuggggccgc

SEQ ID NO: 338132 - RNA, 20 nt, Bordetella pertussis
ggcccuugaucaggcgcaua

SEQ ID NO: 338133 - RNA, 14 nt, Bordetella pertussis
ggcccuugauggcc

SEQ ID NO: 338134 - RNA, 18 nt, Bordetella pertussis
ggcccuugauggccgggc

SEQ ID NO: 338135 - RNA, 14 nt, Bordetella pertussis
ggcccuugcccagc

SEQ ID NO: 338136 - RNA, 16 nt, Bordetella pertussis
ggcccuugccgccuuc

SEQ ID NO: 338137 - RNA, 14 nt, Bordetella pertussis
ggcccuugcgcgaa

SEQ ID NO: 338138 - RNA, 18 nt, Bordetella pertussis
ggcccuugugcguuggcg

SEQ ID NO: 338139 - RNA, 18 nt, Bordetella pertussis
ggccgaaaccgccgcggc

SEQ ID NO: 338140 - RNA, 20 nt, Bordetella pertussis
ggccgaaaccgccgcggcuu

SEQ ID NO: 338141 - RNA, 16 nt, Bordetella pertussis
ggccgaaauggcggcg

SEQ ID NO: 338142 - RNA, 20 nt, Bordetella pertussis
ggccgaaauggcggcgguag

SEQ ID NO: 338143 - RNA, 18 nt, Bordetella pertussis
ggccgaaccgcgcagccg

SEQ ID NO: 338144 - RNA, 15 nt, Bordetella pertussis
ggccgaacgccgccg

SEQ ID NO: 338145 - RNA, 16 nt, Bordetella pertussis
ggccgaacgccgccgc

SEQ ID NO: 338146 - RNA, 22 nt, Bordetella pertussis
ggccgaacugggacaggcccag

SEQ ID NO: 338147 - RNA, 17 nt, Bordetella pertussis
ggccgaacuucagcccg

SEQ ID NO: 338148 - RNA, 15 nt, Bordetella pertussis
ggccgaagcgcaagc

SEQ ID NO: 338149 - RNA, 23 nt, Bordetella pertussis
ggccgaagcgcaagcccaggcgg

SEQ ID NO: 338150 - RNA, 20 nt, Bordetella pertussis
ggccgaaucguucacgcccg

SEQ ID NO: 338151 - RNA, 19 nt, Bordetella pertussis
ggccgaaugcccgcccuug

SEQ ID NO: 338152 - RNA, 15 nt, Bordetella pertussis
ggccgaauugccgcc

SEQ ID NO: 338153 - RNA, 16 nt, Bordetella pertussis
ggccgaauugccgccg

SEQ ID NO: 338154 - RNA, 19 nt, Bordetella pertussis
ggccgacaaggagacauca

SEQ ID NO: 338155 - RNA, 12 nt, Bordetella pertussis
ggccgacccgcg

SEQ ID NO: 338156 - RNA, 19 nt, Bordetella pertussis
ggccgaccggcgcgcgcgu

SEQ ID NO: 338157 - RNA, 17 nt, Bordetella pertussis
ggccgacgaggcgcugu

SEQ ID NO: 338158 - RNA, 12 nt, Bordetella pertussis
ggccgacgcgcu

SEQ ID NO: 338159 - RNA, 15 nt, Bordetella pertussis
ggccgacgcgcuggu

SEQ ID NO: 338160 - RNA, 16 nt, Bordetella pertussis
ggccgacgcgcugucc

SEQ ID NO: 338161 - RNA, 23 nt, Bordetella pertussis
ggccgacgcgcuguccgaugcgc

SEQ ID NO: 338162 - RNA, 13 nt, Bordetella pertussis
ggccgacgcgccc

SEQ ID NO: 338163 - RNA, 19 nt, Bordetella pertussis
ggccgacgcgcccgggcug

SEQ ID NO: 338164 - RNA, 20 nt, Bordetella pertussis
ggccgacgcgcccgggcuga

SEQ ID NO: 338165 - RNA, 16 nt, Bordetella pertussis
ggccgaucccuugugc

SEQ ID NO: 338166 - RNA, 14 nt, Bordetella pertussis
ggccgaucgcgccg

SEQ ID NO: 338167 - RNA, 17 nt, Bordetella pertussis
ggccgaucucacgggcg

SEQ ID NO: 338168 - RNA, 17 nt, Bordetella pertussis
ggccgaucugcugggcc

SEQ ID NO: 338169 - RNA, 22 nt, Bordetella pertussis
ggccgaucugcugggccgggug

SEQ ID NO: 338170 - RNA, 18 nt, Bordetella pertussis
ggccgaugaagacgccgu

SEQ ID NO: 338171 - RNA, 20 nt, Bordetella pertussis
ggccgaugaagacgccgucg

SEQ ID NO: 338172 - RNA, 17 nt, Bordetella pertussis
ggccgaugaauugcgcc

SEQ ID NO: 338173 - RNA, 21 nt, Bordetella pertussis
ggccgaugacaucgccgcugc

SEQ ID NO: 338174 - RNA, 17 nt, Bordetella pertussis
ggccgaugcguccgccg

SEQ ID NO: 338175 - RNA, 20 nt, Bordetella pertussis
ggccgaugcguccgccgugc

SEQ ID NO: 338176 - RNA, 15 nt, Bordetella pertussis
ggccgaugcuggucg

SEQ ID NO: 338177 - RNA, 18 nt, Bordetella pertussis
ggccgauggcguccagca

SEQ ID NO: 338178 - RNA, 19 nt, Bordetella pertussis
ggccgauggcguccagcag

SEQ ID NO: 338179 - RNA, 22 nt, Bordetella pertussis
ggccgauggcguccagcagcag

SEQ ID NO: 338180 - RNA, 15 nt, Bordetella pertussis
ggccgauggucagca

SEQ ID NO: 338181 - RNA, 20 nt, Bordetella pertussis
ggccgauguagcccauggcc

SEQ ID NO: 338182 - RNA, 22 nt, Bordetella pertussis
ggccgauguagcccauggccag

SEQ ID NO: 338183 - RNA, 17 nt, Bordetella pertussis
ggccgaugucgccgccu

SEQ ID NO: 338184 - RNA, 18 nt, Bordetella pertussis
ggccgauuccagcgccgc

SEQ ID NO: 338185 - RNA, 17 nt, Bordetella pertussis
ggccgauuucgcgcgcc

SEQ ID NO: 338186 - RNA, 22 nt, Bordetella pertussis
ggccgauuucgcgcgccagcgc

SEQ ID NO: 338187 - RNA, 23 nt, Bordetella pertussis
ggccgauuucgcgcgccagcgcg

SEQ ID NO: 338188 - RNA, 24 nt, Bordetella pertussis
ggccgauuucgcgcgccagcgcgg

SEQ ID NO: 338189 - RNA, 16 nt, Bordetella pertussis
ggccgauuucggccgc

SEQ ID NO: 338190 - RNA, 19 nt, Bordetella pertussis
ggccgauuucggccgccgg

SEQ ID NO: 338191 - RNA, 20 nt, Bordetella pertussis
ggccgauuucggccgccggc

SEQ ID NO: 338192 - RNA, 22 nt, Bordetella pertussis
ggccgcaacccacccccagcag

SEQ ID NO: 338193 - RNA, 17 nt, Bordetella pertussis
ggccgcaagcaagcccc

SEQ ID NO: 338194 - RNA, 13 nt, Bordetella pertussis
ggccgcacgcgcg

SEQ ID NO: 338195 - RNA, 16 nt, Bordetella pertussis
ggccgcacgcgcggca

SEQ ID NO: 338196 - RNA, 19 nt, Bordetella pertussis
ggccgcacgcgcggcagcg

SEQ ID NO: 338197 - RNA, 20 nt, Bordetella pertussis
ggccgcacgcgcggcagcgc

SEQ ID NO: 338198 - RNA, 21 nt, Bordetella pertussis
ggccgcacgcgcggcagcgcc

SEQ ID NO: 338199 - RNA, 22 nt, Bordetella pertussis
ggccgcacgcgcggcagcgccg

SEQ ID NO: 338200 - RNA, 22 nt, Bordetella pertussis
ggccgcacgcggccgcgggccg

SEQ ID NO: 338201 - RNA, 21 nt, Bordetella pertussis
ggccgcacugggugacgcugg

SEQ ID NO: 338202 - RNA, 18 nt, Bordetella pertussis
ggccgcagcaauugcccc

SEQ ID NO: 338203 - RNA, 17 nt, Bordetella pertussis
ggccgcagcauggcgcc

SEQ ID NO: 338204 - RNA, 20 nt, Bordetella pertussis
ggccgcagcauggcgccagc

SEQ ID NO: 338205 - RNA, 22 nt, Bordetella pertussis
ggccgcagcauggcgccagcug

SEQ ID NO: 338206 - RNA, 14 nt, Bordetella pertussis
ggccgcagccggcu

SEQ ID NO: 338207 - RNA, 21 nt, Bordetella pertussis
ggccgcagcuggacuauggcc

SEQ ID NO: 338208 - RNA, 22 nt, Bordetella pertussis
ggccgcauacgacacgucaucg

SEQ ID NO: 338209 - RNA, 14 nt, Bordetella pertussis
ggccgcauggcggc

SEQ ID NO: 338210 - RNA, 14 nt, Bordetella pertussis
ggccgccaccagcg

SEQ ID NO: 338211 - RNA, 17 nt, Bordetella pertussis
ggccgccacccaggcgg

SEQ ID NO: 338212 - RNA, 19 nt, Bordetella pertussis
ggccgccaccugggccgcc

SEQ ID NO: 338213 - RNA, 22 nt, Bordetella pertussis
ggccgccaccugggccgccugc

SEQ ID NO: 338214 - RNA, 18 nt, Bordetella pertussis
ggccgccacgcccuggca

SEQ ID NO: 338215 - RNA, 13 nt, Bordetella pertussis
ggccgccagcaag

SEQ ID NO: 338216 - RNA, 17 nt, Bordetella pertussis
ggccgccagcaaggcgu

SEQ ID NO: 338217 - RNA, 18 nt, Bordetella pertussis
ggccgccagcaccugcuu

SEQ ID NO: 338218 - RNA, 13 nt, Bordetella pertussis
ggccgccagcaug

SEQ ID NO: 338219 - RNA, 18 nt, Bordetella pertussis
ggccgccagcccgaggca

SEQ ID NO: 338220 - RNA, 12 nt, Bordetella pertussis
ggccgccagccg

SEQ ID NO: 338221 - RNA, 12 nt, Bordetella pertussis
ggccgccagcca

SEQ ID NO: 338222 - RNA, 16 nt, Bordetella pertussis
ggccgccagccggccc

SEQ ID NO: 338223 - RNA, 14 nt, Bordetella pertussis
ggccgccagcgcca

SEQ ID NO: 338224 - RNA, 15 nt, Bordetella pertussis
ggccgccagcggcug

SEQ ID NO: 338225 - RNA, 21 nt, Bordetella pertussis
ggccgccagcggcuggcgccg

SEQ ID NO: 338226 - RNA, 12 nt, Bordetella pertussis
ggccgccagcgu

SEQ ID NO: 338227 - RNA, 22 nt, Bordetella pertussis
ggccgccagcguaucgccgccg

SEQ ID NO: 338228 - RNA, 15 nt, Bordetella pertussis
ggccgccagggccga

SEQ ID NO: 338229 - RNA, 16 nt, Bordetella pertussis
ggccgccagggcggcu

SEQ ID NO: 338230 - RNA, 23 nt, Bordetella pertussis
ggccgccaggucggccaccgccg

SEQ ID NO: 338231 - RNA, 17 nt, Bordetella pertussis
ggccgccauggccggcg

SEQ ID NO: 338232 - RNA, 18 nt, Bordetella pertussis
ggccgccauggccggcgu

SEQ ID NO: 338233 - RNA, 17 nt, Bordetella pertussis
ggccgccauggcgcugg

SEQ ID NO: 338234 - RNA, 13 nt, Bordetella pertussis
ggccgcccagcag

SEQ ID NO: 338235 - RNA, 18 nt, Bordetella pertussis
ggccgcccagcagauggc

SEQ ID NO: 338236 - RNA, 15 nt, Bordetella pertussis
ggccgcccagccgcg

SEQ ID NO: 338237 - RNA, 18 nt, Bordetella pertussis
ggccgcccagccgcgcca

SEQ ID NO: 338238 - RNA, 15 nt, Bordetella pertussis
ggccgcccagcgcau

SEQ ID NO: 338239 - RNA, 15 nt, Bordetella pertussis
ggccgcccaggcgca

SEQ ID NO: 338240 - RNA, 16 nt, Bordetella pertussis
ggccgcccaggcgcag

SEQ ID NO: 338241 - RNA, 21 nt, Bordetella pertussis
ggccgcccccagcgcgccugc

SEQ ID NO: 338242 - RNA, 20 nt, Bordetella pertussis
ggccgcccagucguccagca

SEQ ID NO: 338243 - RNA, 16 nt, Bordetella pertussis
ggccgccccaacggcc

SEQ ID NO: 338244 - RNA, 14 nt, Bordetella pertussis
ggccgcccgcggcc

SEQ ID NO: 338245 - RNA, 15 nt, Bordetella pertussis
ggccgcccgcggccu

SEQ ID NO: 338246 - RNA, 18 nt, Bordetella pertussis
ggccgcccgcggccugca

SEQ ID NO: 338247 - RNA, 13 nt, Bordetella pertussis
ggccgcccgccug

SEQ ID NO: 338248 - RNA, 22 nt, Bordetella pertussis
ggccgcccgccugccggccugg

SEQ ID NO: 338249 - RNA, 14 nt, Bordetella pertussis
ggccgcccuggcgc

SEQ ID NO: 338250 - RNA, 16 nt, Bordetella pertussis
ggccgcccuggcgcga

SEQ ID NO: 338251 - RNA, 20 nt, Bordetella pertussis
ggccgcccuggucaucgcca

SEQ ID NO: 338252 - RNA, 22 nt, Bordetella pertussis
ggccgccgaacggcagcagcgc

SEQ ID NO: 338253 - RNA, 14 nt, Bordetella pertussis
ggccgccgacgccg

SEQ ID NO: 338254 - RNA, 16 nt, Bordetella pertussis
ggccgccgacgccgcc

SEQ ID NO: 338255 - RNA, 13 nt, Bordetella pertussis
ggccgccgccacc

SEQ ID NO: 338256 - RNA, 12 nt, Bordetella pertussis
ggccgccgccgg

SEQ ID NO: 338257 - RNA, 13 nt, Bordetella pertussis
ggccgccgccggu

SEQ ID NO: 338258 - RNA, 15 nt, Bordetella pertussis
ggccgccgccgguca

SEQ ID NO: 338259 - RNA, 14 nt, Bordetella pertussis
ggccgccgccggug

SEQ ID NO: 338260 - RNA, 14 nt, Bordetella pertussis
ggccgccgcgccca

SEQ ID NO: 338261 - RNA, 16 nt, Bordetella pertussis
ggccgccgcgcccagc

SEQ ID NO: 338262 - RNA, 23 nt, Bordetella pertussis
ggccgccgcgcccagcagcgcca

SEQ ID NO: 338263 - RNA, 16 nt, Bordetella pertussis
ggccgccgcgcccgga

SEQ ID NO: 338264 - RNA, 12 nt, Bordetella pertussis
ggccgccgcgcg

SEQ ID NO: 338265 - RNA, 16 nt, Bordetella pertussis
ggccgccgcgcgccgc

SEQ ID NO: 338266 - RNA, 13 nt, Bordetella pertussis
ggccgccgcggcc

SEQ ID NO: 338267 - RNA, 16 nt, Bordetella pertussis
ggccgccgcggccucg

SEQ ID NO: 338268 - RNA, 20 nt, Bordetella pertussis
ggccgccgcggccucggccg

SEQ ID NO: 338269 - RNA, 14 nt, Bordetella pertussis
ggccgccgcgggcg

SEQ ID NO: 338270 - RNA, 17 nt, Bordetella pertussis
ggccgccgcgggcgccg

SEQ ID NO: 338271 - RNA, 18 nt, Bordetella pertussis
ggccgccgcgggcgccgc

SEQ ID NO: 338272 - RNA, 19 nt, Bordetella pertussis
ggccgccgcgggcgccgcg

SEQ ID NO: 338273 - RNA, 17 nt, Bordetella pertussis
ggccgccgcgugcgccg

SEQ ID NO: 338274 - RNA, 22 nt, Bordetella pertussis
ggccgccgcgugcgccgggcug

SEQ ID NO: 338275 - RNA, 17 nt, Bordetella pertussis
ggccgccggacgcaggu

SEQ ID NO: 338276 - RNA, 23 nt, Bordetella pertussis
ggccgccggacgcaggucgucgu

SEQ ID NO: 338277 - RNA, 12 nt, Bordetella pertussis
ggccgccggcca

SEQ ID NO: 338278 - RNA, 15 nt, Bordetella pertussis
ggccgccggccacca

SEQ ID NO: 338279 - RNA, 13 nt, Bordetella pertussis
ggccgccggccag

SEQ ID NO: 338280 - RNA, 15 nt, Bordetella pertussis
ggccgccggccagcg

SEQ ID NO: 338281 - RNA, 18 nt, Bordetella pertussis
ggccgccggccagcgcca

SEQ ID NO: 338282 - RNA, 19 nt, Bordetella pertussis
ggccgccggccagcgccag

SEQ ID NO: 338283 - RNA, 20 nt, Bordetella pertussis
ggccgccggccagcgcggca

SEQ ID NO: 338284 - RNA, 12 nt, Bordetella pertussis
ggccgccggccu

SEQ ID NO: 338285 - RNA, 13 nt, Bordetella pertussis
ggccgccggcgcg

SEQ ID NO: 338286 - RNA, 14 nt, Bordetella pertussis
ggccgccggcggcg

SEQ ID NO: 338287 - RNA, 17 nt, Bordetella pertussis
ggccgccggcggcgccg

SEQ ID NO: 338288 - RNA, 19 nt, Bordetella pertussis
ggccgccggcggcgccggc

SEQ ID NO: 338289 - RNA, 15 nt, Bordetella pertussis
ggccgccggcggcgu

SEQ ID NO: 338290 - RNA, 17 nt, Bordetella pertussis
ggccgccggcggcgucg

SEQ ID NO: 338291 - RNA, 18 nt, Bordetella pertussis
ggccgccgggccgcgacc

SEQ ID NO: 338292 - RNA, 20 nt, Bordetella pertussis
ggccgccggggaggccucga

SEQ ID NO: 338293 - RNA, 22 nt, Bordetella pertussis
ggccgccggggaggccucgacg

SEQ ID NO: 338294 - RNA, 14 nt, Bordetella pertussis
ggccgccgggucgc

SEQ ID NO: 338295 - RNA, 23 nt, Bordetella pertussis
ggccgccgugacuucggccgcca

SEQ ID NO: 338296 - RNA, 21 nt, Bordetella pertussis
ggccgccuauguaggcgccgc

SEQ ID NO: 338297 - RNA, 22 nt, Bordetella pertussis
ggccgccuauguaggcgccgcg

SEQ ID NO: 338298 - RNA, 23 nt, Bordetella pertussis
ggccgccucaccgcgccgggcgu

SEQ ID NO: 338299 - RNA, 13 nt, Bordetella pertussis
ggccgccucggcg

SEQ ID NO: 338300 - RNA, 17 nt, Bordetella pertussis
ggccgccucggcggcca

SEQ ID NO: 338301 - RNA, 19 nt, Bordetella pertussis
ggccgccucggcggccagc

SEQ ID NO: 338302 - RNA, 16 nt, Bordetella pertussis
ggccgccuccaggcgg

SEQ ID NO: 338303 - RNA, 13 nt, Bordetella pertussis
ggccgccuggccc

SEQ ID NO: 338304 - RNA, 23 nt, Bordetella pertussis
ggccgccuggcccaugaacaggc

SEQ ID NO: 338305 - RNA, 15 nt, Bordetella pertussis
ggccgccugcugcgc

SEQ ID NO: 338306 - RNA, 17 nt, Bordetella pertussis
ggccgccugcugcgccg

SEQ ID NO: 338307 - RNA, 20 nt, Bordetella pertussis
ggccgccugcugggccgcgc

SEQ ID NO: 338308 - RNA, 12 nt, Bordetella pertussis
ggccgccugcgc

SEQ ID NO: 338309 - RNA, 23 nt, Bordetella pertussis
ggccgccuugacgguggccgcgg

SEQ ID NO: 338310 - RNA, 22 nt, Bordetella pertussis
ggccgcgaacagauccacgccc

SEQ ID NO: 338311 - RNA, 23 nt, Bordetella pertussis
ggccgcgaacagauccacgcccg

SEQ ID NO: 338312 - RNA, 16 nt, Bordetella pertussis
ggccgcgaacgcgccg

SEQ ID NO: 338313 - RNA, 18 nt, Bordetella pertussis
ggccgcgaacgcgccggc

SEQ ID NO: 338314 - RNA, 19 nt, Bordetella pertussis
ggccgcgaacgcgccggcc

SEQ ID NO: 338315 - RNA, 20 nt, Bordetella pertussis
ggccgcgacauagcgcugga

SEQ ID NO: 338316 - RNA, 22 nt, Bordetella pertussis
ggccgcgaccacggucuggcgc

SEQ ID NO: 338317 - RNA, 15 nt, Bordetella pertussis
ggccgcgacgaucag

SEQ ID NO: 338318 - RNA, 14 nt, Bordetella pertussis
ggccgcgagcaugc

SEQ ID NO: 338319 - RNA, 16 nt, Bordetella pertussis
ggccgcgagcaugcgc

SEQ ID NO: 338320 - RNA, 18 nt, Bordetella pertussis
ggccgcgauauccuugcg

SEQ ID NO: 338321 - RNA, 12 nt, Bordetella pertussis
ggccgcgaugca

SEQ ID NO: 338322 - RNA, 19 nt, Bordetella pertussis
ggccgcgaugucgcgcgcg

SEQ ID NO: 338323 - RNA, 19 nt, Bordetella pertussis
ggccgcgcaaggcggcccg

SEQ ID NO: 338324 - RNA, 20 nt, Bordetella pertussis
ggccgcgcaaggcggcccgg

SEQ ID NO: 338325 - RNA, 22 nt, Bordetella pertussis
ggccgcgcaaggcggcccggcc

SEQ ID NO: 338326 - RNA, 17 nt, Bordetella pertussis
ggccgcgcagcacgccc

SEQ ID NO: 338327 - RNA, 18 nt, Bordetella pertussis
ggccgcgcagcacgcccg

SEQ ID NO: 338328 - RNA, 22 nt, Bordetella pertussis
ggccgcgcagcacgcccgcgcg

SEQ ID NO: 338329 - RNA, 18 nt, Bordetella pertussis
ggccgcuggucaccgccc

SEQ ID NO: 338330 - RNA, 20 nt, Bordetella pertussis
ggccgcuggucaccgccccg

SEQ ID NO: 338331 - RNA, 23 nt, Bordetella pertussis
ggccgcuggucaccgccccgacc

SEQ ID NO: 338332 - RNA, 21 nt, Bordetella pertussis
ggccgcuguucggcgagccgg

SEQ ID NO: 338333 - RNA, 18 nt, Bordetella pertussis
ggccgcuucggccugcgc

SEQ ID NO: 338334 - RNA, 19 nt, Bordetella pertussis
ggccgcuucggccugcgcc

SEQ ID NO: 338335 - RNA, 20 nt, Bordetella pertussis
ggccgcuucggccugcgcca

SEQ ID NO: 338336 - RNA, 21 nt, Bordetella pertussis
ggccgcuucggccugcgccac

SEQ ID NO: 338337 - RNA, 17 nt, Bordetella pertussis
ggccgcuucggcggcca

SEQ ID NO: 338338 - RNA, 20 nt, Bordetella pertussis
ggccgcuucggcggccaugg

SEQ ID NO: 338339 - RNA, 17 nt, Bordetella pertussis
ggccgcuucggcggccg

SEQ ID NO: 338340 - RNA, 20 nt, Bordetella pertussis
ggccgcuucggcggccgcgu

SEQ ID NO: 338341 - RNA, 13 nt, Bordetella pertussis
ggccgcuucgaug

SEQ ID NO: 338342 - RNA, 20 nt, Bordetella pertussis
ggccgcuucgugcggccgca

SEQ ID NO: 338343 - RNA, 20 nt, Bordetella pertussis
ggccgcuugucgaugacgcg

SEQ ID NO: 338344 - RNA, 21 nt, Bordetella pertussis
ggccgcuuucgaccagcgaca

SEQ ID NO: 338345 - RNA, 18 nt, Bordetella pertussis
ggccggaaaugccgcgcg

SEQ ID NO: 338346 - RNA, 21 nt, Bordetella pertussis
ggccggaacagcguccagccg

SEQ ID NO: 338347 - RNA, 18 nt, Bordetella pertussis
ggccggaacugaugccga

SEQ ID NO: 338348 - RNA, 14 nt, Bordetella pertussis
ggccggaugcgcag

SEQ ID NO: 338349 - RNA, 19 nt, Bordetella pertussis
ggccggcaaggggccagcc

SEQ ID NO: 338350 - RNA, 11 nt, Bordetella pertussis
ggccggcacca

SEQ ID NO: 338351 - RNA, 13 nt, Bordetella pertussis
ggccggcaccacg

SEQ ID NO: 338352 - RNA, 13 nt, Bordetella pertussis
ggccggcaccagg

SEQ ID NO: 338353 - RNA, 13 nt, Bordetella pertussis
ggccggcaccccg

SEQ ID NO: 338354 - RNA, 13 nt, Bordetella pertussis
ggccggcacgccc

SEQ ID NO: 338355 - RNA, 20 nt, Bordetella pertussis
ggccggcacgcccagccgca

SEQ ID NO: 338356 - RNA, 17 nt, Bordetella pertussis
ggccggcacgccgauga

SEQ ID NO: 338357 - RNA, 18 nt, Bordetella pertussis
ggccggcacggccggcca

SEQ ID NO: 338358 - RNA, 19 nt, Bordetella pertussis
ggccggcacggccggccag

SEQ ID NO: 338359 - RNA, 22 nt, Bordetella pertussis
ggccggcacggccggccaggcg

SEQ ID NO: 338360 - RNA, 15 nt, Bordetella pertussis
ggccggcacguccgg

SEQ ID NO: 338361 - RNA, 14 nt, Bordetella pertussis
ggccggcagcgcga

SEQ ID NO: 338362 - RNA, 14 nt, Bordetella pertussis
ggccggcagcggcg

SEQ ID NO: 338363 - RNA, 20 nt, Bordetella pertussis
ggccggcaggccggccagca

SEQ ID NO: 338364 - RNA, 17 nt, Bordetella pertussis
ggccggcaucgcgcuga

SEQ ID NO: 338365 - RNA, 20 nt, Bordetella pertussis
ggccggcaugcgccggcccg

SEQ ID NO: 338366 - RNA, 21 nt, Bordetella pertussis
ggccggcaugcgccggcccgg

SEQ ID NO: 338367 - RNA, 23 nt, Bordetella pertussis
ggccggccaacagcucgcgccag

SEQ ID NO: 338368 - RNA, 14 nt, Bordetella pertussis
ggccggccaggcgc

SEQ ID NO: 338369 - RNA, 15 nt, Bordetella pertussis
ggccggccaggcgcc

SEQ ID NO: 338370 - RNA, 16 nt, Bordetella pertussis
ggccggccaggcgccg

SEQ ID NO: 338371 - RNA, 19 nt, Bordetella pertussis
ggccggccaggcgccgcuc

SEQ ID NO: 338372 - RNA, 15 nt, Bordetella pertussis
ggccggccagggcca

SEQ ID NO: 338373 - RNA, 21 nt, Bordetella pertussis
ggccggccagggccacgccgg

SEQ ID NO: 338374 - RNA, 14 nt, Bordetella pertussis
ggccggcgcgcauc

SEQ ID NO: 338375 - RNA, 13 nt, Bordetella pertussis
ggccggcgcgccg

SEQ ID NO: 338376 - RNA, 18 nt, Bordetella pertussis
ggccggcgcgccgcgccg

SEQ ID NO: 338377 - RNA, 20 nt, Bordetella pertussis
ggccggcgcgccgcgccgcc

SEQ ID NO: 338378 - RNA, 18 nt, Bordetella pertussis
ggccggcgcgccggccug

SEQ ID NO: 338379 - RNA, 16 nt, Bordetella pertussis
ggccggcgcgccugcc

SEQ ID NO: 338380 - RNA, 14 nt, Bordetella pertussis
ggccggcgcgcgca

SEQ ID NO: 338381 - RNA, 15 nt, Bordetella pertussis
ggccggcgcgcggcc

SEQ ID NO: 338382 - RNA, 15 nt, Bordetella pertussis
ggccggcgcggcagc

SEQ ID NO: 338383 - RNA, 16 nt, Bordetella pertussis
ggccggcgcgucgccg

SEQ ID NO: 338384 - RNA, 19 nt, Bordetella pertussis
ggccggcggcacgcugcgc

SEQ ID NO: 338385 - RNA, 23 nt, Bordetella pertussis
ggccggcggcacgcugcgcaggc

SEQ ID NO: 338386 - RNA, 15 nt, Bordetella pertussis
ggccggcggcagccg

SEQ ID NO: 338387 - RNA, 19 nt, Bordetella pertussis
ggccggcggcagccggcca

SEQ ID NO: 338388 - RNA, 22 nt, Bordetella pertussis
ggccggcggcgagcgcggcgcg

SEQ ID NO: 338389 - RNA, 15 nt, Bordetella pertussis
ggccggcggcgauca

SEQ ID NO: 338390 - RNA, 13 nt, Bordetella pertussis
ggccggcggcgcc

SEQ ID NO: 338391 - RNA, 14 nt, Bordetella pertussis
ggccggcggcgccg

SEQ ID NO: 338392 - RNA, 12 nt, Bordetella pertussis
ggccggcggcgu

SEQ ID NO: 338393 - RNA, 18 nt, Bordetella pertussis
ggccggcggccagcgcgc

SEQ ID NO: 338394 - RNA, 13 nt, Bordetella pertussis
ggccggcgggcgu

SEQ ID NO: 338395 - RNA, 14 nt, Bordetella pertussis
ggccggcgggcgua

SEQ ID NO: 338396 - RNA, 15 nt, Bordetella pertussis
ggccggcgggcguac

SEQ ID NO: 338397 - RNA, 13 nt, Bordetella pertussis
ggccggcgggcau

SEQ ID NO: 338398 - RNA, 22 nt, Bordetella pertussis
ggccgggcacgaugcguugcgc

SEQ ID NO: 338399 - RNA, 16 nt, Bordetella pertussis
ggccgggcaggccgcg

SEQ ID NO: 338400 - RNA, 16 nt, Bordetella pertussis
ggccgggcaguccugg

SEQ ID NO: 338401 - RNA, 16 nt, Bordetella pertussis
ggccgggccagcgcga

SEQ ID NO: 338402 - RNA, 13 nt, Bordetella pertussis
ggccgggccggcg

SEQ ID NO: 338403 - RNA, 17 nt, Bordetella pertussis
ggccgggcgccaggcug

SEQ ID NO: 338404 - RNA, 15 nt, Bordetella pertussis
ggccgggcgcccagc

SEQ ID NO: 338405 - RNA, 16 nt, Bordetella pertussis
ggccgggcgcccagcg

SEQ ID NO: 338406 - RNA, 14 nt, Bordetella pertussis
ggccgggccgggca

SEQ ID NO: 338407 - RNA, 15 nt, Bordetella pertussis
ggccgggccguggcg

SEQ ID NO: 338408 - RNA, 12 nt, Bordetella pertussis
ggccgggccuca

SEQ ID NO: 338409 - RNA, 18 nt, Bordetella pertussis
ggccggugcaucggccgg

SEQ ID NO: 338410 - RNA, 18 nt, Bordetella pertussis
ggccggggaagccgccgg

SEQ ID NO: 338411 - RNA, 19 nt, Bordetella pertussis
ggccggggaagccgccggc

SEQ ID NO: 338412 - RNA, 21 nt, Bordetella pertussis
ggccggggaagccgccggcgu

SEQ ID NO: 338413 - RNA, 18 nt, Bordetella pertussis
ggccggugaugcggcgcg

SEQ ID NO: 338414 - RNA, 21 nt, Bordetella pertussis
ggccggugaugcggcgcgccg

SEQ ID NO: 338415 - RNA, 18 nt, Bordetella pertussis
ggccgguggaccagggca

SEQ ID NO: 338416 - RNA, 19 nt, Bordetella pertussis
ggccgguggaccagggcac

SEQ ID NO: 338417 - RNA, 22 nt, Bordetella pertussis
ggccgguucgaugaccugggcc

SEQ ID NO: 338418 - RNA, 23 nt, Bordetella pertussis
ggccguaacccgaguccuugacg

SEQ ID NO: 338419 - RNA, 19 nt, Bordetella pertussis
ggccguagagggucuggcg

SEQ ID NO: 338420 - RNA, 16 nt, Bordetella pertussis
ggccguagcguuggcg

SEQ ID NO: 338421 - RNA, 19 nt, Bordetella pertussis
ggccguauggccguuggcc

SEQ ID NO: 338422 - RNA, 16 nt, Bordetella pertussis
ggccgucaacagcaug

SEQ ID NO: 338423 - RNA, 17 nt, Bordetella pertussis
ggccgucaacggcuugg

SEQ ID NO: 338424 - RNA, 21 nt, Bordetella pertussis
ggccgucaagcgucgauggcg

SEQ ID NO: 338425 - RNA, 17 nt, Bordetella pertussis
ggccgucaagcguucau

SEQ ID NO: 338426 - RNA, 21 nt, Bordetella pertussis
ggccgucaagcguucauggcg

SEQ ID NO: 338427 - RNA, 23 nt, Bordetella pertussis
ggccgucaauaucacgcguacgg

SEQ ID NO: 338428 - RNA, 17 nt, Bordetella pertussis
ggccgucaccgccgccg

SEQ ID NO: 338429 - RNA, 19 nt, Bordetella pertussis
ggccgucaccgccgccgcg

SEQ ID NO: 338430 - RNA, 15 nt, Bordetella pertussis
ggccgucagcagcag

SEQ ID NO: 338431 - RNA, 18 nt, Bordetella pertussis
ggccgucagcagcaggcu

SEQ ID NO: 338432 - RNA, 21 nt, Bordetella pertussis
ggccgucaggcguugcgccgc

SEQ ID NO: 338433 - RNA, 13 nt, Bordetella pertussis
ggccguccggccg

SEQ ID NO: 338434 - RNA, 18 nt, Bordetella pertussis
ggccgucgagcacggggc

SEQ ID NO: 338435 - RNA, 14 nt, Bordetella pertussis
ggccgucgagccgg

SEQ ID NO: 338436 - RNA, 17 nt, Bordetella pertussis
ggccgucgagccgggcg

SEQ ID NO: 338437 - RNA, 18 nt, Bordetella pertussis
ggccgucgagccgggcgc

SEQ ID NO: 338438 - RNA, 22 nt, Bordetella pertussis
ggccgucgagccgguccgccuc

SEQ ID NO: 338439 - RNA, 15 nt, Bordetella pertussis
ggccgucgccgaucg

SEQ ID NO: 338440 - RNA, 13 nt, Bordetella pertussis
ggccgucgccgcc

SEQ ID NO: 338441 - RNA, 14 nt, Bordetella pertussis
ggccgucgccgccc

SEQ ID NO: 338442 - RNA, 15 nt, Bordetella pertussis
ggccgucgccgccca

SEQ ID NO: 338443 - RNA, 20 nt, Bordetella pertussis
ggccgucgccgcccaugcgc

SEQ ID NO: 338444 - RNA, 17 nt, Bordetella pertussis
ggccgucgccuucggcg

SEQ ID NO: 338445 - RNA, 14 nt, Bordetella pertussis
ggccgucggccagg

SEQ ID NO: 338446 - RNA, 14 nt, Bordetella pertussis
ggccgucggcgcug

SEQ ID NO: 338447 - RNA, 15 nt, Bordetella pertussis
ggccgucggcgcugg

SEQ ID NO: 338448 - RNA, 17 nt, Bordetella pertussis
ggccucaaccgcgcgua

SEQ ID NO: 338449 - RNA, 13 nt, Bordetella pertussis
ggccucagcggcc

SEQ ID NO: 338450 - RNA, 18 nt, Bordetella pertussis
ggccucagcggccgcugc

SEQ ID NO: 338451 - RNA, 14 nt, Bordetella pertussis
ggccucaugacggg

SEQ ID NO: 338452 - RNA, 21 nt, Bordetella pertussis
ggccucaugacggggccuuca

SEQ ID NO: 338453 - RNA, 13 nt, Bordetella pertussis
ggccucaucccga

SEQ ID NO: 338454 - RNA, 22 nt, Bordetella pertussis
ggccucaucgagcgccugggcg

SEQ ID NO: 338455 - RNA, 15 nt, Bordetella pertussis
ggccuccagcaucgc

SEQ ID NO: 338456 - RNA, 18 nt, Bordetella pertussis
ggccuccagcaucgccgc

SEQ ID NO: 338457 - RNA, 21 nt, Bordetella pertussis
ggccuccagcaucgccgccag

SEQ ID NO: 338458 - RNA, 22 nt, Bordetella pertussis
ggccuccagcaucgccgccagc

SEQ ID NO: 338459 - RNA, 22 nt, Bordetella pertussis
ggccucgaugguggcgauggca

SEQ ID NO: 338460 - RNA, 19 nt, Bordetella pertussis
ggccucgcccaugcgggcg

SEQ ID NO: 338461 - RNA, 22 nt, Bordetella pertussis
ggccucgcccgaucggccggcc

SEQ ID NO: 338462 - RNA, 17 nt, Bordetella pertussis
ggccucgcccuggcgca

SEQ ID NO: 338463 - RNA, 15 nt, Bordetella pertussis
ggccucgccggccug

SEQ ID NO: 338464 - RNA, 16 nt, Bordetella pertussis
ggccucgccggccugg

SEQ ID NO: 338465 - RNA, 20 nt, Bordetella pertussis
ggccucgccggccuggcgcg

SEQ ID NO: 338466 - RNA, 13 nt, Bordetella pertussis
ggccucgcgcucg

SEQ ID NO: 338467 - RNA, 23 nt, Bordetella pertussis
ggccucgcgcucgcgcucggcca

SEQ ID NO: 338468 - RNA, 15 nt, Bordetella pertussis
ggccucgcggcgcag

SEQ ID NO: 338469 - RNA, 16 nt, Bordetella pertussis
ggccucgcggcgcagc

SEQ ID NO: 338470 - RNA, 17 nt, Bordetella pertussis
ggccucgcugccagggu

SEQ ID NO: 338471 - RNA, 16 nt, Bordetella pertussis
ggccucgcugcgggcg

SEQ ID NO: 338472 - RNA, 17 nt, Bordetella pertussis
ggccucgcugcgggcgg

SEQ ID NO: 338473 - RNA, 19 nt, Bordetella pertussis
ggccucgcugcgggcggcc

SEQ ID NO: 338474 - RNA, 23 nt, Bordetella pertussis
ggccucgcugcgggcggccuggg

SEQ ID NO: 338475 - RNA, 20 nt, Bordetella pertussis
ggccucgcuggagaccggca

SEQ ID NO: 338476 - RNA, 20 nt, Bordetella pertussis
ggccucggccaccuggcgca

SEQ ID NO: 338477 - RNA, 15 nt, Bordetella pertussis
ggccucggccagcug

SEQ ID NO: 338478 - RNA, 14 nt, Bordetella pertussis
ggccucggccggca

SEQ ID NO: 338479 - RNA, 15 nt, Bordetella pertussis
ggccucggccggcag

SEQ ID NO: 338480 - RNA, 14 nt, Bordetella pertussis
ggccucgcgggccu

SEQ ID NO: 338481 - RNA, 18 nt, Bordetella pertussis
ggccucgcgggccuuggc

SEQ ID NO: 338482 - RNA, 17 nt, Bordetella pertussis
ggccucggucucgugcg

SEQ ID NO: 338483 - RNA, 23 nt, Bordetella pertussis
ggccucguaggccaucacaucgc

SEQ ID NO: 338484 - RNA, 19 nt, Bordetella pertussis
ggccucguaguguucgaug

SEQ ID NO: 338485 - RNA, 19 nt, Bordetella pertussis
ggccucguccucgucggcg

SEQ ID NO: 338486 - RNA, 19 nt, Bordetella pertussis
ggccucgucgaccacgccg

SEQ ID NO: 338487 - RNA, 18 nt, Bordetella pertussis
ggccugcaaugcggccag

SEQ ID NO: 338488 - RNA, 12 nt, Bordetella pertussis
ggccugcaccgg

SEQ ID NO: 338489 - RNA, 14 nt, Bordetella pertussis
ggccugcacgacgg

SEQ ID NO: 338490 - RNA, 18 nt, Bordetella pertussis
ggccugcaggaagccugc

SEQ ID NO: 338491 - RNA, 20 nt, Bordetella pertussis
ggccugcaggaagccugcgc

SEQ ID NO: 338492 - RNA, 19 nt, Bordetella pertussis
ggccugcaggugccgccgg

SEQ ID NO: 338493 - RNA, 20 nt, Bordetella pertussis
ggccugcaguucggccgcca

SEQ ID NO: 338494 - RNA, 21 nt, Bordetella pertussis
ggccugcaguucggccgccag

SEQ ID NO: 338495 - RNA, 20 nt, Bordetella pertussis
ggccugcagcaugaccgaca

SEQ ID NO: 338496 - RNA, 21 nt, Bordetella pertussis
ggccugccaccgacaagccgg

SEQ ID NO: 338497 - RNA, 13 nt, Bordetella pertussis
ggccugccagccu

SEQ ID NO: 338498 - RNA, 19 nt, Bordetella pertussis
ggccugccauccggccgca

SEQ ID NO: 338499 - RNA, 15 nt, Bordetella pertussis
ggccugcccgcaucc

SEQ ID NO: 338500 - RNA, 17 nt, Bordetella pertussis
ggccugcccgcauccga

SEQ ID NO: 338501 - RNA, 17 nt, Bordetella pertussis
ggccugcccgucgggca

SEQ ID NO: 338502 - RNA, 14 nt, Bordetella pertussis
ggccugccgcgccg

SEQ ID NO: 338503 - RNA, 16 nt, Bordetella pertussis
ggccugccgcgccgac

SEQ ID NO: 338504 - RNA, 20 nt, Bordetella pertussis
ggccugccgcgccgaccggc

SEQ ID NO: 338505 - RNA, 21 nt, Bordetella pertussis
ggccugccgcgccgaccggcc

SEQ ID NO: 338506 - RNA, 14 nt, Bordetella pertussis
ggccugccggcgca

SEQ ID NO: 338507 - RNA, 15 nt, Bordetella pertussis
ggccugccggcgcac

SEQ ID NO: 338508 - RNA, 14 nt, Bordetella pertussis
ggccugcgccaccg

SEQ ID NO: 338509 - RNA, 13 nt, Bordetella pertussis
ggccugcgccagc

SEQ ID NO: 338510 - RNA, 21 nt, Bordetella pertussis
ggccugcgccagcuccagccg

SEQ ID NO: 338511 - RNA, 13 nt, Bordetella pertussis
ggccugcgccgcc

SEQ ID NO: 338512 - RNA, 16 nt, Bordetella pertussis
ggccugcgccgccgcg

SEQ ID NO: 338513 - RNA, 17 nt, Bordetella pertussis
ggccugcgccgccgcgc

SEQ ID NO: 338514 - RNA, 18 nt, Bordetella pertussis
ggccugcgccgccgcgcg

SEQ ID NO: 338515 - RNA, 14 nt, Bordetella pertussis
ggccugcgccggca

SEQ ID NO: 338516 - RNA, 17 nt, Bordetella pertussis
ggccugcgccggcaugg

SEQ ID NO: 338517 - RNA, 16 nt, Bordetella pertussis
ggccugcgcgccgacc

SEQ ID NO: 338518 - RNA, 18 nt, Bordetella pertussis
ggccugcgcgccgaccag

SEQ ID NO: 338519 - RNA, 14 nt, Bordetella pertussis
ggccugcgcgccgg

SEQ ID NO: 338520 - RNA, 13 nt, Bordetella pertussis
ggccugcggcgcc

SEQ ID NO: 338521 - RNA, 16 nt, Bordetella pertussis
ggccugcggcgccagc

SEQ ID NO: 338522 - RNA, 17 nt, Bordetella pertussis
ggccugcggcgccagcg

SEQ ID NO: 338523 - RNA, 20 nt, Bordetella pertussis
ggccugcggcgccagcgccg

SEQ ID NO: 338524 - RNA, 20 nt, Bordetella pertussis
ggccugcgggccgggcaggc

SEQ ID NO: 338525 - RNA, 15 nt, Bordetella pertussis
ggccugcgggcgccg

SEQ ID NO: 338526 - RNA, 16 nt, Bordetella pertussis
ggccugcgggcgccgc

SEQ ID NO: 338527 - RNA, 17 nt, Bordetella pertussis
ggccugcgggcgccgcg

SEQ ID NO: 338528 - RNA, 13 nt, Bordetella pertussis
ggccugcgggcug

SEQ ID NO: 338529 - RNA, 19 nt, Bordetella pertussis
ggccugcgggugcgccugc

SEQ ID NO: 338530 - RNA, 14 nt, Bordetella pertussis
ggccuggguggccu

SEQ ID NO: 338531 - RNA, 16 nt, Bordetella pertussis
ggccuggguggccugg

SEQ ID NO: 338532 - RNA, 17 nt, Bordetella pertussis
ggccuggucagcgccga

SEQ ID NO: 338533 - RNA, 18 nt, Bordetella pertussis
ggccuggucagcgccgac

SEQ ID NO: 338534 - RNA, 16 nt, Bordetella pertussis
ggccugguccgccgcg

SEQ ID NO: 338535 - RNA, 19 nt, Bordetella pertussis
ggccuggucgagcgggcgc

SEQ ID NO: 338536 - RNA, 21 nt, Bordetella pertussis
ggccuggucgagcgggcgcca

SEQ ID NO: 338537 - RNA, 20 nt, Bordetella pertussis
ggccuggucggggucggcca

SEQ ID NO: 338538 - RNA, 16 nt, Bordetella pertussis
ggccugguuggccgcc

SEQ ID NO: 338539 - RNA, 17 nt, Bordetella pertussis
ggccugguuggccgccu

SEQ ID NO: 338540 - RNA, 19 nt, Bordetella pertussis
ggccugguuggccgccugg

SEQ ID NO: 338541 - RNA, 19 nt, Bordetella pertussis
ggccugucacaccccacca

SEQ ID NO: 338542 - RNA, 13 nt, Bordetella pertussis
ggccuguccggca

SEQ ID NO: 338543 - RNA, 16 nt, Bordetella pertussis
ggccugucugguggcg

SEQ ID NO: 338544 - RNA, 20 nt, Bordetella pertussis
ggccuuucucaaggccgaau

SEQ ID NO: 338545 - RNA, 19 nt, Bordetella pertussis
ggccuuuuuuugcggcacg

SEQ ID NO: 338546 - RNA, 20 nt, Bordetella pertussis
ggccuuuuuuugcggcacgg

SEQ ID NO: 338547 - RNA, 16 nt, Bordetella pertussis
ggcgaaacuggccgac

SEQ ID NO: 338548 - RNA, 22 nt, Bordetella pertussis
ggcgaaauacaccuuguuggcg

SEQ ID NO: 338549 - RNA, 16 nt, Bordetella pertussis
ggcgaacauggccgag

SEQ ID NO: 338550 - RNA, 17 nt, Bordetella pertussis
ggcgaacauggccgaga

SEQ ID NO: 338551 - RNA, 13 nt, Bordetella pertussis
ggcgaaccgcggc

SEQ ID NO: 338552 - RNA, 15 nt, Bordetella pertussis
ggcgaaccgcggcgc

SEQ ID NO: 338553 - RNA, 19 nt, Bordetella pertussis
ggcgaaccgcggcgcaggu

SEQ ID NO: 338554 - RNA, 19 nt, Bordetella pertussis
ggcgaacgggguggccggc

SEQ ID NO: 338555 - RNA, 18 nt, Bordetella pertussis
ggcgaacgugcgcgccag

SEQ ID NO: 338556 - RNA, 19 nt, Bordetella pertussis
ggcgaacgugcgcgccagc

SEQ ID NO: 338557 - RNA, 17 nt, Bordetella pertussis
ggcgaacugggcgucgu

SEQ ID NO: 338558 - RNA, 20 nt, Bordetella pertussis
ggcgaagaacaccgccgcgc

SEQ ID NO: 338559 - RNA, 22 nt, Bordetella pertussis
ggcgaagaacaccgccgcgccg

SEQ ID NO: 338560 - RNA, 20 nt, Bordetella pertussis
ggcgaagacgauggcgaucu

SEQ ID NO: 338561 - RNA, 13 nt, Bordetella pertussis
ggcgaagccggca

SEQ ID NO: 338562 - RNA, 18 nt, Bordetella pertussis
ggcgaagccuugcgcggc

SEQ ID NO: 338563 - RNA, 20 nt, Bordetella pertussis
ggcgaagccuugcgcggcca

SEQ ID NO: 338564 - RNA, 22 nt, Bordetella pertussis
ggcgaagcuguccuucguggcg

SEQ ID NO: 338565 - RNA, 15 nt, Bordetella pertussis
ggcgaaggccgccgc

SEQ ID NO: 338566 - RNA, 14 nt, Bordetella pertussis
ggcgaaggcgucgg

SEQ ID NO: 338567 - RNA, 18 nt, Bordetella pertussis
ggcgaagguggcacauca

SEQ ID NO: 338568 - RNA, 21 nt, Bordetella pertussis
ggcgaagguggcacaucagcg

SEQ ID NO: 338569 - RNA, 21 nt, Bordetella pertussis
ggcgaaguccugcaugccaug

SEQ ID NO: 338570 - RNA, 19 nt, Bordetella pertussis
ggcgaagugcccgcuggcc

SEQ ID NO: 338571 - RNA, 14 nt, Bordetella pertussis
ggcgaauccaccgg

SEQ ID NO: 338572 - RNA, 23 nt, Bordetella pertussis
ggcgaauccgcaacccagcagcg

SEQ ID NO: 338573 - RNA, 15 nt, Bordetella pertussis
ggcgaaugccggccg

SEQ ID NO: 338574 - RNA, 19 nt, Bordetella pertussis
ggcgaaugccugguaggcg

SEQ ID NO: 338575 - RNA, 14 nt, Bordetella pertussis
ggcgaauggccacg

SEQ ID NO: 338576 - RNA, 16 nt, Bordetella pertussis
ggcgaugcgcgagcgc

SEQ ID NO: 338577 - RNA, 16 nt, Bordetella pertussis
ggcgaugcggcggccg

SEQ ID NO: 338578 - RNA, 14 nt, Bordetella pertussis
ggcgaugcgggcgg

SEQ ID NO: 338579 - RNA, 23 nt, Bordetella pertussis
ggcgaugcucacgcccaguccca

SEQ ID NO: 338580 - RNA, 14 nt, Bordetella pertussis
ggcgauggcaucgg

SEQ ID NO: 338581 - RNA, 13 nt, Bordetella pertussis
ggcgauggcccgg

SEQ ID NO: 338582 - RNA, 22 nt, Bordetella pertussis
ggcgauggcccgguaggccacg

SEQ ID NO: 338583 - RNA, 12 nt, Bordetella pertussis
ggcgauggccgc

SEQ ID NO: 338584 - RNA, 15 nt, Bordetella pertussis
ggcgauggccgccag

SEQ ID NO: 338585 - RNA, 20 nt, Bordetella pertussis
ggcgauggccgggagcggcc

SEQ ID NO: 338586 - RNA, 21 nt, Bordetella pertussis
ggcgauggccgggagcggcca

SEQ ID NO: 338587 - RNA, 18 nt, Bordetella pertussis
ggcgauggcgcgcgccac

SEQ ID NO: 338588 - RNA, 14 nt, Bordetella pertussis
ggcgauggcgcggc

SEQ ID NO: 338589 - RNA, 15 nt, Bordetella pertussis
ggcgauggcgcggcc

SEQ ID NO: 338590 - RNA, 16 nt, Bordetella pertussis
ggcgauggcgcgucgc

SEQ ID NO: 338591 - RNA, 20 nt, Bordetella pertussis
ggcgauggcgcgucgccgcg

SEQ ID NO: 338592 - RNA, 14 nt, Bordetella pertussis
ggcgauggcguuga

SEQ ID NO: 338593 - RNA, 10 nt, Bordetella pertussis
ggcgauggcu

SEQ ID NO: 338594 - RNA, 14 nt, Bordetella pertussis
ggcgaugggcaccu

SEQ ID NO: 338595 - RNA, 14 nt, Bordetella pertussis
ggcgauguccagcg

SEQ ID NO: 338596 - RNA, 23 nt, Bordetella pertussis
ggcgauguccugguugccgagga

SEQ ID NO: 338597 - RNA, 20 nt, Bordetella pertussis
ggcgauguggcgcgccaugu

SEQ ID NO: 338598 - RNA, 15 nt, Bordetella pertussis
ggcgauguucacgcg

SEQ ID NO: 338599 - RNA, 23 nt, Bordetella pertussis
ggcgauuccgccaacucgcucca

SEQ ID NO: 338600 - RNA, 16 nt, Bordetella pertussis
ggcgcaacgccggccg

SEQ ID NO: 338601 - RNA, 22 nt, Bordetella pertussis
ggcgcaacgccggccgccaugg

SEQ ID NO: 338602 - RNA, 16 nt, Bordetella pertussis
ggcgcaaccggcccga

SEQ ID NO: 338603 - RNA, 16 nt, Bordetella pertussis
ggcgcaacgucgaaca

SEQ ID NO: 338604 - RNA, 23 nt, Bordetella pertussis
ggcgcaacgucgaacagcuucuc

SEQ ID NO: 338605 - RNA, 16 nt, Bordetella pertussis
ggcgcaagacgcggca

SEQ ID NO: 338606 - RNA, 14 nt, Bordetella pertussis
ggcgcaagcgcgcc

SEQ ID NO: 338607 - RNA, 15 nt, Bordetella pertussis
ggcgcaagcgcgccg

SEQ ID NO: 338608 - RNA, 16 nt, Bordetella pertussis
ggcgcaagcgcgccga

SEQ ID NO: 338609 - RNA, 20 nt, Bordetella pertussis
ggcgcaaggcaugcgccagc

SEQ ID NO: 338610 - RNA, 21 nt, Bordetella pertussis
ggcgcaaggcaugcgccagcg

SEQ ID NO: 338611 - RNA, 17 nt, Bordetella pertussis
ggcgcaaggcgucgggc

SEQ ID NO: 338612 - RNA, 22 nt, Bordetella pertussis
ggcgcaaguguggcgcaccgcg

SEQ ID NO: 338613 - RNA, 19 nt, Bordetella pertussis
ggcgcaauaggccgcgaug

SEQ ID NO: 338614 - RNA, 20 nt, Bordetella pertussis
ggcgcacaaccugguacggc

SEQ ID NO: 338615 - RNA, 18 nt, Bordetella pertussis
ggcgcacaccaucagcug

SEQ ID NO: 338616 - RNA, 20 nt, Bordetella pertussis
ggcgcaccugguccauggcg

SEQ ID NO: 338617 - RNA, 13 nt, Bordetella pertussis
ggcgcacgccgcg

SEQ ID NO: 338618 - RNA, 18 nt, Bordetella pertussis
ggcgcacgccgcgccggc

SEQ ID NO: 338619 - RNA, 17 nt, Bordetella pertussis
ggcgcacgccggaccag

SEQ ID NO: 338620 - RNA, 14 nt, Bordetella pertussis
ggcgcacgccgggc

SEQ ID NO: 338621 - RNA, 17 nt, Bordetella pertussis
ggcgcacgccgggcgcg

SEQ ID NO: 338622 - RNA, 13 nt, Bordetella pertussis
ggcgcacgccugu

SEQ ID NO: 338623 - RNA, 12 nt, Bordetella pertussis
ggcgcacgcccc

SEQ ID NO: 338624 - RNA, 21 nt, Bordetella pertussis
ggcgcagauccucgaacaggc

SEQ ID NO: 338625 - RNA, 15 nt, Bordetella pertussis
ggcgcagcaccaggc

SEQ ID NO: 338626 - RNA, 16 nt, Bordetella pertussis
ggcgcagcacgccgcg

SEQ ID NO: 338627 - RNA, 17 nt, Bordetella pertussis
ggcgcagcacgccgcgc

SEQ ID NO: 338628 - RNA, 19 nt, Bordetella pertussis
ggcgcagauggcggcgaug

SEQ ID NO: 338629 - RNA, 16 nt, Bordetella pertussis
ggcgcagaugggcggc

SEQ ID NO: 338630 - RNA, 20 nt, Bordetella pertussis
ggcgcagaugggcggcgacg

SEQ ID NO: 338631 - RNA, 20 nt, Bordetella pertussis
ggcgcagcaaggcgcgccac

SEQ ID NO: 338632 - RNA, 12 nt, Bordetella pertussis
ggcgcagcaggc

SEQ ID NO: 338633 - RNA, 16 nt, Bordetella pertussis
ggcgcagcaggcgcgc

SEQ ID NO: 338634 - RNA, 23 nt, Bordetella pertussis
ggcgcagcaucuugcgccgcugc

SEQ ID NO: 338635 - RNA, 12 nt, Bordetella pertussis
ggcgcagcauga

SEQ ID NO: 338636 - RNA, 21 nt, Bordetella pertussis
ggcgcagcauuucggcgccgc

SEQ ID NO: 338637 - RNA, 14 nt, Bordetella pertussis
ggcgcagcccagcg

SEQ ID NO: 338638 - RNA, 23 nt, Bordetella pertussis
ggcgcagcccagcgcgaugucgc

SEQ ID NO: 338639 - RNA, 18 nt, Bordetella pertussis
ggcgcagcagcgccggca

SEQ ID NO: 338640 - RNA, 14 nt, Bordetella pertussis
ggcgcagccgcgcg

SEQ ID NO: 338641 - RNA, 14 nt, Bordetella pertussis
ggcgcagccggccg

SEQ ID NO: 338642 - RNA, 16 nt, Bordetella pertussis
ggcgcagcgcccaggc

SEQ ID NO: 338643 - RNA, 13 nt, Bordetella pertussis
ggcgcagcgcggc

SEQ ID NO: 338644 - RNA, 15 nt, Bordetella pertussis
ggcgcagcgcguccu

SEQ ID NO: 338645 - RNA, 18 nt, Bordetella pertussis
ggcgcagcggcggcgcgg

SEQ ID NO: 338646 - RNA, 21 nt, Bordetella pertussis
ggcgcagcuccgggucgagcg

SEQ ID NO: 338647 - RNA, 22 nt, Bordetella pertussis
ggcgcagcuccgggucgagcgc

SEQ ID NO: 338648 - RNA, 16 nt, Bordetella pertussis
ggcgcaggccagcgcc

SEQ ID NO: 338649 - RNA, 17 nt, Bordetella pertussis
ggcgcaggccagcgccg

SEQ ID NO: 338650 - RNA, 18 nt, Bordetella pertussis
ggcgcaggccagcgccgc

SEQ ID NO: 338651 - RNA, 23 nt, Bordetella pertussis
ggcgcaggaugcgcuggccggcc

SEQ ID NO: 338652 - RNA, 13 nt, Bordetella pertussis
ggcgcaggccgcc

SEQ ID NO: 338653 - RNA, 15 nt, Bordetella pertussis
ggcgcaggccgccac

SEQ ID NO: 338654 - RNA, 16 nt, Bordetella pertussis
ggcgcaggccgcgccg

SEQ ID NO: 338655 - RNA, 18 nt, Bordetella pertussis
ggcgcaggccgcgccggc

SEQ ID NO: 338656 - RNA, 19 nt, Bordetella pertussis
ggcgcaggccgcgccggcu

SEQ ID NO: 338657 - RNA, 14 nt, Bordetella pertussis
ggcgcaggccggcg

SEQ ID NO: 338658 - RNA, 14 nt, Bordetella pertussis
ggcgcaggccugcg

SEQ ID NO: 338659 - RNA, 16 nt, Bordetella pertussis
ggcgcaggcgcgccag

SEQ ID NO: 338660 - RNA, 16 nt, Bordetella pertussis
ggcgcaggcgcgcgcc

SEQ ID NO: 338661 - RNA, 13 nt, Bordetella pertussis
ggcgcaggcgcgc

SEQ ID NO: 338662 - RNA, 19 nt, Bordetella pertussis
ggcgcagguccaccgccac

SEQ ID NO: 338663 - RNA, 17 nt, Bordetella pertussis
ggcgcaguaucuggugc

SEQ ID NO: 338664 - RNA, 20 nt, Bordetella pertussis
ggcgcaguaucuggugcgcg

SEQ ID NO: 338665 - RNA, 14 nt, Bordetella pertussis
ggcgcagucgagca

SEQ ID NO: 338666 - RNA, 21 nt, Bordetella pertussis
ggcgcagucgagcaccgcgcg

SEQ ID NO: 338667 - RNA, 22 nt, Bordetella pertussis
ggcgcagucgagcaccgcgcgg

SEQ ID NO: 338668 - RNA, 15 nt, Bordetella pertussis
ggcgcaucagcgcgc

SEQ ID NO: 338669 - RNA, 17 nt, Bordetella pertussis
ggcgcaucagcgcgccc

SEQ ID NO: 338670 - RNA, 19 nt, Bordetella pertussis
ggcgcaucagcgcgcccgc

SEQ ID NO: 338671 - RNA, 21 nt, Bordetella pertussis
ggcgcaucagcuuggccacca

SEQ ID NO: 338672 - RNA, 16 nt, Bordetella pertussis
ggcgcaucgacagcgc

SEQ ID NO: 338673 - RNA, 15 nt, Bordetella pertussis
ggcgcaucggcgcca

SEQ ID NO: 338674 - RNA, 17 nt, Bordetella pertussis
ggcgcaucggcgccagu

SEQ ID NO: 338675 - RNA, 15 nt, Bordetella pertussis
ggcgcaugacgaggu

SEQ ID NO: 338676 - RNA, 21 nt, Bordetella pertussis
ggcgcaugacggcgucgagca

SEQ ID NO: 338677 - RNA, 17 nt, Bordetella pertussis
ggcgcaugagccggcag

SEQ ID NO: 338678 - RNA, 21 nt, Bordetella pertussis
ggcgcaugauggccggccugc

SEQ ID NO: 338679 - RNA, 14 nt, Bordetella pertussis
ggcgcaugccacca

SEQ ID NO: 338680 - RNA, 15 nt, Bordetella pertussis
ggcgcaugcugcgcg

SEQ ID NO: 338681 - RNA, 20 nt, Bordetella pertussis
ggcgcauguccgccacgccg

SEQ ID NO: 338682 - RNA, 14 nt, Bordetella pertussis
ggcgcauucgccgg

SEQ ID NO: 338683 - RNA, 17 nt, Bordetella pertussis
ggcgcauugccgucggc

SEQ ID NO: 338684 - RNA, 22 nt, Bordetella pertussis
ggcgcauugccgucggccgcgc

SEQ ID NO: 338685 - RNA, 22 nt, Bordetella pertussis
ggcgccaccccguagcgcaucg

SEQ ID NO: 338686 - RNA, 19 nt, Bordetella pertussis
ggcgccaccuucgccgcgc

SEQ ID NO: 338687 - RNA, 21 nt, Bordetella pertussis
ggcgccaccuucgccgcgcac

SEQ ID NO: 338688 - RNA, 15 nt, Bordetella pertussis
ggcgccacggcuugc

SEQ ID NO: 338689 - RNA, 23 nt, Bordetella pertussis
ggcgccacugccaggcgccccac

SEQ ID NO: 338690 - RNA, 17 nt, Bordetella pertussis
ggcgccagaugcgccgc

SEQ ID NO: 338691 - RNA, 14 nt, Bordetella pertussis
ggcgccagcagcac

SEQ ID NO: 338692 - RNA, 17 nt, Bordetella pertussis
ggcgccagcagcgggcu

SEQ ID NO: 338693 - RNA, 17 nt, Bordetella pertussis
ggcgccagcccgcccgc

SEQ ID NO: 338694 - RNA, 15 nt, Bordetella pertussis
ggcgccagcaugcgc

SEQ ID NO: 338695 - RNA, 19 nt, Bordetella pertussis
ggcgccagccgcuccagga

SEQ ID NO: 338696 - RNA, 13 nt, Bordetella pertussis
ggcgccagcggca

SEQ ID NO: 338697 - RNA, 16 nt, Bordetella pertussis
ggcgccaucgcgguau

SEQ ID NO: 338698 - RNA, 17 nt, Bordetella pertussis
ggcgccaugaucgccgg

SEQ ID NO: 338699 - RNA, 19 nt, Bordetella pertussis
ggcgccaugaucgccggca

SEQ ID NO: 338700 - RNA, 14 nt, Bordetella pertussis
ggcgccaugccgcg

SEQ ID NO: 338701 - RNA, 17 nt, Bordetella pertussis
ggcgccaugcgcaccac

SEQ ID NO: 338702 - RNA, 16 nt, Bordetella pertussis
ggcgccaugcuggccg

SEQ ID NO: 338703 - RNA, 21 nt, Bordetella pertussis
ggcgccaugcuggccgccgcg

SEQ ID NO: 338704 - RNA, 19 nt, Bordetella pertussis
ggcgccauucuucgccgau

SEQ ID NO: 338705 - RNA, 15 nt, Bordetella pertussis
ggcgccaugcgcccg

SEQ ID NO: 338706 - RNA, 16 nt, Bordetella pertussis
ggcgcccacggccgca

SEQ ID NO: 338707 - RNA, 19 nt, Bordetella pertussis
ggcgcccacggccgcaugc

SEQ ID NO: 338708 - RNA, 13 nt, Bordetella pertussis
ggcgcccacgccg

SEQ ID NO: 338709 - RNA, 14 nt, Bordetella pertussis
ggcgcccacgccga

SEQ ID NO: 338710 - RNA, 14 nt, Bordetella pertussis
ggcgcccagcgcca

SEQ ID NO: 338711 - RNA, 21 nt, Bordetella pertussis
ggcgcccagcgcgucggccag

SEQ ID NO: 338712 - RNA, 16 nt, Bordetella pertussis
ggcgcccagcuggcgc

SEQ ID NO: 338713 - RNA, 17 nt, Bordetella pertussis
ggcgcccagcuggcgcc

SEQ ID NO: 338714 - RNA, 20 nt, Bordetella pertussis
ggcgcccaggcccagcgcgc

SEQ ID NO: 338715 - RNA, 12 nt, Bordetella pertussis
ggcgcccaggua

SEQ ID NO: 338716 - RNA, 20 nt, Bordetella pertussis
ggcgcccaucgcggucaucg

SEQ ID NO: 338717 - RNA, 14 nt, Bordetella pertussis
ggcgcccauuccga

SEQ ID NO: 338718 - RNA, 18 nt, Bordetella pertussis
ggcgccccacccggguac

SEQ ID NO: 338719 - RNA, 14 nt, Bordetella pertussis
ggcgccccaggcgu

SEQ ID NO: 338720 - RNA, 13 nt, Bordetella pertussis
ggcgcccccagca

SEQ ID NO: 338721 - RNA, 22 nt, Bordetella pertussis
ggcgccccgaucggcgccgcgc

SEQ ID NO: 338722 - RNA, 18 nt, Bordetella pertussis
ggcgcccccgcggcgccc

SEQ ID NO: 338723 - RNA, 17 nt, Bordetella pertussis
ggcgcccgacggcgccg

SEQ ID NO: 338724 - RNA, 16 nt, Bordetella pertussis
ggcgcccgacggcgcg

SEQ ID NO: 338725 - RNA, 13 nt, Bordetella pertussis
ggcgcccgcaugg

SEQ ID NO: 338726 - RNA, 19 nt, Bordetella pertussis
ggcgcccgccgccgggcgc

SEQ ID NO: 338727 - RNA, 20 nt, Bordetella pertussis
ggcgcccgccgccgggcgcg

SEQ ID NO: 338728 - RNA, 21 nt, Bordetella pertussis
ggcgcccgccgccgggcgcgc

SEQ ID NO: 338729 - RNA, 15 nt, Bordetella pertussis
ggcgcccgcgcaugc

SEQ ID NO: 338730 - RNA, 17 nt, Bordetella pertussis
ggcgcccgcgcgcgagc

SEQ ID NO: 338731 - RNA, 22 nt, Bordetella pertussis
ggcgcccgcgcgcgagcugcgc

SEQ ID NO: 338732 - RNA, 12 nt, Bordetella pertussis
ggcgcccgcugc

SEQ ID NO: 338733 - RNA, 12 nt, Bordetella pertussis
ggcgcccggccg

SEQ ID NO: 338734 - RNA, 13 nt, Bordetella pertussis
ggcgcccggccgg

SEQ ID NO: 338735 - RNA, 15 nt, Bordetella pertussis
ggcgcccggccggcc

SEQ ID NO: 338736 - RNA, 14 nt, Bordetella pertussis
ggcgcccggcggcg

SEQ ID NO: 338737 - RNA, 15 nt, Bordetella pertussis
ggcgcccggcggcgc

SEQ ID NO: 338738 - RNA, 16 nt, Bordetella pertussis
ggcgcccggcggcgcg

SEQ ID NO: 338739 - RNA, 16 nt, Bordetella pertussis
ggcgcccggcgugacg

SEQ ID NO: 338740 - RNA, 14 nt, Bordetella pertussis
ggcgcccgggcugc

SEQ ID NO: 338741 - RNA, 13 nt, Bordetella pertussis
ggcgcccugcgcg

SEQ ID NO: 338742 - RNA, 15 nt, Bordetella pertussis
ggcgcccugcagggc

SEQ ID NO: 338743 - RNA, 20 nt, Bordetella pertussis
ggcgccgaaauuggcgacgu

SEQ ID NO: 338744 - RNA, 19 nt, Bordetella pertussis
ggcgccgaaggcggcgccg

SEQ ID NO: 338745 - RNA, 18 nt, Bordetella pertussis
ggcgccgacaacggcgug

SEQ ID NO: 338746 - RNA, 21 nt, Bordetella pertussis
ggcgccgaccgggccgaccag

SEQ ID NO: 338747 - RNA, 23 nt, Bordetella pertussis
ggcgccgaccgggccgaccaggc

SEQ ID NO: 338748 - RNA, 17 nt, Bordetella pertussis
ggcgccgacccugcccg

SEQ ID NO: 338749 - RNA, 18 nt, Bordetella pertussis
ggcgccgacccugcccgg

SEQ ID NO: 338750 - RNA, 14 nt, Bordetella pertussis
ggcgccgacgcgcu

SEQ ID NO: 338751 - RNA, 17 nt, Bordetella pertussis
ggcgccgacgcgcuggc

SEQ ID NO: 338752 - RNA, 15 nt, Bordetella pertussis
ggcgccgacggcgcc

SEQ ID NO: 338753 - RNA, 19 nt, Bordetella pertussis
ggcgccgacggcgcccugc

SEQ ID NO: 338754 - RNA, 13 nt, Bordetella pertussis
ggcgccgagaugg

SEQ ID NO: 338755 - RNA, 15 nt, Bordetella pertussis
ggcgccgagggccgc

SEQ ID NO: 338756 - RNA, 17 nt, Bordetella pertussis
ggcgccgagggccgcgc

SEQ ID NO: 338757 - RNA, 15 nt, Bordetella pertussis
ggcgccgaucagcag

SEQ ID NO: 338758 - RNA, 18 nt, Bordetella pertussis
ggcgccgauccagcccac

SEQ ID NO: 338759 - RNA, 13 nt, Bordetella pertussis
ggcgccgauccgg

SEQ ID NO: 338760 - RNA, 18 nt, Bordetella pertussis
ggcgccgauccggcgcag

SEQ ID NO: 338761 - RNA, 19 nt, Bordetella pertussis
ggcgccgauccggcgcaga

SEQ ID NO: 338762 - RNA, 20 nt, Bordetella pertussis
ggcgccgauggcgccgcugu

SEQ ID NO: 338763 - RNA, 19 nt, Bordetella pertussis
ggcgccgauuucgccgccg

SEQ ID NO: 338764 - RNA, 18 nt, Bordetella pertussis
ggcgccgcaacgccgggc

SEQ ID NO: 338765 - RNA, 21 nt, Bordetella pertussis
ggcgccgcacaucgucgacgu

SEQ ID NO: 338766 - RNA, 13 nt, Bordetella pertussis
ggcgccgcacccg

SEQ ID NO: 338767 - RNA, 19 nt, Bordetella pertussis
ggcgccgcacgccggucgc

SEQ ID NO: 338768 - RNA, 23 nt, Bordetella pertussis
ggcgccgccccgucaucgggugc

SEQ ID NO: 338769 - RNA, 12 nt, Bordetella pertussis
ggcgccgccggc

SEQ ID NO: 338770 - RNA, 15 nt, Bordetella pertussis
ggcgccgccggccau

SEQ ID NO: 338771 - RNA, 17 nt, Bordetella pertussis
ggcgccgccggccauca

SEQ ID NO: 338772 - RNA, 18 nt, Bordetella pertussis
ggcgccgccggccaucag

SEQ ID NO: 338773 - RNA, 19 nt, Bordetella pertussis
ggcgccgccggcggccugg

SEQ ID NO: 338774 - RNA, 20 nt, Bordetella pertussis
ggcgccgccggcggccugga

SEQ ID NO: 338775 - RNA, 22 nt, Bordetella pertussis
ggcgccgccgugcgcgggcgcg

SEQ ID NO: 338776 - RNA, 18 nt, Bordetella pertussis
ggcgccgccucaggccgg

SEQ ID NO: 338777 - RNA, 11 nt, Bordetella pertussis
ggcgccgcgca

SEQ ID NO: 338778 - RNA, 12 nt, Bordetella pertussis
ggcgccgcgcac

SEQ ID NO: 338779 - RNA, 13 nt, Bordetella pertussis
ggcgccgcgcacg

SEQ ID NO: 338780 - RNA, 14 nt, Bordetella pertussis
ggcgccgcgcacgc

SEQ ID NO: 338781 - RNA, 13 nt, Bordetella pertussis
ggcgccgcgcccg

SEQ ID NO: 338782 - RNA, 22 nt, Bordetella pertussis
ggcgccgcgcccgcuugcggcc

SEQ ID NO: 338783 - RNA, 12 nt, Bordetella pertussis
ggcgccgcgccg

SEQ ID NO: 338784 - RNA, 13 nt, Bordetella pertussis
ggcgccgcgccgg

SEQ ID NO: 338785 - RNA, 19 nt, Bordetella pertussis
ggcgccgcgcgccauccgg

SEQ ID NO: 338786 - RNA, 23 nt, Bordetella pertussis
ggcgccgcgcgccauccggcgca

SEQ ID NO: 338787 - RNA, 15 nt, Bordetella pertussis
ggcgccgcgcgccgc

SEQ ID NO: 338788 - RNA, 16 nt, Bordetella pertussis
ggcgccgcgcggucgc

SEQ ID NO: 338789 - RNA, 20 nt, Bordetella pertussis
ggcgccgcgcggucgccauc

SEQ ID NO: 338790 - RNA, 18 nt, Bordetella pertussis
ggcgccgcgcucgcgcca

SEQ ID NO: 338791 - RNA, 21 nt, Bordetella pertussis
ggcgccgcgcucgcgccaggc

SEQ ID NO: 338792 - RNA, 13 nt, Bordetella pertussis
ggcgccgcggccg

SEQ ID NO: 338793 - RNA, 23 nt, Bordetella pertussis
ggcgccgcguucacgccggcgcg

SEQ ID NO: 338794 - RNA, 16 nt, Bordetella pertussis
ggcgccggacugggcg

SEQ ID NO: 338795 - RNA, 17 nt, Bordetella pertussis
ggcgccggcacgacgau

SEQ ID NO: 338796 - RNA, 11 nt, Bordetella pertussis
ggcgccggcca

SEQ ID NO: 338797 - RNA, 14 nt, Bordetella pertussis
ggcgccggccagcg

SEQ ID NO: 338798 - RNA, 17 nt, Bordetella pertussis
ggcgccggccagcgcgc

SEQ ID NO: 338799 - RNA, 19 nt, Bordetella pertussis
ggcgccggccaggaugagg

SEQ ID NO: 338800 - RNA, 11 nt, Bordetella pertussis
ggcgccggccg

SEQ ID NO: 338801 - RNA, 14 nt, Bordetella pertussis
ggcgccggccgcgc

SEQ ID NO: 338802 - RNA, 21 nt, Bordetella pertussis
ggcgccggccgcgcgcgccau

SEQ ID NO: 338803 - RNA, 17 nt, Bordetella pertussis
ggcgccggccuccagca

SEQ ID NO: 338804 - RNA, 20 nt, Bordetella pertussis
ggcgccggccuccagcaucg

SEQ ID NO: 338805 - RNA, 16 nt, Bordetella pertussis
ggcgccggccuugccg

SEQ ID NO: 338806 - RNA, 13 nt, Bordetella pertussis
ggcgccggcgccc

SEQ ID NO: 338807 - RNA, 14 nt, Bordetella pertussis
ggcgccggcgcccg

SEQ ID NO: 338808 - RNA, 15 nt, Bordetella pertussis
ggcgccggcggcgcg

SEQ ID NO: 338809 - RNA, 16 nt, Bordetella pertussis
ggcgccggcggcgcgg

SEQ ID NO: 338810 - RNA, 19 nt, Bordetella pertussis
ggcgccggcguccacggca

SEQ ID NO: 338811 - RNA, 15 nt, Bordetella pertussis
ggcgccgggcagccc

SEQ ID NO: 338812 - RNA, 17 nt, Bordetella pertussis
ggcgccgggcagcccgc

SEQ ID NO: 338813 - RNA, 21 nt, Bordetella pertussis
ggcgccgggcagcccgcgcac

SEQ ID NO: 338814 - RNA, 12 nt, Bordetella pertussis
ggcgccgggccg

SEQ ID NO: 338815 - RNA, 14 nt, Bordetella pertussis
ggcgccgggcuggu

SEQ ID NO: 338816 - RNA, 23 nt, Bordetella pertussis
ggcgccggguggguucgggcguu

SEQ ID NO: 338817 - RNA, 18 nt, Bordetella pertussis
ggcgccgguccagcgccc

SEQ ID NO: 338818 - RNA, 18 nt, Bordetella pertussis
ggcgccggugaccgccag

SEQ ID NO: 338819 - RNA, 19 nt, Bordetella pertussis
ggcgccggugaccgccagc

SEQ ID NO: 338820 - RNA, 20 nt, Bordetella pertussis
ggcgccggugcgcggcgccc

SEQ ID NO: 338821 - RNA, 17 nt, Bordetella pertussis
ggcgccguccagcgcgg

SEQ ID NO: 338822 - RNA, 21 nt, Bordetella pertussis
ggcgccgucgaagccggcgcc

SEQ ID NO: 338823 - RNA, 18 nt, Bordetella pertussis
ggcgccguguuguccugg

SEQ ID NO: 338824 - RNA, 21 nt, Bordetella pertussis
ggcgccguuuucagcgcaggc

SEQ ID NO: 338825 - RNA, 22 nt, Bordetella pertussis
ggcgccguuuucagcgcaggcu

SEQ ID NO: 338826 - RNA, 20 nt, Bordetella pertussis
ggcgccugcgccaccuggcg

SEQ ID NO: 338827 - RNA, 22 nt, Bordetella pertussis
ggcgccugcgccaccuggcgcc

SEQ ID NO: 338828 - RNA, 12 nt, Bordetella pertussis
ggcgccugcgcg

SEQ ID NO: 338829 - RNA, 16 nt, Bordetella pertussis
ggcgccugcggcaggc

SEQ ID NO: 338830 - RNA, 16 nt, Bordetella pertussis
ggcgccugcggcaugg

SEQ ID NO: 338831 - RNA, 12 nt, Bordetella pertussis
ggcgccugcggg

SEQ ID NO: 338832 - RNA, 16 nt, Bordetella pertussis
ggcgccugcggggccg

SEQ ID NO: 338833 - RNA, 17 nt, Bordetella pertussis
ggcgccugcggggccgc

SEQ ID NO: 338834 - RNA, 12 nt, Bordetella pertussis
ggcgccuggccg

SEQ ID NO: 338835 - RNA, 14 nt, Bordetella pertussis
ggcgccuggccgcc

SEQ ID NO: 338836 - RNA, 15 nt, Bordetella pertussis
ggcgccuggccgccc

SEQ ID NO: 338837 - RNA, 17 nt, Bordetella pertussis
ggcgccuggccgcccag

SEQ ID NO: 338838 - RNA, 24 nt, Bordetella pertussis
ggcgccuggccgcccagcgccugc

SEQ ID NO: 338839 - RNA, 23 nt, Bordetella pertussis
ggcgccuggccguagcguuggcg

SEQ ID NO: 338840 - RNA, 14 nt, Bordetella pertussis
ggcgccugcaagau

SEQ ID NO: 338841 - RNA, 19 nt, Bordetella pertussis
ggcgccugccgcaucccgc

SEQ ID NO: 338842 - RNA, 22 nt, Bordetella pertussis
ggcgccuggggcgggcgggcgc

SEQ ID NO: 338843 - RNA, 23 nt, Bordetella pertussis
ggcgccuggggcgggcgggcgca

SEQ ID NO: 338844 - RNA, 14 nt, Bordetella pertussis
ggcgccuucggcgc

SEQ ID NO: 338845 - RNA, 16 nt, Bordetella pertussis
ggcgccuucggcgcgg

SEQ ID NO: 338846 - RNA, 18 nt, Bordetella pertussis
ggcgccuucggcgcggcg

SEQ ID NO: 338847 - RNA, 21 nt, Bordetella pertussis
ggcgccuuccggcagcggcca

SEQ ID NO: 338848 - RNA, 18 nt, Bordetella pertussis
ggcgccuuggccugggcg

SEQ ID NO: 338849 - RNA, 19 nt, Bordetella pertussis
ggcgcgaaccccuccggcg

SEQ ID NO: 338850 - RNA, 16 nt, Bordetella pertussis
ggcgcgaaacugcacu

SEQ ID NO: 338851 - RNA, 14 nt, Bordetella pertussis
ggcgcgacgccugc

SEQ ID NO: 338852 - RNA, 21 nt, Bordetella pertussis
ggcgcgacgccugcgccaugg

SEQ ID NO: 338853 - RNA, 21 nt, Bordetella pertussis
ggcgcgagcgccgggcgccgc

SEQ ID NO: 338854 - RNA, 13 nt, Bordetella pertussis
ggcgcgcgcaggu

SEQ ID NO: 338855 - RNA, 13 nt, Bordetella pertussis
ggcgcgcgcaugc

SEQ ID NO: 338856 - RNA, 16 nt, Bordetella pertussis
ggcgcgcgcaugcccg

SEQ ID NO: 338857 - RNA, 17 nt, Bordetella pertussis
ggcgcgcgcaugcccga

SEQ ID NO: 338858 - RNA, 13 nt, Bordetella pertussis
ggcgcgcgccagc

SEQ ID NO: 338859 - RNA, 14 nt, Bordetella pertussis
ggcgcgcgccagcg

SEQ ID NO: 338860 - RNA, 14 nt, Bordetella pertussis
ggcgcgcgccaggc

SEQ ID NO: 338861 - RNA, 13 nt, Bordetella pertussis
ggcgcgcgccauc

SEQ ID NO: 338862 - RNA, 14 nt, Bordetella pertussis
ggcgcgcgccaucg

SEQ ID NO: 338863 - RNA, 12 nt, Bordetella pertussis
ggcgcgcgccca

SEQ ID NO: 338864 - RNA, 21 nt, Bordetella pertussis
ggcgcgcgccgaugcgccagg

SEQ ID NO: 338865 - RNA, 13 nt, Bordetella pertussis
ggcgcgcgccugc

SEQ ID NO: 338866 - RNA, 15 nt, Bordetella pertussis
ggcgcgcgcgaccac

SEQ ID NO: 338867 - RNA, 20 nt, Bordetella pertussis
ggcgcgcgcgacuccaccgg

SEQ ID NO: 338868 - RNA, 22 nt, Bordetella pertussis
ggcgcgcgcgacuccaccggcg

SEQ ID NO: 338869 - RNA, 14 nt, Bordetella pertussis
ggcgcgcgccgcgc

SEQ ID NO: 338870 - RNA, 17 nt, Bordetella pertussis
ggcgcgcgccggcucga

SEQ ID NO: 338871 - RNA, 18 nt, Bordetella pertussis
ggcgcgcgcgccgccuac

SEQ ID NO: 338872 - RNA, 16 nt, Bordetella pertussis
ggcgcgcgcgcgcagc

SEQ ID NO: 338873 - RNA, 14 nt, Bordetella pertussis
ggcgcgcgcgcgcc

SEQ ID NO: 338874 - RNA, 16 nt, Bordetella pertussis
ggcgcgcgcgcgccgc

SEQ ID NO: 338875 - RNA, 23 nt, Bordetella pertussis
ggcgcgcgcgcggauauucgucg

SEQ ID NO: 338876 - RNA, 13 nt, Bordetella pertussis
ggcgcgcgcggcg

SEQ ID NO: 338877 - RNA, 17 nt, Bordetella pertussis
ggcgcgcgcggcgccgc

SEQ ID NO: 338878 - RNA, 19 nt, Bordetella pertussis
ggcgcgcgcguacagccgg

SEQ ID NO: 338879 - RNA, 22 nt, Bordetella pertussis
ggcgcgcgcguucguggauggg

SEQ ID NO: 338880 - RNA, 15 nt, Bordetella pertussis
ggcgcgcggcagggc

SEQ ID NO: 338881 - RNA, 15 nt, Bordetella pertussis
ggcgcgcggccucga

SEQ ID NO: 338882 - RNA, 22 nt, Bordetella pertussis
ggcgcgcggcgcgccagcgcgg

SEQ ID NO: 338883 - RNA, 16 nt, Bordetella pertussis
ggcgcgcggcuggggc

SEQ ID NO: 338884 - RNA, 14 nt, Bordetella pertussis
ggcgcgcgggcccu

SEQ ID NO: 338885 - RNA, 14 nt, Bordetella pertussis
ggcgcgcgggggug

SEQ ID NO: 338886 - RNA, 23 nt, Bordetella pertussis
ggcgcgcgggggugcgcgacagc

SEQ ID NO: 338887 - RNA, 23 nt, Bordetella pertussis
ggcgcggaucaugggcucgcgcg

SEQ ID NO: 338888 - RNA, 20 nt, Bordetella pertussis
ggcgcggaucgaacccaugc

SEQ ID NO: 338889 - RNA, 19 nt, Bordetella pertussis
ggcgcggaugaccugcgcc

SEQ ID NO: 338890 - RNA, 20 nt, Bordetella pertussis
ggcgcggaugaccugcgcca

SEQ ID NO: 338891 - RNA, 22 nt, Bordetella pertussis
ggcgcggaugaccugcgccagg

SEQ ID NO: 338892 - RNA, 23 nt, Bordetella pertussis
ggcgcggauugaugucgcgcacc

SEQ ID NO: 338893 - RNA, 24 nt, Bordetella pertussis
ggcgcggauugaugucgcgcaccg

SEQ ID NO: 338894 - RNA, 15 nt, Bordetella pertussis
ggcgcggcagugggc

SEQ ID NO: 338895 - RNA, 16 nt, Bordetella pertussis
ggcgcggcauggcgcc

SEQ ID NO: 338896 - RNA, 18 nt, Bordetella pertussis
ggcgcggcauggcgccgc

SEQ ID NO: 338897 - RNA, 13 nt, Bordetella pertussis
ggcgcggccagca

SEQ ID NO: 338898 - RNA, 15 nt, Bordetella pertussis
ggcgcggccagcacg

SEQ ID NO: 338899 - RNA, 18 nt, Bordetella pertussis
ggcgcggccaggcgcuca

SEQ ID NO: 338900 - RNA, 14 nt, Bordetella pertussis
ggcgcggccagggu

SEQ ID NO: 338901 - RNA, 15 nt, Bordetella pertussis
ggcgcggccccaugc

SEQ ID NO: 338902 - RNA, 22 nt, Bordetella pertussis
ggcgcggccccaugcgcggcac

SEQ ID NO: 338903 - RNA, 14 nt, Bordetella pertussis
ggcgcggcccgcca

SEQ ID NO: 338904 - RNA, 17 nt, Bordetella pertussis
ggcgcggcccgccacgc

SEQ ID NO: 338905 - RNA, 22 nt, Bordetella pertussis
ggcgcggccggaggccgcccac

SEQ ID NO: 338906 - RNA, 13 nt, Bordetella pertussis
ggcgcggccgggc

SEQ ID NO: 338907 - RNA, 12 nt, Bordetella pertussis
ggcgcggccggu

SEQ ID NO: 338908 - RNA, 23 nt, Bordetella pertussis
ggcgcgggaaaugauaguccugc

SEQ ID NO: 338909 - RNA, 13 nt, Bordetella pertussis
ggcgcgggagccc

SEQ ID NO: 338910 - RNA, 18 nt, Bordetella pertussis
ggcgcgggcacucggcca

SEQ ID NO: 338911 - RNA, 13 nt, Bordetella pertussis
ggcgcgggcgaug

SEQ ID NO: 338912 - RNA, 13 nt, Bordetella pertussis
ggcgcgggcggcc

SEQ ID NO: 338913 - RNA, 16 nt, Bordetella pertussis
ggcgcggguggccgga

SEQ ID NO: 338914 - RNA, 15 nt, Bordetella pertussis
ggcgcgguagcgccc

SEQ ID NO: 338915 - RNA, 17 nt, Bordetella pertussis
ggcgcgguauggccgcc

SEQ ID NO: 338916 - RNA, 19 nt, Bordetella pertussis
ggcgcgguauggccgccca

SEQ ID NO: 338917 - RNA, 22 nt, Bordetella pertussis
ggcgcgguauggccgcccagca

SEQ ID NO: 338918 - RNA, 16 nt, Bordetella pertussis
ggcgcggucagcauga

SEQ ID NO: 338919 - RNA, 19 nt, Bordetella pertussis
ggcgcgguccacgcccugg

SEQ ID NO: 338920 - RNA, 20 nt, Bordetella pertussis
ggcgcgguccagcaaggcgu

SEQ ID NO: 338921 - RNA, 17 nt, Bordetella pertussis
ggcgcggucggcgggcu

SEQ ID NO: 338922 - RNA, 18 nt, Bordetella pertussis
ggcgcggugcgcaccagg

SEQ ID NO: 338923 - RNA, 16 nt, Bordetella pertussis
ggcgcgguggccaugc

SEQ ID NO: 338924 - RNA, 23 nt, Bordetella pertussis
ggcgcgguggccaugcugggcgg

SEQ ID NO: 338925 - RNA, 22 nt, Bordetella pertussis
ggcgcgguugguuugcggcgcg

SEQ ID NO: 338926 - RNA, 19 nt, Bordetella pertussis
ggcgcguaugacgcgcuga

SEQ ID NO: 338927 - RNA, 20 nt, Bordetella pertussis
ggcgcguaugacgcgcugau

SEQ ID NO: 338928 - RNA, 23 nt, Bordetella pertussis
ggcgcgucaguugggcgcgccca

SEQ ID NO: 338929 - RNA, 16 nt, Bordetella pertussis
ggcgcguccacgccgu

SEQ ID NO: 338930 - RNA, 18 nt, Bordetella pertussis
ggcgcguccacgccgugg

SEQ ID NO: 338931 - RNA, 14 nt, Bordetella pertussis
ggcgcgucgccgcg

SEQ ID NO: 338932 - RNA, 17 nt, Bordetella pertussis
ggcgcgucgccgcgccg

SEQ ID NO: 338933 - RNA, 13 nt, Bordetella pertussis
ggcgcgucgccgg

SEQ ID NO: 338934 - RNA, 19 nt, Bordetella pertussis
ggcgcgucgccggcgauga

SEQ ID NO: 338935 - RNA, 14 nt, Bordetella pertussis
ggcgcgucgcgcgc

SEQ ID NO: 338936 - RNA, 17 nt, Bordetella pertussis
ggcgcgucgcgcgccag

SEQ ID NO: 338937 - RNA, 13 nt, Bordetella pertussis
ggcgcgucggcgc

SEQ ID NO: 338938 - RNA, 22 nt, Bordetella pertussis
ggcgcgucuggaggacgagcgg

SEQ ID NO: 338939 - RNA, 14 nt, Bordetella pertussis
ggcgcgugccagca

SEQ ID NO: 338940 - RNA, 15 nt, Bordetella pertussis
ggcgcgugccagcag

SEQ ID NO: 338941 - RNA, 18 nt, Bordetella pertussis
ggcgcguggccacggcgu

SEQ ID NO: 338942 - RNA, 20 nt, Bordetella pertussis
ggcgcguggccacggcgucg

SEQ ID NO: 338943 - RNA, 14 nt, Bordetella pertussis
ggcgcguggcccgc

SEQ ID NO: 338944 - RNA, 18 nt, Bordetella pertussis
ggcgcguggcccgcgccg

SEQ ID NO: 338945 - RNA, 19 nt, Bordetella pertussis
ggcgcgugcucaucggcag

SEQ ID NO: 338946 - RNA, 21 nt, Bordetella pertussis
ggcgcgugcucaucggcaggc

SEQ ID NO: 338947 - RNA, 16 nt, Bordetella pertussis
ggcgcgugcuggcgca

SEQ ID NO: 338948 - RNA, 18 nt, Bordetella pertussis
ggcgcgugcuggcgcagc

SEQ ID NO: 338949 - RNA, 13 nt, Bordetella pertussis
ggcgcucagccgu

SEQ ID NO: 338950 - RNA, 24 nt, Bordetella pertussis
ggcgcucagccgugccgcgcgcac

SEQ ID NO: 338951 - RNA, 15 nt, Bordetella pertussis
ggcgcucagcgacgc

SEQ ID NO: 338952 - RNA, 15 nt, Bordetella pertussis
ggcgcucaucaucgc

SEQ ID NO: 338953 - RNA, 12 nt, Bordetella pertussis
ggcgcuccagcc

SEQ ID NO: 338954 - RNA, 16 nt, Bordetella pertussis
ggcgcuccauggcgcc

SEQ ID NO: 338955 - RNA, 17 nt, Bordetella pertussis
ggcgcuccauggcgccg

SEQ ID NO: 338956 - RNA, 14 nt, Bordetella pertussis
ggcgcuccucgcgc

SEQ ID NO: 338957 - RNA, 16 nt, Bordetella pertussis
ggcgcuccucgcgcgc

SEQ ID NO: 338958 - RNA, 17 nt, Bordetella pertussis
ggcgcuccucgcgcgcg

SEQ ID NO: 338959 - RNA, 14 nt, Bordetella pertussis
ggcgcugcggucgc

SEQ ID NO: 338960 - RNA, 19 nt, Bordetella pertussis
ggcgcugcggucgcgaucg

SEQ ID NO: 338961 - RNA, 17 nt, Bordetella pertussis
ggcgcugcucgaaacgc

SEQ ID NO: 338962 - RNA, 14 nt, Bordetella pertussis
ggcgcugcuggccg

SEQ ID NO: 338963 - RNA, 19 nt, Bordetella pertussis
ggcgcugcuggccggccag

SEQ ID NO: 338964 - RNA, 19 nt, Bordetella pertussis
ggcgcugcugucgcgcgac

SEQ ID NO: 338965 - RNA, 15 nt, Bordetella pertussis
ggcgcuggcaggcgc

SEQ ID NO: 338966 - RNA, 14 nt, Bordetella pertussis
ggcgcuggccauca

SEQ ID NO: 338967 - RNA, 14 nt, Bordetella pertussis
ggcgcuggccgcca

SEQ ID NO: 338968 - RNA, 15 nt, Bordetella pertussis
ggcgcuggccgccau

SEQ ID NO: 338969 - RNA, 17 nt, Bordetella pertussis
ggcgcuggccugccgcg

SEQ ID NO: 338970 - RNA, 21 nt, Bordetella pertussis
ggcgcuggccugccgcgccga

SEQ ID NO: 338971 - RNA, 14 nt, Bordetella pertussis
ggcgcuggccuggc

SEQ ID NO: 338972 - RNA, 16 nt, Bordetella pertussis
ggcgcuggccuggccg

SEQ ID NO: 338973 - RNA, 21 nt, Bordetella pertussis
ggcgcuggccuggccgccggc

SEQ ID NO: 338974 - RNA, 22 nt, Bordetella pertussis
ggcgcuggccuggccgccggcg

SEQ ID NO: 338975 - RNA, 19 nt, Bordetella pertussis
ggcgcuguuggccggcgcg

SEQ ID NO: 338976 - RNA, 22 nt, Bordetella pertussis
ggcgcuguuggccggcgcgccc

SEQ ID NO: 338977 - RNA, 23 nt, Bordetella pertussis
ggcgcuguuggccggcgcgcccu

SEQ ID NO: 338978 - RNA, 19 nt, Bordetella pertussis
ggcgcuguuuccgggccug

SEQ ID NO: 338979 - RNA, 14 nt, Bordetella pertussis
ggcgcuggccggcg

SEQ ID NO: 338980 - RNA, 21 nt, Bordetella pertussis
ggcgcuuaccgcgccggcucg

SEQ ID NO: 338981 - RNA, 12 nt, Bordetella pertussis
ggcgcuugcccg

SEQ ID NO: 338982 - RNA, 14 nt, Bordetella pertussis
ggcgcuuggccagc

SEQ ID NO: 338983 - RNA, 16 nt, Bordetella pertussis
ggcgcuuggccagcug

SEQ ID NO: 338984 - RNA, 21 nt, Bordetella pertussis
ggcgcuuggccagcuggcgcg

SEQ ID NO: 338985 - RNA, 20 nt, Bordetella pertussis
ggcgcuugcgcagggcgggc

SEQ ID NO: 338986 - RNA, 20 nt, Bordetella pertussis
ggcgcuugugcgucggcucg

SEQ ID NO: 338987 - RNA, 14 nt, Bordetella pertussis
ggcggacacgcccu

SEQ ID NO: 338988 - RNA, 21 nt, Bordetella pertussis
ggcggacacgcccuggccgua

SEQ ID NO: 338989 - RNA, 16 nt, Bordetella pertussis
ggcggacugcgccgca

SEQ ID NO: 338990 - RNA, 13 nt, Bordetella pertussis
ggcggacuggccg

SEQ ID NO: 338991 - RNA, 18 nt, Bordetella pertussis
ggcggacuggccgcgccg

SEQ ID NO: 338992 - RNA, 16 nt, Bordetella pertussis
ggcggaucacccagcg

SEQ ID NO: 338993 - RNA, 19 nt, Bordetella pertussis
ggcggaucucggccagcag

SEQ ID NO: 338994 - RNA, 22 nt, Bordetella pertussis
ggcggaucucuccgaacgcgac

SEQ ID NO: 338995 - RNA, 16 nt, Bordetella pertussis
ggcggaucuucccgcc

SEQ ID NO: 338996 - RNA, 17 nt, Bordetella pertussis
ggcggaucuucccgcca

SEQ ID NO: 338997 - RNA, 19 nt, Bordetella pertussis
ggcggaucuucccgccaug

SEQ ID NO: 338998 - RNA, 14 nt, Bordetella pertussis
ggcggaugagcagg

SEQ ID NO: 338999 - RNA, 18 nt, Bordetella pertussis
ggcggaugagcaggccgg

SEQ ID NO: 339000 - RNA, 23 nt, Bordetella pertussis
ggcggaugagcaggccgggucgu

SEQ ID NO: 339001 - RNA, 21 nt, Bordetella pertussis
ggcggaucgucuacgcgaacc

SEQ ID NO: 339002 - RNA, 21 nt, Bordetella pertussis
ggcggcaaagucggggcgccg

SEQ ID NO: 339003 - RNA, 18 nt, Bordetella pertussis
ggcggccaggcguacgcu

SEQ ID NO: 339004 - RNA, 21 nt, Bordetella pertussis
ggcggccaggcucugggcgga

SEQ ID NO: 339005 - RNA, 18 nt, Bordetella pertussis
ggcggccagggaaggggc

SEQ ID NO: 339006 - RNA, 22 nt, Bordetella pertussis
ggcggccagggaaggggcggcu

SEQ ID NO: 339007 - RNA, 16 nt, Bordetella pertussis
ggcggccagggccugc

SEQ ID NO: 339008 - RNA, 22 nt, Bordetella pertussis
ggcggccagggccugcgggccg

SEQ ID NO: 339009 - RNA, 24 nt, Bordetella pertussis
ggcggcaaaaaaaaccgcgcgccg

SEQ ID NO: 339010 - RNA, 22 nt, Bordetella pertussis
ggcggccaugacggccauccgg

SEQ ID NO: 339011 - RNA, 16 nt, Bordetella pertussis
ggcggccauggcauga

SEQ ID NO: 339012 - RNA, 23 nt, Bordetella pertussis
ggcggccaucgccauggccacga

SEQ ID NO: 339013 - RNA, 15 nt, Bordetella pertussis
ggcggcccacagcgc

SEQ ID NO: 339014 - RNA, 17 nt, Bordetella pertussis
ggcggcccauucgccca

SEQ ID NO: 339015 - RNA, 20 nt, Bordetella pertussis
ggcggcccauucgcccaugg

SEQ ID NO: 339016 - RNA, 13 nt, Bordetella pertussis
ggcggccgccugc

SEQ ID NO: 339017 - RNA, 18 nt, Bordetella pertussis
ggcggccgccugcgccga

SEQ ID NO: 339018 - RNA, 21 nt, Bordetella pertussis
ggcggccgccugcgccgaggc

SEQ ID NO: 339019 - RNA, 22 nt, Bordetella pertussis
ggcggccgcguccagcgcgcgg

SEQ ID NO: 339020 - RNA, 12 nt, Bordetella pertussis
ggcggccgcggg

SEQ ID NO: 339021 - RNA, 17 nt, Bordetella pertussis
ggcggccgcgggcgugc

SEQ ID NO: 339022 - RNA, 13 nt, Bordetella pertussis
ggcggccggcacg

SEQ ID NO: 339023 - RNA, 14 nt, Bordetella pertussis
ggcggccggcaggc

SEQ ID NO: 339024 - RNA, 13 nt, Bordetella pertussis
ggcggccggccag

SEQ ID NO: 339025 - RNA, 15 nt, Bordetella pertussis
ggcggccggccagcc

SEQ ID NO: 339026 - RNA, 13 nt, Bordetella pertussis
ggcggccggcucg

SEQ ID NO: 339027 - RNA, 14 nt, Bordetella pertussis
ggcggccgggcgua

SEQ ID NO: 339028 - RNA, 15 nt, Bordetella pertussis
ggcggccgggcguac

SEQ ID NO: 339029 - RNA, 14 nt, Bordetella pertussis
ggcggccggggccg

SEQ ID NO: 339030 - RNA, 20 nt, Bordetella pertussis
ggcggccggggccgcccugc

SEQ ID NO: 339031 - RNA, 21 nt, Bordetella pertussis
ggcggccgguaucggccucga

SEQ ID NO: 339032 - RNA, 17 nt, Bordetella pertussis
ggcggccguuggcgugc

SEQ ID NO: 339033 - RNA, 16 nt, Bordetella pertussis
ggcggccuccagcagg

SEQ ID NO: 339034 - RNA, 14 nt, Bordetella pertussis
ggcggccucggcca

SEQ ID NO: 339035 - RNA, 15 nt, Bordetella pertussis
ggcggccucggccag

SEQ ID NO: 339036 - RNA, 13 nt, Bordetella pertussis
ggcggccugcgcc

SEQ ID NO: 339037 - RNA, 14 nt, Bordetella pertussis
ggcggccugcgccg

SEQ ID NO: 339038 - RNA, 17 nt, Bordetella pertussis
ggcggccugcgccggca

SEQ ID NO: 339039 - RNA, 12 nt, Bordetella pertussis
ggcggccuggcc

SEQ ID NO: 339040 - RNA, 13 nt, Bordetella pertussis
ggcggccuggccg

SEQ ID NO: 339041 - RNA, 20 nt, Bordetella pertussis
ggcggccugggaggcgcuga

SEQ ID NO: 339042 - RNA, 21 nt, Bordetella pertussis
ggcggccugggaggcgcugau

SEQ ID NO: 339043 - RNA, 13 nt, Bordetella pertussis
ggcggccugggcc

SEQ ID NO: 339044 - RNA, 15 nt, Bordetella pertussis
ggcggcgacucggca

SEQ ID NO: 339045 - RNA, 22 nt, Bordetella pertussis
ggcggcgagaugccgucgaagg

SEQ ID NO: 339046 - RNA, 14 nt, Bordetella pertussis
ggcggcgagcuggc

SEQ ID NO: 339047 - RNA, 14 nt, Bordetella pertussis
ggcggcgagggcgu

SEQ ID NO: 339048 - RNA, 17 nt, Bordetella pertussis
ggcggcgagggcgucgu

SEQ ID NO: 339049 - RNA, 19 nt, Bordetella pertussis
ggcggcgaucacgccgucg

SEQ ID NO: 339050 - RNA, 17 nt, Bordetella pertussis
ggcggcgaucucgcgcg

SEQ ID NO: 339051 - RNA, 22 nt, Bordetella pertussis
ggcggcgcgcccagcggcaggc

SEQ ID NO: 339052 - RNA, 15 nt, Bordetella pertussis
ggcggcgcgcgcgcc

SEQ ID NO: 339053 - RNA, 23 nt, Bordetella pertussis
ggcggcgcgcucuccgaacaggc

SEQ ID NO: 339054 - RNA, 15 nt, Bordetella pertussis
ggcggcgcgcuuggu

SEQ ID NO: 339055 - RNA, 14 nt, Bordetella pertussis
ggcggcgcggcgcc

SEQ ID NO: 339056 - RNA, 15 nt, Bordetella pertussis
ggcggcgcggcgcug

SEQ ID NO: 339057 - RNA, 16 nt, Bordetella pertussis
ggcggcgcggcgcugg

SEQ ID NO: 339058 - RNA, 17 nt, Bordetella pertussis
ggcggcgcggcgcuggc

SEQ ID NO: 339059 - RNA, 19 nt, Bordetella pertussis
ggcggcgcggcgcuggcgc

SEQ ID NO: 339060 - RNA, 12 nt, Bordetella pertussis
ggcggcgcggcu

SEQ ID NO: 339061 - RNA, 22 nt, Bordetella pertussis
ggcggcgcgggucuugagcggc

SEQ ID NO: 339062 - RNA, 17 nt, Bordetella pertussis
ggcggcgcggucagcau

SEQ ID NO: 339063 - RNA, 20 nt, Bordetella pertussis
ggcggcgcucgaaggcgccg

SEQ ID NO: 339064 - RNA, 12 nt, Bordetella pertussis
ggcggcgcuggc

SEQ ID NO: 339065 - RNA, 16 nt, Bordetella pertussis
ggcggcucggcccuag

SEQ ID NO: 339066 - RNA, 16 nt, Bordetella pertussis
ggcggcugccaguggu

SEQ ID NO: 339067 - RNA, 15 nt, Bordetella pertussis
ggcggcugcccaccu

SEQ ID NO: 339068 - RNA, 20 nt, Bordetella pertussis
ggcggcugcccaccuugcgc

SEQ ID NO: 339069 - RNA, 18 nt, Bordetella pertussis
ggcggcugcccgggcugc

SEQ ID NO: 339070 - RNA, 21 nt, Bordetella pertussis
ggcggcugccgauacgggcgc

SEQ ID NO: 339071 - RNA, 15 nt, Bordetella pertussis
ggcggcugcuggccc

SEQ ID NO: 339072 - RNA, 21 nt, Bordetella pertussis
ggcggcuguagucgccgcugc

SEQ ID NO: 339073 - RNA, 17 nt, Bordetella pertussis
ggcggcugucgggcggc

SEQ ID NO: 339074 - RNA, 21 nt, Bordetella pertussis
ggcggcuggucaacucgcccg

SEQ ID NO: 339075 - RNA, 17 nt, Bordetella pertussis
ggcggcuucaggcgcgc

SEQ ID NO: 339076 - RNA, 19 nt, Bordetella pertussis
ggcggcuucaggcgcgcgg

SEQ ID NO: 339077 - RNA, 23 nt, Bordetella pertussis
ggcggcuucaggcgcgcggcagg

SEQ ID NO: 339078 - RNA, 15 nt, Bordetella pertussis
ggcgggcaucgccca

SEQ ID NO: 339079 - RNA, 20 nt, Bordetella pertussis
ggcgggcaugacgaccgcga

SEQ ID NO: 339080 - RNA, 22 nt, Bordetella pertussis
ggcgggcaugacgaccgcgacc

SEQ ID NO: 339081 - RNA, 17 nt, Bordetella pertussis
ggcgggcagcggcgacg

SEQ ID NO: 339082 - RNA, 20 nt, Bordetella pertussis
ggcgggcagcggcgacggcg

SEQ ID NO: 339083 - RNA, 16 nt, Bordetella pertussis
ggcggcuucgcgcagc

SEQ ID NO: 339084 - RNA, 15 nt, Bordetella pertussis
ggcgggccagcuccc

SEQ ID NO: 339085 - RNA, 21 nt, Bordetella pertussis
ggcgggcccgcaucgcgcgcc

SEQ ID NO: 339086 - RNA, 12 nt, Bordetella pertussis
ggcgggccggcu

SEQ ID NO: 339087 - RNA, 22 nt, Bordetella pertussis
ggcgggcgagaucagccaccgg

SEQ ID NO: 339088 - RNA, 16 nt, Bordetella pertussis
ggcggggacaggcgcc

SEQ ID NO: 339089 - RNA, 21 nt, Bordetella pertussis
ggcggggcgcgccgggccuag

SEQ ID NO: 339090 - RNA, 21 nt, Bordetella pertussis
ggcggggcgugagcaggcgcc

SEQ ID NO: 339091 - RNA, 19 nt, Bordetella pertussis
ggcggggcguucgacgggc

SEQ ID NO: 339092 - RNA, 15 nt, Bordetella pertussis
ggcggggcuggcgcg

SEQ ID NO: 339093 - RNA, 15 nt, Bordetella pertussis
ggcgggggacgcccg

SEQ ID NO: 339094 - RNA, 18 nt, Bordetella pertussis
ggcggggugaucugcgcc

SEQ ID NO: 339095 - RNA, 19 nt, Bordetella pertussis
ggcgggguuggccgccagg

SEQ ID NO: 339096 - RNA, 21 nt, Bordetella pertussis
ggcgggucaaguccggcgccg

SEQ ID NO: 339097 - RNA, 15 nt, Bordetella pertussis
ggcgggucggcgaac

SEQ ID NO: 339098 - RNA, 16 nt, Bordetella pertussis
ggcgggucggcgaaca

SEQ ID NO: 339099 - RNA, 18 nt, Bordetella pertussis
ggcgggugcugcagcgca

SEQ ID NO: 339100 - RNA, 20 nt, Bordetella pertussis
ggcgggugcugcagcgcacc

SEQ ID NO: 339101 - RNA, 19 nt, Bordetella pertussis
ggcggguugugcccgcccg

SEQ ID NO: 339102 - RNA, 17 nt, Bordetella pertussis
ggcggguuucucggccu

SEQ ID NO: 339103 - RNA, 19 nt, Bordetella pertussis
ggcgguaagcguccgcgcg

SEQ ID NO: 339104 - RNA, 13 nt, Bordetella pertussis
ggcgguaccaggc

SEQ ID NO: 339105 - RNA, 16 nt, Bordetella pertussis
ggcgguaccaggccga

SEQ ID NO: 339106 - RNA, 21 nt, Bordetella pertussis
ggcgguaccaggccgagaugu

SEQ ID NO: 339107 - RNA, 16 nt, Bordetella pertussis
ggcgguaugcggcgcc

SEQ ID NO: 339108 - RNA, 18 nt, Bordetella pertussis
ggcggucaaugcggcggc

SEQ ID NO: 339109 - RNA, 19 nt, Bordetella pertussis
ggcggucaaugcggcggcg

SEQ ID NO: 339110 - RNA, 23 nt, Bordetella pertussis
ggcggucaaugcggcggcgcugg

SEQ ID NO: 339111 - RNA, 12 nt, Bordetella pertussis
ggcggucacgcc

SEQ ID NO: 339112 - RNA, 20 nt, Bordetella pertussis
ggcggucauagacggcgucg

SEQ ID NO: 339113 - RNA, 16 nt, Bordetella pertussis
ggcgguccacagcccg

SEQ ID NO: 339114 - RNA, 17 nt, Bordetella pertussis
ggcgguccugcugaucc

SEQ ID NO: 339115 - RNA, 15 nt, Bordetella pertussis
ggcggucgaggcgca

SEQ ID NO: 339116 - RNA, 15 nt, Bordetella pertussis
ggcgguccgguucgc

SEQ ID NO: 339117 - RNA, 19 nt, Bordetella pertussis
ggcgguccgguucgcccac

SEQ ID NO: 339118 - RNA, 13 nt, Bordetella pertussis
ggcggucgcgcug

SEQ ID NO: 339119 - RNA, 13 nt, Bordetella pertussis
ggcggucggcgcg

SEQ ID NO: 339120 - RNA, 21 nt, Bordetella pertussis
ggcggucuccgguucggcgcg

SEQ ID NO: 339121 - RNA, 16 nt, Bordetella pertussis
ggcggucugggcgucc

SEQ ID NO: 339122 - RNA, 22 nt, Bordetella pertussis
ggcggucuucacauagcccggc

SEQ ID NO: 339123 - RNA, 14 nt, Bordetella pertussis
ggcggucuucgaug

SEQ ID NO: 339124 - RNA, 17 nt, Bordetella pertussis
ggcggugaaggcgcccg

SEQ ID NO: 339125 - RNA, 16 nt, Bordetella pertussis
ggcggugaccaccagg

SEQ ID NO: 339126 - RNA, 17 nt, Bordetella pertussis
ggcggugaugucgccgg

SEQ ID NO: 339127 - RNA, 19 nt, Bordetella pertussis
ggcggugaugucgccgguc

SEQ ID NO: 339128 - RNA, 15 nt, Bordetella pertussis
ggcgucgccgcgcac

SEQ ID NO: 339129 - RNA, 17 nt, Bordetella pertussis
ggcgucgccgcgcacga

SEQ ID NO: 339130 - RNA, 13 nt, Bordetella pertussis
ggcgucgccggcc

SEQ ID NO: 339131 - RNA, 15 nt, Bordetella pertussis
ggcgucgcgaugcgc

SEQ ID NO: 339132 - RNA, 23 nt, Bordetella pertussis
ggcgucgcugcuggcggcgcugg

SEQ ID NO: 339133 - RNA, 14 nt, Bordetella pertussis
ggcgucggccgcgc

SEQ ID NO: 339134 - RNA, 16 nt, Bordetella pertussis
ggcgucggccgcgccc

SEQ ID NO: 339135 - RNA, 17 nt, Bordetella pertussis
ggcgucggccgcgccca

SEQ ID NO: 339136 - RNA, 12 nt, Bordetella pertussis
ggcgucggccac

SEQ ID NO: 339137 - RNA, 17 nt, Bordetella pertussis
ggcgucggcgcccggcg

SEQ ID NO: 339138 - RNA, 18 nt, Bordetella pertussis
ggcgucggcgcccggcgc

SEQ ID NO: 339139 - RNA, 19 nt, Bordetella pertussis
ggcgucgggcagcaggcgc

SEQ ID NO: 339140 - RNA, 22 nt, Bordetella pertussis
ggcgucgggcaguugcuggcgg

SEQ ID NO: 339141 - RNA, 23 nt, Bordetella pertussis
ggcgucgggcaguugcuggcggc

SEQ ID NO: 339142 - RNA, 14 nt, Bordetella pertussis
ggcgucgggcuugc

SEQ ID NO: 339143 - RNA, 15 nt, Bordetella pertussis
ggcgucgggggcggc

SEQ ID NO: 339144 - RNA, 16 nt, Bordetella pertussis
ggcgucgggggcggcc

SEQ ID NO: 339145 - RNA, 18 nt, Bordetella pertussis
ggcgucgggggcggccgg

SEQ ID NO: 339146 - RNA, 18 nt, Bordetella pertussis
ggcgucggugccguccag

SEQ ID NO: 339147 - RNA, 20 nt, Bordetella pertussis
ggcgucguagcccucgccca

SEQ ID NO: 339148 - RNA, 21 nt, Bordetella pertussis
ggcgucgucgggaccggcgcg

SEQ ID NO: 339149 - RNA, 19 nt, Bordetella pertussis
ggcgucguggggcgcggcg

SEQ ID NO: 339150 - RNA, 15 nt, Bordetella pertussis
ggcgucguuggccgc

SEQ ID NO: 339151 - RNA, 19 nt, Bordetella pertussis
ggcgucugcccgugcgugc

SEQ ID NO: 339152 - RNA, 23 nt, Bordetella pertussis
ggcgucugcccgugcgugcgccu

SEQ ID NO: 339153 - RNA, 23 nt, Bordetella pertussis
ggcgucugcccgugcgugugccu

SEQ ID NO: 339154 - RNA, 21 nt, Bordetella pertussis
ggcgucuggaaacuguuggcg

SEQ ID NO: 339155 - RNA, 18 nt, Bordetella pertussis
ggcgucugguacaacauc

SEQ ID NO: 339156 - RNA, 16 nt, Bordetella pertussis
ggcgugaaaggccagc

SEQ ID NO: 339157 - RNA, 17 nt, Bordetella pertussis
ggcgugaaaggccagcg

SEQ ID NO: 339158 - RNA, 15 nt, Bordetella pertussis
ggcgugaacgccccg

SEQ ID NO: 339159 - RNA, 23 nt, Bordetella pertussis
ggcgugaacgccccggccgaucg

SEQ ID NO: 339160 - RNA, 18 nt, Bordetella pertussis
ggcgugaacucggggugg

SEQ ID NO: 339161 - RNA, 13 nt, Bordetella pertussis
ggcgugaccagcu

SEQ ID NO: 339162 - RNA, 20 nt, Bordetella pertussis
ggcgugaccagcugcaccag

SEQ ID NO: 339163 - RNA, 15 nt, Bordetella pertussis
ggcgugaccgcgacg

SEQ ID NO: 339164 - RNA, 18 nt, Bordetella pertussis
ggcgugaccgcgacgcgc

SEQ ID NO: 339165 - RNA, 22 nt, Bordetella pertussis
ggcgugaccgcgacgcgccugc

SEQ ID NO: 339166 - RNA, 23 nt, Bordetella pertussis
ggcgugacgcgcggguccaggcc

SEQ ID NO: 339167 - RNA, 17 nt, Bordetella pertussis
ggcgugacguugccgcg

SEQ ID NO: 339168 - RNA, 15 nt, Bordetella pertussis
ggcgugcgcgggcgc

SEQ ID NO: 339169 - RNA, 16 nt, Bordetella pertussis
ggcgugcgcgggcgcc

SEQ ID NO: 339170 - RNA, 21 nt, Bordetella pertussis
ggcgugcgcgggcgccaucgc

SEQ ID NO: 339171 - RNA, 12 nt, Bordetella pertussis
ggcgugcggaug

SEQ ID NO: 339172 - RNA, 21 nt, Bordetella pertussis
ggcgugcggauggucgagcgc

SEQ ID NO: 339173 - RNA, 15 nt, Bordetella pertussis
ggcgugcggcccagc

SEQ ID NO: 339174 - RNA, 15 nt, Bordetella pertussis
ggcgugcgcuugcgc

SEQ ID NO: 339175 - RNA, 20 nt, Bordetella pertussis
ggcgugcugcagggcugcga

SEQ ID NO: 339176 - RNA, 23 nt, Bordetella pertussis
ggcgugcugcggcugaucaccgc

SEQ ID NO: 339177 - RNA, 14 nt, Bordetella pertussis
ggcguuccuggcgc

SEQ ID NO: 339178 - RNA, 17 nt, Bordetella pertussis
ggcguuccuggcgcugu

SEQ ID NO: 339179 - RNA, 23 nt, Bordetella pertussis
ggcguucucgacccgcucggcca

SEQ ID NO: 339180 - RNA, 19 nt, Bordetella pertussis
ggcguucuggucagccgug

SEQ ID NO: 339181 - RNA, 23 nt, Bordetella pertussis
ggcguucuggucagccgugucgc

SEQ ID NO: 339182 - RNA, 16 nt, Bordetella pertussis
ggcucccaccggugcg

SEQ ID NO: 339183 - RNA, 22 nt, Bordetella pertussis
ggcucccaccggugcggaucau

SEQ ID NO: 339184 - RNA, 22 nt, Bordetella pertussis
ggcuccccuggucagggcugca

SEQ ID NO: 339185 - RNA, 14 nt, Bordetella pertussis
ggcucccgcgccau

SEQ ID NO: 339186 - RNA, 22 nt, Bordetella pertussis
ggcuccgagggacaccgcaggu

SEQ ID NO: 339187 - RNA, 13 nt, Bordetella pertussis
ggcuccggccgcu

SEQ ID NO: 339188 - RNA, 18 nt, Bordetella pertussis
ggcugaaaucccccgcgu

SEQ ID NO: 339189 - RNA, 20 nt, Bordetella pertussis
ggcugaaaucccccgcgucg

SEQ ID NO: 339190 - RNA, 21 nt, Bordetella pertussis
ggcugaacauccugaccggcu

SEQ ID NO: 339191 - RNA, 16 nt, Bordetella pertussis
ggcugaaggggcuccc

SEQ ID NO: 339192 - RNA, 14 nt, Bordetella pertussis
ggcugaaugccgcc

SEQ ID NO: 339193 - RNA, 15 nt, Bordetella pertussis
ggcugaccagcgcgu

SEQ ID NO: 339194 - RNA, 12 nt, Bordetella pertussis
ggcugacgcccg

SEQ ID NO: 339195 - RNA, 17 nt, Bordetella pertussis
ggcugacgcccggcucg

SEQ ID NO: 339196 - RNA, 19 nt, Bordetella pertussis
ggcugagccauuccggcug

SEQ ID NO: 339197 - RNA, 22 nt, Bordetella pertussis
ggcugagcgacaugucgccgcg

SEQ ID NO: 339198 - RNA, 20 nt, Bordetella pertussis
ggcugaucacccacagcagc

SEQ ID NO: 339199 - RNA, 22 nt, Bordetella pertussis
ggcugaucacccacagcagcgc

SEQ ID NO: 339200 - RNA, 15 nt, Bordetella pertussis
ggcugaucaccgccg

SEQ ID NO: 339201 - RNA, 18 nt, Bordetella pertussis
ggcugauccgcaccggcg

SEQ ID NO: 339202 - RNA, 22 nt, Bordetella pertussis
ggcugauccgcaccggcgugcg

SEQ ID NO: 339203 - RNA, 14 nt, Bordetella pertussis
ggcugcaccagcgc

SEQ ID NO: 339204 - RNA, 20 nt, Bordetella pertussis
ggcugcaccagcgcgccgcg

SEQ ID NO: 339205 - RNA, 22 nt, Bordetella pertussis
ggcugcaccagcgcgccgcgcg

SEQ ID NO: 339206 - RNA, 16 nt, Bordetella pertussis
ggcugcaccugccugc

SEQ ID NO: 339207 - RNA, 20 nt, Bordetella pertussis
ggcugcaccugccugccgcc

SEQ ID NO: 339208 - RNA, 19 nt, Bordetella pertussis
ggcugcacgauguugccgc

SEQ ID NO: 339209 - RNA, 23 nt, Bordetella pertussis
ggcugcacgauguugccgccggc

SEQ ID NO: 339210 - RNA, 13 nt, Bordetella pertussis
ggcugcagccagu

SEQ ID NO: 339211 - RNA, 22 nt, Bordetella pertussis
ggcugcagccaguugggccagg

SEQ ID NO: 339212 - RNA, 22 nt, Bordetella pertussis
ggcugccauuccagcuccggcg

SEQ ID NO: 339213 - RNA, 21 nt, Bordetella pertussis
ggcugcccaccuugcgcgcga

SEQ ID NO: 339214 - RNA, 21 nt, Bordetella pertussis
ggcugcccgggcugcugcacg

SEQ ID NO: 339215 - RNA, 18 nt, Bordetella pertussis
ggcugcccuggcccaggc

SEQ ID NO: 339216 - RNA, 15 nt, Bordetella pertussis
ggcugcccuggcgcu

SEQ ID NO: 339217 - RNA, 17 nt, Bordetella pertussis
ggcugcccuggcgcugu

SEQ ID NO: 339218 - RNA, 19 nt, Bordetella pertussis
ggcugccgauacgggcgcg

SEQ ID NO: 339219 - RNA, 15 nt, Bordetella pertussis
ggcugccggcagcag

SEQ ID NO: 339220 - RNA, 14 nt, Bordetella pertussis
ggcugccgucggcc

SEQ ID NO: 339221 - RNA, 18 nt, Bordetella pertussis
ggcugccgucggccagcu

SEQ ID NO: 339222 - RNA, 15 nt, Bordetella pertussis
ggcugccgucgucgu

SEQ ID NO: 339223 - RNA, 21 nt, Bordetella pertussis
ggcugcgaaaggccgagccau

SEQ ID NO: 339224 - RNA, 12 nt, Bordetella pertussis
ggcugcgacagg

SEQ ID NO: 339225 - RNA, 23 nt, Bordetella pertussis
ggcugcgaugcgggccuggaucg

SEQ ID NO: 339226 - RNA, 20 nt, Bordetella pertussis
ggcugcgcaggcgccgcagu

SEQ ID NO: 339227 - RNA, 18 nt, Bordetella pertussis
ggcugcgcaggucggcca

SEQ ID NO: 339228 - RNA, 21 nt, Bordetella pertussis
ggcugcgcaggucggccagga

SEQ ID NO: 339229 - RNA, 15 nt, Bordetella pertussis
ggcugcgcgccggcg

SEQ ID NO: 339230 - RNA, 18 nt, Bordetella pertussis
ggcugcgcgccggcgccu

SEQ ID NO: 339231 - RNA, 15 nt, Bordetella pertussis
ggcugcgcgccgugg

SEQ ID NO: 339232 - RNA, 16 nt, Bordetella pertussis
ggcugcgcgccguggu

SEQ ID NO: 339233 - RNA, 18 nt, Bordetella pertussis
ggcugcgcgcgcagccag

SEQ ID NO: 339234 - RNA, 19 nt, Bordetella pertussis
ggcugcgcgcgccagcgcc

SEQ ID NO: 339235 - RNA, 21 nt, Bordetella pertussis
ggcugcgcggguccggcgugc

SEQ ID NO: 339236 - RNA, 15 nt, Bordetella pertussis
ggcugcggcguggcg

SEQ ID NO: 339237 - RNA, 20 nt, Bordetella pertussis
ggcugcucguucugcgcgcc

SEQ ID NO: 339238 - RNA, 17 nt, Bordetella pertussis
ggcugcugggccggcgc

SEQ ID NO: 339239 - RNA, 18 nt, Bordetella pertussis
ggcugcugggccggcgcg

SEQ ID NO: 339240 - RNA, 21 nt, Bordetella pertussis
ggcugcuugagcagccacugc

SEQ ID NO: 339241 - RNA, 15 nt, Bordetella pertussis
ggcugcuugcccagc

SEQ ID NO: 339242 - RNA, 17 nt, Bordetella pertussis
ggcuggaagucagccgg

SEQ ID NO: 339243 - RNA, 19 nt, Bordetella pertussis
ggcuggaagucagccggug

SEQ ID NO: 339244 - RNA, 13 nt, Bordetella pertussis
ggcuggacgcgcg

SEQ ID NO: 339245 - RNA, 22 nt, Bordetella pertussis
ggcuggagaacgagccggccgc

SEQ ID NO: 339246 - RNA, 22 nt, Bordetella pertussis
ggcuggagcucuaugucgccgg

SEQ ID NO: 339247 - RNA, 17 nt, Bordetella pertussis
ggcuggauggugccgcc

SEQ ID NO: 339248 - RNA, 21 nt, Bordetella pertussis
ggcuggauggugccgccgccc

SEQ ID NO: 339249 - RNA, 18 nt, Bordetella pertussis
ggcuggauccggcgcugg

SEQ ID NO: 339250 - RNA, 22 nt, Bordetella pertussis
ggcuggauccggcgcuggcgca

SEQ ID NO: 339251 - RNA, 14 nt, Bordetella pertussis
ggcuggcagcgacc

SEQ ID NO: 339252 - RNA, 12 nt, Bordetella pertussis
ggcuggcauggc

SEQ ID NO: 339253 - RNA, 20 nt, Bordetella pertussis
ggcuggcauugagggcguac

SEQ ID NO: 339254 - RNA, 14 nt, Bordetella pertussis
ggcuggccagccgg

SEQ ID NO: 339255 - RNA, 16 nt, Bordetella pertussis
ggcuggccagcggggc

SEQ ID NO: 339256 - RNA, 13 nt, Bordetella pertussis
ggcuggccagcug

SEQ ID NO: 339257 - RNA, 18 nt, Bordetella pertussis
ggcuggccagcuggcggc

SEQ ID NO: 339258 - RNA, 19 nt, Bordetella pertussis
ggcuggccagcuggcggcg

SEQ ID NO: 339259 - RNA, 20 nt, Bordetella pertussis
ggcuggccgaucaccugcag

SEQ ID NO: 339260 - RNA, 13 nt, Bordetella pertussis
ggcuggccggcca

SEQ ID NO: 339261 - RNA, 12 nt, Bordetella pertussis
ggcuggccggcg

SEQ ID NO: 339262 - RNA, 20 nt, Bordetella pertussis
ggcuggccggcguggccugc

SEQ ID NO: 339263 - RNA, 13 nt, Bordetella pertussis
ggcuggcgcaaga

SEQ ID NO: 339264 - RNA, 12 nt, Bordetella pertussis
ggcuggcgauca

SEQ ID NO: 339265 - RNA, 20 nt, Bordetella pertussis
ggcuggcgccguucgucgcg

SEQ ID NO: 339266 - RNA, 20 nt, Bordetella pertussis
ggcuggcgcggcuggcgaug

SEQ ID NO: 339267 - RNA, 16 nt, Bordetella pertussis
ggcuggcggugcgugc

SEQ ID NO: 339268 - RNA, 13 nt, Bordetella pertussis
ggcugggacaggc

SEQ ID NO: 339269 - RNA, 18 nt, Bordetella pertussis
ggcugggagagccggcca

SEQ ID NO: 339270 - RNA, 19 nt, Bordetella pertussis
ggcugggagagccggccac

SEQ ID NO: 339271 - RNA, 14 nt, Bordetella pertussis
ggcugggccagaug

SEQ ID NO: 339272 - RNA, 18 nt, Bordetella pertussis
ggcuggucaacucgcccg

SEQ ID NO: 339273 - RNA, 20 nt, Bordetella pertussis
ggcuggucaggcggucgaca

SEQ ID NO: 339274 - RNA, 21 nt, Bordetella pertussis
ggcuggucccugcgcgaggug

SEQ ID NO: 339275 - RNA, 17 nt, Bordetella pertussis
ggcuggucuucgagcgc

SEQ ID NO: 339276 - RNA, 23 nt, Bordetella pertussis
ggcuggugcgccgugcccggcgg

SEQ ID NO: 339277 - RNA, 18 nt, Bordetella pertussis
ggcugguggugccgcgca

SEQ ID NO: 339278 - RNA, 23 nt, Bordetella pertussis
ggcuucgucauggucgaccagca

SEQ ID NO: 339279 - RNA, 14 nt, Bordetella pertussis
ggcuucgucgacca

SEQ ID NO: 339280 - RNA, 16 nt, Bordetella pertussis
ggcuucgucgccggcg

SEQ ID NO: 339281 - RNA, 16 nt, Bordetella pertussis
ggcuucguuggugucg

SEQ ID NO: 339282 - RNA, 23 nt, Bordetella pertussis
ggcuucguuggugucggcggcga

SEQ ID NO: 339283 - RNA, 19 nt, Bordetella pertussis
ggcuugaccacggccagca

SEQ ID NO: 339284 - RNA, 18 nt, Bordetella pertussis
ggcuugauggccagcgcg

SEQ ID NO: 339285 - RNA, 19 nt, Bordetella pertussis
ggcuugauggccagcgcgc

SEQ ID NO: 339286 - RNA, 15 nt, Bordetella pertussis
ggcuugauggcgaug

SEQ ID NO: 339287 - RNA, 18 nt, Bordetella pertussis
ggcuugcacgccggccac

SEQ ID NO: 339288 - RNA, 21 nt, Bordetella pertussis
ggcuugauaugggcgagcagg

SEQ ID NO: 339289 - RNA, 17 nt, Bordetella pertussis
ggcuugguugucgcgca

SEQ ID NO: 339290 - RNA, 19 nt, Bordetella pertussis
ggcuuguucgagcgcgcgc

SEQ ID NO: 339291 - RNA, 20 nt, Bordetella pertussis
ggcuuucaugggccugggcg

SEQ ID NO: 339292 - RNA, 20 nt, Bordetella pertussis
ggcuuucgccgcgggccugc

SEQ ID NO: 339293 - RNA, 18 nt, Bordetella pertussis
ggcuuucggucucgcgcg

SEQ ID NO: 339294 - RNA, 14 nt, Bordetella pertussis
ggcuuugccugcga

SEQ ID NO: 339295 - RNA, 23 nt, Bordetella pertussis
ggcuuuuucucggccucgcggcg

SEQ ID NO: 339296 - RNA, 19 nt, Bordetella pertussis
ggcuuuuuuucgccgggcg

SEQ ID NO: 339297 - RNA, 20 nt, Bordetella pertussis
ggcuuuuuuucgccgggcgg

SEQ ID NO: 339298 - RNA, 23 nt, Bordetella pertussis
ggcuuuuuuucgccgggcggcgc

SEQ ID NO: 339299 - RNA, 23 nt, Bordetella pertussis
gggaaacucgcgcagcgugaccg

SEQ ID NO: 339300 - RNA, 15 nt, Bordetella pertussis
gggaagcugucggcg

SEQ ID NO: 339301 - RNA, 19 nt, Bordetella pertussis
gggaagcugucggcgcugg

SEQ ID NO: 339302 - RNA, 20 nt, Bordetella pertussis
gggacaggcaccccgucaug

SEQ ID NO: 339303 - RNA, 22 nt, Bordetella pertussis
gggacaggcaccccgucaugcg

SEQ ID NO: 339304 - RNA, 16 nt, Bordetella pertussis
gggacaggcacccgca

SEQ ID NO: 339305 - RNA, 13 nt, Bordetella pertussis
gggacgccagccc

SEQ ID NO: 339306 - RNA, 23 nt, Bordetella pertussis
gggacgccagcccgccggcgcgc

SEQ ID NO: 339307 - RNA, 16 nt, Bordetella pertussis
gggacgccggcgggca

SEQ ID NO: 339308 - RNA, 12 nt, Bordetella pertussis
gggacgcgggcc

SEQ ID NO: 339309 - RNA, 15 nt, Bordetella pertussis
gggacggcgcgggca

SEQ ID NO: 339310 - RNA, 20 nt, Bordetella pertussis
gggauccacgccgccggcca

SEQ ID NO: 339311 - RNA, 22 nt, Bordetella pertussis
gggauugccgcgcgguggggcg

SEQ ID NO: 339312 - RNA, 17 nt, Bordetella pertussis
gggauuggcgaaaggca

SEQ ID NO: 339313 - RNA, 15 nt, Bordetella pertussis
gggauuucgcuggcc

SEQ ID NO: 339314 - RNA, 20 nt, Bordetella pertussis
gggauuucgcuggccaucgu

SEQ ID NO: 339315 - RNA, 15 nt, Bordetella pertussis
gggcaaaacgcgcau

SEQ ID NO: 339316 - RNA, 22 nt, Bordetella pertussis
gggcaaagaaauugggcguggc

SEQ ID NO: 339317 - RNA, 21 nt, Bordetella pertussis
gggcacgaugcguugcgccuc

SEQ ID NO: 339318 - RNA, 14 nt, Bordetella pertussis
gggcacgcgcgcgg

SEQ ID NO: 339319 - RNA, 14 nt, Bordetella pertussis
gggcacgcgcuuga

SEQ ID NO: 339320 - RNA, 21 nt, Bordetella pertussis
gggcagaacggaaacgcccag

SEQ ID NO: 339321 - RNA, 17 nt, Bordetella pertussis
gggcagcacgcgcacca

SEQ ID NO: 339322 - RNA, 20 nt, Bordetella pertussis
gggcagcacgcgcaccaggc

SEQ ID NO: 339323 - RNA, 14 nt, Bordetella pertussis
gggcagcaggcgca

SEQ ID NO: 339324 - RNA, 17 nt, Bordetella pertussis
gggcagcaggcgcauca

SEQ ID NO: 339325 - RNA, 19 nt, Bordetella pertussis
gggcagcccgcgcacgccc

SEQ ID NO: 339326 - RNA, 15 nt, Bordetella pertussis
gggcagcggcgacgg

SEQ ID NO: 339327 - RNA, 15 nt, Bordetella pertussis
gggcagcucgcgguc

SEQ ID NO: 339328 - RNA, 17 nt, Bordetella pertussis
gggcaggaagccggccc

SEQ ID NO: 339329 - RNA, 20 nt, Bordetella pertussis
gggcaggacgccggcgccgg

SEQ ID NO: 339330 - RNA, 11 nt, Bordetella pertussis
gggcaggccca

SEQ ID NO: 339331 - RNA, 15 nt, Bordetella pertussis
gggcaggcccagcca

SEQ ID NO: 339332 - RNA, 22 nt, Bordetella pertussis
gggcaggcccaugacgccggug

SEQ ID NO: 339333 - RNA, 19 nt, Bordetella pertussis
gggcaggccuggucgagcg

SEQ ID NO: 339334 - RNA, 15 nt, Bordetella pertussis
gggcaggccuucgcg

SEQ ID NO: 339335 - RNA, 14 nt, Bordetella pertussis
gggcagggcgacgu

SEQ ID NO: 339336 - RNA, 12 nt, Bordetella pertussis
gggcagggcgcc

SEQ ID NO: 339337 - RNA, 15 nt, Bordetella pertussis
gggcaggcuggcgcg

SEQ ID NO: 339338 - RNA, 15 nt, Bordetella pertussis
gggcaggugccccac

SEQ ID NO: 339339 - RNA, 19 nt, Bordetella pertussis
gggcaguccuucagcuuga

SEQ ID NO: 339340 - RNA, 12 nt, Bordetella pertussis
gggcagugcgcc

SEQ ID NO: 339341 - RNA, 21 nt, Bordetella pertussis
gggcaucaggggcucggccag

SEQ ID NO: 339342 - RNA, 19 nt, Bordetella pertussis
gggcccggacgcggccggc

SEQ ID NO: 339343 - RNA, 20 nt, Bordetella pertussis
gggcccggacgcggccggca

SEQ ID NO: 339344 - RNA, 22 nt, Bordetella pertussis
gggcccggccacggccgggccu

SEQ ID NO: 339345 - RNA, 17 nt, Bordetella pertussis
gggcccgggcgcgcugu

SEQ ID NO: 339346 - RNA, 16 nt, Bordetella pertussis
gggcccgucgcgccag

SEQ ID NO: 339347 - RNA, 22 nt, Bordetella pertussis
gggccgccgcgcccagccgcgc

SEQ ID NO: 339348 - RNA, 22 nt, Bordetella pertussis
gggccgcgaccacggucuggcg

SEQ ID NO: 339349 - RNA, 17 nt, Bordetella pertussis
gggccgcgagcaugcgc

SEQ ID NO: 339350 - RNA, 19 nt, Bordetella pertussis
gggccgcgagcaugcgcag

SEQ ID NO: 339351 - RNA, 23 nt, Bordetella pertussis
gggccgcgagcaugcgcagcgcg

SEQ ID NO: 339352 - RNA, 17 nt, Bordetella pertussis
gggccgcgccgcggcac

SEQ ID NO: 339353 - RNA, 13 nt, Bordetella pertussis
gggccgcgcgcgg

SEQ ID NO: 339354 - RNA, 17 nt, Bordetella pertussis
gggccgcgcgcgggcgc

SEQ ID NO: 339355 - RNA, 18 nt, Bordetella pertussis
gggccgcggcgcgcgcgg

SEQ ID NO: 339356 - RNA, 12 nt, Bordetella pertussis
gggccgcugguc

SEQ ID NO: 339357 - RNA, 18 nt, Bordetella pertussis
gggccgcuggucaccgcc

SEQ ID NO: 339358 - RNA, 13 nt, Bordetella pertussis
gggccgcuggucg

SEQ ID NO: 339359 - RNA, 16 nt, Bordetella pertussis
gggccgcuguugagga

SEQ ID NO: 339360 - RNA, 14 nt, Bordetella pertussis
gggccgcuggcccg

SEQ ID NO: 339361 - RNA, 15 nt, Bordetella pertussis
gggccggccugcguc

SEQ ID NO: 339362 - RNA, 17 nt, Bordetella pertussis
gggccggccugcgucgc

SEQ ID NO: 339363 - RNA, 17 nt, Bordetella pertussis
gggccggcgcgcgcagg

SEQ ID NO: 339364 - RNA, 22 nt, Bordetella pertussis
gggccggcucauucggcgcgcu

SEQ ID NO: 339365 - RNA, 19 nt, Bordetella pertussis
gggccggcuuuggacaggc

SEQ ID NO: 339366 - RNA, 18 nt, Bordetella pertussis
gggccgggccggcgggcg

SEQ ID NO: 339367 - RNA, 12 nt, Bordetella pertussis
gggccgggcgcc

SEQ ID NO: 339368 - RNA, 16 nt, Bordetella pertussis
gggccgggcgccaggc

SEQ ID NO: 339369 - RNA, 13 nt, Bordetella pertussis
gggccuagcccgg

SEQ ID NO: 339370 - RNA, 15 nt, Bordetella pertussis
gggccucggccagcu

SEQ ID NO: 339371 - RNA, 15 nt, Bordetella pertussis
gggccucgcgggccu

SEQ ID NO: 339372 - RNA, 19 nt, Bordetella pertussis
gggccugcgggccgggcag

SEQ ID NO: 339373 - RNA, 14 nt, Bordetella pertussis
gggccugcugucgc

SEQ ID NO: 339374 - RNA, 18 nt, Bordetella pertussis
gggccuggaagcuggcca

SEQ ID NO: 339375 - RNA, 21 nt, Bordetella pertussis
gggccuggaagcuggccagcg

SEQ ID NO: 339376 - RNA, 22 nt, Bordetella pertussis
gggccuggcggaucucggccag

SEQ ID NO: 339377 - RNA, 15 nt, Bordetella pertussis
gggcgacaggcgcgc

SEQ ID NO: 339378 - RNA, 18 nt, Bordetella pertussis
gggcgacgucccaggccg

SEQ ID NO: 339379 - RNA, 16 nt, Bordetella pertussis
gggcgacuccagcccg

SEQ ID NO: 339380 - RNA, 17 nt, Bordetella pertussis
gggcgacuccagcccga

SEQ ID NO: 339381 - RNA, 14 nt, Bordetella pertussis
gggcgacugcagca

SEQ ID NO: 339382 - RNA, 15 nt, Bordetella pertussis
gggcgaucagcaccg

SEQ ID NO: 339383 - RNA, 14 nt, Bordetella pertussis
gggcgaucaugcag

SEQ ID NO: 339384 - RNA, 16 nt, Bordetella pertussis
gggcgcggcauggcgc

SEQ ID NO: 339385 - RNA, 23 nt, Bordetella pertussis
gggcgcggcauggcgccgcgccg

SEQ ID NO: 339386 - RNA, 13 nt, Bordetella pertussis
gggcgcggcccgg

SEQ ID NO: 339387 - RNA, 18 nt, Bordetella pertussis
gggcgcggaacagccugg

SEQ ID NO: 339388 - RNA, 12 nt, Bordetella pertussis
gggcgcggcgcc

SEQ ID NO: 339389 - RNA, 17 nt, Bordetella pertussis
gggcgcggcggcguucc

SEQ ID NO: 339390 - RNA, 12 nt, Bordetella pertussis
gggcgcggcggu

SEQ ID NO: 339391 - RNA, 15 nt, Bordetella pertussis
gggcgcggugcgcac

SEQ ID NO: 339392 - RNA, 17 nt, Bordetella pertussis
gggcgcggugcgcacca

SEQ ID NO: 339393 - RNA, 13 nt, Bordetella pertussis
gggcgcguggccc

SEQ ID NO: 339394 - RNA, 19 nt, Bordetella pertussis
gggcgcugcacgcagcgca

SEQ ID NO: 339395 - RNA, 21 nt, Bordetella pertussis
gggcgcugcacgcagcgcagg

SEQ ID NO: 339396 - RNA, 15 nt, Bordetella pertussis
gggcgcugcgccggc

SEQ ID NO: 339397 - RNA, 20 nt, Bordetella pertussis
gggcggaaaacagcaccagc

SEQ ID NO: 339398 - RNA, 12 nt, Bordetella pertussis
gggcggaucguc

SEQ ID NO: 339399 - RNA, 16 nt, Bordetella pertussis
gggcggaugagcaggc

SEQ ID NO: 339400 - RNA, 19 nt, Bordetella pertussis
gggcggccacgcgccgccc

SEQ ID NO: 339401 - RNA, 18 nt, Bordetella pertussis
gggcggccacggcgguga

SEQ ID NO: 339402 - RNA, 12 nt, Bordetella pertussis
gggcggcccagc

SEQ ID NO: 339403 - RNA, 22 nt, Bordetella pertussis
gggcggccggcgcgucgccggc

SEQ ID NO: 339404 - RNA, 14 nt, Bordetella pertussis
gggcggccucgacg

SEQ ID NO: 339405 - RNA, 22 nt, Bordetella pertussis
gggcggccuuggccgcagccgg

SEQ ID NO: 339406 - RNA, 14 nt, Bordetella pertussis
gggcggcgagccga

SEQ ID NO: 339407 - RNA, 13 nt, Bordetella pertussis
gggcggcgcagca

SEQ ID NO: 339408 - RNA, 20 nt, Bordetella pertussis
gggcggcgccuggucgcgcg

SEQ ID NO: 339409 - RNA, 18 nt, Bordetella pertussis
gggcggcgcggccaaccc

SEQ ID NO: 339410 - RNA, 14 nt, Bordetella pertussis
gggcggcgcgggcg

SEQ ID NO: 339411 - RNA, 16 nt, Bordetella pertussis
gggcggcguagagcgc

SEQ ID NO: 339412 - RNA, 15 nt, Bordetella pertussis
gggcggcuaggcgca

SEQ ID NO: 339413 - RNA, 16 nt, Bordetella pertussis
gggcggcuaggcgcag

SEQ ID NO: 339414 - RNA, 15 nt, Bordetella pertussis
gggcggcugccagug

SEQ ID NO: 339415 - RNA, 14 nt, Bordetella pertussis
gggcggcugcccgg

SEQ ID NO: 339416 - RNA, 12 nt, Bordetella pertussis
gggcggcguugu

SEQ ID NO: 339417 - RNA, 13 nt, Bordetella pertussis
gggcgggcgcugc

SEQ ID NO: 339418 - RNA, 16 nt, Bordetella pertussis
gggcggguucguggcu

SEQ ID NO: 339419 - RNA, 19 nt, Bordetella pertussis
gggcggguugugcccgccc

SEQ ID NO: 339420 - RNA, 13 nt, Bordetella pertussis
gggcggggcguga

SEQ ID NO: 339421 - RNA, 19 nt, Bordetella pertussis
gggcggggcgugagcaggc

SEQ ID NO: 339422 - RNA, 13 nt, Bordetella pertussis
gggcggugggcag

SEQ ID NO: 339423 - RNA, 16 nt, Bordetella pertussis
gggcgguugcgcugcu

SEQ ID NO: 339424 - RNA, 21 nt, Bordetella pertussis
gggcgucaucggcgcgcagca

SEQ ID NO: 339425 - RNA, 13 nt, Bordetella pertussis
gggcgucgcugcu

SEQ ID NO: 339426 - RNA, 17 nt, Bordetella pertussis
gggcgucgcugcuggcg

SEQ ID NO: 339427 - RNA, 20 nt, Bordetella pertussis
gggugcccaguucgcggccg

SEQ ID NO: 339428 - RNA, 15 nt, Bordetella pertussis
gggugccccgccgga

SEQ ID NO: 339429 - RNA, 13 nt, Bordetella pertussis
gggugcgaggcga

SEQ ID NO: 339430 - RNA, 20 nt, Bordetella pertussis
gggugcgaggcgaacauggc

SEQ ID NO: 339431 - RNA, 17 nt, Bordetella pertussis
gggugcgccgccggccu

SEQ ID NO: 339432 - RNA, 22 nt, Bordetella pertussis
gggugcgccugcagcgccgccu

SEQ ID NO: 339433 - RNA, 21 nt, Bordetella pertussis
gggugcuccugccaggcgccg

SEQ ID NO: 339434 - RNA, 15 nt, Bordetella pertussis
ggguggccacgccca

SEQ ID NO: 339435 - RNA, 14 nt, Bordetella pertussis
ggguggccagcgcc

SEQ ID NO: 339436 - RNA, 15 nt, Bordetella pertussis
ggguggccucgcccu

SEQ ID NO: 339437 - RNA, 13 nt, Bordetella pertussis
ggguggcgccggc

SEQ ID NO: 339438 - RNA, 14 nt, Bordetella pertussis
ggguggcgccguuc

SEQ ID NO: 339439 - RNA, 13 nt, Bordetella pertussis
ggguggcggggcg

SEQ ID NO: 339440 - RNA, 14 nt, Bordetella pertussis
ggguggcggggcgc

SEQ ID NO: 339441 - RNA, 15 nt, Bordetella pertussis
ggguggugaagaacc

SEQ ID NO: 339442 - RNA, 17 nt, Bordetella pertussis
ggguguagucgcggccg

SEQ ID NO: 339443 - RNA, 20 nt, Bordetella pertussis
gggugucgacgcgaugcccg

SEQ ID NO: 339444 - RNA, 18 nt, Bordetella pertussis
gggugucgcuccucccca

SEQ ID NO: 339445 - RNA, 15 nt, Bordetella pertussis
ggguguggccaugca

SEQ ID NO: 339446 - RNA, 19 nt, Bordetella pertussis
ggguucgccgcugucgcag

SEQ ID NO: 339447 - RNA, 12 nt, Bordetella pertussis
ggguucgggcau

SEQ ID NO: 339448 - RNA, 20 nt, Bordetella pertussis
ggguucuguccggcgcuggc

SEQ ID NO: 339449 - RNA, 17 nt, Bordetella pertussis
ggguugccauucggugg

SEQ ID NO: 339450 - RNA, 22 nt, Bordetella pertussis
ggguugcgcgccagcucgcgca

SEQ ID NO: 339451 - RNA, 18 nt, Bordetella pertussis
ggguugugggccgucaug

SEQ ID NO: 339452 - RNA, 16 nt, Bordetella pertussis
ggguuuccagcccgug

SEQ ID NO: 339453 - RNA, 15 nt, Bordetella pertussis
gguaaagcgccggcc

SEQ ID NO: 339454 - RNA, 23 nt, Bordetella pertussis
gguaagcuggcgcuuggccagcu

SEQ ID NO: 339455 - RNA, 23 nt, Bordetella pertussis
gguacaacaucaaugacauggcc

SEQ ID NO: 339456 - RNA, 14 nt, Bordetella pertussis
gguacagcgcgccc

SEQ ID NO: 339457 - RNA, 17 nt, Bordetella pertussis
gguacagcgcgcccgau

SEQ ID NO: 339458 - RNA, 12 nt, Bordetella pertussis
gguacaggccgc

SEQ ID NO: 339459 - RNA, 24 nt, Bordetella pertussis
gguacaccugacgcgaaaaucgcc

SEQ ID NO: 339460 - RNA, 21 nt, Bordetella pertussis
gguacaggucguagaccgccg

SEQ ID NO: 339461 - RNA, 21 nt, Bordetella pertussis
gguacaucauccccagcgccg

SEQ ID NO: 339462 - RNA, 17 nt, Bordetella pertussis
gguacccaugcggggcg

SEQ ID NO: 339463 - RNA, 22 nt, Bordetella pertussis
gguacccccagcggcgcaccga

SEQ ID NO: 339464 - RNA, 14 nt, Bordetella pertussis
gguacgacgagcgc

SEQ ID NO: 339465 - RNA, 15 nt, Bordetella pertussis
gguacgccggccuga

SEQ ID NO: 339466 - RNA, 15 nt, Bordetella pertussis
gguacggcaucccga

SEQ ID NO: 339467 - RNA, 17 nt, Bordetella pertussis
gguacgcgcaguccgca

SEQ ID NO: 339468 - RNA, 20 nt, Bordetella pertussis
gguacguggccccaggcgug

SEQ ID NO: 339469 - RNA, 21 nt, Bordetella pertussis
gguacguggccccaggcguga

SEQ ID NO: 339470 - RNA, 13 nt, Bordetella pertussis
gguagacgaccga

SEQ ID NO: 339471 - RNA, 22 nt, Bordetella pertussis
gguagaccacgcgcugcgcgcc

SEQ ID NO: 339472 - RNA, 19 nt, Bordetella pertussis
gguagaucagcgcgucggc

SEQ ID NO: 339473 - RNA, 15 nt, Bordetella pertussis
gguagcgcacgcacc

SEQ ID NO: 339474 - RNA, 15 nt, Bordetella pertussis
gguagcgcugggcgc

SEQ ID NO: 339475 - RNA, 20 nt, Bordetella pertussis
gguagcgcugggcgccagca

SEQ ID NO: 339476 - RNA, 15 nt, Bordetella pertussis
gguagcgguccagcu

SEQ ID NO: 339477 - RNA, 19 nt, Bordetella pertussis
gguagcgguccagcugcgc

SEQ ID NO: 339478 - RNA, 16 nt, Bordetella pertussis
gguagcggucgccgcg

SEQ ID NO: 339479 - RNA, 18 nt, Bordetella pertussis
gguagcugaccgaagcgc

SEQ ID NO: 339480 - RNA, 22 nt, Bordetella pertussis
gguagcugcugacugugcagcc

SEQ ID NO: 339481 - RNA, 19 nt, Bordetella pertussis
gguaggacggcagcaccgc

SEQ ID NO: 339482 - RNA, 18 nt, Bordetella pertussis
gguaggcaaagcgcagca

SEQ ID NO: 339483 - RNA, 13 nt, Bordetella pertussis
gguaggcccagca

SEQ ID NO: 339484 - RNA, 15 nt, Bordetella pertussis
gguaggcgagcaggu

SEQ ID NO: 339485 - RNA, 18 nt, Bordetella pertussis
gguaggcgcccgacggcg

SEQ ID NO: 339486 - RNA, 21 nt, Bordetella pertussis
gguaggcgggacuggcgagca

SEQ ID NO: 339487 - RNA, 14 nt, Bordetella pertussis
gguagggcgcggcc

SEQ ID NO: 339488 - RNA, 16 nt, Bordetella pertussis
gguaguaaucgcgcgc

SEQ ID NO: 339489 - RNA, 17 nt, Bordetella pertussis
gguaguaaucgcgcgcc

SEQ ID NO: 339490 - RNA, 21 nt, Bordetella pertussis
gguagucgccggcuuccagca

SEQ ID NO: 339491 - RNA, 15 nt, Bordetella pertussis
gguagucggccacca

SEQ ID NO: 339492 - RNA, 22 nt, Bordetella pertussis
gguagugcaaggugaacgauuu

SEQ ID NO: 339493 - RNA, 20 nt, Bordetella pertussis
gguagugcaggccgcgcagc

SEQ ID NO: 339494 - RNA, 15 nt, Bordetella pertussis
gguagugcggcgcca

SEQ ID NO: 339495 - RNA, 17 nt, Bordetella pertussis
gguagugcggcgccagc

SEQ ID NO: 339496 - RNA, 14 nt, Bordetella pertussis
gguaguuggccagg

SEQ ID NO: 339497 - RNA, 22 nt, Bordetella pertussis
gguaucccaccugcagccagau

SEQ ID NO: 339498 - RNA, 13 nt, Bordetella pertussis
gguauccggcgca

SEQ ID NO: 339499 - RNA, 16 nt, Bordetella pertussis
gguauccggcgcacgc

SEQ ID NO: 339500 - RNA, 18 nt, Bordetella pertussis
gguaucgggcaacaaggc

SEQ ID NO: 339501 - RNA, 17 nt, Bordetella pertussis
gguaucgucgaccugga

SEQ ID NO: 339502 - RNA, 21 nt, Bordetella pertussis
gguaucguucgcgcgcgcggu

SEQ ID NO: 339503 - RNA, 17 nt, Bordetella pertussis
gguauguauggcggucg

SEQ ID NO: 339504 - RNA, 22 nt, Bordetella pertussis
gguauucgcugcuggccgcggu

SEQ ID NO: 339505 - RNA, 13 nt, Bordetella pertussis
gguauugcggggc

SEQ ID NO: 339506 - RNA, 23 nt, Bordetella pertussis
gguauugcggggcggcguacagg

SEQ ID NO: 339507 - RNA, 16 nt, Bordetella pertussis
ggucaaguccggcgcc

SEQ ID NO: 339508 - RNA, 18 nt, Bordetella pertussis
ggucaaguccggcgccgc

SEQ ID NO: 339509 - RNA, 20 nt, Bordetella pertussis
ggucaccacccgcacgccgg

SEQ ID NO: 339510 - RNA, 17 nt, Bordetella pertussis
ggucacccggcgcaugc

SEQ ID NO: 339511 - RNA, 20 nt, Bordetella pertussis
ggucacgacgggugaggcga

SEQ ID NO: 339512 - RNA, 22 nt, Bordetella pertussis
ggucacgacgggugaggcgacg

SEQ ID NO: 339513 - RNA, 14 nt, Bordetella pertussis
ggucacgcccaggc

SEQ ID NO: 339514 - RNA, 20 nt, Bordetella pertussis
ggucacgcugguggccacca

SEQ ID NO: 339515 - RNA, 11 nt, Bordetella pertussis
ggucacggccu

SEQ ID NO: 339516 - RNA, 14 nt, Bordetella pertussis
ggucacgggcgaug

SEQ ID NO: 339517 - RNA, 18 nt, Bordetella pertussis
ggucacggucuggcccac

SEQ ID NO: 339518 - RNA, 22 nt, Bordetella pertussis
ggucacggucuggcccacgcgc

SEQ ID NO: 339519 - RNA, 20 nt, Bordetella pertussis
ggucacguucagcgccggca

SEQ ID NO: 339520 - RNA, 23 nt, Bordetella pertussis
ggucacguucagcgccggcauga

SEQ ID NO: 339521 - RNA, 21 nt, Bordetella pertussis
ggucacguucgaccugccgcc

SEQ ID NO: 339522 - RNA, 18 nt, Bordetella pertussis
ggucacugccgaaacgcu

SEQ ID NO: 339523 - RNA, 20 nt, Bordetella pertussis
ggucagcaaccccagcagcg

SEQ ID NO: 339524 - RNA, 16 nt, Bordetella pertussis
ggucagcaccucggcg

SEQ ID NO: 339525 - RNA, 19 nt, Bordetella pertussis
ggucagcaccucggcgccc

SEQ ID NO: 339526 - RNA, 19 nt, Bordetella pertussis
ggucagcacuugccggccg

SEQ ID NO: 339527 - RNA, 15 nt, Bordetella pertussis
ggucagcagcaugcc

SEQ ID NO: 339528 - RNA, 16 nt, Bordetella pertussis
ggucagcagggcgccg

SEQ ID NO: 339529 - RNA, 22 nt, Bordetella pertussis
ggucagcaugaagcugcccagc

SEQ ID NO: 339530 - RNA, 23 nt, Bordetella pertussis
ggucagcaugaagcugcccagca

SEQ ID NO: 339531 - RNA, 13 nt, Bordetella pertussis
ggucagcccggcg

SEQ ID NO: 339532 - RNA, 18 nt, Bordetella pertussis
ggucagcccaggcgggcg

SEQ ID NO: 339533 - RNA, 15 nt, Bordetella pertussis
ggucagccugggcgc

SEQ ID NO: 339534 - RNA, 22 nt, Bordetella pertussis
ggucagccuugcuccggcguga

SEQ ID NO: 339535 - RNA, 12 nt, Bordetella pertussis
ggucagcgccga

SEQ ID NO: 339536 - RNA, 15 nt, Bordetella pertussis
ggucagcgccgacga

SEQ ID NO: 339537 - RNA, 22 nt, Bordetella pertussis
ggucagcgccggcacgcugacc

SEQ ID NO: 339538 - RNA, 17 nt, Bordetella pertussis
ggucagcgccuugccgc

SEQ ID NO: 339539 - RNA, 22 nt, Bordetella pertussis
ggucagcgccuugccgccgugc

SEQ ID NO: 339540 - RNA, 19 nt, Bordetella pertussis
ggucaggucgcugcccagc

SEQ ID NO: 339541 - RNA, 21 nt, Bordetella pertussis
ggucaggucgcugcccagcau

SEQ ID NO: 339542 - RNA, 17 nt, Bordetella pertussis
ggucagguugcgccggc

SEQ ID NO: 339543 - RNA, 16 nt, Bordetella pertussis
ggucaguccgcccagc

SEQ ID NO: 339544 - RNA, 19 nt, Bordetella pertussis
ggucaucaccaggguggcg

SEQ ID NO: 339545 - RNA, 22 nt, Bordetella pertussis
ggucaucacgcggucgaugcgc

SEQ ID NO: 339546 - RNA, 19 nt, Bordetella pertussis
gguccacauccgcgcugcu

SEQ ID NO: 339547 - RNA, 16 nt, Bordetella pertussis
gguccaccaccuucag

SEQ ID NO: 339548 - RNA, 17 nt, Bordetella pertussis
gguccaccaccuucagg

SEQ ID NO: 339549 - RNA, 22 nt, Bordetella pertussis
gguccacgcccuggcuggcggc

SEQ ID NO: 339550 - RNA, 19 nt, Bordetella pertussis
gguccacggcauggccagc

SEQ ID NO: 339551 - RNA, 15 nt, Bordetella pertussis
gguccacguggcgac

SEQ ID NO: 339552 - RNA, 17 nt, Bordetella pertussis
gguccgaaccgaccgcc

SEQ ID NO: 339553 - RNA, 23 nt, Bordetella pertussis
gguccuaaauugccgcgaggcgc

SEQ ID NO: 339554 - RNA, 19 nt, Bordetella pertussis
gguccugcacgcgggccag

SEQ ID NO: 339555 - RNA, 13 nt, Bordetella pertussis
gguccugcgcgcc

SEQ ID NO: 339556 - RNA, 22 nt, Bordetella pertussis
gguccugguaucccucgcccag

SEQ ID NO: 339557 - RNA, 16 nt, Bordetella pertussis
gguccuugccgggcuc

SEQ ID NO: 339558 - RNA, 16 nt, Bordetella pertussis
ggucgaacaggcuggu

SEQ ID NO: 339559 - RNA, 23 nt, Bordetella pertussis
ggucgaagcacugcaggccaucg

SEQ ID NO: 339560 - RNA, 21 nt, Bordetella pertussis
ggucgaauuucccggguggcg

SEQ ID NO: 339561 - RNA, 17 nt, Bordetella pertussis
ggucgagcgccugcgcc

SEQ ID NO: 339562 - RNA, 19 nt, Bordetella pertussis
ggucgagcgccugcgccac

SEQ ID NO: 339563 - RNA, 15 nt, Bordetella pertussis
ggucgagcgcucgcu

SEQ ID NO: 339564 - RNA, 22 nt, Bordetella pertussis
ggucgagguccugcucggugcu

SEQ ID NO: 339565 - RNA, 22 nt, Bordetella pertussis
ggucgcauuggccgccgccacc

SEQ ID NO: 339566 - RNA, 12 nt, Bordetella pertussis
ggucgcacgaca

SEQ ID NO: 339567 - RNA, 19 nt, Bordetella pertussis
ggucgccagcacgcgcagc

SEQ ID NO: 339568 - RNA, 13 nt, Bordetella pertussis
ggucgccagcagg

SEQ ID NO: 339569 - RNA, 14 nt, Bordetella pertussis
ggucgccgcgggca

SEQ ID NO: 339570 - RNA, 15 nt, Bordetella pertussis
ggucgccggcgcaac

SEQ ID NO: 339571 - RNA, 13 nt, Bordetella pertussis
ggucgccgggcag

SEQ ID NO: 339572 - RNA, 15 nt, Bordetella pertussis
ggucgccgggcagcg

SEQ ID NO: 339573 - RNA, 18 nt, Bordetella pertussis
ggucgccgggcagcgggc

SEQ ID NO: 339574 - RNA, 18 nt, Bordetella pertussis
ggucgccgucaggaucag

SEQ ID NO: 339575 - RNA, 24 nt, Bordetella pertussis
ggucgccgucaggaucaggccggc

SEQ ID NO: 339576 - RNA, 22 nt, Bordetella pertussis
ggucgcgaccucggcggcgucg

SEQ ID NO: 339577 - RNA, 19 nt, Bordetella pertussis
ggucgcgagcugcgcgacc

SEQ ID NO: 339578 - RNA, 17 nt, Bordetella pertussis
ggucgcgaucgucgacc

SEQ ID NO: 339579 - RNA, 22 nt, Bordetella pertussis
ggucgcgcaccuguucggcggc

SEQ ID NO: 339580 - RNA, 12 nt, Bordetella pertussis
ggucgcgcagca

SEQ ID NO: 339581 - RNA, 16 nt, Bordetella pertussis
ggucgcgcagcagggc

SEQ ID NO: 339582 - RNA, 23 nt, Bordetella pertussis
ggucgcgcagcauauccgcgugc

SEQ ID NO: 339583 - RNA, 19 nt, Bordetella pertussis
ggucgcgggccaggccggc

SEQ ID NO: 339584 - RNA, 16 nt, Bordetella pertussis
ggucgcggugcgccac

SEQ ID NO: 339585 - RNA, 17 nt, Bordetella pertussis
ggucgcugcccagcaug

SEQ ID NO: 339586 - RNA, 22 nt, Bordetella pertussis
ggucgcuguacuuguccaucgc

SEQ ID NO: 339587 - RNA, 14 nt, Bordetella pertussis
ggucgcuguagcgc

SEQ ID NO: 339588 - RNA, 18 nt, Bordetella pertussis
ggucgcuguagcgcagcc

SEQ ID NO: 339589 - RNA, 16 nt, Bordetella pertussis
ggucgcuuccagcgca

SEQ ID NO: 339590 - RNA, 20 nt, Bordetella pertussis
ggucggaaacacguccagcg

SEQ ID NO: 339591 - RNA, 13 nt, Bordetella pertussis
ggucggacgcgcc

SEQ ID NO: 339592 - RNA, 18 nt, Bordetella pertussis
ggucggacgcgccgggcg

SEQ ID NO: 339593 - RNA, 14 nt, Bordetella pertussis
ggucggagucggcg

SEQ ID NO: 339594 - RNA, 17 nt, Bordetella pertussis
ggucggagucggcgccg

SEQ ID NO: 339595 - RNA, 19 nt, Bordetella pertussis
ggucggagucggcgccgcg

SEQ ID NO: 339596 - RNA, 14 nt, Bordetella pertussis
ggucggccucggcg

SEQ ID NO: 339597 - RNA, 15 nt, Bordetella pertussis
ggucggcgaccgugc

SEQ ID NO: 339598 - RNA, 21 nt, Bordetella pertussis
ggucggcgaugcgcggggccg

SEQ ID NO: 339599 - RNA, 14 nt, Bordetella pertussis
ggucggcgcggggc

SEQ ID NO: 339600 - RNA, 13 nt, Bordetella pertussis
ggucggcgcggca

SEQ ID NO: 339601 - RNA, 15 nt, Bordetella pertussis
ggucggcggccagcg

SEQ ID NO: 339602 - RNA, 18 nt, Bordetella pertussis
ggucggcggccagcgcgc

SEQ ID NO: 339603 - RNA, 14 nt, Bordetella pertussis
ggucggguagcugc

SEQ ID NO: 339604 - RNA, 13 nt, Bordetella pertussis
ggucggguccagc

SEQ ID NO: 339605 - RNA, 17 nt, Bordetella pertussis
ggucggguccagcacgc

SEQ ID NO: 339606 - RNA, 19 nt, Bordetella pertussis
ggucggguaaagcggugcu

SEQ ID NO: 339607 - RNA, 22 nt, Bordetella pertussis
ggucgucccagcgcacgcagcg

SEQ ID NO: 339608 - RNA, 23 nt, Bordetella pertussis
ggucgucccagcgcacgcagcgc

SEQ ID NO: 339609 - RNA, 23 nt, Bordetella pertussis
ggucguccaauucgagcaggcgc

SEQ ID NO: 339610 - RNA, 12 nt, Bordetella pertussis
ggucgucgagcc

SEQ ID NO: 339611 - RNA, 17 nt, Bordetella pertussis
ggucgucgagccgggcc

SEQ ID NO: 339612 - RNA, 18 nt, Bordetella pertussis
ggucgucggccacgcccu

SEQ ID NO: 339613 - RNA, 17 nt, Bordetella pertussis
ggucgucgcggcccugg

SEQ ID NO: 339614 - RNA, 23 nt, Bordetella pertussis
ggucgugcggcacgcacagcaug

SEQ ID NO: 339615 - RNA, 18 nt, Bordetella pertussis
ggucgucgggcggcgcga

SEQ ID NO: 339616 - RNA, 17 nt, Bordetella pertussis
ggucguggcccagccgg

SEQ ID NO: 339617 - RNA, 19 nt, Bordetella pertussis
ggucguggcugaccagcag

SEQ ID NO: 339618 - RNA, 22 nt, Bordetella pertussis
ggucguuguggcaggcgucggc

SEQ ID NO: 339619 - RNA, 14 nt, Bordetella pertussis
ggucugggccagca

SEQ ID NO: 339620 - RNA, 20 nt, Bordetella pertussis
ggucuucacauagcccggcg

SEQ ID NO: 339621 - RNA, 22 nt, Bordetella pertussis
ggucuucacauagcccggcgcg

SEQ ID NO: 339622 - RNA, 16 nt, Bordetella pertussis
ggucuuccgguacgcg

SEQ ID NO: 339623 - RNA, 13 nt, Bordetella pertussis
ggucuucgagcgc

SEQ ID NO: 339624 - RNA, 18 nt, Bordetella pertussis
ggucuucgagcgcgagca

SEQ ID NO: 339625 - RNA, 16 nt, Bordetella pertussis
ggucuucgaugcuggc

SEQ ID NO: 339626 - RNA, 20 nt, Bordetella pertussis
ggucuucgaugcuggcgcgg

SEQ ID NO: 339627 - RNA, 15 nt, Bordetella pertussis
ggucuuccaggcgca

SEQ ID NO: 339628 - RNA, 21 nt, Bordetella pertussis
ggucuuccaggcgcaggcgcg

SEQ ID NO: 339629 - RNA, 13 nt, Bordetella pertussis
ggucuucgggcgu

SEQ ID NO: 339630 - RNA, 15 nt, Bordetella pertussis
ggucuucgggcgugc

SEQ ID NO: 339631 - RNA, 20 nt, Bordetella pertussis
ggucuugagcggcccgggcg

SEQ ID NO: 339632 - RNA, 12 nt, Bordetella pertussis
ggucuugccgcg

SEQ ID NO: 339633 - RNA, 16 nt, Bordetella pertussis
ggugaagaaccgccgc

SEQ ID NO: 339634 - RNA, 20 nt, Bordetella pertussis
ggugaagcccucgucgcggc

SEQ ID NO: 339635 - RNA, 14 nt, Bordetella pertussis
ggugaccuggcgcg

SEQ ID NO: 339636 - RNA, 22 nt, Bordetella pertussis
ggugaccuggggguucgugggc

SEQ ID NO: 339637 - RNA, 17 nt, Bordetella pertussis
ggugacgcuggagcgcg

SEQ ID NO: 339638 - RNA, 16 nt, Bordetella pertussis
ggugacggcguagccg

SEQ ID NO: 339639 - RNA, 13 nt, Bordetella pertussis
ggugacguugacc

SEQ ID NO: 339640 - RNA, 19 nt, Bordetella pertussis
ggugauccacugcagcagu

SEQ ID NO: 339641 - RNA, 20 nt, Bordetella pertussis
ggugaugcgcgcggccagcg

SEQ ID NO: 339642 - RNA, 17 nt, Bordetella pertussis
ggugauggugucgaagc

SEQ ID NO: 339643 - RNA, 18 nt, Bordetella pertussis
ggugauggugucgaagcc

SEQ ID NO: 339644 - RNA, 13 nt, Bordetella pertussis
ggugcacgugggc

SEQ ID NO: 339645 - RNA, 18 nt, Bordetella pertussis
ggugcagcccagcaccac

SEQ ID NO: 339646 - RNA, 19 nt, Bordetella pertussis
ggugcagcccagcaccacg

SEQ ID NO: 339647 - RNA, 13 nt, Bordetella pertussis
ggugcagcggcuc

SEQ ID NO: 339648 - RNA, 16 nt, Bordetella pertussis
ggugcgguugcgaggc

SEQ ID NO: 339649 - RNA, 22 nt, Bordetella pertussis
ggugcgguugcgaggcggccuu

SEQ ID NO: 339650 - RNA, 13 nt, Bordetella pertussis
ggugcguaccagc

SEQ ID NO: 339651 - RNA, 17 nt, Bordetella pertussis
ggugcgugcgcccaugg

SEQ ID NO: 339652 - RNA, 22 nt, Bordetella pertussis
ggugcucaaccucgacgcgcau

SEQ ID NO: 339653 - RNA, 15 nt, Bordetella pertussis
ggugcucggccagcg

SEQ ID NO: 339654 - RNA, 23 nt, Bordetella pertussis
ggugcucggccagcgcgcgccag

SEQ ID NO: 339655 - RNA, 14 nt, Bordetella pertussis
ggugcugagacggc

SEQ ID NO: 339656 - RNA, 18 nt, Bordetella pertussis
ggugcugcagcgcaccac

SEQ ID NO: 339657 - RNA, 22 nt, Bordetella pertussis
ggugcugcccugcaugaccgcc

SEQ ID NO: 339658 - RNA, 15 nt, Bordetella pertussis
ggugcugcgggucga

SEQ ID NO: 339659 - RNA, 13 nt, Bordetella pertussis
ggugcuggccgaa

SEQ ID NO: 339660 - RNA, 19 nt, Bordetella pertussis
ggugcugggcggcgggcac

SEQ ID NO: 339661 - RNA, 15 nt, Bordetella pertussis
ggugcugggucauca

SEQ ID NO: 339662 - RNA, 15 nt, Bordetella pertussis
gguggauucggacgc

SEQ ID NO: 339663 - RNA, 22 nt, Bordetella pertussis
gguggcagagggcgacggcggc

SEQ ID NO: 339664 - RNA, 17 nt, Bordetella pertussis
gguggcgcccggcggcg

SEQ ID NO: 339665 - RNA, 19 nt, Bordetella pertussis
gguggcgccggccaccgcc

SEQ ID NO: 339666 - RNA, 17 nt, Bordetella pertussis
gguggcggacaggcccu

SEQ ID NO: 339667 - RNA, 12 nt, Bordetella pertussis
gguggcggcggg

SEQ ID NO: 339668 - RNA, 15 nt, Bordetella pertussis
gguggcggcggguca

SEQ ID NO: 339669 - RNA, 23 nt, Bordetella pertussis
gguggcguaguagcccaggccca

SEQ ID NO: 339670 - RNA, 15 nt, Bordetella pertussis
gguggcgugcagcag

SEQ ID NO: 339671 - RNA, 15 nt, Bordetella pertussis
gguggcugcgcaggu

SEQ ID NO: 339672 - RNA, 22 nt, Bordetella pertussis
ggugggaaucggcaccucggcg

SEQ ID NO: 339673 - RNA, 19 nt, Bordetella pertussis
ggugggcaccucggggugc

SEQ ID NO: 339674 - RNA, 12 nt, Bordetella pertussis
ggugggcagcag

SEQ ID NO: 339675 - RNA, 19 nt, Bordetella pertussis
ggugggcagcagcacgccc

SEQ ID NO: 339676 - RNA, 17 nt, Bordetella pertussis
ggugggccacucgaugg

SEQ ID NO: 339677 - RNA, 23 nt, Bordetella pertussis
ggugggccacucgaugggcgcgc

SEQ ID NO: 339678 - RNA, 23 nt, Bordetella pertussis
ggugggccgagcccgcgucggcg

SEQ ID NO: 339679 - RNA, 21 nt, Bordetella pertussis
ggugggcgaaccgcggcgcag

SEQ ID NO: 339680 - RNA, 22 nt, Bordetella pertussis
ggugggcgaaccgcggcgcagg

SEQ ID NO: 339681 - RNA, 24 nt, Bordetella pertussis
ggugggcgaugcauucggcggccg

SEQ ID NO: 339682 - RNA, 19 nt, Bordetella pertussis
ggugggcgcgccgcgacgc

SEQ ID NO: 339683 - RNA, 19 nt, Bordetella pertussis
ggugggcgcgcucagcgcc

SEQ ID NO: 339684 - RNA, 15 nt, Bordetella pertussis
gguggugccgcgcac

SEQ ID NO: 339685 - RNA, 16 nt, Bordetella pertussis
gguggugccgcgcacg

SEQ ID NO: 339686 - RNA, 17 nt, Bordetella pertussis
gguggugccgcgcacga

SEQ ID NO: 339687 - RNA, 13 nt, Bordetella pertussis
gguggugccugcu

SEQ ID NO: 339688 - RNA, 17 nt, Bordetella pertussis
ggugucauagcgccagc

SEQ ID NO: 339689 - RNA, 22 nt, Bordetella pertussis
gguguccggaugcacguagcgc

SEQ ID NO: 339690 - RNA, 21 nt, Bordetella pertussis
gguguccuggucggcgcggca

SEQ ID NO: 339691 - RNA, 23 nt, Bordetella pertussis
ggugucgaagccgugcucgugcg

SEQ ID NO: 339692 - RNA, 23 nt, Bordetella pertussis
ggugucgaugggguagucggcca

SEQ ID NO: 339693 - RNA, 20 nt, Bordetella pertussis
ggugucggacaacugcgcga

SEQ ID NO: 339694 - RNA, 17 nt, Bordetella pertussis
ggugucgccgcccaugc

SEQ ID NO: 339695 - RNA, 20 nt, Bordetella pertussis
gguucgacgccggcagcgac

SEQ ID NO: 339696 - RNA, 13 nt, Bordetella pertussis
gguuggccgccag

SEQ ID NO: 339697 - RNA, 19 nt, Bordetella pertussis
gguuggccuugacggcgcg

SEQ ID NO: 339698 - RNA, 20 nt, Bordetella pertussis
gguuggcgaugcucacgccc

SEQ ID NO: 339699 - RNA, 15 nt, Bordetella pertussis
gguuggcgcgccgug

SEQ ID NO: 339700 - RNA, 16 nt, Bordetella pertussis
gguuggcgugcccguu

SEQ ID NO: 339701 - RNA, 21 nt, Bordetella pertussis
gguuggucgucagcgccgcga

SEQ ID NO: 339702 - RNA, 15 nt, Bordetella pertussis
gguuggugucgcgca

SEQ ID NO: 339703 - RNA, 18 nt, Bordetella pertussis
gguugguuugcggcgcga

SEQ ID NO: 339704 - RNA, 18 nt, Bordetella pertussis
gguuguccgaaccacccg

SEQ ID NO: 339705 - RNA, 22 nt, Bordetella pertussis
gguugucggcgccacaggugcg

SEQ ID NO: 339706 - RNA, 18 nt, Bordetella pertussis
gguugugccccuugccca

SEQ ID NO: 339707 - RNA, 22 nt, Bordetella pertussis
gguuguggccguggcggccaca

SEQ ID NO: 339708 - RNA, 21 nt, Bordetella pertussis
guaacucaugccuaucaaggg

SEQ ID NO: 339709 - RNA, 17 nt, Bordetella pertussis
guaauggcgcuccagcc

SEQ ID NO: 339710 - RNA, 15 nt, Bordetella pertussis
guacaacgccgcguc

SEQ ID NO: 339711 - RNA, 14 nt, Bordetella pertussis
guacaccggcgugc

SEQ ID NO: 339712 - RNA, 17 nt, Bordetella pertussis
guacacgcgcaacaugg

SEQ ID NO: 339713 - RNA, 17 nt, Bordetella pertussis
guacacggccagcacgu

SEQ ID NO: 339714 - RNA, 17 nt, Bordetella pertussis
guacagcagcagcacgg

SEQ ID NO: 339715 - RNA, 13 nt, Bordetella pertussis
guacagccaggcc

SEQ ID NO: 339716 - RNA, 13 nt, Bordetella pertussis
guacagccccagc

SEQ ID NO: 339717 - RNA, 16 nt, Bordetella pertussis
guacagccccagcgcc

SEQ ID NO: 339718 - RNA, 17 nt, Bordetella pertussis
guacagccccagcgcca

SEQ ID NO: 339719 - RNA, 16 nt, Bordetella pertussis
guacagcccgaacaga

SEQ ID NO: 339720 - RNA, 13 nt, Bordetella pertussis
guacagccgcggc

SEQ ID NO: 339721 - RNA, 11 nt, Bordetella pertussis
guacagcgcgc

SEQ ID NO: 339722 - RNA, 22 nt, Bordetella pertussis
guacagcuugagaguguugacg

SEQ ID NO: 339723 - RNA, 20 nt, Bordetella pertussis
guacaggcacucgguaucgu

SEQ ID NO: 339724 - RNA, 22 nt, Bordetella pertussis
guacaggccgccggucacugcc

SEQ ID NO: 339725 - RNA, 15 nt, Bordetella pertussis
guacaggccggcggc

SEQ ID NO: 339726 - RNA, 15 nt, Bordetella pertussis
guacaggcugccguc

SEQ ID NO: 339727 - RNA, 22 nt, Bordetella pertussis
guacaggcugccgucggccagc

SEQ ID NO: 339728 - RNA, 17 nt, Bordetella pertussis
guaccagcccagcccgc

SEQ ID NO: 339729 - RNA, 15 nt, Bordetella pertussis
guacccaugcggggc

SEQ ID NO: 339730 - RNA, 17 nt, Bordetella pertussis
guacccaugcggggcgg

SEQ ID NO: 339731 - RNA, 14 nt, Bordetella pertussis
guaccccagcaugu

SEQ ID NO: 339732 - RNA, 14 nt, Bordetella pertussis
guacccccagcggc

SEQ ID NO: 339733 - RNA, 14 nt, Bordetella pertussis
guacccgcgccggc

SEQ ID NO: 339734 - RNA, 17 nt, Bordetella pertussis
guacccggugcagcgug

SEQ ID NO: 339735 - RNA, 20 nt, Bordetella pertussis
guacccggugcagcguggcg

SEQ ID NO: 339736 - RNA, 23 nt, Bordetella pertussis
guacccggugcagcguggcgcgg

SEQ ID NO: 339737 - RNA, 17 nt, Bordetella pertussis
guaccgccacaccgcug

SEQ ID NO: 339738 - RNA, 14 nt, Bordetella pertussis
guacgacagcaagg

SEQ ID NO: 339739 - RNA, 16 nt, Bordetella pertussis
guacgacagcaagggc

SEQ ID NO: 339740 - RNA, 20 nt, Bordetella pertussis
guacgacgccgugcugaucg

SEQ ID NO: 339741 - RNA, 13 nt, Bordetella pertussis
guacgagcggcgg

SEQ ID NO: 339742 - RNA, 14 nt, Bordetella pertussis
guacgagcggcggc

SEQ ID NO: 339743 - RNA, 22 nt, Bordetella pertussis
guacgaggaccuguggcgcacc

SEQ ID NO: 339744 - RNA, 20 nt, Bordetella pertussis
guacgaggcauacaggcugu

SEQ ID NO: 339745 - RNA, 21 nt, Bordetella pertussis
guacgacgucuugcugccguc

SEQ ID NO: 339746 - RNA, 21 nt, Bordetella pertussis
guacgauagcggaugaugggc

SEQ ID NO: 339747 - RNA, 21 nt, Bordetella pertussis
guacgaucaggcggcgcggcg

SEQ ID NO: 339748 - RNA, 18 nt, Bordetella pertussis
guacgcaccgccgccggc

SEQ ID NO: 339749 - RNA, 15 nt, Bordetella pertussis
guacgccaucgacgc

SEQ ID NO: 339750 - RNA, 23 nt, Bordetella pertussis
guacgccaugcgauacagcuugg

SEQ ID NO: 339751 - RNA, 15 nt, Bordetella pertussis
guacgcaucggcgcc

SEQ ID NO: 339752 - RNA, 18 nt, Bordetella pertussis
guacgcaucggcgccggc

SEQ ID NO: 339753 - RNA, 14 nt, Bordetella pertussis
guacgcccagcugg

SEQ ID NO: 339754 - RNA, 12 nt, Bordetella pertussis
guacgccggccu

SEQ ID NO: 339755 - RNA, 20 nt, Bordetella pertussis
guacgccggccugacgcgca

SEQ ID NO: 339756 - RNA, 14 nt, Bordetella pertussis
guacguaccaggcc

SEQ ID NO: 339757 - RNA, 16 nt, Bordetella pertussis
guacguaccaggccgu

SEQ ID NO: 339758 - RNA, 18 nt, Bordetella pertussis
guacguacugccauggcc

SEQ ID NO: 339759 - RNA, 15 nt, Bordetella pertussis
guacguggcgcggcu

SEQ ID NO: 339760 - RNA, 22 nt, Bordetella pertussis
guacuuggcgauggccgccagc

SEQ ID NO: 339761 - RNA, 13 nt, Bordetella pertussis
guagaacgccagg

SEQ ID NO: 339762 - RNA, 19 nt, Bordetella pertussis
guagacaugcucgaugccg

SEQ ID NO: 339763 - RNA, 14 nt, Bordetella pertussis
guagaccaccagca

SEQ ID NO: 339764 - RNA, 17 nt, Bordetella pertussis
guagcccauggccaggg

SEQ ID NO: 339765 - RNA, 15 nt, Bordetella pertussis
guagccgggucuggc

SEQ ID NO: 339766 - RNA, 20 nt, Bordetella pertussis
guagccgggucuggccggcc

SEQ ID NO: 339767 - RNA, 20 nt, Bordetella pertussis
guagccgguaucgcggcgca

SEQ ID NO: 339768 - RNA, 19 nt, Bordetella pertussis
guagccguccucgcgggcc

SEQ ID NO: 339769 - RNA, 14 nt, Bordetella pertussis
guagcgcagcaccg

SEQ ID NO: 339770 - RNA, 22 nt, Bordetella pertussis
guagcgcagcaccggcagaugg

SEQ ID NO: 339771 - RNA, 18 nt, Bordetella pertussis
guagcgcaagcaggucac

SEQ ID NO: 339772 - RNA, 17 nt, Bordetella pertussis
guagcgcaggcgcuuga

SEQ ID NO: 339773 - RNA, 23 nt, Bordetella pertussis
guagcgcaucgcgaugcgcagca

SEQ ID NO: 339774 - RNA, 14 nt, Bordetella pertussis
guagcgccagcguu

SEQ ID NO: 339775 - RNA, 21 nt, Bordetella pertussis
guagcgccagcguucggccac

SEQ ID NO: 339776 - RNA, 19 nt, Bordetella pertussis
guagcgccucgcaucggcc

SEQ ID NO: 339777 - RNA, 22 nt, Bordetella pertussis
guagcgccucgcaucggccugc

SEQ ID NO: 339778 - RNA, 23 nt, Bordetella pertussis
guagcgccucgcaucggccugca

SEQ ID NO: 339779 - RNA, 17 nt, Bordetella pertussis
guagcgcgccagccgcg

SEQ ID NO: 339780 - RNA, 17 nt, Bordetella pertussis
guagcgcguggccagca

SEQ ID NO: 339781 - RNA, 20 nt, Bordetella pertussis
guagcgcguggccagcacgg

SEQ ID NO: 339782 - RNA, 14 nt, Bordetella pertussis
guagcgcucgacuu

SEQ ID NO: 339783 - RNA, 23 nt, Bordetella pertussis
guagcgcucguccaugccggcca

SEQ ID NO: 339784 - RNA, 21 nt, Bordetella pertussis
guagcgcugggcgccagcagc

SEQ ID NO: 339785 - RNA, 22 nt, Bordetella pertussis
guagcggaucgcggcgcggcuu

SEQ ID NO: 339786 - RNA, 14 nt, Bordetella pertussis
guagcggccgccca

SEQ ID NO: 339787 - RNA, 15 nt, Bordetella pertussis
guagcgggcggcggc

SEQ ID NO: 339788 - RNA, 20 nt, Bordetella pertussis
guagcgguagggcgauggcg

SEQ ID NO: 339789 - RNA, 21 nt, Bordetella pertussis
guagcgguagggcgauggcgc

SEQ ID NO: 339790 - RNA, 14 nt, Bordetella pertussis
guaggacggcagca

SEQ ID NO: 339791 - RNA, 15 nt, Bordetella pertussis
guagucgccgcugcc

SEQ ID NO: 339792 - RNA, 18 nt, Bordetella pertussis
guagugcaggccgcgcag

SEQ ID NO: 339793 - RNA, 19 nt, Bordetella pertussis
guagugcggcgccagcugg

SEQ ID NO: 339794 - RNA, 18 nt, Bordetella pertussis
guagugguaugaccggcg

SEQ ID NO: 339795 - RNA, 22 nt, Bordetella pertussis
guaguguuccugguagccggcg

SEQ ID NO: 339796 - RNA, 14 nt, Bordetella pertussis
guaguucggcgcgu

SEQ ID NO: 339797 - RNA, 16 nt, Bordetella pertussis
guaguuggucgagcgc

SEQ ID NO: 339798 - RNA, 19 nt, Bordetella pertussis
guaguugucgucgcgcugg

SEQ ID NO: 339799 - RNA, 14 nt, Bordetella pertussis
guauagaugcgcgg

SEQ ID NO: 339800 - RNA, 20 nt, Bordetella pertussis
guauagcgguacucgcgcgg

SEQ ID NO: 339801 - RNA, 21 nt, Bordetella pertussis
guaucccaccugcagccagau

SEQ ID NO: 339802 - RNA, 14 nt, Bordetella pertussis
guaucccggccagg

SEQ ID NO: 339803 - RNA, 13 nt, Bordetella pertussis
guauccuggcgcg

SEQ ID NO: 339804 - RNA, 19 nt, Bordetella pertussis
guaucgacccaggccggcg

SEQ ID NO: 339805 - RNA, 15 nt, Bordetella pertussis
guaucgauagccgac

SEQ ID NO: 339806 - RNA, 15 nt, Bordetella pertussis
guaugacagggugcc

SEQ ID NO: 339807 - RNA, 14 nt, Bordetella pertussis
guaugacgcgcuga

SEQ ID NO: 339808 - RNA, 18 nt, Bordetella pertussis
guaugcaccgggccgaac

SEQ ID NO: 339809 - RNA, 17 nt, Bordetella pertussis
guaugcacgaccaggcc

SEQ ID NO: 339810 - RNA, 23 nt, Bordetella pertussis
guaugcacgaugccgucgccgcc

SEQ ID NO: 339811 - RNA, 12 nt, Bordetella pertussis
guaugcgcagcg

SEQ ID NO: 339812 - RNA, 18 nt, Bordetella pertussis
guauggcccgccaccacg

SEQ ID NO: 339813 - RNA, 21 nt, Bordetella pertussis
guauggcccgccaccacggcg

SEQ ID NO: 339814 - RNA, 15 nt, Bordetella pertussis
guauggccgcccagc

SEQ ID NO: 339815 - RNA, 15 nt, Bordetella pertussis
guaugguuggccacg

SEQ ID NO: 339816 - RNA, 17 nt, Bordetella pertussis
guauggcugcaccugcc

SEQ ID NO: 339817 - RNA, 21 nt, Bordetella pertussis
gucaccacccgcacgccggcc

SEQ ID NO: 339818 - RNA, 16 nt, Bordetella pertussis
gucaccagcaggcggc

SEQ ID NO: 339819 - RNA, 16 nt, Bordetella pertussis
gucacccggcgcaugc

SEQ ID NO: 339820 - RNA, 16 nt, Bordetella pertussis
gucaccgagcugagca

SEQ ID NO: 339821 - RNA, 23 nt, Bordetella pertussis
gucaccgagcugagcaccagcag

SEQ ID NO: 339822 - RNA, 19 nt, Bordetella pertussis
gucaccgcgcccagggugg

SEQ ID NO: 339823 - RNA, 15 nt, Bordetella pertussis
gucacgauuucggcc

SEQ ID NO: 339824 - RNA, 21 nt, Bordetella pertussis
gucacgcacagcaccuggugg

SEQ ID NO: 339825 - RNA, 13 nt, Bordetella pertussis
gucacgcggccgg

SEQ ID NO: 339826 - RNA, 16 nt, Bordetella pertussis
gucacgcggccgggca

SEQ ID NO: 339827 - RNA, 17 nt, Bordetella pertussis
gucacgcugguggccac

SEQ ID NO: 339828 - RNA, 22 nt, Bordetella pertussis
gucacggcaagacggcgcucgg

SEQ ID NO: 339829 - RNA, 15 nt, Bordetella pertussis
gucacggaucagccg

SEQ ID NO: 339830 - RNA, 17 nt, Bordetella pertussis
gucacggaucagccgcu

SEQ ID NO: 339831 - RNA, 18 nt, Bordetella pertussis
gucacguacucgccgucg

SEQ ID NO: 339832 - RNA, 19 nt, Bordetella pertussis
gucacguacucgccgucga

SEQ ID NO: 339833 - RNA, 17 nt, Bordetella pertussis
gucacggucuggcccac

SEQ ID NO: 339834 - RNA, 19 nt, Bordetella pertussis
gucacggucuggcccacgc

SEQ ID NO: 339835 - RNA, 16 nt, Bordetella pertussis
gucacguucagcgccg

SEQ ID NO: 339836 - RNA, 23 nt, Bordetella pertussis
gucagagcccuucgacgcggcgg

SEQ ID NO: 339837 - RNA, 14 nt, Bordetella pertussis
gucagcaaccccag

SEQ ID NO: 339838 - RNA, 20 nt, Bordetella pertussis
gucagcaaccccagcagcgc

SEQ ID NO: 339839 - RNA, 22 nt, Bordetella pertussis
gucagcaaccccagcagcgccg

SEQ ID NO: 339840 - RNA, 23 nt, Bordetella pertussis
gucagcaaccccagcagcgccgg

SEQ ID NO: 339841 - RNA, 15 nt, Bordetella pertussis
gucagcacaucgccc

SEQ ID NO: 339842 - RNA, 14 nt, Bordetella pertussis
guccagcguggcgc

SEQ ID NO: 339843 - RNA, 15 nt, Bordetella pertussis
guccagcguggcgca

SEQ ID NO: 339844 - RNA, 14 nt, Bordetella pertussis
guccagcuccagcg

SEQ ID NO: 339845 - RNA, 19 nt, Bordetella pertussis
guccaggaagcagcccagc

SEQ ID NO: 339846 - RNA, 13 nt, Bordetella pertussis
guccaggcccagc

SEQ ID NO: 339847 - RNA, 14 nt, Bordetella pertussis
guccaggcccagcg

SEQ ID NO: 339848 - RNA, 13 nt, Bordetella pertussis
guccaggccggcc

SEQ ID NO: 339849 - RNA, 19 nt, Bordetella pertussis
guccaggccggccugcaau

SEQ ID NO: 339850 - RNA, 19 nt, Bordetella pertussis
guccaggcccuggcggcgc

SEQ ID NO: 339851 - RNA, 17 nt, Bordetella pertussis
guccaggccgaaauggc

SEQ ID NO: 339852 - RNA, 23 nt, Bordetella pertussis
guccagguugggcaccaccaccg

SEQ ID NO: 339853 - RNA, 17 nt, Bordetella pertussis
guccagucccguggcgc

SEQ ID NO: 339854 - RNA, 15 nt, Bordetella pertussis
guccaguccuucgcg

SEQ ID NO: 339855 - RNA, 21 nt, Bordetella pertussis
gucccccugcggggacaggca

SEQ ID NO: 339856 - RNA, 12 nt, Bordetella pertussis
guccccgaacgg

SEQ ID NO: 339857 - RNA, 21 nt, Bordetella pertussis
guccccgcacggggacaggca

SEQ ID NO: 339858 - RNA, 19 nt, Bordetella pertussis
guccccgcagggacaggca

SEQ ID NO: 339859 - RNA, 20 nt, Bordetella pertussis
guccccgcagggacaggcac

SEQ ID NO: 339860 - RNA, 19 nt, Bordetella pertussis
guccccgcagggacaggcu

SEQ ID NO: 339861 - RNA, 23 nt, Bordetella pertussis
guccccgcaugggggcuggcgcu

SEQ ID NO: 339862 - RNA, 13 nt, Bordetella pertussis
guccccgccggga

SEQ ID NO: 339863 - RNA, 14 nt, Bordetella pertussis
guccccgccgggac

SEQ ID NO: 339864 - RNA, 19 nt, Bordetella pertussis
guccccgccgggacaggca

SEQ ID NO: 339865 - RNA, 13 nt, Bordetella pertussis
guccccgccgggg

SEQ ID NO: 339866 - RNA, 14 nt, Bordetella pertussis
guccccgcggggac

SEQ ID NO: 339867 - RNA, 19 nt, Bordetella pertussis
guccccgcggggacagaua

SEQ ID NO: 339868 - RNA, 23 nt, Bordetella pertussis
guccccgcggggacaggcacccu

SEQ ID NO: 339869 - RNA, 20 nt, Bordetella pertussis
guccccgcugggacaggcac

SEQ ID NO: 339870 - RNA, 19 nt, Bordetella pertussis
guccccgucgggacaggcu

SEQ ID NO: 339871 - RNA, 19 nt, Bordetella pertussis
guccccguggggacagaua

SEQ ID NO: 339872 - RNA, 20 nt, Bordetella pertussis
guccccugcggggacaggca

SEQ ID NO: 339873 - RNA, 18 nt, Bordetella pertussis
gucccgcaccgaccagcg

SEQ ID NO: 339874 - RNA, 21 nt, Bordetella pertussis
gucccgcaccgaccagcgcgc

SEQ ID NO: 339875 - RNA, 20 nt, Bordetella pertussis
gucccugaacguggcgucca

SEQ ID NO: 339876 - RNA, 14 nt, Bordetella pertussis
gucccugcggggac

SEQ ID NO: 339877 - RNA, 21 nt, Bordetella pertussis
gucccugcggggacuggcucc

SEQ ID NO: 339878 - RNA, 19 nt, Bordetella pertussis
gucccugcgggggcaggca

SEQ ID NO: 339879 - RNA, 14 nt, Bordetella pertussis
gucccugccgggac

SEQ ID NO: 339880 - RNA, 19 nt, Bordetella pertussis
gucccugccgggacaggca

SEQ ID NO: 339881 - RNA, 15 nt, Bordetella pertussis
gucccugguccagca

SEQ ID NO: 339882 - RNA, 18 nt, Bordetella pertussis
guccgaaccacccggcca

SEQ ID NO: 339883 - RNA, 21 nt, Bordetella pertussis
guccgaaccacccggccaucg

SEQ ID NO: 339884 - RNA, 19 nt, Bordetella pertussis
guccgaaccgaccgccacg

SEQ ID NO: 339885 - RNA, 17 nt, Bordetella pertussis
guccgaauacgccacgu

SEQ ID NO: 339886 - RNA, 14 nt, Bordetella pertussis
guccgccaugcgau

SEQ ID NO: 339887 - RNA, 20 nt, Bordetella pertussis
guccgcccagccaggcgcca

SEQ ID NO: 339888 - RNA, 21 nt, Bordetella pertussis
guccgcccagccaggcgccag

SEQ ID NO: 339889 - RNA, 22 nt, Bordetella pertussis
guccgccccauccacggcgcca

SEQ ID NO: 339890 - RNA, 23 nt, Bordetella pertussis
guccgccccauccacggcgccau

SEQ ID NO: 339891 - RNA, 13 nt, Bordetella pertussis
guccgccggcacg

SEQ ID NO: 339892 - RNA, 22 nt, Bordetella pertussis
guccgccgcgaccaccagcacc

SEQ ID NO: 339893 - RNA, 17 nt, Bordetella pertussis
guccgccguagcgcgcc

SEQ ID NO: 339894 - RNA, 21 nt, Bordetella pertussis
guccgccguagcgcgccagcc

SEQ ID NO: 339895 - RNA, 15 nt, Bordetella pertussis
guccgccgugcaggc

SEQ ID NO: 339896 - RNA, 22 nt, Bordetella pertussis
guccgccgugcaggcccgggcg

SEQ ID NO: 339897 - RNA, 19 nt, Bordetella pertussis
guccgcgcgcagcgcgccg

SEQ ID NO: 339898 - RNA, 16 nt, Bordetella pertussis
guccgcgcgccgcugu

SEQ ID NO: 339899 - RNA, 17 nt, Bordetella pertussis
guccgcggcccgcccgc

SEQ ID NO: 339900 - RNA, 15 nt, Bordetella pertussis
guccgcgucggccgc

SEQ ID NO: 339901 - RNA, 14 nt, Bordetella pertussis
guccgcgugggcau

SEQ ID NO: 339902 - RNA, 19 nt, Bordetella pertussis
guccgcgugggcauggugg

SEQ ID NO: 339903 - RNA, 15 nt, Bordetella pertussis
guccgcucgaggcca

SEQ ID NO: 339904 - RNA, 17 nt, Bordetella pertussis
guccgcuucgucgggca

SEQ ID NO: 339905 - RNA, 23 nt, Bordetella pertussis
guccgcuucgucgggcagcgcgg

SEQ ID NO: 339906 - RNA, 17 nt, Bordetella pertussis
guccggaucccaggccg

SEQ ID NO: 339907 - RNA, 19 nt, Bordetella pertussis
guccggaucccaggccggc

SEQ ID NO: 339908 - RNA, 23 nt, Bordetella pertussis
guccggaugcacguagcgcagca

SEQ ID NO: 339909 - RNA, 18 nt, Bordetella pertussis
guccggcagcacccagcg

SEQ ID NO: 339910 - RNA, 19 nt, Bordetella pertussis
guccggccccaggaugcgc

SEQ ID NO: 339911 - RNA, 21 nt, Bordetella pertussis
guccggccccaggaugcgcac

SEQ ID NO: 339912 - RNA, 13 nt, Bordetella pertussis
guccggccgcgca

SEQ ID NO: 339913 - RNA, 20 nt, Bordetella pertussis
guccggccgcgcaaggcggc

SEQ ID NO: 339914 - RNA, 23 nt, Bordetella pertussis
guccggccgcgcaaggcggcccg

SEQ ID NO: 339915 - RNA, 21 nt, Bordetella pertussis
guccggcgcccgccgccgggc

SEQ ID NO: 339916 - RNA, 16 nt, Bordetella pertussis
guccggcgccgccggg

SEQ ID NO: 339917 - RNA, 14 nt, Bordetella pertussis
guccggcgcgucgc

SEQ ID NO: 339918 - RNA, 17 nt, Bordetella pertussis
guccggcgggccgcugu

SEQ ID NO: 339919 - RNA, 18 nt, Bordetella pertussis
guccggcgugccauggac

SEQ ID NO: 339920 - RNA, 17 nt, Bordetella pertussis
guccgggccgguuucgg

SEQ ID NO: 339921 - RNA, 22 nt, Bordetella pertussis
guccggguugcccacgccuucc

SEQ ID NO: 339922 - RNA, 18 nt, Bordetella pertussis
guccgguauccuggcgcg

SEQ ID NO: 339923 - RNA, 13 nt, Bordetella pertussis
guccggucgcgcg

SEQ ID NO: 339924 - RNA, 18 nt, Bordetella pertussis
guccgguucgcccaccac

SEQ ID NO: 339925 - RNA, 22 nt, Bordetella pertussis
guccguacgccacuuccuugcc

SEQ ID NO: 339926 - RNA, 18 nt, Bordetella pertussis
guccguaguugcgccccg

SEQ ID NO: 339927 - RNA, 14 nt, Bordetella pertussis
guccguaucgcggc

SEQ ID NO: 339928 - RNA, 16 nt, Bordetella pertussis
guccguaucgcggccg

SEQ ID NO: 339929 - RNA, 15 nt, Bordetella pertussis
guccgucgggcaagc

SEQ ID NO: 339930 - RNA, 21 nt, Bordetella pertussis
guccgucucgcccaggcccag

SEQ ID NO: 339931 - RNA, 22 nt, Bordetella pertussis
guccgugaagccguccuugagg

SEQ ID NO: 339932 - RNA, 18 nt, Bordetella pertussis
guccgugcuggccgcgga

SEQ ID NO: 339933 - RNA, 16 nt, Bordetella pertussis
guccguggccggcgcg

SEQ ID NO: 339934 - RNA, 18 nt, Bordetella pertussis
guccguuucgucggcgcg

SEQ ID NO: 339935 - RNA, 18 nt, Bordetella pertussis
guccuaaauugccgcgag

SEQ ID NO: 339936 - RNA, 22 nt, Bordetella pertussis
guccuaaauugccgcgaggcgc

SEQ ID NO: 339937 - RNA, 21 nt, Bordetella pertussis
guccucaggcccgcggcgcca

SEQ ID NO: 339938 - RNA, 22 nt, Bordetella pertussis
guccucaggcccgcggcgccag

SEQ ID NO: 339939 - RNA, 22 nt, Bordetella pertussis
guccuccccgcugaccuggugu

SEQ ID NO: 339940 - RNA, 17 nt, Bordetella pertussis
guccucgaugacgacga

SEQ ID NO: 339941 - RNA, 17 nt, Bordetella pertussis
guccucgcacgugacgc

SEQ ID NO: 339942 - RNA, 21 nt, Bordetella pertussis
guccucgcacgugacgccggc

SEQ ID NO: 339943 - RNA, 19 nt, Bordetella pertussis
guccucggccagccgggcg

SEQ ID NO: 339944 - RNA, 13 nt, Bordetella pertussis
guccucggccugg

SEQ ID NO: 339945 - RNA, 16 nt, Bordetella pertussis
guccucuacuggcuga

SEQ ID NO: 339946 - RNA, 18 nt, Bordetella pertussis
guccugaaucgcccgggc

SEQ ID NO: 339947 - RNA, 15 nt, Bordetella pertussis
guccugaggccaggc

SEQ ID NO: 339948 - RNA, 15 nt, Bordetella pertussis
guccugcacgcgggc

SEQ ID NO: 339949 - RNA, 15 nt, Bordetella pertussis
guccugcaggaaggc

SEQ ID NO: 339950 - RNA, 13 nt, Bordetella pertussis
guccugcaggccc

SEQ ID NO: 339951 - RNA, 17 nt, Bordetella pertussis
guccugcaggcccggcg

SEQ ID NO: 339952 - RNA, 18 nt, Bordetella pertussis
guccugcaggcggcgcau

SEQ ID NO: 339953 - RNA, 20 nt, Bordetella pertussis
guccugcaggcggcgcauca

SEQ ID NO: 339954 - RNA, 17 nt, Bordetella pertussis
guccugcaucgccaugc

SEQ ID NO: 339955 - RNA, 19 nt, Bordetella pertussis
guccugcaucgccaugccg

SEQ ID NO: 339956 - RNA, 20 nt, Bordetella pertussis
guccugcaucgccaugccgg

SEQ ID NO: 339957 - RNA, 22 nt, Bordetella pertussis
guccugccaguugccgccgccg

SEQ ID NO: 339958 - RNA, 23 nt, Bordetella pertussis
guccugccaguugccgccgccgg

SEQ ID NO: 339959 - RNA, 20 nt, Bordetella pertussis
guccugccauugcgcggccu

SEQ ID NO: 339960 - RNA, 22 nt, Bordetella pertussis
guccugccauugcgcggccugc

SEQ ID NO: 339961 - RNA, 21 nt, Bordetella pertussis
guccugccggggcacccaggc

SEQ ID NO: 339962 - RNA, 15 nt, Bordetella pertussis
guccugcggcggcag

SEQ ID NO: 339963 - RNA, 20 nt, Bordetella pertussis
guccuggacagugcccugac

SEQ ID NO: 339964 - RNA, 14 nt, Bordetella pertussis
guccuggcaggccg

SEQ ID NO: 339965 - RNA, 14 nt, Bordetella pertussis
guccuggcgcgcca

SEQ ID NO: 339966 - RNA, 19 nt, Bordetella pertussis
guccuggcgcgccaggaag

SEQ ID NO: 339967 - RNA, 20 nt, Bordetella pertussis
guccuggcggccgcccagca

SEQ ID NO: 339968 - RNA, 21 nt, Bordetella pertussis
guccuggcgaccggcggcacc

SEQ ID NO: 339969 - RNA, 20 nt, Bordetella pertussis
guccuggcguggccguucgg

SEQ ID NO: 339970 - RNA, 19 nt, Bordetella pertussis
guccugggccgagcgcgcc

SEQ ID NO: 339971 - RNA, 23 nt, Bordetella pertussis
guccugggccgagcgcgccagca

SEQ ID NO: 339972 - RNA, 17 nt, Bordetella pertussis
guccuggggcgcggucu

SEQ ID NO: 339973 - RNA, 23 nt, Bordetella pertussis
guccugguaagaaaccuggcccg

SEQ ID NO: 339974 - RNA, 22 nt, Bordetella pertussis
guccugguagaucagcgcgucg

SEQ ID NO: 339975 - RNA, 18 nt, Bordetella pertussis
guccugguaucccucgcc

SEQ ID NO: 339976 - RNA, 20 nt, Bordetella pertussis
guccugguaucccucgccca

SEQ ID NO: 339977 - RNA, 14 nt, Bordetella pertussis
guccuggugcacgc

SEQ ID NO: 339978 - RNA, 18 nt, Bordetella pertussis
guccugguggaccugccg

SEQ ID NO: 339979 - RNA, 15 nt, Bordetella pertussis
guccuucagcacgcu

SEQ ID NO: 339980 - RNA, 14 nt, Bordetella pertussis
guccuucguggcgc

SEQ ID NO: 339981 - RNA, 16 nt, Bordetella pertussis
guccuucguggcgccg

SEQ ID NO: 339982 - RNA, 16 nt, Bordetella pertussis
guccuugagcgccagc

SEQ ID NO: 339983 - RNA, 23 nt, Bordetella pertussis
guccuugagcgccagcucggcca

SEQ ID NO: 339984 - RNA, 13 nt, Bordetella pertussis
guccuugccgggc

SEQ ID NO: 339985 - RNA, 23 nt, Bordetella pertussis
gucgaaauaggaucccggcgcca

SEQ ID NO: 339986 - RNA, 14 nt, Bordetella pertussis
gucgaacagcugca

SEQ ID NO: 339987 - RNA, 17 nt, Bordetella pertussis
gucgaacagcugcagcg

SEQ ID NO: 339988 - RNA, 23 nt, Bordetella pertussis
gucgaacaggcugguggcgucga

SEQ ID NO: 339989 - RNA, 13 nt, Bordetella pertussis
gucgaaccagccg

SEQ ID NO: 339990 - RNA, 13 nt, Bordetella pertussis
gucgaacggccgg

SEQ ID NO: 339991 - RNA, 14 nt, Bordetella pertussis
gucgaacggccggg

SEQ ID NO: 339992 - RNA, 16 nt, Bordetella pertussis
gucgaacguggcggcg

SEQ ID NO: 339993 - RNA, 17 nt, Bordetella pertussis
gucgaacguggcggcga

SEQ ID NO: 339994 - RNA, 19 nt, Bordetella pertussis
gucgaagaaggccuuggcc

SEQ ID NO: 339995 - RNA, 17 nt, Bordetella pertussis
gucgaagaucagggugg

SEQ ID NO: 339996 - RNA, 19 nt, Bordetella pertussis
gucgaagaucuucggcaug

SEQ ID NO: 339997 - RNA, 23 nt, Bordetella pertussis
gucgaagcaggcgguacagcgga

SEQ ID NO: 339998 - RNA, 17 nt, Bordetella pertussis
gucgaagccggcgccau

SEQ ID NO: 339999 - RNA, 17 nt, Bordetella pertussis
gucgaaggcggccggca

SEQ ID NO: 340000 - RNA, 20 nt, Bordetella pertussis
gucgaaguagaacgccggcu

SEQ ID NO: 340001 - RNA, 22 nt, Bordetella pertussis
gucgaaugcacgggcgcugccc

SEQ ID NO: 340002 - RNA, 12 nt, Bordetella pertussis
gucgacauacgc

SEQ ID NO: 340003 - RNA, 16 nt, Bordetella pertussis
gucgacauagacgcgc

SEQ ID NO: 340004 - RNA, 18 nt, Bordetella pertussis
gucgacauagacgcgcag

SEQ ID NO: 340005 - RNA, 21 nt, Bordetella pertussis
gucgacauagacgcgcagcgg

SEQ ID NO: 340006 - RNA, 23 nt, Bordetella pertussis
gucgacauagacgcgcagcggca

SEQ ID NO: 340007 - RNA, 13 nt, Bordetella pertussis
gucgaccaccagc

SEQ ID NO: 340008 - RNA, 16 nt, Bordetella pertussis
gucgaccaccagcauc

SEQ ID NO: 340009 - RNA, 16 nt, Bordetella pertussis
gucgaccacgccggcg

SEQ ID NO: 340010 - RNA, 22 nt, Bordetella pertussis
gucgaccacgccggcggccaug

SEQ ID NO: 340011 - RNA, 21 nt, Bordetella pertussis
gucgaccagcagccgguuggc

SEQ ID NO: 340012 - RNA, 15 nt, Bordetella pertussis
gucgaccaggccggu

SEQ ID NO: 340013 - RNA, 19 nt, Bordetella pertussis
gucgaccaguucggccagc

SEQ ID NO: 340014 - RNA, 22 nt, Bordetella pertussis
gucgacccacuugagcagcgcc

SEQ ID NO: 340015 - RNA, 18 nt, Bordetella pertussis
gucgacccucagcccgca

SEQ ID NO: 340016 - RNA, 16 nt, Bordetella pertussis
gucgaccgcgaagccg

SEQ ID NO: 340017 - RNA, 21 nt, Bordetella pertussis
gucgaccgcgaagcgcgccag

SEQ ID NO: 340018 - RNA, 20 nt, Bordetella pertussis
gucgaccgcgggcgcgcgcc

SEQ ID NO: 340019 - RNA, 21 nt, Bordetella pertussis
gucgaccggaaucaccgccgc

SEQ ID NO: 340020 - RNA, 15 nt, Bordetella pertussis
gucgaccggcccgca

SEQ ID NO: 340021 - RNA, 14 nt, Bordetella pertussis
gucgaccucgagca

SEQ ID NO: 340022 - RNA, 20 nt, Bordetella pertussis
gucgaccugcuugcccagca

SEQ ID NO: 340023 - RNA, 14 nt, Bordetella pertussis
gucgacgacggcaa

SEQ ID NO: 340024 - RNA, 15 nt, Bordetella pertussis
gucgacgaucaggcc

SEQ ID NO: 340025 - RNA, 22 nt, Bordetella pertussis
gucgacgcagcagccgcuaggu

SEQ ID NO: 340026 - RNA, 14 nt, Bordetella pertussis
gucgacgccggcga

SEQ ID NO: 340027 - RNA, 12 nt, Bordetella pertussis
gucgacgcgaug

SEQ ID NO: 340028 - RNA, 17 nt, Bordetella pertussis
gucgacgcgaugcccgc

SEQ ID NO: 340029 - RNA, 17 nt, Bordetella pertussis
gucgacguuaugcucgc

SEQ ID NO: 340030 - RNA, 18 nt, Bordetella pertussis
gucgacguugcgcgacag

SEQ ID NO: 340031 - RNA, 19 nt, Bordetella pertussis
gucgacguugcgcgacagg

SEQ ID NO: 340032 - RNA, 15 nt, Bordetella pertussis
gucgagaccagcagc

SEQ ID NO: 340033 - RNA, 14 nt, Bordetella pertussis
gucgagcaccgcgc

SEQ ID NO: 340034 - RNA, 22 nt, Bordetella pertussis
gucgaguagaaguaggcggcca

SEQ ID NO: 340035 - RNA, 18 nt, Bordetella pertussis
gucgaguucggcgcgccc

SEQ ID NO: 340036 - RNA, 21 nt, Bordetella pertussis
gucgaguucgucgucgccacc

SEQ ID NO: 340037 - RNA, 16 nt, Bordetella pertussis
gucgaguugcgcgcca

SEQ ID NO: 340038 - RNA, 17 nt, Bordetella pertussis
gucgaguugcgcgccau

SEQ ID NO: 340039 - RNA, 23 nt, Bordetella pertussis
gucgauaucgaugaauucgaccc

SEQ ID NO: 340040 - RNA, 21 nt, Bordetella pertussis
gucgaucagccccugccaugc

SEQ ID NO: 340041 - RNA, 16 nt, Bordetella pertussis
gucgaucagcgcgggc

SEQ ID NO: 340042 - RNA, 21 nt, Bordetella pertussis
gucgaucaugaugcgcugggc

SEQ ID NO: 340043 - RNA, 17 nt, Bordetella pertussis
gucgaucauggccagcc

SEQ ID NO: 340044 - RNA, 17 nt, Bordetella pertussis
gucgaucauggcgccga

SEQ ID NO: 340045 - RNA, 19 nt, Bordetella pertussis
gucgaucaggcccagcacg

SEQ ID NO: 340046 - RNA, 16 nt, Bordetella pertussis
gucgaugcgcacgccc

SEQ ID NO: 340047 - RNA, 14 nt, Bordetella pertussis
gucgauggcccgca

SEQ ID NO: 340048 - RNA, 16 nt, Bordetella pertussis
gucgaugggcccgggc

SEQ ID NO: 340049 - RNA, 14 nt, Bordetella pertussis
gucgauguccagcg

SEQ ID NO: 340050 - RNA, 14 nt, Bordetella pertussis
gucgcaggccgcgg

SEQ ID NO: 340051 - RNA, 16 nt, Bordetella pertussis
gucgcaggccgcggcc

SEQ ID NO: 340052 - RNA, 17 nt, Bordetella pertussis
gucgcaggccgcggcca

SEQ ID NO: 340053 - RNA, 23 nt, Bordetella pertussis
gucgcaggccgcggccaggccca

SEQ ID NO: 340054 - RNA, 18 nt, Bordetella pertussis
gucgcagucggggccgca

SEQ ID NO: 340055 - RNA, 15 nt, Bordetella pertussis
gucgccaccgcccag

SEQ ID NO: 340056 - RNA, 22 nt, Bordetella pertussis
gucgccaccucgaucaccaccg

SEQ ID NO: 340057 - RNA, 16 nt, Bordetella pertussis
gucgccacgccauugc

SEQ ID NO: 340058 - RNA, 17 nt, Bordetella pertussis
gucgccacgggcgucac

SEQ ID NO: 340059 - RNA, 20 nt, Bordetella pertussis
gucgccacgggcgucaccgg

SEQ ID NO: 340060 - RNA, 13 nt, Bordetella pertussis
gucgccagcacgc

SEQ ID NO: 340061 - RNA, 17 nt, Bordetella pertussis
gucgccagcacgcgcag

SEQ ID NO: 340062 - RNA, 15 nt, Bordetella pertussis
gucgccagcaggccc

SEQ ID NO: 340063 - RNA, 13 nt, Bordetella pertussis
gucgccagcgacg

SEQ ID NO: 340064 - RNA, 19 nt, Bordetella pertussis
gucgccagcgacgacuuga

SEQ ID NO: 340065 - RNA, 16 nt, Bordetella pertussis
gucgccagcgauccau

SEQ ID NO: 340066 - RNA, 17 nt, Bordetella pertussis
gucgccagcgcgucgcg

SEQ ID NO: 340067 - RNA, 13 nt, Bordetella pertussis
gucgcccuggcgg

SEQ ID NO: 340068 - RNA, 16 nt, Bordetella pertussis
gucgcccuggcggcgg

SEQ ID NO: 340069 - RNA, 20 nt, Bordetella pertussis
gucgcccuggcggcggucaa

SEQ ID NO: 340070 - RNA, 21 nt, Bordetella pertussis
gucgcccuugauggccucggc

SEQ ID NO: 340071 - RNA, 15 nt, Bordetella pertussis
gucgccgacccgggc

SEQ ID NO: 340072 - RNA, 18 nt, Bordetella pertussis
gucgccgcccacggcgac

SEQ ID NO: 340073 - RNA, 20 nt, Bordetella pertussis
gucgccgcccaugcgcaugg

SEQ ID NO: 340074 - RNA, 22 nt, Bordetella pertussis
gucgccgcccugcugcccgccg

SEQ ID NO: 340075 - RNA, 13 nt, Bordetella pertussis
gucgccgccgcgc

SEQ ID NO: 340076 - RNA, 14 nt, Bordetella pertussis
gucgccgccgcgca

SEQ ID NO: 340077 - RNA, 12 nt, Bordetella pertussis
gucgccggcaug

SEQ ID NO: 340078 - RNA, 13 nt, Bordetella pertussis
gucgccggccagg

SEQ ID NO: 340079 - RNA, 14 nt, Bordetella pertussis
gucgccggccaggc

SEQ ID NO: 340080 - RNA, 15 nt, Bordetella pertussis
gucgccggccaggca

SEQ ID NO: 340081 - RNA, 20 nt, Bordetella pertussis
gucgccggccaguggcgcgg

SEQ ID NO: 340082 - RNA, 13 nt, Bordetella pertussis
gucgccggcgcaa

SEQ ID NO: 340083 - RNA, 14 nt, Bordetella pertussis
gucgccggcgcaac

SEQ ID NO: 340084 - RNA, 14 nt, Bordetella pertussis
gucgccggcgcugc

SEQ ID NO: 340085 - RNA, 14 nt, Bordetella pertussis
gucgccggcguugg

SEQ ID NO: 340086 - RNA, 15 nt, Bordetella pertussis
gucgccggcguuggu

SEQ ID NO: 340087 - RNA, 11 nt, Bordetella pertussis
gucgccgggca

SEQ ID NO: 340088 - RNA, 16 nt, Bordetella pertussis
gucgccgggcagcggg

SEQ ID NO: 340089 - RNA, 21 nt, Bordetella pertussis
gucgccgggcagcgggccgca

SEQ ID NO: 340090 - RNA, 20 nt, Bordetella pertussis
gucgccuggucgacgccggc

SEQ ID NO: 340091 - RNA, 21 nt, Bordetella pertussis
gucgccuggucgacgccggcg

SEQ ID NO: 340092 - RNA, 19 nt, Bordetella pertussis
gucgccuguaucagcgccu

SEQ ID NO: 340093 - RNA, 22 nt, Bordetella pertussis
gucgccuguaucagcgccugca

SEQ ID NO: 340094 - RNA, 15 nt, Bordetella pertussis
gucgccuucggcggc

SEQ ID NO: 340095 - RNA, 17 nt, Bordetella pertussis
gucgccuucggcggcga

SEQ ID NO: 340096 - RNA, 16 nt, Bordetella pertussis
gucgccuugucgggga

SEQ ID NO: 340097 - RNA, 12 nt, Bordetella pertussis
gucgcgaccgcc

SEQ ID NO: 340098 - RNA, 19 nt, Bordetella pertussis
gucgcgaccgccgccuugg

SEQ ID NO: 340099 - RNA, 18 nt, Bordetella pertussis
gucgcgaccucggcggcg

SEQ ID NO: 340100 - RNA, 14 nt, Bordetella pertussis
gucgcgagcugcgc

SEQ ID NO: 340101 - RNA, 21 nt, Bordetella pertussis
gucgcgauccggugaucaucg

SEQ ID NO: 340102 - RNA, 15 nt, Bordetella pertussis
gucgcgaugcgccag

SEQ ID NO: 340103 - RNA, 20 nt, Bordetella pertussis
gucgcgaugcgucaggggca

SEQ ID NO: 340104 - RNA, 16 nt, Bordetella pertussis
gucgcgcaacgccggg

SEQ ID NO: 340105 - RNA, 17 nt, Bordetella pertussis
gucgcgcaacgccgggu

SEQ ID NO: 340106 - RNA, 18 nt, Bordetella pertussis
gucgcgcaacgccggguc

SEQ ID NO: 340107 - RNA, 13 nt, Bordetella pertussis
gucgcgcaccagg

SEQ ID NO: 340108 - RNA, 15 nt, Bordetella pertussis
gucgcgcacccgcag

SEQ ID NO: 340109 - RNA, 13 nt, Bordetella pertussis
gucgcgcaccgcc

SEQ ID NO: 340110 - RNA, 20 nt, Bordetella pertussis
gucgcgcagcaccucggggc

SEQ ID NO: 340111 - RNA, 22 nt, Bordetella pertussis
gucgcgcagcacgauggggcca

SEQ ID NO: 340112 - RNA, 13 nt, Bordetella pertussis
gucgcgcagcagg

SEQ ID NO: 340113 - RNA, 14 nt, Bordetella pertussis
gucgcgcagcaggg

SEQ ID NO: 340114 - RNA, 22 nt, Bordetella pertussis
gucgcgcgacuggcccaggcgg

SEQ ID NO: 340115 - RNA, 20 nt, Bordetella pertussis
gucgcgcgcaucgccgaaca

SEQ ID NO: 340116 - RNA, 14 nt, Bordetella pertussis
gucgcgcgccaggc

SEQ ID NO: 340117 - RNA, 16 nt, Bordetella pertussis
gucgcgcgccaggcgg

SEQ ID NO: 340118 - RNA, 15 nt, Bordetella pertussis
gucgcgcgcgcggau

SEQ ID NO: 340119 - RNA, 13 nt, Bordetella pertussis
gucgcgcggcggc

SEQ ID NO: 340120 - RNA, 17 nt, Bordetella pertussis
gucgcgcggcggcacca

SEQ ID NO: 340121 - RNA, 18 nt, Bordetella pertussis
gucgcggcgucgaccgcg

SEQ ID NO: 340122 - RNA, 13 nt, Bordetella pertussis
gucgcggcguugu

SEQ ID NO: 340123 - RNA, 12 nt, Bordetella pertussis
gucgcggcuggg

SEQ ID NO: 340124 - RNA, 13 nt, Bordetella pertussis
gucgcggcugggc

SEQ ID NO: 340125 - RNA, 14 nt, Bordetella pertussis
gucgcggcugggca

SEQ ID NO: 340126 - RNA, 21 nt, Bordetella pertussis
gucgcgggcagugcgccggac

SEQ ID NO: 340127 - RNA, 16 nt, Bordetella pertussis
gucgcgggccaggccg

SEQ ID NO: 340128 - RNA, 17 nt, Bordetella pertussis
gucgcgggccaggccgg

SEQ ID NO: 340129 - RNA, 18 nt, Bordetella pertussis
gucgcgggccaggccggc

SEQ ID NO: 340130 - RNA, 19 nt, Bordetella pertussis
gucgcgggccaggccggcc

SEQ ID NO: 340131 - RNA, 22 nt, Bordetella pertussis
gucgcgggcccgcucggccagc

SEQ ID NO: 340132 - RNA, 17 nt, Bordetella pertussis
gucgcgggugcgggcaa

SEQ ID NO: 340133 - RNA, 23 nt, Bordetella pertussis
gucgcgggugcgggcaaacggcg

SEQ ID NO: 340134 - RNA, 17 nt, Bordetella pertussis
gucgcucaugaccagcg

SEQ ID NO: 340135 - RNA, 21 nt, Bordetella pertussis
gucgcucauggaggggcgcag

SEQ ID NO: 340136 - RNA, 17 nt, Bordetella pertussis
gucgcucccccaugcgg

SEQ ID NO: 340137 - RNA, 17 nt, Bordetella pertussis
gucgcucugcgcggcau

SEQ ID NO: 340138 - RNA, 20 nt, Bordetella pertussis
gucgcugccgcgcgauccgg

SEQ ID NO: 340139 - RNA, 15 nt, Bordetella pertussis
gucgcugcggccggu

SEQ ID NO: 340140 - RNA, 14 nt, Bordetella pertussis
gucgcugcuggcgg

SEQ ID NO: 340141 - RNA, 15 nt, Bordetella pertussis
gucgcugcuggcggc

SEQ ID NO: 340142 - RNA, 22 nt, Bordetella pertussis
gucgcuggcccacucggugcgc

SEQ ID NO: 340143 - RNA, 12 nt, Bordetella pertussis
gucgcuggcgcc

SEQ ID NO: 340144 - RNA, 12 nt, Bordetella pertussis
gucgcuggcgcg

SEQ ID NO: 340145 - RNA, 17 nt, Bordetella pertussis
gucggacgcgccgggcg

SEQ ID NO: 340146 - RNA, 22 nt, Bordetella pertussis
gucggacgcgccgggcgaaccg

SEQ ID NO: 340147 - RNA, 14 nt, Bordetella pertussis
gucggacgcgcgcc

SEQ ID NO: 340148 - RNA, 13 nt, Bordetella pertussis
gucgcuggggcgc

SEQ ID NO: 340149 - RNA, 15 nt, Bordetella pertussis
gucggagucggcgcc

SEQ ID NO: 340150 - RNA, 22 nt, Bordetella pertussis
gucggagucggcgccgcgcagc

SEQ ID NO: 340151 - RNA, 16 nt, Bordetella pertussis
gucggaguugcccgaa

SEQ ID NO: 340152 - RNA, 13 nt, Bordetella pertussis
gucggcacgucgg

SEQ ID NO: 340153 - RNA, 19 nt, Bordetella pertussis
gucggcacgucgggcagga

SEQ ID NO: 340154 - RNA, 22 nt, Bordetella pertussis
gucggauagaguucggcgcggc

SEQ ID NO: 340155 - RNA, 20 nt, Bordetella pertussis
gucggcauggccaucgcggu

SEQ ID NO: 340156 - RNA, 21 nt, Bordetella pertussis
gucggcauggccaucgcgguc

SEQ ID NO: 340157 - RNA, 22 nt, Bordetella pertussis
gucggcaugucgaugccguaca

SEQ ID NO: 340158 - RNA, 16 nt, Bordetella pertussis
gucggccaaggccggc

SEQ ID NO: 340159 - RNA, 19 nt, Bordetella pertussis
gucggccaaggccggcgcg

SEQ ID NO: 340160 - RNA, 21 nt, Bordetella pertussis
gucggccaccaccagguacac

SEQ ID NO: 340161 - RNA, 15 nt, Bordetella pertussis
gucggccaccaggcc

SEQ ID NO: 340162 - RNA, 16 nt, Bordetella pertussis
gucggccaccaggccg

SEQ ID NO: 340163 - RNA, 19 nt, Bordetella pertussis
gucggccaccgccguggca

SEQ ID NO: 340164 - RNA, 20 nt, Bordetella pertussis
gucggcggguuugcccagua

SEQ ID NO: 340165 - RNA, 20 nt, Bordetella pertussis
gucggcgguccacagcccgg

SEQ ID NO: 340166 - RNA, 21 nt, Bordetella pertussis
gucggcucgucgaacagcauc

SEQ ID NO: 340167 - RNA, 19 nt, Bordetella pertussis
gucggcuuccaucaggaac

SEQ ID NO: 340168 - RNA, 15 nt, Bordetella pertussis
gucgggacggcgcgg

SEQ ID NO: 340169 - RNA, 17 nt, Bordetella pertussis
gucggggcaggccuggu

SEQ ID NO: 340170 - RNA, 14 nt, Bordetella pertussis
gucggggccgggcc

SEQ ID NO: 340171 - RNA, 15 nt, Bordetella pertussis
gucggggcgccgguc

SEQ ID NO: 340172 - RNA, 14 nt, Bordetella pertussis
gucggggcgcucga

SEQ ID NO: 340173 - RNA, 13 nt, Bordetella pertussis
gucgggggccggc

SEQ ID NO: 340174 - RNA, 16 nt, Bordetella pertussis
gucgggggcggccggg

SEQ ID NO: 340175 - RNA, 22 nt, Bordetella pertussis
gucggguugcccugcgcaucga

SEQ ID NO: 340176 - RNA, 16 nt, Bordetella pertussis
gucggguugccgcugc

SEQ ID NO: 340177 - RNA, 21 nt, Bordetella pertussis
gucggucagcacuugccggcc

SEQ ID NO: 340178 - RNA, 16 nt, Bordetella pertussis
gucggugccgccgagc

SEQ ID NO: 340179 - RNA, 22 nt, Bordetella pertussis
gucggugcacacgccuucggcg

SEQ ID NO: 340180 - RNA, 14 nt, Bordetella pertussis
gucggugccgucca

SEQ ID NO: 340181 - RNA, 13 nt, Bordetella pertussis
gucguacagcgcc

SEQ ID NO: 340182 - RNA, 14 nt, Bordetella pertussis
gucguacagcgccu

SEQ ID NO: 340183 - RNA, 19 nt, Bordetella pertussis
gucguacuggugggccgac

SEQ ID NO: 340184 - RNA, 17 nt, Bordetella pertussis
gucguagaacacgucga

SEQ ID NO: 340185 - RNA, 17 nt, Bordetella pertussis
gucguagaccgccgcgc

SEQ ID NO: 340186 - RNA, 17 nt, Bordetella pertussis
gucguagcccucgccca

SEQ ID NO: 340187 - RNA, 19 nt, Bordetella pertussis
gucguagcccucgcccagg

SEQ ID NO: 340188 - RNA, 16 nt, Bordetella pertussis
gucguagcgccagcgu

SEQ ID NO: 340189 - RNA, 17 nt, Bordetella pertussis
gucguagcgccagcguu

SEQ ID NO: 340190 - RNA, 19 nt, Bordetella pertussis
gucguagcggaugaagggc

SEQ ID NO: 340191 - RNA, 13 nt, Bordetella pertussis
gucguaucgccgc

SEQ ID NO: 340192 - RNA, 15 nt, Bordetella pertussis
gucgucagcacgccc

SEQ ID NO: 340193 - RNA, 14 nt, Bordetella pertussis
gucgucagcgccgc

SEQ ID NO: 340194 - RNA, 18 nt, Bordetella pertussis
gucgucagcgccgcgaug

SEQ ID NO: 340195 - RNA, 15 nt, Bordetella pertussis
gucgucaucgccauc

SEQ ID NO: 340196 - RNA, 19 nt, Bordetella pertussis
gucguccaauucgagcagg

SEQ ID NO: 340197 - RNA, 13 nt, Bordetella pertussis
gucguccagcacg

SEQ ID NO: 340198 - RNA, 13 nt, Bordetella pertussis
gucguccagcuug

SEQ ID NO: 340199 - RNA, 20 nt, Bordetella pertussis
gucgucgaugccgaccaggc

SEQ ID NO: 340200 - RNA, 17 nt, Bordetella pertussis
gucgucgauggcccgca

SEQ ID NO: 340201 - RNA, 15 nt, Bordetella pertussis
gucgucgggaccggc

SEQ ID NO: 340202 - RNA, 16 nt, Bordetella pertussis
gucgucgguggggcag

SEQ ID NO: 340203 - RNA, 21 nt, Bordetella pertussis
gucgucguagcgggcggcggc

SEQ ID NO: 340204 - RNA, 17 nt, Bordetella pertussis
gucgucguccacgcccg

SEQ ID NO: 340205 - RNA, 16 nt, Bordetella pertussis
gucgucguccaggcgc

SEQ ID NO: 340206 - RNA, 15 nt, Bordetella pertussis
gucgugaucgccagc

SEQ ID NO: 340207 - RNA, 16 nt, Bordetella pertussis
gucgugaucgccagcg

SEQ ID NO: 340208 - RNA, 19 nt, Bordetella pertussis
gucgugaucgccagcgccg

SEQ ID NO: 340209 - RNA, 23 nt, Bordetella pertussis
gucguggcugaccagcagcaccg

SEQ ID NO: 340210 - RNA, 20 nt, Bordetella pertussis
gucguggggcgcggcggcgu

SEQ ID NO: 340211 - RNA, 22 nt, Bordetella pertussis
gucguuccagaacggcgcggga

SEQ ID NO: 340212 - RNA, 20 nt, Bordetella pertussis
gucguucgaacugguacagc

SEQ ID NO: 340213 - RNA, 12 nt, Bordetella pertussis
gucucgaacgcc

SEQ ID NO: 340214 - RNA, 19 nt, Bordetella pertussis
gucucgaacgccgcgucgc

SEQ ID NO: 340215 - RNA, 21 nt, Bordetella pertussis
gucucgcccaggcccagcauc

SEQ ID NO: 340216 - RNA, 20 nt, Bordetella pertussis
gucucgcccaugaucagggc

SEQ ID NO: 340217 - RNA, 15 nt, Bordetella pertussis
gucucgcgcggccgg

SEQ ID NO: 340218 - RNA, 22 nt, Bordetella pertussis
gucucguccacccccgucagca

SEQ ID NO: 340219 - RNA, 22 nt, Bordetella pertussis
gucucguuccagaugcgcagca

SEQ ID NO: 340220 - RNA, 17 nt, Bordetella pertussis
gucugcgugcgcggcgu

SEQ ID NO: 340221 - RNA, 16 nt, Bordetella pertussis
gucugcuacaccgugc

SEQ ID NO: 340222 - RNA, 19 nt, Bordetella pertussis
gucugcugguacagcccca

SEQ ID NO: 340223 - RNA, 20 nt, Bordetella pertussis
gucugcugguacagccccag

SEQ ID NO: 340224 - RNA, 20 nt, Bordetella pertussis
gucugcuggucgcgggccag

SEQ ID NO: 340225 - RNA, 23 nt, Bordetella pertussis
gucuggagauggguacagcgcgc

SEQ ID NO: 340226 - RNA, 14 nt, Bordetella pertussis
gucuggagcggccu

SEQ ID NO: 340227 - RNA, 16 nt, Bordetella pertussis
gucuggccggugaugc

SEQ ID NO: 340228 - RNA, 14 nt, Bordetella pertussis
gucuggcggccggu

SEQ ID NO: 340229 - RNA, 14 nt, Bordetella pertussis
gucugggccagcag

SEQ ID NO: 340230 - RNA, 14 nt, Bordetella pertussis
gucugggccaugcc

SEQ ID NO: 340231 - RNA, 19 nt, Bordetella pertussis
gucugggcgucccaggcca

SEQ ID NO: 340232 - RNA, 20 nt, Bordetella pertussis
gucuggucgcacaucagguc

SEQ ID NO: 340233 - RNA, 17 nt, Bordetella pertussis
gucuucgaugcuggcgc

SEQ ID NO: 340234 - RNA, 19 nt, Bordetella pertussis
gucuucgaugcuggcgcgg

SEQ ID NO: 340235 - RNA, 19 nt, Bordetella pertussis
gucuugagcggcccgggcg

SEQ ID NO: 340236 - RNA, 18 nt, Bordetella pertussis
gucuugcgcccgcaucgg

SEQ ID NO: 340237 - RNA, 16 nt, Bordetella pertussis
gugaauaccgcgcaca

SEQ ID NO: 340238 - RNA, 13 nt, Bordetella pertussis
gugaccagcugca

SEQ ID NO: 340239 - RNA, 15 nt, Bordetella pertussis
gugaccacggcgcgc

SEQ ID NO: 340240 - RNA, 18 nt, Bordetella pertussis
gugaccgacaggccuggc

SEQ ID NO: 340241 - RNA, 23 nt, Bordetella pertussis
gugaccgcgacgcgccugcgcgc

SEQ ID NO: 340242 - RNA, 18 nt, Bordetella pertussis
gugaccgcguaggccuuc

SEQ ID NO: 340243 - RNA, 14 nt, Bordetella pertussis
gugaccggacuguc

SEQ ID NO: 340244 - RNA, 19 nt, Bordetella pertussis
gugaccggcgugacgcgcg

SEQ ID NO: 340245 - RNA, 18 nt, Bordetella pertussis
gugacgauauccaggcgc

SEQ ID NO: 340246 - RNA, 17 nt, Bordetella pertussis
gugacgaugcccgacga

SEQ ID NO: 340247 - RNA, 15 nt, Bordetella pertussis
gugacgcccugccau

SEQ ID NO: 340248 - RNA, 22 nt, Bordetella pertussis
gugacgcugauggccgccagcg

SEQ ID NO: 340249 - RNA, 20 nt, Bordetella pertussis
gugacggauucccagcucca

SEQ ID NO: 340250 - RNA, 13 nt, Bordetella pertussis
gugacggccgcca

SEQ ID NO: 340251 - RNA, 15 nt, Bordetella pertussis
gugacggcggcgcgc

SEQ ID NO: 340252 - RNA, 17 nt, Bordetella pertussis
gugacggcggcgcgcgg

SEQ ID NO: 340253 - RNA, 19 nt, Bordetella pertussis
gugacgggcugggccgagg

SEQ ID NO: 340254 - RNA, 21 nt, Bordetella pertussis
gugacgggcugggccgaggcg

SEQ ID NO: 340255 - RNA, 19 nt, Bordetella pertussis
gugacguagcgguagggcg

SEQ ID NO: 340256 - RNA, 22 nt, Bordetella pertussis
gugagaaaagugaucaccgcca

SEQ ID NO: 340257 - RNA, 20 nt, Bordetella pertussis
gugaucgguaaugagcccga

SEQ ID NO: 340258 - RNA, 22 nt, Bordetella pertussis
gugaucugguccacggcggcgg

SEQ ID NO: 340259 - RNA, 15 nt, Bordetella pertussis
gugaugggcgcaucc

SEQ ID NO: 340260 - RNA, 16 nt, Bordetella pertussis
gugaugucgccgguca

SEQ ID NO: 340261 - RNA, 15 nt, Bordetella pertussis
gugcaagcggccggc

SEQ ID NO: 340262 - RNA, 17 nt, Bordetella pertussis
gugcaaggugaacgauu

SEQ ID NO: 340263 - RNA, 13 nt, Bordetella pertussis
gugcacgaugccc

SEQ ID NO: 340264 - RNA, 17 nt, Bordetella pertussis
gugcacgaugcccaggg

SEQ ID NO: 340265 - RNA, 18 nt, Bordetella pertussis
gugcacgcccgcggcgcc

SEQ ID NO: 340266 - RNA, 19 nt, Bordetella pertussis
gugcacgcccgcggcgccc

SEQ ID NO: 340267 - RNA, 20 nt, Bordetella pertussis
gugcacgcccgcggcgccca

SEQ ID NO: 340268 - RNA, 17 nt, Bordetella pertussis
gugcagaucugcacgcu

SEQ ID NO: 340269 - RNA, 23 nt, Bordetella pertussis
gugcaggcccgggcgccugcgcc

SEQ ID NO: 340270 - RNA, 19 nt, Bordetella pertussis
gugcaggccgcgcagcacg

SEQ ID NO: 340271 - RNA, 21 nt, Bordetella pertussis
gugcaggggguggcggccguc

SEQ ID NO: 340272 - RNA, 14 nt, Bordetella pertussis
gugcaggguuggcg

SEQ ID NO: 340273 - RNA, 19 nt, Bordetella pertussis
gugccaccgcccaggcgca

SEQ ID NO: 340274 - RNA, 20 nt, Bordetella pertussis
gugccagcaggucgcgcacg

SEQ ID NO: 340275 - RNA, 16 nt, Bordetella pertussis
gugcccucgcugcgcg

SEQ ID NO: 340276 - RNA, 18 nt, Bordetella pertussis
gugcccugacccgcuggc

SEQ ID NO: 340277 - RNA, 16 nt, Bordetella pertussis
gugcccugcggcgcgg

SEQ ID NO: 340278 - RNA, 15 nt, Bordetella pertussis
gugcccuugggggcc

SEQ ID NO: 340279 - RNA, 15 nt, Bordetella pertussis
gugccgacggcgcgg

SEQ ID NO: 340280 - RNA, 21 nt, Bordetella pertussis
gugccgcacgguggcgccguc

SEQ ID NO: 340281 - RNA, 23 nt, Bordetella pertussis
gugccgcacgguggcgccgucgc

SEQ ID NO: 340282 - RNA, 18 nt, Bordetella pertussis
gugccgcagacggucgac

SEQ ID NO: 340283 - RNA, 16 nt, Bordetella pertussis
gugccgcagcgaggug

SEQ ID NO: 340284 - RNA, 13 nt, Bordetella pertussis
gugccgcaggcca

SEQ ID NO: 340285 - RNA, 14 nt, Bordetella pertussis
gugccgccagcggg

SEQ ID NO: 340286 - RNA, 16 nt, Bordetella pertussis
gugccgcccaggagca

SEQ ID NO: 340287 - RNA, 15 nt, Bordetella pertussis
gugccgcccuugggc

SEQ ID NO: 340288 - RNA, 22 nt, Bordetella pertussis
gugccgccgcccgacagcacgc

SEQ ID NO: 340289 - RNA, 16 nt, Bordetella pertussis
gugccgggaugcugcu

SEQ ID NO: 340290 - RNA, 22 nt, Bordetella pertussis
gugccgggaugcugcucggcca

SEQ ID NO: 340291 - RNA, 16 nt, Bordetella pertussis
gugccggggaucacca

SEQ ID NO: 340292 - RNA, 17 nt, Bordetella pertussis
gugccgguugcgcgccg

SEQ ID NO: 340293 - RNA, 18 nt, Bordetella pertussis
gugccgguugcgcgccga

SEQ ID NO: 340294 - RNA, 12 nt, Bordetella pertussis
gugccgucgaug

SEQ ID NO: 340295 - RNA, 15 nt, Bordetella pertussis
gugccguucccgccg

SEQ ID NO: 340296 - RNA, 18 nt, Bordetella pertussis
gugccguucccgccgggc

SEQ ID NO: 340297 - RNA, 20 nt, Bordetella pertussis
gugccguucggccagcgcgc

SEQ ID NO: 340298 - RNA, 21 nt, Bordetella pertussis
gugccguucggccagcgcgcg

SEQ ID NO: 340299 - RNA, 22 nt, Bordetella pertussis
gugcgagggcucgaccgccgcc

SEQ ID NO: 340300 - RNA, 16 nt, Bordetella pertussis
gugcgcaccaggccca

SEQ ID NO: 340301 - RNA, 19 nt, Bordetella pertussis
gugcgcaccuugcccacgc

SEQ ID NO: 340302 - RNA, 15 nt, Bordetella pertussis
gugcgcagcaccagc

SEQ ID NO: 340303 - RNA, 13 nt, Bordetella pertussis
gugcgcagccggg

SEQ ID NO: 340304 - RNA, 21 nt, Bordetella pertussis
gugcgcagccgggcugccggc

SEQ ID NO: 340305 - RNA, 22 nt, Bordetella pertussis
gugcgccgugcccggcgggccg

SEQ ID NO: 340306 - RNA, 20 nt, Bordetella pertussis
gugcgccugacccagucgca

SEQ ID NO: 340307 - RNA, 20 nt, Bordetella pertussis
gugcgcgcagggcggccggc

SEQ ID NO: 340308 - RNA, 22 nt, Bordetella pertussis
gugcgcgcagggcggccggcac

SEQ ID NO: 340309 - RNA, 22 nt, Bordetella pertussis
gugcgcgccaaaaggcagcagg

SEQ ID NO: 340310 - RNA, 18 nt, Bordetella pertussis
gugcgcgccacggcgucg

SEQ ID NO: 340311 - RNA, 20 nt, Bordetella pertussis
gugcgcgcgcccccagcgcc

SEQ ID NO: 340312 - RNA, 13 nt, Bordetella pertussis
gugcgcggcgcgc

SEQ ID NO: 340313 - RNA, 15 nt, Bordetella pertussis
gugcgcggcgcgccg

SEQ ID NO: 340314 - RNA, 17 nt, Bordetella pertussis
gugcgcggcgcgccguc

SEQ ID NO: 340315 - RNA, 14 nt, Bordetella pertussis
gugcgcggcguuga

SEQ ID NO: 340316 - RNA, 19 nt, Bordetella pertussis
gugcgcgggcgcggcaggc

SEQ ID NO: 340317 - RNA, 21 nt, Bordetella pertussis
gugcgcgugggcacccggccg

SEQ ID NO: 340318 - RNA, 22 nt, Bordetella pertussis
gugcgcguuaaccucccgauau

SEQ ID NO: 340319 - RNA, 20 nt, Bordetella pertussis
gugcgcguuccggccgcgcc

SEQ ID NO: 340320 - RNA, 22 nt, Bordetella pertussis
gugcgcuaccgcuucccuggca

SEQ ID NO: 340321 - RNA, 17 nt, Bordetella pertussis
gugcgcuggcugggccu

SEQ ID NO: 340322 - RNA, 16 nt, Bordetella pertussis
gugcggccgcagcagu

SEQ ID NO: 340323 - RNA, 15 nt, Bordetella pertussis
gugcggccgcagcgg

SEQ ID NO: 340324 - RNA, 18 nt, Bordetella pertussis
gugcggccgcagcggacg

SEQ ID NO: 340325 - RNA, 14 nt, Bordetella pertussis
gugcggcccagccg

SEQ ID NO: 340326 - RNA, 16 nt, Bordetella pertussis
gugcggcccagccgcu

SEQ ID NO: 340327 - RNA, 13 nt, Bordetella pertussis
gugcggccaugau

SEQ ID NO: 340328 - RNA, 21 nt, Bordetella pertussis
gugcggccucggcgggcggcg

SEQ ID NO: 340329 - RNA, 24 nt, Bordetella pertussis
gugcggccucggcgggcggcgcca

SEQ ID NO: 340330 - RNA, 22 nt, Bordetella pertussis
gugcggcgccacugccaggcgc

SEQ ID NO: 340331 - RNA, 23 nt, Bordetella pertussis
gugcggcgccacugccaggcgcc

SEQ ID NO: 340332 - RNA, 14 nt, Bordetella pertussis
gugcggcggcgacu

SEQ ID NO: 340333 - RNA, 16 nt, Bordetella pertussis
gugcguccaggacgcg

SEQ ID NO: 340334 - RNA, 15 nt, Bordetella pertussis
gugcgugcgccuguc

SEQ ID NO: 340335 - RNA, 23 nt, Bordetella pertussis
gugcguggucgcgggugguggcc

SEQ ID NO: 340336 - RNA, 19 nt, Bordetella pertussis
gugcguggugacccguccg

SEQ ID NO: 340337 - RNA, 18 nt, Bordetella pertussis
gugcguuggcgcggcgca

SEQ ID NO: 340338 - RNA, 14 nt, Bordetella pertussis
guggugcagcggca

SEQ ID NO: 340339 - RNA, 19 nt, Bordetella pertussis
guggugcgggccgcgcugg

SEQ ID NO: 340340 - RNA, 15 nt, Bordetella pertussis
guggugcgcggucca

SEQ ID NO: 340341 - RNA, 16 nt, Bordetella pertussis
gugguggugcgggccg

SEQ ID NO: 340342 - RNA, 14 nt, Bordetella pertussis
gugguucaugacgu

SEQ ID NO: 340343 - RNA, 23 nt, Bordetella pertussis
guguacagccgccuggcgcggcg

SEQ ID NO: 340344 - RNA, 18 nt, Bordetella pertussis
guguaccgggccgacgcg

SEQ ID NO: 340345 - RNA, 18 nt, Bordetella pertussis
guguagaccugcgggccg

SEQ ID NO: 340346 - RNA, 21 nt, Bordetella pertussis
guguagaagaacagcagaugg

SEQ ID NO: 340347 - RNA, 22 nt, Bordetella pertussis
guguagaagaacagcagauggc

SEQ ID NO: 340348 - RNA, 15 nt, Bordetella pertussis
guguccacgaacgcg

SEQ ID NO: 340349 - RNA, 16 nt, Bordetella pertussis
guguccagcggcgcca

SEQ ID NO: 340350 - RNA, 13 nt, Bordetella pertussis
gugucccggcggg

SEQ ID NO: 340351 - RNA, 20 nt, Bordetella pertussis
gugucgccguggcgggucca

SEQ ID NO: 340352 - RNA, 23 nt, Bordetella pertussis
gugucgcucccccaugcggggac

SEQ ID NO: 340353 - RNA, 20 nt, Bordetella pertussis
gugugaucgccgacgauguc

SEQ ID NO: 340354 - RNA, 19 nt, Bordetella pertussis
guguggccaugcaccagca

SEQ ID NO: 340355 - RNA, 14 nt, Bordetella pertussis
gugugguuggcgcu

SEQ ID NO: 340356 - RNA, 21 nt, Bordetella pertussis
guguucgagcaggcgcgcggu

SEQ ID NO: 340357 - RNA, 14 nt, Bordetella pertussis
guguucgcgcacca

SEQ ID NO: 340358 - RNA, 18 nt, Bordetella pertussis
guuacacuggcccuggca

SEQ ID NO: 340359 - RNA, 19 nt, Bordetella pertussis
guuacagcuuuucgcaccu

SEQ ID NO: 340360 - RNA, 18 nt, Bordetella pertussis
guucaccaggaagcgcgc

SEQ ID NO: 340361 - RNA, 19 nt, Bordetella pertussis
guucaccaggaagcgcgcc

SEQ ID NO: 340362 - RNA, 22 nt, Bordetella pertussis
guucacccagguaucggccagc

SEQ ID NO: 340363 - RNA, 23 nt, Bordetella pertussis
guucacccagguaucggccagca

SEQ ID NO: 340364 - RNA, 15 nt, Bordetella pertussis
guucacgccggcgcg

SEQ ID NO: 340365 - RNA, 14 nt, Bordetella pertussis
guucagcagcgcca

SEQ ID NO: 340366 - RNA, 16 nt, Bordetella pertussis
guucagcagcgccacg

SEQ ID NO: 340367 - RNA, 17 nt, Bordetella pertussis
guucagcgcgccagcgc

SEQ ID NO: 340368 - RNA, 20 nt, Bordetella pertussis
guucagcgcgcgcgccgacg

SEQ ID NO: 340369 - RNA, 20 nt, Bordetella pertussis
guucagcuucagccugggcc

SEQ ID NO: 340370 - RNA, 17 nt, Bordetella pertussis
guucaggccccggccgg

SEQ ID NO: 340371 - RNA, 18 nt, Bordetella pertussis
guucaggccccggccggu

SEQ ID NO: 340372 - RNA, 12 nt, Bordetella pertussis
guucaggcuggc

SEQ ID NO: 340373 - RNA, 20 nt, Bordetella pertussis
guucagguguucgcgcacca

SEQ ID NO: 340374 - RNA, 17 nt, Bordetella pertussis
guucaucgggccggcgg

SEQ ID NO: 340375 - RNA, 20 nt, Bordetella pertussis
guucaugaccaucgcgcacu

SEQ ID NO: 340376 - RNA, 19 nt, Bordetella pertussis
guucaugaccgccgcgccg

SEQ ID NO: 340377 - RNA, 19 nt, Bordetella pertussis
guucaugcguucggccagc

SEQ ID NO: 340378 - RNA, 20 nt, Bordetella pertussis
guucaugcguucggccagcc

SEQ ID NO: 340379 - RNA, 18 nt, Bordetella pertussis
guucauggcgcaugacgg

SEQ ID NO: 340380 - RNA, 16 nt, Bordetella pertussis
guuccagaacggcgcg

SEQ ID NO: 340381 - RNA, 19 nt, Bordetella pertussis
guuccagaugcgcagcagg

SEQ ID NO: 340382 - RNA, 11 nt, Bordetella pertussis
guuccagcaga

SEQ ID NO: 340383 - RNA, 20 nt, Bordetella pertussis
guuccagcgccuggcgggcc

SEQ ID NO: 340384 - RNA, 13 nt, Bordetella pertussis
guuccaggcggau

SEQ ID NO: 340385 - RNA, 20 nt, Bordetella pertussis
guuccaggucaucaccaggg

SEQ ID NO: 340386 - RNA, 21 nt, Bordetella pertussis
guuccaguccagcgucggcgu

SEQ ID NO: 340387 - RNA, 14 nt, Bordetella pertussis
guucccagcgcgcg

SEQ ID NO: 340388 - RNA, 18 nt, Bordetella pertussis
guucccuacccgccgggc

SEQ ID NO: 340389 - RNA, 14 nt, Bordetella pertussis
guuccgcgacgcgg

SEQ ID NO: 340390 - RNA, 12 nt, Bordetella pertussis
guuccggcgcgc

SEQ ID NO: 340391 - RNA, 18 nt, Bordetella pertussis
guuccugcaaggccggcg

SEQ ID NO: 340392 - RNA, 12 nt, Bordetella pertussis
guuccuggcgcu

SEQ ID NO: 340393 - RNA, 14 nt, Bordetella pertussis
guuccuggcgcugu

SEQ ID NO: 340394 - RNA, 16 nt, Bordetella pertussis
guucgaaagccagcgc

SEQ ID NO: 340395 - RNA, 17 nt, Bordetella pertussis
guucgaaagccagcgcc

SEQ ID NO: 340396 - RNA, 19 nt, Bordetella pertussis
guucgaaguccgcgcgcag

SEQ ID NO: 340397 - RNA, 22 nt, Bordetella pertussis
guucgaaguccgcgcgcagcgc

SEQ ID NO: 340398 - RNA, 16 nt, Bordetella pertussis
guucgacgcggccgac

SEQ ID NO: 340399 - RNA, 23 nt, Bordetella pertussis
guucgacgcugaucucggccugc

SEQ ID NO: 340400 - RNA, 14 nt, Bordetella pertussis
guucgacgggcagg

SEQ ID NO: 340401 - RNA, 23 nt, Bordetella pertussis
guucgaccugaagguggcguuca

SEQ ID NO: 340402 - RNA, 15 nt, Bordetella pertussis
guucgaccugccgcc

SEQ ID NO: 340403 - RNA, 17 nt, Bordetella pertussis
guucgacuucguccggc

SEQ ID NO: 340404 - RNA, 20 nt, Bordetella pertussis
guucgacuucguccggcgcg

SEQ ID NO: 340405 - RNA, 15 nt, Bordetella pertussis
guucgagcaggcgcg

SEQ ID NO: 340406 - RNA, 20 nt, Bordetella pertussis
guucgagcgcgcgcaugcgc

SEQ ID NO: 340407 - RNA, 22 nt, Bordetella pertussis
guucgagcgcgcgcaugcgcac

SEQ ID NO: 340408 - RNA, 15 nt, Bordetella pertussis
guucgauggcggcca

SEQ ID NO: 340409 - RNA, 19 nt, Bordetella pertussis
guucgauggcggccagggc

SEQ ID NO: 340410 - RNA, 16 nt, Bordetella pertussis
guucgcauagcgccgg

SEQ ID NO: 340411 - RNA, 20 nt, Bordetella pertussis
guucgcaccagucccgcacc

SEQ ID NO: 340412 - RNA, 15 nt, Bordetella pertussis
guucgcccaccacca

SEQ ID NO: 340413 - RNA, 16 nt, Bordetella pertussis
guucgcccaccaccag

SEQ ID NO: 340414 - RNA, 18 nt, Bordetella pertussis
guucgcccaccaccagcg

SEQ ID NO: 340415 - RNA, 19 nt, Bordetella pertussis
guucgcccaccaccagcgg

SEQ ID NO: 340416 - RNA, 12 nt, Bordetella pertussis
guucgccgcacc

SEQ ID NO: 340417 - RNA, 16 nt, Bordetella pertussis
guucgccgcaccaggc

SEQ ID NO: 340418 - RNA, 13 nt, Bordetella pertussis
guucgccggcgcc

SEQ ID NO: 340419 - RNA, 14 nt, Bordetella pertussis
guucgccggcgccg

SEQ ID NO: 340420 - RNA, 21 nt, Bordetella pertussis
guucgccgugcagggccaggu

SEQ ID NO: 340421 - RNA, 18 nt, Bordetella pertussis
guucgcgcaacucggcca

SEQ ID NO: 340422 - RNA, 14 nt, Bordetella pertussis
guucgcgcaccagc

SEQ ID NO: 340423 - RNA, 15 nt, Bordetella pertussis
guucgcgcaccagcg

SEQ ID NO: 340424 - RNA, 21 nt, Bordetella pertussis
guucgcgcagaucccaggcgc

SEQ ID NO: 340425 - RNA, 20 nt, Bordetella pertussis
guucgcgccaggcgccgggc

SEQ ID NO: 340426 - RNA, 12 nt, Bordetella pertussis
guucgcgccgcg

SEQ ID NO: 340427 - RNA, 17 nt, Bordetella pertussis
guucgcgcgccggcagg

SEQ ID NO: 340428 - RNA, 20 nt, Bordetella pertussis
guucgcggcccugggcgcgg

SEQ ID NO: 340429 - RNA, 13 nt, Bordetella pertussis
guucgcggccgga

SEQ ID NO: 340430 - RNA, 13 nt, Bordetella pertussis
guucgcggccggc

SEQ ID NO: 340431 - RNA, 18 nt, Bordetella pertussis
guucggcagcgaggcgca

SEQ ID NO: 340432 - RNA, 14 nt, Bordetella pertussis
guucggccacggcu

SEQ ID NO: 340433 - RNA, 13 nt, Bordetella pertussis
guucggccagcgc

SEQ ID NO: 340434 - RNA, 21 nt, Bordetella pertussis
guucggccagcggcaggccca

SEQ ID NO: 340435 - RNA, 15 nt, Bordetella pertussis
guucggccgccaggu

SEQ ID NO: 340436 - RNA, 21 nt, Bordetella pertussis
guucggccgccaggucggcca

SEQ ID NO: 340437 - RNA, 16 nt, Bordetella pertussis
guucggcgaugcgggc

SEQ ID NO: 340438 - RNA, 19 nt, Bordetella pertussis
guucggcgaugcgggcggc

SEQ ID NO: 340439 - RNA, 14 nt, Bordetella pertussis
guucggcgccgggc

SEQ ID NO: 340440 - RNA, 11 nt, Bordetella pertussis
guucggcgcgc

SEQ ID NO: 340441 - RNA, 15 nt, Bordetella pertussis
guucggcgcggcgcg

SEQ ID NO: 340442 - RNA, 21 nt, Bordetella pertussis
guucggcgaccgccggccggu

SEQ ID NO: 340443 - RNA, 20 nt, Bordetella pertussis
guucggcggcgcccaucagg

SEQ ID NO: 340444 - RNA, 20 nt, Bordetella pertussis
guucggcgguuccagccugg

SEQ ID NO: 340445 - RNA, 17 nt, Bordetella pertussis
guucggcgucggugccg

SEQ ID NO: 340446 - RNA, 23 nt, Bordetella pertussis
guucggcuugcacgccggccacg

SEQ ID NO: 340447 - RNA, 15 nt, Bordetella pertussis
guucgggcggcaggu

SEQ ID NO: 340448 - RNA, 16 nt, Bordetella pertussis
guucggggacaggcac

SEQ ID NO: 340449 - RNA, 19 nt, Bordetella pertussis
guucggucagcgcggcgca

SEQ ID NO: 340450 - RNA, 23 nt, Bordetella pertussis
guucggugcgcagcggcaggcgg

SEQ ID NO: 340451 - RNA, 19 nt, Bordetella pertussis
guucugcgcguccuggcgc

SEQ ID NO: 340452 - RNA, 13 nt, Bordetella pertussis
guucugcggcgcg

SEQ ID NO: 340453 - RNA, 19 nt, Bordetella pertussis
guucugcguggcggcgucg

SEQ ID NO: 340454 - RNA, 14 nt, Bordetella pertussis
guucuggaucgcgc

SEQ ID NO: 340455 - RNA, 20 nt, Bordetella pertussis
guucuggcagugcgccuggc

SEQ ID NO: 340456 - RNA, 16 nt, Bordetella pertussis
guucuggcugcgcgcc

SEQ ID NO: 340457 - RNA, 17 nt, Bordetella pertussis
guucuggucgaacuggc

SEQ ID NO: 340458 - RNA, 16 nt, Bordetella pertussis
guucuguccggcgcug

SEQ ID NO: 340459 - RNA, 20 nt, Bordetella pertussis
guugaccaugaccaugccgg

SEQ ID NO: 340460 - RNA, 20 nt, Bordetella pertussis
guugacccauaccagcccgg

SEQ ID NO: 340461 - RNA, 20 nt, Bordetella pertussis
guugaccgagcccggcacca

SEQ ID NO: 340462 - RNA, 18 nt, Bordetella pertussis
guugaccggguugagcgu

SEQ ID NO: 340463 - RNA, 20 nt, Bordetella pertussis
guugacgaucucgcccugcu

SEQ ID NO: 340464 - RNA, 20 nt, Bordetella pertussis
guugauccagcgcucgggcu

SEQ ID NO: 340465 - RNA, 19 nt, Bordetella pertussis
guugaucucgcccagcagg

SEQ ID NO: 340466 - RNA, 19 nt, Bordetella pertussis
guugaugaugaucggcgcc

SEQ ID NO: 340467 - RNA, 15 nt, Bordetella pertussis
guugcccaccagccg

SEQ ID NO: 340468 - RNA, 24 nt, Bordetella pertussis
guugcccaccagccgggcggccac

SEQ ID NO: 340469 - RNA, 19 nt, Bordetella pertussis
guugccccauugcgggugg

SEQ ID NO: 340470 - RNA, 19 nt, Bordetella pertussis
guugcccgaaggcagcggc

SEQ ID NO: 340471 - RNA, 22 nt, Bordetella pertussis
guugcccgagcgcgacagcacc

SEQ ID NO: 340472 - RNA, 14 nt, Bordetella pertussis
guugcccggcaggc

SEQ ID NO: 340473 - RNA, 17 nt, Bordetella pertussis
guugccgaagcgucggc

SEQ ID NO: 340474 - RNA, 19 nt, Bordetella pertussis
guugccgaagcgucggccu

SEQ ID NO: 340475 - RNA, 15 nt, Bordetella pertussis
guugccgccgccggc

SEQ ID NO: 340476 - RNA, 18 nt, Bordetella pertussis
guugccgccgccggcgcg

SEQ ID NO: 340477 - RNA, 14 nt, Bordetella pertussis
guugccgccggcca

SEQ ID NO: 340478 - RNA, 18 nt, Bordetella pertussis
guugcgaggcggccuuga

SEQ ID NO: 340479 - RNA, 15 nt, Bordetella pertussis
guugcgcaucgcgca

SEQ ID NO: 340480 - RNA, 19 nt, Bordetella pertussis
guugcgcaucgcgcacccg

SEQ ID NO: 340481 - RNA, 11 nt, Bordetella pertussis
guugcgcgccg

SEQ ID NO: 340482 - RNA, 13 nt, Bordetella pertussis
guugcgcgccguc

SEQ ID NO: 340483 - RNA, 21 nt, Bordetella pertussis
guugcgcgccgucggcgucga

SEQ ID NO: 340484 - RNA, 13 nt, Bordetella pertussis
guugcgggcgcac

SEQ ID NO: 340485 - RNA, 21 nt, Bordetella pertussis
guugcgggcgcaccuggucca

SEQ ID NO: 340486 - RNA, 19 nt, Bordetella pertussis
guugcgggcugcgcggguc

SEQ ID NO: 340487 - RNA, 22 nt, Bordetella pertussis
guugcuccagccaggcgcgcag

SEQ ID NO: 340488 - RNA, 14 nt, Bordetella pertussis
guugcucgcgcgca

SEQ ID NO: 340489 - RNA, 21 nt, Bordetella pertussis
guugcucuugaccugggccag

SEQ ID NO: 340490 - RNA, 23 nt, Bordetella pertussis
guugcucuugaccugggccagca

SEQ ID NO: 340491 - RNA, 15 nt, Bordetella pertussis
guuggccgccagccg

SEQ ID NO: 340492 - RNA, 17 nt, Bordetella pertussis
guuggccgccagccggc

SEQ ID NO: 340493 - RNA, 19 nt, Bordetella pertussis
guuggccuugacggcgcgg

SEQ ID NO: 340494 - RNA, 17 nt, Bordetella pertussis
guuggccugccauccgg

SEQ ID NO: 340495 - RNA, 20 nt, Bordetella pertussis
guuggccugccauccggccg

SEQ ID NO: 340496 - RNA, 19 nt, Bordetella pertussis
guuggcgaaugccugguag

SEQ ID NO: 340497 - RNA, 13 nt, Bordetella pertussis
guuggcgcccagc

SEQ ID NO: 340498 - RNA, 16 nt, Bordetella pertussis
guuggcgcccagcgcc

SEQ ID NO: 340499 - RNA, 17 nt, Bordetella pertussis
guuggcgcccagcgcca

SEQ ID NO: 340500 - RNA, 15 nt, Bordetella pertussis
guuggcgccggccgc

SEQ ID NO: 340501 - RNA, 23 nt, Bordetella pertussis
guuggcgccggccgcgcgcgcca

SEQ ID NO: 340502 - RNA, 14 nt, Bordetella pertussis
guuggcgcugcugc

SEQ ID NO: 340503 - RNA, 18 nt, Bordetella pertussis
guuggcgcugcugcuggc

SEQ ID NO: 340504 - RNA, 23 nt, Bordetella pertussis
guuggcgggcgcuucgucggccg

SEQ ID NO: 340505 - RNA, 20 nt, Bordetella pertussis
guuggcguccaggcgcgcca

SEQ ID NO: 340506 - RNA, 24 nt, Bordetella pertussis
guugggccagggccucgcgggccu

SEQ ID NO: 340507 - RNA, 16 nt, Bordetella pertussis
guuggucaccacgccu

SEQ ID NO: 340508 - RNA, 23 nt, Bordetella pertussis
guuggucaccacgccuucgagca

SEQ ID NO: 340509 - RNA, 23 nt, Bordetella pertussis
guuggucgaauuucccggguggc

SEQ ID NO: 340510 - RNA, 17 nt, Bordetella pertussis
guugucggcgcagaugg

SEQ ID NO: 340511 - RNA, 16 nt, Bordetella pertussis
guuguucagguuggca

SEQ ID NO: 340512 - RNA, 21 nt, Bordetella pertussis
guuucaggccugcggcgccag

SEQ ID NO: 340513 - RNA, 13 nt, Bordetella pertussis
uaaagaugcgcgc

SEQ ID NO: 340514 - RNA, 14 nt, Bordetella pertussis
uaaagaugcgcgcc

SEQ ID NO: 340515 - RNA, 22 nt, Bordetella pertussis
uaaucgagcuggcccacgccca

SEQ ID NO: 340516 - RNA, 13 nt, Bordetella pertussis
uacagccaggcca

SEQ ID NO: 340517 - RNA, 17 nt, Bordetella pertussis
uacagccaggccagcag

SEQ ID NO: 340518 - RNA, 16 nt, Bordetella pertussis
uacagccccagcgcca

SEQ ID NO: 340519 - RNA, 17 nt, Bordetella pertussis
uacagcgccugcgcggc

SEQ ID NO: 340520 - RNA, 13 nt, Bordetella pertussis
uacagcgcgcccg

SEQ ID NO: 340521 - RNA, 15 nt, Bordetella pertussis
uacagcgcgcccgau

SEQ ID NO: 340522 - RNA, 13 nt, Bordetella pertussis
uaccacgcgcggc

SEQ ID NO: 340523 - RNA, 12 nt, Bordetella pertussis
uaccaggcgcgc

SEQ ID NO: 340524 - RNA, 14 nt, Bordetella pertussis
uaccaggccgacga

SEQ ID NO: 340525 - RNA, 15 nt, Bordetella pertussis
uaccaggcguaucga

SEQ ID NO: 340526 - RNA, 23 nt, Bordetella pertussis
uaccccguagaacuucacgccga

SEQ ID NO: 340527 - RNA, 14 nt, Bordetella pertussis
uacccgccgggcgg

SEQ ID NO: 340528 - RNA, 16 nt, Bordetella pertussis
uacccgccgggcggcg

SEQ ID NO: 340529 - RNA, 12 nt, Bordetella pertussis
uacccgcgccgg

SEQ ID NO: 340530 - RNA, 19 nt, Bordetella pertussis
uacccgcgccggcggcaag

SEQ ID NO: 340531 - RNA, 23 nt, Bordetella pertussis
uacccgcuucgacggcuugcgca

SEQ ID NO: 340532 - RNA, 23 nt, Bordetella pertussis
uacccggucgaucagggcgcgga

SEQ ID NO: 340533 - RNA, 23 nt, Bordetella pertussis
uaccgaaucgaacuuggcgcggu

SEQ ID NO: 340534 - RNA, 15 nt, Bordetella pertussis
uaccgaucuacgacg

SEQ ID NO: 340535 - RNA, 18 nt, Bordetella pertussis
uaccgccgccugcgcgaa

SEQ ID NO: 340536 - RNA, 20 nt, Bordetella pertussis
uaccgccuugccuugcgcgg

SEQ ID NO: 340537 - RNA, 20 nt, Bordetella pertussis
uaccggcgccgacgcgcugg

SEQ ID NO: 340538 - RNA, 20 nt, Bordetella pertussis
uaccgucguccucggcacgg

SEQ ID NO: 340539 - RNA, 21 nt, Bordetella pertussis
uaccgucguccucggcacggc

SEQ ID NO: 340540 - RNA, 15 nt, Bordetella pertussis
uacgcaucggcgccg

SEQ ID NO: 340541 - RNA, 20 nt, Bordetella pertussis
uacgccaugaacgcuugacg

SEQ ID NO: 340542 - RNA, 22 nt, Bordetella pertussis
uacgccaugagcgcuugacggc

SEQ ID NO: 340543 - RNA, 22 nt, Bordetella pertussis
uacgccgaauugcuggagcgcc

SEQ ID NO: 340544 - RNA, 17 nt, Bordetella pertussis
uacgccgauggcgcggc

SEQ ID NO: 340545 - RNA, 23 nt, Bordetella pertussis
uacgccgauggcgcggccgccag

SEQ ID NO: 340546 - RNA, 21 nt, Bordetella pertussis
uacgccguugcggcccgccga

SEQ ID NO: 340547 - RNA, 16 nt, Bordetella pertussis
uacugcacgcggucca

SEQ ID NO: 340548 - RNA, 20 nt, Bordetella pertussis
uacugcgcaugggcgcaggc

SEQ ID NO: 340549 - RNA, 20 nt, Bordetella pertussis
uacuggccgauggucagcau

SEQ ID NO: 340550 - RNA, 13 nt, Bordetella pertussis
uacuggcuggucu

SEQ ID NO: 340551 - RNA, 12 nt, Bordetella pertussis
uacuugccggcg

SEQ ID NO: 340552 - RNA, 17 nt, Bordetella pertussis
uacuugcgcagcgcggc

SEQ ID NO: 340553 - RNA, 14 nt, Bordetella pertussis
uacuuguccgccac

SEQ ID NO: 340554 - RNA, 19 nt, Bordetella pertussis
uagaccacgcgcugcgcgc

SEQ ID NO: 340555 - RNA, 20 nt, Bordetella pertussis
uagaccacgcgcugcgcgcc

SEQ ID NO: 340556 - RNA, 16 nt, Bordetella pertussis
uagaccugcgggccgc

SEQ ID NO: 340557 - RNA, 17 nt, Bordetella pertussis
uagagcugcggcgcggc

SEQ ID NO: 340558 - RNA, 20 nt, Bordetella pertussis
uagccaccgauaucgauacc

SEQ ID NO: 340559 - RNA, 19 nt, Bordetella pertussis
uagcccagcaccugcaggc

SEQ ID NO: 340560 - RNA, 23 nt, Bordetella pertussis
uagcccagcaccugcaggccgcc

SEQ ID NO: 340561 - RNA, 14 nt, Bordetella pertussis
uagcccaggccgcc

SEQ ID NO: 340562 - RNA, 17 nt, Bordetella pertussis
uagcccagguccagcgc

SEQ ID NO: 340563 - RNA, 17 nt, Bordetella pertussis
uagcccuuguggccgcc

SEQ ID NO: 340564 - RNA, 15 nt, Bordetella pertussis
uagccgaucuggccc

SEQ ID NO: 340565 - RNA, 18 nt, Bordetella pertussis
uagccgaugaccggccag

SEQ ID NO: 340566 - RNA, 20 nt, Bordetella pertussis
uagccgaccacccgcgccag

SEQ ID NO: 340567 - RNA, 17 nt, Bordetella pertussis
uagcgcaagcccgucag

SEQ ID NO: 340568 - RNA, 20 nt, Bordetella pertussis
uagcgcacgcaccgcgccag

SEQ ID NO: 340569 - RNA, 15 nt, Bordetella pertussis
uagcggccggcgcgc

SEQ ID NO: 340570 - RNA, 19 nt, Bordetella pertussis
uagcgggccugcagcauga

SEQ ID NO: 340571 - RNA, 16 nt, Bordetella pertussis
uagcgguagccggcgu

SEQ ID NO: 340572 - RNA, 22 nt, Bordetella pertussis
uagcgguccggggcgggcgcgg

SEQ ID NO: 340573 - RNA, 13 nt, Bordetella pertussis
uauccuggcgcgg

SEQ ID NO: 340574 - RNA, 18 nt, Bordetella pertussis
uaucgacccaggccggcg

SEQ ID NO: 340575 - RNA, 13 nt, Bordetella pertussis
uaucgcccgcgcg

SEQ ID NO: 340576 - RNA, 15 nt, Bordetella pertussis
uaucgcggcgcaggc

SEQ ID NO: 340577 - RNA, 12 nt, Bordetella pertussis
uaucgcggcgcg

SEQ ID NO: 340578 - RNA, 15 nt, Bordetella pertussis
uaucgcggcgcggcg

SEQ ID NO: 340579 - RNA, 16 nt, Bordetella pertussis
uaucgcguggcgcgcc

SEQ ID NO: 340580 - RNA, 18 nt, Bordetella pertussis
uaucgcguggcgcgccag

SEQ ID NO: 340581 - RNA, 21 nt, Bordetella pertussis
uaucggcagcguacgcacgcc

SEQ ID NO: 340582 - RNA, 13 nt, Bordetella pertussis
uaucugccgcgca

SEQ ID NO: 340583 - RNA, 20 nt, Bordetella pertussis
uaucuguccccgcggggaca

SEQ ID NO: 340584 - RNA, 22 nt, Bordetella pertussis
uaucuggcaaugguccagcagg

SEQ ID NO: 340585 - RNA, 15 nt, Bordetella pertussis
uaugcacgaugccgu

SEQ ID NO: 340586 - RNA, 19 nt, Bordetella pertussis
uaugcccucuucggcggcc

SEQ ID NO: 340587 - RNA, 16 nt, Bordetella pertussis
uaugccguaggcgccg

SEQ ID NO: 340588 - RNA, 19 nt, Bordetella pertussis
uauugcacggugccgcgcg

SEQ ID NO: 340589 - RNA, 20 nt, Bordetella pertussis
ucaaaccaagcagggacaga

SEQ ID NO: 340590 - RNA, 17 nt, Bordetella pertussis
ucaacaucgcccugucg

SEQ ID NO: 340591 - RNA, 19 nt, Bordetella pertussis
ucaacccgccggccaucac

SEQ ID NO: 340592 - RNA, 19 nt, Bordetella pertussis
ucaaccggcguucuggcgc

SEQ ID NO: 340593 - RNA, 15 nt, Bordetella pertussis
ucaaccucgacgcgc

SEQ ID NO: 340594 - RNA, 18 nt, Bordetella pertussis
ucaaccucgacgcgcauu

SEQ ID NO: 340595 - RNA, 19 nt, Bordetella pertussis
ucaaccuucucgaugcgcg

SEQ ID NO: 340596 - RNA, 22 nt, Bordetella pertussis
ucaacgcccagguugcggccgc

SEQ ID NO: 340597 - RNA, 11 nt, Bordetella pertussis
ucaacguggcg

SEQ ID NO: 340598 - RNA, 14 nt, Bordetella pertussis
ucaacucgcccgau

SEQ ID NO: 340599 - RNA, 13 nt, Bordetella pertussis
ucaagcagcgccg

SEQ ID NO: 340600 - RNA, 17 nt, Bordetella pertussis
ucaagcggcugcccuug

SEQ ID NO: 340601 - RNA, 17 nt, Bordetella pertussis
ucaagcguucauggcgu

SEQ ID NO: 340602 - RNA, 17 nt, Bordetella pertussis
ucaaggcaagaaucgac

SEQ ID NO: 340603 - RNA, 20 nt, Bordetella pertussis
ucaaggccugcccgggcacc

SEQ ID NO: 340604 - RNA, 20 nt, Bordetella pertussis
ucaagggguggcuguccccg

SEQ ID NO: 340605 - RNA, 13 nt, Bordetella pertussis
ucaaguccggcgc

SEQ ID NO: 340606 - RNA, 20 nt, Bordetella pertussis
ucaaguccggcgccgccggg

SEQ ID NO: 340607 - RNA, 15 nt, Bordetella pertussis
ucaauccgccgccag

SEQ ID NO: 340608 - RNA, 23 nt, Bordetella pertussis
ucaaugcggcggcgcuggccugc

SEQ ID NO: 340609 - RNA, 17 nt, Bordetella pertussis
ucaauguauuuggcggc

SEQ ID NO: 340610 - RNA, 17 nt, Bordetella pertussis
ucacaggcccgcgcggc

SEQ ID NO: 340611 - RNA, 13 nt, Bordetella pertussis
ucacauaggccgg

SEQ ID NO: 340612 - RNA, 20 nt, Bordetella pertussis
ucacauaggccggcaccccg

SEQ ID NO: 340613 - RNA, 20 nt, Bordetella pertussis
ucacaugucacacgaagaac

SEQ ID NO: 340614 - RNA, 19 nt, Bordetella pertussis
ucaccacccgcacgccggc

SEQ ID NO: 340615 - RNA, 20 nt, Bordetella pertussis
ucaccacgccuucgagcacc

SEQ ID NO: 340616 - RNA, 20 nt, Bordetella pertussis
ucaccagcucgcggcccugg

SEQ ID NO: 340617 - RNA, 19 nt, Bordetella pertussis
ucaccaggguggcgggcgc

SEQ ID NO: 340618 - RNA, 20 nt, Bordetella pertussis
ucaccaggguggcgggcgcc

SEQ ID NO: 340619 - RNA, 17 nt, Bordetella pertussis
ucaccauggccgacagc

SEQ ID NO: 340620 - RNA, 18 nt, Bordetella pertussis
ucacccacagcagcgcgc

SEQ ID NO: 340621 - RNA, 16 nt, Bordetella pertussis
ucacccagcggcuggc

SEQ ID NO: 340622 - RNA, 20 nt, Bordetella pertussis
ucaccccgcccugcccggcg

SEQ ID NO: 340623 - RNA, 23 nt, Bordetella pertussis
ucaccccgcccugcccggcgagc

SEQ ID NO: 340624 - RNA, 16 nt, Bordetella pertussis
ucaccgccgcccgcag

SEQ ID NO: 340625 - RNA, 19 nt, Bordetella pertussis
ucaccgccgcccgcaggca

SEQ ID NO: 340626 - RNA, 18 nt, Bordetella pertussis
ucaccgccgccgccacca

SEQ ID NO: 340627 - RNA, 17 nt, Bordetella pertussis
ucaccgccgccgcgccg

SEQ ID NO: 340628 - RNA, 17 nt, Bordetella pertussis
ucaccgccgcgaccggg

SEQ ID NO: 340629 - RNA, 14 nt, Bordetella pertussis
ucaccgccgcgccg

SEQ ID NO: 340630 - RNA, 13 nt, Bordetella pertussis
ucaccgccgcggc

SEQ ID NO: 340631 - RNA, 17 nt, Bordetella pertussis
ucaccguuuggccugcc

SEQ ID NO: 340632 - RNA, 19 nt, Bordetella pertussis
ucacgccgaugaccagggc

SEQ ID NO: 340633 - RNA, 22 nt, Bordetella pertussis
ucacgccgaugaccagggcgcc

SEQ ID NO: 340634 - RNA, 15 nt, Bordetella pertussis
ucacgccggcgcgcc

SEQ ID NO: 340635 - RNA, 18 nt, Bordetella pertussis
ucacgccggcgcgccggg

SEQ ID NO: 340636 - RNA, 21 nt, Bordetella pertussis
ucacgccgguguucucgcugg

SEQ ID NO: 340637 - RNA, 19 nt, Bordetella pertussis
ucacgcgcaaggcgggcug

SEQ ID NO: 340638 - RNA, 22 nt, Bordetella pertussis
ucacggccgucaauaucacgcg

SEQ ID NO: 340639 - RNA, 16 nt, Bordetella pertussis
ucacggcgcgcgccug

SEQ ID NO: 340640 - RNA, 20 nt, Bordetella pertussis
ucacgggcgccagcagcggg

SEQ ID NO: 340641 - RNA, 19 nt, Bordetella pertussis
ucacgggcuguucgcgcag

SEQ ID NO: 340642 - RNA, 15 nt, Bordetella pertussis
ucagaaaggcagcgg

SEQ ID NO: 340643 - RNA, 15 nt, Bordetella pertussis
ucagauggcgcagcg

SEQ ID NO: 340644 - RNA, 17 nt, Bordetella pertussis
ucagcaccucggcgccc

SEQ ID NO: 340645 - RNA, 19 nt, Bordetella pertussis
ucagcaccucggcgcccag

SEQ ID NO: 340646 - RNA, 13 nt, Bordetella pertussis
ucagcacgcucag

SEQ ID NO: 340647 - RNA, 15 nt, Bordetella pertussis
ucagcacggucggcg

SEQ ID NO: 340648 - RNA, 19 nt, Bordetella pertussis
ucagcacgaucuggcgcgc

SEQ ID NO: 340649 - RNA, 19 nt, Bordetella pertussis
ucagcagacccuggcgcgc

SEQ ID NO: 340650 - RNA, 20 nt, Bordetella pertussis
ucagcagcaggcccuccggc

SEQ ID NO: 340651 - RNA, 22 nt, Bordetella pertussis
ucagcagcaggcccuccggcgc

SEQ ID NO: 340652 - RNA, 19 nt, Bordetella pertussis
ucagcagcucguugaccug

SEQ ID NO: 340653 - RNA, 19 nt, Bordetella pertussis
ucagcagggucgagaccag

SEQ ID NO: 340654 - RNA, 17 nt, Bordetella pertussis
ucagcaggucggcgcgg

SEQ ID NO: 340655 - RNA, 18 nt, Bordetella pertussis
ucagcaggucggcgcggc

SEQ ID NO: 340656 - RNA, 16 nt, Bordetella pertussis
ucagcauggagcuggg

SEQ ID NO: 340657 - RNA, 21 nt, Bordetella pertussis
ucagcauggagcuggggccgc

SEQ ID NO: 340658 - RNA, 15 nt, Bordetella pertussis
ucagcccaggcgggc

SEQ ID NO: 340659 - RNA, 19 nt, Bordetella pertussis
ucagcccaggcgggcgugc

SEQ ID NO: 340660 - RNA, 15 nt, Bordetella pertussis
ucagccccaggcgcg

SEQ ID NO: 340661 - RNA, 18 nt, Bordetella pertussis
ucagcccgcaccgcccgc

SEQ ID NO: 340662 - RNA, 19 nt, Bordetella pertussis
ucagcccgccaucgcgcau

SEQ ID NO: 340663 - RNA, 19 nt, Bordetella pertussis
ucagcccgccuggcgccgc

SEQ ID NO: 340664 - RNA, 21 nt, Bordetella pertussis
ucagcccgccuggcgccgcgc

SEQ ID NO: 340665 - RNA, 15 nt, Bordetella pertussis
ucagcccggcgcgcc

SEQ ID NO: 340666 - RNA, 17 nt, Bordetella pertussis
ucagccgugccgcgcgc

SEQ ID NO: 340667 - RNA, 15 nt, Bordetella pertussis
ucagccgugucgccc

SEQ ID NO: 340668 - RNA, 21 nt, Bordetella pertussis
ucagccugccggcgcgcccag

SEQ ID NO: 340669 - RNA, 16 nt, Bordetella pertussis
ucagccugggcgccug

SEQ ID NO: 340670 - RNA, 18 nt, Bordetella pertussis
ucagccuugcuccggcgu

SEQ ID NO: 340671 - RNA, 21 nt, Bordetella pertussis
ucagcgaaugcgacagcgaca

SEQ ID NO: 340672 - RNA, 20 nt, Bordetella pertussis
ucaggcgauccugcccaccg

SEQ ID NO: 340673 - RNA, 22 nt, Bordetella pertussis
ucaggcgcggauugaugucgcg

SEQ ID NO: 340674 - RNA, 17 nt, Bordetella pertussis
ucaggcgcucgaucgga

SEQ ID NO: 340675 - RNA, 16 nt, Bordetella pertussis
ucaggcggagucgccc

SEQ ID NO: 340676 - RNA, 23 nt, Bordetella pertussis
ucaggcggaugcgguacugcggc

SEQ ID NO: 340677 - RNA, 20 nt, Bordetella pertussis
ucaggcggugccccggccuc

SEQ ID NO: 340678 - RNA, 18 nt, Bordetella pertussis
ucagggaggcuguccccg

SEQ ID NO: 340679 - RNA, 19 nt, Bordetella pertussis
ucagggccgcagcaccuug

SEQ ID NO: 340680 - RNA, 15 nt, Bordetella pertussis
ucagggcgccgcggc

SEQ ID NO: 340681 - RNA, 23 nt, Bordetella pertussis
ucaggguggagaauucggcgcgu

SEQ ID NO: 340682 - RNA, 19 nt, Bordetella pertussis
ucagggugggcacgcgcgc

SEQ ID NO: 340683 - RNA, 14 nt, Bordetella pertussis
ucagggugucgccg

SEQ ID NO: 340684 - RNA, 19 nt, Bordetella pertussis
ucagguucaugaccaucgc

SEQ ID NO: 340685 - RNA, 15 nt, Bordetella pertussis
ucagguuguccagcg

SEQ ID NO: 340686 - RNA, 20 nt, Bordetella pertussis
ucaguaucucggcgcccgcg

SEQ ID NO: 340687 - RNA, 14 nt, Bordetella pertussis
ucauacgacgcggc

SEQ ID NO: 340688 - RNA, 14 nt, Bordetella pertussis
ucaucaaacgcggc

SEQ ID NO: 340689 - RNA, 17 nt, Bordetella pertussis
ucaucaaacgcggcgcc

SEQ ID NO: 340690 - RNA, 13 nt, Bordetella pertussis
ucauccgcgcaug

SEQ ID NO: 340691 - RNA, 17 nt, Bordetella pertussis
ucauccuggucgacgcg

SEQ ID NO: 340692 - RNA, 18 nt, Bordetella pertussis
ucaucgaugcgccgcacc

SEQ ID NO: 340693 - RNA, 14 nt, Bordetella pertussis
ucaucgccgacgcg

SEQ ID NO: 340694 - RNA, 19 nt, Bordetella pertussis
ucaugccggcaagcacgaa

SEQ ID NO: 340695 - RNA, 14 nt, Bordetella pertussis
ucaugcgcaccuug

SEQ ID NO: 340696 - RNA, 17 nt, Bordetella pertussis
ucaugcguucggccagc

SEQ ID NO: 340697 - RNA, 18 nt, Bordetella pertussis
ucauggcacagcgcggcg

SEQ ID NO: 340698 - RNA, 15 nt, Bordetella pertussis
ucauggccgcgccca

SEQ ID NO: 340699 - RNA, 14 nt, Bordetella pertussis
ucauggcggcaggc

SEQ ID NO: 340700 - RNA, 18 nt, Bordetella pertussis
ucauggcggcaggcgcga

SEQ ID NO: 340701 - RNA, 16 nt, Bordetella pertussis
ucauggcgccgauggc

SEQ ID NO: 340702 - RNA, 21 nt, Bordetella pertussis
ucauggcgccgauggcgccgc

SEQ ID NO: 340703 - RNA, 16 nt, Bordetella pertussis
ucauggcgucggccac

SEQ ID NO: 340704 - RNA, 16 nt, Bordetella pertussis
uccaccagccggccgc

SEQ ID NO: 340705 - RNA, 17 nt, Bordetella pertussis
uccaccagccggccgcc

SEQ ID NO: 340706 - RNA, 14 nt, Bordetella pertussis
uccacgaacgcgau

SEQ ID NO: 340707 - RNA, 19 nt, Bordetella pertussis
uccacgcacaccgcccgaa

SEQ ID NO: 340708 - RNA, 23 nt, Bordetella pertussis
uccacgcagaaauggaugcgcgc

SEQ ID NO: 340709 - RNA, 22 nt, Bordetella pertussis
uccacgcccagcgccggcacgc

SEQ ID NO: 340710 - RNA, 15 nt, Bordetella pertussis
uccacgcccgcgccg

SEQ ID NO: 340711 - RNA, 22 nt, Bordetella pertussis
uccagaacgcgccguaccccag

SEQ ID NO: 340712 - RNA, 15 nt, Bordetella pertussis
uccagaacggcgcgg

SEQ ID NO: 340713 - RNA, 16 nt, Bordetella pertussis
uccagaacggcgcggg

SEQ ID NO: 340714 - RNA, 23 nt, Bordetella pertussis
uccagacccgaaucucccggcgc

SEQ ID NO: 340715 - RNA, 23 nt, Bordetella pertussis
uccagacgauggugccggccguc

SEQ ID NO: 340716 - RNA, 14 nt, Bordetella pertussis
uccagacgggcugg

SEQ ID NO: 340717 - RNA, 21 nt, Bordetella pertussis
uccagagggaaaacagcgcgg

SEQ ID NO: 340718 - RNA, 19 nt, Bordetella pertussis
uccagagucugccuggcga

SEQ ID NO: 340719 - RNA, 21 nt, Bordetella pertussis
uccagcacgacgacggccggc

SEQ ID NO: 340720 - RNA, 18 nt, Bordetella pertussis
uccagcacgcggcgcagc

SEQ ID NO: 340721 - RNA, 14 nt, Bordetella pertussis
uccagcacggccgc

SEQ ID NO: 340722 - RNA, 14 nt, Bordetella pertussis
uccagcacggcgag

SEQ ID NO: 340723 - RNA, 16 nt, Bordetella pertussis
uccagcagaucgcggc

SEQ ID NO: 340724 - RNA, 15 nt, Bordetella pertussis
uccagcagcagcgcc

SEQ ID NO: 340725 - RNA, 16 nt, Bordetella pertussis
uccagcagcagcgccg

SEQ ID NO: 340726 - RNA, 19 nt, Bordetella pertussis
uccagcagcagcgccgcgc

SEQ ID NO: 340727 - RNA, 21 nt, Bordetella pertussis
uccagcagauucaugggcggc

SEQ ID NO: 340728 - RNA, 15 nt, Bordetella pertussis
uccagccgagccugg

SEQ ID NO: 340729 - RNA, 18 nt, Bordetella pertussis
uccagccgaucagccggc

SEQ ID NO: 340730 - RNA, 13 nt, Bordetella pertussis
uccagccgcaggc

SEQ ID NO: 340731 - RNA, 15 nt, Bordetella pertussis
uccagcaggauggcg

SEQ ID NO: 340732 - RNA, 19 nt, Bordetella pertussis
uccagccguuggcgcccag

SEQ ID NO: 340733 - RNA, 23 nt, Bordetella pertussis
uccagccguuggcgcccagcgcc

SEQ ID NO: 340734 - RNA, 19 nt, Bordetella pertussis
uccagcgacucggucagca

SEQ ID NO: 340735 - RNA, 19 nt, Bordetella pertussis
uccagcgccagcaccggca

SEQ ID NO: 340736 - RNA, 14 nt, Bordetella pertussis
uccagcgccagcag

SEQ ID NO: 340737 - RNA, 19 nt, Bordetella pertussis
uccagcgcccgcggaaagc

SEQ ID NO: 340738 - RNA, 12 nt, Bordetella pertussis
uccagcgccugg

SEQ ID NO: 340739 - RNA, 17 nt, Bordetella pertussis
uccagcgccuggcgggc

SEQ ID NO: 340740 - RNA, 23 nt, Bordetella pertussis
uccagcgccugggguaggcgcgg

SEQ ID NO: 340741 - RNA, 19 nt, Bordetella pertussis
uccagcgcgcccagcgcgc

SEQ ID NO: 340742 - RNA, 22 nt, Bordetella pertussis
uccagcgcgcccgaggcgcgca

SEQ ID NO: 340743 - RNA, 23 nt, Bordetella pertussis
uccagcgcgcccgaggcgcgcag

SEQ ID NO: 340744 - RNA, 21 nt, Bordetella pertussis
uccagcgcgaaaugcccagcg

SEQ ID NO: 340745 - RNA, 21 nt, Bordetella pertussis
uccagcgcgcgaucgccagca

SEQ ID NO: 340746 - RNA, 23 nt, Bordetella pertussis
uccagcgcggcaugccgcugcag

SEQ ID NO: 340747 - RNA, 14 nt, Bordetella pertussis
uccagcgcggcgcc

SEQ ID NO: 340748 - RNA, 22 nt, Bordetella pertussis
uccagcgcuucgugcagcgcgu

SEQ ID NO: 340749 - RNA, 23 nt, Bordetella pertussis
uccagcggaaguauucgcgcggc

SEQ ID NO: 340750 - RNA, 23 nt, Bordetella pertussis
uccagcugcuucaguuccaggcg

SEQ ID NO: 340751 - RNA, 22 nt, Bordetella pertussis
uccagcuggcccuggcagacgu

SEQ ID NO: 340752 - RNA, 19 nt, Bordetella pertussis
uccaggaaagcgccgccgc

SEQ ID NO: 340753 - RNA, 22 nt, Bordetella pertussis
uccaggaacugcuccacgugcg

SEQ ID NO: 340754 - RNA, 14 nt, Bordetella pertussis
uccauagcgccgcu

SEQ ID NO: 340755 - RNA, 19 nt, Bordetella pertussis
ucccaaccgggacaggcac

SEQ ID NO: 340756 - RNA, 20 nt, Bordetella pertussis
ucccaaccgggacaggcacc

SEQ ID NO: 340757 - RNA, 14 nt, Bordetella pertussis
ucccacaggcgcgc

SEQ ID NO: 340758 - RNA, 16 nt, Bordetella pertussis
ucccagaaacuggcgc

SEQ ID NO: 340759 - RNA, 14 nt, Bordetella pertussis
ucccagaccugcgc

SEQ ID NO: 340760 - RNA, 16 nt, Bordetella pertussis
ucccagaccugcgcgc

SEQ ID NO: 340761 - RNA, 20 nt, Bordetella pertussis
ucccagaccugcgcgccggc

SEQ ID NO: 340762 - RNA, 15 nt, Bordetella pertussis
ucccagauggcgccu

SEQ ID NO: 340763 - RNA, 16 nt, Bordetella pertussis
ucccagccgucgcgcu

SEQ ID NO: 340764 - RNA, 19 nt, Bordetella pertussis
ucccagccgucgcgcugca

SEQ ID NO: 340765 - RNA, 18 nt, Bordetella pertussis
ucccagcgcacgcagcgc

SEQ ID NO: 340766 - RNA, 18 nt, Bordetella pertussis
ucccagcggggacaggca

SEQ ID NO: 340767 - RNA, 13 nt, Bordetella pertussis
ucccagcuccagu

SEQ ID NO: 340768 - RNA, 18 nt, Bordetella pertussis
ucccaggaucaccgccgc

SEQ ID NO: 340769 - RNA, 13 nt, Bordetella pertussis
ucccaggcccggc

SEQ ID NO: 340770 - RNA, 14 nt, Bordetella pertussis
ucccaggcccggcc

SEQ ID NO: 340771 - RNA, 19 nt, Bordetella pertussis
ucccaggcccggccgcagg

SEQ ID NO: 340772 - RNA, 21 nt, Bordetella pertussis
ucccaggcgaggcuggcgccc

SEQ ID NO: 340773 - RNA, 18 nt, Bordetella pertussis
ucccaguccggcagcacc

SEQ ID NO: 340774 - RNA, 17 nt, Bordetella pertussis
ucccaguucugcagcgu

SEQ ID NO: 340775 - RNA, 20 nt, Bordetella pertussis
uccccaacggggacgggcgc

SEQ ID NO: 340776 - RNA, 15 nt, Bordetella pertussis
uccccaaguacacgg

SEQ ID NO: 340777 - RNA, 17 nt, Bordetella pertussis
uccccaaguacacgguc

SEQ ID NO: 340778 - RNA, 20 nt, Bordetella pertussis
uccccacagggggacuggca

SEQ ID NO: 340779 - RNA, 22 nt, Bordetella pertussis
uccccacagggggacuggcacc

SEQ ID NO: 340780 - RNA, 20 nt, Bordetella pertussis
uccccacagggggucuggca

SEQ ID NO: 340781 - RNA, 22 nt, Bordetella pertussis
uccccacauggggacuggcacc

SEQ ID NO: 340782 - RNA, 16 nt, Bordetella pertussis
uccccacguggacagg

SEQ ID NO: 340783 - RNA, 18 nt, Bordetella pertussis
uccccacguggacaggca

SEQ ID NO: 340784 - RNA, 19 nt, Bordetella pertussis
uccccacguggacaggcac

SEQ ID NO: 340785 - RNA, 20 nt, Bordetella pertussis
uccccacguggacaggcacc

SEQ ID NO: 340786 - RNA, 16 nt, Bordetella pertussis
uccccaccgggacagg

SEQ ID NO: 340787 - RNA, 18 nt, Bordetella pertussis
uccccaccgggacaggca

SEQ ID NO: 340788 - RNA, 20 nt, Bordetella pertussis
uccccacugggggacuggca

SEQ ID NO: 340789 - RNA, 22 nt, Bordetella pertussis
uccccacugggggacuggcacc

SEQ ID NO: 340790 - RNA, 12 nt, Bordetella pertussis
uccccagcgccg

SEQ ID NO: 340791 - RNA, 13 nt, Bordetella pertussis
uccccagcgccgc

SEQ ID NO: 340792 - RNA, 19 nt, Bordetella pertussis
uccccaucaucugcggcac

SEQ ID NO: 340793 - RNA, 20 nt, Bordetella pertussis
uccccaugcggggacuggca

SEQ ID NO: 340794 - RNA, 23 nt, Bordetella pertussis
uccccaugcggggacuggcacca

SEQ ID NO: 340795 - RNA, 18 nt, Bordetella pertussis
uccccauguggggacagg

SEQ ID NO: 340796 - RNA, 19 nt, Bordetella pertussis
ucccccaugcggggacagg

SEQ ID NO: 340797 - RNA, 18 nt, Bordetella pertussis
uccccccauggggacugg

SEQ ID NO: 340798 - RNA, 22 nt, Bordetella pertussis
uccccccauggggacuggcacc

SEQ ID NO: 340799 - RNA, 16 nt, Bordetella pertussis
ucccccgcggggacag

SEQ ID NO: 340800 - RNA, 22 nt, Bordetella pertussis
ucccccgcgucggacgcgcgcc

SEQ ID NO: 340801 - RNA, 16 nt, Bordetella pertussis
ucccccuacugcccuc

SEQ ID NO: 340802 - RNA, 23 nt, Bordetella pertussis
uccccgaacggggacuggcacca

SEQ ID NO: 340803 - RNA, 17 nt, Bordetella pertussis
uccccgaaggggacugg

SEQ ID NO: 340804 - RNA, 19 nt, Bordetella pertussis
uccccgaaggggacuggcu

SEQ ID NO: 340805 - RNA, 19 nt, Bordetella pertussis
uccccgcaagggggacugg

SEQ ID NO: 340806 - RNA, 21 nt, Bordetella pertussis
uccccgcaagggggacuggca

SEQ ID NO: 340807 - RNA, 23 nt, Bordetella pertussis
uccccgcaagggggacuggcacc

SEQ ID NO: 340808 - RNA, 18 nt, Bordetella pertussis
uccccgcacggggacagg

SEQ ID NO: 340809 - RNA, 18 nt, Bordetella pertussis
uccccgcacggggacugg

SEQ ID NO: 340810 - RNA, 20 nt, Bordetella pertussis
uccccgcacggggacuggca

SEQ ID NO: 340811 - RNA, 14 nt, Bordetella pertussis
uccccgcagggaca

SEQ ID NO: 340812 - RNA, 18 nt, Bordetella pertussis
uccccgcagggacaggca

SEQ ID NO: 340813 - RNA, 19 nt, Bordetella pertussis
uccccgcagggacaggcac

SEQ ID NO: 340814 - RNA, 20 nt, Bordetella pertussis
uccccgcauggggacuggcg

SEQ ID NO: 340815 - RNA, 23 nt, Bordetella pertussis
uccccgcauggggacuggcgccu

SEQ ID NO: 340816 - RNA, 21 nt, Bordetella pertussis
uccccgcaugggggcuggcgc

SEQ ID NO: 340817 - RNA, 11 nt, Bordetella pertussis
uccccgccggg

SEQ ID NO: 340818 - RNA, 18 nt, Bordetella pertussis
uccccgccgggacaggca

SEQ ID NO: 340819 - RNA, 20 nt, Bordetella pertussis
uccccgccgggacaggcacc

SEQ ID NO: 340820 - RNA, 20 nt, Bordetella pertussis
uccccgccggggcaggcucc

SEQ ID NO: 340821 - RNA, 14 nt, Bordetella pertussis
uccccgcggggaca

SEQ ID NO: 340822 - RNA, 16 nt, Bordetella pertussis
uccccgcggggacagg

SEQ ID NO: 340823 - RNA, 18 nt, Bordetella pertussis
uccccgcggggacaggca

SEQ ID NO: 340824 - RNA, 19 nt, Bordetella pertussis
uccccgcggggacaggcac

SEQ ID NO: 340825 - RNA, 20 nt, Bordetella pertussis
uccccgcggggacaggcacc

SEQ ID NO: 340826 - RNA, 20 nt, Bordetella pertussis
uccccgcggggacaggcucc

SEQ ID NO: 340827 - RNA, 16 nt, Bordetella pertussis
uccccgcggggacugg

SEQ ID NO: 340828 - RNA, 17 nt, Bordetella pertussis
uccccgcgugccugucc

SEQ ID NO: 340829 - RNA, 15 nt, Bordetella pertussis
uccccgcugggacag

SEQ ID NO: 340830 - RNA, 16 nt, Bordetella pertussis
uccccgcugggacagg

SEQ ID NO: 340831 - RNA, 18 nt, Bordetella pertussis
uccccgcugggacaggca

SEQ ID NO: 340832 - RNA, 19 nt, Bordetella pertussis
uccccgcugggacaggcac

SEQ ID NO: 340833 - RNA, 20 nt, Bordetella pertussis
uccccgcugggacaggcaca

SEQ ID NO: 340834 - RNA, 17 nt, Bordetella pertussis
uccccgucggcggcaag

SEQ ID NO: 340835 - RNA, 16 nt, Bordetella pertussis
uccccguggggacaga

SEQ ID NO: 340836 - RNA, 16 nt, Bordetella pertussis
uccccguggggacagg

SEQ ID NO: 340837 - RNA, 20 nt, Bordetella pertussis
uccccguucggggacaggca

SEQ ID NO: 340838 - RNA, 22 nt, Bordetella pertussis
uccccguucggggacaggcacc

SEQ ID NO: 340839 - RNA, 20 nt, Bordetella pertussis
uccccgugcggggaccggca

SEQ ID NO: 340840 - RNA, 17 nt, Bordetella pertussis
uccccugcggggacagg

SEQ ID NO: 340841 - RNA, 19 nt, Bordetella pertussis
uccccugcggggacaggca

SEQ ID NO: 340842 - RNA, 17 nt, Bordetella pertussis
uccccuucucggccguc

SEQ ID NO: 340843 - RNA, 19 nt, Bordetella pertussis
ucccgauauaugacguaga

SEQ ID NO: 340844 - RNA, 20 nt, Bordetella pertussis
ucccggcugggacaggcacc

SEQ ID NO: 340845 - RNA, 15 nt, Bordetella pertussis
ucccggguggcgcca

SEQ ID NO: 340846 - RNA, 20 nt, Bordetella pertussis
uccgacaccgucaggaagcc

SEQ ID NO: 340847 - RNA, 15 nt, Bordetella pertussis
uccgacaggcgccgc

SEQ ID NO: 340848 - RNA, 18 nt, Bordetella pertussis
uccgacaggcgccgcaac

SEQ ID NO: 340849 - RNA, 13 nt, Bordetella pertussis
uccgaugcuggug

SEQ ID NO: 340850 - RNA, 13 nt, Bordetella pertussis
uccgccacccugg

SEQ ID NO: 340851 - RNA, 14 nt, Bordetella pertussis
uccgccaccgcgcc

SEQ ID NO: 340852 - RNA, 16 nt, Bordetella pertussis
uccgccaugcggcgcc

SEQ ID NO: 340853 - RNA, 18 nt, Bordetella pertussis
uccgccauggaggcgcag

SEQ ID NO: 340854 - RNA, 22 nt, Bordetella pertussis
uccgccauggaggcgcagcgcg

SEQ ID NO: 340855 - RNA, 17 nt, Bordetella pertussis
uccgcccagccaggcgc

SEQ ID NO: 340856 - RNA, 20 nt, Bordetella pertussis
uccgcccagccaggcgccag

SEQ ID NO: 340857 - RNA, 16 nt, Bordetella pertussis
uccgccauaugcgcga

SEQ ID NO: 340858 - RNA, 15 nt, Bordetella pertussis
uccgccgugcaggcc

SEQ ID NO: 340859 - RNA, 17 nt, Bordetella pertussis
uccgccuacuggcgcgc

SEQ ID NO: 340860 - RNA, 18 nt, Bordetella pertussis
uccgccuacuggcgcgcg

SEQ ID NO: 340861 - RNA, 21 nt, Bordetella pertussis
uccgcgcaugauuccugucgc

SEQ ID NO: 340862 - RNA, 20 nt, Bordetella pertussis
uccgcgcauggacugcaggc

SEQ ID NO: 340863 - RNA, 18 nt, Bordetella pertussis
uccgcgccacacgggcgc

SEQ ID NO: 340864 - RNA, 19 nt, Bordetella pertussis
uccgcgccacacgggcgcc

SEQ ID NO: 340865 - RNA, 13 nt, Bordetella pertussis
uccgcgcgcagcg

SEQ ID NO: 340866 - RNA, 15 nt, Bordetella pertussis
uccgcgcucgcccag

SEQ ID NO: 340867 - RNA, 20 nt, Bordetella pertussis
uccgcgcugcugccgucggc

SEQ ID NO: 340868 - RNA, 14 nt, Bordetella pertussis
uccgcguccaucug

SEQ ID NO: 340869 - RNA, 12 nt, Bordetella pertussis
uccgcgucgccg

SEQ ID NO: 340870 - RNA, 19 nt, Bordetella pertussis
uccgcgugggcaugguggc

SEQ ID NO: 340871 - RNA, 16 nt, Bordetella pertussis
uccgcuaccaggcgcg

SEQ ID NO: 340872 - RNA, 17 nt, Bordetella pertussis
uccgcuaccaggcgcgc

SEQ ID NO: 340873 - RNA, 15 nt, Bordetella pertussis
uccgcucaugccggc

SEQ ID NO: 340874 - RNA, 19 nt, Bordetella pertussis
uccggacugaacgcgucca

SEQ ID NO: 340875 - RNA, 21 nt, Bordetella pertussis
uccggcaaagaucaccugggc

SEQ ID NO: 340876 - RNA, 12 nt, Bordetella pertussis
uccggccgcgca

SEQ ID NO: 340877 - RNA, 13 nt, Bordetella pertussis
uccggccgugccg

SEQ ID NO: 340878 - RNA, 19 nt, Bordetella pertussis
uccggcgaccgacggcauc

SEQ ID NO: 340879 - RNA, 13 nt, Bordetella pertussis
uccgggcggcguu

SEQ ID NO: 340880 - RNA, 16 nt, Bordetella pertussis
uccggggugccugucc

SEQ ID NO: 340881 - RNA, 13 nt, Bordetella pertussis
uccggguccagcc

SEQ ID NO: 340882 - RNA, 18 nt, Bordetella pertussis
uccggguccagccccacg

SEQ ID NO: 340883 - RNA, 16 nt, Bordetella pertussis
uccgggucgcggcacg

SEQ ID NO: 340884 - RNA, 20 nt, Bordetella pertussis
ucgacgcgcgucgugcccgc

SEQ ID NO: 340885 - RNA, 23 nt, Bordetella pertussis
ucgacgcgcgucgugcccgccac

SEQ ID NO: 340886 - RNA, 14 nt, Bordetella pertussis
ucgacgcggccgac

SEQ ID NO: 340887 - RNA, 22 nt, Bordetella pertussis
ucgacggcgccuauugcgacgc

SEQ ID NO: 340888 - RNA, 17 nt, Bordetella pertussis
ucgacggcgcgcgcguu

SEQ ID NO: 340889 - RNA, 14 nt, Bordetella pertussis
ucgacggugcgcgc

SEQ ID NO: 340890 - RNA, 15 nt, Bordetella pertussis
ucgacggugcgcgcc

SEQ ID NO: 340891 - RNA, 16 nt, Bordetella pertussis
ucgacggugcgcgcca

SEQ ID NO: 340892 - RNA, 15 nt, Bordetella pertussis
ucgacguccuggugg

SEQ ID NO: 340893 - RNA, 20 nt, Bordetella pertussis
ucgacguccugguggaccug

SEQ ID NO: 340894 - RNA, 18 nt, Bordetella pertussis
ucgacgucguaccccgag

SEQ ID NO: 340895 - RNA, 14 nt, Bordetella pertussis
ucgacucggccgag

SEQ ID NO: 340896 - RNA, 19 nt, Bordetella pertussis
ucgacuucguccggcgcgu

SEQ ID NO: 340897 - RNA, 22 nt, Bordetella pertussis
ucgacuuggccugguuggccgc

SEQ ID NO: 340898 - RNA, 22 nt, Bordetella pertussis
ucgagaaguuggcgggcgcuuc

SEQ ID NO: 340899 - RNA, 18 nt, Bordetella pertussis
ucgagaccagcagcgggu

SEQ ID NO: 340900 - RNA, 22 nt, Bordetella pertussis
ucgagagccugggcgcgcgccc

SEQ ID NO: 340901 - RNA, 23 nt, Bordetella pertussis
ucgagagccugggcgcgcgccca

SEQ ID NO: 340902 - RNA, 18 nt, Bordetella pertussis
ucgagauccgccggcgau

SEQ ID NO: 340903 - RNA, 13 nt, Bordetella pertussis
ucgagcaccgcgc

SEQ ID NO: 340904 - RNA, 17 nt, Bordetella pertussis
ucgagcaccgugaccug

SEQ ID NO: 340905 - RNA, 17 nt, Bordetella pertussis
ucgagcacgcggcgcgg

SEQ ID NO: 340906 - RNA, 18 nt, Bordetella pertussis
ucgagcacgcggcgcggc

SEQ ID NO: 340907 - RNA, 22 nt, Bordetella pertussis
ucgagcacgguuucgccgugcu

SEQ ID NO: 340908 - RNA, 20 nt, Bordetella pertussis
ucgagcacuucgagcgacgg

SEQ ID NO: 340909 - RNA, 17 nt, Bordetella pertussis
ucgagcagcgcaucgau

SEQ ID NO: 340910 - RNA, 16 nt, Bordetella pertussis
ucgagcaggccgccgc

SEQ ID NO: 340911 - RNA, 13 nt, Bordetella pertussis
ucgagcaggccgg

SEQ ID NO: 340912 - RNA, 14 nt, Bordetella pertussis
ucgagcaggcgcag

SEQ ID NO: 340913 - RNA, 22 nt, Bordetella pertussis
ucgagcaggcgcaggccgcgcg

SEQ ID NO: 340914 - RNA, 16 nt, Bordetella pertussis
ucgagcaggcgcgcgg

SEQ ID NO: 340915 - RNA, 21 nt, Bordetella pertussis
ucgagcaucauggcgcgcgcc

SEQ ID NO: 340916 - RNA, 15 nt, Bordetella pertussis
ucgagcaugcgggcc

SEQ ID NO: 340917 - RNA, 23 nt, Bordetella pertussis
ucgagcaugcgggccaugucggc

SEQ ID NO: 340918 - RNA, 17 nt, Bordetella pertussis
ucgagcauugccgcggc

SEQ ID NO: 340919 - RNA, 14 nt, Bordetella pertussis
ucgagccaggugga

SEQ ID NO: 340920 - RNA, 19 nt, Bordetella pertussis
ucgagccagguggacagcg

SEQ ID NO: 340921 - RNA, 19 nt, Bordetella pertussis
ucgagccgcagaacagcag

SEQ ID NO: 340922 - RNA, 20 nt, Bordetella pertussis
ucgagccgggccacgcgcac

SEQ ID NO: 340923 - RNA, 14 nt, Bordetella pertussis
ucgagccgggcgcc

SEQ ID NO: 340924 - RNA, 20 nt, Bordetella pertussis
ucgagccggacgugggcgcc

SEQ ID NO: 340925 - RNA, 23 nt, Bordetella pertussis
ucgagcgccugcgccacguccag

SEQ ID NO: 340926 - RNA, 17 nt, Bordetella pertussis
ucgagcgccugggcggc

SEQ ID NO: 340927 - RNA, 20 nt, Bordetella pertussis
ucgagcgccugggcggccac

SEQ ID NO: 340928 - RNA, 18 nt, Bordetella pertussis
ucgagcgcggccaggcgc

SEQ ID NO: 340929 - RNA, 15 nt, Bordetella pertussis
ucgagcgcggcgcgc

SEQ ID NO: 340930 - RNA, 16 nt, Bordetella pertussis
ucgagcgcggcgcgcg

SEQ ID NO: 340931 - RNA, 18 nt, Bordetella pertussis
ucgagcuggcuggccagc

SEQ ID NO: 340932 - RNA, 20 nt, Bordetella pertussis
ucgaggaaccagccgucggc

SEQ ID NO: 340933 - RNA, 15 nt, Bordetella pertussis
ucgaggaaggcccgc

SEQ ID NO: 340934 - RNA, 17 nt, Bordetella pertussis
ucgaggaaggcccgcgu

SEQ ID NO: 340935 - RNA, 19 nt, Bordetella pertussis
ucgaggaccugaccgugca

SEQ ID NO: 340936 - RNA, 18 nt, Bordetella pertussis
ucgagguauucgcgcgau

SEQ ID NO: 340937 - RNA, 14 nt, Bordetella pertussis
ucgagguggcgcau

SEQ ID NO: 340938 - RNA, 15 nt, Bordetella pertussis
ucgaguggugcgcgg

SEQ ID NO: 340939 - RNA, 15 nt, Bordetella pertussis
ucgauaccgucgcgc

SEQ ID NO: 340940 - RNA, 14 nt, Bordetella pertussis
ucgauacgccgggc

SEQ ID NO: 340941 - RNA, 16 nt, Bordetella pertussis
ucgaucaccaccggca

SEQ ID NO: 340942 - RNA, 15 nt, Bordetella pertussis
ucgaucacggcgcgc

SEQ ID NO: 340943 - RNA, 14 nt, Bordetella pertussis
ucgaucacgaagcc

SEQ ID NO: 340944 - RNA, 17 nt, Bordetella pertussis
ucgaucacgaagcccag

SEQ ID NO: 340945 - RNA, 17 nt, Bordetella pertussis
ucgaucagccagccggc

SEQ ID NO: 340946 - RNA, 14 nt, Bordetella pertussis
ucgaucagcgcgcc

SEQ ID NO: 340947 - RNA, 15 nt, Bordetella pertussis
ucgaucaggcugucg

SEQ ID NO: 340948 - RNA, 22 nt, Bordetella pertussis
ucgaucagggcgaacggggugg

SEQ ID NO: 340949 - RNA, 15 nt, Bordetella pertussis
ucgaucagggcgcgg

SEQ ID NO: 340950 - RNA, 22 nt, Bordetella pertussis
ucgaucauggcgccgauggcgc

SEQ ID NO: 340951 - RNA, 18 nt, Bordetella pertussis
ucgauccggcagcagcag

SEQ ID NO: 340952 - RNA, 23 nt, Bordetella pertussis
ucgauccgggcaccuucgaggaa

SEQ ID NO: 340953 - RNA, 13 nt, Bordetella pertussis
ucgaucgccaggu

SEQ ID NO: 340954 - RNA, 21 nt, Bordetella pertussis
ucgaucgccaggucggccagc

SEQ ID NO: 340955 - RNA, 19 nt, Bordetella pertussis
ucgaucgcaucgcggcagc

SEQ ID NO: 340956 - RNA, 15 nt, Bordetella pertussis
ucgaucgccgccggc

SEQ ID NO: 340957 - RNA, 22 nt, Bordetella pertussis
ucgaucgucuugaccagcaggc

SEQ ID NO: 340958 - RNA, 19 nt, Bordetella pertussis
ucgaucuucucgccgcgcg

SEQ ID NO: 340959 - RNA, 23 nt, Bordetella pertussis
ucgaugaacaagguacccgcgcc

SEQ ID NO: 340960 - RNA, 19 nt, Bordetella pertussis
ucgaugaugcgguugauca

SEQ ID NO: 340961 - RNA, 17 nt, Bordetella pertussis
ucgaugcccagcaccgc

SEQ ID NO: 340962 - RNA, 16 nt, Bordetella pertussis
ucgaugccgaccaggc

SEQ ID NO: 340963 - RNA, 18 nt, Bordetella pertussis
ucgaugcccucgcgcacg

SEQ ID NO: 340964 - RNA, 12 nt, Bordetella pertussis
ucgaugccggcg

SEQ ID NO: 340965 - RNA, 19 nt, Bordetella pertussis
ucgaugcgccgcaccagcg

SEQ ID NO: 340966 - RNA, 12 nt, Bordetella pertussis
ucgaugcgcgaa

SEQ ID NO: 340967 - RNA, 18 nt, Bordetella pertussis
ucgaugcgcuugccgacc

SEQ ID NO: 340968 - RNA, 19 nt, Bordetella pertussis
ucgaugcggucggccgcgc

SEQ ID NO: 340969 - RNA, 20 nt, Bordetella pertussis
ucgaugcggucggccgcgcc

SEQ ID NO: 340970 - RNA, 13 nt, Bordetella pertussis
ucgaugcuggcgc

SEQ ID NO: 340971 - RNA, 17 nt, Bordetella pertussis
ucgaugcuggcggcauc

SEQ ID NO: 340972 - RNA, 15 nt, Bordetella pertussis
ucgauggcggccagg

SEQ ID NO: 340973 - RNA, 23 nt, Bordetella pertussis
ucgauggcguacagcagggugcc

SEQ ID NO: 340974 - RNA, 17 nt, Bordetella pertussis
ucgaugggcccgggcag

SEQ ID NO: 340975 - RNA, 20 nt, Bordetella pertussis
ucgauggggucgggccgcgc

SEQ ID NO: 340976 - RNA, 21 nt, Bordetella pertussis
ucgauggggucgggccgcgcg

SEQ ID NO: 340977 - RNA, 13 nt, Bordetella pertussis
ucgaugggcgcgc

SEQ ID NO: 340978 - RNA, 15 nt, Bordetella pertussis
ucgaugggcgcgcgc

SEQ ID NO: 340979 - RNA, 21 nt, Bordetella pertussis
ucgauggucaguccgcccagc

SEQ ID NO: 340980 - RNA, 14 nt, Bordetella pertussis
ucgaugucaucgcc

SEQ ID NO: 340981 - RNA, 19 nt, Bordetella pertussis
ucgaugugcaugccgucgc

SEQ ID NO: 340982 - RNA, 17 nt, Bordetella pertussis
ucgauguggccuaccgc

SEQ ID NO: 340983 - RNA, 17 nt, Bordetella pertussis
ucgauguggcgcuggcg

SEQ ID NO: 340984 - RNA, 18 nt, Bordetella pertussis
ucgauugaccagcaccag

SEQ ID NO: 340985 - RNA, 18 nt, Bordetella pertussis
ucgauuucggcggccagg

SEQ ID NO: 340986 - RNA, 23 nt, Bordetella pertussis
ucgcaacaacggggucaucgcga

SEQ ID NO: 340987 - RNA, 15 nt, Bordetella pertussis
ucgcaagugcuggcc

SEQ ID NO: 340988 - RNA, 22 nt, Bordetella pertussis
ucgcaagugcuggcccgccagc

SEQ ID NO: 340989 - RNA, 22 nt, Bordetella pertussis
ucgcaauacgucgcgaccgccg

SEQ ID NO: 340990 - RNA, 16 nt, Bordetella pertussis
ucgcaaucgacgaaca

SEQ ID NO: 340991 - RNA, 20 nt, Bordetella pertussis
ucgcacagccggggcgagcg

SEQ ID NO: 340992 - RNA, 18 nt, Bordetella pertussis
ucgcacacgcgcugggcg

SEQ ID NO: 340993 - RNA, 20 nt, Bordetella pertussis
ucgcacaucaggucgaccug

SEQ ID NO: 340994 - RNA, 21 nt, Bordetella pertussis
ucgcaccagucccgcaccgac

SEQ ID NO: 340995 - RNA, 21 nt, Bordetella pertussis
ucgcacggccgucaacagcau

SEQ ID NO: 340996 - RNA, 17 nt, Bordetella pertussis
ucgcacgugacgccggc

SEQ ID NO: 340997 - RNA, 23 nt, Bordetella pertussis
ucgcacuggguuuuuccggcucu

SEQ ID NO: 340998 - RNA, 14 nt, Bordetella pertussis
ucgcaggccgcggc

SEQ ID NO: 340999 - RNA, 20 nt, Bordetella pertussis
ucgcaggccugcugcagcgu

SEQ ID NO: 341000 - RNA, 20 nt, Bordetella pertussis
ucgcagggcgcaacgccggc

SEQ ID NO: 341001 - RNA, 20 nt, Bordetella pertussis
ucgcaggaauccuggugcca

SEQ ID NO: 341002 - RNA, 22 nt, Bordetella pertussis
ucgcauacggacgagcgcagca

SEQ ID NO: 341003 - RNA, 15 nt, Bordetella pertussis
ucgcaucggccugca

SEQ ID NO: 341004 - RNA, 21 nt, Bordetella pertussis
ucgcaugcgguuucucagcgc

SEQ ID NO: 341005 - RNA, 18 nt, Bordetella pertussis
ucgcauuucucggccugg

SEQ ID NO: 341006 - RNA, 16 nt, Bordetella pertussis
ucgccaaagcgcagcg

SEQ ID NO: 341007 - RNA, 17 nt, Bordetella pertussis
ucgccaaagcgcagcgu

SEQ ID NO: 341008 - RNA, 20 nt, Bordetella pertussis
ucgccaacgucggcagccag

SEQ ID NO: 341009 - RNA, 21 nt, Bordetella pertussis
ucgccaaucugccgcugaccg

SEQ ID NO: 341010 - RNA, 12 nt, Bordetella pertussis
ucgccaccgccc

SEQ ID NO: 341011 - RNA, 23 nt, Bordetella pertussis
ucgccacgcuguugcgccugucc

SEQ ID NO: 341012 - RNA, 21 nt, Bordetella pertussis
ucgccacgggcgucaccggcg

SEQ ID NO: 341013 - RNA, 12 nt, Bordetella pertussis
ucgccagcgccg

SEQ ID NO: 341014 - RNA, 14 nt, Bordetella pertussis
ucgccagcggcagc

SEQ ID NO: 341015 - RNA, 21 nt, Bordetella pertussis
ucgccaggacguccaggccuu

SEQ ID NO: 341016 - RNA, 13 nt, Bordetella pertussis
ucgccaggcgcgu

SEQ ID NO: 341017 - RNA, 20 nt, Bordetella pertussis
ucgccagggcgaugaccggc

SEQ ID NO: 341018 - RNA, 14 nt, Bordetella pertussis
ucgcccaugcgggc

SEQ ID NO: 341019 - RNA, 18 nt, Bordetella pertussis
ucgcccauugcggcgggc

SEQ ID NO: 341020 - RNA, 22 nt, Bordetella pertussis
ucgccccccaugccggaacagg

SEQ ID NO: 341021 - RNA, 19 nt, Bordetella pertussis
ucgcccccgaaggccgcgc

SEQ ID NO: 341022 - RNA, 20 nt, Bordetella pertussis
ucgccccggcgcgcagcgcc

SEQ ID NO: 341023 - RNA, 17 nt, Bordetella pertussis
ucgcccgaccugcuggc

SEQ ID NO: 341024 - RNA, 13 nt, Bordetella pertussis
ucgcccgggcgcc

SEQ ID NO: 341025 - RNA, 14 nt, Bordetella pertussis
ucgcccgugcgcgg

SEQ ID NO: 341026 - RNA, 14 nt, Bordetella pertussis
ucgcccggggcggc

SEQ ID NO: 341027 - RNA, 17 nt, Bordetella pertussis
ucgcccggguacggcag

SEQ ID NO: 341028 - RNA, 14 nt, Bordetella pertussis
ucgcccucgcgcca

SEQ ID NO: 341029 - RNA, 15 nt, Bordetella pertussis
ucgcccucgcgccac

SEQ ID NO: 341030 - RNA, 16 nt, Bordetella pertussis
ucgccgagccgggcca

SEQ ID NO: 341031 - RNA, 15 nt, Bordetella pertussis
ucgccgcagccguug

SEQ ID NO: 341032 - RNA, 18 nt, Bordetella pertussis
ucgccgcaguuccaggca

SEQ ID NO: 341033 - RNA, 21 nt, Bordetella pertussis
ucgccgcaugggcgcgcccgg

SEQ ID NO: 341034 - RNA, 15 nt, Bordetella pertussis
ucgccgcccagccgg

SEQ ID NO: 341035 - RNA, 16 nt, Bordetella pertussis
ucgccgcccagccggc

SEQ ID NO: 341036 - RNA, 20 nt, Bordetella pertussis
ucgccgcccagccggccgau

SEQ ID NO: 341037 - RNA, 13 nt, Bordetella pertussis
ucgccgcccaugc

SEQ ID NO: 341038 - RNA, 19 nt, Bordetella pertussis
ucgccgcccugcugcccgc

SEQ ID NO: 341039 - RNA, 22 nt, Bordetella pertussis
ucgccgcccugcugcccgccgc

SEQ ID NO: 341040 - RNA, 17 nt, Bordetella pertussis
ucgccgccgcccgcccg

SEQ ID NO: 341041 - RNA, 22 nt, Bordetella pertussis
ucgccgccgcgcucggcgcugc

SEQ ID NO: 341042 - RNA, 14 nt, Bordetella pertussis
ucgccggcccugcc

SEQ ID NO: 341043 - RNA, 13 nt, Bordetella pertussis
ucgccggccgcgc

SEQ ID NO: 341044 - RNA, 16 nt, Bordetella pertussis
ucgccggccuggcgcg

SEQ ID NO: 341045 - RNA, 17 nt, Bordetella pertussis
ucgccggccuggcgcgc

SEQ ID NO: 341046 - RNA, 12 nt, Bordetella pertussis
ucgccgggcggc

SEQ ID NO: 341047 - RNA, 12 nt, Bordetella pertussis
ucgccggggcgc

SEQ ID NO: 341048 - RNA, 15 nt, Bordetella pertussis
ucgccggggcgcacc

SEQ ID NO: 341049 - RNA, 18 nt, Bordetella pertussis
ucgccggggcgcaccggc

SEQ ID NO: 341050 - RNA, 21 nt, Bordetella pertussis
ucgccggggcgcaccggcacg

SEQ ID NO: 341051 - RNA, 15 nt, Bordetella pertussis
ucgccgguagcgcug

SEQ ID NO: 341052 - RNA, 23 nt, Bordetella pertussis
ucgccgguagcgcugggcgccag

SEQ ID NO: 341053 - RNA, 15 nt, Bordetella pertussis
ucgccgucgcccugg

SEQ ID NO: 341054 - RNA, 16 nt, Bordetella pertussis
ucgccgucggcauagc

SEQ ID NO: 341055 - RNA, 17 nt, Bordetella pertussis
ucgccgugcagggccag

SEQ ID NO: 341056 - RNA, 18 nt, Bordetella pertussis
ucgccgugcugggcggcc

SEQ ID NO: 341057 - RNA, 14 nt, Bordetella pertussis
ucgccucccauugc

SEQ ID NO: 341058 - RNA, 16 nt, Bordetella pertussis
ucgccuccccaggcca

SEQ ID NO: 341059 - RNA, 17 nt, Bordetella pertussis
ucgccuccccaggccag

SEQ ID NO: 341060 - RNA, 19 nt, Bordetella pertussis
ucgccucguauucgcccgg

SEQ ID NO: 341061 - RNA, 19 nt, Bordetella pertussis
ucgccugacguucggggcg

SEQ ID NO: 341062 - RNA, 21 nt, Bordetella pertussis
ucgccuguaucugcgccguga

SEQ ID NO: 341063 - RNA, 19 nt, Bordetella pertussis
ucgccuggucgacgccggc

SEQ ID NO: 341064 - RNA, 21 nt, Bordetella pertussis
ucgcgcacauccagccgaugc

SEQ ID NO: 341065 - RNA, 16 nt, Bordetella pertussis
ucgcgcaccaccuggc

SEQ ID NO: 341066 - RNA, 13 nt, Bordetella pertussis
ucgcgcaccagcg

SEQ ID NO: 341067 - RNA, 14 nt, Bordetella pertussis
ucgcgcacccgcag

SEQ ID NO: 341068 - RNA, 17 nt, Bordetella pertussis
ucgcgcaccgaggugcc

SEQ ID NO: 341069 - RNA, 17 nt, Bordetella pertussis
ucgcgcaccgcaugggc

SEQ ID NO: 341070 - RNA, 20 nt, Bordetella pertussis
ucgcgcacggugcgcacgau

SEQ ID NO: 341071 - RNA, 18 nt, Bordetella pertussis
ucgcgcagcgccuggccg

SEQ ID NO: 341072 - RNA, 13 nt, Bordetella pertussis
ucgcgcagcggcg

SEQ ID NO: 341073 - RNA, 14 nt, Bordetella pertussis
ucgcgcagggcggc

SEQ ID NO: 341074 - RNA, 18 nt, Bordetella pertussis
ucgcgcagggcggccucg

SEQ ID NO: 341075 - RNA, 22 nt, Bordetella pertussis
ucgcgcaggcgugcgcgggcgc

SEQ ID NO: 341076 - RNA, 23 nt, Bordetella pertussis
ucgcgccgcgucuucggcgcggc

SEQ ID NO: 341077 - RNA, 14 nt, Bordetella pertussis
ucgcgccggccgac

SEQ ID NO: 341078 - RNA, 20 nt, Bordetella pertussis
ucgcgccggccgacggcgcu

SEQ ID NO: 341079 - RNA, 14 nt, Bordetella pertussis
ucgcgccggccugg

SEQ ID NO: 341080 - RNA, 19 nt, Bordetella pertussis
ucgcgccggccugggcggc

SEQ ID NO: 341081 - RNA, 18 nt, Bordetella pertussis
ucgcgccggucacgcugg

SEQ ID NO: 341082 - RNA, 23 nt, Bordetella pertussis
ucgcgccggucacgcugguggcc

SEQ ID NO: 341083 - RNA, 19 nt, Bordetella pertussis
ucgcgccuaccggcgccga

SEQ ID NO: 341084 - RNA, 14 nt, Bordetella pertussis
ucgcgccugcccgc

SEQ ID NO: 341085 - RNA, 20 nt, Bordetella pertussis
ucgcgccugcccgcaacgcc

SEQ ID NO: 341086 - RNA, 16 nt, Bordetella pertussis
ucgcgcgaccacuggc

SEQ ID NO: 341087 - RNA, 17 nt, Bordetella pertussis
ucgcgcgacuggcccag

SEQ ID NO: 341088 - RNA, 19 nt, Bordetella pertussis
ucgcgcgagaauggcgcga

SEQ ID NO: 341089 - RNA, 15 nt, Bordetella pertussis
ucgcgcgcacgcgcu

SEQ ID NO: 341090 - RNA, 23 nt, Bordetella pertussis
ucgcgcucgagcaucuggcgcau

SEQ ID NO: 341091 - RNA, 14 nt, Bordetella pertussis
ucgcgcucgcccgg

SEQ ID NO: 341092 - RNA, 14 nt, Bordetella pertussis
ucgcgcucggcgac

SEQ ID NO: 341093 - RNA, 14 nt, Bordetella pertussis
ucgcgcugcgcgcc

SEQ ID NO: 341094 - RNA, 23 nt, Bordetella pertussis
ucgcgcugcgcgccgccgcgcug

SEQ ID NO: 341095 - RNA, 14 nt, Bordetella pertussis
ucgcgcuggcccca

SEQ ID NO: 341096 - RNA, 17 nt, Bordetella pertussis
ucgcgcuggcccgcgcg

SEQ ID NO: 341097 - RNA, 18 nt, Bordetella pertussis
ucgcgcuggcccgcgcga

SEQ ID NO: 341098 - RNA, 13 nt, Bordetella pertussis
ucgcgcugcaggc

SEQ ID NO: 341099 - RNA, 15 nt, Bordetella pertussis
ucgcgcugcaggcgu

SEQ ID NO: 341100 - RNA, 21 nt, Bordetella pertussis
ucgcgcuggcgguggccgcgc

SEQ ID NO: 341101 - RNA, 23 nt, Bordetella pertussis
ucgcgcuggcgguggccgcgcau

SEQ ID NO: 341102 - RNA, 18 nt, Bordetella pertussis
ucgcgcuguuccagccag

SEQ ID NO: 341103 - RNA, 15 nt, Bordetella pertussis
ucgcuaugcagcugc

SEQ ID NO: 341104 - RNA, 20 nt, Bordetella pertussis
ucgcuaugcagcugcgccag

SEQ ID NO: 341105 - RNA, 19 nt, Bordetella pertussis
ucgcucagaagcuguagcg

SEQ ID NO: 341106 - RNA, 20 nt, Bordetella pertussis
ucgcugcccuacgacacgcu

SEQ ID NO: 341107 - RNA, 12 nt, Bordetella pertussis
ucgcugccggcg

SEQ ID NO: 341108 - RNA, 16 nt, Bordetella pertussis
ucgcugcgcacgcugg

SEQ ID NO: 341109 - RNA, 21 nt, Bordetella pertussis
ucgcugcucgacagcagcccg

SEQ ID NO: 341110 - RNA, 17 nt, Bordetella pertussis
ucgcugcugaccgacgg

SEQ ID NO: 341111 - RNA, 12 nt, Bordetella pertussis
ucgcugcuggcc

SEQ ID NO: 341112 - RNA, 15 nt, Bordetella pertussis
ucgcuggagaccggc

SEQ ID NO: 341113 - RNA, 23 nt, Bordetella pertussis
ucgcuggcccacucggugcgcgc

SEQ ID NO: 341114 - RNA, 16 nt, Bordetella pertussis
ucgcuggcgaagaccg

SEQ ID NO: 341115 - RNA, 18 nt, Bordetella pertussis
ucgcuggcggaccgaacg

SEQ ID NO: 341116 - RNA, 16 nt, Bordetella pertussis
ucggacaggucggcgc

SEQ ID NO: 341117 - RNA, 22 nt, Bordetella pertussis
ucggacccgaaacccagaucgc

SEQ ID NO: 341118 - RNA, 19 nt, Bordetella pertussis
ucggacgagacaggcgcgc

SEQ ID NO: 341119 - RNA, 20 nt, Bordetella pertussis
ucggacgagacaggcgcgcc

SEQ ID NO: 341120 - RNA, 22 nt, Bordetella pertussis
ucggacgagacaggcgcgccau

SEQ ID NO: 341121 - RNA, 20 nt, Bordetella pertussis
ucggagaaaucgccgccggc

SEQ ID NO: 341122 - RNA, 23 nt, Bordetella pertussis
ucggacugggucagaacgacgau

SEQ ID NO: 341123 - RNA, 18 nt, Bordetella pertussis
ucggagucggcgccgcgc

SEQ ID NO: 341124 - RNA, 23 nt, Bordetella pertussis
ucggaguugcccgaaggcagcgg

SEQ ID NO: 341125 - RNA, 11 nt, Bordetella pertussis
ucggcaccggc

SEQ ID NO: 341126 - RNA, 12 nt, Bordetella pertussis
ucggcaccggca

SEQ ID NO: 341127 - RNA, 18 nt, Bordetella pertussis
ucggcaccggcagccauc

SEQ ID NO: 341128 - RNA, 15 nt, Bordetella pertussis
ucggcaccgaggccg

SEQ ID NO: 341129 - RNA, 23 nt, Bordetella pertussis
ucggcacgacgcugaugcccagc

SEQ ID NO: 341130 - RNA, 13 nt, Bordetella pertussis
ucggcacggccag

SEQ ID NO: 341131 - RNA, 21 nt, Bordetella pertussis
ucggcacgggucaggcugcgg

SEQ ID NO: 341132 - RNA, 14 nt, Bordetella pertussis
ucggcaucggccac

SEQ ID NO: 341133 - RNA, 16 nt, Bordetella pertussis
ucggcaucggccacgc

SEQ ID NO: 341134 - RNA, 20 nt, Bordetella pertussis
ucggcauggccaggaagaac

SEQ ID NO: 341135 - RNA, 14 nt, Bordetella pertussis
ucggcauggccauc

SEQ ID NO: 341136 - RNA, 15 nt, Bordetella pertussis
ucggcauggcgcgcg

SEQ ID NO: 341137 - RNA, 21 nt, Bordetella pertussis
ucggccacuuucgcgcgcgcc

SEQ ID NO: 341138 - RNA, 15 nt, Bordetella pertussis
ucggccagcagcgcc

SEQ ID NO: 341139 - RNA, 15 nt, Bordetella pertussis
ucggccagcagcuug

SEQ ID NO: 341140 - RNA, 23 nt, Bordetella pertussis
ucggccagcauacccugcgcgcc

SEQ ID NO: 341141 - RNA, 15 nt, Bordetella pertussis
ucggccagccccacc

SEQ ID NO: 341142 - RNA, 13 nt, Bordetella pertussis
ucggccagcgcgc

SEQ ID NO: 341143 - RNA, 18 nt, Bordetella pertussis
ucggccagcgcgcggccg

SEQ ID NO: 341144 - RNA, 21 nt, Bordetella pertussis
ucggccagcgcgcggggcagg

SEQ ID NO: 341145 - RNA, 14 nt, Bordetella pertussis
ucggccaugcgcgc

SEQ ID NO: 341146 - RNA, 13 nt, Bordetella pertussis
ucggccauggugc

SEQ ID NO: 341147 - RNA, 20 nt, Bordetella pertussis
ucggccauggugccccaugc

SEQ ID NO: 341148 - RNA, 21 nt, Bordetella pertussis
ucggccauguagauggccgcc

SEQ ID NO: 341149 - RNA, 19 nt, Bordetella pertussis
ucggcccacuggaucgccg

SEQ ID NO: 341150 - RNA, 16 nt, Bordetella pertussis
ucggccccugcccugc

SEQ ID NO: 341151 - RNA, 13 nt, Bordetella pertussis
ucggcccgcgcca

SEQ ID NO: 341152 - RNA, 21 nt, Bordetella pertussis
ucggcccuagagcaugcggcg

SEQ ID NO: 341153 - RNA, 16 nt, Bordetella pertussis
ucggcccugucggccg

SEQ ID NO: 341154 - RNA, 15 nt, Bordetella pertussis
ucggccgaaccgcgc

SEQ ID NO: 341155 - RNA, 16 nt, Bordetella pertussis
ucggccgccagccggc

SEQ ID NO: 341156 - RNA, 23 nt, Bordetella pertussis
ucggccgccagguagcggguggc

SEQ ID NO: 341157 - RNA, 20 nt, Bordetella pertussis
ucggccgccaggucggccac

SEQ ID NO: 341158 - RNA, 18 nt, Bordetella pertussis
ucggccugcucgcaggcc

SEQ ID NO: 341159 - RNA, 21 nt, Bordetella pertussis
ucggccuggaacauggcccgg

SEQ ID NO: 341160 - RNA, 22 nt, Bordetella pertussis
ucggccugguccgccgcgacca

SEQ ID NO: 341161 - RNA, 16 nt, Bordetella pertussis
ucggccuugggcgcgg

SEQ ID NO: 341162 - RNA, 17 nt, Bordetella pertussis
ucggccuugggcgcggc

SEQ ID NO: 341163 - RNA, 22 nt, Bordetella pertussis
ucggcgacgacuacgcgcuggc

SEQ ID NO: 341164 - RNA, 21 nt, Bordetella pertussis
ucggcgaucaccugcguggcc

SEQ ID NO: 341165 - RNA, 14 nt, Bordetella pertussis
ucggcgaugcgcga

SEQ ID NO: 341166 - RNA, 14 nt, Bordetella pertussis
ucggcgaugcgggc

SEQ ID NO: 341167 - RNA, 18 nt, Bordetella pertussis
ucggcgauggcgcgcgcc

SEQ ID NO: 341168 - RNA, 15 nt, Bordetella pertussis
ucggcgauggcccgg

SEQ ID NO: 341169 - RNA, 15 nt, Bordetella pertussis
ucggcgcaucggcgc

SEQ ID NO: 341170 - RNA, 19 nt, Bordetella pertussis
ucggcgccaagcggcaggc

SEQ ID NO: 341171 - RNA, 20 nt, Bordetella pertussis
ucggcgccaguagcgccggc

SEQ ID NO: 341172 - RNA, 18 nt, Bordetella pertussis
ucggcgccaugaucgccg

SEQ ID NO: 341173 - RNA, 20 nt, Bordetella pertussis
ucggcgccaugaucgccggc

SEQ ID NO: 341174 - RNA, 22 nt, Bordetella pertussis
ucggcgccaugcuggccgccgc

SEQ ID NO: 341175 - RNA, 13 nt, Bordetella pertussis
ucggcgcccacgc

SEQ ID NO: 341176 - RNA, 16 nt, Bordetella pertussis
ucggcgcccacgccga

SEQ ID NO: 341177 - RNA, 19 nt, Bordetella pertussis
ucggcgccgcgcgcggccc

SEQ ID NO: 341178 - RNA, 22 nt, Bordetella pertussis
ucggcgccgcgcugauccuggc

SEQ ID NO: 341179 - RNA, 18 nt, Bordetella pertussis
ucggcgccgcggcgcuuc

SEQ ID NO: 341180 - RNA, 13 nt, Bordetella pertussis
ucggcgccgcgcg

SEQ ID NO: 341181 - RNA, 20 nt, Bordetella pertussis
ucggcgccggcggcgcggau

SEQ ID NO: 341182 - RNA, 16 nt, Bordetella pertussis
ucggcgccggcgucca

SEQ ID NO: 341183 - RNA, 22 nt, Bordetella pertussis
ucggcgccggcguccacggcau

SEQ ID NO: 341184 - RNA, 14 nt, Bordetella pertussis
ucggcgccgggcga

SEQ ID NO: 341185 - RNA, 15 nt, Bordetella pertussis
ucggcgccgggcgac

SEQ ID NO: 341186 - RNA, 16 nt, Bordetella pertussis
ucggcgccuggccgcc

SEQ ID NO: 341187 - RNA, 19 nt, Bordetella pertussis
ucggcgccuggccgcccag

SEQ ID NO: 341188 - RNA, 22 nt, Bordetella pertussis
ucggcgccuggccgcccagcgc

SEQ ID NO: 341189 - RNA, 15 nt, Bordetella pertussis
ucggcgcgcgccggc

SEQ ID NO: 341190 - RNA, 23 nt, Bordetella pertussis
ucggcgcgcgcgacuccaccggc

SEQ ID NO: 341191 - RNA, 18 nt, Bordetella pertussis
ucggcgcgcgugccgcgc

SEQ ID NO: 341192 - RNA, 20 nt, Bordetella pertussis
ucggcgcgcgugccgcgcag

SEQ ID NO: 341193 - RNA, 18 nt, Bordetella pertussis
ucggcgcggcgccgucca

SEQ ID NO: 341194 - RNA, 17 nt, Bordetella pertussis
ucggcgcggcgcguuca

SEQ ID NO: 341195 - RNA, 14 nt, Bordetella pertussis
ucggcgcggcgggc

SEQ ID NO: 341196 - RNA, 16 nt, Bordetella pertussis
ucggcggccagcgcgc

SEQ ID NO: 341197 - RNA, 19 nt, Bordetella pertussis
ucggcggccagcgcgcccu

SEQ ID NO: 341198 - RNA, 19 nt, Bordetella pertussis
ucggcggccaugccgacgg

SEQ ID NO: 341199 - RNA, 14 nt, Bordetella pertussis
ucggcggcccacag

SEQ ID NO: 341200 - RNA, 15 nt, Bordetella pertussis
ucggcggccgccugc

SEQ ID NO: 341201 - RNA, 19 nt, Bordetella pertussis
ucggcggccgccugcgccg

SEQ ID NO: 341202 - RNA, 15 nt, Bordetella pertussis
ucggcggccuccggc

SEQ ID NO: 341203 - RNA, 21 nt, Bordetella pertussis
ucggcggccugcuuggcagcc

SEQ ID NO: 341204 - RNA, 16 nt, Bordetella pertussis
ucggcggccugggcca

SEQ ID NO: 341205 - RNA, 17 nt, Bordetella pertussis
ucggcggccugggccau

SEQ ID NO: 341206 - RNA, 23 nt, Bordetella pertussis
ucggcgucggugccguccagcgc

SEQ ID NO: 341207 - RNA, 20 nt, Bordetella pertussis
ucggcuccgccauugcgccg

SEQ ID NO: 341208 - RNA, 20 nt, Bordetella pertussis
ucggcuugcacgccggccac

SEQ ID NO: 341209 - RNA, 14 nt, Bordetella pertussis
ucggcuugccgcgc

SEQ ID NO: 341210 - RNA, 15 nt, Bordetella pertussis
ucggcuugccgcgcg

SEQ ID NO: 341211 - RNA, 19 nt, Bordetella pertussis
ucggcuuguucgagcgcgc

SEQ ID NO: 341212 - RNA, 18 nt, Bordetella pertussis
ucgggaaacaggcccacg

SEQ ID NO: 341213 - RNA, 22 nt, Bordetella pertussis
ucgggaaacaggcccacggcau

SEQ ID NO: 341214 - RNA, 16 nt, Bordetella pertussis
ucgggacgcaggccca

SEQ ID NO: 341215 - RNA, 15 nt, Bordetella pertussis
ucgggaccggcgcgu

SEQ ID NO: 341216 - RNA, 21 nt, Bordetella pertussis
ucgggauaguccagcaccggc

SEQ ID NO: 341217 - RNA, 18 nt, Bordetella pertussis
ucgggauccgugcggcgc

SEQ ID NO: 341218 - RNA, 18 nt, Bordetella pertussis
ucgggaugccccgcccgc

SEQ ID NO: 341219 - RNA, 20 nt, Bordetella pertussis
ucgggcacgaucaccgccgc

SEQ ID NO: 341220 - RNA, 13 nt, Bordetella pertussis
ucgggcagcacgc

SEQ ID NO: 341221 - RNA, 16 nt, Bordetella pertussis
ucgggcagcacgcgca

SEQ ID NO: 341222 - RNA, 20 nt, Bordetella pertussis
ucgggcagcacgcgcaccag

SEQ ID NO: 341223 - RNA, 12 nt, Bordetella pertussis
ucgggcagcgcg

SEQ ID NO: 341224 - RNA, 22 nt, Bordetella pertussis
ucgggcagggugggcacgcgcu

SEQ ID NO: 341225 - RNA, 19 nt, Bordetella pertussis
ucgggcaggucggcgcggg

SEQ ID NO: 341226 - RNA, 16 nt, Bordetella pertussis
ucgggcaguugcuggc

SEQ ID NO: 341227 - RNA, 23 nt, Bordetella pertussis
ucgggcaguugcuggcggccgug

SEQ ID NO: 341228 - RNA, 17 nt, Bordetella pertussis
ucgggcaugucgcggcc

SEQ ID NO: 341229 - RNA, 15 nt, Bordetella pertussis
ucgggccacccgccg

SEQ ID NO: 341230 - RNA, 13 nt, Bordetella pertussis
ucgggccggcggc

SEQ ID NO: 341231 - RNA, 16 nt, Bordetella pertussis
ucgggccggcggcagc

SEQ ID NO: 341232 - RNA, 16 nt, Bordetella pertussis
ucgggcgacaggcgcg

SEQ ID NO: 341233 - RNA, 21 nt, Bordetella pertussis
ucgggcgaggucagcccggcg

SEQ ID NO: 341234 - RNA, 12 nt, Bordetella pertussis
ucgggcgcaacg

SEQ ID NO: 341235 - RNA, 22 nt, Bordetella pertussis
ucgggcgcaacgucgaacagcu

SEQ ID NO: 341236 - RNA, 13 nt, Bordetella pertussis
ucgggcgcggcau

SEQ ID NO: 341237 - RNA, 15 nt, Bordetella pertussis
ucgggcgcggugcgc

SEQ ID NO: 341238 - RNA, 17 nt, Bordetella pertussis
ucggggaaauugacggc

SEQ ID NO: 341239 - RNA, 17 nt, Bordetella pertussis
ucggggccgcagcugga

SEQ ID NO: 341240 - RNA, 17 nt, Bordetella pertussis
ucgguaaugagcccgau

SEQ ID NO: 341241 - RNA, 16 nt, Bordetella pertussis
ucgguaucgggcaaca

SEQ ID NO: 341242 - RNA, 16 nt, Bordetella pertussis
ucggucaugcccaugc

SEQ ID NO: 341243 - RNA, 20 nt, Bordetella pertussis
ucggucauguccagcgccag

SEQ ID NO: 341244 - RNA, 23 nt, Bordetella pertussis
ucggucgccuguaucagcgccug

SEQ ID NO: 341245 - RNA, 22 nt, Bordetella pertussis
ucggucggcuugauaugggcga

SEQ ID NO: 341246 - RNA, 23 nt, Bordetella pertussis
ucggugcgccgccgccgcggccu

SEQ ID NO: 341247 - RNA, 19 nt, Bordetella pertussis
ucggugcgcgcgcccaccg

SEQ ID NO: 341248 - RNA, 17 nt, Bordetella pertussis
ucggugcggaagacgau

SEQ ID NO: 341249 - RNA, 19 nt, Bordetella pertussis
ucggugcgggccggcgcgc

SEQ ID NO: 341250 - RNA, 21 nt, Bordetella pertussis
ucggugcgggccggcgcgccu

SEQ ID NO: 341251 - RNA, 15 nt, Bordetella pertussis
ucgguggccagccag

SEQ ID NO: 341252 - RNA, 17 nt, Bordetella pertussis
ucguagcccucgcccag

SEQ ID NO: 341253 - RNA, 16 nt, Bordetella pertussis
ucguagccgccgacga

SEQ ID NO: 341254 - RNA, 18 nt, Bordetella pertussis
ucgucaacccgucgacgc

SEQ ID NO: 341255 - RNA, 18 nt, Bordetella pertussis
ucgucauugaagcgguau

SEQ ID NO: 341256 - RNA, 23 nt, Bordetella pertussis
ucguccacccccgucagcacggu

SEQ ID NO: 341257 - RNA, 16 nt, Bordetella pertussis
ucgucauggucgacca

SEQ ID NO: 341258 - RNA, 14 nt, Bordetella pertussis
ucguccacgcccgg

SEQ ID NO: 341259 - RNA, 13 nt, Bordetella pertussis
ucguccagcacgc

SEQ ID NO: 341260 - RNA, 19 nt, Bordetella pertussis
ucguccagcgacuccggcc

SEQ ID NO: 341261 - RNA, 17 nt, Bordetella pertussis
ucguccagcguggcgca

SEQ ID NO: 341262 - RNA, 14 nt, Bordetella pertussis
ucguccagcuccag

SEQ ID NO: 341263 - RNA, 15 nt, Bordetella pertussis
ucguccaggcgcacc

SEQ ID NO: 341264 - RNA, 21 nt, Bordetella pertussis
ucguccugcaggaaggccgcc

SEQ ID NO: 341265 - RNA, 14 nt, Bordetella pertussis
ucgucgaacagcau

SEQ ID NO: 341266 - RNA, 13 nt, Bordetella pertussis
ucgucgaaggcgc

SEQ ID NO: 341267 - RNA, 19 nt, Bordetella pertussis
ucgucgaccaccagcaucg

SEQ ID NO: 341268 - RNA, 22 nt, Bordetella pertussis
ucgucgaccaccagcaucgcgc

SEQ ID NO: 341269 - RNA, 12 nt, Bordetella pertussis
ucgucggccgcc

SEQ ID NO: 341270 - RNA, 14 nt, Bordetella pertussis
ucgucggcgcgcgc

SEQ ID NO: 341271 - RNA, 13 nt, Bordetella pertussis
ucgucggcgcugc

SEQ ID NO: 341272 - RNA, 19 nt, Bordetella pertussis
ucgucggcgcugcagcgca

SEQ ID NO: 341273 - RNA, 20 nt, Bordetella pertussis
ucgucggcgggacgcaggcc

SEQ ID NO: 341274 - RNA, 13 nt, Bordetella pertussis
ucgucgggaccgg

SEQ ID NO: 341275 - RNA, 20 nt, Bordetella pertussis
ucgugaucgaccgccagcag

SEQ ID NO: 341276 - RNA, 19 nt, Bordetella pertussis
ucgugcaucaucugggcgu

SEQ ID NO: 341277 - RNA, 15 nt, Bordetella pertussis
ucgugcccagcuggc

SEQ ID NO: 341278 - RNA, 20 nt, Bordetella pertussis
ucgugcccagcuggcaccgc

SEQ ID NO: 341279 - RNA, 16 nt, Bordetella pertussis
ucgugccgcacggugg

SEQ ID NO: 341280 - RNA, 15 nt, Bordetella pertussis
ucgugccgggcagca

SEQ ID NO: 341281 - RNA, 13 nt, Bordetella pertussis
ucgugcggcacgc

SEQ ID NO: 341282 - RNA, 20 nt, Bordetella pertussis
ucgugcugcugcaggcgcgg

SEQ ID NO: 341283 - RNA, 12 nt, Bordetella pertussis
ucguggcccagc

SEQ ID NO: 341284 - RNA, 17 nt, Bordetella pertussis
ucguggcccagcaccgc

SEQ ID NO: 341285 - RNA, 11 nt, Bordetella pertussis
ucguggcgccg

SEQ ID NO: 341286 - RNA, 13 nt, Bordetella pertussis
ucguggcgcgccu

SEQ ID NO: 341287 - RNA, 14 nt, Bordetella pertussis
ucguggggcgcggc

SEQ ID NO: 341288 - RNA, 20 nt, Bordetella pertussis
ucguggggcgcggcggcguu

SEQ ID NO: 341289 - RNA, 23 nt, Bordetella pertussis
ucguggguucgaaucccaccauc

SEQ ID NO: 341290 - RNA, 22 nt, Bordetella pertussis
ucguuggccgcguagcccaugu

SEQ ID NO: 341291 - RNA, 15 nt, Bordetella pertussis
ucguuggugcccagc

SEQ ID NO: 341292 - RNA, 22 nt, Bordetella pertussis
ucucaggccgaggcugcgcgcg

SEQ ID NO: 341293 - RNA, 16 nt, Bordetella pertussis
ucuccaggaugcgcga

SEQ ID NO: 341294 - RNA, 15 nt, Bordetella pertussis
ucuccagcgccagca

SEQ ID NO: 341295 - RNA, 19 nt, Bordetella pertussis
ucuccaugcgauagcgggc

SEQ ID NO: 341296 - RNA, 19 nt, Bordetella pertussis
ugaaacggcaagagccugg

SEQ ID NO: 341297 - RNA, 16 nt, Bordetella pertussis
ugaaccaggccgccag

SEQ ID NO: 341298 - RNA, 18 nt, Bordetella pertussis
ugaaccccggcugcgcgg

SEQ ID NO: 341299 - RNA, 16 nt, Bordetella pertussis
ugaaccgcaacgccag

SEQ ID NO: 341300 - RNA, 14 nt, Bordetella pertussis
ugaaccgcagcgcc

SEQ ID NO: 341301 - RNA, 14 nt, Bordetella pertussis
ugaacgaccagcac

SEQ ID NO: 341302 - RNA, 19 nt, Bordetella pertussis
ugaacgauuucuucgccug

SEQ ID NO: 341303 - RNA, 19 nt, Bordetella pertussis
ugaacugcaggccgccggc

SEQ ID NO: 341304 - RNA, 13 nt, Bordetella pertussis
ugaagacgccguc

SEQ ID NO: 341305 - RNA, 15 nt, Bordetella pertussis
ugaagacgcgcucgc

SEQ ID NO: 341306 - RNA, 19 nt, Bordetella pertussis
ugaagacgcgcucgccguc

SEQ ID NO: 341307 - RNA, 14 nt, Bordetella pertussis
ugaagcuggcgccg

SEQ ID NO: 341308 - RNA, 20 nt, Bordetella pertussis
ugaaggaccucgcgccgguc

SEQ ID NO: 341309 - RNA, 20 nt, Bordetella pertussis
ugaaggccgaggccagguug

SEQ ID NO: 341310 - RNA, 19 nt, Bordetella pertussis
ugaaggcgaugggcaccug

SEQ ID NO: 341311 - RNA, 18 nt, Bordetella pertussis
ugaaucgcccgggcgccg

SEQ ID NO: 341312 - RNA, 13 nt, Bordetella pertussis
ugacaugcgggcc

SEQ ID NO: 341313 - RNA, 22 nt, Bordetella pertussis
ugacauggccacggcccugguc

SEQ ID NO: 341314 - RNA, 16 nt, Bordetella pertussis
ugaccaccaggccgcc

SEQ ID NO: 341315 - RNA, 22 nt, Bordetella pertussis
ugaccaccgucuugcccgccag

SEQ ID NO: 341316 - RNA, 14 nt, Bordetella pertussis
ugaccacgcccugg

SEQ ID NO: 341317 - RNA, 13 nt, Bordetella pertussis
ugaccacggccag

SEQ ID NO: 341318 - RNA, 15 nt, Bordetella pertussis
ugaccacggcgcgcc

SEQ ID NO: 341319 - RNA, 17 nt, Bordetella pertussis
ugaccacggcgcgcccg

SEQ ID NO: 341320 - RNA, 17 nt, Bordetella pertussis
ugaccagcaccagcgcc

SEQ ID NO: 341321 - RNA, 14 nt, Bordetella pertussis
ugaccagcagcacc

SEQ ID NO: 341322 - RNA, 23 nt, Bordetella pertussis
ugaccagcagcaccgugccggcg

SEQ ID NO: 341323 - RNA, 15 nt, Bordetella pertussis
ugaccagcagcgccg

SEQ ID NO: 341324 - RNA, 19 nt, Bordetella pertussis
ugaccagcagcgccggggg

SEQ ID NO: 341325 - RNA, 16 nt, Bordetella pertussis
ugaccagccagccgcc

SEQ ID NO: 341326 - RNA, 12 nt, Bordetella pertussis
ugaccagcgccg

SEQ ID NO: 341327 - RNA, 16 nt, Bordetella pertussis
ugaccagcgccggcgc

SEQ ID NO: 341328 - RNA, 20 nt, Bordetella pertussis
ugaccagcugcaccaggcuu

SEQ ID NO: 341329 - RNA, 14 nt, Bordetella pertussis
ugaccagggcgccg

SEQ ID NO: 341330 - RNA, 17 nt, Bordetella pertussis
ugaccagggcgccgacc

SEQ ID NO: 341331 - RNA, 20 nt, Bordetella pertussis
ugaccaguucgcgcagcgcc

SEQ ID NO: 341332 - RNA, 16 nt, Bordetella pertussis
ugaccgaagcgggcga

SEQ ID NO: 341333 - RNA, 13 nt, Bordetella pertussis
ugaccgacaggcc

SEQ ID NO: 341334 - RNA, 17 nt, Bordetella pertussis
ugaccgacaggccuggc

SEQ ID NO: 341335 - RNA, 18 nt, Bordetella pertussis
ugaccgacgugcgccgca

SEQ ID NO: 341336 - RNA, 14 nt, Bordetella pertussis
ugaccgagggcgcg

SEQ ID NO: 341337 - RNA, 15 nt, Bordetella pertussis
ugaccgagggcgcgu

SEQ ID NO: 341338 - RNA, 20 nt, Bordetella pertussis
ugaccgccagcauccagccg

SEQ ID NO: 341339 - RNA, 15 nt, Bordetella pertussis
ugaccgccgccagca

SEQ ID NO: 341340 - RNA, 14 nt, Bordetella pertussis
ugaccgccgcgccg

SEQ ID NO: 341341 - RNA, 16 nt, Bordetella pertussis
ugaccgccggcaccag

SEQ ID NO: 341342 - RNA, 17 nt, Bordetella pertussis
ugaccgccucgaugccc

SEQ ID NO: 341343 - RNA, 23 nt, Bordetella pertussis
ugaccgcggacgccauggcggcg

SEQ ID NO: 341344 - RNA, 24 nt, Bordetella pertussis
ugaccgcggacgccauggcggcgg

SEQ ID NO: 341345 - RNA, 12 nt, Bordetella pertussis
ugaccgcguccg

SEQ ID NO: 341346 - RNA, 22 nt, Bordetella pertussis
ugaccggccuggucaugacggg

SEQ ID NO: 341347 - RNA, 20 nt, Bordetella pertussis
ugaccggcguauggcccgcc

SEQ ID NO: 341348 - RNA, 15 nt, Bordetella pertussis
ugaccggcuggcgca

SEQ ID NO: 341349 - RNA, 19 nt, Bordetella pertussis
ugaccggcuggcgcacguc

SEQ ID NO: 341350 - RNA, 21 nt, Bordetella pertussis
ugaccggggcguccaccgccg

SEQ ID NO: 341351 - RNA, 23 nt, Bordetella pertussis
ugaccgggucgucgggcggcgcg

SEQ ID NO: 341352 - RNA, 16 nt, Bordetella pertussis
ugaccuauucgucguc

SEQ ID NO: 341353 - RNA, 15 nt, Bordetella pertussis
ugaccucgcccaggc

SEQ ID NO: 341354 - RNA, 17 nt, Bordetella pertussis
ugaccucgcgcugcagc

SEQ ID NO: 341355 - RNA, 14 nt, Bordetella pertussis
ugaccucggccugc

SEQ ID NO: 341356 - RNA, 13 nt, Bordetella pertussis
ugaccugcgccag

SEQ ID NO: 341357 - RNA, 17 nt, Bordetella pertussis
ugaccugcucgucgcca

SEQ ID NO: 341358 - RNA, 13 nt, Bordetella pertussis
ugaccugggccag

SEQ ID NO: 341359 - RNA, 15 nt, Bordetella pertussis
ugaccugggccagca

SEQ ID NO: 341360 - RNA, 17 nt, Bordetella pertussis
ugaccuggucgggcgug

SEQ ID NO: 341361 - RNA, 19 nt, Bordetella pertussis
ugaccuggugugccugucc

SEQ ID NO: 341362 - RNA, 13 nt, Bordetella pertussis
ugaccuggcgcgc

SEQ ID NO: 341363 - RNA, 14 nt, Bordetella pertussis
ugaccuggcgcgcg

SEQ ID NO: 341364 - RNA, 21 nt, Bordetella pertussis
ugaccuugagaugccagcggc

SEQ ID NO: 341365 - RNA, 18 nt, Bordetella pertussis
ugaccuugccgauccagc

SEQ ID NO: 341366 - RNA, 23 nt, Bordetella pertussis
ugacgaccgcgacccgauagccg

SEQ ID NO: 341367 - RNA, 22 nt, Bordetella pertussis
ugacgaccuugcggccgcgcac

SEQ ID NO: 341368 - RNA, 12 nt, Bordetella pertussis
ugacgacgccgg

SEQ ID NO: 341369 - RNA, 16 nt, Bordetella pertussis
ugacgauauccaggcg

SEQ ID NO: 341370 - RNA, 16 nt, Bordetella pertussis
ugacgaucucgcccug

SEQ ID NO: 341371 - RNA, 18 nt, Bordetella pertussis
ugacgaucucggcguuga

SEQ ID NO: 341372 - RNA, 19 nt, Bordetella pertussis
ugacgcagccgcccggcag

SEQ ID NO: 341373 - RNA, 23 nt, Bordetella pertussis
ugacgccgccgaagggcaccgug

SEQ ID NO: 341374 - RNA, 20 nt, Bordetella pertussis
ugacgccggcgaaugccggc

SEQ ID NO: 341375 - RNA, 13 nt, Bordetella pertussis
ugacgccggcggc

SEQ ID NO: 341376 - RNA, 23 nt, Bordetella pertussis
ugacgccggcuucagccgcaagc

SEQ ID NO: 341377 - RNA, 22 nt, Bordetella pertussis
ugacgcgauacugcgcaugggc

SEQ ID NO: 341378 - RNA, 18 nt, Bordetella pertussis
ugacgcgcugaugcgcgg

SEQ ID NO: 341379 - RNA, 20 nt, Bordetella pertussis
ugacgcgcugaugcgcggcg

SEQ ID NO: 341380 - RNA, 18 nt, Bordetella pertussis
ugacgcucauccaggcgc

SEQ ID NO: 341381 - RNA, 23 nt, Bordetella pertussis
ugacgcugacccuggccgaacgc

SEQ ID NO: 341382 - RNA, 16 nt, Bordetella pertussis
ugacgcugauggccgc

SEQ ID NO: 341383 - RNA, 19 nt, Bordetella pertussis
ugacgcugauggccgccag

SEQ ID NO: 341384 - RNA, 20 nt, Bordetella pertussis
ugacgcuggagauggcgccg

SEQ ID NO: 341385 - RNA, 18 nt, Bordetella pertussis
ugacgcuggagcgcggcg

SEQ ID NO: 341386 - RNA, 20 nt, Bordetella pertussis
ugacgcuggagcgcggcggc

SEQ ID NO: 341387 - RNA, 23 nt, Bordetella pertussis
ugacgcuggagcgcggcggcgug

SEQ ID NO: 341388 - RNA, 18 nt, Bordetella pertussis
ugacggccauccggccac

SEQ ID NO: 341389 - RNA, 12 nt, Bordetella pertussis
ugacggcgcgga

SEQ ID NO: 341390 - RNA, 16 nt, Bordetella pertussis
ugacggcggcgcgcgg

SEQ ID NO: 341391 - RNA, 22 nt, Bordetella pertussis
ugacggcuucgaccacgcggcg

SEQ ID NO: 341392 - RNA, 17 nt, Bordetella pertussis
ugacggggcggcgccug

SEQ ID NO: 341393 - RNA, 20 nt, Bordetella pertussis
ugacggggugccuguccccg

SEQ ID NO: 341394 - RNA, 15 nt, Bordetella pertussis
ugacggggacgccgg

SEQ ID NO: 341395 - RNA, 16 nt, Bordetella pertussis
ugacggggacgccggc

SEQ ID NO: 341396 - RNA, 23 nt, Bordetella pertussis
ugacgggucacccgccgcaccag

SEQ ID NO: 341397 - RNA, 16 nt, Bordetella pertussis
ugacggugccgagcag

SEQ ID NO: 341398 - RNA, 16 nt, Bordetella pertussis
ugacgguggugucggc

SEQ ID NO: 341399 - RNA, 21 nt, Bordetella pertussis
ugacguagcggaucgcggcgc

SEQ ID NO: 341400 - RNA, 14 nt, Bordetella pertussis
ugacguccggcggg

SEQ ID NO: 341401 - RNA, 14 nt, Bordetella pertussis
ugacguccagccag

SEQ ID NO: 341402 - RNA, 18 nt, Bordetella pertussis
ugacugcggugccugucc

SEQ ID NO: 341403 - RNA, 14 nt, Bordetella pertussis
ugagcacggcgcgg

SEQ ID NO: 341404 - RNA, 18 nt, Bordetella pertussis
ugagcagcguugcggcgu

SEQ ID NO: 341405 - RNA, 14 nt, Bordetella pertussis
ugagcaggcgccug

SEQ ID NO: 341406 - RNA, 19 nt, Bordetella pertussis
ugagcaggcgccugccccg

SEQ ID NO: 341407 - RNA, 14 nt, Bordetella pertussis
ugagcaggcgcgag

SEQ ID NO: 341408 - RNA, 15 nt, Bordetella pertussis
ugagccaggcgcccg

SEQ ID NO: 341409 - RNA, 16 nt, Bordetella pertussis
ugagccaggcgcccgg

SEQ ID NO: 341410 - RNA, 14 nt, Bordetella pertussis
ugagccaugccguc

SEQ ID NO: 341411 - RNA, 23 nt, Bordetella pertussis
ugagccaugccgucuggcggcag

SEQ ID NO: 341412 - RNA, 13 nt, Bordetella pertussis
ugagcgccgacgg

SEQ ID NO: 341413 - RNA, 20 nt, Bordetella pertussis
ugagcgccgccgccaugguc

SEQ ID NO: 341414 - RNA, 13 nt, Bordetella pertussis
ugagcgccggggc

SEQ ID NO: 341415 - RNA, 19 nt, Bordetella pertussis
ugagcgcggccucgccggc

SEQ ID NO: 341416 - RNA, 17 nt, Bordetella pertussis
ugagcgcuugacggcca

SEQ ID NO: 341417 - RNA, 16 nt, Bordetella pertussis
ugagcggcccgggcga

SEQ ID NO: 341418 - RNA, 20 nt, Bordetella pertussis
ugagcgugaagucggccggc

SEQ ID NO: 341419 - RNA, 15 nt, Bordetella pertussis
ugagcugaugcucgc

SEQ ID NO: 341420 - RNA, 16 nt, Bordetella pertussis
ugagggcgcgggccag

SEQ ID NO: 341421 - RNA, 16 nt, Bordetella pertussis
ugaucaguccgacgac

SEQ ID NO: 341422 - RNA, 13 nt, Bordetella pertussis
ugaucaugccgcu

SEQ ID NO: 341423 - RNA, 19 nt, Bordetella pertussis
ugaucccggcgcuggccgc

SEQ ID NO: 341424 - RNA, 20 nt, Bordetella pertussis
ugaucccggcgcuggccgcc

SEQ ID NO: 341425 - RNA, 14 nt, Bordetella pertussis
ugaucgaccgccag

SEQ ID NO: 341426 - RNA, 21 nt, Bordetella pertussis
ugaucgaucagccagccggcg

SEQ ID NO: 341427 - RNA, 13 nt, Bordetella pertussis
ugaucgccagcgc

SEQ ID NO: 341428 - RNA, 13 nt, Bordetella pertussis
ugaucgccgccuu

SEQ ID NO: 341429 - RNA, 23 nt, Bordetella pertussis
ugaucgccggcgcccccagcagc

SEQ ID NO: 341430 - RNA, 20 nt, Bordetella pertussis
ugaucgcgcagcaccgccag

SEQ ID NO: 341431 - RNA, 17 nt, Bordetella pertussis
ugaucgccucggggcuc

SEQ ID NO: 341432 - RNA, 15 nt, Bordetella pertussis
ugaucggccgacugc

SEQ ID NO: 341433 - RNA, 14 nt, Bordetella pertussis
ugaucggcgcaacc

SEQ ID NO: 341434 - RNA, 16 nt, Bordetella pertussis
ugaucuacgcgcgcgc

SEQ ID NO: 341435 - RNA, 17 nt, Bordetella pertussis
ugaucuacgcgcgcgcc

SEQ ID NO: 341436 - RNA, 13 nt, Bordetella pertussis
ugaucugcucgcc

SEQ ID NO: 341437 - RNA, 23 nt, Bordetella pertussis
ugaucugcuugaggccgcgcgcc

SEQ ID NO: 341438 - RNA, 14 nt, Bordetella pertussis
ugaugcggcgccac

SEQ ID NO: 341439 - RNA, 18 nt, Bordetella pertussis
ugaugcggcgccacgcag

SEQ ID NO: 341440 - RNA, 14 nt, Bordetella pertussis
ugaugcggcgcgcc

SEQ ID NO: 341441 - RNA, 16 nt, Bordetella pertussis
ugaugcggcgcgccgc

SEQ ID NO: 341442 - RNA, 22 nt, Bordetella pertussis
ugaugcuggucagccugggcgc

SEQ ID NO: 341443 - RNA, 21 nt, Bordetella pertussis
ugauggaggccaggaucccga

SEQ ID NO: 341444 - RNA, 16 nt, Bordetella pertussis
ugcaacuggugcacga

SEQ ID NO: 341445 - RNA, 15 nt, Bordetella pertussis
ugcaaggccugcugc

SEQ ID NO: 341446 - RNA, 23 nt, Bordetella pertussis
ugcaauaacgccacuugcaggcc

SEQ ID NO: 341447 - RNA, 23 nt, Bordetella pertussis
ugcacccaggcgccgauccaggg

SEQ ID NO: 341448 - RNA, 17 nt, Bordetella pertussis
ugcaccgcguggcgcug

SEQ ID NO: 341449 - RNA, 21 nt, Bordetella pertussis
ugcaccggcuugucgaccagu

SEQ ID NO: 341450 - RNA, 15 nt, Bordetella pertussis
ugcaccugcuccagc

SEQ ID NO: 341451 - RNA, 15 nt, Bordetella pertussis
ugcaccuugggcgcc

SEQ ID NO: 341452 - RNA, 12 nt, Bordetella pertussis
ugcacgaccagg

SEQ ID NO: 341453 - RNA, 16 nt, Bordetella pertussis
ugcacgacuacggcgg

SEQ ID NO: 341454 - RNA, 19 nt, Bordetella pertussis
ugcacgauauuggcgucgg

SEQ ID NO: 341455 - RNA, 20 nt, Bordetella pertussis
ugcacgaugcccagggccgc

SEQ ID NO: 341456 - RNA, 15 nt, Bordetella pertussis
ugcacgauggcgccg

SEQ ID NO: 341457 - RNA, 17 nt, Bordetella pertussis
ugcacgauggcgccggc

SEQ ID NO: 341458 - RNA, 22 nt, Bordetella pertussis
ugcacgcaggauaccggagcgg

SEQ ID NO: 341459 - RNA, 17 nt, Bordetella pertussis
ugcacgcccgcggcgcc

SEQ ID NO: 341460 - RNA, 20 nt, Bordetella pertussis
ugcacgcccgcggcgcccag

SEQ ID NO: 341461 - RNA, 17 nt, Bordetella pertussis
ugcacgccgggcgcgcu

SEQ ID NO: 341462 - RNA, 13 nt, Bordetella pertussis
ugcacgcgcgcgg

SEQ ID NO: 341463 - RNA, 19 nt, Bordetella pertussis
ugcacgcgcgcgggcgcgc

SEQ ID NO: 341464 - RNA, 19 nt, Bordetella pertussis
ugcagguccggucgcgcgu

SEQ ID NO: 341465 - RNA, 22 nt, Bordetella pertussis
ugcagguccggucgcgcgugca

SEQ ID NO: 341466 - RNA, 19 nt, Bordetella pertussis
ugcaggucuucgggcgugc

SEQ ID NO: 341467 - RNA, 16 nt, Bordetella pertussis
ugcaggugccgccggc

SEQ ID NO: 341468 - RNA, 19 nt, Bordetella pertussis
ugcaucccaauuggccgcc

SEQ ID NO: 341469 - RNA, 15 nt, Bordetella pertussis
ugcauccggcccagc

SEQ ID NO: 341470 - RNA, 17 nt, Bordetella pertussis
ugcauccggcccagcgc

SEQ ID NO: 341471 - RNA, 14 nt, Bordetella pertussis
ugcaucggccggcg

SEQ ID NO: 341472 - RNA, 22 nt, Bordetella pertussis
ugcaucggccggcggucgcgcu

SEQ ID NO: 341473 - RNA, 21 nt, Bordetella pertussis
ugcaucuccaggaugcgcgac

SEQ ID NO: 341474 - RNA, 14 nt, Bordetella pertussis
ugcaucucgaagcg

SEQ ID NO: 341475 - RNA, 20 nt, Bordetella pertussis
ugcaugaccgccgccagcag

SEQ ID NO: 341476 - RNA, 21 nt, Bordetella pertussis
ugcaugaccgccgccagcagc

SEQ ID NO: 341477 - RNA, 15 nt, Bordetella pertussis
ugcaugaccgccggc

SEQ ID NO: 341478 - RNA, 15 nt, Bordetella pertussis
ugcaugacggccagg

SEQ ID NO: 341479 - RNA, 15 nt, Bordetella pertussis
ugcaugccgaccacc

SEQ ID NO: 341480 - RNA, 12 nt, Bordetella pertussis
ugcaugcgcgcc

SEQ ID NO: 341481 - RNA, 14 nt, Bordetella pertussis
ugccacaucacgcc

SEQ ID NO: 341482 - RNA, 17 nt, Bordetella pertussis
ugccaccagcgcgccag

SEQ ID NO: 341483 - RNA, 14 nt, Bordetella pertussis
ugccaccgcccagg

SEQ ID NO: 341484 - RNA, 15 nt, Bordetella pertussis
ugccaccgcccaggc

SEQ ID NO: 341485 - RNA, 16 nt, Bordetella pertussis
ugccagcaggucgcgc

SEQ ID NO: 341486 - RNA, 21 nt, Bordetella pertussis
ugccagcaggucgcgcacgcu

SEQ ID NO: 341487 - RNA, 22 nt, Bordetella pertussis
ugccagccauguucgaccagga

SEQ ID NO: 341488 - RNA, 15 nt, Bordetella pertussis
ugccagcggcgcagc

SEQ ID NO: 341489 - RNA, 16 nt, Bordetella pertussis
ugccagcggcgcagcc

SEQ ID NO: 341490 - RNA, 18 nt, Bordetella pertussis
ugcccaaugucaccgacg

SEQ ID NO: 341491 - RNA, 22 nt, Bordetella pertussis
ugcccaaugucaccgacgccag

SEQ ID NO: 341492 - RNA, 15 nt, Bordetella pertussis
ugcccaccacggcgg

SEQ ID NO: 341493 - RNA, 15 nt, Bordetella pertussis
ugcccaccagccgcc

SEQ ID NO: 341494 - RNA, 18 nt, Bordetella pertussis
ugcccaccagccgcccgg

SEQ ID NO: 341495 - RNA, 19 nt, Bordetella pertussis
ugcccaccagccgcccggc

SEQ ID NO: 341496 - RNA, 20 nt, Bordetella pertussis
ugcccaccagccgggcggcc

SEQ ID NO: 341497 - RNA, 23 nt, Bordetella pertussis
ugcccaccgccaggaagaucggc

SEQ ID NO: 341498 - RNA, 13 nt, Bordetella pertussis
ugcccacgcgcuc

SEQ ID NO: 341499 - RNA, 17 nt, Bordetella pertussis
ugcccacgcgcuccugc

SEQ ID NO: 341500 - RNA, 20 nt, Bordetella pertussis
ugcccacgcgcuccugcucg

SEQ ID NO: 341501 - RNA, 14 nt, Bordetella pertussis
ugcccagauccagc

SEQ ID NO: 341502 - RNA, 22 nt, Bordetella pertussis
ugcccagcagcuccucggccug

SEQ ID NO: 341503 - RNA, 12 nt, Bordetella pertussis
ugcccagcgcca

SEQ ID NO: 341504 - RNA, 20 nt, Bordetella pertussis
ugcccagcgccagggccgcc

SEQ ID NO: 341505 - RNA, 15 nt, Bordetella pertussis
ugcccagcgccgccg

SEQ ID NO: 341506 - RNA, 20 nt, Bordetella pertussis
ugcccagcguguaggcggcc

SEQ ID NO: 341507 - RNA, 13 nt, Bordetella pertussis
ugcccaggcccag

SEQ ID NO: 341508 - RNA, 16 nt, Bordetella pertussis
ugcccaggcccgccag

SEQ ID NO: 341509 - RNA, 21 nt, Bordetella pertussis
ugcccaggcccuggcuggcca

SEQ ID NO: 341510 - RNA, 15 nt, Bordetella pertussis
ugcccaggccggcgc

SEQ ID NO: 341511 - RNA, 22 nt, Bordetella pertussis
ugcccagggccacgaaacccag

SEQ ID NO: 341512 - RNA, 16 nt, Bordetella pertussis
ugcccagggccgcgcc

SEQ ID NO: 341513 - RNA, 20 nt, Bordetella pertussis
ugcccaggucguugcgcgaa

SEQ ID NO: 341514 - RNA, 14 nt, Bordetella pertussis
ugcccaugccgcca

SEQ ID NO: 341515 - RNA, 15 nt, Bordetella pertussis
ugcccaugccgccau

SEQ ID NO: 341516 - RNA, 20 nt, Bordetella pertussis
ugcccauggggugcuccugc

SEQ ID NO: 341517 - RNA, 21 nt, Bordetella pertussis
ugcccauuuccaccacgcggu

SEQ ID NO: 341518 - RNA, 16 nt, Bordetella pertussis
ugccccacacgcgcgc

SEQ ID NO: 341519 - RNA, 20 nt, Bordetella pertussis
ugccccagcuugucggccgc

SEQ ID NO: 341520 - RNA, 18 nt, Bordetella pertussis
ugccccagguccgccggc

SEQ ID NO: 341521 - RNA, 20 nt, Bordetella pertussis
ugccccagguccgccggcac

SEQ ID NO: 341522 - RNA, 20 nt, Bordetella pertussis
ugccccaguccaggccggcc

SEQ ID NO: 341523 - RNA, 14 nt, Bordetella pertussis
ugccccauccagcg

SEQ ID NO: 341524 - RNA, 23 nt, Bordetella pertussis
ugccccauuuuuuugccugcucg

SEQ ID NO: 341525 - RNA, 19 nt, Bordetella pertussis
ugccccgauccgcgggcgg

SEQ ID NO: 341526 - RNA, 17 nt, Bordetella pertussis
ugccccgcaugcgcaga

SEQ ID NO: 341527 - RNA, 21 nt, Bordetella pertussis
ugccccggccucgcggcgcgu

SEQ ID NO: 341528 - RNA, 21 nt, Bordetella pertussis
ugccccgugccgcggcgcggc

SEQ ID NO: 341529 - RNA, 15 nt, Bordetella pertussis
ugccccucggcgggc

SEQ ID NO: 341530 - RNA, 16 nt, Bordetella pertussis
ugccccucggcgggcu

SEQ ID NO: 341531 - RNA, 20 nt, Bordetella pertussis
ugccccugcggggacaggca

SEQ ID NO: 341532 - RNA, 18 nt, Bordetella pertussis
ugcccgaagcgcagcacc

SEQ ID NO: 341533 - RNA, 22 nt, Bordetella pertussis
ugcccgaagcgcagcaccaggu

SEQ ID NO: 341534 - RNA, 13 nt, Bordetella pertussis
ugcccgaagcggc

SEQ ID NO: 341535 - RNA, 17 nt, Bordetella pertussis
ugcccgaagcggcccgg

SEQ ID NO: 341536 - RNA, 19 nt, Bordetella pertussis
ugcccgaaggcagcggcac

SEQ ID NO: 341537 - RNA, 20 nt, Bordetella pertussis
ugcccgaccgcaugggcgcc

SEQ ID NO: 341538 - RNA, 22 nt, Bordetella pertussis
ugcccgaccgcaugggcgccga

SEQ ID NO: 341539 - RNA, 17 nt, Bordetella pertussis
ugcccgacgccgcgcgc

SEQ ID NO: 341540 - RNA, 15 nt, Bordetella pertussis
ugcccggcaggcaca

SEQ ID NO: 341541 - RNA, 21 nt, Bordetella pertussis
ugcccggcagggugacgggcu

SEQ ID NO: 341542 - RNA, 13 nt, Bordetella pertussis
ugcccggcgagca

SEQ ID NO: 341543 - RNA, 18 nt, Bordetella pertussis
ugcccggcgagcauggcg

SEQ ID NO: 341544 - RNA, 14 nt, Bordetella pertussis
ugcccgggcaccag

SEQ ID NO: 341545 - RNA, 15 nt, Bordetella pertussis
ugcccgggcagcacc

SEQ ID NO: 341546 - RNA, 19 nt, Bordetella pertussis
ugcccgggcgggaauucgc

SEQ ID NO: 341547 - RNA, 16 nt, Bordetella pertussis
ugccgacgaugccgcc

SEQ ID NO: 341548 - RNA, 19 nt, Bordetella pertussis
ugccgacggauucgcccag

SEQ ID NO: 341549 - RNA, 21 nt, Bordetella pertussis
ugccgacggauucgcccaggg

SEQ ID NO: 341550 - RNA, 12 nt, Bordetella pertussis
ugccgacggcgc

SEQ ID NO: 341551 - RNA, 14 nt, Bordetella pertussis
ugccgacggcgcgg

SEQ ID NO: 341552 - RNA, 16 nt, Bordetella pertussis
ugccgagacggccgcc

SEQ ID NO: 341553 - RNA, 16 nt, Bordetella pertussis
ugccgaucagcgggcu

SEQ ID NO: 341554 - RNA, 20 nt, Bordetella pertussis
ugccgauguuguuggccgcc

SEQ ID NO: 341555 - RNA, 17 nt, Bordetella pertussis
ugccgcacgaucgcgcc

SEQ ID NO: 341556 - RNA, 20 nt, Bordetella pertussis
ugccgcagacggucgacacc

SEQ ID NO: 341557 - RNA, 19 nt, Bordetella pertussis
ugccgcagauggccagcag

SEQ ID NO: 341558 - RNA, 20 nt, Bordetella pertussis
ugccgcagauggccagcagc

SEQ ID NO: 341559 - RNA, 19 nt, Bordetella pertussis
ugccgcccagcaugcgcgc

SEQ ID NO: 341560 - RNA, 11 nt, Bordetella pertussis
ugccgcccagg

SEQ ID NO: 341561 - RNA, 21 nt, Bordetella pertussis
ugccgcccaggucggacgcgc

SEQ ID NO: 341562 - RNA, 23 nt, Bordetella pertussis
ugccgcccaggucggacgcgccg

SEQ ID NO: 341563 - RNA, 17 nt, Bordetella pertussis
ugccgcccaugccgccg

SEQ ID NO: 341564 - RNA, 19 nt, Bordetella pertussis
ugccgcccgagcuggccgg

SEQ ID NO: 341565 - RNA, 20 nt, Bordetella pertussis
ugccgcccgagcuggccggc

SEQ ID NO: 341566 - RNA, 13 nt, Bordetella pertussis
ugccgcccgccau

SEQ ID NO: 341567 - RNA, 16 nt, Bordetella pertussis
ugccgcccuggcgcag

SEQ ID NO: 341568 - RNA, 17 nt, Bordetella pertussis
ugccgccgaaccagcgc

SEQ ID NO: 341569 - RNA, 14 nt, Bordetella pertussis
ugccgccggcgcgg

SEQ ID NO: 341570 - RNA, 15 nt, Bordetella pertussis
ugccgccggcgcggc

SEQ ID NO: 341571 - RNA, 21 nt, Bordetella pertussis
ugccgccggcgcggcugcugg

SEQ ID NO: 341572 - RNA, 22 nt, Bordetella pertussis
ugccgccggcgcggcugcuggg

SEQ ID NO: 341573 - RNA, 14 nt, Bordetella pertussis
ugccgccggcgcgu

SEQ ID NO: 341574 - RNA, 14 nt, Bordetella pertussis
ugccgccggcgggc

SEQ ID NO: 341575 - RNA, 17 nt, Bordetella pertussis
ugccgccggcgggcaac

SEQ ID NO: 341576 - RNA, 16 nt, Bordetella pertussis
ugccgccgugaugccg

SEQ ID NO: 341577 - RNA, 16 nt, Bordetella pertussis
ugccgccgugcgagca

SEQ ID NO: 341578 - RNA, 20 nt, Bordetella pertussis
ugccgcucaauucggccuga

SEQ ID NO: 341579 - RNA, 21 nt, Bordetella pertussis
ugccgcucaauucggccugac

SEQ ID NO: 341580 - RNA, 20 nt, Bordetella pertussis
ugccgcugaucuuccugggc

SEQ ID NO: 341581 - RNA, 22 nt, Bordetella pertussis
ugccgcugaucuuccugggcga

SEQ ID NO: 341582 - RNA, 19 nt, Bordetella pertussis
ugccgcugcaugggcggcc

SEQ ID NO: 341583 - RNA, 16 nt, Bordetella pertussis
ugccgcuggugaucug

SEQ ID NO: 341584 - RNA, 17 nt, Bordetella pertussis
ugccgcuggugaucugc

SEQ ID NO: 341585 - RNA, 12 nt, Bordetella pertussis
ugccgcuggugc

SEQ ID NO: 341586 - RNA, 14 nt, Bordetella pertussis
ugccggacgccgac

SEQ ID NO: 341587 - RNA, 16 nt, Bordetella pertussis
ugccggagcccgucag

SEQ ID NO: 341588 - RNA, 17 nt, Bordetella pertussis
ugccggaggucggcgca

SEQ ID NO: 341589 - RNA, 16 nt, Bordetella pertussis
ugccggaucagcgccu

SEQ ID NO: 341590 - RNA, 12 nt, Bordetella pertussis
ugccggauggcg

SEQ ID NO: 341591 - RNA, 15 nt, Bordetella pertussis
ugccggauggcgcgg

SEQ ID NO: 341592 - RNA, 16 nt, Bordetella pertussis
ugccggauggcgcgga

SEQ ID NO: 341593 - RNA, 16 nt, Bordetella pertussis
ugccggcaagcacgaa

SEQ ID NO: 341594 - RNA, 19 nt, Bordetella pertussis
ugccggcauaggcggcgca

SEQ ID NO: 341595 - RNA, 20 nt, Bordetella pertussis
ugccggcauaggcggcgcag

SEQ ID NO: 341596 - RNA, 18 nt, Bordetella pertussis
ugccggccagcacgggcg

SEQ ID NO: 341597 - RNA, 14 nt, Bordetella pertussis
ugccggccagcagc

SEQ ID NO: 341598 - RNA, 18 nt, Bordetella pertussis
ugccggccaugcucagca

SEQ ID NO: 341599 - RNA, 20 nt, Bordetella pertussis
ugccggcccaucuguacggc

SEQ ID NO: 341600 - RNA, 14 nt, Bordetella pertussis
ugccggccgaccgg

SEQ ID NO: 341601 - RNA, 17 nt, Bordetella pertussis
ugccggccgaccggcgc

SEQ ID NO: 341602 - RNA, 19 nt, Bordetella pertussis
ugccggccgaccggcgcgc

SEQ ID NO: 341603 - RNA, 18 nt, Bordetella pertussis
ugccggccgcccaggcgc

SEQ ID NO: 341604 - RNA, 19 nt, Bordetella pertussis
ugccggccgcccaggcgca

SEQ ID NO: 341605 - RNA, 14 nt, Bordetella pertussis
ugccggccggccag

SEQ ID NO: 341606 - RNA, 19 nt, Bordetella pertussis
ugccggccugaggcccgau

SEQ ID NO: 341607 - RNA, 15 nt, Bordetella pertussis
ugccggcgaucacgc

SEQ ID NO: 341608 - RNA, 20 nt, Bordetella pertussis
ugccggcgcccuugaugccg

SEQ ID NO: 341609 - RNA, 21 nt, Bordetella pertussis
ugccggcgcgccucggcgcgc

SEQ ID NO: 341610 - RNA, 23 nt, Bordetella pertussis
ugccggcgcgccucggcgcgcgc

SEQ ID NO: 341611 - RNA, 15 nt, Bordetella pertussis
ugccggcgcgggcgc

SEQ ID NO: 341612 - RNA, 16 nt, Bordetella pertussis
ugccggcgcgggcgca

SEQ ID NO: 341613 - RNA, 12 nt, Bordetella pertussis
ugccggcgcgca

SEQ ID NO: 341614 - RNA, 15 nt, Bordetella pertussis
ugccggcgcugcgca

SEQ ID NO: 341615 - RNA, 18 nt, Bordetella pertussis
ugccggcgcugcgcagca

SEQ ID NO: 341616 - RNA, 17 nt, Bordetella pertussis
ugccggcguggcgcgca

SEQ ID NO: 341617 - RNA, 15 nt, Bordetella pertussis
ugccgggacaggcac

SEQ ID NO: 341618 - RNA, 22 nt, Bordetella pertussis
ugccgggcaagcagauggccau

SEQ ID NO: 341619 - RNA, 15 nt, Bordetella pertussis
ugccgggccuggugc

SEQ ID NO: 341620 - RNA, 20 nt, Bordetella pertussis
ugccgggccuggugcccgac

SEQ ID NO: 341621 - RNA, 15 nt, Bordetella pertussis
ugccgggcuugcgca

SEQ ID NO: 341622 - RNA, 19 nt, Bordetella pertussis
ugccggucaggaugcgcgc

SEQ ID NO: 341623 - RNA, 21 nt, Bordetella pertussis
ugccggucaggaugcgcgcca

SEQ ID NO: 341624 - RNA, 22 nt, Bordetella pertussis
ugccggucaggaugcgcgccag

SEQ ID NO: 341625 - RNA, 16 nt, Bordetella pertussis
ugccggucuccagcgc

SEQ ID NO: 341626 - RNA, 15 nt, Bordetella pertussis
ugccggugcgcgugg

SEQ ID NO: 341627 - RNA, 17 nt, Bordetella pertussis
ugccggugcucggccag

SEQ ID NO: 341628 - RNA, 17 nt, Bordetella pertussis
ugccgguggacggccag

SEQ ID NO: 341629 - RNA, 18 nt, Bordetella pertussis
ugccgguggacggccagc

SEQ ID NO: 341630 - RNA, 20 nt, Bordetella pertussis
ugccguccagcgcggcgcca

SEQ ID NO: 341631 - RNA, 21 nt, Bordetella pertussis
ugccguccagcgcggcgccau

SEQ ID NO: 341632 - RNA, 13 nt, Bordetella pertussis
ugccguccugcug

SEQ ID NO: 341633 - RNA, 14 nt, Bordetella pertussis
ugccguccugcugc

SEQ ID NO: 341634 - RNA, 22 nt, Bordetella pertussis
ugccguccugcugcggcacgau

SEQ ID NO: 341635 - RNA, 15 nt, Bordetella pertussis
ugccguccuggcgac

SEQ ID NO: 341636 - RNA, 19 nt, Bordetella pertussis
ugccgucgagaaugacggu

SEQ ID NO: 341637 - RNA, 15 nt, Bordetella pertussis
ugccgucgagcgcga

SEQ ID NO: 341638 - RNA, 19 nt, Bordetella pertussis
ugccgucgagcgcggccag

SEQ ID NO: 341639 - RNA, 20 nt, Bordetella pertussis
ugccgucgagcgcggccagg

SEQ ID NO: 341640 - RNA, 11 nt, Bordetella pertussis
ugccgucgcca

SEQ ID NO: 341641 - RNA, 20 nt, Bordetella pertussis
ugccgucgccaaagcgcagc

SEQ ID NO: 341642 - RNA, 21 nt, Bordetella pertussis
ugccgucgccaaagcgcagcg

SEQ ID NO: 341643 - RNA, 14 nt, Bordetella pertussis
ugccgucgcgcacc

SEQ ID NO: 341644 - RNA, 18 nt, Bordetella pertussis
ugccgucggccagcuugc

SEQ ID NO: 341645 - RNA, 14 nt, Bordetella pertussis
ugccgucggccugg

SEQ ID NO: 341646 - RNA, 15 nt, Bordetella pertussis
ugccgucggcguugu

SEQ ID NO: 341647 - RNA, 21 nt, Bordetella pertussis
ugccgucggcguugugccggc

SEQ ID NO: 341648 - RNA, 22 nt, Bordetella pertussis
ugccgucggcguugugccggcg

SEQ ID NO: 341649 - RNA, 14 nt, Bordetella pertussis
ugccuccaggcgca

SEQ ID NO: 341650 - RNA, 22 nt, Bordetella pertussis
ugccucguucaugucgcgggug

SEQ ID NO: 341651 - RNA, 15 nt, Bordetella pertussis
ugccugauggcgcgu

SEQ ID NO: 341652 - RNA, 16 nt, Bordetella pertussis
ugccugauggcgcgug

SEQ ID NO: 341653 - RNA, 20 nt, Bordetella pertussis
ugccugcaaaaaacaagcuc

SEQ ID NO: 341654 - RNA, 20 nt, Bordetella pertussis
ugccugccccugcggggaca

SEQ ID NO: 341655 - RNA, 12 nt, Bordetella pertussis
ugccugccggcc

SEQ ID NO: 341656 - RNA, 14 nt, Bordetella pertussis
ugccugccggccgg

SEQ ID NO: 341657 - RNA, 17 nt, Bordetella pertussis
ugccugcgaugccggcg

SEQ ID NO: 341658 - RNA, 19 nt, Bordetella pertussis
ugccugcgaugccggcgug

SEQ ID NO: 341659 - RNA, 21 nt, Bordetella pertussis
ugccugcgaugccggcguggc

SEQ ID NO: 341660 - RNA, 16 nt, Bordetella pertussis
ugccuggacgcgcugg

SEQ ID NO: 341661 - RNA, 19 nt, Bordetella pertussis
ugccugggugcuggugcgc

SEQ ID NO: 341662 - RNA, 17 nt, Bordetella pertussis
ugccugguaggcgagca

SEQ ID NO: 341663 - RNA, 15 nt, Bordetella pertussis
ugccuggucgaagua

SEQ ID NO: 341664 - RNA, 20 nt, Bordetella pertussis
ugccugucccaaccgggaca

SEQ ID NO: 341665 - RNA, 15 nt, Bordetella pertussis
ugccuguccccacag

SEQ ID NO: 341666 - RNA, 20 nt, Bordetella pertussis
ugccuguccccacguggaca

SEQ ID NO: 341667 - RNA, 21 nt, Bordetella pertussis
ugccuguccccacugggggac

SEQ ID NO: 341668 - RNA, 15 nt, Bordetella pertussis
ugccuguccccgcag

SEQ ID NO: 341669 - RNA, 20 nt, Bordetella pertussis
ugccuguccccgcagggaca

SEQ ID NO: 341670 - RNA, 20 nt, Bordetella pertussis
ugccuguccccgcggggaca

SEQ ID NO: 341671 - RNA, 16 nt, Bordetella pertussis
ugccuguccccguggg

SEQ ID NO: 341672 - RNA, 20 nt, Bordetella pertussis
ugccugucccggcugggaca

SEQ ID NO: 341673 - RNA, 20 nt, Bordetella pertussis
ugccugucccugcgggggca

SEQ ID NO: 341674 - RNA, 15 nt, Bordetella pertussis
ugcgacagcaccggg

SEQ ID NO: 341675 - RNA, 20 nt, Bordetella pertussis
ugcgacagcagcaugcggcc

SEQ ID NO: 341676 - RNA, 17 nt, Bordetella pertussis
ugcgacagcagggccag

SEQ ID NO: 341677 - RNA, 21 nt, Bordetella pertussis
ugcgacgauccggcgaccgac

SEQ ID NO: 341678 - RNA, 12 nt, Bordetella pertussis
ugcgacgccgcc

SEQ ID NO: 341679 - RNA, 18 nt, Bordetella pertussis
ugcgacggaugggcgccg

SEQ ID NO: 341680 - RNA, 16 nt, Bordetella pertussis
ugcgagacgaaggcgc

SEQ ID NO: 341681 - RNA, 21 nt, Bordetella pertussis
ugcgagacgaaggcgccggcc

SEQ ID NO: 341682 - RNA, 16 nt, Bordetella pertussis
ugcgagacgcgcucgc

SEQ ID NO: 341683 - RNA, 23 nt, Bordetella pertussis
ugcgagcagaugcaccggccagu

SEQ ID NO: 341684 - RNA, 12 nt, Bordetella pertussis
ugcgaugccggc

SEQ ID NO: 341685 - RNA, 16 nt, Bordetella pertussis
ugcgcaggcccgacag

SEQ ID NO: 341686 - RNA, 14 nt, Bordetella pertussis
ugcgcaggcgccgc

SEQ ID NO: 341687 - RNA, 19 nt, Bordetella pertussis
ugcgcaggcugucgaugcg

SEQ ID NO: 341688 - RNA, 16 nt, Bordetella pertussis
ugcgcaggucggccag

SEQ ID NO: 341689 - RNA, 17 nt, Bordetella pertussis
ugcgcaggucggccagg

SEQ ID NO: 341690 - RNA, 21 nt, Bordetella pertussis
ugcgcaucgaucagcgcgccg

SEQ ID NO: 341691 - RNA, 17 nt, Bordetella pertussis
ugcgcaucgaugcggcc

SEQ ID NO: 341692 - RNA, 16 nt, Bordetella pertussis
ugcgcaucggcggcag

SEQ ID NO: 341693 - RNA, 16 nt, Bordetella pertussis
ugcgcauggccagcac

SEQ ID NO: 341694 - RNA, 20 nt, Bordetella pertussis
ugcgcauggccagcgcgcag

SEQ ID NO: 341695 - RNA, 12 nt, Bordetella pertussis
ugcgcauggccg

SEQ ID NO: 341696 - RNA, 15 nt, Bordetella pertussis
ugcgcaugggcgcag

SEQ ID NO: 341697 - RNA, 19 nt, Bordetella pertussis
ugcgccagccacgcgcgcu

SEQ ID NO: 341698 - RNA, 15 nt, Bordetella pertussis
ugcgccagccagcgc

SEQ ID NO: 341699 - RNA, 21 nt, Bordetella pertussis
ugcgccagccagcgcaugccg

SEQ ID NO: 341700 - RNA, 13 nt, Bordetella pertussis
ugcgccagccguu

SEQ ID NO: 341701 - RNA, 14 nt, Bordetella pertussis
ugcgccagccguug

SEQ ID NO: 341702 - RNA, 13 nt, Bordetella pertussis
ugcgccagcgcca

SEQ ID NO: 341703 - RNA, 13 nt, Bordetella pertussis
ugcgccagcgccu

SEQ ID NO: 341704 - RNA, 17 nt, Bordetella pertussis
ugcgccagcgcugucca

SEQ ID NO: 341705 - RNA, 21 nt, Bordetella pertussis
ugcgccagcgcuguccaggcc

SEQ ID NO: 341706 - RNA, 14 nt, Bordetella pertussis
ugcgccagcggcga

SEQ ID NO: 341707 - RNA, 15 nt, Bordetella pertussis
ugcgccagcggcgac

SEQ ID NO: 341708 - RNA, 19 nt, Bordetella pertussis
ugcgccagcuccagccgca

SEQ ID NO: 341709 - RNA, 17 nt, Bordetella pertussis
ugcgccagcuugcgcgc

SEQ ID NO: 341710 - RNA, 20 nt, Bordetella pertussis
ugcgccaggcaaaggcccag

SEQ ID NO: 341711 - RNA, 17 nt, Bordetella pertussis
ugcgccaggugggccag

SEQ ID NO: 341712 - RNA, 18 nt, Bordetella pertussis
ugcgccaggugggccagg

SEQ ID NO: 341713 - RNA, 16 nt, Bordetella pertussis
ugcgccaguccagcgc

SEQ ID NO: 341714 - RNA, 20 nt, Bordetella pertussis
ugcgccaguccagcgcgccg

SEQ ID NO: 341715 - RNA, 20 nt, Bordetella pertussis
ugcgccaguugcggggcgcc

SEQ ID NO: 341716 - RNA, 20 nt, Bordetella pertussis
ugcgccgaucgcggcuccag

SEQ ID NO: 341717 - RNA, 13 nt, Bordetella pertussis
ugcgccgaggccu

SEQ ID NO: 341718 - RNA, 22 nt, Bordetella pertussis
ugcgccgaggccugcugugcga

SEQ ID NO: 341719 - RNA, 13 nt, Bordetella pertussis
ugcgccgcaccag

SEQ ID NO: 341720 - RNA, 15 nt, Bordetella pertussis
ugcgccgcaugcggc

SEQ ID NO: 341721 - RNA, 14 nt, Bordetella pertussis
ugcgccgcccgugc

SEQ ID NO: 341722 - RNA, 18 nt, Bordetella pertussis
ugcgccgcccgugccagu

SEQ ID NO: 341723 - RNA, 20 nt, Bordetella pertussis
ugcgccgccgccgcggccug

SEQ ID NO: 341724 - RNA, 12 nt, Bordetella pertussis
ugcgccgccggc

SEQ ID NO: 341725 - RNA, 17 nt, Bordetella pertussis
ugcgccgccggccugcu

SEQ ID NO: 341726 - RNA, 19 nt, Bordetella pertussis
ugcgccgccggccugcugc

SEQ ID NO: 341727 - RNA, 13 nt, Bordetella pertussis
ugcgccgcgccaa

SEQ ID NO: 341728 - RNA, 12 nt, Bordetella pertussis
ugcgccgcgccg

SEQ ID NO: 341729 - RNA, 12 nt, Bordetella pertussis
ugcgccgcguca

SEQ ID NO: 341730 - RNA, 14 nt, Bordetella pertussis
ugcgccggcccggc

SEQ ID NO: 341731 - RNA, 13 nt, Bordetella pertussis
ugcgccggccugg

SEQ ID NO: 341732 - RNA, 14 nt, Bordetella pertussis
ugcgccggccuggc

SEQ ID NO: 341733 - RNA, 17 nt, Bordetella pertussis
ugcgccggccuggcgcg

SEQ ID NO: 341734 - RNA, 19 nt, Bordetella pertussis
ugcgccggccuggcgcgac

SEQ ID NO: 341735 - RNA, 17 nt, Bordetella pertussis
ugcgccggcucagcccc

SEQ ID NO: 341736 - RNA, 16 nt, Bordetella pertussis
ugcgccggcauggcca

SEQ ID NO: 341737 - RNA, 17 nt, Bordetella pertussis
ugcgccgggcgcggcca

SEQ ID NO: 341738 - RNA, 18 nt, Bordetella pertussis
ugcgccgggcgcggccag

SEQ ID NO: 341739 - RNA, 14 nt, Bordetella pertussis
ugcgccggggcgcc

SEQ ID NO: 341740 - RNA, 15 nt, Bordetella pertussis
ugcgccggggcgccg

SEQ ID NO: 341741 - RNA, 21 nt, Bordetella pertussis
ugcgccgugacguugagcgcc

SEQ ID NO: 341742 - RNA, 12 nt, Bordetella pertussis
ugcgccugcugg

SEQ ID NO: 341743 - RNA, 13 nt, Bordetella pertussis
ugcgccugcuggu

SEQ ID NO: 341744 - RNA, 14 nt, Bordetella pertussis
ugcgccugcugguc

SEQ ID NO: 341745 - RNA, 17 nt, Bordetella pertussis
ugcgccugcuggucggc

SEQ ID NO: 341746 - RNA, 19 nt, Bordetella pertussis
ugcgccugcuggucggccu

SEQ ID NO: 341747 - RNA, 16 nt, Bordetella pertussis
ugcgccuggccgcgcu

SEQ ID NO: 341748 - RNA, 22 nt, Bordetella pertussis
ugcgccuggcggacgauggccu

SEQ ID NO: 341749 - RNA, 12 nt, Bordetella pertussis
ugcgccuggcgu

SEQ ID NO: 341750 - RNA, 18 nt, Bordetella pertussis
ugcgccugggcggcgcag

SEQ ID NO: 341751 - RNA, 13 nt, Bordetella pertussis
ugcgcgaacgcgc

SEQ ID NO: 341752 - RNA, 22 nt, Bordetella pertussis
ugcgcgaacgcgcgccggccag

SEQ ID NO: 341753 - RNA, 17 nt, Bordetella pertussis
ugcgcgaacgcggccau

SEQ ID NO: 341754 - RNA, 15 nt, Bordetella pertussis
ugcgcgaaacggccg

SEQ ID NO: 341755 - RNA, 16 nt, Bordetella pertussis
ugcgcgccugcugguc

SEQ ID NO: 341756 - RNA, 23 nt, Bordetella pertussis
ugcgcgccuugaaccccggcugc

SEQ ID NO: 341757 - RNA, 13 nt, Bordetella pertussis
ugcgcgcgcagcc

SEQ ID NO: 341758 - RNA, 12 nt, Bordetella pertussis
ugcgcgcgccag

SEQ ID NO: 341759 - RNA, 15 nt, Bordetella pertussis
ugcgcgcgccagcgc

SEQ ID NO: 341760 - RNA, 22 nt, Bordetella pertussis
ugcgcgcgccauggugaacggc

SEQ ID NO: 341761 - RNA, 12 nt, Bordetella pertussis
ugcgcgcgcccc

SEQ ID NO: 341762 - RNA, 18 nt, Bordetella pertussis
ugcgcgcgcccccagcgc

SEQ ID NO: 341763 - RNA, 22 nt, Bordetella pertussis
ugcgcgcgcgguugagcgccag

SEQ ID NO: 341764 - RNA, 16 nt, Bordetella pertussis
ugcgcgcggccagcgc

SEQ ID NO: 341765 - RNA, 21 nt, Bordetella pertussis
ugcgcgcggccgaggucggcg

SEQ ID NO: 341766 - RNA, 22 nt, Bordetella pertussis
ugcgcggcauacgccgauggcg

SEQ ID NO: 341767 - RNA, 20 nt, Bordetella pertussis
ugcgcggugcgggugggcgc

SEQ ID NO: 341768 - RNA, 22 nt, Bordetella pertussis
ugcgcggugcgggugggcgcgc

SEQ ID NO: 341769 - RNA, 15 nt, Bordetella pertussis
ugcgcgguugggcgc

SEQ ID NO: 341770 - RNA, 19 nt, Bordetella pertussis
ugcgcgguugggcgcacag

SEQ ID NO: 341771 - RNA, 18 nt, Bordetella pertussis
ugcgcguacguggcgcgg

SEQ ID NO: 341772 - RNA, 17 nt, Bordetella pertussis
ugcgcguaggcgcgcgc

SEQ ID NO: 341773 - RNA, 18 nt, Bordetella pertussis
ugcgcguccuggcgcgag

SEQ ID NO: 341774 - RNA, 17 nt, Bordetella pertussis
ugcgcguccugggccga

SEQ ID NO: 341775 - RNA, 16 nt, Bordetella pertussis
ugcgcgucgacagcau

SEQ ID NO: 341776 - RNA, 23 nt, Bordetella pertussis
ugcgcgucgacagcaugaacggc

SEQ ID NO: 341777 - RNA, 16 nt, Bordetella pertussis
ugcgcgucuccagcgc

SEQ ID NO: 341778 - RNA, 19 nt, Bordetella pertussis
ugcgcgucuccagcgccgg

SEQ ID NO: 341779 - RNA, 14 nt, Bordetella pertussis
ugcgcguggcgcga

SEQ ID NO: 341780 - RNA, 18 nt, Bordetella pertussis
ugcgcguucaugucgguc

SEQ ID NO: 341781 - RNA, 16 nt, Bordetella pertussis
ugcgcguuggccugac

SEQ ID NO: 341782 - RNA, 13 nt, Bordetella pertussis
ugcgcucgcccag

SEQ ID NO: 341783 - RNA, 22 nt, Bordetella pertussis
ugcgcucgguguggauggcggu

SEQ ID NO: 341784 - RNA, 15 nt, Bordetella pertussis
ugcggaucaagcggc

SEQ ID NO: 341785 - RNA, 18 nt, Bordetella pertussis
ugcggcacaaccuggcgc

SEQ ID NO: 341786 - RNA, 21 nt, Bordetella pertussis
ugcggcacaaccuggcgcgcg

SEQ ID NO: 341787 - RNA, 22 nt, Bordetella pertussis
ugcggcacaaccuggcgcgcgg

SEQ ID NO: 341788 - RNA, 15 nt, Bordetella pertussis
ugcggcaccugcugc

SEQ ID NO: 341789 - RNA, 20 nt, Bordetella pertussis
ugcggcacgaucggcgccug

SEQ ID NO: 341790 - RNA, 14 nt, Bordetella pertussis
ugcggcacggccag

SEQ ID NO: 341791 - RNA, 15 nt, Bordetella pertussis
ugcggcacggccagc

SEQ ID NO: 341792 - RNA, 13 nt, Bordetella pertussis
ugcggcacgugcc

SEQ ID NO: 341793 - RNA, 18 nt, Bordetella pertussis
ugcggcagcgacucgccg

SEQ ID NO: 341794 - RNA, 13 nt, Bordetella pertussis
ugcggcagcgccg

SEQ ID NO: 341795 - RNA, 14 nt, Bordetella pertussis
ugcggcagcgccgc

SEQ ID NO: 341796 - RNA, 15 nt, Bordetella pertussis
ugcggcagggccucc

SEQ ID NO: 341797 - RNA, 15 nt, Bordetella pertussis
ugcggcagccaggug

SEQ ID NO: 341798 - RNA, 19 nt, Bordetella pertussis
ugcggcaggugcgucacgc

SEQ ID NO: 341799 - RNA, 16 nt, Bordetella pertussis
ugcggccaggcggggu

SEQ ID NO: 341800 - RNA, 14 nt, Bordetella pertussis
ugcggcccagccgc

SEQ ID NO: 341801 - RNA, 15 nt, Bordetella pertussis
ugcggcggcgggcgg

SEQ ID NO: 341802 - RNA, 17 nt, Bordetella pertussis
ugcggcggcgggcggcc

SEQ ID NO: 341803 - RNA, 24 nt, Bordetella pertussis
ugcggcggcugugggccucgcugg

SEQ ID NO: 341804 - RNA, 22 nt, Bordetella pertussis
ugcggcgggcgggucgaugucg

SEQ ID NO: 341805 - RNA, 14 nt, Bordetella pertussis
ugcggcuccugcug

SEQ ID NO: 341806 - RNA, 20 nt, Bordetella pertussis
ugcggcuccugcuggcgcgu

SEQ ID NO: 341807 - RNA, 18 nt, Bordetella pertussis
ugcggcugaucaccgccg

SEQ ID NO: 341808 - RNA, 12 nt, Bordetella pertussis
ugcgggccugca

SEQ ID NO: 341809 - RNA, 19 nt, Bordetella pertussis
ugcgggcgcaagccagcac

SEQ ID NO: 341810 - RNA, 22 nt, Bordetella pertussis
ugcgggcgcagcgccgcuucca

SEQ ID NO: 341811 - RNA, 12 nt, Bordetella pertussis
ugcgggcgccgc

SEQ ID NO: 341812 - RNA, 17 nt, Bordetella pertussis
ugcgggcugaugcaggc

SEQ ID NO: 341813 - RNA, 12 nt, Bordetella pertussis
ugcggggcaccu

SEQ ID NO: 341814 - RNA, 14 nt, Bordetella pertussis
ugcggggcgcccag

SEQ ID NO: 341815 - RNA, 20 nt, Bordetella pertussis
ugcggggcggcaggucgcgc

SEQ ID NO: 341816 - RNA, 15 nt, Bordetella pertussis
ugcggggacaggcac

SEQ ID NO: 341817 - RNA, 16 nt, Bordetella pertussis
ugcggguacuggccga

SEQ ID NO: 341818 - RNA, 19 nt, Bordetella pertussis
ugcggguacuggccgacgg

SEQ ID NO: 341819 - RNA, 22 nt, Bordetella pertussis
uggaaccgcgguacgcgggcau

SEQ ID NO: 341820 - RNA, 20 nt, Bordetella pertussis
uggaaccgguuggccagcuc

SEQ ID NO: 341821 - RNA, 23 nt, Bordetella pertussis
uggaacucguuggccagcgcgcc

SEQ ID NO: 341822 - RNA, 19 nt, Bordetella pertussis
uggaagacguggcccgcgu

SEQ ID NO: 341823 - RNA, 20 nt, Bordetella pertussis
uggaagaucacauaggccgg

SEQ ID NO: 341824 - RNA, 19 nt, Bordetella pertussis
uggaagcgcgccaggcgca

SEQ ID NO: 341825 - RNA, 14 nt, Bordetella pertussis
uggaagcugcggcc

SEQ ID NO: 341826 - RNA, 19 nt, Bordetella pertussis
uggaagguccacggcaugg

SEQ ID NO: 341827 - RNA, 17 nt, Bordetella pertussis
uggacacagcggcgcga

SEQ ID NO: 341828 - RNA, 22 nt, Bordetella pertussis
uggacaggcaccugcgaccgag

SEQ ID NO: 341829 - RNA, 19 nt, Bordetella pertussis
uggacagcaguucggccgg

SEQ ID NO: 341830 - RNA, 18 nt, Bordetella pertussis
uggaccagcccguccugg

SEQ ID NO: 341831 - RNA, 15 nt, Bordetella pertussis
uggaccagggcacgg

SEQ ID NO: 341832 - RNA, 22 nt, Bordetella pertussis
uggaccccaguuccagcacgac

SEQ ID NO: 341833 - RNA, 18 nt, Bordetella pertussis
uggaccccuugcggccgc

SEQ ID NO: 341834 - RNA, 16 nt, Bordetella pertussis
uggaccgggaauggcg

SEQ ID NO: 341835 - RNA, 18 nt, Bordetella pertussis
uggaccugccguucgcgc

SEQ ID NO: 341836 - RNA, 20 nt, Bordetella pertussis
uggaccuggacgagggccgc

SEQ ID NO: 341837 - RNA, 16 nt, Bordetella pertussis
uggaccggcuccggcc

SEQ ID NO: 341838 - RNA, 20 nt, Bordetella pertussis
uggacgaauacgcuggcgcg

SEQ ID NO: 341839 - RNA, 16 nt, Bordetella pertussis
uggacgagcucgucgg

SEQ ID NO: 341840 - RNA, 23 nt, Bordetella pertussis
uggacgaggcgauggucggccgg

SEQ ID NO: 341841 - RNA, 18 nt, Bordetella pertussis
uggacgagggccggcgcc

SEQ ID NO: 341842 - RNA, 20 nt, Bordetella pertussis
uggacgaguugcucggagcc

SEQ ID NO: 341843 - RNA, 22 nt, Bordetella pertussis
uggacgcccuggcgcaggccgg

SEQ ID NO: 341844 - RNA, 20 nt, Bordetella pertussis
uggacgccgccggcccagga

SEQ ID NO: 341845 - RNA, 16 nt, Bordetella pertussis
uggacgcgcuggccga

SEQ ID NO: 341846 - RNA, 16 nt, Bordetella pertussis
uggacgucugagcgcc

SEQ ID NO: 341847 - RNA, 21 nt, Bordetella pertussis
uggagaacgagccggccgcgc

SEQ ID NO: 341848 - RNA, 14 nt, Bordetella pertussis
uggagaagcgccgc

SEQ ID NO: 341849 - RNA, 16 nt, Bordetella pertussis
uggagaagcgccgcgc

SEQ ID NO: 341850 - RNA, 15 nt, Bordetella pertussis
uggagacggaugccg

SEQ ID NO: 341851 - RNA, 16 nt, Bordetella pertussis
uggagacggaugccgu

SEQ ID NO: 341852 - RNA, 22 nt, Bordetella pertussis
uggagacggaugccgucuuggc

SEQ ID NO: 341853 - RNA, 20 nt, Bordetella pertussis
uggagagggccuggucagcg

SEQ ID NO: 341854 - RNA, 15 nt, Bordetella pertussis
uggagaucgccgccg

SEQ ID NO: 341855 - RNA, 12 nt, Bordetella pertussis
uggagauggcgc

SEQ ID NO: 341856 - RNA, 14 nt, Bordetella pertussis
uggagauggcgccg

SEQ ID NO: 341857 - RNA, 16 nt, Bordetella pertussis
uggagcgcggcggcgu

SEQ ID NO: 341858 - RNA, 22 nt, Bordetella pertussis
uggagcggccuggccccgcgcg

SEQ ID NO: 341859 - RNA, 23 nt, Bordetella pertussis
uggagcucuaugucgccggccag

SEQ ID NO: 341860 - RNA, 15 nt, Bordetella pertussis
uggagcuggggccgc

SEQ ID NO: 341861 - RNA, 15 nt, Bordetella pertussis
uggaggacgccgacc

SEQ ID NO: 341862 - RNA, 13 nt, Bordetella pertussis
uggaggcgcagcg

SEQ ID NO: 341863 - RNA, 23 nt, Bordetella pertussis
uggaggugccguccggcaccucg

SEQ ID NO: 341864 - RNA, 20 nt, Bordetella pertussis
uggagucugcgugugccgcc

SEQ ID NO: 341865 - RNA, 17 nt, Bordetella pertussis
uggaucacgugccagcc

SEQ ID NO: 341866 - RNA, 19 nt, Bordetella pertussis
uggaucaggaugggcgcgg

SEQ ID NO: 341867 - RNA, 17 nt, Bordetella pertussis
uggaugaagcguucggc

SEQ ID NO: 341868 - RNA, 15 nt, Bordetella pertussis
uggaugacucgggca

SEQ ID NO: 341869 - RNA, 14 nt, Bordetella pertussis
uggaugaugcgcga

SEQ ID NO: 341870 - RNA, 21 nt, Bordetella pertussis
uggaugccaugccgggcaagc

SEQ ID NO: 341871 - RNA, 14 nt, Bordetella pertussis
uggaugcgcgcccc

SEQ ID NO: 341872 - RNA, 21 nt, Bordetella pertussis
uggaugcgcuugccgcccacu

SEQ ID NO: 341873 - RNA, 13 nt, Bordetella pertussis
uggauggccugcu

SEQ ID NO: 341874 - RNA, 17 nt, Bordetella pertussis
uggauggcggccgccag

SEQ ID NO: 341875 - RNA, 21 nt, Bordetella pertussis
uggauggucacgcccaggcgc

SEQ ID NO: 341876 - RNA, 14 nt, Bordetella pertussis
uggauggugccgcc

SEQ ID NO: 341877 - RNA, 23 nt, Bordetella pertussis
uggauucgauugccuggucgaag

SEQ ID NO: 341878 - RNA, 16 nt, Bordetella pertussis
uggauucgcgccggcc

SEQ ID NO: 341879 - RNA, 13 nt, Bordetella pertussis
uggcaaagcgcgc

SEQ ID NO: 341880 - RNA, 20 nt, Bordetella pertussis
uggcaaccucgccgcgccag

SEQ ID NO: 341881 - RNA, 20 nt, Bordetella pertussis
uggcaacguugcugcagcgu

SEQ ID NO: 341882 - RNA, 15 nt, Bordetella pertussis
uggcaaggcccgccg

SEQ ID NO: 341883 - RNA, 15 nt, Bordetella pertussis
uggcaaugguccagc

SEQ ID NO: 341884 - RNA, 22 nt, Bordetella pertussis
uggcacagccgcagccgucgcg

SEQ ID NO: 341885 - RNA, 13 nt, Bordetella pertussis
uggcaccggcaaa

SEQ ID NO: 341886 - RNA, 17 nt, Bordetella pertussis
uggcagaguggcaggag

SEQ ID NO: 341887 - RNA, 14 nt, Bordetella pertussis
uggcagaugcgcgc

SEQ ID NO: 341888 - RNA, 16 nt, Bordetella pertussis
uggcagaugcgcgcca

SEQ ID NO: 341889 - RNA, 20 nt, Bordetella pertussis
uggcagaugcgcgccaggcg

SEQ ID NO: 341890 - RNA, 22 nt, Bordetella pertussis
uggcagcagaucggcggccugg

SEQ ID NO: 341891 - RNA, 20 nt, Bordetella pertussis
uggcagcgaccgcggcgguc

SEQ ID NO: 341892 - RNA, 14 nt, Bordetella pertussis
uggcagcuggcgcg

SEQ ID NO: 341893 - RNA, 14 nt, Bordetella pertussis
uggcaggccagcau

SEQ ID NO: 341894 - RNA, 17 nt, Bordetella pertussis
uggcaggcuggcauuga

SEQ ID NO: 341895 - RNA, 23 nt, Bordetella pertussis
uggcaggcuggcauugagggcgu

SEQ ID NO: 341896 - RNA, 17 nt, Bordetella pertussis
uggcagggcgccgcgcg

SEQ ID NO: 341897 - RNA, 15 nt, Bordetella pertussis
uggcauagaugccga

SEQ ID NO: 341898 - RNA, 19 nt, Bordetella pertussis
uggcauaguccucgugguu

SEQ ID NO: 341899 - RNA, 15 nt, Bordetella pertussis
uggcaucgucgcgcu

SEQ ID NO: 341900 - RNA, 16 nt, Bordetella pertussis
uggcaugccaugcgca

SEQ ID NO: 341901 - RNA, 17 nt, Bordetella pertussis
uggcaugccaugcgcac

SEQ ID NO: 341902 - RNA, 19 nt, Bordetella pertussis
uggcauggcgcgugcgcgc

SEQ ID NO: 341903 - RNA, 18 nt, Bordetella pertussis
uggcaugugccaccgccc

SEQ ID NO: 341904 - RNA, 20 nt, Bordetella pertussis
uggcaugugccaccgcccag

SEQ ID NO: 341905 - RNA, 13 nt, Bordetella pertussis
uggccaacgccac

SEQ ID NO: 341906 - RNA, 13 nt, Bordetella pertussis
uggccaaugcgcc

SEQ ID NO: 341907 - RNA, 16 nt, Bordetella pertussis
uggccaauggccgcgg

SEQ ID NO: 341908 - RNA, 20 nt, Bordetella pertussis
uggccaccaaaaacggucug

SEQ ID NO: 341909 - RNA, 20 nt, Bordetella pertussis
uggccaccacgcccaucugc

SEQ ID NO: 341910 - RNA, 12 nt, Bordetella pertussis
uggccaccaggu

SEQ ID NO: 341911 - RNA, 17 nt, Bordetella pertussis
uggccacccgacagcuc

SEQ ID NO: 341912 - RNA, 19 nt, Bordetella pertussis
uggccaccgaagcggcguu

SEQ ID NO: 341913 - RNA, 21 nt, Bordetella pertussis
uggccacugccuuacucgcuc

SEQ ID NO: 341914 - RNA, 21 nt, Bordetella pertussis
uggccagcacauacgccgccg

SEQ ID NO: 341915 - RNA, 13 nt, Bordetella pertussis
uggccagcagcgc

SEQ ID NO: 341916 - RNA, 20 nt, Bordetella pertussis
uggccagcagcgcaucgcgc

SEQ ID NO: 341917 - RNA, 14 nt, Bordetella pertussis
uggccagcagcgcc

SEQ ID NO: 341918 - RNA, 15 nt, Bordetella pertussis
uggccagcagcgccg

SEQ ID NO: 341919 - RNA, 14 nt, Bordetella pertussis
uggccagccaggcg

SEQ ID NO: 341920 - RNA, 16 nt, Bordetella pertussis
uggccagccggcccag

SEQ ID NO: 341921 - RNA, 18 nt, Bordetella pertussis
uggccagccggcccagca

SEQ ID NO: 341922 - RNA, 16 nt, Bordetella pertussis
uggccagcgccgccag

SEQ ID NO: 341923 - RNA, 20 nt, Bordetella pertussis
uggccagcgcgacggccucg

SEQ ID NO: 341924 - RNA, 21 nt, Bordetella pertussis
uggccagcgguucgucggcgc

SEQ ID NO: 341925 - RNA, 14 nt, Bordetella pertussis
uggccagcuccagg

SEQ ID NO: 341926 - RNA, 18 nt, Bordetella pertussis
uggccagcuggcgcgugg

SEQ ID NO: 341927 - RNA, 21 nt, Bordetella pertussis
uggccagcuggcggcgcagca

SEQ ID NO: 341928 - RNA, 23 nt, Bordetella pertussis
uggccaggcugucccagauggcg

SEQ ID NO: 341929 - RNA, 23 nt, Bordetella pertussis
uggccagggaggaacugggcgcc

SEQ ID NO: 341930 - RNA, 21 nt, Bordetella pertussis
uggccaggguuugcuggcgca

SEQ ID NO: 341931 - RNA, 22 nt, Bordetella pertussis
uggccaggguuugcuggcgcag

SEQ ID NO: 341932 - RNA, 24 nt, Bordetella pertussis
uggccaggguuugcuggcgcagca

SEQ ID NO: 341933 - RNA, 21 nt, Bordetella pertussis
uggccagguccacauccgcgc

SEQ ID NO: 341934 - RNA, 18 nt, Bordetella pertussis
uggccagguggcggcggc

SEQ ID NO: 341935 - RNA, 17 nt, Bordetella pertussis
uggccaucaacguggcg

SEQ ID NO: 341936 - RNA, 13 nt, Bordetella pertussis
uggccaucaccgc

SEQ ID NO: 341937 - RNA, 21 nt, Bordetella pertussis
uggccaugcugggcgggcugg

SEQ ID NO: 341938 - RNA, 19 nt, Bordetella pertussis
uggccauuccuuccgggcc

SEQ ID NO: 341939 - RNA, 18 nt, Bordetella pertussis
uggcccaagcccguggcg

SEQ ID NO: 341940 - RNA, 18 nt, Bordetella pertussis
uggcccacgcccauguag

SEQ ID NO: 341941 - RNA, 13 nt, Bordetella pertussis
uggcccacgcgca

SEQ ID NO: 341942 - RNA, 19 nt, Bordetella pertussis
uggcccacucggugcgcgc

SEQ ID NO: 341943 - RNA, 20 nt, Bordetella pertussis
uggcccacucggugcgcgcg

SEQ ID NO: 341944 - RNA, 22 nt, Bordetella pertussis
uggcccacucggugcgcgcgcc

SEQ ID NO: 341945 - RNA, 21 nt, Bordetella pertussis
uggcccagcaccgccgccagu

SEQ ID NO: 341946 - RNA, 19 nt, Bordetella pertussis
uggcccagccggugcgcgg

SEQ ID NO: 341947 - RNA, 20 nt, Bordetella pertussis
uggcccagccggugcgcggc

SEQ ID NO: 341948 - RNA, 18 nt, Bordetella pertussis
uggcccagaucugccgca

SEQ ID NO: 341949 - RNA, 18 nt, Bordetella pertussis
uggcccagcuccagcugg

SEQ ID NO: 341950 - RNA, 19 nt, Bordetella pertussis
uggcccagcuccagcuggc

SEQ ID NO: 341951 - RNA, 16 nt, Bordetella pertussis
uggcccagcugggcgg

SEQ ID NO: 341952 - RNA, 17 nt, Bordetella pertussis
uggcccagcugggcggc

SEQ ID NO: 341953 - RNA, 15 nt, Bordetella pertussis
uggcccaggcgggcc

SEQ ID NO: 341954 - RNA, 21 nt, Bordetella pertussis
uggcccagggcagcggccaga

SEQ ID NO: 341955 - RNA, 22 nt, Bordetella pertussis
uggcccaguugaaucggcgcga

SEQ ID NO: 341956 - RNA, 19 nt, Bordetella pertussis
uggcccaugaacaggcacg

SEQ ID NO: 341957 - RNA, 15 nt, Bordetella pertussis
uggccccaggcgccc

SEQ ID NO: 341958 - RNA, 16 nt, Bordetella pertussis
uggccccaggcgcccg

SEQ ID NO: 341959 - RNA, 13 nt, Bordetella pertussis
uggccccgcgcga

SEQ ID NO: 341960 - RNA, 16 nt, Bordetella pertussis
uggcccgcaccgggcg

SEQ ID NO: 341961 - RNA, 19 nt, Bordetella pertussis
uggcccgcaccgggcggcc

SEQ ID NO: 341962 - RNA, 22 nt, Bordetella pertussis
uggcccgcagguggggcagcag

SEQ ID NO: 341963 - RNA, 13 nt, Bordetella pertussis
uggcccgccacca

SEQ ID NO: 341964 - RNA, 20 nt, Bordetella pertussis
uggcccgccagcaaggcggc

SEQ ID NO: 341965 - RNA, 18 nt, Bordetella pertussis
uggcccgcgugacggccg

SEQ ID NO: 341966 - RNA, 21 nt, Bordetella pertussis
uggcccgguuggggucgcgcu

SEQ ID NO: 341967 - RNA, 18 nt, Bordetella pertussis
uggcccugcagcggccag

SEQ ID NO: 341968 - RNA, 15 nt, Bordetella pertussis
uggcccuggcgggcc

SEQ ID NO: 341969 - RNA, 19 nt, Bordetella pertussis
uggcccuuggucugcaggc

SEQ ID NO: 341970 - RNA, 22 nt, Bordetella pertussis
uggccgaacgccgccgcagccg

SEQ ID NO: 341971 - RNA, 21 nt, Bordetella pertussis
uggccgacaugucgugcuggc

SEQ ID NO: 341972 - RNA, 17 nt, Bordetella pertussis
uggccgacgauggccgg

SEQ ID NO: 341973 - RNA, 22 nt, Bordetella pertussis
uggccgacggguggguggacag

SEQ ID NO: 341974 - RNA, 19 nt, Bordetella pertussis
uggccgaggugcccaucag

SEQ ID NO: 341975 - RNA, 13 nt, Bordetella pertussis
uggccgauggccu

SEQ ID NO: 341976 - RNA, 15 nt, Bordetella pertussis
uggccgauuccagcg

SEQ ID NO: 341977 - RNA, 15 nt, Bordetella pertussis
uggccgauucgaccu

SEQ ID NO: 341978 - RNA, 20 nt, Bordetella pertussis
uggccgauuucgcgcgccag

SEQ ID NO: 341979 - RNA, 23 nt, Bordetella pertussis
uggccgccacacgaggaccgcga

SEQ ID NO: 341980 - RNA, 15 nt, Bordetella pertussis
uggccgccaccagcg

SEQ ID NO: 341981 - RNA, 20 nt, Bordetella pertussis
uggccgccagcggcuggcgc

SEQ ID NO: 341982 - RNA, 21 nt, Bordetella pertussis
uggccgccagcggcuggcgcc

SEQ ID NO: 341983 - RNA, 23 nt, Bordetella pertussis
uggccgccagcggcuggcgccgu

SEQ ID NO: 341984 - RNA, 23 nt, Bordetella pertussis
uggccgccagcguaucgccgccg

SEQ ID NO: 341985 - RNA, 17 nt, Bordetella pertussis
uggccgccauggcgcug

SEQ ID NO: 341986 - RNA, 16 nt, Bordetella pertussis
uggccgcccgcggccu

SEQ ID NO: 341987 - RNA, 13 nt, Bordetella pertussis
uggccgcccagca

SEQ ID NO: 341988 - RNA, 15 nt, Bordetella pertussis
uggccgcccuggcgc

SEQ ID NO: 341989 - RNA, 16 nt, Bordetella pertussis
uggccgcccuggcgcg

SEQ ID NO: 341990 - RNA, 17 nt, Bordetella pertussis
uggccgcccuggcgcga

SEQ ID NO: 341991 - RNA, 23 nt, Bordetella pertussis
uggccgccgaacggcagcagcgc

SEQ ID NO: 341992 - RNA, 13 nt, Bordetella pertussis
uggccgccgcgcg

SEQ ID NO: 341993 - RNA, 16 nt, Bordetella pertussis
uggccgccgcgcgccg

SEQ ID NO: 341994 - RNA, 22 nt, Bordetella pertussis
uggccgccgcgggcgccgcgca

SEQ ID NO: 341995 - RNA, 15 nt, Bordetella pertussis
uggccgccggcgcgg

SEQ ID NO: 341996 - RNA, 23 nt, Bordetella pertussis
uggccgccggcgcgguggccaug

SEQ ID NO: 341997 - RNA, 14 nt, Bordetella pertussis
uggccgccggcggc

SEQ ID NO: 341998 - RNA, 20 nt, Bordetella pertussis
uggccgccugcugcgccguc

SEQ ID NO: 341999 - RNA, 16 nt, Bordetella pertussis
uggccggcaucgcgcu

SEQ ID NO: 342000 - RNA, 14 nt, Bordetella pertussis
uggccggccaacag

SEQ ID NO: 342001 - RNA, 12 nt, Bordetella pertussis
uggccggccugg

SEQ ID NO: 342002 - RNA, 18 nt, Bordetella pertussis
uggccggccuggcgcgca

SEQ ID NO: 342003 - RNA, 15 nt, Bordetella pertussis
uggccggcgacggca

SEQ ID NO: 342004 - RNA, 15 nt, Bordetella pertussis
uggccggccgccggg

SEQ ID NO: 342005 - RNA, 22 nt, Bordetella pertussis
uggccggccgcguggccgcgcu

SEQ ID NO: 342006 - RNA, 15 nt, Bordetella pertussis
uggccggcgcgaacc

SEQ ID NO: 342007 - RNA, 13 nt, Bordetella pertussis
uggccggcgcgcg

SEQ ID NO: 342008 - RNA, 20 nt, Bordetella pertussis
uggccggcgcggcagccugg

SEQ ID NO: 342009 - RNA, 17 nt, Bordetella pertussis
uggccggcguggccugc

SEQ ID NO: 342010 - RNA, 23 nt, Bordetella pertussis
uggccggcguguucagcgcgcgc

SEQ ID NO: 342011 - RNA, 14 nt, Bordetella pertussis
uggccgggccgugg

SEQ ID NO: 342012 - RNA, 16 nt, Bordetella pertussis
uggccgggccguggcg

SEQ ID NO: 342013 - RNA, 16 nt, Bordetella pertussis
uggccggggaagccgc

SEQ ID NO: 342014 - RNA, 20 nt, Bordetella pertussis
uggccggggaagccgccggc

SEQ ID NO: 342015 - RNA, 15 nt, Bordetella pertussis
uggccugcccuggac

SEQ ID NO: 342016 - RNA, 13 nt, Bordetella pertussis
uggccugcgccgc

SEQ ID NO: 342017 - RNA, 19 nt, Bordetella pertussis
uggccugcgccgccgcgcg

SEQ ID NO: 342018 - RNA, 17 nt, Bordetella pertussis
uggccugcuuggcgcgc

SEQ ID NO: 342019 - RNA, 18 nt, Bordetella pertussis
uggccugcuuggcgcgca

SEQ ID NO: 342020 - RNA, 16 nt, Bordetella pertussis
uggccugggccaggac

SEQ ID NO: 342021 - RNA, 12 nt, Bordetella pertussis
uggccugggcgc

SEQ ID NO: 342022 - RNA, 20 nt, Bordetella pertussis
uggccugguuggccgccugg

SEQ ID NO: 342023 - RNA, 15 nt, Bordetella pertussis
uggccuuccugcuga

SEQ ID NO: 342024 - RNA, 16 nt, Bordetella pertussis
uggccuucgaccugcc

SEQ ID NO: 342025 - RNA, 22 nt, Bordetella pertussis
uggccuucuucacguagccggc

SEQ ID NO: 342026 - RNA, 13 nt, Bordetella pertussis
uggccuugacggc

SEQ ID NO: 342027 - RNA, 15 nt, Bordetella pertussis
uggccuugcgcgucc

SEQ ID NO: 342028 - RNA, 17 nt, Bordetella pertussis
uggccuugcugcccgac

SEQ ID NO: 342029 - RNA, 22 nt, Bordetella pertussis
uggcgaacaguugcaccagugc

SEQ ID NO: 342030 - RNA, 24 nt, Bordetella pertussis
uggcgaacauguuguuggucgcca

SEQ ID NO: 342031 - RNA, 18 nt, Bordetella pertussis
uggcgaacgugcgcgcca

SEQ ID NO: 342032 - RNA, 14 nt, Bordetella pertussis
uggcgaaggccgcc

SEQ ID NO: 342033 - RNA, 20 nt, Bordetella pertussis
uggcgcaccaggcuggggcc

SEQ ID NO: 342034 - RNA, 14 nt, Bordetella pertussis
uggcgcacgccggg

SEQ ID NO: 342035 - RNA, 15 nt, Bordetella pertussis
uggcgcacgccgggc

SEQ ID NO: 342036 - RNA, 17 nt, Bordetella pertussis
uggcgcagaugggcggc

SEQ ID NO: 342037 - RNA, 20 nt, Bordetella pertussis
uggcgcagaugggcggcgac

SEQ ID NO: 342038 - RNA, 16 nt, Bordetella pertussis
uggcgcagcaaggcgc

SEQ ID NO: 342039 - RNA, 19 nt, Bordetella pertussis
uggcgcagcaaggcgcgcc

SEQ ID NO: 342040 - RNA, 13 nt, Bordetella pertussis
uggcgcagcacgc

SEQ ID NO: 342041 - RNA, 21 nt, Bordetella pertussis
uggcgcagcacgccgcgccag

SEQ ID NO: 342042 - RNA, 17 nt, Bordetella pertussis
uggcgcagcaggcgcgc

SEQ ID NO: 342043 - RNA, 20 nt, Bordetella pertussis
uggcgcaggaacucagcgca

SEQ ID NO: 342044 - RNA, 15 nt, Bordetella pertussis
uggcgcaggccggcg

SEQ ID NO: 342045 - RNA, 15 nt, Bordetella pertussis
uggcgcaggcgcgcc

SEQ ID NO: 342046 - RNA, 17 nt, Bordetella pertussis
uggcgcaggcgcgccag

SEQ ID NO: 342047 - RNA, 17 nt, Bordetella pertussis
uggcgcaggcgcgcgcc

SEQ ID NO: 342048 - RNA, 20 nt, Bordetella pertussis
uggcgcaguaucccggccag

SEQ ID NO: 342049 - RNA, 17 nt, Bordetella pertussis
uggcgcagugggccagu

SEQ ID NO: 342050 - RNA, 19 nt, Bordetella pertussis
uggcgcaugacggcgucga

SEQ ID NO: 342051 - RNA, 14 nt, Bordetella pertussis
uggcgcaugacggg

SEQ ID NO: 342052 - RNA, 17 nt, Bordetella pertussis
uggcgccagcccgcccg

SEQ ID NO: 342053 - RNA, 18 nt, Bordetella pertussis
uggcgccagcuggaccgc

SEQ ID NO: 342054 - RNA, 22 nt, Bordetella pertussis
uggcgcccggccugcgggcgcc

SEQ ID NO: 342055 - RNA, 23 nt, Bordetella pertussis
uggcgcccggccugcgggcgccg

SEQ ID NO: 342056 - RNA, 17 nt, Bordetella pertussis
uggcgccgaaggcggcg

SEQ ID NO: 342057 - RNA, 19 nt, Bordetella pertussis
uggcgccgaaggcggcgcc

SEQ ID NO: 342058 - RNA, 15 nt, Bordetella pertussis
uggcgcgaggcggcg

SEQ ID NO: 342059 - RNA, 17 nt, Bordetella pertussis
uggcgcgaggcggcgac

SEQ ID NO: 342060 - RNA, 22 nt, Bordetella pertussis
uggcgcgcaaccaggggcggcg

SEQ ID NO: 342061 - RNA, 17 nt, Bordetella pertussis
uggcgcgcaucggcgcc

SEQ ID NO: 342062 - RNA, 18 nt, Bordetella pertussis
uggcgcgcaucggcgccg

SEQ ID NO: 342063 - RNA, 20 nt, Bordetella pertussis
uggcgcgccaggaagcgcgc

SEQ ID NO: 342064 - RNA, 21 nt, Bordetella pertussis
uggcgcgccaggcgauggccg

SEQ ID NO: 342065 - RNA, 14 nt, Bordetella pertussis
uggcgcgcccacug

SEQ ID NO: 342066 - RNA, 23 nt, Bordetella pertussis
uggcgcgccgccucgcgcuccag

SEQ ID NO: 342067 - RNA, 20 nt, Bordetella pertussis
uggcgcgcggccugggcggc

SEQ ID NO: 342068 - RNA, 14 nt, Bordetella pertussis
uggcgcgcggcugg

SEQ ID NO: 342069 - RNA, 16 nt, Bordetella pertussis
uggcgcugcugcuggc

SEQ ID NO: 342070 - RNA, 13 nt, Bordetella pertussis
uggcgcuguuggc

SEQ ID NO: 342071 - RNA, 22 nt, Bordetella pertussis
uggcgcuguuuccgggccuggc

SEQ ID NO: 342072 - RNA, 19 nt, Bordetella pertussis
uggcgcuugugcgucggcu

SEQ ID NO: 342073 - RNA, 19 nt, Bordetella pertussis
uggcggaccgaacggccgg

SEQ ID NO: 342074 - RNA, 17 nt, Bordetella pertussis
uggcggaucucggccag

SEQ ID NO: 342075 - RNA, 22 nt, Bordetella pertussis
uggcggcacacgcagacuccag

SEQ ID NO: 342076 - RNA, 16 nt, Bordetella pertussis
uggcggcaggcgcgag

SEQ ID NO: 342077 - RNA, 16 nt, Bordetella pertussis
uggcggccaggcgcgc

SEQ ID NO: 342078 - RNA, 16 nt, Bordetella pertussis
uggcggccgccagcgc

SEQ ID NO: 342079 - RNA, 14 nt, Bordetella pertussis
uggcggccgcccag

SEQ ID NO: 342080 - RNA, 19 nt, Bordetella pertussis
uggcgguuguugcccaccg

SEQ ID NO: 342081 - RNA, 20 nt, Bordetella pertussis
uggcgguuguugcccaccgc

SEQ ID NO: 342082 - RNA, 19 nt, Bordetella pertussis
uggcguaauagcuggcggc

SEQ ID NO: 342083 - RNA, 20 nt, Bordetella pertussis
uggcguaauagcuggcggcg

SEQ ID NO: 342084 - RNA, 15 nt, Bordetella pertussis
uggcguacagcaggg

SEQ ID NO: 342085 - RNA, 23 nt, Bordetella pertussis
uggcguacggcugcaccaguuug

SEQ ID NO: 342086 - RNA, 14 nt, Bordetella pertussis
uggcguagccggaa

SEQ ID NO: 342087 - RNA, 13 nt, Bordetella pertussis
uggcguaggcggc

SEQ ID NO: 342088 - RNA, 15 nt, Bordetella pertussis
uggcguccaccuuga

SEQ ID NO: 342089 - RNA, 22 nt, Bordetella pertussis
uggcguccaccuugacgcgcag

SEQ ID NO: 342090 - RNA, 14 nt, Bordetella pertussis
uggcguccagcagc

SEQ ID NO: 342091 - RNA, 16 nt, Bordetella pertussis
uggcguccagcagcag

SEQ ID NO: 342092 - RNA, 15 nt, Bordetella pertussis
uggcguccagccugc

SEQ ID NO: 342093 - RNA, 19 nt, Bordetella pertussis
uggcguccaggcgcgccag

SEQ ID NO: 342094 - RNA, 19 nt, Bordetella pertussis
uggcguccaugcagguggc

SEQ ID NO: 342095 - RNA, 14 nt, Bordetella pertussis
uggcgucgaucaug

SEQ ID NO: 342096 - RNA, 18 nt, Bordetella pertussis
uggcgucgaucaugaugc

SEQ ID NO: 342097 - RNA, 17 nt, Bordetella pertussis
uggcgucgggggcggcc

SEQ ID NO: 342098 - RNA, 21 nt, Bordetella pertussis
uggcgucguccguggccggcg

SEQ ID NO: 342099 - RNA, 14 nt, Bordetella pertussis
uggcgucugcccgu

SEQ ID NO: 342100 - RNA, 20 nt, Bordetella pertussis
uggcgugcagguacugggcc

SEQ ID NO: 342101 - RNA, 22 nt, Bordetella pertussis
uggcgugcagguacugggccac

SEQ ID NO: 342102 - RNA, 17 nt, Bordetella pertussis
uggcguggugggcaccg

SEQ ID NO: 342103 - RNA, 22 nt, Bordetella pertussis
uggcguguccgccguagcgcgc

SEQ ID NO: 342104 - RNA, 23 nt, Bordetella pertussis
uggcguguccgccguagcgcgcc

SEQ ID NO: 342105 - RNA, 15 nt, Bordetella pertussis
uggcguggcgcgcgc

SEQ ID NO: 342106 - RNA, 18 nt, Bordetella pertussis
uggcgugucuccgggcgg

SEQ ID NO: 342107 - RNA, 19 nt, Bordetella pertussis
uggcgugucuccgggcggg

SEQ ID NO: 342108 - RNA, 21 nt, Bordetella pertussis
uggcguucgcggugggcagcg

SEQ ID NO: 342109 - RNA, 20 nt, Bordetella pertussis
uggcguugacggcccagcuc

SEQ ID NO: 342110 - RNA, 23 nt, Bordetella pertussis
uggcguugacguggcugagccau

SEQ ID NO: 342111 - RNA, 20 nt, Bordetella pertussis
uggcguugauguccggguug

SEQ ID NO: 342112 - RNA, 14 nt, Bordetella pertussis
uggcguuggccugc

SEQ ID NO: 342113 - RNA, 12 nt, Bordetella pertussis
uggcugagccau

SEQ ID NO: 342114 - RNA, 21 nt, Bordetella pertussis
uggcugagccauuccggcugg

SEQ ID NO: 342115 - RNA, 15 nt, Bordetella pertussis
uggcugcccuggcgc

SEQ ID NO: 342116 - RNA, 14 nt, Bordetella pertussis
uggcugcgcgccgu

SEQ ID NO: 342117 - RNA, 15 nt, Bordetella pertussis
uggcugcgcgccugg

SEQ ID NO: 342118 - RNA, 14 nt, Bordetella pertussis
ugggaagacuucgu

SEQ ID NO: 342119 - RNA, 19 nt, Bordetella pertussis
ugggacaggcacaccgugg

SEQ ID NO: 342120 - RNA, 18 nt, Bordetella pertussis
ugggacgccagcccgccg

SEQ ID NO: 342121 - RNA, 18 nt, Bordetella pertussis
ugggcagcggcaucacgc

SEQ ID NO: 342122 - RNA, 20 nt, Bordetella pertussis
ugggcagcggcaucacgccg

SEQ ID NO: 342123 - RNA, 23 nt, Bordetella pertussis
ugggcaggugcuuggcggucugg

SEQ ID NO: 342124 - RNA, 23 nt, Bordetella pertussis
ugggcaucaggggcucggccagg

SEQ ID NO: 342125 - RNA, 17 nt, Bordetella pertussis
ugggcaugguggcgaag

SEQ ID NO: 342126 - RNA, 20 nt, Bordetella pertussis
ugggcauuucccagccgucg

SEQ ID NO: 342127 - RNA, 22 nt, Bordetella pertussis
ugggccacagggcgaaggccag

SEQ ID NO: 342128 - RNA, 19 nt, Bordetella pertussis
ugggccacucgaugggcgc

SEQ ID NO: 342129 - RNA, 24 nt, Bordetella pertussis
ugggccagauagucgcggaugcgc

SEQ ID NO: 342130 - RNA, 15 nt, Bordetella pertussis
ugggccagcaucggc

SEQ ID NO: 342131 - RNA, 14 nt, Bordetella pertussis
ugggccucggccag

SEQ ID NO: 342132 - RNA, 14 nt, Bordetella pertussis
ugggccugcggcgu

SEQ ID NO: 342133 - RNA, 17 nt, Bordetella pertussis
ugggccugcggcgucag

SEQ ID NO: 342134 - RNA, 13 nt, Bordetella pertussis
ugggccugggcgc

SEQ ID NO: 342135 - RNA, 16 nt, Bordetella pertussis
ugggcgaacuggucga

SEQ ID NO: 342136 - RNA, 19 nt, Bordetella pertussis
ugggcgaagccacggcccg

SEQ ID NO: 342137 - RNA, 23 nt, Bordetella pertussis
ugggcgaagccacggcccgccag

SEQ ID NO: 342138 - RNA, 15 nt, Bordetella pertussis
ugggcgacgcggcgu

SEQ ID NO: 342139 - RNA, 13 nt, Bordetella pertussis
ugggcgagcaggc

SEQ ID NO: 342140 - RNA, 18 nt, Bordetella pertussis
ugggcgagguagggcgcg

SEQ ID NO: 342141 - RNA, 11 nt, Bordetella pertussis
ugggcggcgua

SEQ ID NO: 342142 - RNA, 18 nt, Bordetella pertussis
ugggcggcguagagcgcc

SEQ ID NO: 342143 - RNA, 20 nt, Bordetella pertussis
ugggcgucgaaggcggccgg

SEQ ID NO: 342144 - RNA, 18 nt, Bordetella pertussis
ugggcguggcgcgcgugc

SEQ ID NO: 342145 - RNA, 14 nt, Bordetella pertussis
ugggcgugcccuug

SEQ ID NO: 342146 - RNA, 17 nt, Bordetella pertussis
ugggcguucucguuggg

SEQ ID NO: 342147 - RNA, 16 nt, Bordetella pertussis
uggggcgaggggggcg

SEQ ID NO: 342148 - RNA, 12 nt, Bordetella pertussis
uggggcgggcgc

SEQ ID NO: 342149 - RNA, 16 nt, Bordetella pertussis
uggggcgggcgggcgc

SEQ ID NO: 342150 - RNA, 22 nt, Bordetella pertussis
uggggcgguggucaucgaugcg

SEQ ID NO: 342151 - RNA, 21 nt, Bordetella pertussis
uggggcggccgggagccuguc

SEQ ID NO: 342152 - RNA, 15 nt, Bordetella pertussis
uggggcuggccgccg

SEQ ID NO: 342153 - RNA, 23 nt, Bordetella pertussis
ugggggcccacaugccgugccag

SEQ ID NO: 342154 - RNA, 20 nt, Bordetella pertussis
ugggggcgaagacgauggcg

SEQ ID NO: 342155 - RNA, 14 nt, Bordetella pertussis
ugggggcuggcgcu

SEQ ID NO: 342156 - RNA, 17 nt, Bordetella pertussis
uggggguucgugggcga

SEQ ID NO: 342157 - RNA, 13 nt, Bordetella pertussis
ugggguggagcgc

SEQ ID NO: 342158 - RNA, 15 nt, Bordetella pertussis
uggguggcggggcgc

SEQ ID NO: 342159 - RNA, 20 nt, Bordetella pertussis
uggguguggccaugcaccag

SEQ ID NO: 342160 - RNA, 14 nt, Bordetella pertussis
uggugcgggccgcg

SEQ ID NO: 342161 - RNA, 15 nt, Bordetella pertussis
uggugcgggccgcgc

SEQ ID NO: 342162 - RNA, 14 nt, Bordetella pertussis
uggugcugcugggc

SEQ ID NO: 342163 - RNA, 16 nt, Bordetella pertussis
uggugcugcugggcgc

SEQ ID NO: 342164 - RNA, 18 nt, Bordetella pertussis
uggugcuggugcuggugc

SEQ ID NO: 342165 - RNA, 21 nt, Bordetella pertussis
uggugcuggugcuggugccgc

SEQ ID NO: 342166 - RNA, 18 nt, Bordetella pertussis
ugguggcagagggcgacg

SEQ ID NO: 342167 - RNA, 20 nt, Bordetella pertussis
ugguggccuugcugcccgac

SEQ ID NO: 342168 - RNA, 15 nt, Bordetella pertussis
uggugggccgacggc

SEQ ID NO: 342169 - RNA, 15 nt, Bordetella pertussis
ugguggucuggucgc

SEQ ID NO: 342170 - RNA, 19 nt, Bordetella pertussis
uguacaagcgcacgcuggg

SEQ ID NO: 342171 - RNA, 19 nt, Bordetella pertussis
uguaccgggccgacgcgcc

SEQ ID NO: 342172 - RNA, 21 nt, Bordetella pertussis
uguaccucagccugcuggugc

SEQ ID NO: 342173 - RNA, 13 nt, Bordetella pertussis
uguacgacagcaa

SEQ ID NO: 342174 - RNA, 21 nt, Bordetella pertussis
uguacgcaucggcgccggcgu

SEQ ID NO: 342175 - RNA, 14 nt, Bordetella pertussis
uguacucggccagg

SEQ ID NO: 342176 - RNA, 18 nt, Bordetella pertussis
uguacuggucgcgcagcu

SEQ ID NO: 342177 - RNA, 19 nt, Bordetella pertussis
uguagagcaggccgcccag

SEQ ID NO: 342178 - RNA, 15 nt, Bordetella pertussis
uguagaucuggcgcg

SEQ ID NO: 342179 - RNA, 18 nt, Bordetella pertussis
uguagcccuggcgcugca

SEQ ID NO: 342180 - RNA, 15 nt, Bordetella pertussis
uguagcugcccgcga

SEQ ID NO: 342181 - RNA, 23 nt, Bordetella pertussis
uguccaagcgcguggccaucaac

SEQ ID NO: 342182 - RNA, 13 nt, Bordetella pertussis
uguccagcgccag

SEQ ID NO: 342183 - RNA, 15 nt, Bordetella pertussis
uguccagcgccagca

SEQ ID NO: 342184 - RNA, 23 nt, Bordetella pertussis
ugucccggcggggcaggcgccug

SEQ ID NO: 342185 - RNA, 18 nt, Bordetella pertussis
ugucccggcugggacagg

SEQ ID NO: 342186 - RNA, 20 nt, Bordetella pertussis
ugucccggcugggacaggca

SEQ ID NO: 342187 - RNA, 20 nt, Bordetella pertussis
ugucccugccgggacaggca

SEQ ID NO: 342188 - RNA, 13 nt, Bordetella pertussis
uguccgaugcgcu

SEQ ID NO: 342189 - RNA, 20 nt, Bordetella pertussis
uguccgccguagcgcgccag

SEQ ID NO: 342190 - RNA, 21 nt, Bordetella pertussis
uguccgccugcggacggcggg

SEQ ID NO: 342191 - RNA, 13 nt, Bordetella pertussis
ugucgaccaguug

SEQ ID NO: 342192 - RNA, 16 nt, Bordetella pertussis
ugucgagcaggccgcc

SEQ ID NO: 342193 - RNA, 17 nt, Bordetella pertussis
ugucgagcgcgaugcca

SEQ ID NO: 342194 - RNA, 21 nt, Bordetella pertussis
ugucgagguaagugggcugcg

SEQ ID NO: 342195 - RNA, 14 nt, Bordetella pertussis
ugucgcgcaccgcc

SEQ ID NO: 342196 - RNA, 15 nt, Bordetella pertussis
ugucgcgcaccgccu

SEQ ID NO: 342197 - RNA, 18 nt, Bordetella pertussis
ugucgcgcccgauggugc

SEQ ID NO: 342198 - RNA, 19 nt, Bordetella pertussis
ugucgcgccgcgaugcacg

SEQ ID NO: 342199 - RNA, 13 nt, Bordetella pertussis
ugucgcgcgccug

SEQ ID NO: 342200 - RNA, 19 nt, Bordetella pertussis
ugucgcgcgccugcgcgcc

SEQ ID NO: 342201 - RNA, 11 nt, Bordetella pertussis
ugucgcgcgcg

SEQ ID NO: 342202 - RNA, 16 nt, Bordetella pertussis
ugucgcgcgcgcucag

SEQ ID NO: 342203 - RNA, 22 nt, Bordetella pertussis
ugucgcgcgcgcucagggggcg

SEQ ID NO: 342204 - RNA, 19 nt, Bordetella pertussis
ugucgcggcccacggccag

SEQ ID NO: 342205 - RNA, 21 nt, Bordetella pertussis
ugucgcggcccacggccagca

SEQ ID NO: 342206 - RNA, 22 nt, Bordetella pertussis
ugucgcggcccacggccagcac

SEQ ID NO: 342207 - RNA, 22 nt, Bordetella pertussis
ugucgcgggcccgcucggccag

SEQ ID NO: 342208 - RNA, 13 nt, Bordetella pertussis
ugugcacgugcga

SEQ ID NO: 342209 - RNA, 13 nt, Bordetella pertussis
ugugcaugcgcgc

SEQ ID NO: 342210 - RNA, 17 nt, Bordetella pertussis
ugugccaccgcccaggc

SEQ ID NO: 342211 - RNA, 22 nt, Bordetella pertussis
uguggcgggucccaaccagggc

SEQ ID NO: 342212 - RNA, 22 nt, Bordetella pertussis
uguggucggcgaccgugcgcca

SEQ ID NO: 342213 - RNA, 15 nt, Bordetella pertussis
uguggugaaagccgc

SEQ ID NO: 342214 - RNA, 15 nt, Bordetella pertussis
ugugguuggcgcugc

SEQ ID NO: 342215 - RNA, 14 nt, Bordetella pertussis
uguucacgcccagg

SEQ ID NO: 342216 - RNA, 18 nt, Bordetella pertussis
uguucagcuucagccugg

SEQ ID NO: 342217 - RNA, 21 nt, Bordetella pertussis
uguucagguguucgcgcacca

SEQ ID NO: 342218 - RNA, 19 nt, Bordetella pertussis
uguuccggcuggauggugc

SEQ ID NO: 342219 - RNA, 14 nt, Bordetella pertussis
uguuccugcgcgac

SEQ ID NO: 342220 - RNA, 13 nt, Bordetella pertussis
uguucgcgcagca

SEQ ID NO: 342221 - RNA, 21 nt, Bordetella pertussis
uguucgcgcagcaggccgcgc

SEQ ID NO: 342222 - RNA, 14 nt, Bordetella pertussis
uguucgcgcgcggu

SEQ ID NO: 342223 - RNA, 23 nt, Bordetella pertussis
uguucgcgcgcgguauccagguc

SEQ ID NO: 342224 - RNA, 19 nt, Bordetella pertussis
uguucgugauccugaccau

SEQ ID NO: 342225 - RNA, 21 nt, Bordetella pertussis
uguugcauucccggaccgcgc

SEQ ID NO: 342226 - RNA, 16 nt, Bordetella pertussis
uguugcccaccgccag

SEQ ID NO: 342227 - RNA, 13 nt, Bordetella pertussis
uguugcgcgccgu

SEQ ID NO: 342228 - RNA, 14 nt, Bordetella pertussis
uguugcuuggcguc

SEQ ID NO: 342229 - RNA, 16 nt, Bordetella pertussis
uguuggccgucgccag

SEQ ID NO: 342230 - RNA, 21 nt, Bordetella pertussis
uguugggccaccuggcagccg

SEQ ID NO: 342231 - RNA, 11 nt, Bordetella pertussis
uuacagcuuuu

SEQ ID NO: 342232 - RNA, 20 nt, Bordetella pertussis
uucaaccggcguucuggcgc

SEQ ID NO: 342233 - RNA, 19 nt, Bordetella pertussis
uucacauagcccggcgcga

SEQ ID NO: 342234 - RNA, 18 nt, Bordetella pertussis
uucaccaggaagcgcgcc

SEQ ID NO: 342235 - RNA, 18 nt, Bordetella pertussis
uucagacugcugccggau

SEQ ID NO: 342236 - RNA, 13 nt, Bordetella pertussis
uucaggcgccgca

SEQ ID NO: 342237 - RNA, 13 nt, Bordetella pertussis
uucaggcgcgcgg

SEQ ID NO: 342238 - RNA, 16 nt, Bordetella pertussis
uucaggcgcgcggcag

SEQ ID NO: 342239 - RNA, 13 nt, Bordetella pertussis
uucagggcgccgg

SEQ ID NO: 342240 - RNA, 12 nt, Bordetella pertussis
uucaggucgcga

SEQ ID NO: 342241 - RNA, 18 nt, Bordetella pertussis
uucagguguucgcgcacc

SEQ ID NO: 342242 - RNA, 21 nt, Bordetella pertussis
uucagugcucgggcugcggcu

SEQ ID NO: 342243 - RNA, 17 nt, Bordetella pertussis
uucaucacgggcgccag

SEQ ID NO: 342244 - RNA, 15 nt, Bordetella pertussis
uucaucagcgcgcgc

SEQ ID NO: 342245 - RNA, 16 nt, Bordetella pertussis
uucauccagcgcgcga

SEQ ID NO: 342246 - RNA, 18 nt, Bordetella pertussis
uuccaagcgcacgcgcag

SEQ ID NO: 342247 - RNA, 20 nt, Bordetella pertussis
uuccaagcgcacgcgcagca

SEQ ID NO: 342248 - RNA, 16 nt, Bordetella pertussis
uuccagaugcgcagca

SEQ ID NO: 342249 - RNA, 17 nt, Bordetella pertussis
uuccagcucguccaggu

SEQ ID NO: 342250 - RNA, 17 nt, Bordetella pertussis
uuccaggacgacaggca

SEQ ID NO: 342251 - RNA, 17 nt, Bordetella pertussis
uuccgccuacuggcgcg

SEQ ID NO: 342252 - RNA, 16 nt, Bordetella pertussis
uuccgcuaccaggcgc

SEQ ID NO: 342253 - RNA, 20 nt, Bordetella pertussis
uuccgcuuccggccgggcca

SEQ ID NO: 342254 - RNA, 21 nt, Bordetella pertussis
uuccggcagcggccagcgcgg

SEQ ID NO: 342255 - RNA, 21 nt, Bordetella pertussis
uugaacagcuggaagcgcgcc

SEQ ID NO: 342256 - RNA, 16 nt, Bordetella pertussis
uugaacuccgcggcgu

SEQ ID NO: 342257 - RNA, 16 nt, Bordetella pertussis
uugaagacgcccaggu

SEQ ID NO: 342258 - RNA, 19 nt, Bordetella pertussis
uugaaggccgaggccaggu

SEQ ID NO: 342259 - RNA, 18 nt, Bordetella pertussis
uugaaguaaucgcccggc

SEQ ID NO: 342260 - RNA, 15 nt, Bordetella pertussis
uugaaguugcucggc

SEQ ID NO: 342261 - RNA, 14 nt, Bordetella pertussis
uugaccgccagcau

SEQ ID NO: 342262 - RNA, 13 nt, Bordetella pertussis
uugacgcgcgcgg

SEQ ID NO: 342263 - RNA, 17 nt, Bordetella pertussis
uugacggggacgccggc

SEQ ID NO: 342264 - RNA, 17 nt, Bordetella pertussis
uugagcgccagcucggc

SEQ ID NO: 342265 - RNA, 21 nt, Bordetella pertussis
uugagcgccggggcguggccg

SEQ ID NO: 342266 - RNA, 20 nt, Bordetella pertussis
uugagcgcggccucgccggc

SEQ ID NO: 342267 - RNA, 16 nt, Bordetella pertussis
uugaggccagcacgcc

SEQ ID NO: 342268 - RNA, 13 nt, Bordetella pertussis
uugaugcccagcu

SEQ ID NO: 342269 - RNA, 14 nt, Bordetella pertussis
uugaugccgucggc

SEQ ID NO: 342270 - RNA, 18 nt, Bordetella pertussis
uugauggccagcgcgcgg

SEQ ID NO: 342271 - RNA, 14 nt, Bordetella pertussis
uugcacaacgggca

SEQ ID NO: 342272 - RNA, 20 nt, Bordetella pertussis
uugcaccagugcgccggcgc

SEQ ID NO: 342273 - RNA, 12 nt, Bordetella pertussis
uugcacgccggc

SEQ ID NO: 342274 - RNA, 19 nt, Bordetella pertussis
uugcacggugccgcgcgcu

SEQ ID NO: 342275 - RNA, 14 nt, Bordetella pertussis
uugcagcagcacgc

SEQ ID NO: 342276 - RNA, 18 nt, Bordetella pertussis
uugcagcgcgccaggcgc

SEQ ID NO: 342277 - RNA, 15 nt, Bordetella pertussis
uugcaguucgccggc

SEQ ID NO: 342278 - RNA, 17 nt, Bordetella pertussis
uugcaguucgccggcgc

SEQ ID NO: 342279 - RNA, 13 nt, Bordetella pertussis
uugccacggcggg

SEQ ID NO: 342280 - RNA, 23 nt, Bordetella pertussis
uugccacuauuuucagaagcgcc

SEQ ID NO: 342281 - RNA, 18 nt, Bordetella pertussis
uugccagggccuggcaca

SEQ ID NO: 342282 - RNA, 14 nt, Bordetella pertussis
uugcccacgcgcuc

SEQ ID NO: 342283 - RNA, 12 nt, Bordetella pertussis
uugcccagcacc

SEQ ID NO: 342284 - RNA, 15 nt, Bordetella pertussis
uugcccagcagcucc

SEQ ID NO: 342285 - RNA, 13 nt, Bordetella pertussis
uugccccagcacg

SEQ ID NO: 342286 - RNA, 18 nt, Bordetella pertussis
uugccccgauccgcgggc

SEQ ID NO: 342287 - RNA, 14 nt, Bordetella pertussis
uugcccgcccgacg

SEQ ID NO: 342288 - RNA, 12 nt, Bordetella pertussis
uugcccuggcca

SEQ ID NO: 342289 - RNA, 16 nt, Bordetella pertussis
uugccgaagcgucggc

SEQ ID NO: 342290 - RNA, 23 nt, Bordetella pertussis
uugccgaugcgguaggcccagca

SEQ ID NO: 342291 - RNA, 23 nt, Bordetella pertussis
uugccgcacgaucgcgccggccu

SEQ ID NO: 342292 - RNA, 19 nt, Bordetella pertussis
uugccgccgccgcgcgcgg

SEQ ID NO: 342293 - RNA, 15 nt, Bordetella pertussis
uugccgcgaggcgca

SEQ ID NO: 342294 - RNA, 13 nt, Bordetella pertussis
uugccgcgcgcga

SEQ ID NO: 342295 - RNA, 17 nt, Bordetella pertussis
uugccgcggcgcggccu

SEQ ID NO: 342296 - RNA, 17 nt, Bordetella pertussis
uugccgcuggacgcgcc

SEQ ID NO: 342297 - RNA, 13 nt, Bordetella pertussis
uugccggccagca

SEQ ID NO: 342298 - RNA, 21 nt, Bordetella pertussis
uugccggccaggacgaucccg

SEQ ID NO: 342299 - RNA, 20 nt, Bordetella pertussis
uugccggcgaucacgccgaa

SEQ ID NO: 342300 - RNA, 15 nt, Bordetella pertussis
uugccggugcucggc

SEQ ID NO: 342301 - RNA, 20 nt, Bordetella pertussis
uugccguacgagugcaggcc

SEQ ID NO: 342302 - RNA, 16 nt, Bordetella pertussis
uugccuuggggcggcc

SEQ ID NO: 342303 - RNA, 19 nt, Bordetella pertussis
uugcgaacggccgcccggc

SEQ ID NO: 342304 - RNA, 22 nt, Bordetella pertussis
uugcgcaagccggccgcgcggc

SEQ ID NO: 342305 - RNA, 21 nt, Bordetella pertussis
uugcgcaccccggugucgccg

SEQ ID NO: 342306 - RNA, 21 nt, Bordetella pertussis
uugcgccacggucugcacgcc

SEQ ID NO: 342307 - RNA, 16 nt, Bordetella pertussis
uugcgcccgcaucggc

SEQ ID NO: 342308 - RNA, 22 nt, Bordetella pertussis
uugcgcccgcaucggcuggcgc

SEQ ID NO: 342309 - RNA, 22 nt, Bordetella pertussis
uugcgccggcgcuacagggugc

SEQ ID NO: 342310 - RNA, 21 nt, Bordetella pertussis
uugcgccgcaacgccgccggc

SEQ ID NO: 342311 - RNA, 18 nt, Bordetella pertussis
uugcgcgaaggccgcccc

SEQ ID NO: 342312 - RNA, 19 nt, Bordetella pertussis
uugcgcgccagcucgcgca

SEQ ID NO: 342313 - RNA, 13 nt, Bordetella pertussis
uugcgcggccaug

SEQ ID NO: 342314 - RNA, 16 nt, Bordetella pertussis
uugcgcguccaggcca

SEQ ID NO: 342315 - RNA, 16 nt, Bordetella pertussis
uugcgcuggcgcgcgg

SEQ ID NO: 342316 - RNA, 17 nt, Bordetella pertussis
uugcgcuggcgcgcggc

SEQ ID NO: 342317 - RNA, 15 nt, Bordetella pertussis
uugcggcccuugcgc

SEQ ID NO: 342318 - RNA, 13 nt, Bordetella pertussis
uugcggcaggugc

SEQ ID NO: 342319 - RNA, 13 nt, Bordetella pertussis
uugcggcgcuggc

SEQ ID NO: 342320 - RNA, 14 nt, Bordetella pertussis
uugcggcgcuuggc

SEQ ID NO: 342321 - RNA, 14 nt, Bordetella pertussis
uugcggcgggcggg

SEQ ID NO: 342322 - RNA, 13 nt, Bordetella pertussis
uugcgggcgcgcu

SEQ ID NO: 342323 - RNA, 12 nt, Bordetella pertussis
uugcggggcgcg

SEQ ID NO: 342324 - RNA, 23 nt, Bordetella pertussis
uugcgggugggcauccagcggca

SEQ ID NO: 342325 - RNA, 23 nt, Bordetella pertussis
uugcgguccaugucggccgacca

SEQ ID NO: 342326 - RNA, 19 nt, Bordetella pertussis
uugcgucuccagcgcggcg

SEQ ID NO: 342327 - RNA, 15 nt, Bordetella pertussis
uugcucgugcuggcc

SEQ ID NO: 342328 - RNA, 18 nt, Bordetella pertussis
uugcugaaccugcuggcc

SEQ ID NO: 342329 - RNA, 15 nt, Bordetella pertussis
uugcugcugcuggcu

SEQ ID NO: 342330 - RNA, 19 nt, Bordetella pertussis
uugcuggcaaagcgcgcgu

SEQ ID NO: 342331 - RNA, 14 nt, Bordetella pertussis
uugcuggcccagga

SEQ ID NO: 342332 - RNA, 22 nt, Bordetella pertussis
uuggaccccaguuccagcacga

SEQ ID NO: 342333 - RNA, 21 nt, Bordetella pertussis
uuggcaaccucgccgcgccag

SEQ ID NO: 342334 - RNA, 22 nt, Bordetella pertussis
uuggcaaggcccgccgcggcag

SEQ ID NO: 342335 - RNA, 14 nt, Bordetella pertussis
uuggccaaugcgcc

SEQ ID NO: 342336 - RNA, 19 nt, Bordetella pertussis
uuggccaaugcgccgcgcc

SEQ ID NO: 342337 - RNA, 18 nt, Bordetella pertussis
uuggccacuuccagcgcc

SEQ ID NO: 342338 - RNA, 15 nt, Bordetella pertussis
uuggccacuucgccg

SEQ ID NO: 342339 - RNA, 10 nt, Bordetella pertussis
uuggccagcg

SEQ ID NO: 342340 - RNA, 20 nt, Bordetella pertussis
uuggccagcgcgacggccuc

SEQ ID NO: 342341 - RNA, 14 nt, Bordetella pertussis
uuggccagcgcgcc

SEQ ID NO: 342342 - RNA, 19 nt, Bordetella pertussis
uuggcccugcagcggccag

SEQ ID NO: 342343 - RNA, 15 nt, Bordetella pertussis
uuggccgcagccggc

SEQ ID NO: 342344 - RNA, 17 nt, Bordetella pertussis
uuggccgcccuggcgcg

SEQ ID NO: 342345 - RNA, 18 nt, Bordetella pertussis
uuggccgccaggacuucg

SEQ ID NO: 342346 - RNA, 11 nt, Bordetella pertussis
uuggccgcgcg

SEQ ID NO: 342347 - RNA, 14 nt, Bordetella pertussis
uuggccgcgcgccg

SEQ ID NO: 342348 - RNA, 14 nt, Bordetella pertussis
uuggccggcgcgcc

SEQ ID NO: 342349 - RNA, 15 nt, Bordetella pertussis
uuggccggcgcgccc

SEQ ID NO: 342350 - RNA, 16 nt, Bordetella pertussis
uuggccuucggcgauc

SEQ ID NO: 342351 - RNA, 18 nt, Bordetella pertussis
uuggccuugcgcguccag

SEQ ID NO: 342352 - RNA, 17 nt, Bordetella pertussis
uuggccuuggcggcccc

SEQ ID NO: 342353 - RNA, 20 nt, Bordetella pertussis
uuggcgaacgugcgcgccag

SEQ ID NO: 342354 - RNA, 13 nt, Bordetella pertussis
uugggcgcgccca

SEQ ID NO: 342355 - RNA, 18 nt, Bordetella pertussis
uugguggggucgaugcca

SEQ ID NO: 342356 - RNA, 15 nt, Bordetella pertussis
uugucaagcagcgcc

SEQ ID NO: 342357 - RNA, 12 nt, Bordetella pertussis
uuguccagguug

SEQ ID NO: 342358 - RNA, 22 nt, Bordetella pertussis
uugugcugccaugccgcgcgcc

SEQ ID NO: 342359 - RNA, 19 nt, Bordetella pertussis
uuuccgcuaccaggcgcgc

SEQ ID NO: 342360 - RNA, 13 nt, Bordetella pertussis
uuucgaugcgcac

SEQ ID NO: 342361 - RNA, 18 nt, Bordetella pertussis
uuucgcagcggaugccgc

SEQ ID NO: 342362 - RNA, 20 nt, Bordetella pertussis
uuucgcccgcccacauggcg

SEQ ID NO: 342363 - RNA, 13 nt, Bordetella pertussis
uuucggagcggcu

SEQ ID NO: 342364 - RNA, 20 nt, Bordetella pertussis
uuugcccaguacgaugccgu

SEQ ID NO: 342365 - RNA, 22 nt, Bordetella pertussis
aaacaggcccacggcaucgccg

SEQ ID NO: 342366 - RNA, 14 nt, Bordetella pertussis
aaacaggcgccguc

SEQ ID NO: 342367 - RNA, 14 nt, Bordetella pertussis
aaacccucgugauc

SEQ ID NO: 342368 - RNA, 19 nt, Bordetella pertussis
aaaccgcucguaucgcccu

SEQ ID NO: 342369 - RNA, 22 nt, Bordetella pertussis
aaaccgucgaugaccagcgccg

SEQ ID NO: 342370 - RNA, 20 nt, Bordetella pertussis
aaacggccaagcagcgccug

SEQ ID NO: 342371 - RNA, 20 nt, Bordetella pertussis
aaacggccgggucccuggcc

SEQ ID NO: 342372 - RNA, 13 nt, Bordetella pertussis
aaagagccugucc

SEQ ID NO: 342373 - RNA, 22 nt, Bordetella pertussis
aaagcggcgauccgccgcggcc

SEQ ID NO: 342374 - RNA, 22 nt, Bordetella pertussis
aaagcggguugcggcagcgccg

SEQ ID NO: 342375 - RNA, 15 nt, Bordetella pertussis
aaagcguuccagcag

SEQ ID NO: 342376 - RNA, 22 nt, Bordetella pertussis
aaaucccccgcgucggacgcgc

SEQ ID NO: 342377 - RNA, 19 nt, Bordetella pertussis
aaaugccgaagcgcgcgug

SEQ ID NO: 342378 - RNA, 17 nt, Bordetella pertussis
aacaccaccgagggccg

SEQ ID NO: 342379 - RNA, 22 nt, Bordetella pertussis
aacaccaggguggcgccggcca

SEQ ID NO: 342380 - RNA, 16 nt, Bordetella pertussis
aacaccgccgcgccgc

SEQ ID NO: 342381 - RNA, 19 nt, Bordetella pertussis
aacaccggcaggccgcgcu

SEQ ID NO: 342382 - RNA, 22 nt, Bordetella pertussis
aacaccggcaggccgcgcugcc

SEQ ID NO: 342383 - RNA, 15 nt, Bordetella pertussis
aacacgaccagcagg

SEQ ID NO: 342384 - RNA, 14 nt, Bordetella pertussis
aaccggcgcgcgcg

SEQ ID NO: 342385 - RNA, 22 nt, Bordetella pertussis
aaccgguggugcugcugggcgc

SEQ ID NO: 342386 - RNA, 18 nt, Bordetella pertussis
aaccgucgaugaccagcg

SEQ ID NO: 342387 - RNA, 14 nt, Bordetella pertussis
aaccucgccgcgcc

SEQ ID NO: 342388 - RNA, 21 nt, Bordetella pertussis
aaccucgccgcgccagcugcg

SEQ ID NO: 342389 - RNA, 12 nt, Bordetella pertussis
aaccuggcgcgc

SEQ ID NO: 342390 - RNA, 18 nt, Bordetella pertussis
aacgacgcaggcgccgca

SEQ ID NO: 342391 - RNA, 17 nt, Bordetella pertussis
aacgagccggccgcgcc

SEQ ID NO: 342392 - RNA, 20 nt, Bordetella pertussis
aacgccagggucugcugguc

SEQ ID NO: 342393 - RNA, 22 nt, Bordetella pertussis
aacgccagggucugcuggucgc

SEQ ID NO: 342394 - RNA, 14 nt, Bordetella pertussis
aacgcccggcgcgg

SEQ ID NO: 342395 - RNA, 13 nt, Bordetella pertussis
aacgcccugacga

SEQ ID NO: 342396 - RNA, 15 nt, Bordetella pertussis
aacgccugccagaac

SEQ ID NO: 342397 - RNA, 13 nt, Bordetella pertussis
aacgcggcgccgc

SEQ ID NO: 342398 - RNA, 16 nt, Bordetella pertussis
aacgcgguggcguugg

SEQ ID NO: 342399 - RNA, 20 nt, Bordetella pertussis
aacgcguaggucaggcccac

SEQ ID NO: 342400 - RNA, 17 nt, Bordetella pertussis
aacgcguucaagucgcc

SEQ ID NO: 342401 - RNA, 15 nt, Bordetella pertussis
aacggcagcgcgcgc

SEQ ID NO: 342402 - RNA, 15 nt, Bordetella pertussis
aacggccccgccagg

SEQ ID NO: 342403 - RNA, 17 nt, Bordetella pertussis
aacggccggucagccca

SEQ ID NO: 342404 - RNA, 18 nt, Bordetella pertussis
aacggccuucggcggcgc

SEQ ID NO: 342405 - RNA, 20 nt, Bordetella pertussis
aacggccuucggcggcgcgc

SEQ ID NO: 342406 - RNA, 11 nt, Bordetella pertussis
aacggcgcggg

SEQ ID NO: 342407 - RNA, 19 nt, Bordetella pertussis
aacggcgcgggaauauccg

SEQ ID NO: 342408 - RNA, 20 nt, Bordetella pertussis
aacuccaggaaagcgccgcc

SEQ ID NO: 342409 - RNA, 13 nt, Bordetella pertussis
aacucgaggcggc

SEQ ID NO: 342410 - RNA, 15 nt, Bordetella pertussis
aacucgaggcggcgc

SEQ ID NO: 342411 - RNA, 16 nt, Bordetella pertussis
aacucgauggccucgg

SEQ ID NO: 342412 - RNA, 21 nt, Bordetella pertussis
aacucgggguggaacugggcu

SEQ ID NO: 342413 - RNA, 14 nt, Bordetella pertussis
aacugccggcgcgg

SEQ ID NO: 342414 - RNA, 17 nt, Bordetella pertussis
aacugccggcgcgggcg

SEQ ID NO: 342415 - RNA, 23 nt, Bordetella pertussis
aacugccggcgcgggcgcaggcg

SEQ ID NO: 342416 - RNA, 12 nt, Bordetella pertussis
aacuggugcccg

SEQ ID NO: 342417 - RNA, 18 nt, Bordetella pertussis
aacugucgcgccacggcu

SEQ ID NO: 342418 - RNA, 13 nt, Bordetella pertussis
aacuuggcgcggu

SEQ ID NO: 342419 - RNA, 17 nt, Bordetella pertussis
aacuugggaucggccag

SEQ ID NO: 342420 - RNA, 22 nt, Bordetella pertussis
aagacauggcgcgcgccagcgg

SEQ ID NO: 342421 - RNA, 18 nt, Bordetella pertussis
aagaccgugaucggcgca

SEQ ID NO: 342422 - RNA, 21 nt, Bordetella pertussis
aagacgcccaggcccaccgca

SEQ ID NO: 342423 - RNA, 12 nt, Bordetella pertussis
aagacgccuguc

SEQ ID NO: 342424 - RNA, 19 nt, Bordetella pertussis
aagccagauaaaggccgca

SEQ ID NO: 342425 - RNA, 21 nt, Bordetella pertussis
aagccagauaaaggccgcaac

SEQ ID NO: 342426 - RNA, 23 nt, Bordetella pertussis
aagccgauccgcgacgcccuggc

SEQ ID NO: 342427 - RNA, 18 nt, Bordetella pertussis
aagccgcccggccggcac

SEQ ID NO: 342428 - RNA, 14 nt, Bordetella pertussis
aagccggaaccgcg

SEQ ID NO: 342429 - RNA, 17 nt, Bordetella pertussis
aagccggccgcgccgcg

SEQ ID NO: 342430 - RNA, 24 nt, Bordetella pertussis
aagccggucgacccucagcccgca

SEQ ID NO: 342431 - RNA, 17 nt, Bordetella pertussis
aagcgccacagcgccau

SEQ ID NO: 342432 - RNA, 16 nt, Bordetella pertussis
aagcgcccuggcgugg

SEQ ID NO: 342433 - RNA, 23 nt, Bordetella pertussis
aagcggcugcccuugcuguacuc

SEQ ID NO: 342434 - RNA, 22 nt, Bordetella pertussis
aagcggcgauccgccgcggcca

SEQ ID NO: 342435 - RNA, 18 nt, Bordetella pertussis
aagcggcucaggcgcgga

SEQ ID NO: 342436 - RNA, 13 nt, Bordetella pertussis
aagcggucgaugu

SEQ ID NO: 342437 - RNA, 17 nt, Bordetella pertussis
aagcgguggcggccguu

SEQ ID NO: 342438 - RNA, 17 nt, Bordetella pertussis
aagcguacguaccaggc

SEQ ID NO: 342439 - RNA, 16 nt, Bordetella pertussis
aaggcagcaccgccac

SEQ ID NO: 342440 - RNA, 13 nt, Bordetella pertussis
aaggccgaggcca

SEQ ID NO: 342441 - RNA, 20 nt, Bordetella pertussis
aaggccgccgcgcccagcag

SEQ ID NO: 342442 - RNA, 16 nt, Bordetella pertussis
aaggccgccggacgca

SEQ ID NO: 342443 - RNA, 14 nt, Bordetella pertussis
aaggccgccggcca

SEQ ID NO: 342444 - RNA, 21 nt, Bordetella pertussis
aaggccgcgaacgcgccggcc

SEQ ID NO: 342445 - RNA, 15 nt, Bordetella pertussis
aaggccuuggccugg

SEQ ID NO: 342446 - RNA, 12 nt, Bordetella pertussis
aaggcugcagcu

SEQ ID NO: 342447 - RNA, 16 nt, Bordetella pertussis
aaggcugcagcuugcg

SEQ ID NO: 342448 - RNA, 22 nt, Bordetella pertussis
aaggcugcagcuugcgcgccag

SEQ ID NO: 342449 - RNA, 17 nt, Bordetella pertussis
aaggcuucgucgaccag

SEQ ID NO: 342450 - RNA, 19 nt, Bordetella pertussis
aaggcuucucgaccaggcg

SEQ ID NO: 342451 - RNA, 22 nt, Bordetella pertussis
aaggcuucucgaccaggcgggc

SEQ ID NO: 342452 - RNA, 19 nt, Bordetella pertussis
aaggucggcacgacgcuga

SEQ ID NO: 342453 - RNA, 22 nt, Bordetella pertussis
aagucggcccugucggccgaac

SEQ ID NO: 342454 - RNA, 13 nt, Bordetella pertussis
aaguggcggcggg

SEQ ID NO: 342455 - RNA, 16 nt, Bordetella pertussis
aagugggcugcggcgu

SEQ ID NO: 342456 - RNA, 18 nt, Bordetella pertussis
aagugggcugcggcgugg

SEQ ID NO: 342457 - RNA, 13 nt, Bordetella pertussis
aaguggucgcgca

SEQ ID NO: 342458 - RNA, 18 nt, Bordetella pertussis
aaguucggcagcgaggcg

SEQ ID NO: 342459 - RNA, 15 nt, Bordetella pertussis
aaucaccgccgcgac

SEQ ID NO: 342460 - RNA, 17 nt, Bordetella pertussis
aaugacgguggugucgg

SEQ ID NO: 342461 - RNA, 19 nt, Bordetella pertussis
aaugccagggugaccuggc

SEQ ID NO: 342462 - RNA, 14 nt, Bordetella pertussis
aaugcgccgcgcca

SEQ ID NO: 342463 - RNA, 13 nt, Bordetella pertussis
aaugcgcgcgcgg

SEQ ID NO: 342464 - RNA, 20 nt, Bordetella pertussis
aauggcggcgguagcgcucg

SEQ ID NO: 342465 - RNA, 13 nt, Bordetella pertussis
aauggucggccuc

SEQ ID NO: 342466 - RNA, 17 nt, Bordetella pertussis
aauguugauccggucgc

SEQ ID NO: 342467 - RNA, 20 nt, Bordetella pertussis
aauuccugaacgccgggccg

SEQ ID NO: 342468 - RNA, 14 nt, Bordetella pertussis
aauugccccagcac

SEQ ID NO: 342469 - RNA, 15 nt, Bordetella pertussis
aauugccgcgaggcg

SEQ ID NO: 342470 - RNA, 16 nt, Bordetella pertussis
aauuugaacagccgcc

SEQ ID NO: 342471 - RNA, 20 nt, Bordetella pertussis
acaacauuggguacgacggc

SEQ ID NO: 342472 - RNA, 15 nt, Bordetella pertussis
acaaccuggcgcgcg

SEQ ID NO: 342473 - RNA, 20 nt, Bordetella pertussis
acaacgccgcguccgcccgc

SEQ ID NO: 342474 - RNA, 17 nt, Bordetella pertussis
acaagccgggcgccggc

SEQ ID NO: 342475 - RNA, 15 nt, Bordetella pertussis
acaagcgcacgcugg

SEQ ID NO: 342476 - RNA, 17 nt, Bordetella pertussis
acaagcgcguggccggc

SEQ ID NO: 342477 - RNA, 19 nt, Bordetella pertussis
acaaggauggacuggccgc

SEQ ID NO: 342478 - RNA, 12 nt, Bordetella pertussis
acaaggcgcgcg

SEQ ID NO: 342479 - RNA, 22 nt, Bordetella pertussis
acaaggcggccgcgcccgcaac

SEQ ID NO: 342480 - RNA, 14 nt, Bordetella pertussis
acaauugaugcggg

SEQ ID NO: 342481 - RNA, 14 nt, Bordetella pertussis
acacaagaucgcau

SEQ ID NO: 342482 - RNA, 16 nt, Bordetella pertussis
acacaaggcggccgcg

SEQ ID NO: 342483 - RNA, 13 nt, Bordetella pertussis
acaccagcgccag

SEQ ID NO: 342484 - RNA, 18 nt, Bordetella pertussis
acaccaggguggcgccgg

SEQ ID NO: 342485 - RNA, 19 nt, Bordetella pertussis
acaccaggguggcgccggc

SEQ ID NO: 342486 - RNA, 21 nt, Bordetella pertussis
acaccaggguggcgccggcca

SEQ ID NO: 342487 - RNA, 21 nt, Bordetella pertussis
acaccaggaagagcuggcgcu

SEQ ID NO: 342488 - RNA, 21 nt, Bordetella pertussis
acaccagguugucggcgccac

SEQ ID NO: 342489 - RNA, 16 nt, Bordetella pertussis
acaccgccgcgccgcc

SEQ ID NO: 342490 - RNA, 13 nt, Bordetella pertussis
acaccggcaggcc

SEQ ID NO: 342491 - RNA, 17 nt, Bordetella pertussis
acaccggcgcgccuggc

SEQ ID NO: 342492 - RNA, 21 nt, Bordetella pertussis
acaccggcgcgccuggcgcgc

SEQ ID NO: 342493 - RNA, 19 nt, Bordetella pertussis
acaccgucacgcgcaaggc

SEQ ID NO: 342494 - RNA, 22 nt, Bordetella pertussis
acaccgucacgcgcaaggcggg

SEQ ID NO: 342495 - RNA, 23 nt, Bordetella pertussis
acaccguggcaugccaugcgcac

SEQ ID NO: 342496 - RNA, 18 nt, Bordetella pertussis
acaccuuguuggcgccgg

SEQ ID NO: 342497 - RNA, 20 nt, Bordetella pertussis
acaccuuguuggcgccggcc

SEQ ID NO: 342498 - RNA, 14 nt, Bordetella pertussis
acacgacgaaggug

SEQ ID NO: 342499 - RNA, 15 nt, Bordetella pertussis
acacgaugaucgcgc

SEQ ID NO: 342500 - RNA, 19 nt, Bordetella pertussis
acacgcauuugcagcggcg

SEQ ID NO: 342501 - RNA, 23 nt, Bordetella pertussis
acacgcauuugcagcggcggcac

SEQ ID NO: 342502 - RNA, 18 nt, Bordetella pertussis
acacgccgcgcgaucgcc

SEQ ID NO: 342503 - RNA, 19 nt, Bordetella pertussis
acacgccgcgcgaucgccg

SEQ ID NO: 342504 - RNA, 18 nt, Bordetella pertussis
acacgcgcgacgccgugg

SEQ ID NO: 342505 - RNA, 18 nt, Bordetella pertussis
acacgcgcgccgcgggcu

SEQ ID NO: 342506 - RNA, 23 nt, Bordetella pertussis
acacgcgcugggcguggcgcgcg

SEQ ID NO: 342507 - RNA, 20 nt, Bordetella pertussis
acacgcgguagguagcgcgc

SEQ ID NO: 342508 - RNA, 16 nt, Bordetella pertussis
acacgcuagggcgugg

SEQ ID NO: 342509 - RNA, 23 nt, Bordetella pertussis
acacgcggugcaucucggcaucg

SEQ ID NO: 342510 - RNA, 16 nt, Bordetella pertussis
acacgcucuugcgcgc

SEQ ID NO: 342511 - RNA, 13 nt, Bordetella pertussis
acacggccagcac

SEQ ID NO: 342512 - RNA, 22 nt, Bordetella pertussis
acacgcuggcggacacgcccug

SEQ ID NO: 342513 - RNA, 20 nt, Bordetella pertussis
acacggcgcgggcggucggc

SEQ ID NO: 342514 - RNA, 18 nt, Bordetella pertussis
acacggcggugccgcgca

SEQ ID NO: 342515 - RNA, 14 nt, Bordetella pertussis
acacggucagcaac

SEQ ID NO: 342516 - RNA, 22 nt, Bordetella pertussis
acacggucagcaaccccagcag

SEQ ID NO: 342517 - RNA, 15 nt, Bordetella pertussis
acacguccagcgccg

SEQ ID NO: 342518 - RNA, 14 nt, Bordetella pertussis
acacgucgaucagc

SEQ ID NO: 342519 - RNA, 18 nt, Bordetella pertussis
acacgucaucguggccgc

SEQ ID NO: 342520 - RNA, 22 nt, Bordetella pertussis
acacugucgccacgggcgucac

SEQ ID NO: 342521 - RNA, 13 nt, Bordetella pertussis
acagaucgccgcc

SEQ ID NO: 342522 - RNA, 17 nt, Bordetella pertussis
acagcaaggacaaggcg

SEQ ID NO: 342523 - RNA, 21 nt, Bordetella pertussis
acagcaagggcgucuucgccg

SEQ ID NO: 342524 - RNA, 16 nt, Bordetella pertussis
acagcacauggcgcgc

SEQ ID NO: 342525 - RNA, 17 nt, Bordetella pertussis
acagcacauggcgcgcc

SEQ ID NO: 342526 - RNA, 15 nt, Bordetella pertussis
acagcaccagcaugc

SEQ ID NO: 342527 - RNA, 17 nt, Bordetella pertussis
acagcaccugguggcgc

SEQ ID NO: 342528 - RNA, 21 nt, Bordetella pertussis
acagcaccugguggcgcuggc

SEQ ID NO: 342529 - RNA, 16 nt, Bordetella pertussis
acagcagcaugcggcc

SEQ ID NO: 342530 - RNA, 18 nt, Bordetella pertussis
acagcagcccgcuggccg

SEQ ID NO: 342531 - RNA, 17 nt, Bordetella pertussis
acagcagcgcgccgccg

SEQ ID NO: 342532 - RNA, 21 nt, Bordetella pertussis
acagcaggucggagucggcgc

SEQ ID NO: 342533 - RNA, 22 nt, Bordetella pertussis
acagcaguuucugcaccggcgc

SEQ ID NO: 342534 - RNA, 20 nt, Bordetella pertussis
acagcaucagcggcagcacg

SEQ ID NO: 342535 - RNA, 23 nt, Bordetella pertussis
acagcgacagccaggccagcgcc

SEQ ID NO: 342536 - RNA, 20 nt, Bordetella pertussis
acagcgcucuauucggccaa

SEQ ID NO: 342537 - RNA, 14 nt, Bordetella pertussis
acagcggaucgccg

SEQ ID NO: 342538 - RNA, 17 nt, Bordetella pertussis
acagcggaucgccggua

SEQ ID NO: 342539 - RNA, 19 nt, Bordetella pertussis
acagcgguucguagccggu

SEQ ID NO: 342540 - RNA, 13 nt, Bordetella pertussis
acagcguccagcc

SEQ ID NO: 342541 - RNA, 17 nt, Bordetella pertussis
acagcuggaagcgcgcc

SEQ ID NO: 342542 - RNA, 19 nt, Bordetella pertussis
acaggaacuccggcggcgc

SEQ ID NO: 342543 - RNA, 22 nt, Bordetella pertussis
acaggccggcaagaugccggcc

SEQ ID NO: 342544 - RNA, 15 nt, Bordetella pertussis
acaggccggcggcga

SEQ ID NO: 342545 - RNA, 20 nt, Bordetella pertussis
acaggccggcggcgagcgcg

SEQ ID NO: 342546 - RNA, 21 nt, Bordetella pertussis
acaggccggcggcgagcgcgg

SEQ ID NO: 342547 - RNA, 14 nt, Bordetella pertussis
acaggcgcccgugc

SEQ ID NO: 342548 - RNA, 18 nt, Bordetella pertussis
acaggcgcgccagccgcg

SEQ ID NO: 342549 - RNA, 17 nt, Bordetella pertussis
acaggcgcucgcccucg

SEQ ID NO: 342550 - RNA, 13 nt, Bordetella pertussis
acaggcgcucgcg

SEQ ID NO: 342551 - RNA, 16 nt, Bordetella pertussis
acaggcgccacagggc

SEQ ID NO: 342552 - RNA, 13 nt, Bordetella pertussis
acaggcugccguc

SEQ ID NO: 342553 - RNA, 13 nt, Bordetella pertussis
acaggucgccgaa

SEQ ID NO: 342554 - RNA, 22 nt, Bordetella pertussis
acaggucggcgcccacgccgaa

SEQ ID NO: 342555 - RNA, 19 nt, Bordetella pertussis
acaggucguagaccgccgc

SEQ ID NO: 342556 - RNA, 22 nt, Bordetella pertussis
acaggucguagaccgccgcgcc

SEQ ID NO: 342557 - RNA, 18 nt, Bordetella pertussis
acaggugcgcggcgcgcc

SEQ ID NO: 342558 - RNA, 22 nt, Bordetella pertussis
acaggugcgcggcgcgccgucc

SEQ ID NO: 342559 - RNA, 14 nt, Bordetella pertussis
acaguucggccagc

SEQ ID NO: 342560 - RNA, 15 nt, Bordetella pertussis
accaggccgauggcg

SEQ ID NO: 342561 - RNA, 23 nt, Bordetella pertussis
accaggccgccggccagcgccag

SEQ ID NO: 342562 - RNA, 17 nt, Bordetella pertussis
accaggccggccagggc

SEQ ID NO: 342563 - RNA, 13 nt, Bordetella pertussis
accaggccgcggc

SEQ ID NO: 342564 - RNA, 17 nt, Bordetella pertussis
accaggccggcggcggg

SEQ ID NO: 342565 - RNA, 18 nt, Bordetella pertussis
accaggccgucggccagg

SEQ ID NO: 342566 - RNA, 19 nt, Bordetella pertussis
accaggccguggcccagcc

SEQ ID NO: 342567 - RNA, 23 nt, Bordetella pertussis
accaggccugccugauggcgcgu

SEQ ID NO: 342568 - RNA, 15 nt, Bordetella pertussis
accaggcgcgcgcca

SEQ ID NO: 342569 - RNA, 17 nt, Bordetella pertussis
accaggcgcgcgccauc

SEQ ID NO: 342570 - RNA, 21 nt, Bordetella pertussis
accaggcgcgcgccaucgacg

SEQ ID NO: 342571 - RNA, 22 nt, Bordetella pertussis
accaggcgcgcgccaucgacgg

SEQ ID NO: 342572 - RNA, 21 nt, Bordetella pertussis
accaggcggcgacgaugccgc

SEQ ID NO: 342573 - RNA, 19 nt, Bordetella pertussis
accaggcgggcaucgccca

SEQ ID NO: 342574 - RNA, 21 nt, Bordetella pertussis
accaggcgggcaucgcccacc

SEQ ID NO: 342575 - RNA, 12 nt, Bordetella pertussis
accaggcgcuga

SEQ ID NO: 342576 - RNA, 13 nt, Bordetella pertussis
accaggcgcugac

SEQ ID NO: 342577 - RNA, 19 nt, Bordetella pertussis
accaggcugcgcgccggcg

SEQ ID NO: 342578 - RNA, 23 nt, Bordetella pertussis
accagggcccggacgcggccggc

SEQ ID NO: 342579 - RNA, 19 nt, Bordetella pertussis
accagggcgcccgccgacg

SEQ ID NO: 342580 - RNA, 13 nt, Bordetella pertussis
accagggcgccga

SEQ ID NO: 342581 - RNA, 13 nt, Bordetella pertussis
accaggguggcgc

SEQ ID NO: 342582 - RNA, 16 nt, Bordetella pertussis
accaggguggcgccgg

SEQ ID NO: 342583 - RNA, 17 nt, Bordetella pertussis
accaggguggcgccggc

SEQ ID NO: 342584 - RNA, 18 nt, Bordetella pertussis
accaggguggcgccggcc

SEQ ID NO: 342585 - RNA, 23 nt, Bordetella pertussis
accaggguggcgggcgccugcgg

SEQ ID NO: 342586 - RNA, 14 nt, Bordetella pertussis
accagguaucgacc

SEQ ID NO: 342587 - RNA, 17 nt, Bordetella pertussis
accaggguuuccucgcc

SEQ ID NO: 342588 - RNA, 19 nt, Bordetella pertussis
accagguccuggcggccgc

SEQ ID NO: 342589 - RNA, 21 nt, Bordetella pertussis
accaggucgcggugcgccacg

SEQ ID NO: 342590 - RNA, 23 nt, Bordetella pertussis
accaggucguacagcgccugcgc

SEQ ID NO: 342591 - RNA, 18 nt, Bordetella pertussis
accaggugcgggccgcuc

SEQ ID NO: 342592 - RNA, 17 nt, Bordetella pertussis
accaggugggcgcgcuc

SEQ ID NO: 342593 - RNA, 18 nt, Bordetella pertussis
accaguagcacacgccga

SEQ ID NO: 342594 - RNA, 15 nt, Bordetella pertussis
accagugcgccggcg

SEQ ID NO: 342595 - RNA, 19 nt, Bordetella pertussis
accagugcgccggcgcggc

SEQ ID NO: 342596 - RNA, 23 nt, Bordetella pertussis
accagugcgccggcgcggcgguc

SEQ ID NO: 342597 - RNA, 17 nt, Bordetella pertussis
accaguuucucggccac

SEQ ID NO: 342598 - RNA, 22 nt, Bordetella pertussis
accaucaacgggccgcugguca

SEQ ID NO: 342599 - RNA, 21 nt, Bordetella pertussis
accaucgccgagccgcugucg

SEQ ID NO: 342600 - RNA, 15 nt, Bordetella pertussis
accaucgccgccugc

SEQ ID NO: 342601 - RNA, 16 nt, Bordetella pertussis
accaugaccaugccgg

SEQ ID NO: 342602 - RNA, 16 nt, Bordetella pertussis
accaugccgauggcgg

SEQ ID NO: 342603 - RNA, 22 nt, Bordetella pertussis
accaugcgcugggcaugggcgg

SEQ ID NO: 342604 - RNA, 16 nt, Bordetella pertussis
accaugcgcaccaggc

SEQ ID NO: 342605 - RNA, 21 nt, Bordetella pertussis
accaugcgcaccaggcgcucg

SEQ ID NO: 342606 - RNA, 16 nt, Bordetella pertussis
accaugugcuugccgc

SEQ ID NO: 342607 - RNA, 20 nt, Bordetella pertussis
accauuucgauuucggcggc

SEQ ID NO: 342608 - RNA, 21 nt, Bordetella pertussis
accauuucgauuucggcggcc

SEQ ID NO: 342609 - RNA, 21 nt, Bordetella pertussis
acccagccggacccgcgccgc

SEQ ID NO: 342610 - RNA, 21 nt, Bordetella pertussis
acccccgucagcacggucggc

SEQ ID NO: 342611 - RNA, 18 nt, Bordetella pertussis
acccccggcaccaggaac

SEQ ID NO: 342612 - RNA, 20 nt, Bordetella pertussis
acccccugaccggcggcguc

SEQ ID NO: 342613 - RNA, 16 nt, Bordetella pertussis
accccgagggcgcggc

SEQ ID NO: 342614 - RNA, 21 nt, Bordetella pertussis
accccgagggcgcggcgccgc

SEQ ID NO: 342615 - RNA, 22 nt, Bordetella pertussis
accccgaguugaggaugcgcgc

SEQ ID NO: 342616 - RNA, 14 nt, Bordetella pertussis
accccggcgccgcg

SEQ ID NO: 342617 - RNA, 23 nt, Bordetella pertussis
acccgauacgacacgccgcgcga

SEQ ID NO: 342618 - RNA, 17 nt, Bordetella pertussis
acccgauagccgcgcgc

SEQ ID NO: 342619 - RNA, 20 nt, Bordetella pertussis
acccgaugacggggcggcgc

SEQ ID NO: 342620 - RNA, 21 nt, Bordetella pertussis
acccgaugacggggcggcgcc

SEQ ID NO: 342621 - RNA, 16 nt, Bordetella pertussis
acccgcaaaaccgggc

SEQ ID NO: 342622 - RNA, 20 nt, Bordetella pertussis
acccgcaaaaccgggcccgg

SEQ ID NO: 342623 - RNA, 21 nt, Bordetella pertussis
acccgcaaaaccgggcccgga

SEQ ID NO: 342624 - RNA, 20 nt, Bordetella pertussis
acccgcauugaucgaucagc

SEQ ID NO: 342625 - RNA, 18 nt, Bordetella pertussis
acccgccauccuggccgc

SEQ ID NO: 342626 - RNA, 15 nt, Bordetella pertussis
acccgcccacgcggc

SEQ ID NO: 342627 - RNA, 17 nt, Bordetella pertussis
acccgcccacgcggcgc

SEQ ID NO: 342628 - RNA, 22 nt, Bordetella pertussis
acccgcccgaaccggcaucccu

SEQ ID NO: 342629 - RNA, 15 nt, Bordetella pertussis
acccgcccggggcca

SEQ ID NO: 342630 - RNA, 18 nt, Bordetella pertussis
acccgccuggacggcgag

SEQ ID NO: 342631 - RNA, 15 nt, Bordetella pertussis
acccgcgccaggaac

SEQ ID NO: 342632 - RNA, 20 nt, Bordetella pertussis
acccgcgcccagcuguccaa

SEQ ID NO: 342633 - RNA, 20 nt, Bordetella pertussis
acccgcggcccuugcgcgaa

SEQ ID NO: 342634 - RNA, 19 nt, Bordetella pertussis
acccgcuaccccggcagcg

SEQ ID NO: 342635 - RNA, 13 nt, Bordetella pertussis
acccgcucggcca

SEQ ID NO: 342636 - RNA, 13 nt, Bordetella pertussis
acccgcugggcca

SEQ ID NO: 342637 - RNA, 18 nt, Bordetella pertussis
acccgcugggccagcauc

SEQ ID NO: 342638 - RNA, 21 nt, Bordetella pertussis
acccgcugggccagcaucggc

SEQ ID NO: 342639 - RNA, 14 nt, Bordetella pertussis
accgaacggccggu

SEQ ID NO: 342640 - RNA, 17 nt, Bordetella pertussis
accgaaucgaacuuggc

SEQ ID NO: 342641 - RNA, 15 nt, Bordetella pertussis
accgacaggccuggc

SEQ ID NO: 342642 - RNA, 17 nt, Bordetella pertussis
accgacaggaugggcgc

SEQ ID NO: 342643 - RNA, 14 nt, Bordetella pertussis
accgacaugaccgc

SEQ ID NO: 342644 - RNA, 15 nt, Bordetella pertussis
accgaccagcgcgcg

SEQ ID NO: 342645 - RNA, 14 nt, Bordetella pertussis
accgaccgccacga

SEQ ID NO: 342646 - RNA, 18 nt, Bordetella pertussis
accgaccugaucgcgcag

SEQ ID NO: 342647 - RNA, 13 nt, Bordetella pertussis
accgacgcagcgc

SEQ ID NO: 342648 - RNA, 13 nt, Bordetella pertussis
accgagcugagca

SEQ ID NO: 342649 - RNA, 22 nt, Bordetella pertussis
accgagggccggacuggcgcgc

SEQ ID NO: 342650 - RNA, 13 nt, Bordetella pertussis
accgagggcgcgu

SEQ ID NO: 342651 - RNA, 14 nt, Bordetella pertussis
accgaggugccggc

SEQ ID NO: 342652 - RNA, 14 nt, Bordetella pertussis
accgauccagcccg

SEQ ID NO: 342653 - RNA, 15 nt, Bordetella pertussis
accgaugcgccggcc

SEQ ID NO: 342654 - RNA, 17 nt, Bordetella pertussis
accgaugcgccggccug

SEQ ID NO: 342655 - RNA, 19 nt, Bordetella pertussis
accgaugcgccggccuggc

SEQ ID NO: 342656 - RNA, 14 nt, Bordetella pertussis
accgauucgcgcac

SEQ ID NO: 342657 - RNA, 24 nt, Bordetella pertussis
accgcaaggaaguggccgagcgca

SEQ ID NO: 342658 - RNA, 18 nt, Bordetella pertussis
accgcagaagcagccgcg

SEQ ID NO: 342659 - RNA, 20 nt, Bordetella pertussis
accgcaggggauugccgcgc

SEQ ID NO: 342660 - RNA, 22 nt, Bordetella pertussis
accgcaggggauugccgcgcgg

SEQ ID NO: 342661 - RNA, 14 nt, Bordetella pertussis
accgcaucgcgcag

SEQ ID NO: 342662 - RNA, 20 nt, Bordetella pertussis
accgcaucgcgcagcgugcg

SEQ ID NO: 342663 - RNA, 15 nt, Bordetella pertussis
accgcaugcggcaca

SEQ ID NO: 342664 - RNA, 22 nt, Bordetella pertussis
accgcaugcggcacaaccuggc

SEQ ID NO: 342665 - RNA, 22 nt, Bordetella pertussis
accgccagcaggcccugggcca

SEQ ID NO: 342666 - RNA, 17 nt, Bordetella pertussis
accgccagcauccagcc

SEQ ID NO: 342667 - RNA, 11 nt, Bordetella pertussis
accgccagccc

SEQ ID NO: 342668 - RNA, 15 nt, Bordetella pertussis
accgccagcgcgucg

SEQ ID NO: 342669 - RNA, 21 nt, Bordetella pertussis
accgccagcgcgucguccagc

SEQ ID NO: 342670 - RNA, 18 nt, Bordetella pertussis
accgccagcucggccugc

SEQ ID NO: 342671 - RNA, 23 nt, Bordetella pertussis
accgccagcucggccugcggcuc

SEQ ID NO: 342672 - RNA, 19 nt, Bordetella pertussis
accgccaggcagauccgcc

SEQ ID NO: 342673 - RNA, 21 nt, Bordetella pertussis
accgcccgcugcuaugcgugg

SEQ ID NO: 342674 - RNA, 14 nt, Bordetella pertussis
accgccgccggccc

SEQ ID NO: 342675 - RNA, 14 nt, Bordetella pertussis
accgccgcgccgcu

SEQ ID NO: 342676 - RNA, 20 nt, Bordetella pertussis
accgccgcggcgaugccggc

SEQ ID NO: 342677 - RNA, 23 nt, Bordetella pertussis
accgccgcggcgaugccggccag

SEQ ID NO: 342678 - RNA, 17 nt, Bordetella pertussis
accgccggcaccagcgc

SEQ ID NO: 342679 - RNA, 13 nt, Bordetella pertussis
accgccggcggcg

SEQ ID NO: 342680 - RNA, 14 nt, Bordetella pertussis
accgccuccagcgc

SEQ ID NO: 342681 - RNA, 13 nt, Bordetella pertussis
accgccucgacgc

SEQ ID NO: 342682 - RNA, 22 nt, Bordetella pertussis
accgccucgacgcccgggcggc

SEQ ID NO: 342683 - RNA, 15 nt, Bordetella pertussis
accgccucgaucgcc

SEQ ID NO: 342684 - RNA, 19 nt, Bordetella pertussis
accgccugcugcgccuggc

SEQ ID NO: 342685 - RNA, 14 nt, Bordetella pertussis
accgcgaugcugcg

SEQ ID NO: 342686 - RNA, 22 nt, Bordetella pertussis
accgcgcacaggucgccgaagg

SEQ ID NO: 342687 - RNA, 17 nt, Bordetella pertussis
accgcgccagcgccggc

SEQ ID NO: 342688 - RNA, 20 nt, Bordetella pertussis
accgcgccagcgccggcgcg

SEQ ID NO: 342689 - RNA, 15 nt, Bordetella pertussis
accgcgcggcgcugc

SEQ ID NO: 342690 - RNA, 17 nt, Bordetella pertussis
accgcgcggcgcugcac

SEQ ID NO: 342691 - RNA, 18 nt, Bordetella pertussis
accgcgcguaucggcgcg

SEQ ID NO: 342692 - RNA, 16 nt, Bordetella pertussis
accgcgggcgcgcgcc

SEQ ID NO: 342693 - RNA, 16 nt, Bordetella pertussis
accgcggugccgcgcg

SEQ ID NO: 342694 - RNA, 17 nt, Bordetella pertussis
accgcggugccgcgcgc

SEQ ID NO: 342695 - RNA, 18 nt, Bordetella pertussis
accgcggugccgcgcgcg

SEQ ID NO: 342696 - RNA, 20 nt, Bordetella pertussis
accgcggugccgcgcgcggc

SEQ ID NO: 342697 - RNA, 14 nt, Bordetella pertussis
accgcgucggccug

SEQ ID NO: 342698 - RNA, 16 nt, Bordetella pertussis
accgcgucggccugcc

SEQ ID NO: 342699 - RNA, 12 nt, Bordetella pertussis
accgcguggcgc

SEQ ID NO: 342700 - RNA, 15 nt, Bordetella pertussis
accgcguggcgcugc

SEQ ID NO: 342701 - RNA, 16 nt, Bordetella pertussis
accgcguggcgcugcg

SEQ ID NO: 342702 - RNA, 16 nt, Bordetella pertussis
accgcguugagcgccg

SEQ ID NO: 342703 - RNA, 13 nt, Bordetella pertussis
accgcugaucagg

SEQ ID NO: 342704 - RNA, 16 nt, Bordetella pertussis
accgcuggccaggcuc

SEQ ID NO: 342705 - RNA, 15 nt, Bordetella pertussis
accgcuucggucagc

SEQ ID NO: 342706 - RNA, 21 nt, Bordetella pertussis
accgcuucuucgucgcgccag

SEQ ID NO: 342707 - RNA, 14 nt, Bordetella pertussis
accgcuuccgccac

SEQ ID NO: 342708 - RNA, 18 nt, Bordetella pertussis
accggagcggcucgccgc

SEQ ID NO: 342709 - RNA, 15 nt, Bordetella pertussis
accggaggcgccgcg

SEQ ID NO: 342710 - RNA, 17 nt, Bordetella pertussis
accggauccugcggcgc

SEQ ID NO: 342711 - RNA, 18 nt, Bordetella pertussis
accggcaagccuugcggc

SEQ ID NO: 342712 - RNA, 22 nt, Bordetella pertussis
accggcaagcgcucgccggcgc

SEQ ID NO: 342713 - RNA, 12 nt, Bordetella pertussis
accggcaaggcc

SEQ ID NO: 342714 - RNA, 15 nt, Bordetella pertussis
accggcaaggccgcg

SEQ ID NO: 342715 - RNA, 17 nt, Bordetella pertussis
accggcaaggccgcgaa

SEQ ID NO: 342716 - RNA, 19 nt, Bordetella pertussis
accggcacgccggcggcgc

SEQ ID NO: 342717 - RNA, 13 nt, Bordetella pertussis
accggcacgcgcc

SEQ ID NO: 342718 - RNA, 16 nt, Bordetella pertussis
accgggccgacgcgcc

SEQ ID NO: 342719 - RNA, 14 nt, Bordetella pertussis
accggcacgccggc

SEQ ID NO: 342720 - RNA, 13 nt, Bordetella pertussis
accgggcggcccg

SEQ ID NO: 342721 - RNA, 15 nt, Bordetella pertussis
accgggcggcccggc

SEQ ID NO: 342722 - RNA, 20 nt, Bordetella pertussis
accgggucgucgggcggcgc

SEQ ID NO: 342723 - RNA, 18 nt, Bordetella pertussis
accggguggcugcgcagg

SEQ ID NO: 342724 - RNA, 14 nt, Bordetella pertussis
accggucggccggc

SEQ ID NO: 342725 - RNA, 17 nt, Bordetella pertussis
accggucggccggcagc

SEQ ID NO: 342726 - RNA, 18 nt, Bordetella pertussis
accggucggccggcagcg

SEQ ID NO: 342727 - RNA, 18 nt, Bordetella pertussis
accggugaucagcaggcc

SEQ ID NO: 342728 - RNA, 20 nt, Bordetella pertussis
accggugaucagcaggccca

SEQ ID NO: 342729 - RNA, 19 nt, Bordetella pertussis
accgguggugcugcugggc

SEQ ID NO: 342730 - RNA, 16 nt, Bordetella pertussis
accgguuggccagcuc

SEQ ID NO: 342731 - RNA, 15 nt, Bordetella pertussis
accguagcgcaggcg

SEQ ID NO: 342732 - RNA, 17 nt, Bordetella pertussis
accgucaggaagcccga

SEQ ID NO: 342733 - RNA, 19 nt, Bordetella pertussis
accguccuugagcgccagc

SEQ ID NO: 342734 - RNA, 20 nt, Bordetella pertussis
accguccuugagcgccagcu

SEQ ID NO: 342735 - RNA, 19 nt, Bordetella pertussis
accgucgaugaccagcgcc

SEQ ID NO: 342736 - RNA, 15 nt, Bordetella pertussis
accgucguccucggc

SEQ ID NO: 342737 - RNA, 17 nt, Bordetella pertussis
accgucucgaacgccgc

SEQ ID NO: 342738 - RNA, 20 nt, Bordetella pertussis
accgucuggcguacgcugcu

SEQ ID NO: 342739 - RNA, 14 nt, Bordetella pertussis
accgucuugcccgc

SEQ ID NO: 342740 - RNA, 13 nt, Bordetella pertussis
accgugaccagcg

SEQ ID NO: 342741 - RNA, 20 nt, Bordetella pertussis
accgugcgccaacgcgucga

SEQ ID NO: 342742 - RNA, 18 nt, Bordetella pertussis
accgugugaucgccgacg

SEQ ID NO: 342743 - RNA, 17 nt, Bordetella pertussis
accguuuuggcaggcug

SEQ ID NO: 342744 - RNA, 16 nt, Bordetella pertussis
accucagccugcuggu

SEQ ID NO: 342745 - RNA, 14 nt, Bordetella pertussis
accuccaccgccag

SEQ ID NO: 342746 - RNA, 17 nt, Bordetella pertussis
accucgaugaacgaccc

SEQ ID NO: 342747 - RNA, 13 nt, Bordetella pertussis
accucgauggcgg

SEQ ID NO: 342748 - RNA, 16 nt, Bordetella pertussis
accucgcgccggucac

SEQ ID NO: 342749 - RNA, 16 nt, Bordetella pertussis
accucgcgcugcagca

SEQ ID NO: 342750 - RNA, 17 nt, Bordetella pertussis
accucgcgcugcagcau

SEQ ID NO: 342751 - RNA, 21 nt, Bordetella pertussis
accucggacgagacaggcgcg

SEQ ID NO: 342752 - RNA, 19 nt, Bordetella pertussis
accucggcaccgaggccga

SEQ ID NO: 342753 - RNA, 18 nt, Bordetella pertussis
accucggccggggcgguc

SEQ ID NO: 342754 - RNA, 14 nt, Bordetella pertussis
accucggcgccgcg

SEQ ID NO: 342755 - RNA, 13 nt, Bordetella pertussis
accucggcggcgu

SEQ ID NO: 342756 - RNA, 15 nt, Bordetella pertussis
accucggggcgcggc

SEQ ID NO: 342757 - RNA, 19 nt, Bordetella pertussis
accucguaaguggcggcgg

SEQ ID NO: 342758 - RNA, 20 nt, Bordetella pertussis
accucuccacuggccuucuu

SEQ ID NO: 342759 - RNA, 19 nt, Bordetella pertussis
accucuucagcccggcgcg

SEQ ID NO: 342760 - RNA, 21 nt, Bordetella pertussis
accucuucagcccggcgcgcc

SEQ ID NO: 342761 - RNA, 17 nt, Bordetella pertussis
accugaacaccggcgcg

SEQ ID NO: 342762 - RNA, 17 nt, Bordetella pertussis
accugaccgugcauccc

SEQ ID NO: 342763 - RNA, 15 nt, Bordetella pertussis
accugagccaggcgc

SEQ ID NO: 342764 - RNA, 18 nt, Bordetella pertussis
accugaucgcgcagcgcc

SEQ ID NO: 342765 - RNA, 20 nt, Bordetella pertussis
accugaucgcgcagcgccug

SEQ ID NO: 342766 - RNA, 14 nt, Bordetella pertussis
accugcaccgccgc

SEQ ID NO: 342767 - RNA, 16 nt, Bordetella pertussis
accugcacgauggcgc

SEQ ID NO: 342768 - RNA, 17 nt, Bordetella pertussis
accugcacgauggcgcc

SEQ ID NO: 342769 - RNA, 22 nt, Bordetella pertussis
accugcaagauuucauggcguc

SEQ ID NO: 342770 - RNA, 17 nt, Bordetella pertussis
accuugacgcgcaggcc

SEQ ID NO: 342771 - RNA, 21 nt, Bordetella pertussis
accuugagaugccagcggcgc

SEQ ID NO: 342772 - RNA, 20 nt, Bordetella pertussis
accuugcccgucagcggcgc

SEQ ID NO: 342773 - RNA, 22 nt, Bordetella pertussis
accuugcccgucagcggcgcgc

SEQ ID NO: 342774 - RNA, 14 nt, Bordetella pertussis
accuugcgcgcgaa

SEQ ID NO: 342775 - RNA, 14 nt, Bordetella pertussis
accuugcggccgcg

SEQ ID NO: 342776 - RNA, 16 nt, Bordetella pertussis
accuugcggccgcgca

SEQ ID NO: 342777 - RNA, 19 nt, Bordetella pertussis
accuuggcggcuggcgcgg

SEQ ID NO: 342778 - RNA, 15 nt, Bordetella pertussis
accuugggcgccugc

SEQ ID NO: 342779 - RNA, 17 nt, Bordetella pertussis
accuuguuggcgccggc

SEQ ID NO: 342780 - RNA, 20 nt, Bordetella pertussis
accuuguuggcgccggccgc

SEQ ID NO: 342781 - RNA, 23 nt, Bordetella pertussis
accuuuccgaucagcugcggccc

SEQ ID NO: 342782 - RNA, 14 nt, Bordetella pertussis
acgaaaugccggcg

SEQ ID NO: 342783 - RNA, 15 nt, Bordetella pertussis
acgaacagcgccagg

SEQ ID NO: 342784 - RNA, 15 nt, Bordetella pertussis
acgaacaggccgccg

SEQ ID NO: 342785 - RNA, 14 nt, Bordetella pertussis
acgaagccgaugcg

SEQ ID NO: 342786 - RNA, 19 nt, Bordetella pertussis
acgaagccgaugcgccgcg

SEQ ID NO: 342787 - RNA, 22 nt, Bordetella pertussis
acgaagcgcagcaccgcgcgca

SEQ ID NO: 342788 - RNA, 16 nt, Bordetella pertussis
acgaaggcgaucugcg

SEQ ID NO: 342789 - RNA, 17 nt, Bordetella pertussis
acgaagggauagcgccg

SEQ ID NO: 342790 - RNA, 23 nt, Bordetella pertussis
acgaaguacucgccggcgcugcg

SEQ ID NO: 342791 - RNA, 15 nt, Bordetella pertussis
acgaauaaucgccgg

SEQ ID NO: 342792 - RNA, 13 nt, Bordetella pertussis
acgaauacgcugg

SEQ ID NO: 342793 - RNA, 20 nt, Bordetella pertussis
acgaauuucucggccagcgc

SEQ ID NO: 342794 - RNA, 22 nt, Bordetella pertussis
acgacacccggucggcccaggu

SEQ ID NO: 342795 - RNA, 12 nt, Bordetella pertussis
acgacacgccca

SEQ ID NO: 342796 - RNA, 14 nt, Bordetella pertussis
acgacacgccgcgc

SEQ ID NO: 342797 - RNA, 13 nt, Bordetella pertussis
acgacagcgacac

SEQ ID NO: 342798 - RNA, 17 nt, Bordetella pertussis
acgacagcggcgagcgc

SEQ ID NO: 342799 - RNA, 14 nt, Bordetella pertussis
acgaccagcaggcc

SEQ ID NO: 342800 - RNA, 22 nt, Bordetella pertussis
acgaccaggccguggcccagcc

SEQ ID NO: 342801 - RNA, 19 nt, Bordetella pertussis
acgaccgagccggccagcg

SEQ ID NO: 342802 - RNA, 23 nt, Bordetella pertussis
acgaccuugcccgucagcggcgc

SEQ ID NO: 342803 - RNA, 22 nt, Bordetella pertussis
acgaccuugcuggaccgcgccu

SEQ ID NO: 342804 - RNA, 17 nt, Bordetella pertussis
acgaccuuggcggccga

SEQ ID NO: 342805 - RNA, 17 nt, Bordetella pertussis
acgacgaaacccgggcc

SEQ ID NO: 342806 - RNA, 13 nt, Bordetella pertussis
acgaccugcgcau

SEQ ID NO: 342807 - RNA, 13 nt, Bordetella pertussis
acgacgacggccg

SEQ ID NO: 342808 - RNA, 17 nt, Bordetella pertussis
acgacgacggccggcgc

SEQ ID NO: 342809 - RNA, 17 nt, Bordetella pertussis
acgacgacuacuggcaa

SEQ ID NO: 342810 - RNA, 22 nt, Bordetella pertussis
acgacgagaguuucggcgacga

SEQ ID NO: 342811 - RNA, 15 nt, Bordetella pertussis
acgacgagaucgcgc

SEQ ID NO: 342812 - RNA, 17 nt, Bordetella pertussis
acgacgagaucgcgccu

SEQ ID NO: 342813 - RNA, 16 nt, Bordetella pertussis
acgacgaucggccuga

SEQ ID NO: 342814 - RNA, 22 nt, Bordetella pertussis
acgacgaucugguccugggccg

SEQ ID NO: 342815 - RNA, 15 nt, Bordetella pertussis
acgacgcagcgugcg

SEQ ID NO: 342816 - RNA, 12 nt, Bordetella pertussis
acgacgccgucg

SEQ ID NO: 342817 - RNA, 16 nt, Bordetella pertussis
acgacgcgaaccaggc

SEQ ID NO: 342818 - RNA, 14 nt, Bordetella pertussis
acgacggccggcgc

SEQ ID NO: 342819 - RNA, 19 nt, Bordetella pertussis
acgacggccuccgcgccga

SEQ ID NO: 342820 - RNA, 16 nt, Bordetella pertussis
acgacguagucggcgc

SEQ ID NO: 342821 - RNA, 22 nt, Bordetella pertussis
acgacguggccuaccacgcaug

SEQ ID NO: 342822 - RNA, 16 nt, Bordetella pertussis
acgacguugggcaugc

SEQ ID NO: 342823 - RNA, 21 nt, Bordetella pertussis
acgacguugggcaugccgauc

SEQ ID NO: 342824 - RNA, 19 nt, Bordetella pertussis
acgagaacucgguggcggu

SEQ ID NO: 342825 - RNA, 17 nt, Bordetella pertussis
acgagaaugcgccgucc

SEQ ID NO: 342826 - RNA, 18 nt, Bordetella pertussis
acgagaaugcgccguccg

SEQ ID NO: 342827 - RNA, 14 nt, Bordetella pertussis
acgagacaggcgcg

SEQ ID NO: 342828 - RNA, 21 nt, Bordetella pertussis
acgaggcgauggucggccgga

SEQ ID NO: 342829 - RNA, 15 nt, Bordetella pertussis
acgaggcgcggucgu

SEQ ID NO: 342830 - RNA, 12 nt, Bordetella pertussis
acgagggccgcg

SEQ ID NO: 342831 - RNA, 13 nt, Bordetella pertussis
acgagggccggcg

SEQ ID NO: 342832 - RNA, 17 nt, Bordetella pertussis
acgagggccggcgccag

SEQ ID NO: 342833 - RNA, 19 nt, Bordetella pertussis
acgaggucuugccgaucgg

SEQ ID NO: 342834 - RNA, 15 nt, Bordetella pertussis
acgagugcaggcccg

SEQ ID NO: 342835 - RNA, 16 nt, Bordetella pertussis
acgagugcaggcccga

SEQ ID NO: 342836 - RNA, 18 nt, Bordetella pertussis
acgauccacggccggcgc

SEQ ID NO: 342837 - RNA, 15 nt, Bordetella pertussis
acgaucgcgccggcc

SEQ ID NO: 342838 - RNA, 16 nt, Bordetella pertussis
acgaucgcgccggccu

SEQ ID NO: 342839 - RNA, 14 nt, Bordetella pertussis
acgaucgcggcgcu

SEQ ID NO: 342840 - RNA, 12 nt, Bordetella pertussis
acgaucggcgcc

SEQ ID NO: 342841 - RNA, 17 nt, Bordetella pertussis
acgauggcgccggcuuc

SEQ ID NO: 342842 - RNA, 20 nt, Bordetella pertussis
acgauggggccgucgccgau

SEQ ID NO: 342843 - RNA, 16 nt, Bordetella pertussis
acgauggugccggccg

SEQ ID NO: 342844 - RNA, 19 nt, Bordetella pertussis
acgauguagaucuggcgcg

SEQ ID NO: 342845 - RNA, 20 nt, Bordetella pertussis
acgaugucgccgccgcgcac

SEQ ID NO: 342846 - RNA, 21 nt, Bordetella pertussis
acgaugucguccagcuccagg

SEQ ID NO: 342847 - RNA, 19 nt, Bordetella pertussis
acgauucuuuccuggccgg

SEQ ID NO: 342848 - RNA, 19 nt, Bordetella pertussis
acgauugucgucgcgcgag

SEQ ID NO: 342849 - RNA, 13 nt, Bordetella pertussis
acgauuucggcca

SEQ ID NO: 342850 - RNA, 17 nt, Bordetella pertussis
acgcaaccggucggccg

SEQ ID NO: 342851 - RNA, 19 nt, Bordetella pertussis
acgcaaccggucggccggc

SEQ ID NO: 342852 - RNA, 20 nt, Bordetella pertussis
acgcaaccggucggccggca

SEQ ID NO: 342853 - RNA, 13 nt, Bordetella pertussis
acgcaaucggcga

SEQ ID NO: 342854 - RNA, 14 nt, Bordetella pertussis
acgcacaagggccc

SEQ ID NO: 342855 - RNA, 16 nt, Bordetella pertussis
acgcacagcaugcgcu

SEQ ID NO: 342856 - RNA, 13 nt, Bordetella pertussis
acgcaccgccgcc

SEQ ID NO: 342857 - RNA, 17 nt, Bordetella pertussis
acgcaccgccgccggcc

SEQ ID NO: 342858 - RNA, 22 nt, Bordetella pertussis
acgcaccgcgccagcgccggcg

SEQ ID NO: 342859 - RNA, 17 nt, Bordetella pertussis
acgcacgguacgccgaa

SEQ ID NO: 342860 - RNA, 14 nt, Bordetella pertussis
acgcagaccacgcc

SEQ ID NO: 342861 - RNA, 19 nt, Bordetella pertussis
acgcagacuccaggagcuc

SEQ ID NO: 342862 - RNA, 21 nt, Bordetella pertussis
acgccuugcccgggcuggccg

SEQ ID NO: 342863 - RNA, 18 nt, Bordetella pertussis
acgccuugcucgaccagg

SEQ ID NO: 342864 - RNA, 19 nt, Bordetella pertussis
acgccuuguucgcgcgcgg

SEQ ID NO: 342865 - RNA, 12 nt, Bordetella pertussis
acgcgaacccga

SEQ ID NO: 342866 - RNA, 17 nt, Bordetella pertussis
acgcgacacgcagcaac

SEQ ID NO: 342867 - RNA, 21 nt, Bordetella pertussis
acgcgauuuccuugcgccgcc

SEQ ID NO: 342868 - RNA, 18 nt, Bordetella pertussis
acgcgcaagccgcuggau

SEQ ID NO: 342869 - RNA, 14 nt, Bordetella pertussis
acgcgcaagcggcc

SEQ ID NO: 342870 - RNA, 22 nt, Bordetella pertussis
acgcgcaaggcgggcuggucgc

SEQ ID NO: 342871 - RNA, 23 nt, Bordetella pertussis
acgcgcaccagcuuggccugcgg

SEQ ID NO: 342872 - RNA, 22 nt, Bordetella pertussis
acgcgcaccaggccugccugau

SEQ ID NO: 342873 - RNA, 14 nt, Bordetella pertussis
acgcgcacggccag

SEQ ID NO: 342874 - RNA, 15 nt, Bordetella pertussis
acgcgcagcacgcug

SEQ ID NO: 342875 - RNA, 18 nt, Bordetella pertussis
acgcgcagcacgcugcgc

SEQ ID NO: 342876 - RNA, 20 nt, Bordetella pertussis
acgcgcagcgaacggcccac

SEQ ID NO: 342877 - RNA, 15 nt, Bordetella pertussis
acgcgcagcggcagg

SEQ ID NO: 342878 - RNA, 13 nt, Bordetella pertussis
acgcgcagcgucu

SEQ ID NO: 342879 - RNA, 13 nt, Bordetella pertussis
acgcgcgcggcgc

SEQ ID NO: 342880 - RNA, 14 nt, Bordetella pertussis
acgcgcgcggcgcg

SEQ ID NO: 342881 - RNA, 16 nt, Bordetella pertussis
acgcgcgcggcgcggc

SEQ ID NO: 342882 - RNA, 15 nt, Bordetella pertussis
acgcgcgcgggcgcg

SEQ ID NO: 342883 - RNA, 17 nt, Bordetella pertussis
acgcgcgcgggcgcgcc

SEQ ID NO: 342884 - RNA, 19 nt, Bordetella pertussis
acgcgcgcgggcgcgccgu

SEQ ID NO: 342885 - RNA, 13 nt, Bordetella pertussis
acgcgcgggcugg

SEQ ID NO: 342886 - RNA, 13 nt, Bordetella pertussis
acgcgcggcagcg

SEQ ID NO: 342887 - RNA, 23 nt, Bordetella pertussis
acgcgcggccuauuuggcggccu

SEQ ID NO: 342888 - RNA, 18 nt, Bordetella pertussis
acgcgcguccuuggcggc

SEQ ID NO: 342889 - RNA, 16 nt, Bordetella pertussis
acgcgcuccggcugcg

SEQ ID NO: 342890 - RNA, 17 nt, Bordetella pertussis
acgcgcuccggcugcgc

SEQ ID NO: 342891 - RNA, 18 nt, Bordetella pertussis
acgcgcuccggcugcgcg

SEQ ID NO: 342892 - RNA, 20 nt, Bordetella pertussis
acgcgcuccggcugcgcgcg

SEQ ID NO: 342893 - RNA, 22 nt, Bordetella pertussis
acgcgcuccugcucggcgaugc

SEQ ID NO: 342894 - RNA, 16 nt, Bordetella pertussis
acgcgcucgccgucga

SEQ ID NO: 342895 - RNA, 15 nt, Bordetella pertussis
acgcgcucgcgcgcg

SEQ ID NO: 342896 - RNA, 13 nt, Bordetella pertussis
acgcgcugccgga

SEQ ID NO: 342897 - RNA, 14 nt, Bordetella pertussis
acgcgcugcgcgcc

SEQ ID NO: 342898 - RNA, 23 nt, Bordetella pertussis
acgcgcugcugcaguugcgccac

SEQ ID NO: 342899 - RNA, 12 nt, Bordetella pertussis
acgcgcuggccg

SEQ ID NO: 342900 - RNA, 14 nt, Bordetella pertussis
acgcgcuggccgac

SEQ ID NO: 342901 - RNA, 22 nt, Bordetella pertussis
acgcgcugguaguagagcgaau

SEQ ID NO: 342902 - RNA, 16 nt, Bordetella pertussis
acgcgcuguaggcgcc

SEQ ID NO: 342903 - RNA, 18 nt, Bordetella pertussis
acgcgcuguaggcgccgg

SEQ ID NO: 342904 - RNA, 19 nt, Bordetella pertussis
acgcgcuguaggcgccggc

SEQ ID NO: 342905 - RNA, 22 nt, Bordetella pertussis
acgcgcuguaggcgccggcgcc

SEQ ID NO: 342906 - RNA, 21 nt, Bordetella pertussis
acgcgcuugcucggugcgggc

SEQ ID NO: 342907 - RNA, 16 nt, Bordetella pertussis
acgcgcuguugcuggc

SEQ ID NO: 342908 - RNA, 17 nt, Bordetella pertussis
acgcgcuguugcuggcc

SEQ ID NO: 342909 - RNA, 14 nt, Bordetella pertussis
acgcggcggccggu

SEQ ID NO: 342910 - RNA, 20 nt, Bordetella pertussis
acgcggcguacuggcgcggc

SEQ ID NO: 342911 - RNA, 13 nt, Bordetella pertussis
acgcggcgucagg

SEQ ID NO: 342912 - RNA, 18 nt, Bordetella pertussis
acgcggcgucgacgcccg

SEQ ID NO: 342913 - RNA, 19 nt, Bordetella pertussis
acgcgggcauugggcagcg

SEQ ID NO: 342914 - RNA, 16 nt, Bordetella pertussis
acgcgggccacgcgcc

SEQ ID NO: 342915 - RNA, 12 nt, Bordetella pertussis
acgcgggcgugg

SEQ ID NO: 342916 - RNA, 16 nt, Bordetella pertussis
acgcgggcguggucau

SEQ ID NO: 342917 - RNA, 16 nt, Bordetella pertussis
acgcgggccggccguu

SEQ ID NO: 342918 - RNA, 11 nt, Bordetella pertussis
acgcggggaca

SEQ ID NO: 342919 - RNA, 20 nt, Bordetella pertussis
acgcggguucgacgccggca

SEQ ID NO: 342920 - RNA, 19 nt, Bordetella pertussis
acgcgguagguagcgcgca

SEQ ID NO: 342921 - RNA, 14 nt, Bordetella pertussis
acgcgguccacgcc

SEQ ID NO: 342922 - RNA, 21 nt, Bordetella pertussis
acgcgguccagccccugcccg

SEQ ID NO: 342923 - RNA, 14 nt, Bordetella pertussis
acgcggucgaugcg

SEQ ID NO: 342924 - RNA, 15 nt, Bordetella pertussis
acgcggucgaugcgc

SEQ ID NO: 342925 - RNA, 21 nt, Bordetella pertussis
acgcggugcaucucggcaucg

SEQ ID NO: 342926 - RNA, 22 nt, Bordetella pertussis
acgcggugcaucucggcaucgg

SEQ ID NO: 342927 - RNA, 12 nt, Bordetella pertussis
acgcgguggcgu

SEQ ID NO: 342928 - RNA, 23 nt, Bordetella pertussis
acgcucagcaugcgcugggcggu

SEQ ID NO: 342929 - RNA, 17 nt, Bordetella pertussis
acgcucauccaggcgcg

SEQ ID NO: 342930 - RNA, 23 nt, Bordetella pertussis
acgcucgagguaggcgggacugg

SEQ ID NO: 342931 - RNA, 14 nt, Bordetella pertussis
acgcucgaugcgcc

SEQ ID NO: 342932 - RNA, 16 nt, Bordetella pertussis
acgcucgaugcgccag

SEQ ID NO: 342933 - RNA, 14 nt, Bordetella pertussis
acgcugaucgccgg

SEQ ID NO: 342934 - RNA, 18 nt, Bordetella pertussis
acgcugaucgccggcgcc

SEQ ID NO: 342935 - RNA, 16 nt, Bordetella pertussis
acgcugaucggccgac

SEQ ID NO: 342936 - RNA, 16 nt, Bordetella pertussis
acgcugaucucggccu

SEQ ID NO: 342937 - RNA, 17 nt, Bordetella pertussis
acgcugaugcgcgucag

SEQ ID NO: 342938 - RNA, 14 nt, Bordetella pertussis
acgcugauggccgc

SEQ ID NO: 342939 - RNA, 15 nt, Bordetella pertussis
acgcugauggccgcc

SEQ ID NO: 342940 - RNA, 22 nt, Bordetella pertussis
acgcugauggccgccagcggcu

SEQ ID NO: 342941 - RNA, 13 nt, Bordetella pertussis
acgcugcccugcu

SEQ ID NO: 342942 - RNA, 14 nt, Bordetella pertussis
acgcugcgcaggcg

SEQ ID NO: 342943 - RNA, 19 nt, Bordetella pertussis
acgcugcgcggcggcuugc

SEQ ID NO: 342944 - RNA, 21 nt, Bordetella pertussis
acgcuggaagagaccgcuuau

SEQ ID NO: 342945 - RNA, 22 nt, Bordetella pertussis
acgcuguaacaacacguacgac

SEQ ID NO: 342946 - RNA, 21 nt, Bordetella pertussis
acgcuguacugguaccaggcg

SEQ ID NO: 342947 - RNA, 16 nt, Bordetella pertussis
acgcuguagaggcgcg

SEQ ID NO: 342948 - RNA, 13 nt, Bordetella pertussis
acgcugucgcgcc

SEQ ID NO: 342949 - RNA, 16 nt, Bordetella pertussis
acgcuuaucgcggcgc

SEQ ID NO: 342950 - RNA, 17 nt, Bordetella pertussis
acgcuuaucgcggcgcg

SEQ ID NO: 342951 - RNA, 19 nt, Bordetella pertussis
acgcuuccugggccugcgg

SEQ ID NO: 342952 - RNA, 15 nt, Bordetella pertussis
acgcuugacggccag

SEQ ID NO: 342953 - RNA, 22 nt, Bordetella pertussis
acgcuuugcgucuccacgccgc

SEQ ID NO: 342954 - RNA, 12 nt, Bordetella pertussis
acggacagcccg

SEQ ID NO: 342955 - RNA, 17 nt, Bordetella pertussis
acggacagcccgcgcug

SEQ ID NO: 342956 - RNA, 12 nt, Bordetella pertussis
acggacgagcgc

SEQ ID NO: 342957 - RNA, 17 nt, Bordetella pertussis
acggauggucgugcggc

SEQ ID NO: 342958 - RNA, 23 nt, Bordetella pertussis
acggcaaaacggugccuugcggc

SEQ ID NO: 342959 - RNA, 19 nt, Bordetella pertussis
acggcaaaagccggggugc

SEQ ID NO: 342960 - RNA, 16 nt, Bordetella pertussis
acggcaagagccuggc

SEQ ID NO: 342961 - RNA, 19 nt, Bordetella pertussis
acggcaagucgacgcugau

SEQ ID NO: 342962 - RNA, 21 nt, Bordetella pertussis
acggcaaugucgcaggccgcg

SEQ ID NO: 342963 - RNA, 13 nt, Bordetella pertussis
acggcaccagccg

SEQ ID NO: 342964 - RNA, 13 nt, Bordetella pertussis
acggcagauggac

SEQ ID NO: 342965 - RNA, 20 nt, Bordetella pertussis
acggcacgccucgccggccc

SEQ ID NO: 342966 - RNA, 16 nt, Bordetella pertussis
acggcagcagcgcgcc

SEQ ID NO: 342967 - RNA, 17 nt, Bordetella pertussis
acggcagcagcgcgccg

SEQ ID NO: 342968 - RNA, 18 nt, Bordetella pertussis
acggcagcagcgcgccgg

SEQ ID NO: 342969 - RNA, 12 nt, Bordetella pertussis
acggcagccccg

SEQ ID NO: 342970 - RNA, 12 nt, Bordetella pertussis
acggcagcgcgc

SEQ ID NO: 342971 - RNA, 22 nt, Bordetella pertussis
acggcagcuugucgaucgccac

SEQ ID NO: 342972 - RNA, 16 nt, Bordetella pertussis
acggcaggcgccugcc

SEQ ID NO: 342973 - RNA, 17 nt, Bordetella pertussis
acggcaggcgccugccc

SEQ ID NO: 342974 - RNA, 19 nt, Bordetella pertussis
acggcaggcgccugcccug

SEQ ID NO: 342975 - RNA, 19 nt, Bordetella pertussis
acggcaucggccagcauac

SEQ ID NO: 342976 - RNA, 21 nt, Bordetella pertussis
acggcaucggcgccgcgcgcu

SEQ ID NO: 342977 - RNA, 18 nt, Bordetella pertussis
acggcaucuguccgcgcc

SEQ ID NO: 342978 - RNA, 22 nt, Bordetella pertussis
acggcauggccagcuucgggcc

SEQ ID NO: 342979 - RNA, 20 nt, Bordetella pertussis
acggcauggccggcaggucg

SEQ ID NO: 342980 - RNA, 20 nt, Bordetella pertussis
acggcaugucccgaggcgcc

SEQ ID NO: 342981 - RNA, 15 nt, Bordetella pertussis
acggccaacccucgc

SEQ ID NO: 342982 - RNA, 18 nt, Bordetella pertussis
acggccaagcagcgccug

SEQ ID NO: 342983 - RNA, 20 nt, Bordetella pertussis
acggccaagcagcgccugcc

SEQ ID NO: 342984 - RNA, 21 nt, Bordetella pertussis
acggccaagcagcgccugccg

SEQ ID NO: 342985 - RNA, 16 nt, Bordetella pertussis
acggccaccagggccc

SEQ ID NO: 342986 - RNA, 17 nt, Bordetella pertussis
acggccacgaucaucag

SEQ ID NO: 342987 - RNA, 17 nt, Bordetella pertussis
acggccacggccggcag

SEQ ID NO: 342988 - RNA, 16 nt, Bordetella pertussis
acggccagcacguaga

SEQ ID NO: 342989 - RNA, 21 nt, Bordetella pertussis
acggccagcaggagcccgcug

SEQ ID NO: 342990 - RNA, 21 nt, Bordetella pertussis
acggccagcaucguaucgggc

SEQ ID NO: 342991 - RNA, 22 nt, Bordetella pertussis
acggccagcaucguaucgggcg

SEQ ID NO: 342992 - RNA, 21 nt, Bordetella pertussis
acggccagcauuaccagcaac

SEQ ID NO: 342993 - RNA, 16 nt, Bordetella pertussis
acggccagcgccagcc

SEQ ID NO: 342994 - RNA, 18 nt, Bordetella pertussis
acggccagcgucagcgca

SEQ ID NO: 342995 - RNA, 16 nt, Bordetella pertussis
acggccaggacggcau

SEQ ID NO: 342996 - RNA, 21 nt, Bordetella pertussis
acggcccacgcugucggggug

SEQ ID NO: 342997 - RNA, 21 nt, Bordetella pertussis
acggcggaaugcggcgacagg

SEQ ID NO: 342998 - RNA, 15 nt, Bordetella pertussis
acggcggacuggccg

SEQ ID NO: 342999 - RNA, 16 nt, Bordetella pertussis
acggcggacuggccgc

SEQ ID NO: 343000 - RNA, 22 nt, Bordetella pertussis
acggcggacuggccgcgccgcu

SEQ ID NO: 343001 - RNA, 22 nt, Bordetella pertussis
acggcggcaggccgcgccacag

SEQ ID NO: 343002 - RNA, 20 nt, Bordetella pertussis
acggcggcgaucacgccguc

SEQ ID NO: 343003 - RNA, 13 nt, Bordetella pertussis
acggcggcgcggc

SEQ ID NO: 343004 - RNA, 18 nt, Bordetella pertussis
acggcggcgcggcgccag

SEQ ID NO: 343005 - RNA, 20 nt, Bordetella pertussis
acggcggcggccaucgccau

SEQ ID NO: 343006 - RNA, 13 nt, Bordetella pertussis
acggcgggccggc

SEQ ID NO: 343007 - RNA, 15 nt, Bordetella pertussis
acggcgggaucgggc

SEQ ID NO: 343008 - RNA, 14 nt, Bordetella pertussis
acggcgggcgcgca

SEQ ID NO: 343009 - RNA, 20 nt, Bordetella pertussis
acggcgggcgcgcaggccuc

SEQ ID NO: 343010 - RNA, 17 nt, Bordetella pertussis
acgggaauccgcugcgc

SEQ ID NO: 343011 - RNA, 22 nt, Bordetella pertussis
acgggaauccgcugcgccgagg

SEQ ID NO: 343012 - RNA, 16 nt, Bordetella pertussis
acgggauugccgucac

SEQ ID NO: 343013 - RNA, 19 nt, Bordetella pertussis
acgggcacgauggccgcgc

SEQ ID NO: 343014 - RNA, 15 nt, Bordetella pertussis
acgggcagacgccau

SEQ ID NO: 343015 - RNA, 21 nt, Bordetella pertussis
acgggcgagggcugcccucgc

SEQ ID NO: 343016 - RNA, 11 nt, Bordetella pertussis
acgggcgccag

SEQ ID NO: 343017 - RNA, 17 nt, Bordetella pertussis
acgggcgccuguccccg

SEQ ID NO: 343018 - RNA, 20 nt, Bordetella pertussis
acgggcgccuguccccgcug

SEQ ID NO: 343019 - RNA, 15 nt, Bordetella pertussis
acgggcgcggcgucg

SEQ ID NO: 343020 - RNA, 21 nt, Bordetella pertussis
acgggcgcacaguugcaggcc

SEQ ID NO: 343021 - RNA, 21 nt, Bordetella pertussis
acgggcgcugcacgcagcgca

SEQ ID NO: 343022 - RNA, 17 nt, Bordetella pertussis
acgggcggcggcgcgcg

SEQ ID NO: 343023 - RNA, 19 nt, Bordetella pertussis
acgggcggcggcgcgcgcg

SEQ ID NO: 343024 - RNA, 18 nt, Bordetella pertussis
acgggcggcgucgccgcg

SEQ ID NO: 343025 - RNA, 22 nt, Bordetella pertussis
acgggcggcgucgccgcgcacg

SEQ ID NO: 343026 - RNA, 16 nt, Bordetella pertussis
acgggcggcugcuggc

SEQ ID NO: 343027 - RNA, 15 nt, Bordetella pertussis
acgggcucgcugacc

SEQ ID NO: 343028 - RNA, 14 nt, Bordetella pertussis
acgggcugauggcc

SEQ ID NO: 343029 - RNA, 13 nt, Bordetella pertussis
acgggcugggccg

SEQ ID NO: 343030 - RNA, 20 nt, Bordetella pertussis
acgggcugggccgaggcgcc

SEQ ID NO: 343031 - RNA, 14 nt, Bordetella pertussis
acggguaucgucga

SEQ ID NO: 343032 - RNA, 15 nt, Bordetella pertussis
acgggucaggcugcg

SEQ ID NO: 343033 - RNA, 16 nt, Bordetella pertussis
acgggugaggcgacgg

SEQ ID NO: 343034 - RNA, 12 nt, Bordetella pertussis
acgguaggcgcg

SEQ ID NO: 343035 - RNA, 18 nt, Bordetella pertussis
acgguaucucagcgcgcc

SEQ ID NO: 343036 - RNA, 14 nt, Bordetella pertussis
acgguaucgcgucg

SEQ ID NO: 343037 - RNA, 24 nt, Bordetella pertussis
acggucagcaaccccagcagcgcc

SEQ ID NO: 343038 - RNA, 18 nt, Bordetella pertussis
acgguccaggcggccgcg

SEQ ID NO: 343039 - RNA, 15 nt, Bordetella pertussis
acgguccugcgcgcc

SEQ ID NO: 343040 - RNA, 22 nt, Bordetella pertussis
acggucgaagaucuucggcaug

SEQ ID NO: 343041 - RNA, 23 nt, Bordetella pertussis
acggucgacaccgugaaggugcc

SEQ ID NO: 343042 - RNA, 16 nt, Bordetella pertussis
acggucgccggcaugu

SEQ ID NO: 343043 - RNA, 16 nt, Bordetella pertussis
acggucgcgagcugcg

SEQ ID NO: 343044 - RNA, 16 nt, Bordetella pertussis
acggucggcacgucgg

SEQ ID NO: 343045 - RNA, 13 nt, Bordetella pertussis
acggucucguucc

SEQ ID NO: 343046 - RNA, 17 nt, Bordetella pertussis
acggucugcacgccggg

SEQ ID NO: 343047 - RNA, 22 nt, Bordetella pertussis
acggucugcacgccgggcgcgc

SEQ ID NO: 343048 - RNA, 16 nt, Bordetella pertussis
acggucugccgcugau

SEQ ID NO: 343049 - RNA, 21 nt, Bordetella pertussis
acgguggcuggggcuggcaug

SEQ ID NO: 343050 - RNA, 23 nt, Bordetella pertussis
acgguggcgaaggccgccgcgcc

SEQ ID NO: 343051 - RNA, 20 nt, Bordetella pertussis
acggugggcagcagcacgcc

SEQ ID NO: 343052 - RNA, 14 nt, Bordetella pertussis
acggugggcgacgc

SEQ ID NO: 343053 - RNA, 21 nt, Bordetella pertussis
acgguggugucggcggccagc

SEQ ID NO: 343054 - RNA, 24 nt, Bordetella pertussis
acgguucagcgcgccagcgcgcga

SEQ ID NO: 343055 - RNA, 23 nt, Bordetella pertussis
acguaggccauugaaagcgcgag

SEQ ID NO: 343056 - RNA, 23 nt, Bordetella pertussis
acguaguugguggcaggcgccca

SEQ ID NO: 343057 - RNA, 12 nt, Bordetella pertussis
acgucgccggcg

SEQ ID NO: 343058 - RNA, 16 nt, Bordetella pertussis
acgucgcgaccgccgc

SEQ ID NO: 343059 - RNA, 17 nt, Bordetella pertussis
acgucgcggcugggcaa

SEQ ID NO: 343060 - RNA, 14 nt, Bordetella pertussis
acgucggugacggc

SEQ ID NO: 343061 - RNA, 14 nt, Bordetella pertussis
acgucguaccccga

SEQ ID NO: 343062 - RNA, 18 nt, Bordetella pertussis
acgugcugcugcacguga

SEQ ID NO: 343063 - RNA, 22 nt, Bordetella pertussis
acguggaccgcgcgguggccgc

SEQ ID NO: 343064 - RNA, 20 nt, Bordetella pertussis
acguggcccgcgugacggcc

SEQ ID NO: 343065 - RNA, 21 nt, Bordetella pertussis
acguggaugaugcgcgagccg

SEQ ID NO: 343066 - RNA, 13 nt, Bordetella pertussis
acguggcgacguc

SEQ ID NO: 343067 - RNA, 15 nt, Bordetella pertussis
acguguugccaggcg

SEQ ID NO: 343068 - RNA, 23 nt, Bordetella pertussis
acugaacgcguccaggcccuggc

SEQ ID NO: 343069 - RNA, 17 nt, Bordetella pertussis
acugcagcaguucggcg

SEQ ID NO: 343070 - RNA, 20 nt, Bordetella pertussis
acugcagcaguucggcgucg

SEQ ID NO: 343071 - RNA, 21 nt, Bordetella pertussis
acugcagcaguucggcgucgg

SEQ ID NO: 343072 - RNA, 20 nt, Bordetella pertussis
acugcaggaugaggcgccgg

SEQ ID NO: 343073 - RNA, 18 nt, Bordetella pertussis
acugcaggccgccggccu

SEQ ID NO: 343074 - RNA, 14 nt, Bordetella pertussis
acugccggcgcggg

SEQ ID NO: 343075 - RNA, 16 nt, Bordetella pertussis
acugccggcgcgggcg

SEQ ID NO: 343076 - RNA, 18 nt, Bordetella pertussis
acugcgugaaacgcucga

SEQ ID NO: 343077 - RNA, 13 nt, Bordetella pertussis
acuggcccaggcg

SEQ ID NO: 343078 - RNA, 14 nt, Bordetella pertussis
acuggccgaugguc

SEQ ID NO: 343079 - RNA, 12 nt, Bordetella pertussis
acuggccgcgcc

SEQ ID NO: 343080 - RNA, 12 nt, Bordetella pertussis
acuggccgcgcu

SEQ ID NO: 343081 - RNA, 14 nt, Bordetella pertussis
acuggccggccugg

SEQ ID NO: 343082 - RNA, 13 nt, Bordetella pertussis
acuggcgcgcgca

SEQ ID NO: 343083 - RNA, 22 nt, Bordetella pertussis
acuggcgcggcgcuacgccgcc

SEQ ID NO: 343084 - RNA, 12 nt, Bordetella pertussis
acuggcgcugcc

SEQ ID NO: 343085 - RNA, 17 nt, Bordetella pertussis
acugggugcuggccaac

SEQ ID NO: 343086 - RNA, 20 nt, Bordetella pertussis
acuggguggccagcgccgcc

SEQ ID NO: 343087 - RNA, 16 nt, Bordetella pertussis
acuuccgcuuccggcc

SEQ ID NO: 343088 - RNA, 23 nt, Bordetella pertussis
acuuccucgaccagcccggccgc

SEQ ID NO: 343089 - RNA, 19 nt, Bordetella pertussis
acuucgaaaaugacggcga

SEQ ID NO: 343090 - RNA, 15 nt, Bordetella pertussis
acuucgacggcagca

SEQ ID NO: 343091 - RNA, 21 nt, Bordetella pertussis
acuucgagcgacggcaaugcc

SEQ ID NO: 343092 - RNA, 16 nt, Bordetella pertussis
agaaaccuggcccggc

SEQ ID NO: 343093 - RNA, 19 nt, Bordetella pertussis
agaaacuggcgcugccgac

SEQ ID NO: 343094 - RNA, 17 nt, Bordetella pertussis
agaaauagcccgcggcc

SEQ ID NO: 343095 - RNA, 14 nt, Bordetella pertussis
agaaaucgccgccg

SEQ ID NO: 343096 - RNA, 17 nt, Bordetella pertussis
agaacagcggaucgccg

SEQ ID NO: 343097 - RNA, 18 nt, Bordetella pertussis
agaacagggugccgcccu

SEQ ID NO: 343098 - RNA, 15 nt, Bordetella pertussis
agaacccggccggcg

SEQ ID NO: 343099 - RNA, 21 nt, Bordetella pertussis
agaacccggccggcgccggca

SEQ ID NO: 343100 - RNA, 12 nt, Bordetella pertussis
agaacgcggccg

SEQ ID NO: 343101 - RNA, 14 nt, Bordetella pertussis
agaacgcgucgcuc

SEQ ID NO: 343102 - RNA, 16 nt, Bordetella pertussis
agaacgcaugcgugcg

SEQ ID NO: 343103 - RNA, 14 nt, Bordetella pertussis
agaacucggccgca

SEQ ID NO: 343104 - RNA, 21 nt, Bordetella pertussis
agaacugcucgaccgcuucgg

SEQ ID NO: 343105 - RNA, 14 nt, Bordetella pertussis
agaagaagccgggc

SEQ ID NO: 343106 - RNA, 23 nt, Bordetella pertussis
agaagaucgucgacguccuggug

SEQ ID NO: 343107 - RNA, 19 nt, Bordetella pertussis
agaagcagccgcgcggccg

SEQ ID NO: 343108 - RNA, 19 nt, Bordetella pertussis
agaagccgggcucgcugac

SEQ ID NO: 343109 - RNA, 14 nt, Bordetella pertussis
agaagcgccgcgcc

SEQ ID NO: 343110 - RNA, 14 nt, Bordetella pertussis
agaaggccuuggcc

SEQ ID NO: 343111 - RNA, 14 nt, Bordetella pertussis
agacacgcuagggc

SEQ ID NO: 343112 - RNA, 15 nt, Bordetella pertussis
agacagauguccgug

SEQ ID NO: 343113 - RNA, 21 nt, Bordetella pertussis
agacaugcucgaugccggccu

SEQ ID NO: 343114 - RNA, 22 nt, Bordetella pertussis
agacaugcugcgacagcagggc

SEQ ID NO: 343115 - RNA, 13 nt, Bordetella pertussis
agacauggcgcgc

SEQ ID NO: 343116 - RNA, 20 nt, Bordetella pertussis
agacauugucaagcagcgcc

SEQ ID NO: 343117 - RNA, 13 nt, Bordetella pertussis
agaccaagcugcg

SEQ ID NO: 343118 - RNA, 18 nt, Bordetella pertussis
agaccacgauggccggcg

SEQ ID NO: 343119 - RNA, 14 nt, Bordetella pertussis
agaccacgccggcg

SEQ ID NO: 343120 - RNA, 19 nt, Bordetella pertussis
agaccacgcgcugcgcgcc

SEQ ID NO: 343121 - RNA, 13 nt, Bordetella pertussis
agacccuggcgcg

SEQ ID NO: 343122 - RNA, 18 nt, Bordetella pertussis
agaccgagcgcgcccgcu

SEQ ID NO: 343123 - RNA, 20 nt, Bordetella pertussis
agaccgagcgcgcccgcuug

SEQ ID NO: 343124 - RNA, 17 nt, Bordetella pertussis
agaccggguuuccagcc

SEQ ID NO: 343125 - RNA, 18 nt, Bordetella pertussis
agaccguggaaaccgcgu

SEQ ID NO: 343126 - RNA, 21 nt, Bordetella pertussis
agaccguggaaaccgcgucgu

SEQ ID NO: 343127 - RNA, 14 nt, Bordetella pertussis
agaccuaccaggcc

SEQ ID NO: 343128 - RNA, 18 nt, Bordetella pertussis
agaccugcgcgccggcau

SEQ ID NO: 343129 - RNA, 15 nt, Bordetella pertussis
agacgaaggcgccgg

SEQ ID NO: 343130 - RNA, 20 nt, Bordetella pertussis
agacgaagucccagccggcc

SEQ ID NO: 343131 - RNA, 16 nt, Bordetella pertussis
agacgaugcccaggcc

SEQ ID NO: 343132 - RNA, 19 nt, Bordetella pertussis
agacgaugcccaggcccgc

SEQ ID NO: 343133 - RNA, 22 nt, Bordetella pertussis
agacgauggccgaaugcccgcc

SEQ ID NO: 343134 - RNA, 14 nt, Bordetella pertussis
agacgcggcagggc

SEQ ID NO: 343135 - RNA, 17 nt, Bordetella pertussis
agacgcgcucgccgucg

SEQ ID NO: 343136 - RNA, 23 nt, Bordetella pertussis
agacgcgcuuuuccccgcccagc

SEQ ID NO: 343137 - RNA, 13 nt, Bordetella pertussis
agacggccgccga

SEQ ID NO: 343138 - RNA, 16 nt, Bordetella pertussis
agacggcgcucggccu

SEQ ID NO: 343139 - RNA, 20 nt, Bordetella pertussis
agacggcuugaccacggcca

SEQ ID NO: 343140 - RNA, 17 nt, Bordetella pertussis
agacggucaccgcgccc

SEQ ID NO: 343141 - RNA, 20 nt, Bordetella pertussis
agacggucaccgcgcccagg

SEQ ID NO: 343142 - RNA, 21 nt, Bordetella pertussis
agacgucggcgauggcccggu

SEQ ID NO: 343143 - RNA, 19 nt, Bordetella pertussis
agagaaucaugggcgacgc

SEQ ID NO: 343144 - RNA, 14 nt, Bordetella pertussis
agagcaggccgccc

SEQ ID NO: 343145 - RNA, 15 nt, Bordetella pertussis
agagcaugcggcguc

SEQ ID NO: 343146 - RNA, 19 nt, Bordetella pertussis
agagcccuucgacgcggcg

SEQ ID NO: 343147 - RNA, 20 nt, Bordetella pertussis
agagcgccacgccagcggcg

SEQ ID NO: 343148 - RNA, 14 nt, Bordetella pertussis
agagcugcggcgcg

SEQ ID NO: 343149 - RNA, 18 nt, Bordetella pertussis
agagcugcggcgcggcgc

SEQ ID NO: 343150 - RNA, 15 nt, Bordetella pertussis
agaggaacgccgcgc

SEQ ID NO: 343151 - RNA, 14 nt, Bordetella pertussis
agagggagcgacac

SEQ ID NO: 343152 - RNA, 12 nt, Bordetella pertussis
agagggcgacgg

SEQ ID NO: 343153 - RNA, 21 nt, Bordetella pertussis
agagggcggggcgugagcagg

SEQ ID NO: 343154 - RNA, 16 nt, Bordetella pertussis
agaguuucggcgacga

SEQ ID NO: 343155 - RNA, 14 nt, Bordetella pertussis
agauaccggcaugg

SEQ ID NO: 343156 - RNA, 18 nt, Bordetella pertussis
agauagaacgagguccgc

SEQ ID NO: 343157 - RNA, 18 nt, Bordetella pertussis
agaucacauaggccggca

SEQ ID NO: 343158 - RNA, 18 nt, Bordetella pertussis
agaucagccgcugcagca

SEQ ID NO: 343159 - RNA, 20 nt, Bordetella pertussis
agaucaggucgaugccggcg

SEQ ID NO: 343160 - RNA, 13 nt, Bordetella pertussis
agauccgccggcg

SEQ ID NO: 343161 - RNA, 21 nt, Bordetella pertussis
agaucgcauuucucggccugg

SEQ ID NO: 343162 - RNA, 21 nt, Bordetella pertussis
agaucgcccgcgugcgugccg

SEQ ID NO: 343163 - RNA, 23 nt, Bordetella pertussis
agaucgccgccgaagccgccgcc

SEQ ID NO: 343164 - RNA, 13 nt, Bordetella pertussis
agaucgccgccgc

SEQ ID NO: 343165 - RNA, 14 nt, Bordetella pertussis
agaucgccgccgcc

SEQ ID NO: 343166 - RNA, 23 nt, Bordetella pertussis
agaucgcggcggguggccucgcc

SEQ ID NO: 343167 - RNA, 16 nt, Bordetella pertussis
agaucggcccggcgcc

SEQ ID NO: 343168 - RNA, 18 nt, Bordetella pertussis
agaucggcccggcgccgg

SEQ ID NO: 343169 - RNA, 15 nt, Bordetella pertussis
agaucggcggccugg

SEQ ID NO: 343170 - RNA, 15 nt, Bordetella pertussis
agaucucgacgucgu

SEQ ID NO: 343171 - RNA, 13 nt, Bordetella pertussis
agaucuggcgcgu

SEQ ID NO: 343172 - RNA, 15 nt, Bordetella pertussis
agaucuugccggccg

SEQ ID NO: 343173 - RNA, 16 nt, Bordetella pertussis
agaugauccggacuga

SEQ ID NO: 343174 - RNA, 15 nt, Bordetella pertussis
agaugcaccggccag

SEQ ID NO: 343175 - RNA, 17 nt, Bordetella pertussis
agaugccagcggcgcag

SEQ ID NO: 343176 - RNA, 14 nt, Bordetella pertussis
agaugcgcgccgua

SEQ ID NO: 343177 - RNA, 16 nt, Bordetella pertussis
agaugcgggucggcgc

SEQ ID NO: 343178 - RNA, 14 nt, Bordetella pertussis
agauggcccagggc

SEQ ID NO: 343179 - RNA, 20 nt, Bordetella pertussis
agauggcgcaggcgcgcgcc

SEQ ID NO: 343180 - RNA, 13 nt, Bordetella pertussis
agauggcgccgau

SEQ ID NO: 343181 - RNA, 12 nt, Bordetella pertussis
agauggcggcga

SEQ ID NO: 343182 - RNA, 19 nt, Bordetella pertussis
agauggcuuucuaucauca

SEQ ID NO: 343183 - RNA, 14 nt, Bordetella pertussis
agaugggcaggccc

SEQ ID NO: 343184 - RNA, 15 nt, Bordetella pertussis
agaugggcaggccca

SEQ ID NO: 343185 - RNA, 13 nt, Bordetella pertussis
agaugggcggcga

SEQ ID NO: 343186 - RNA, 23 nt, Bordetella pertussis
agauggggguggaaaugccggcg

SEQ ID NO: 343187 - RNA, 16 nt, Bordetella pertussis
agaugucaguccucau

SEQ ID NO: 343188 - RNA, 14 nt, Bordetella pertussis
agaugugcggcgug

SEQ ID NO: 343189 - RNA, 15 nt, Bordetella pertussis
agauucaugggcggc

SEQ ID NO: 343190 - RNA, 22 nt, Bordetella pertussis
agauugccgcgcggcgcguuca

SEQ ID NO: 343191 - RNA, 14 nt, Bordetella pertussis
agauuggccgagcg

SEQ ID NO: 343192 - RNA, 20 nt, Bordetella pertussis
agcagcgugaugcggucggc

SEQ ID NO: 343193 - RNA, 22 nt, Bordetella pertussis
agcagcguggccaccaggcgcg

SEQ ID NO: 343194 - RNA, 23 nt, Bordetella pertussis
agcagcguggccgccaccagcgc

SEQ ID NO: 343195 - RNA, 18 nt, Bordetella pertussis
agcagcguugcggcgucg

SEQ ID NO: 343196 - RNA, 22 nt, Bordetella pertussis
agcaggcccugggccagcagcu

SEQ ID NO: 343197 - RNA, 16 nt, Bordetella pertussis
agcaggcccugggcga

SEQ ID NO: 343198 - RNA, 13 nt, Bordetella pertussis
agcaggccgcgcg

SEQ ID NO: 343199 - RNA, 14 nt, Bordetella pertussis
agcaggccgcgcgu

SEQ ID NO: 343200 - RNA, 14 nt, Bordetella pertussis
agcagcuggcgcag

SEQ ID NO: 343201 - RNA, 16 nt, Bordetella pertussis
agcaggccggcggcga

SEQ ID NO: 343202 - RNA, 22 nt, Bordetella pertussis
agcaggccguaaccggccaguc

SEQ ID NO: 343203 - RNA, 17 nt, Bordetella pertussis
agcaggccguugccgcu

SEQ ID NO: 343204 - RNA, 20 nt, Bordetella pertussis
agcaggcgaaacgccagccc

SEQ ID NO: 343205 - RNA, 16 nt, Bordetella pertussis
agcaggcgcaccagcg

SEQ ID NO: 343206 - RNA, 14 nt, Bordetella pertussis
agcaggcgcaggcc

SEQ ID NO: 343207 - RNA, 19 nt, Bordetella pertussis
agcaggcgcaggccgcgcg

SEQ ID NO: 343208 - RNA, 16 nt, Bordetella pertussis
agcaggcgcaucagcu

SEQ ID NO: 343209 - RNA, 15 nt, Bordetella pertussis
agcaggcgcgagcgc

SEQ ID NO: 343210 - RNA, 17 nt, Bordetella pertussis
agcaggcgcgcggccuc

SEQ ID NO: 343211 - RNA, 20 nt, Bordetella pertussis
agcaggcgcgcucaggccgc

SEQ ID NO: 343212 - RNA, 19 nt, Bordetella pertussis
agcaggcgcucggccagcg

SEQ ID NO: 343213 - RNA, 20 nt, Bordetella pertussis
agcaggcggccgaccagcac

SEQ ID NO: 343214 - RNA, 18 nt, Bordetella pertussis
agcagggcaucaccaucg

SEQ ID NO: 343215 - RNA, 13 nt, Bordetella pertussis
agcagggcggcgu

SEQ ID NO: 343216 - RNA, 19 nt, Bordetella pertussis
agcagggucagcggccggc

SEQ ID NO: 343217 - RNA, 21 nt, Bordetella pertussis
agcaguucggucagcgcggcg

SEQ ID NO: 343218 - RNA, 22 nt, Bordetella pertussis
agcaguucggucagcgcggcgc

SEQ ID NO: 343219 - RNA, 21 nt, Bordetella pertussis
agcaguugacccauaccagcc

SEQ ID NO: 343220 - RNA, 18 nt, Bordetella pertussis
agcaugaaaugcuggucg

SEQ ID NO: 343221 - RNA, 20 nt, Bordetella pertussis
agcaugaagcugcccagcaa

SEQ ID NO: 343222 - RNA, 17 nt, Bordetella pertussis
agcaugaccgacaggcg

SEQ ID NO: 343223 - RNA, 17 nt, Bordetella pertussis
agcaugaucuugccgac

SEQ ID NO: 343224 - RNA, 20 nt, Bordetella pertussis
agcaugccgcgguggcgggc

SEQ ID NO: 343225 - RNA, 22 nt, Bordetella pertussis
agcaugcgcagcgcgucggcgc

SEQ ID NO: 343226 - RNA, 15 nt, Bordetella pertussis
agcaugcgcgcggcc

SEQ ID NO: 343227 - RNA, 15 nt, Bordetella pertussis
agcaugcgcuggucg

SEQ ID NO: 343228 - RNA, 23 nt, Bordetella pertussis
agcaugcgcuggucgcgcagcac

SEQ ID NO: 343229 - RNA, 13 nt, Bordetella pertussis
agcaugcggcguc

SEQ ID NO: 343230 - RNA, 23 nt, Bordetella pertussis
agcaugcggcguccugccgcgac

SEQ ID NO: 343231 - RNA, 21 nt, Bordetella pertussis
agcauggcgccaugcgacagc

SEQ ID NO: 343232 - RNA, 17 nt, Bordetella pertussis
agcauggcggccaggcg

SEQ ID NO: 343233 - RNA, 14 nt, Bordetella pertussis
agcauggcggcgcc

SEQ ID NO: 343234 - RNA, 12 nt, Bordetella pertussis
agcauggcgggc

SEQ ID NO: 343235 - RNA, 20 nt, Bordetella pertussis
agcauggcaugagcgccucg

SEQ ID NO: 343236 - RNA, 23 nt, Bordetella pertussis
agcauggccguggcgugcaggcc

SEQ ID NO: 343237 - RNA, 17 nt, Bordetella pertussis
agcauuucggcgccgcc

SEQ ID NO: 343238 - RNA, 21 nt, Bordetella pertussis
agcauuucggcgccgccggcc

SEQ ID NO: 343239 - RNA, 13 nt, Bordetella pertussis
agccaagcagggc

SEQ ID NO: 343240 - RNA, 13 nt, Bordetella pertussis
agccacgccggcg

SEQ ID NO: 343241 - RNA, 14 nt, Bordetella pertussis
agccacgccggcgc

SEQ ID NO: 343242 - RNA, 22 nt, Bordetella pertussis
agccacgccggcgcgccggccg

SEQ ID NO: 343243 - RNA, 16 nt, Bordetella pertussis
agccacgcgcgauccg

SEQ ID NO: 343244 - RNA, 14 nt, Bordetella pertussis
agccacggcccgcc

SEQ ID NO: 343245 - RNA, 17 nt, Bordetella pertussis
agccacggcccgccagg

SEQ ID NO: 343246 - RNA, 15 nt, Bordetella pertussis
agccagccggcggcc

SEQ ID NO: 343247 - RNA, 13 nt, Bordetella pertussis
agccagcgccgca

SEQ ID NO: 343248 - RNA, 16 nt, Bordetella pertussis
agccagcgccgcagcg

SEQ ID NO: 343249 - RNA, 13 nt, Bordetella pertussis
agccagcgccugc

SEQ ID NO: 343250 - RNA, 15 nt, Bordetella pertussis
agccagcgccugcgc

SEQ ID NO: 343251 - RNA, 13 nt, Bordetella pertussis
agccagcggcgcg

SEQ ID NO: 343252 - RNA, 15 nt, Bordetella pertussis
agccagcggcgcggc

SEQ ID NO: 343253 - RNA, 19 nt, Bordetella pertussis
agccagcggcgcggcgcgc

SEQ ID NO: 343254 - RNA, 14 nt, Bordetella pertussis
agccagcggugcgc

SEQ ID NO: 343255 - RNA, 17 nt, Bordetella pertussis
agccagcggugcgcggc

SEQ ID NO: 343256 - RNA, 21 nt, Bordetella pertussis
agccaucaucaucgucggcgc

SEQ ID NO: 343257 - RNA, 22 nt, Bordetella pertussis
agccauccucgcccagcggcgc

SEQ ID NO: 343258 - RNA, 15 nt, Bordetella pertussis
agccaugcggacgcc

SEQ ID NO: 343259 - RNA, 20 nt, Bordetella pertussis
agccaugcggacgccagccc

SEQ ID NO: 343260 - RNA, 22 nt, Bordetella pertussis
agccaugccgucuggcggcagc

SEQ ID NO: 343261 - RNA, 23 nt, Bordetella pertussis
agccaugccgucuggcggcagcu

SEQ ID NO: 343262 - RNA, 19 nt, Bordetella pertussis
agccauucgauggcggcgc

SEQ ID NO: 343263 - RNA, 14 nt, Bordetella pertussis
agccauucggccag

SEQ ID NO: 343264 - RNA, 21 nt, Bordetella pertussis
agccauugccgcacgaucgcg

SEQ ID NO: 343265 - RNA, 13 nt, Bordetella pertussis
agccauugucggu

SEQ ID NO: 343266 - RNA, 17 nt, Bordetella pertussis
agccccagcagcacgcc

SEQ ID NO: 343267 - RNA, 20 nt, Bordetella pertussis
agccccagcagcacgcccag

SEQ ID NO: 343268 - RNA, 16 nt, Bordetella pertussis
agccccagcgccagcg

SEQ ID NO: 343269 - RNA, 22 nt, Bordetella pertussis
agccccaggcaggcgggcccgc

SEQ ID NO: 343270 - RNA, 13 nt, Bordetella pertussis
agccccaggcgcg

SEQ ID NO: 343271 - RNA, 19 nt, Bordetella pertussis
agccccaggcgcguuucgg

SEQ ID NO: 343272 - RNA, 19 nt, Bordetella pertussis
agcccccgcgcugcgcccg

SEQ ID NO: 343273 - RNA, 17 nt, Bordetella pertussis
agcccgagcggcgccag

SEQ ID NO: 343274 - RNA, 19 nt, Bordetella pertussis
agcccgauaugcagccgca

SEQ ID NO: 343275 - RNA, 13 nt, Bordetella pertussis
agcccgaucgacg

SEQ ID NO: 343276 - RNA, 17 nt, Bordetella pertussis
agcccgaucgacggccg

SEQ ID NO: 343277 - RNA, 21 nt, Bordetella pertussis
agcccgaugcgccaggccucg

SEQ ID NO: 343278 - RNA, 21 nt, Bordetella pertussis
agcccgcacauacaaggcgcg

SEQ ID NO: 343279 - RNA, 12 nt, Bordetella pertussis
agcccgcgucgg

SEQ ID NO: 343280 - RNA, 16 nt, Bordetella pertussis
agcccgcgucggcgcg

SEQ ID NO: 343281 - RNA, 18 nt, Bordetella pertussis
agcccgcguucaggcgcg

SEQ ID NO: 343282 - RNA, 19 nt, Bordetella pertussis
agcccgcugccgaauucgu

SEQ ID NO: 343283 - RNA, 19 nt, Bordetella pertussis
agcccgcugccgagacggc

SEQ ID NO: 343284 - RNA, 21 nt, Bordetella pertussis
agcccgcugccgagacggccg

SEQ ID NO: 343285 - RNA, 13 nt, Bordetella pertussis
agcccgcuggccg

SEQ ID NO: 343286 - RNA, 16 nt, Bordetella pertussis
agcccggcaccaugcg

SEQ ID NO: 343287 - RNA, 19 nt, Bordetella pertussis
agcccggcaccaugcgcac

SEQ ID NO: 343288 - RNA, 15 nt, Bordetella pertussis
agcccggcacgucgg

SEQ ID NO: 343289 - RNA, 20 nt, Bordetella pertussis
agcccggccagagccuggaa

SEQ ID NO: 343290 - RNA, 18 nt, Bordetella pertussis
agcccggccccaggccgg

SEQ ID NO: 343291 - RNA, 14 nt, Bordetella pertussis
agcccggccgccag

SEQ ID NO: 343292 - RNA, 18 nt, Bordetella pertussis
agcccggccgccagcaug

SEQ ID NO: 343293 - RNA, 15 nt, Bordetella pertussis
agcccgugcgggccu

SEQ ID NO: 343294 - RNA, 14 nt, Bordetella pertussis
agcccguggcggga

SEQ ID NO: 343295 - RNA, 17 nt, Bordetella pertussis
agcccgugggcggcgua

SEQ ID NO: 343296 - RNA, 18 nt, Bordetella pertussis
agcccgugggcggcguag

SEQ ID NO: 343297 - RNA, 17 nt, Bordetella pertussis
agcccugcguggcgcag

SEQ ID NO: 343298 - RNA, 22 nt, Bordetella pertussis
agcccuugaucagcggcggcac

SEQ ID NO: 343299 - RNA, 14 nt, Bordetella pertussis
agcccuuguggccg

SEQ ID NO: 343300 - RNA, 21 nt, Bordetella pertussis
agccgaagaaccaguagcaca

SEQ ID NO: 343301 - RNA, 20 nt, Bordetella pertussis
agccgaucagccggccaugg

SEQ ID NO: 343302 - RNA, 22 nt, Bordetella pertussis
agccgaucagccggccauggcc

SEQ ID NO: 343303 - RNA, 19 nt, Bordetella pertussis
agccgcagcaggcgcucgg

SEQ ID NO: 343304 - RNA, 13 nt, Bordetella pertussis
agccgcagcggca

SEQ ID NO: 343305 - RNA, 19 nt, Bordetella pertussis
agccgcagcggcagcgcac

SEQ ID NO: 343306 - RNA, 14 nt, Bordetella pertussis
agccgcaugccggc

SEQ ID NO: 343307 - RNA, 18 nt, Bordetella pertussis
agccgccauaggcgcgca

SEQ ID NO: 343308 - RNA, 15 nt, Bordetella pertussis
agccgccccagcagc

SEQ ID NO: 343309 - RNA, 19 nt, Bordetella pertussis
agccgccccagcagcagcg

SEQ ID NO: 343310 - RNA, 15 nt, Bordetella pertussis
agccgccccggcgcg

SEQ ID NO: 343311 - RNA, 17 nt, Bordetella pertussis
agccgccccggcgcggc

SEQ ID NO: 343312 - RNA, 22 nt, Bordetella pertussis
agccgccccggcgcggcgcgcg

SEQ ID NO: 343313 - RNA, 14 nt, Bordetella pertussis
agccgccgcaggcu

SEQ ID NO: 343314 - RNA, 12 nt, Bordetella pertussis
agccgccgccgu

SEQ ID NO: 343315 - RNA, 14 nt, Bordetella pertussis
agccgccgccguca

SEQ ID NO: 343316 - RNA, 22 nt, Bordetella pertussis
agccgccgccgucaacgcccag

SEQ ID NO: 343317 - RNA, 18 nt, Bordetella pertussis
agccgcgcacacauggcg

SEQ ID NO: 343318 - RNA, 19 nt, Bordetella pertussis
agccgcgccugcagcagcg

SEQ ID NO: 343319 - RNA, 22 nt, Bordetella pertussis
agccgcgccugcagcagcggca

SEQ ID NO: 343320 - RNA, 20 nt, Bordetella pertussis
agccgcgcgccugcagcagc

SEQ ID NO: 343321 - RNA, 21 nt, Bordetella pertussis
agccgcgcgccugcagcagcg

SEQ ID NO: 343322 - RNA, 13 nt, Bordetella pertussis
agccgcgcgccuu

SEQ ID NO: 343323 - RNA, 20 nt, Bordetella pertussis
agccgcgcgcggccggcgcg

SEQ ID NO: 343324 - RNA, 16 nt, Bordetella pertussis
agccgcgcggccgggc

SEQ ID NO: 343325 - RNA, 15 nt, Bordetella pertussis
agccgcggccgccgu

SEQ ID NO: 343326 - RNA, 15 nt, Bordetella pertussis
agccgcggcgccgca

SEQ ID NO: 343327 - RNA, 17 nt, Bordetella pertussis
agccgcucggccacgcg

SEQ ID NO: 343328 - RNA, 16 nt, Bordetella pertussis
agccgcugacugggcg

SEQ ID NO: 343329 - RNA, 18 nt, Bordetella pertussis
agccgcugcagcacgcac

SEQ ID NO: 343330 - RNA, 14 nt, Bordetella pertussis
agccgcugcgcgcg

SEQ ID NO: 343331 - RNA, 16 nt, Bordetella pertussis
agccgcugcgcgcggc

SEQ ID NO: 343332 - RNA, 20 nt, Bordetella pertussis
agccgcugcgcgcggccugg

SEQ ID NO: 343333 - RNA, 22 nt, Bordetella pertussis
agccgcuggcgaucaggccgcc

SEQ ID NO: 343334 - RNA, 14 nt, Bordetella pertussis
agccgcuggcgcgc

SEQ ID NO: 343335 - RNA, 15 nt, Bordetella pertussis
agccgcuggcgcgcc

SEQ ID NO: 343336 - RNA, 19 nt, Bordetella pertussis
agccgcugucgcaggcgcu

SEQ ID NO: 343337 - RNA, 14 nt, Bordetella pertussis
agccgcuugcccgu

SEQ ID NO: 343338 - RNA, 15 nt, Bordetella pertussis
agccgcuugcggcca

SEQ ID NO: 343339 - RNA, 16 nt, Bordetella pertussis
agccgcuugcggccag

SEQ ID NO: 343340 - RNA, 22 nt, Bordetella pertussis
agccgcuuggccugcgccaccg

SEQ ID NO: 343341 - RNA, 21 nt, Bordetella pertussis
agccggaaugcaccacggcca

SEQ ID NO: 343342 - RNA, 22 nt, Bordetella pertussis
agccggaaugcaccacggccac

SEQ ID NO: 343343 - RNA, 13 nt, Bordetella pertussis
agccggacccgcg

SEQ ID NO: 343344 - RNA, 18 nt, Bordetella pertussis
agccggacccgcgccgca

SEQ ID NO: 343345 - RNA, 19 nt, Bordetella pertussis
agccggacccgcgccgcag

SEQ ID NO: 343346 - RNA, 19 nt, Bordetella pertussis
agccggacgugggcgccua

SEQ ID NO: 343347 - RNA, 22 nt, Bordetella pertussis
agccggauugcuugacgccgcc

SEQ ID NO: 343348 - RNA, 16 nt, Bordetella pertussis
agccggccagcgccac

SEQ ID NO: 343349 - RNA, 12 nt, Bordetella pertussis
agccggcccagc

SEQ ID NO: 343350 - RNA, 20 nt, Bordetella pertussis
agccggcccagcacgccgcg

SEQ ID NO: 343351 - RNA, 23 nt, Bordetella pertussis
agccggcccagcacgccgcgcuc

SEQ ID NO: 343352 - RNA, 16 nt, Bordetella pertussis
agccggccgcgccgcg

SEQ ID NO: 343353 - RNA, 15 nt, Bordetella pertussis
agccggccgcgcggc

SEQ ID NO: 343354 - RNA, 13 nt, Bordetella pertussis
agccggccgccga

SEQ ID NO: 343355 - RNA, 14 nt, Bordetella pertussis
agccggcgcgccau

SEQ ID NO: 343356 - RNA, 14 nt, Bordetella pertussis
agccggcgccaucg

SEQ ID NO: 343357 - RNA, 15 nt, Bordetella pertussis
agccggcggcaugcg

SEQ ID NO: 343358 - RNA, 13 nt, Bordetella pertussis
agccgggcgccgg

SEQ ID NO: 343359 - RNA, 13 nt, Bordetella pertussis
agccgggcggcca

SEQ ID NO: 343360 - RNA, 21 nt, Bordetella pertussis
agccguccuuggcgccggcga

SEQ ID NO: 343361 - RNA, 20 nt, Bordetella pertussis
agccguuggcgcccagcgcc

SEQ ID NO: 343362 - RNA, 21 nt, Bordetella pertussis
agccuaggcugcagccaguug

SEQ ID NO: 343363 - RNA, 19 nt, Bordetella pertussis
agccucacaugucacacga

SEQ ID NO: 343364 - RNA, 20 nt, Bordetella pertussis
agccucauccccgcgugccu

SEQ ID NO: 343365 - RNA, 16 nt, Bordetella pertussis
agccucgagguggcgc

SEQ ID NO: 343366 - RNA, 20 nt, Bordetella pertussis
agccucgcccuugcggcgag

SEQ ID NO: 343367 - RNA, 15 nt, Bordetella pertussis
agccucguuggucag

SEQ ID NO: 343368 - RNA, 21 nt, Bordetella pertussis
agccugauucccaggcccggc

SEQ ID NO: 343369 - RNA, 15 nt, Bordetella pertussis
agccugccgcggccg

SEQ ID NO: 343370 - RNA, 13 nt, Bordetella pertussis
agccugccggcgg

SEQ ID NO: 343371 - RNA, 15 nt, Bordetella pertussis
agccugccggcggcc

SEQ ID NO: 343372 - RNA, 15 nt, Bordetella pertussis
agccugcccgggcag

SEQ ID NO: 343373 - RNA, 22 nt, Bordetella pertussis
agccugcuaguacaccgucgcg

SEQ ID NO: 343374 - RNA, 15 nt, Bordetella pertussis
agccuucggccggcu

SEQ ID NO: 343375 - RNA, 16 nt, Bordetella pertussis
agccuugcgcggccag

SEQ ID NO: 343376 - RNA, 17 nt, Bordetella pertussis
agccuugucgcgggcag

SEQ ID NO: 343377 - RNA, 19 nt, Bordetella pertussis
agccuugucgcgggcagug

SEQ ID NO: 343378 - RNA, 14 nt, Bordetella pertussis
agccuugcggcuug

SEQ ID NO: 343379 - RNA, 17 nt, Bordetella pertussis
agccuugcuccggcgug

SEQ ID NO: 343380 - RNA, 13 nt, Bordetella pertussis
agcgaaggggcgc

SEQ ID NO: 343381 - RNA, 14 nt, Bordetella pertussis
agcgacccguggcc

SEQ ID NO: 343382 - RNA, 17 nt, Bordetella pertussis
agcgacccguggcccgg

SEQ ID NO: 343383 - RNA, 17 nt, Bordetella pertussis
agcgacgcgcgccggcg

SEQ ID NO: 343384 - RNA, 22 nt, Bordetella pertussis
agcgagaccguggaaaccgcgu

SEQ ID NO: 343385 - RNA, 15 nt, Bordetella pertussis
agcgagagcgccacg

SEQ ID NO: 343386 - RNA, 12 nt, Bordetella pertussis
agcgagugcgcc

SEQ ID NO: 343387 - RNA, 22 nt, Bordetella pertussis
agcgauacccgcuucgacggcu

SEQ ID NO: 343388 - RNA, 17 nt, Bordetella pertussis
agcgcaccgucgccagg

SEQ ID NO: 343389 - RNA, 17 nt, Bordetella pertussis
agcgcacgcaccgcgcc

SEQ ID NO: 343390 - RNA, 12 nt, Bordetella pertussis
agcgcacgcagc

SEQ ID NO: 343391 - RNA, 13 nt, Bordetella pertussis
agcgcacgcgcag

SEQ ID NO: 343392 - RNA, 20 nt, Bordetella pertussis
agcgcacgguccaggcggcc

SEQ ID NO: 343393 - RNA, 19 nt, Bordetella pertussis
agcgcagcaccgcgcgcac

SEQ ID NO: 343394 - RNA, 22 nt, Bordetella pertussis
agcgcagcagauugccgcgcgg

SEQ ID NO: 343395 - RNA, 13 nt, Bordetella pertussis
agcgcagccacgg

SEQ ID NO: 343396 - RNA, 14 nt, Bordetella pertussis
agcgcagccgcucc

SEQ ID NO: 343397 - RNA, 21 nt, Bordetella pertussis
agcgcagccgcuccagccacc

SEQ ID NO: 343398 - RNA, 15 nt, Bordetella pertussis
agcgcauaggacgcc

SEQ ID NO: 343399 - RNA, 21 nt, Bordetella pertussis
agcgcauaggacgccaccagu

SEQ ID NO: 343400 - RNA, 14 nt, Bordetella pertussis
agcgcaucgagcuc

SEQ ID NO: 343401 - RNA, 20 nt, Bordetella pertussis
agcgcaucgaucucggccuc

SEQ ID NO: 343402 - RNA, 15 nt, Bordetella pertussis
agcgcaucgccgcag

SEQ ID NO: 343403 - RNA, 17 nt, Bordetella pertussis
agcgcaucgcgcgcgcc

SEQ ID NO: 343404 - RNA, 18 nt, Bordetella pertussis
agcgcaugaugcugccgg

SEQ ID NO: 343405 - RNA, 21 nt, Bordetella pertussis
agcgcaugaugcugccgggca

SEQ ID NO: 343406 - RNA, 20 nt, Bordetella pertussis
agcgcaugccgucgagcgcg

SEQ ID NO: 343407 - RNA, 17 nt, Bordetella pertussis
agcgcaugucgaagcag

SEQ ID NO: 343408 - RNA, 17 nt, Bordetella pertussis
agcgcauugccgccgcc

SEQ ID NO: 343409 - RNA, 13 nt, Bordetella pertussis
agcgcauugcggu

SEQ ID NO: 343410 - RNA, 23 nt, Bordetella pertussis
agcgcauuggugagcacgcgcac

SEQ ID NO: 343411 - RNA, 15 nt, Bordetella pertussis
agcgccaccagcagc

SEQ ID NO: 343412 - RNA, 18 nt, Bordetella pertussis
agcgccaccagcagcgcc

SEQ ID NO: 343413 - RNA, 20 nt, Bordetella pertussis
agcgccaccagcagcgccag

SEQ ID NO: 343414 - RNA, 13 nt, Bordetella pertussis
agcgccacgccag

SEQ ID NO: 343415 - RNA, 14 nt, Bordetella pertussis
agcgccacgccagc

SEQ ID NO: 343416 - RNA, 17 nt, Bordetella pertussis
agcgccacgccagcggc

SEQ ID NO: 343417 - RNA, 20 nt, Bordetella pertussis
agcgccacgccagcggcgag

SEQ ID NO: 343418 - RNA, 18 nt, Bordetella pertussis
agcgccacgcccuggcgg

SEQ ID NO: 343419 - RNA, 13 nt, Bordetella pertussis
agcgccaccggcu

SEQ ID NO: 343420 - RNA, 22 nt, Bordetella pertussis
agcgccaccguggccacggccg

SEQ ID NO: 343421 - RNA, 16 nt, Bordetella pertussis
agcgccacgcgagccc

SEQ ID NO: 343422 - RNA, 18 nt, Bordetella pertussis
agcgccagaaagcgcggc

SEQ ID NO: 343423 - RNA, 24 nt, Bordetella pertussis
agcgccagcaccggcacgcgccag

SEQ ID NO: 343424 - RNA, 13 nt, Bordetella pertussis
agcgccagcagca

SEQ ID NO: 343425 - RNA, 23 nt, Bordetella pertussis
agcgccagcagggucagcggccg

SEQ ID NO: 343426 - RNA, 23 nt, Bordetella pertussis
agcgccaugaugucgcgcgccug

SEQ ID NO: 343427 - RNA, 17 nt, Bordetella pertussis
agcgcccaaucgggcag

SEQ ID NO: 343428 - RNA, 14 nt, Bordetella pertussis
agcgcccaggccga

SEQ ID NO: 343429 - RNA, 17 nt, Bordetella pertussis
agcgccgcgaugcgguu

SEQ ID NO: 343430 - RNA, 11 nt, Bordetella pertussis
agcgccgcgcc

SEQ ID NO: 343431 - RNA, 22 nt, Bordetella pertussis
agcgccgcgccagguaggccgg

SEQ ID NO: 343432 - RNA, 14 nt, Bordetella pertussis
agcgccgcgccucg

SEQ ID NO: 343433 - RNA, 21 nt, Bordetella pertussis
agcgccgcgccucggacgccu

SEQ ID NO: 343434 - RNA, 14 nt, Bordetella pertussis
agcgccgcgcgcgu

SEQ ID NO: 343435 - RNA, 16 nt, Bordetella pertussis
agcgccgcgcgcgugc

SEQ ID NO: 343436 - RNA, 22 nt, Bordetella pertussis
agcgccgcggcguccgaauacg

SEQ ID NO: 343437 - RNA, 13 nt, Bordetella pertussis
agcgccgcgucga

SEQ ID NO: 343438 - RNA, 22 nt, Bordetella pertussis
agcgccgcucgacgucgcccug

SEQ ID NO: 343439 - RNA, 18 nt, Bordetella pertussis
agcgccggcagccccagc

SEQ ID NO: 343440 - RNA, 20 nt, Bordetella pertussis
agcgccggcagccccagcgc

SEQ ID NO: 343441 - RNA, 14 nt, Bordetella pertussis
agcgccggcagcgc

SEQ ID NO: 343442 - RNA, 15 nt, Bordetella pertussis
agcgccggcacgcug

SEQ ID NO: 343443 - RNA, 23 nt, Bordetella pertussis
agcgccggcaggcgcgccagccc

SEQ ID NO: 343444 - RNA, 14 nt, Bordetella pertussis
agcgccggcccgcc

SEQ ID NO: 343445 - RNA, 21 nt, Bordetella pertussis
agcgccggcgcaugagccggc

SEQ ID NO: 343446 - RNA, 12 nt, Bordetella pertussis
agcgccggcgcg

SEQ ID NO: 343447 - RNA, 16 nt, Bordetella pertussis
agcgccggcgcgcgcu

SEQ ID NO: 343448 - RNA, 15 nt, Bordetella pertussis
agcgccggcugggcg

SEQ ID NO: 343449 - RNA, 20 nt, Bordetella pertussis
agcgccggcuugcgccagcc

SEQ ID NO: 343450 - RNA, 18 nt, Bordetella pertussis
agcgccgggcgccgcgcc

SEQ ID NO: 343451 - RNA, 15 nt, Bordetella pertussis
agcgccggggcgugg

SEQ ID NO: 343452 - RNA, 23 nt, Bordetella pertussis
agcgccggggggcgcacgccgcg

SEQ ID NO: 343453 - RNA, 22 nt, Bordetella pertussis
agcgccggggucagcgccggca

SEQ ID NO: 343454 - RNA, 21 nt, Bordetella pertussis
agcgccgguucgacgcugauc

SEQ ID NO: 343455 - RNA, 16 nt, Bordetella pertussis
agcgccguaccagcgc

SEQ ID NO: 343456 - RNA, 16 nt, Bordetella pertussis
agcgccgucagcagcg

SEQ ID NO: 343457 - RNA, 18 nt, Bordetella pertussis
agcgcggcgaaggcgcgg

SEQ ID NO: 343458 - RNA, 23 nt, Bordetella pertussis
agcgcggcgaaggcgcggcugcg

SEQ ID NO: 343459 - RNA, 22 nt, Bordetella pertussis
agcgcggcgauacgcgccgccu

SEQ ID NO: 343460 - RNA, 12 nt, Bordetella pertussis
agcgcggcgcac

SEQ ID NO: 343461 - RNA, 21 nt, Bordetella pertussis
agcgcggcgcacagggcgucg

SEQ ID NO: 343462 - RNA, 13 nt, Bordetella pertussis
agcgcggcgccgg

SEQ ID NO: 343463 - RNA, 18 nt, Bordetella pertussis
agcgcggcgccggccguc

SEQ ID NO: 343464 - RNA, 16 nt, Bordetella pertussis
agcgcggcgccggccu

SEQ ID NO: 343465 - RNA, 20 nt, Bordetella pertussis
agcgcggcgcggccagcagc

SEQ ID NO: 343466 - RNA, 21 nt, Bordetella pertussis
agcgcggcgcggccagcagcg

SEQ ID NO: 343467 - RNA, 13 nt, Bordetella pertussis
agcgcggcgcugg

SEQ ID NO: 343468 - RNA, 21 nt, Bordetella pertussis
agcgcggcggacugcgccgca

SEQ ID NO: 343469 - RNA, 14 nt, Bordetella pertussis
agcgcggcggcagc

SEQ ID NO: 343470 - RNA, 23 nt, Bordetella pertussis
agcgcggcggcgaccggcgccgg

SEQ ID NO: 343471 - RNA, 12 nt, Bordetella pertussis
agcgcggcgggc

SEQ ID NO: 343472 - RNA, 19 nt, Bordetella pertussis
agcgcggcgggcggcgcgg

SEQ ID NO: 343473 - RNA, 14 nt, Bordetella pertussis
agcgcggcugcggg

SEQ ID NO: 343474 - RNA, 20 nt, Bordetella pertussis
agcgcgucgagcagcgcauc

SEQ ID NO: 343475 - RNA, 17 nt, Bordetella pertussis
agcgcgucgagcaggcc

SEQ ID NO: 343476 - RNA, 14 nt, Bordetella pertussis
agcgcgucgccgcc

SEQ ID NO: 343477 - RNA, 18 nt, Bordetella pertussis
agcgcgucgccgccauug

SEQ ID NO: 343478 - RNA, 22 nt, Bordetella pertussis
agcgcgucgcguagcgcggccg

SEQ ID NO: 343479 - RNA, 16 nt, Bordetella pertussis
agcgcgucggccagcg

SEQ ID NO: 343480 - RNA, 14 nt, Bordetella pertussis
agcgcgucggcgcc

SEQ ID NO: 343481 - RNA, 19 nt, Bordetella pertussis
agcgcgucggcgccgaugg

SEQ ID NO: 343482 - RNA, 15 nt, Bordetella pertussis
agcgcgucggcgcgg

SEQ ID NO: 343483 - RNA, 20 nt, Bordetella pertussis
agcgcgugcagccagcggcc

SEQ ID NO: 343484 - RNA, 16 nt, Bordetella pertussis
agcgcucgccggcgcg

SEQ ID NO: 343485 - RNA, 18 nt, Bordetella pertussis
agcgcucgccggcgcgca

SEQ ID NO: 343486 - RNA, 14 nt, Bordetella pertussis
agcgcucgcgcagg

SEQ ID NO: 343487 - RNA, 16 nt, Bordetella pertussis
agcgcucgcgcaggcg

SEQ ID NO: 343488 - RNA, 13 nt, Bordetella pertussis
agcgcucggccac

SEQ ID NO: 343489 - RNA, 13 nt, Bordetella pertussis
agcgcucgggcuc

SEQ ID NO: 343490 - RNA, 18 nt, Bordetella pertussis
agcgcucgggcucgcgcg

SEQ ID NO: 343491 - RNA, 18 nt, Bordetella pertussis
agcgcucguccaugccgg

SEQ ID NO: 343492 - RNA, 12 nt, Bordetella pertussis
agcgcugcgccg

SEQ ID NO: 343493 - RNA, 18 nt, Bordetella pertussis
agcgcugcgccgcggcgc

SEQ ID NO: 343494 - RNA, 20 nt, Bordetella pertussis
agcgcugcgccgcggcgcug

SEQ ID NO: 343495 - RNA, 22 nt, Bordetella pertussis
agcgcuggaacguuugcggacg

SEQ ID NO: 343496 - RNA, 16 nt, Bordetella pertussis
agcgcuggacgcccug

SEQ ID NO: 343497 - RNA, 22 nt, Bordetella pertussis
agcgcuggacgcccuggcgcag

SEQ ID NO: 343498 - RNA, 18 nt, Bordetella pertussis
agcgcuggcccgucaugg

SEQ ID NO: 343499 - RNA, 17 nt, Bordetella pertussis
agcggaaacgcgcgcgc

SEQ ID NO: 343500 - RNA, 21 nt, Bordetella pertussis
agcggaugaugcggcgccacg

SEQ ID NO: 343501 - RNA, 15 nt, Bordetella pertussis
agcggaugcgccgcc

SEQ ID NO: 343502 - RNA, 17 nt, Bordetella pertussis
agcggauguccggcgcg

SEQ ID NO: 343503 - RNA, 18 nt, Bordetella pertussis
agcggcaaagccgcugcg

SEQ ID NO: 343504 - RNA, 18 nt, Bordetella pertussis
agcggccagccugccgcg

SEQ ID NO: 343505 - RNA, 20 nt, Bordetella pertussis
agcggccagcgcggcggcag

SEQ ID NO: 343506 - RNA, 20 nt, Bordetella pertussis
agcggcccgggcgagauggc

SEQ ID NO: 343507 - RNA, 18 nt, Bordetella pertussis
agcggccgcugccgcgcg

SEQ ID NO: 343508 - RNA, 22 nt, Bordetella pertussis
agcggccgcugccgcgcgccgg

SEQ ID NO: 343509 - RNA, 12 nt, Bordetella pertussis
agcggccggccu

SEQ ID NO: 343510 - RNA, 13 nt, Bordetella pertussis
agcggccggcgcg

SEQ ID NO: 343511 - RNA, 14 nt, Bordetella pertussis
agcggccggcgcgc

SEQ ID NO: 343512 - RNA, 16 nt, Bordetella pertussis
agcggccggcgcgcgc

SEQ ID NO: 343513 - RNA, 15 nt, Bordetella pertussis
agcggccgucgccuu

SEQ ID NO: 343514 - RNA, 17 nt, Bordetella pertussis
agcggccuguucgcggu

SEQ ID NO: 343515 - RNA, 13 nt, Bordetella pertussis
agcggcgagcgcg

SEQ ID NO: 343516 - RNA, 15 nt, Bordetella pertussis
agcggcgagcgcggc

SEQ ID NO: 343517 - RNA, 16 nt, Bordetella pertussis
agcggcgagcgcggcg

SEQ ID NO: 343518 - RNA, 12 nt, Bordetella pertussis
agcggcgauccg

SEQ ID NO: 343519 - RNA, 20 nt, Bordetella pertussis
agcggcgcaccagcgaggcg

SEQ ID NO: 343520 - RNA, 12 nt, Bordetella pertussis
agcggcgucgcg

SEQ ID NO: 343521 - RNA, 19 nt, Bordetella pertussis
agcggcguauaggccaccc

SEQ ID NO: 343522 - RNA, 14 nt, Bordetella pertussis
agcggcgugcggcc

SEQ ID NO: 343523 - RNA, 15 nt, Bordetella pertussis
agcggcguggcggcc

SEQ ID NO: 343524 - RNA, 17 nt, Bordetella pertussis
agcggcguggcggccag

SEQ ID NO: 343525 - RNA, 20 nt, Bordetella pertussis
agcggcguggcggccaggcc

SEQ ID NO: 343526 - RNA, 15 nt, Bordetella pertussis
agcggcguggggccg

SEQ ID NO: 343527 - RNA, 20 nt, Bordetella pertussis
agcggcguggggccggccgc

SEQ ID NO: 343528 - RNA, 22 nt, Bordetella pertussis
agcggcguggggccggccgcgc

SEQ ID NO: 343529 - RNA, 15 nt, Bordetella pertussis
agcggcucaggcgcg

SEQ ID NO: 343530 - RNA, 17 nt, Bordetella pertussis
agcggcucaggcgcgga

SEQ ID NO: 343531 - RNA, 20 nt, Bordetella pertussis
agcggcucgagcggcagcag

SEQ ID NO: 343532 - RNA, 20 nt, Bordetella pertussis
agcgggccagcgcggccagg

SEQ ID NO: 343533 - RNA, 15 nt, Bordetella pertussis
agcgggcccgucgcg

SEQ ID NO: 343534 - RNA, 17 nt, Bordetella pertussis
agcgggcccgucgcgcc

SEQ ID NO: 343535 - RNA, 23 nt, Bordetella pertussis
agcgggcccgucgcgccaggccg

SEQ ID NO: 343536 - RNA, 21 nt, Bordetella pertussis
agcgggccgcagcauggcgcc

SEQ ID NO: 343537 - RNA, 22 nt, Bordetella pertussis
agcgggccgcagcauggcgcca

SEQ ID NO: 343538 - RNA, 21 nt, Bordetella pertussis
agcgggcggcggcgcguucgc

SEQ ID NO: 343539 - RNA, 14 nt, Bordetella pertussis
agcgguugcgccag

SEQ ID NO: 343540 - RNA, 18 nt, Bordetella pertussis
agcguacguaccaggccg

SEQ ID NO: 343541 - RNA, 21 nt, Bordetella pertussis
agcguacguaccaggccgucg

SEQ ID NO: 343542 - RNA, 13 nt, Bordetella pertussis
agcguaucgccgc

SEQ ID NO: 343543 - RNA, 14 nt, Bordetella pertussis
agcguaucgccgcc

SEQ ID NO: 343544 - RNA, 22 nt, Bordetella pertussis
agcguauuccccuucucggccg

SEQ ID NO: 343545 - RNA, 16 nt, Bordetella pertussis
agcgucaauccgccgc

SEQ ID NO: 343546 - RNA, 17 nt, Bordetella pertussis
agcgucaauccgccgcc

SEQ ID NO: 343547 - RNA, 19 nt, Bordetella pertussis
agcgucaauccgccgccag

SEQ ID NO: 343548 - RNA, 22 nt, Bordetella pertussis
agcgucaccagcaggcggccga

SEQ ID NO: 343549 - RNA, 21 nt, Bordetella pertussis
agcgucacggcaagacggcgc

SEQ ID NO: 343550 - RNA, 22 nt, Bordetella pertussis
agcgucacggcaagacggcgcu

SEQ ID NO: 343551 - RNA, 17 nt, Bordetella pertussis
agcgucagcugggcaug

SEQ ID NO: 343552 - RNA, 14 nt, Bordetella pertussis
agcgucaugcgcac

SEQ ID NO: 343553 - RNA, 22 nt, Bordetella pertussis
agcgucaugugcugcggcagcc

SEQ ID NO: 343554 - RNA, 14 nt, Bordetella pertussis
agcguccagccgcc

SEQ ID NO: 343555 - RNA, 18 nt, Bordetella pertussis
agcguccagccgcccgug

SEQ ID NO: 343556 - RNA, 12 nt, Bordetella pertussis
agcguccaggcg

SEQ ID NO: 343557 - RNA, 15 nt, Bordetella pertussis
agcguccaggcggcc

SEQ ID NO: 343558 - RNA, 23 nt, Bordetella pertussis
agcguccaggcggccaucgccgc

SEQ ID NO: 343559 - RNA, 12 nt, Bordetella pertussis
agcgucggccug

SEQ ID NO: 343560 - RNA, 13 nt, Bordetella pertussis
agcgucggccugc

SEQ ID NO: 343561 - RNA, 20 nt, Bordetella pertussis
agcgucggcguaaggccgcc

SEQ ID NO: 343562 - RNA, 17 nt, Bordetella pertussis
agcgugggcucgaugcg

SEQ ID NO: 343563 - RNA, 19 nt, Bordetella pertussis
agcguggugggccacucga

SEQ ID NO: 343564 - RNA, 20 nt, Bordetella pertussis
agcguguagagcaggccgcc

SEQ ID NO: 343565 - RNA, 16 nt, Bordetella pertussis
agcguguaggcggccg

SEQ ID NO: 343566 - RNA, 17 nt, Bordetella pertussis
agcgugucgaacaccag

SEQ ID NO: 343567 - RNA, 19 nt, Bordetella pertussis
agcgugucgaacaccaggu

SEQ ID NO: 343568 - RNA, 14 nt, Bordetella pertussis
agcgugucgccgac

SEQ ID NO: 343569 - RNA, 21 nt, Bordetella pertussis
agcguuccagcagaucgcggc

SEQ ID NO: 343570 - RNA, 17 nt, Bordetella pertussis
agcguuuccagggcgcg

SEQ ID NO: 343571 - RNA, 16 nt, Bordetella pertussis
agcuccaccgggcuga

SEQ ID NO: 343572 - RNA, 20 nt, Bordetella pertussis
agcuccagccgggucggcug

SEQ ID NO: 343573 - RNA, 23 nt, Bordetella pertussis
agcucgaccaucauggccagggc

SEQ ID NO: 343574 - RNA, 18 nt, Bordetella pertussis
agcucggccugcggcucg

SEQ ID NO: 343575 - RNA, 20 nt, Bordetella pertussis
agcucggcgaagccgcagcg

SEQ ID NO: 343576 - RNA, 23 nt, Bordetella pertussis
agcucggcgaagccgcagcggca

SEQ ID NO: 343577 - RNA, 15 nt, Bordetella pertussis
agcucggcggccgcc

SEQ ID NO: 343578 - RNA, 18 nt, Bordetella pertussis
agcucggcggccgccugc

SEQ ID NO: 343579 - RNA, 13 nt, Bordetella pertussis
agcucggcggcga

SEQ ID NO: 343580 - RNA, 14 nt, Bordetella pertussis
agcugcgcgaccuc

SEQ ID NO: 343581 - RNA, 17 nt, Bordetella pertussis
agcugcggccccggcac

SEQ ID NO: 343582 - RNA, 13 nt, Bordetella pertussis
agcugcggcgcgg

SEQ ID NO: 343583 - RNA, 14 nt, Bordetella pertussis
agcugcggcgcggc

SEQ ID NO: 343584 - RNA, 20 nt, Bordetella pertussis
agcuggcgcguggccgccac

SEQ ID NO: 343585 - RNA, 12 nt, Bordetella pertussis
agcuggcggcgc

SEQ ID NO: 343586 - RNA, 17 nt, Bordetella pertussis
agcuggcggcgcagcac

SEQ ID NO: 343587 - RNA, 13 nt, Bordetella pertussis
agcuggcguucgu

SEQ ID NO: 343588 - RNA, 16 nt, Bordetella pertussis
agcuggcuggccagcg

SEQ ID NO: 343589 - RNA, 16 nt, Bordetella pertussis
agcuggggccgcgcgc

SEQ ID NO: 343590 - RNA, 19 nt, Bordetella pertussis
agcuggggccgcgcgccaa

SEQ ID NO: 343591 - RNA, 23 nt, Bordetella pertussis
agcuggugccgguugcgcgccga

SEQ ID NO: 343592 - RNA, 18 nt, Bordetella pertussis
agcuguagcccuggcgcu

SEQ ID NO: 343593 - RNA, 14 nt, Bordetella pertussis
agcugucggcgcug

SEQ ID NO: 343594 - RNA, 15 nt, Bordetella pertussis
agcugucggcgcugg

SEQ ID NO: 343595 - RNA, 15 nt, Bordetella pertussis
agcuguuccugcucg

SEQ ID NO: 343596 - RNA, 20 nt, Bordetella pertussis
agcuguugcagcggcuucau

SEQ ID NO: 343597 - RNA, 12 nt, Bordetella pertussis
agcuuccaggua

SEQ ID NO: 343598 - RNA, 16 nt, Bordetella pertussis
agcuucugcgccugcu

SEQ ID NO: 343599 - RNA, 20 nt, Bordetella pertussis
agcuucuugaacucggccag

SEQ ID NO: 343600 - RNA, 20 nt, Bordetella pertussis
agcuugaugccggcguucug

SEQ ID NO: 343601 - RNA, 18 nt, Bordetella pertussis
agcuugaugggcgaggcg

SEQ ID NO: 343602 - RNA, 20 nt, Bordetella pertussis
agcuugcccgcgcgcacgug

SEQ ID NO: 343603 - RNA, 15 nt, Bordetella pertussis
agcuugcccggcgug

SEQ ID NO: 343604 - RNA, 15 nt, Bordetella pertussis
agcuugcgcgccgca

SEQ ID NO: 343605 - RNA, 16 nt, Bordetella pertussis
agcuugcgcuggcgcg

SEQ ID NO: 343606 - RNA, 19 nt, Bordetella pertussis
agcuuggacagcgcguugg

SEQ ID NO: 343607 - RNA, 18 nt, Bordetella pertussis
agcuuggccaccacgccc

SEQ ID NO: 343608 - RNA, 15 nt, Bordetella pertussis
agcuuggccggugcc

SEQ ID NO: 343609 - RNA, 16 nt, Bordetella pertussis
agcuuggcgcgccgga

SEQ ID NO: 343610 - RNA, 20 nt, Bordetella pertussis
agcuugggcauuucccagcc

SEQ ID NO: 343611 - RNA, 17 nt, Bordetella pertussis
agcuugucggccgcgcg

SEQ ID NO: 343612 - RNA, 15 nt, Bordetella pertussis
aggaaagaggccagg

SEQ ID NO: 343613 - RNA, 13 nt, Bordetella pertussis
aggaaagccggcg

SEQ ID NO: 343614 - RNA, 15 nt, Bordetella pertussis
aggaaagcgccgccg

SEQ ID NO: 343615 - RNA, 21 nt, Bordetella pertussis
aggaacaccaccuccaccgcc

SEQ ID NO: 343616 - RNA, 20 nt, Bordetella pertussis
aggaacauguucacgcccag

SEQ ID NO: 343617 - RNA, 19 nt, Bordetella pertussis
aggaaccagcggcuggcgg

SEQ ID NO: 343618 - RNA, 16 nt, Bordetella pertussis
aggaacggcauggcau

SEQ ID NO: 343619 - RNA, 14 nt, Bordetella pertussis
aggaacuccggcgg

SEQ ID NO: 343620 - RNA, 24 nt, Bordetella pertussis
aggaacucgcacacgcgcugggcg

SEQ ID NO: 343621 - RNA, 13 nt, Bordetella pertussis
aggaacuggacgg

SEQ ID NO: 343622 - RNA, 19 nt, Bordetella pertussis
aggaacugggcgccggcca

SEQ ID NO: 343623 - RNA, 21 nt, Bordetella pertussis
aggaacugggcgccggccagg

SEQ ID NO: 343624 - RNA, 14 nt, Bordetella pertussis
aggaagccgugcgc

SEQ ID NO: 343625 - RNA, 16 nt, Bordetella pertussis
aggaagccugcgcgcg

SEQ ID NO: 343626 - RNA, 16 nt, Bordetella pertussis
aggaagcgcgccgcgc

SEQ ID NO: 343627 - RNA, 19 nt, Bordetella pertussis
aggaagcgcgccgcgcgca

SEQ ID NO: 343628 - RNA, 13 nt, Bordetella pertussis
aggaaggcccgcg

SEQ ID NO: 343629 - RNA, 13 nt, Bordetella pertussis
aggaaggcccggu

SEQ ID NO: 343630 - RNA, 22 nt, Bordetella pertussis
aggaaguccugguuggccucgc

SEQ ID NO: 343631 - RNA, 23 nt, Bordetella pertussis
aggaagucggucagcucgucgcc

SEQ ID NO: 343632 - RNA, 19 nt, Bordetella pertussis
aggaaguggccgagcgcac

SEQ ID NO: 343633 - RNA, 17 nt, Bordetella pertussis
aggacaaggcgcgcgcc

SEQ ID NO: 343634 - RNA, 21 nt, Bordetella pertussis
aggacaccaugauggccgcgc

SEQ ID NO: 343635 - RNA, 20 nt, Bordetella pertussis
aggaccgcgaugcugcgcaa

SEQ ID NO: 343636 - RNA, 21 nt, Bordetella pertussis
aggacgccaccagugcgccgg

SEQ ID NO: 343637 - RNA, 22 nt, Bordetella pertussis
aggacgccaccagugcgccggc

SEQ ID NO: 343638 - RNA, 17 nt, Bordetella pertussis
aggacgaucccggccac

SEQ ID NO: 343639 - RNA, 14 nt, Bordetella pertussis
aggacgccggcgcc

SEQ ID NO: 343640 - RNA, 16 nt, Bordetella pertussis
aggacgccggcgccgg

SEQ ID NO: 343641 - RNA, 16 nt, Bordetella pertussis
aggacgcguccucggc

SEQ ID NO: 343642 - RNA, 20 nt, Bordetella pertussis
aggacgcguccucggccagc

SEQ ID NO: 343643 - RNA, 13 nt, Bordetella pertussis
aggacggcgccgu

SEQ ID NO: 343644 - RNA, 15 nt, Bordetella pertussis
aggacggcgccgucc

SEQ ID NO: 343645 - RNA, 21 nt, Bordetella pertussis
aggacggcgccguccgcaucg

SEQ ID NO: 343646 - RNA, 23 nt, Bordetella pertussis
aggacggggaacaggcgcgccag

SEQ ID NO: 343647 - RNA, 14 nt, Bordetella pertussis
aggacguccaggcc

SEQ ID NO: 343648 - RNA, 22 nt, Bordetella pertussis
aggacuaagaugaaucgcaugc

SEQ ID NO: 343649 - RNA, 15 nt, Bordetella pertussis
aggacuucgucgauc

SEQ ID NO: 343650 - RNA, 16 nt, Bordetella pertussis
aggagcaacuggggcg

SEQ ID NO: 343651 - RNA, 22 nt, Bordetella pertussis
aggaggaacaggaugcgcaugg

SEQ ID NO: 343652 - RNA, 14 nt, Bordetella pertussis
aggaggcgcgggca

SEQ ID NO: 343653 - RNA, 18 nt, Bordetella pertussis
aggaucaccgccgcgccg

SEQ ID NO: 343654 - RNA, 15 nt, Bordetella pertussis
aggaucaggccggcg

SEQ ID NO: 343655 - RNA, 19 nt, Bordetella pertussis
aggaucaggccggcgaugg

SEQ ID NO: 343656 - RNA, 16 nt, Bordetella pertussis
aggaucgcggccagcc

SEQ ID NO: 343657 - RNA, 16 nt, Bordetella pertussis
aggaucuggccggcgc

SEQ ID NO: 343658 - RNA, 17 nt, Bordetella pertussis
aggaucuggccggcgcu

SEQ ID NO: 343659 - RNA, 19 nt, Bordetella pertussis
aggaugcccuuggcggcga

SEQ ID NO: 343660 - RNA, 19 nt, Bordetella pertussis
aggaugcgcaccggccagg

SEQ ID NO: 343661 - RNA, 14 nt, Bordetella pertussis
aggaugcgcgccag

SEQ ID NO: 343662 - RNA, 18 nt, Bordetella pertussis
aggauggccacgaccacc

SEQ ID NO: 343663 - RNA, 16 nt, Bordetella pertussis
aggaugggcgcggcgc

SEQ ID NO: 343664 - RNA, 16 nt, Bordetella pertussis
aggauggcgccagccc

SEQ ID NO: 343665 - RNA, 22 nt, Bordetella pertussis
aggauguccacggucgccggca

SEQ ID NO: 343666 - RNA, 20 nt, Bordetella pertussis
aggauguucaugaccgccgc

SEQ ID NO: 343667 - RNA, 21 nt, Bordetella pertussis
aggauguucaugaccgccgcg

SEQ ID NO: 343668 - RNA, 23 nt, Bordetella pertussis
aggauguucaugaccgccgcgcc

SEQ ID NO: 343669 - RNA, 14 nt, Bordetella pertussis
aggcaaucagcccg

SEQ ID NO: 343670 - RNA, 13 nt, Bordetella pertussis
aggcaaugcgcag

SEQ ID NO: 343671 - RNA, 20 nt, Bordetella pertussis
aggcaaugcgcaggcccgac

SEQ ID NO: 343672 - RNA, 14 nt, Bordetella pertussis
aggcacaaggccga

SEQ ID NO: 343673 - RNA, 23 nt, Bordetella pertussis
aggcacauugccguacgccaucg

SEQ ID NO: 343674 - RNA, 17 nt, Bordetella pertussis
aggcacccccgaccgag

SEQ ID NO: 343675 - RNA, 18 nt, Bordetella pertussis
aggcacccccgaccgagc

SEQ ID NO: 343676 - RNA, 21 nt, Bordetella pertussis
aggcacccccgaccgagccac

SEQ ID NO: 343677 - RNA, 15 nt, Bordetella pertussis
aggcaccccggcgcc

SEQ ID NO: 343678 - RNA, 15 nt, Bordetella pertussis
aggcaccccgucguc

SEQ ID NO: 343679 - RNA, 14 nt, Bordetella pertussis
aggcacccgcgcgc

SEQ ID NO: 343680 - RNA, 13 nt, Bordetella pertussis
aggcaccgccgca

SEQ ID NO: 343681 - RNA, 17 nt, Bordetella pertussis
aggcaccugcgaccgag

SEQ ID NO: 343682 - RNA, 18 nt, Bordetella pertussis
aggcaccugcgaccgagc

SEQ ID NO: 343683 - RNA, 21 nt, Bordetella pertussis
aggcaccugcgaccgagccac

SEQ ID NO: 343684 - RNA, 22 nt, Bordetella pertussis
aggcacgacgcgaaccaggcca

SEQ ID NO: 343685 - RNA, 17 nt, Bordetella pertussis
aggcacucuugccgcug

SEQ ID NO: 343686 - RNA, 20 nt, Bordetella pertussis
aggcacucuugccgcugcgc

SEQ ID NO: 343687 - RNA, 17 nt, Bordetella pertussis
aggcauugcgccagccg

SEQ ID NO: 343688 - RNA, 17 nt, Bordetella pertussis
aggcauuggcgccgcgc

SEQ ID NO: 343689 - RNA, 18 nt, Bordetella pertussis
aggcauuggcgccgcgcu

SEQ ID NO: 343690 - RNA, 19 nt, Bordetella pertussis
aggcauuggcggcggcguu

SEQ ID NO: 343691 - RNA, 19 nt, Bordetella pertussis
aggcauugaagcuggcgcc

SEQ ID NO: 343692 - RNA, 22 nt, Bordetella pertussis
aggccacccgccguaccgggcg

SEQ ID NO: 343693 - RNA, 18 nt, Bordetella pertussis
aggccaccgacggcgcgg

SEQ ID NO: 343694 - RNA, 18 nt, Bordetella pertussis
aggccaccgcggugccgc

SEQ ID NO: 343695 - RNA, 19 nt, Bordetella pertussis
aggccagugccuggacgcg

SEQ ID NO: 343696 - RNA, 23 nt, Bordetella pertussis
aggccaucggcgccaagcggcag

SEQ ID NO: 343697 - RNA, 19 nt, Bordetella pertussis
aggccaugaucaggccgaa

SEQ ID NO: 343698 - RNA, 20 nt, Bordetella pertussis
aggcccaccagggccagcuu

SEQ ID NO: 343699 - RNA, 14 nt, Bordetella pertussis
aggcccacgacgaa

SEQ ID NO: 343700 - RNA, 14 nt, Bordetella pertussis
aggcccagcacgcg

SEQ ID NO: 343701 - RNA, 14 nt, Bordetella pertussis
aggcccagccagcg

SEQ ID NO: 343702 - RNA, 17 nt, Bordetella pertussis
aggcccagcccgccgau

SEQ ID NO: 343703 - RNA, 18 nt, Bordetella pertussis
aggcccgugcuccagaac

SEQ ID NO: 343704 - RNA, 14 nt, Bordetella pertussis
aggcccugccgccu

SEQ ID NO: 343705 - RNA, 23 nt, Bordetella pertussis
aggcccugcgcguugagcagcau

SEQ ID NO: 343706 - RNA, 20 nt, Bordetella pertussis
aggcccuggcuggccagccg

SEQ ID NO: 343707 - RNA, 19 nt, Bordetella pertussis
aggcccugggccagcagcu

SEQ ID NO: 343708 - RNA, 21 nt, Bordetella pertussis
aggcccuggggccgcggcgcg

SEQ ID NO: 343709 - RNA, 23 nt, Bordetella pertussis
aggccgaaauggcggcgguagcg

SEQ ID NO: 343710 - RNA, 10 nt, Bordetella pertussis
aggccgaacc

SEQ ID NO: 343711 - RNA, 14 nt, Bordetella pertussis
aggccgaacgcggu

SEQ ID NO: 343712 - RNA, 21 nt, Bordetella pertussis
aggccgaugaauugcgccacg

SEQ ID NO: 343713 - RNA, 16 nt, Bordetella pertussis
aggccgauuucggccg

SEQ ID NO: 343714 - RNA, 14 nt, Bordetella pertussis
aggccgcaacccac

SEQ ID NO: 343715 - RNA, 15 nt, Bordetella pertussis
aggccgcagcgggcc

SEQ ID NO: 343716 - RNA, 22 nt, Bordetella pertussis
aggccgcagcgggcccgucgcg

SEQ ID NO: 343717 - RNA, 19 nt, Bordetella pertussis
aggccgccacuugcggcag

SEQ ID NO: 343718 - RNA, 20 nt, Bordetella pertussis
aggccgccacuugcggcagg

SEQ ID NO: 343719 - RNA, 13 nt, Bordetella pertussis
aggccgcccgccc

SEQ ID NO: 343720 - RNA, 20 nt, Bordetella pertussis
aggccgcccgccccggcgca

SEQ ID NO: 343721 - RNA, 13 nt, Bordetella pertussis
aggccgcccagcc

SEQ ID NO: 343722 - RNA, 16 nt, Bordetella pertussis
aggccgcccagccgcg

SEQ ID NO: 343723 - RNA, 16 nt, Bordetella pertussis
aggccgcccagcgcau

SEQ ID NO: 343724 - RNA, 16 nt, Bordetella pertussis
aggccgccagggccga

SEQ ID NO: 343725 - RNA, 17 nt, Bordetella pertussis
aggcgucguuggccgcg

SEQ ID NO: 343726 - RNA, 20 nt, Bordetella pertussis
aggcgugaacgccccggccg

SEQ ID NO: 343727 - RNA, 19 nt, Bordetella pertussis
aggcgucgggcacguccgg

SEQ ID NO: 343728 - RNA, 14 nt, Bordetella pertussis
aggcgugccgcgca

SEQ ID NO: 343729 - RNA, 17 nt, Bordetella pertussis
aggcgugcgcgggcgcc

SEQ ID NO: 343730 - RNA, 22 nt, Bordetella pertussis
aggcugcagcuugcgcgccagu

SEQ ID NO: 343731 - RNA, 18 nt, Bordetella pertussis
aggcugcccuggcccagg

SEQ ID NO: 343732 - RNA, 17 nt, Bordetella pertussis
aggcugccgucggccag

SEQ ID NO: 343733 - RNA, 19 nt, Bordetella pertussis
aggcugcgcaggcgccgca

SEQ ID NO: 343734 - RNA, 22 nt, Bordetella pertussis
aggcugcgcgccggcgccuugg

SEQ ID NO: 343735 - RNA, 14 nt, Bordetella pertussis
aggcugcgcgcgcc

SEQ ID NO: 343736 - RNA, 15 nt, Bordetella pertussis
aggcuggccggcgug

SEQ ID NO: 343737 - RNA, 20 nt, Bordetella pertussis
aggcuggccggcguggccug

SEQ ID NO: 343738 - RNA, 14 nt, Bordetella pertussis
aggcuggcgcccac

SEQ ID NO: 343739 - RNA, 13 nt, Bordetella pertussis
aggcuggcgcggu

SEQ ID NO: 343740 - RNA, 16 nt, Bordetella pertussis
aggcuucgcccgccac

SEQ ID NO: 343741 - RNA, 18 nt, Bordetella pertussis
aggcuucgucgaccagca

SEQ ID NO: 343742 - RNA, 21 nt, Bordetella pertussis
aggcuucucgaccaggcgggc

SEQ ID NO: 343743 - RNA, 19 nt, Bordetella pertussis
aggcuugcagcaacgcggc

SEQ ID NO: 343744 - RNA, 20 nt, Bordetella pertussis
aggcuugcagcuugcgcgcc

SEQ ID NO: 343745 - RNA, 21 nt, Bordetella pertussis
aggcuugcagcuugcgcgccc

SEQ ID NO: 343746 - RNA, 21 nt, Bordetella pertussis
aggcuuucgaagccgccccac

SEQ ID NO: 343747 - RNA, 16 nt, Bordetella pertussis
aggcuuugcgcgccau

SEQ ID NO: 343748 - RNA, 23 nt, Bordetella pertussis
agggacaggcaccccggcgccgc

SEQ ID NO: 343749 - RNA, 15 nt, Bordetella pertussis
agggaccaccccgag

SEQ ID NO: 343750 - RNA, 15 nt, Bordetella pertussis
agggacgggccagcc

SEQ ID NO: 343751 - RNA, 18 nt, Bordetella pertussis
agggcacaucggccaccc

SEQ ID NO: 343752 - RNA, 17 nt, Bordetella pertussis
agggcagcucgcguccg

SEQ ID NO: 343753 - RNA, 22 nt, Bordetella pertussis
agggcagcucgcguccgcucau

SEQ ID NO: 343754 - RNA, 23 nt, Bordetella pertussis
agggcaggucgucgagccgggcc

SEQ ID NO: 343755 - RNA, 15 nt, Bordetella pertussis
agggccaccacgccg

SEQ ID NO: 343756 - RNA, 14 nt, Bordetella pertussis
agggccacgcccag

SEQ ID NO: 343757 - RNA, 22 nt, Bordetella pertussis
agggccacgccggccgccuggc

SEQ ID NO: 343758 - RNA, 19 nt, Bordetella pertussis
agggccggacuggcgcgca

SEQ ID NO: 343759 - RNA, 20 nt, Bordetella pertussis
agggccggacuggcgcgcac

SEQ ID NO: 343760 - RNA, 20 nt, Bordetella pertussis
agggccggccgggcgcggcg

SEQ ID NO: 343761 - RNA, 12 nt, Bordetella pertussis
agggccggcgcc

SEQ ID NO: 343762 - RNA, 15 nt, Bordetella pertussis
agggccucgcgggcc

SEQ ID NO: 343763 - RNA, 15 nt, Bordetella pertussis
agggccugcgggccg

SEQ ID NO: 343764 - RNA, 23 nt, Bordetella pertussis
agggcgaacgggguggccggcgc

SEQ ID NO: 343765 - RNA, 15 nt, Bordetella pertussis
agggcgaagcgcgcc

SEQ ID NO: 343766 - RNA, 17 nt, Bordetella pertussis
agggcgaagcgcgccuc

SEQ ID NO: 343767 - RNA, 19 nt, Bordetella pertussis
agggcgacugcagcaggcu

SEQ ID NO: 343768 - RNA, 20 nt, Bordetella pertussis
agggcgacugcagcaggcug

SEQ ID NO: 343769 - RNA, 21 nt, Bordetella pertussis
agggcgcgccggaacauggcg

SEQ ID NO: 343770 - RNA, 17 nt, Bordetella pertussis
agggcgcgggccagcuc

SEQ ID NO: 343771 - RNA, 20 nt, Bordetella pertussis
agggcggaaaacagcaccag

SEQ ID NO: 343772 - RNA, 22 nt, Bordetella pertussis
agggcggaaaacagcaccagca

SEQ ID NO: 343773 - RNA, 12 nt, Bordetella pertussis
agggcggccagg

SEQ ID NO: 343774 - RNA, 14 nt, Bordetella pertussis
agggcggccaggcc

SEQ ID NO: 343775 - RNA, 19 nt, Bordetella pertussis
agggcggccaugccgucac

SEQ ID NO: 343776 - RNA, 19 nt, Bordetella pertussis
agggcggccccggccgccc

SEQ ID NO: 343777 - RNA, 14 nt, Bordetella pertussis
agggcggccggcac

SEQ ID NO: 343778 - RNA, 12 nt, Bordetella pertussis
agggcggcgcgg

SEQ ID NO: 343779 - RNA, 19 nt, Bordetella pertussis
agggcgggcggugcggccu

SEQ ID NO: 343780 - RNA, 21 nt, Bordetella pertussis
agggcgggggacgcccgcccg

SEQ ID NO: 343781 - RNA, 14 nt, Bordetella pertussis
aggggcugccguga

SEQ ID NO: 343782 - RNA, 14 nt, Bordetella pertussis
aggggcucgcgccc

SEQ ID NO: 343783 - RNA, 14 nt, Bordetella pertussis
aggggcucggccag

SEQ ID NO: 343784 - RNA, 22 nt, Bordetella pertussis
aggggcucuucgacagcgcgca

SEQ ID NO: 343785 - RNA, 22 nt, Bordetella pertussis
agggucagcccgccaucgcgca

SEQ ID NO: 343786 - RNA, 16 nt, Bordetella pertussis
agggugccuguccccg

SEQ ID NO: 343787 - RNA, 21 nt, Bordetella pertussis
agggugccuguccccgcgggg

SEQ ID NO: 343788 - RNA, 19 nt, Bordetella pertussis
agggugccugucccggcug

SEQ ID NO: 343789 - RNA, 15 nt, Bordetella pertussis
agggugcggcgccac

SEQ ID NO: 343790 - RNA, 17 nt, Bordetella pertussis
agggugcggcgccacug

SEQ ID NO: 343791 - RNA, 20 nt, Bordetella pertussis
aggguggcauugacgcccac

SEQ ID NO: 343792 - RNA, 15 nt, Bordetella pertussis
aggguggccacgccc

SEQ ID NO: 343793 - RNA, 15 nt, Bordetella pertussis
aggguggcgccggcc

SEQ ID NO: 343794 - RNA, 23 nt, Bordetella pertussis
agggugucgccggggcgcaccgg

SEQ ID NO: 343795 - RNA, 18 nt, Bordetella pertussis
aggguugcaguucgccgg

SEQ ID NO: 343796 - RNA, 22 nt, Bordetella pertussis
aggguugcaguucgccggcgcc

SEQ ID NO: 343797 - RNA, 15 nt, Bordetella pertussis
aggguuucgacgccu

SEQ ID NO: 343798 - RNA, 18 nt, Bordetella pertussis
aggguuuuauacggcgcg

SEQ ID NO: 343799 - RNA, 16 nt, Bordetella pertussis
agguagaccacgcgcu

SEQ ID NO: 343800 - RNA, 22 nt, Bordetella pertussis
agguagaccacgcgcugcgcgc

SEQ ID NO: 343801 - RNA, 19 nt, Bordetella pertussis
agguaggcgggacuggcga

SEQ ID NO: 343802 - RNA, 18 nt, Bordetella pertussis
agguagggcgcggccagg

SEQ ID NO: 343803 - RNA, 19 nt, Bordetella pertussis
agguagguggacacgccca

SEQ ID NO: 343804 - RNA, 18 nt, Bordetella pertussis
agguaucgacccaggccg

SEQ ID NO: 343805 - RNA, 20 nt, Bordetella pertussis
aggucgccguucuggcugcg

SEQ ID NO: 343806 - RNA, 21 nt, Bordetella pertussis
aggucgcggugcgccacgaug

SEQ ID NO: 343807 - RNA, 23 nt, Bordetella pertussis
aggucgcuucgguggcgcgcaac

SEQ ID NO: 343808 - RNA, 16 nt, Bordetella pertussis
aggucggacgcgccgg

SEQ ID NO: 343809 - RNA, 19 nt, Bordetella pertussis
aggucggacgcgccgggcg

SEQ ID NO: 343810 - RNA, 17 nt, Bordetella pertussis
aggucguagaccgccgc

SEQ ID NO: 343811 - RNA, 20 nt, Bordetella pertussis
aggucguaguauccgacgcg

SEQ ID NO: 343812 - RNA, 20 nt, Bordetella pertussis
aggucgucgagccgggccac

SEQ ID NO: 343813 - RNA, 22 nt, Bordetella pertussis
aggucguggcccagccggugcg

SEQ ID NO: 343814 - RNA, 22 nt, Bordetella pertussis
aggucguuguggcaggcgucgg

SEQ ID NO: 343815 - RNA, 14 nt, Bordetella pertussis
aggugcuuggcggu

SEQ ID NO: 343816 - RNA, 21 nt, Bordetella pertussis
aggugcuuggcggucugggcg

SEQ ID NO: 343817 - RNA, 16 nt, Bordetella pertussis
agguggacagcgccag

SEQ ID NO: 343818 - RNA, 16 nt, Bordetella pertussis
agguggaugcguucgc

SEQ ID NO: 343819 - RNA, 19 nt, Bordetella pertussis
agguggcgaugccgggcac

SEQ ID NO: 343820 - RNA, 22 nt, Bordetella pertussis
agguggcgcauucgccggacac

SEQ ID NO: 343821 - RNA, 21 nt, Bordetella pertussis
aggugggccgagcccgcgucg

SEQ ID NO: 343822 - RNA, 15 nt, Bordetella pertussis
aggugggcggcagca

SEQ ID NO: 343823 - RNA, 13 nt, Bordetella pertussis
aggugugccagcc

SEQ ID NO: 343824 - RNA, 20 nt, Bordetella pertussis
aggugugccagccgcuggcg

SEQ ID NO: 343825 - RNA, 15 nt, Bordetella pertussis
agguuagcggcagug

SEQ ID NO: 343826 - RNA, 16 nt, Bordetella pertussis
agguucggagcacgga

SEQ ID NO: 343827 - RNA, 20 nt, Bordetella pertussis
agguucucgauguggcgcug

SEQ ID NO: 343828 - RNA, 14 nt, Bordetella pertussis
agguugaaggccgc

SEQ ID NO: 343829 - RNA, 15 nt, Bordetella pertussis
agguugaaggccgcg

SEQ ID NO: 343830 - RNA, 16 nt, Bordetella pertussis
agguugcccgagcgcg

SEQ ID NO: 343831 - RNA, 18 nt, Bordetella pertussis
agguugcccgagcgcgac

SEQ ID NO: 343832 - RNA, 17 nt, Bordetella pertussis
aguacagcagcagcacg

SEQ ID NO: 343833 - RNA, 19 nt, Bordetella pertussis
aguacaggcugccgucguc

SEQ ID NO: 343834 - RNA, 21 nt, Bordetella pertussis
aguaggcggccaggccgaacg

SEQ ID NO: 343835 - RNA, 16 nt, Bordetella pertussis
agucaucgauggccag

SEQ ID NO: 343836 - RNA, 14 nt, Bordetella pertussis
agucauguagcggc

SEQ ID NO: 343837 - RNA, 15 nt, Bordetella pertussis
aguccaggccggccu

SEQ ID NO: 343838 - RNA, 21 nt, Bordetella pertussis
aguccaggguguccuggucgg

SEQ ID NO: 343839 - RNA, 17 nt, Bordetella pertussis
agucccaggaucaccgc

SEQ ID NO: 343840 - RNA, 21 nt, Bordetella pertussis
aguccgagcccgggcgugccu

SEQ ID NO: 343841 - RNA, 13 nt, Bordetella pertussis
aguccgcagcgca

SEQ ID NO: 343842 - RNA, 16 nt, Bordetella pertussis
aguccgcagcgcagcg

SEQ ID NO: 343843 - RNA, 20 nt, Bordetella pertussis
aguccgcccagccaggcgcc

SEQ ID NO: 343844 - RNA, 12 nt, Bordetella pertussis
aguccgcgcgca

SEQ ID NO: 343845 - RNA, 21 nt, Bordetella pertussis
aguccggaucccaggccggcu

SEQ ID NO: 343846 - RNA, 14 nt, Bordetella pertussis
aguccggcgccgcc

SEQ ID NO: 343847 - RNA, 21 nt, Bordetella pertussis
aguccgguauccuggcgcgga

SEQ ID NO: 343848 - RNA, 23 nt, Bordetella pertussis
aguccucaugcgggacaggcgcc

SEQ ID NO: 343849 - RNA, 14 nt, Bordetella pertussis
agucgaaccagccg

SEQ ID NO: 343850 - RNA, 20 nt, Bordetella pertussis
agucgacccaccuggccaca

SEQ ID NO: 343851 - RNA, 20 nt, Bordetella pertussis
agucgacgcugaucggccga

SEQ ID NO: 343852 - RNA, 13 nt, Bordetella pertussis
agucgagcaccgc

SEQ ID NO: 343853 - RNA, 18 nt, Bordetella pertussis
agucgaugaaggcgccga

SEQ ID NO: 343854 - RNA, 18 nt, Bordetella pertussis
agucgcaguucggccuca

SEQ ID NO: 343855 - RNA, 12 nt, Bordetella pertussis
agucgccgcgcc

SEQ ID NO: 343856 - RNA, 13 nt, Bordetella pertussis
agucgccgcgccc

SEQ ID NO: 343857 - RNA, 16 nt, Bordetella pertussis
agucgccgcgcccgcg

SEQ ID NO: 343858 - RNA, 17 nt, Bordetella pertussis
agucgccgcugccgggc

SEQ ID NO: 343859 - RNA, 21 nt, Bordetella pertussis
agucgccggcuuccagcagca

SEQ ID NO: 343860 - RNA, 17 nt, Bordetella pertussis
agucgcggaugcgcgcc

SEQ ID NO: 343861 - RNA, 19 nt, Bordetella pertussis
agucggaguagggcagcga

SEQ ID NO: 343862 - RNA, 16 nt, Bordetella pertussis
agucggccuggcgcuc

SEQ ID NO: 343863 - RNA, 16 nt, Bordetella pertussis
agucggcgauggcgcg

SEQ ID NO: 343864 - RNA, 13 nt, Bordetella pertussis
agucggcgccgcg

SEQ ID NO: 343865 - RNA, 15 nt, Bordetella pertussis
agucggcgccgcgca

SEQ ID NO: 343866 - RNA, 15 nt, Bordetella pertussis
agucgggacggcgcg

SEQ ID NO: 343867 - RNA, 16 nt, Bordetella pertussis
agucgggcagcgcccg

SEQ ID NO: 343868 - RNA, 15 nt, Bordetella pertussis
agucggucgccgcag

SEQ ID NO: 343869 - RNA, 16 nt, Bordetella pertussis
agucgucgaaggcgcg

SEQ ID NO: 343870 - RNA, 17 nt, Bordetella pertussis
agucguugccggccagc

SEQ ID NO: 343871 - RNA, 13 nt, Bordetella pertussis
agugcaggccgcg

SEQ ID NO: 343872 - RNA, 20 nt, Bordetella pertussis
agugcaggggguggcggccg

SEQ ID NO: 343873 - RNA, 22 nt, Bordetella pertussis
agugcaggggguggcggccguc

SEQ ID NO: 343874 - RNA, 16 nt, Bordetella pertussis
agugcccaggcccgug

SEQ ID NO: 343875 - RNA, 17 nt, Bordetella pertussis
agugcccaggcccgugc

SEQ ID NO: 343876 - RNA, 19 nt, Bordetella pertussis
agugcccccacgcugcgcc

SEQ ID NO: 343877 - RNA, 21 nt, Bordetella pertussis
agugcccccacgcugcgcccg

SEQ ID NO: 343878 - RNA, 20 nt, Bordetella pertussis
agugccuggacgcgcuggcc

SEQ ID NO: 343879 - RNA, 22 nt, Bordetella pertussis
agugccuggacgcgcuggccga

SEQ ID NO: 343880 - RNA, 17 nt, Bordetella pertussis
aguggcccaagcccgug

SEQ ID NO: 343881 - RNA, 19 nt, Bordetella pertussis
agugggccaguucgcggcg

SEQ ID NO: 343882 - RNA, 14 nt, Bordetella pertussis
aguguuucggccug

SEQ ID NO: 343883 - RNA, 17 nt, Bordetella pertussis
aguucagcagcgccacg

SEQ ID NO: 343884 - RNA, 19 nt, Bordetella pertussis
aguugcucggagcccagug

SEQ ID NO: 343885 - RNA, 21 nt, Bordetella pertussis
aguugcuugcgauaggugcgc

SEQ ID NO: 343886 - RNA, 21 nt, Bordetella pertussis
aguugggcgcgcccagccccg

SEQ ID NO: 343887 - RNA, 15 nt, Bordetella pertussis
auacaaggcgcggca

SEQ ID NO: 343888 - RNA, 13 nt, Bordetella pertussis
auaccacgcgcgg

SEQ ID NO: 343889 - RNA, 16 nt, Bordetella pertussis
auaccacgcgcggcgg

SEQ ID NO: 343890 - RNA, 20 nt, Bordetella pertussis
auagcggccggcgcgcgcga

SEQ ID NO: 343891 - RNA, 19 nt, Bordetella pertussis
auagcgggccugcagcaug

SEQ ID NO: 343892 - RNA, 20 nt, Bordetella pertussis
auagcgggccugcagcauga

SEQ ID NO: 343893 - RNA, 20 nt, Bordetella pertussis
auagguuguauucguccagg

SEQ ID NO: 343894 - RNA, 24 nt, Bordetella pertussis
auauccacgccuucggcgcgcgcc

SEQ ID NO: 343895 - RNA, 14 nt, Bordetella pertussis
auauccaggcggcg

SEQ ID NO: 343896 - RNA, 15 nt, Bordetella pertussis
auauccaggcggcgc

SEQ ID NO: 343897 - RNA, 13 nt, Bordetella pertussis
auaucccauggga

SEQ ID NO: 343898 - RNA, 15 nt, Bordetella pertussis
auaugcagccgcacc

SEQ ID NO: 343899 - RNA, 20 nt, Bordetella pertussis
auaugcagccgcaccagcgc

SEQ ID NO: 343900 - RNA, 14 nt, Bordetella pertussis
auaugccgccggcc

SEQ ID NO: 343901 - RNA, 22 nt, Bordetella pertussis
aucaacgacaaagccuccgcau

SEQ ID NO: 343902 - RNA, 18 nt, Bordetella pertussis
aucaccgccauggcggcc

SEQ ID NO: 343903 - RNA, 20 nt, Bordetella pertussis
aucaccgccauggcggccgc

SEQ ID NO: 343904 - RNA, 14 nt, Bordetella pertussis
aucaccgccgcgcc

SEQ ID NO: 343905 - RNA, 18 nt, Bordetella pertussis
aucaccgccgcggcgaug

SEQ ID NO: 343906 - RNA, 13 nt, Bordetella pertussis
aucacgccgucga

SEQ ID NO: 343907 - RNA, 12 nt, Bordetella pertussis
aucacgcggucg

SEQ ID NO: 343908 - RNA, 13 nt, Bordetella pertussis
aucacgggcgcca

SEQ ID NO: 343909 - RNA, 14 nt, Bordetella pertussis
aucacgggcgccag

SEQ ID NO: 343910 - RNA, 19 nt, Bordetella pertussis
aucagccacgugaagcgcc

SEQ ID NO: 343911 - RNA, 14 nt, Bordetella pertussis
aucagccagccgcu

SEQ ID NO: 343912 - RNA, 14 nt, Bordetella pertussis
aucagccagccggc

SEQ ID NO: 343913 - RNA, 20 nt, Bordetella pertussis
aucagccagccggcggccag

SEQ ID NO: 343914 - RNA, 16 nt, Bordetella pertussis
aucagccggccauggc

SEQ ID NO: 343915 - RNA, 21 nt, Bordetella pertussis
aucagcgaaugcgacagcgac

SEQ ID NO: 343916 - RNA, 15 nt, Bordetella pertussis
aucagcgugccgccg

SEQ ID NO: 343917 - RNA, 20 nt, Bordetella pertussis
aucagcucgaccacggcggc

SEQ ID NO: 343918 - RNA, 19 nt, Bordetella pertussis
aucagggugggcacgcgcg

SEQ ID NO: 343919 - RNA, 23 nt, Bordetella pertussis
aucaguccgacgacaaacccgac

SEQ ID NO: 343920 - RNA, 20 nt, Bordetella pertussis
aucauccuggucgacgcgac

SEQ ID NO: 343921 - RNA, 20 nt, Bordetella pertussis
aucaucgaggcaaucagccc

SEQ ID NO: 343922 - RNA, 20 nt, Bordetella pertussis
aucaucgcgcuggcgcgcga

SEQ ID NO: 343923 - RNA, 16 nt, Bordetella pertussis
aucaucggcgccauca

SEQ ID NO: 343924 - RNA, 14 nt, Bordetella pertussis
aucaugaggcggcg

SEQ ID NO: 343925 - RNA, 15 nt, Bordetella pertussis
aucaugaggcggcgg

SEQ ID NO: 343926 - RNA, 17 nt, Bordetella pertussis
aucaugaggcggcggua

SEQ ID NO: 343927 - RNA, 17 nt, Bordetella pertussis
aucaugaugaugauguu

SEQ ID NO: 343928 - RNA, 15 nt, Bordetella pertussis
aucaugaugcgcugg

SEQ ID NO: 343929 - RNA, 22 nt, Bordetella pertussis
aucaugcaguacaggcgcgugg

SEQ ID NO: 343930 - RNA, 20 nt, Bordetella pertussis
aucaugccgcugaccagcac

SEQ ID NO: 343931 - RNA, 18 nt, Bordetella pertussis
aucaugcgcugcuggcca

SEQ ID NO: 343932 - RNA, 18 nt, Bordetella pertussis
aucaugcgguuugcagga

SEQ ID NO: 343933 - RNA, 13 nt, Bordetella pertussis
aucauggcgccga

SEQ ID NO: 343934 - RNA, 13 nt, Bordetella pertussis
aucauggcgucgg

SEQ ID NO: 343935 - RNA, 18 nt, Bordetella pertussis
auccaccggcgcgcgcau

SEQ ID NO: 343936 - RNA, 17 nt, Bordetella pertussis
auccacgccgccggcca

SEQ ID NO: 343937 - RNA, 18 nt, Bordetella pertussis
auccacgccuucggcgcg

SEQ ID NO: 343938 - RNA, 22 nt, Bordetella pertussis
auccacgccuucggcgcgcgcc

SEQ ID NO: 343939 - RNA, 13 nt, Bordetella pertussis
auccacggccggc

SEQ ID NO: 343940 - RNA, 14 nt, Bordetella pertussis
auccacggcgccau

SEQ ID NO: 343941 - RNA, 19 nt, Bordetella pertussis
auccacugcagcaguucgg

SEQ ID NO: 343942 - RNA, 15 nt, Bordetella pertussis
auccacucggccagc

SEQ ID NO: 343943 - RNA, 15 nt, Bordetella pertussis
auccagcccgcgggu

SEQ ID NO: 343944 - RNA, 15 nt, Bordetella pertussis
auccagccgaucagc

SEQ ID NO: 343945 - RNA, 22 nt, Bordetella pertussis
auccagcgccagcaccggcacg

SEQ ID NO: 343946 - RNA, 14 nt, Bordetella pertussis
auccagcgcgccca

SEQ ID NO: 343947 - RNA, 23 nt, Bordetella pertussis
auccagcgcgcccgaggcgcgca

SEQ ID NO: 343948 - RNA, 16 nt, Bordetella pertussis
auccagcgcggccacg

SEQ ID NO: 343949 - RNA, 17 nt, Bordetella pertussis
auccagcgcucgggcuc

SEQ ID NO: 343950 - RNA, 16 nt, Bordetella pertussis
auccagcucggcgaug

SEQ ID NO: 343951 - RNA, 21 nt, Bordetella pertussis
auccagcucgguggucaacgg

SEQ ID NO: 343952 - RNA, 15 nt, Bordetella pertussis
auccaggcggcgcuc

SEQ ID NO: 343953 - RNA, 18 nt, Bordetella pertussis
auccagguaggcggcgcg

SEQ ID NO: 343954 - RNA, 20 nt, Bordetella pertussis
auccaggucuacccgcgcga

SEQ ID NO: 343955 - RNA, 22 nt, Bordetella pertussis
auccagguggucuugaggucgc

SEQ ID NO: 343956 - RNA, 18 nt, Bordetella pertussis
auccagguugucgcgcga

SEQ ID NO: 343957 - RNA, 17 nt, Bordetella pertussis
auccaucggcgcgcgcu

SEQ ID NO: 343958 - RNA, 14 nt, Bordetella pertussis
auccaucugguggu

SEQ ID NO: 343959 - RNA, 14 nt, Bordetella pertussis
auccauguggccag

SEQ ID NO: 343960 - RNA, 15 nt, Bordetella pertussis
auccauguggccagc

SEQ ID NO: 343961 - RNA, 15 nt, Bordetella pertussis
aucccaauuggccgc

SEQ ID NO: 343962 - RNA, 13 nt, Bordetella pertussis
aucccaggccggc

SEQ ID NO: 343963 - RNA, 22 nt, Bordetella pertussis
aucccaggcgcucagccgugcc

SEQ ID NO: 343964 - RNA, 14 nt, Bordetella pertussis
aucccccgcggagg

SEQ ID NO: 343965 - RNA, 13 nt, Bordetella pertussis
aucccggccaggc

SEQ ID NO: 343966 - RNA, 18 nt, Bordetella pertussis
aucccggccaggcgccgg

SEQ ID NO: 343967 - RNA, 19 nt, Bordetella pertussis
aucccggccaggcgccggc

SEQ ID NO: 343968 - RNA, 15 nt, Bordetella pertussis
aucccggcgacaccg

SEQ ID NO: 343969 - RNA, 21 nt, Bordetella pertussis
aucccggcgacaccgcggccu

SEQ ID NO: 343970 - RNA, 22 nt, Bordetella pertussis
aucccggcgaucaugccgccga

SEQ ID NO: 343971 - RNA, 16 nt, Bordetella pertussis
aucccggcgccagcca

SEQ ID NO: 343972 - RNA, 18 nt, Bordetella pertussis
aucccgucauggcggcag

SEQ ID NO: 343973 - RNA, 19 nt, Bordetella pertussis
aucccgucauggcggcagg

SEQ ID NO: 343974 - RNA, 22 nt, Bordetella pertussis
aucccucgcccagcgagccggc

SEQ ID NO: 343975 - RNA, 18 nt, Bordetella pertussis
aucccugaucccggcgcu

SEQ ID NO: 343976 - RNA, 22 nt, Bordetella pertussis
auccgaauuccugaacgccggg

SEQ ID NO: 343977 - RNA, 15 nt, Bordetella pertussis
auccgacgcguucgc

SEQ ID NO: 343978 - RNA, 19 nt, Bordetella pertussis
auccgcaaguucggcagcg

SEQ ID NO: 343979 - RNA, 21 nt, Bordetella pertussis
auccgcccguugcggcgccuc

SEQ ID NO: 343980 - RNA, 15 nt, Bordetella pertussis
auccgccgcggccag

SEQ ID NO: 343981 - RNA, 19 nt, Bordetella pertussis
auccgccguugcucgcgcg

SEQ ID NO: 343982 - RNA, 15 nt, Bordetella pertussis
auccgcgcugcugcc

SEQ ID NO: 343983 - RNA, 18 nt, Bordetella pertussis
auccgcgcugcugccguc

SEQ ID NO: 343984 - RNA, 13 nt, Bordetella pertussis
auccggcagcagc

SEQ ID NO: 343985 - RNA, 14 nt, Bordetella pertussis
auccggccacgcau

SEQ ID NO: 343986 - RNA, 19 nt, Bordetella pertussis
auccggccagcacgccggc

SEQ ID NO: 343987 - RNA, 22 nt, Bordetella pertussis
auccggccagcacgccggcggg

SEQ ID NO: 343988 - RNA, 15 nt, Bordetella pertussis
auccggcccagcgcc

SEQ ID NO: 343989 - RNA, 21 nt, Bordetella pertussis
auccggcccggugcagccgcc

SEQ ID NO: 343990 - RNA, 22 nt, Bordetella pertussis
auccggccgcacgcggccgcgg

SEQ ID NO: 343991 - RNA, 17 nt, Bordetella pertussis
auccggcgaccgacggc

SEQ ID NO: 343992 - RNA, 23 nt, Bordetella pertussis
auccggcgcacgccccgacgcgg

SEQ ID NO: 343993 - RNA, 18 nt, Bordetella pertussis
auccggcgcaugauggcc

SEQ ID NO: 343994 - RNA, 14 nt, Bordetella pertussis
auccgggcccgguu

SEQ ID NO: 343995 - RNA, 21 nt, Bordetella pertussis
auccgggugaaguugucgucg

SEQ ID NO: 343996 - RNA, 15 nt, Bordetella pertussis
auccguuggugccga

SEQ ID NO: 343997 - RNA, 21 nt, Bordetella pertussis
auccucgcccagcggcgccga

SEQ ID NO: 343998 - RNA, 22 nt, Bordetella pertussis
auccucgcccagcggcgccgac

SEQ ID NO: 343999 - RNA, 18 nt, Bordetella pertussis
auccucgcugccggcgcc

SEQ ID NO: 344000 - RNA, 22 nt, Bordetella pertussis
auccucgggcgacuccagcccg

SEQ ID NO: 344001 - RNA, 13 nt, Bordetella pertussis
auccuggcgcgga

SEQ ID NO: 344002 - RNA, 15 nt, Bordetella pertussis
auccuggcgcggaca

SEQ ID NO: 344003 - RNA, 21 nt, Bordetella pertussis
auccuggcucugaucgcgcug

SEQ ID NO: 344004 - RNA, 19 nt, Bordetella pertussis
aucgaaaccggcgcgcgcg

SEQ ID NO: 344005 - RNA, 22 nt, Bordetella pertussis
aucgaacgacucgucgaccacc

SEQ ID NO: 344006 - RNA, 21 nt, Bordetella pertussis
aucgaaggcagcgcggccggc

SEQ ID NO: 344007 - RNA, 17 nt, Bordetella pertussis
aucgaaggcgaccggca

SEQ ID NO: 344008 - RNA, 22 nt, Bordetella pertussis
aucgaauggucggccucggcga

SEQ ID NO: 344009 - RNA, 20 nt, Bordetella pertussis
aucgaauuugaacagccgcc

SEQ ID NO: 344010 - RNA, 22 nt, Bordetella pertussis
aucgggcagcacgcgcaccagg

SEQ ID NO: 344011 - RNA, 16 nt, Bordetella pertussis
aucgggccggcggcag

SEQ ID NO: 344012 - RNA, 15 nt, Bordetella pertussis
aucggugcggccggu

SEQ ID NO: 344013 - RNA, 14 nt, Bordetella pertussis
aucguaggcgcugu

SEQ ID NO: 344014 - RNA, 19 nt, Bordetella pertussis
aucguaggcgcuguuggcc

SEQ ID NO: 344015 - RNA, 20 nt, Bordetella pertussis
aucgucgacguccuggugga

SEQ ID NO: 344016 - RNA, 14 nt, Bordetella pertussis
aucgucgcgcugcg

SEQ ID NO: 344017 - RNA, 16 nt, Bordetella pertussis
aucgucgcugcggccg

SEQ ID NO: 344018 - RNA, 16 nt, Bordetella pertussis
aucgucggacaacgcc

SEQ ID NO: 344019 - RNA, 10 nt, Bordetella pertussis
aucgucggcg

SEQ ID NO: 344020 - RNA, 13 nt, Bordetella pertussis
aucucagcgcgcc

SEQ ID NO: 344021 - RNA, 22 nt, Bordetella pertussis
aucuccaggaugcgcgacaccg

SEQ ID NO: 344022 - RNA, 13 nt, Bordetella pertussis
aucucccggcgcc

SEQ ID NO: 344023 - RNA, 14 nt, Bordetella pertussis
aucucccggcgccc

SEQ ID NO: 344024 - RNA, 20 nt, Bordetella pertussis
aucucggcgcccgcggccug

SEQ ID NO: 344025 - RNA, 16 nt, Bordetella pertussis
aucucggccagcagcg

SEQ ID NO: 344026 - RNA, 19 nt, Bordetella pertussis
aucucgggauaggccucgg

SEQ ID NO: 344027 - RNA, 20 nt, Bordetella pertussis
aucucgggcaggucggccag

SEQ ID NO: 344028 - RNA, 20 nt, Bordetella pertussis
aucucguggcccagcaccgc

SEQ ID NO: 344029 - RNA, 14 nt, Bordetella pertussis
aucugcaugccgac

SEQ ID NO: 344030 - RNA, 22 nt, Bordetella pertussis
aucugccccagcuugucggccg

SEQ ID NO: 344031 - RNA, 19 nt, Bordetella pertussis
aucugcgagccuucggccg

SEQ ID NO: 344032 - RNA, 17 nt, Bordetella pertussis
aucuggaccgcgcgcga

SEQ ID NO: 344033 - RNA, 20 nt, Bordetella pertussis
aucuggcaaugguccagcag

SEQ ID NO: 344034 - RNA, 14 nt, Bordetella pertussis
aucuggcgcgcgac

SEQ ID NO: 344035 - RNA, 17 nt, Bordetella pertussis
aucuugaugcggccguu

SEQ ID NO: 344036 - RNA, 15 nt, Bordetella pertussis
aucuuggugcgcgcc

SEQ ID NO: 344037 - RNA, 22 nt, Bordetella pertussis
aucuuggugcgcgccaggucgc

SEQ ID NO: 344038 - RNA, 18 nt, Bordetella pertussis
augaaaaagggcgcacca

SEQ ID NO: 344039 - RNA, 19 nt, Bordetella pertussis
augaaacgaucggcgaagg

SEQ ID NO: 344040 - RNA, 21 nt, Bordetella pertussis
augaaagcgaacagggcgcga

SEQ ID NO: 344041 - RNA, 19 nt, Bordetella pertussis
augaacggcagcgcgcgcg

SEQ ID NO: 344042 - RNA, 21 nt, Bordetella pertussis
augaacggcagcgcgcgcgug

SEQ ID NO: 344043 - RNA, 18 nt, Bordetella pertussis
augaagcgguggcggccg

SEQ ID NO: 344044 - RNA, 16 nt, Bordetella pertussis
augaagcguucggccu

SEQ ID NO: 344045 - RNA, 16 nt, Bordetella pertussis
augaccagcgccggcg

SEQ ID NO: 344046 - RNA, 18 nt, Bordetella pertussis
augaccagcgccggcgca

SEQ ID NO: 344047 - RNA, 18 nt, Bordetella pertussis
augaccagggcgccgacc

SEQ ID NO: 344048 - RNA, 20 nt, Bordetella pertussis
augaccugcgacagcaccgg

SEQ ID NO: 344049 - RNA, 11 nt, Bordetella pertussis
augacgaucac

SEQ ID NO: 344050 - RNA, 14 nt, Bordetella pertussis
augacgcagccgcc

SEQ ID NO: 344051 - RNA, 22 nt, Bordetella pertussis
augacgccgggcgcggcccggc

SEQ ID NO: 344052 - RNA, 22 nt, Bordetella pertussis
augacgcgcugaugcgcggcgg

SEQ ID NO: 344053 - RNA, 13 nt, Bordetella pertussis
augacgcgccgcg

SEQ ID NO: 344054 - RNA, 16 nt, Bordetella pertussis
augacgcgccgcgccu

SEQ ID NO: 344055 - RNA, 13 nt, Bordetella pertussis
augacggggcggc

SEQ ID NO: 344056 - RNA, 15 nt, Bordetella pertussis
augacggggcggcgc

SEQ ID NO: 344057 - RNA, 13 nt, Bordetella pertussis
augacggcgucga

SEQ ID NO: 344058 - RNA, 15 nt, Bordetella pertussis
augagcacgccccaa

SEQ ID NO: 344059 - RNA, 17 nt, Bordetella pertussis
augagcugaugcucgcc

SEQ ID NO: 344060 - RNA, 13 nt, Bordetella pertussis
augaggccccugu

SEQ ID NO: 344061 - RNA, 13 nt, Bordetella pertussis
augaggcggcggu

SEQ ID NO: 344062 - RNA, 19 nt, Bordetella pertussis
augauguucauacgcgcgc

SEQ ID NO: 344063 - RNA, 21 nt, Bordetella pertussis
augcaacacgaccagcaggcc

SEQ ID NO: 344064 - RNA, 22 nt, Bordetella pertussis
augcaccacggccacgucgguc

SEQ ID NO: 344065 - RNA, 14 nt, Bordetella pertussis
augcacgaccaggc

SEQ ID NO: 344066 - RNA, 17 nt, Bordetella pertussis
augcacgauauuggcgu

SEQ ID NO: 344067 - RNA, 20 nt, Bordetella pertussis
augcacgauauuggcgucgg

SEQ ID NO: 344068 - RNA, 20 nt, Bordetella pertussis
augcaccugcagggucagcc

SEQ ID NO: 344069 - RNA, 19 nt, Bordetella pertussis
augcacggaacgugccguc

SEQ ID NO: 344070 - RNA, 17 nt, Bordetella pertussis
augcagcacacggucag

SEQ ID NO: 344071 - RNA, 11 nt, Bordetella pertussis
augcagccgcc

SEQ ID NO: 344072 - RNA, 13 nt, Bordetella pertussis
augcagcugcgcc

SEQ ID NO: 344073 - RNA, 19 nt, Bordetella pertussis
augcaggucggggcgcucg

SEQ ID NO: 344074 - RNA, 20 nt, Bordetella pertussis
augcaggucggggcgcucga

SEQ ID NO: 344075 - RNA, 15 nt, Bordetella pertussis
augcauucggcggcc

SEQ ID NO: 344076 - RNA, 18 nt, Bordetella pertussis
augcauucggcggccggc

SEQ ID NO: 344077 - RNA, 20 nt, Bordetella pertussis
augccagcggcgcagccggc

SEQ ID NO: 344078 - RNA, 22 nt, Bordetella pertussis
augccagggugaccuggcgcgc

SEQ ID NO: 344079 - RNA, 22 nt, Bordetella pertussis
augccagugaaacgcgacgcgc

SEQ ID NO: 344080 - RNA, 14 nt, Bordetella pertussis
augccaugccgggc

SEQ ID NO: 344081 - RNA, 14 nt, Bordetella pertussis
augcccagcccggc

SEQ ID NO: 344082 - RNA, 15 nt, Bordetella pertussis
augcccagcgagcug

SEQ ID NO: 344083 - RNA, 23 nt, Bordetella pertussis
augcccagcgagcuggugauggu

SEQ ID NO: 344084 - RNA, 16 nt, Bordetella pertussis
augcccagcaccgcca

SEQ ID NO: 344085 - RNA, 14 nt, Bordetella pertussis
augcccaggcccgc

SEQ ID NO: 344086 - RNA, 19 nt, Bordetella pertussis
augcccaggcccuggcugg

SEQ ID NO: 344087 - RNA, 13 nt, Bordetella pertussis
augcccaggucgu

SEQ ID NO: 344088 - RNA, 18 nt, Bordetella pertussis
augcccaugccgccaugc

SEQ ID NO: 344089 - RNA, 21 nt, Bordetella pertussis
augcccauggggugcuccugc

SEQ ID NO: 344090 - RNA, 20 nt, Bordetella pertussis
augccccaguccaggccggc

SEQ ID NO: 344091 - RNA, 14 nt, Bordetella pertussis
augccccgcccgcg

SEQ ID NO: 344092 - RNA, 20 nt, Bordetella pertussis
augcccgcgcaccaggcgcg

SEQ ID NO: 344093 - RNA, 17 nt, Bordetella pertussis
augcccuccucggccag

SEQ ID NO: 344094 - RNA, 20 nt, Bordetella pertussis
augcccucuucggcggccag

SEQ ID NO: 344095 - RNA, 21 nt, Bordetella pertussis
augcccucuucggcggccagc

SEQ ID NO: 344096 - RNA, 16 nt, Bordetella pertussis
augcccugcgccagcg

SEQ ID NO: 344097 - RNA, 21 nt, Bordetella pertussis
augcccuucggcaugcugcgu

SEQ ID NO: 344098 - RNA, 14 nt, Bordetella pertussis
augccgaacagcau

SEQ ID NO: 344099 - RNA, 22 nt, Bordetella pertussis
augccgaacagcauggcggcgc

SEQ ID NO: 344100 - RNA, 22 nt, Bordetella pertussis
augccgaaccagaucaggucga

SEQ ID NO: 344101 - RNA, 20 nt, Bordetella pertussis
augccgaacucgcgcucggc

SEQ ID NO: 344102 - RNA, 23 nt, Bordetella pertussis
augccgaacucgcgcucggccag

SEQ ID NO: 344103 - RNA, 20 nt, Bordetella pertussis
augccgaacugucgcgccac

SEQ ID NO: 344104 - RNA, 22 nt, Bordetella pertussis
augccgaacugucgcgccacgg

SEQ ID NO: 344105 - RNA, 15 nt, Bordetella pertussis
augccgaagcgcgcg

SEQ ID NO: 344106 - RNA, 16 nt, Bordetella pertussis
augccgaagcgcgcgu

SEQ ID NO: 344107 - RNA, 17 nt, Bordetella pertussis
augccgaccaccagcac

SEQ ID NO: 344108 - RNA, 20 nt, Bordetella pertussis
augccgaccaccagcaccga

SEQ ID NO: 344109 - RNA, 15 nt, Bordetella pertussis
augccgaccacggcu

SEQ ID NO: 344110 - RNA, 18 nt, Bordetella pertussis
augccgcccacgccaugg

SEQ ID NO: 344111 - RNA, 22 nt, Bordetella pertussis
augccgcccagcaugcgcgcga

SEQ ID NO: 344112 - RNA, 11 nt, Bordetella pertussis
augccgcccgc

SEQ ID NO: 344113 - RNA, 22 nt, Bordetella pertussis
augccgccgaaccagcgcacca

SEQ ID NO: 344114 - RNA, 15 nt, Bordetella pertussis
augccggccagcagc

SEQ ID NO: 344115 - RNA, 17 nt, Bordetella pertussis
augccggccagcagcga

SEQ ID NO: 344116 - RNA, 21 nt, Bordetella pertussis
augccggccagcagcgacggc

SEQ ID NO: 344117 - RNA, 20 nt, Bordetella pertussis
augccggcgaugaugggguc

SEQ ID NO: 344118 - RNA, 13 nt, Bordetella pertussis
augccggcgcugc

SEQ ID NO: 344119 - RNA, 13 nt, Bordetella pertussis
augccggcggcgc

SEQ ID NO: 344120 - RNA, 20 nt, Bordetella pertussis
augccugguuagagcagcgg

SEQ ID NO: 344121 - RNA, 16 nt, Bordetella pertussis
augcgaaagccggccu

SEQ ID NO: 344122 - RNA, 17 nt, Bordetella pertussis
augcgaaagccggccuc

SEQ ID NO: 344123 - RNA, 14 nt, Bordetella pertussis
augcgaaagcggcc

SEQ ID NO: 344124 - RNA, 16 nt, Bordetella pertussis
augccuuggugggguc

SEQ ID NO: 344125 - RNA, 15 nt, Bordetella pertussis
augcgacagcgacag

SEQ ID NO: 344126 - RNA, 15 nt, Bordetella pertussis
augcgagacgaaggc

SEQ ID NO: 344127 - RNA, 22 nt, Bordetella pertussis
augcgagcaaaggacacgcgcg

SEQ ID NO: 344128 - RNA, 20 nt, Bordetella pertussis
augcgcagcgcgucggcgcg

SEQ ID NO: 344129 - RNA, 21 nt, Bordetella pertussis
augcgcagcgcgucggcgcgg

SEQ ID NO: 344130 - RNA, 17 nt, Bordetella pertussis
augcgcaggacggcgcc

SEQ ID NO: 344131 - RNA, 19 nt, Bordetella pertussis
augcgcaggacggcgccgu

SEQ ID NO: 344132 - RNA, 20 nt, Bordetella pertussis
augcgcaggacggcgccguc

SEQ ID NO: 344133 - RNA, 14 nt, Bordetella pertussis
augcgcaggcccga

SEQ ID NO: 344134 - RNA, 14 nt, Bordetella pertussis
augcgcauggccag

SEQ ID NO: 344135 - RNA, 16 nt, Bordetella pertussis
augcgccagcgccugg

SEQ ID NO: 344136 - RNA, 16 nt, Bordetella pertussis
augcgccaggccucgg

SEQ ID NO: 344137 - RNA, 14 nt, Bordetella pertussis
augcgccaggcgcu

SEQ ID NO: 344138 - RNA, 20 nt, Bordetella pertussis
augcgcccgaugcucgccgg

SEQ ID NO: 344139 - RNA, 21 nt, Bordetella pertussis
augcgcccgaugcucgccggc

SEQ ID NO: 344140 - RNA, 22 nt, Bordetella pertussis
augcgcccgaugcucgccggcg

SEQ ID NO: 344141 - RNA, 14 nt, Bordetella pertussis
augcgcccggccac

SEQ ID NO: 344142 - RNA, 13 nt, Bordetella pertussis
augcgccgcgcuu

SEQ ID NO: 344143 - RNA, 13 nt, Bordetella pertussis
augcgccggccug

SEQ ID NO: 344144 - RNA, 18 nt, Bordetella pertussis
augcgccggccuggcgcg

SEQ ID NO: 344145 - RNA, 17 nt, Bordetella pertussis
augcgcgaacgcgcgcc

SEQ ID NO: 344146 - RNA, 18 nt, Bordetella pertussis
augcgcgaagcgcccugg

SEQ ID NO: 344147 - RNA, 16 nt, Bordetella pertussis
augcgcgccaggcgcg

SEQ ID NO: 344148 - RNA, 12 nt, Bordetella pertussis
augcgcgccagu

SEQ ID NO: 344149 - RNA, 21 nt, Bordetella pertussis
augcgcgccccgucggccguc

SEQ ID NO: 344150 - RNA, 22 nt, Bordetella pertussis
augcgcgccguacagccgcggc

SEQ ID NO: 344151 - RNA, 11 nt, Bordetella pertussis
augcgcgcgcg

SEQ ID NO: 344152 - RNA, 22 nt, Bordetella pertussis
augcgcgcgcggaucgacgcga

SEQ ID NO: 344153 - RNA, 14 nt, Bordetella pertussis
augcgcgcggccag

SEQ ID NO: 344154 - RNA, 14 nt, Bordetella pertussis
augcgcgcggccuc

SEQ ID NO: 344155 - RNA, 18 nt, Bordetella pertussis
augcgcgcgugcagcgcc

SEQ ID NO: 344156 - RNA, 20 nt, Bordetella pertussis
augcgcggggccaggcgcag

SEQ ID NO: 344157 - RNA, 14 nt, Bordetella pertussis
augcggcccgcgcu

SEQ ID NO: 344158 - RNA, 22 nt, Bordetella pertussis
augcggccgucgccgcccaugc

SEQ ID NO: 344159 - RNA, 17 nt, Bordetella pertussis
augcggccuucgccggu

SEQ ID NO: 344160 - RNA, 16 nt, Bordetella pertussis
augcggcgccacgcag

SEQ ID NO: 344161 - RNA, 17 nt, Bordetella pertussis
augcggcgccugucccg

SEQ ID NO: 344162 - RNA, 19 nt, Bordetella pertussis
augcggcgcgccgcgucgg

SEQ ID NO: 344163 - RNA, 15 nt, Bordetella pertussis
augcggcggcgcugg

SEQ ID NO: 344164 - RNA, 19 nt, Bordetella pertussis
augcggcggcgcuggccug

SEQ ID NO: 344165 - RNA, 21 nt, Bordetella pertussis
augcggcggcgggcggccggc

SEQ ID NO: 344166 - RNA, 22 nt, Bordetella pertussis
augcgggccaugucggcuucgg

SEQ ID NO: 344167 - RNA, 17 nt, Bordetella pertussis
augcgggccacgccggc

SEQ ID NO: 344168 - RNA, 17 nt, Bordetella pertussis
augcucgccggcgccgc

SEQ ID NO: 344169 - RNA, 18 nt, Bordetella pertussis
augcucgccggcgccgcc

SEQ ID NO: 344170 - RNA, 18 nt, Bordetella pertussis
augcucguccaucgccug

SEQ ID NO: 344171 - RNA, 17 nt, Bordetella pertussis
augcugcagcgcaucgc

SEQ ID NO: 344172 - RNA, 18 nt, Bordetella pertussis
augcugcagcugcuugcc

SEQ ID NO: 344173 - RNA, 20 nt, Bordetella pertussis
augcugcguaggcaggggcu

SEQ ID NO: 344174 - RNA, 15 nt, Bordetella pertussis
augcuggagauguuc

SEQ ID NO: 344175 - RNA, 19 nt, Bordetella pertussis
augcuggcauugacgacgc

SEQ ID NO: 344176 - RNA, 22 nt, Bordetella pertussis
augcuggcccagcugggcggcg

SEQ ID NO: 344177 - RNA, 16 nt, Bordetella pertussis
augcugggcgggcugg

SEQ ID NO: 344178 - RNA, 19 nt, Bordetella pertussis
auggacgagggccggcgcc

SEQ ID NO: 344179 - RNA, 20 nt, Bordetella pertussis
auggacgagggccggcgcca

SEQ ID NO: 344180 - RNA, 21 nt, Bordetella pertussis
auggacgagggccggcgccag

SEQ ID NO: 344181 - RNA, 13 nt, Bordetella pertussis
auggaccgccgcc

SEQ ID NO: 344182 - RNA, 20 nt, Bordetella pertussis
auggacgcguucucgcgcuu

SEQ ID NO: 344183 - RNA, 20 nt, Bordetella pertussis
auggagucggucagccugau

SEQ ID NO: 344184 - RNA, 13 nt, Bordetella pertussis
auggaugcgcgcc

SEQ ID NO: 344185 - RNA, 14 nt, Bordetella pertussis
auggauucgcgccg

SEQ ID NO: 344186 - RNA, 17 nt, Bordetella pertussis
auggauucgcgccggcc

SEQ ID NO: 344187 - RNA, 15 nt, Bordetella pertussis
auggauuucgaccgc

SEQ ID NO: 344188 - RNA, 21 nt, Bordetella pertussis
auggcagcacaagggccccuc

SEQ ID NO: 344189 - RNA, 18 nt, Bordetella pertussis
auggcagcagaucggcgg

SEQ ID NO: 344190 - RNA, 21 nt, Bordetella pertussis
auggcagcagaucggcggccu

SEQ ID NO: 344191 - RNA, 15 nt, Bordetella pertussis
auggcagggcgccgc

SEQ ID NO: 344192 - RNA, 19 nt, Bordetella pertussis
auggcagggcgccgcgcgg

SEQ ID NO: 344193 - RNA, 16 nt, Bordetella pertussis
auggcauggggcaggc

SEQ ID NO: 344194 - RNA, 19 nt, Bordetella pertussis
auggcauggggcaggcgca

SEQ ID NO: 344195 - RNA, 20 nt, Bordetella pertussis
auggccgaaucguucacgcc

SEQ ID NO: 344196 - RNA, 21 nt, Bordetella pertussis
auggccgacagcgucgagcug

SEQ ID NO: 344197 - RNA, 16 nt, Bordetella pertussis
auggccgccagcggcu

SEQ ID NO: 344198 - RNA, 14 nt, Bordetella pertussis
auggccgcgcccag

SEQ ID NO: 344199 - RNA, 22 nt, Bordetella pertussis
auggccgcgcgcagcgaggccu

SEQ ID NO: 344200 - RNA, 13 nt, Bordetella pertussis
auggccggcgcga

SEQ ID NO: 344201 - RNA, 18 nt, Bordetella pertussis
auggccgggccguggcga

SEQ ID NO: 344202 - RNA, 15 nt, Bordetella pertussis
auggcgaucgaacgc

SEQ ID NO: 344203 - RNA, 20 nt, Bordetella pertussis
auggcgaucgaacgcggcca

SEQ ID NO: 344204 - RNA, 21 nt, Bordetella pertussis
auggcgaucgaacgcggccag

SEQ ID NO: 344205 - RNA, 19 nt, Bordetella pertussis
auggcgaugaccucggcga

SEQ ID NO: 344206 - RNA, 13 nt, Bordetella pertussis
auggcgccagccc

SEQ ID NO: 344207 - RNA, 17 nt, Bordetella pertussis
auggcgccgcgccgccg

SEQ ID NO: 344208 - RNA, 15 nt, Bordetella pertussis
auggcgccgcugucg

SEQ ID NO: 344209 - RNA, 15 nt, Bordetella pertussis
auggcgcgcgccgcg

SEQ ID NO: 344210 - RNA, 12 nt, Bordetella pertussis
auggcgcgcgcg

SEQ ID NO: 344211 - RNA, 15 nt, Bordetella pertussis
auggcgcgcgggccc

SEQ ID NO: 344212 - RNA, 21 nt, Bordetella pertussis
auggcgcggccgccagcccga

SEQ ID NO: 344213 - RNA, 20 nt, Bordetella pertussis
auggcgcgucgccgcgccgu

SEQ ID NO: 344214 - RNA, 18 nt, Bordetella pertussis
auggcgcgugcgcgcgcc

SEQ ID NO: 344215 - RNA, 14 nt, Bordetella pertussis
auggcggcggccac

SEQ ID NO: 344216 - RNA, 14 nt, Bordetella pertussis
auggcggcggcguc

SEQ ID NO: 344217 - RNA, 16 nt, Bordetella pertussis
auggcggggauggagu

SEQ ID NO: 344218 - RNA, 17 nt, Bordetella pertussis
auggcgggguuggccgc

SEQ ID NO: 344219 - RNA, 20 nt, Bordetella pertussis
auggcgggguuggccgccag

SEQ ID NO: 344220 - RNA, 17 nt, Bordetella pertussis
auggcgguggccagcgc

SEQ ID NO: 344221 - RNA, 17 nt, Bordetella pertussis
auggcguacagcagggu

SEQ ID NO: 344222 - RNA, 21 nt, Bordetella pertussis
auggcguagcccuuguggccg

SEQ ID NO: 344223 - RNA, 20 nt, Bordetella pertussis
auggcguaugacagggugcc

SEQ ID NO: 344224 - RNA, 14 nt, Bordetella pertussis
augggccugggcgc

SEQ ID NO: 344225 - RNA, 20 nt, Bordetella pertussis
augggcgaagccacggcccg

SEQ ID NO: 344226 - RNA, 22 nt, Bordetella pertussis
augggcgacgcgacacgcagca

SEQ ID NO: 344227 - RNA, 20 nt, Bordetella pertussis
augggcgcggcgcgcgccga

SEQ ID NO: 344228 - RNA, 21 nt, Bordetella pertussis
augggcgcgguagcgccccuc

SEQ ID NO: 344229 - RNA, 23 nt, Bordetella pertussis
augggcgcgguagcgccccucgc

SEQ ID NO: 344230 - RNA, 19 nt, Bordetella pertussis
augggcggccucggccagc

SEQ ID NO: 344231 - RNA, 23 nt, Bordetella pertussis
augggcggcgacgaacccgggcg

SEQ ID NO: 344232 - RNA, 13 nt, Bordetella pertussis
augggcgcgcccg

SEQ ID NO: 344233 - RNA, 13 nt, Bordetella pertussis
augggcgucgucg

SEQ ID NO: 344234 - RNA, 22 nt, Bordetella pertussis
augggcguggugcugacggacu

SEQ ID NO: 344235 - RNA, 14 nt, Bordetella pertussis
augggggcgagcgg

SEQ ID NO: 344236 - RNA, 20 nt, Bordetella pertussis
auggggucgggccgcgcgcg

SEQ ID NO: 344237 - RNA, 14 nt, Bordetella pertussis
auggguacagcgcg

SEQ ID NO: 344238 - RNA, 18 nt, Bordetella pertussis
augguauguauggcgguc

SEQ ID NO: 344239 - RNA, 16 nt, Bordetella pertussis
auggucaccacccgca

SEQ ID NO: 344240 - RNA, 19 nt, Bordetella pertussis
auguaaaaacccggccugc

SEQ ID NO: 344241 - RNA, 20 nt, Bordetella pertussis
auguauucaucacgggcgcc

SEQ ID NO: 344242 - RNA, 13 nt, Bordetella pertussis
auguccagcggcg

SEQ ID NO: 344243 - RNA, 15 nt, Bordetella pertussis
auguccaccagccgg

SEQ ID NO: 344244 - RNA, 16 nt, Bordetella pertussis
augucgccgccgcgca

SEQ ID NO: 344245 - RNA, 13 nt, Bordetella pertussis
augucgcgcgccu

SEQ ID NO: 344246 - RNA, 15 nt, Bordetella pertussis
augucgcgcgccugc

SEQ ID NO: 344247 - RNA, 23 nt, Bordetella pertussis
augucgcgcgccugcgcgccgcc

SEQ ID NO: 344248 - RNA, 12 nt, Bordetella pertussis
augucgcgcgcg

SEQ ID NO: 344249 - RNA, 17 nt, Bordetella pertussis
auuacccauggcaccga

SEQ ID NO: 344250 - RNA, 16 nt, Bordetella pertussis
auuccaccuugccgcu

SEQ ID NO: 344251 - RNA, 14 nt, Bordetella pertussis
auuccagcgccgcc

SEQ ID NO: 344252 - RNA, 15 nt, Bordetella pertussis
auuccaguugcgcgc

SEQ ID NO: 344253 - RNA, 18 nt, Bordetella pertussis
auucccgcccugacgccu

SEQ ID NO: 344254 - RNA, 16 nt, Bordetella pertussis
auucccuggcgcgcca

SEQ ID NO: 344255 - RNA, 22 nt, Bordetella pertussis
auuccggggucaauccgcccgu

SEQ ID NO: 344256 - RNA, 15 nt, Bordetella pertussis
auucgauggcggcgc

SEQ ID NO: 344257 - RNA, 18 nt, Bordetella pertussis
auucgauggcggcgcugg

SEQ ID NO: 344258 - RNA, 10 nt, Bordetella pertussis
auucgcgccu

SEQ ID NO: 344259 - RNA, 16 nt, Bordetella pertussis
auucgcgcggcgacac

SEQ ID NO: 344260 - RNA, 20 nt, Bordetella pertussis
auucgcgcuggcgcgagaac

SEQ ID NO: 344261 - RNA, 19 nt, Bordetella pertussis
auucgucgcugccgcgcga

SEQ ID NO: 344262 - RNA, 17 nt, Bordetella pertussis
auucucgcccugcuggc

SEQ ID NO: 344263 - RNA, 19 nt, Bordetella pertussis
auugcagggugucggccag

SEQ ID NO: 344264 - RNA, 17 nt, Bordetella pertussis
auugcaugaccgccggc

SEQ ID NO: 344265 - RNA, 17 nt, Bordetella pertussis
auugccacggcgggccg

SEQ ID NO: 344266 - RNA, 14 nt, Bordetella pertussis
auugccgccgcgca

SEQ ID NO: 344267 - RNA, 14 nt, Bordetella pertussis
auugcgcggccagg

SEQ ID NO: 344268 - RNA, 16 nt, Bordetella pertussis
auugcggggcggcgua

SEQ ID NO: 344269 - RNA, 15 nt, Bordetella pertussis
auuggcccugcuggg

SEQ ID NO: 344270 - RNA, 19 nt, Bordetella pertussis
auuggcgaacgugcgcgcc

SEQ ID NO: 344271 - RNA, 19 nt, Bordetella pertussis
auuggcgucggccgccgug

SEQ ID NO: 344272 - RNA, 20 nt, Bordetella pertussis
auuggcgucggccgccguga

SEQ ID NO: 344273 - RNA, 17 nt, Bordetella pertussis
auuggcgcccaucgcgg

SEQ ID NO: 344274 - RNA, 23 nt, Bordetella pertussis
auugggacgccagcccgccggcg

SEQ ID NO: 344275 - RNA, 16 nt, Bordetella pertussis
auugucaagcagcgcc

SEQ ID NO: 344276 - RNA, 21 nt, Bordetella pertussis
auugucuuugaagggcggcgc

SEQ ID NO: 344277 - RNA, 16 nt, Bordetella pertussis
auugugcaugcgcgcc

SEQ ID NO: 344278 - RNA, 15 nt, Bordetella pertussis
auuuccucagccugg

SEQ ID NO: 344279 - RNA, 17 nt, Bordetella pertussis
auuuccucgaccagcgc

SEQ ID NO: 344280 - RNA, 14 nt, Bordetella pertussis
auuucgcuggccau

SEQ ID NO: 344281 - RNA, 13 nt, Bordetella pertussis
auuucggcgccgc

SEQ ID NO: 344282 - RNA, 14 nt, Bordetella pertussis
auuucggcgccgcc

SEQ ID NO: 344283 - RNA, 17 nt, Bordetella pertussis
auuucggcggccaggcc

SEQ ID NO: 344284 - RNA, 14 nt, Bordetella pertussis
auuugccgccugaa

SEQ ID NO: 344285 - RNA, 14 nt, Bordetella pertussis
caaaacgcaugacc

SEQ ID NO: 344286 - RNA, 20 nt, Bordetella pertussis
caaaacggugccuugcggcg

SEQ ID NO: 344287 - RNA, 21 nt, Bordetella pertussis
caaaacggugccuugcggcgc

SEQ ID NO: 344288 - RNA, 20 nt, Bordetella pertussis
caaacccggcgaagccggca

SEQ ID NO: 344289 - RNA, 17 nt, Bordetella pertussis
caaaccugaugccuguc

SEQ ID NO: 344290 - RNA, 18 nt, Bordetella pertussis
caaaccugaugccugucc

SEQ ID NO: 344291 - RNA, 22 nt, Bordetella pertussis
caaacgcacgauuucacccagg

SEQ ID NO: 344292 - RNA, 14 nt, Bordetella pertussis
caaacgcggcgccg

SEQ ID NO: 344293 - RNA, 22 nt, Bordetella pertussis
caaacgcggcgccgccggcggc

SEQ ID NO: 344294 - RNA, 14 nt, Bordetella pertussis
caaacggcggcagg

SEQ ID NO: 344295 - RNA, 17 nt, Bordetella pertussis
caaacggcggcaggccg

SEQ ID NO: 344296 - RNA, 23 nt, Bordetella pertussis
caaagacggcuugaccacggcca

SEQ ID NO: 344297 - RNA, 13 nt, Bordetella pertussis
caaagaucaccug

SEQ ID NO: 344298 - RNA, 13 nt, Bordetella pertussis
caaaggcccaggc

SEQ ID NO: 344299 - RNA, 16 nt, Bordetella pertussis
caacacguacgaccgc

SEQ ID NO: 344300 - RNA, 21 nt, Bordetella pertussis
caacagacccgggccgcuggc

SEQ ID NO: 344301 - RNA, 15 nt, Bordetella pertussis
caacuccacgcccug

SEQ ID NO: 344302 - RNA, 20 nt, Bordetella pertussis
caacucgaggcggcgcagga

SEQ ID NO: 344303 - RNA, 21 nt, Bordetella pertussis
caacuggccggccuggcgcgc

SEQ ID NO: 344304 - RNA, 23 nt, Bordetella pertussis
caacugggccaaccacgagcugc

SEQ ID NO: 344305 - RNA, 20 nt, Bordetella pertussis
caacugguagugcggcgcca

SEQ ID NO: 344306 - RNA, 15 nt, Bordetella pertussis
caacuucagccagcg

SEQ ID NO: 344307 - RNA, 18 nt, Bordetella pertussis
caacuuccagcgcccgcg

SEQ ID NO: 344308 - RNA, 20 nt, Bordetella pertussis
caacuuccagcgcccgcgga

SEQ ID NO: 344309 - RNA, 21 nt, Bordetella pertussis
caagaucgcauuucucggccu

SEQ ID NO: 344310 - RNA, 20 nt, Bordetella pertussis
caagaucgccggcuacggca

SEQ ID NO: 344311 - RNA, 22 nt, Bordetella pertussis
caagauggcccagggcagcggc

SEQ ID NO: 344312 - RNA, 19 nt, Bordetella pertussis
caagcagacccgcgcccag

SEQ ID NO: 344313 - RNA, 15 nt, Bordetella pertussis
caagcagauggccau

SEQ ID NO: 344314 - RNA, 21 nt, Bordetella pertussis
caagcagauggccaucgacgc

SEQ ID NO: 344315 - RNA, 19 nt, Bordetella pertussis
caagcagcgagagcgccac

SEQ ID NO: 344316 - RNA, 14 nt, Bordetella pertussis
caagcagcgccugc

SEQ ID NO: 344317 - RNA, 17 nt, Bordetella pertussis
caagccagcggcgcggc

SEQ ID NO: 344318 - RNA, 18 nt, Bordetella pertussis
caagcccaccgggccggc

SEQ ID NO: 344319 - RNA, 19 nt, Bordetella pertussis
caagcccaggcggcccagc

SEQ ID NO: 344320 - RNA, 16 nt, Bordetella pertussis
caagccccaggcaggc

SEQ ID NO: 344321 - RNA, 16 nt, Bordetella pertussis
caagccgauccgcgac

SEQ ID NO: 344322 - RNA, 17 nt, Bordetella pertussis
caagcgccacagcgcca

SEQ ID NO: 344323 - RNA, 18 nt, Bordetella pertussis
caagcgcgccaugaacuc

SEQ ID NO: 344324 - RNA, 12 nt, Bordetella pertussis
caagcgcgccga

SEQ ID NO: 344325 - RNA, 19 nt, Bordetella pertussis
caagcgcguggccaucaac

SEQ ID NO: 344326 - RNA, 22 nt, Bordetella pertussis
caagcgcguggccggcgacggc

SEQ ID NO: 344327 - RNA, 13 nt, Bordetella pertussis
caagcgcucgccg

SEQ ID NO: 344328 - RNA, 14 nt, Bordetella pertussis
caagcgcucgccgg

SEQ ID NO: 344329 - RNA, 15 nt, Bordetella pertussis
caagcgcucgccggc

SEQ ID NO: 344330 - RNA, 22 nt, Bordetella pertussis
caagcgcucgccggcgcgcagg

SEQ ID NO: 344331 - RNA, 14 nt, Bordetella pertussis
caagcgcucggcca

SEQ ID NO: 344332 - RNA, 21 nt, Bordetella pertussis
caagcggcaggcggcagaagg

SEQ ID NO: 344333 - RNA, 23 nt, Bordetella pertussis
caagcggcguggggccggccgcg

SEQ ID NO: 344334 - RNA, 20 nt, Bordetella pertussis
caagcguacguaccaggccg

SEQ ID NO: 344335 - RNA, 16 nt, Bordetella pertussis
caagcgucgauggcgu

SEQ ID NO: 344336 - RNA, 15 nt, Bordetella pertussis
caaggggcggaucgu

SEQ ID NO: 344337 - RNA, 23 nt, Bordetella pertussis
caagggcgucuucgccgaccagc

SEQ ID NO: 344338 - RNA, 22 nt, Bordetella pertussis
caaggguucgggcaugucgcgg

SEQ ID NO: 344339 - RNA, 17 nt, Bordetella pertussis
caagguacccgcgccgg

SEQ ID NO: 344340 - RNA, 18 nt, Bordetella pertussis
caagguacccgcgccggc

SEQ ID NO: 344341 - RNA, 19 nt, Bordetella pertussis
caagguacccgcgccggcg

SEQ ID NO: 344342 - RNA, 21 nt, Bordetella pertussis
caaggguuguggccguggcgg

SEQ ID NO: 344343 - RNA, 17 nt, Bordetella pertussis
caagguccaggcccggc

SEQ ID NO: 344344 - RNA, 23 nt, Bordetella pertussis
caaggugaaauagccaugcggac

SEQ ID NO: 344345 - RNA, 19 nt, Bordetella pertussis
caagguggcgugcagcagg

SEQ ID NO: 344346 - RNA, 21 nt, Bordetella pertussis
caagucgaguucggcgcgccc

SEQ ID NO: 344347 - RNA, 21 nt, Bordetella pertussis
caauaacagaggaacgccgcg

SEQ ID NO: 344348 - RNA, 23 nt, Bordetella pertussis
caauaacgccacuugcaggccgc

SEQ ID NO: 344349 - RNA, 14 nt, Bordetella pertussis
caauacccgccaca

SEQ ID NO: 344350 - RNA, 19 nt, Bordetella pertussis
caauacgaaaaccaggcug

SEQ ID NO: 344351 - RNA, 19 nt, Bordetella pertussis
caaucaugcgcugcuggcc

SEQ ID NO: 344352 - RNA, 19 nt, Bordetella pertussis
caaucccggcgacaccgcg

SEQ ID NO: 344353 - RNA, 19 nt, Bordetella pertussis
caaucgguuucggugcgga

SEQ ID NO: 344354 - RNA, 15 nt, Bordetella pertussis
caaugaaaaagccgc

SEQ ID NO: 344355 - RNA, 16 nt, Bordetella pertussis
caaugcggccaggccc

SEQ ID NO: 344356 - RNA, 17 nt, Bordetella pertussis
caaugcggccaggcccg

SEQ ID NO: 344357 - RNA, 15 nt, Bordetella pertussis
caaugguccagcagg

SEQ ID NO: 344358 - RNA, 16 nt, Bordetella pertussis
caaugguccagcaggg

SEQ ID NO: 344359 - RNA, 19 nt, Bordetella pertussis
caaugucaccgacgccagc

SEQ ID NO: 344360 - RNA, 18 nt, Bordetella pertussis
caauugcgugguggccuu

SEQ ID NO: 344361 - RNA, 21 nt, Bordetella pertussis
caauuggccgcccuggcgcga

SEQ ID NO: 344362 - RNA, 15 nt, Bordetella pertussis
cacaaccuggcgcgc

SEQ ID NO: 344363 - RNA, 18 nt, Bordetella pertussis
cacaagccguacagcgaa

SEQ ID NO: 344364 - RNA, 16 nt, Bordetella pertussis
cacaagcgcguggccg

SEQ ID NO: 344365 - RNA, 14 nt, Bordetella pertussis
cacaagcggcccca

SEQ ID NO: 344366 - RNA, 20 nt, Bordetella pertussis
cacaaggauggacuggccgc

SEQ ID NO: 344367 - RNA, 12 nt, Bordetella pertussis
cacaaggcggcc

SEQ ID NO: 344368 - RNA, 13 nt, Bordetella pertussis
cacaagggccccg

SEQ ID NO: 344369 - RNA, 16 nt, Bordetella pertussis
cacaccaucagcugga

SEQ ID NO: 344370 - RNA, 14 nt, Bordetella pertussis
cacaccgucacgcg

SEQ ID NO: 344371 - RNA, 20 nt, Bordetella pertussis
cacaccguucccggugccag

SEQ ID NO: 344372 - RNA, 15 nt, Bordetella pertussis
cacacgaucgucagc

SEQ ID NO: 344373 - RNA, 22 nt, Bordetella pertussis
cacacgaucgucagcagcacgc

SEQ ID NO: 344374 - RNA, 19 nt, Bordetella pertussis
cacacgcauuugcagcggc

SEQ ID NO: 344375 - RNA, 11 nt, Bordetella pertussis
cacacgcgcgc

SEQ ID NO: 344376 - RNA, 21 nt, Bordetella pertussis
cacacggucagcaaccccagc

SEQ ID NO: 344377 - RNA, 16 nt, Bordetella pertussis
cacacuuggccggcga

SEQ ID NO: 344378 - RNA, 19 nt, Bordetella pertussis
cacagcagcgcgccgccga

SEQ ID NO: 344379 - RNA, 16 nt, Bordetella pertussis
cacagcgccaucgcgc

SEQ ID NO: 344380 - RNA, 17 nt, Bordetella pertussis
cacagcgccaucgcgcg

SEQ ID NO: 344381 - RNA, 19 nt, Bordetella pertussis
cacagcguggcgaagucga

SEQ ID NO: 344382 - RNA, 20 nt, Bordetella pertussis
cacagggcgaaggccagcgc

SEQ ID NO: 344383 - RNA, 22 nt, Bordetella pertussis
cacagggcgaaggccagcgccu

SEQ ID NO: 344384 - RNA, 19 nt, Bordetella pertussis
cacagggggucuggcaccu

SEQ ID NO: 344385 - RNA, 19 nt, Bordetella pertussis
cacagggucaaggcgcggc

SEQ ID NO: 344386 - RNA, 21 nt, Bordetella pertussis
cacagggucaaggcgcggccg

SEQ ID NO: 344387 - RNA, 14 nt, Bordetella pertussis
cacaggguggcgcc

SEQ ID NO: 344388 - RNA, 15 nt, Bordetella pertussis
cacaggguggcgccc

SEQ ID NO: 344389 - RNA, 19 nt, Bordetella pertussis
cacaggugcgcggcgcgcc

SEQ ID NO: 344390 - RNA, 14 nt, Bordetella pertussis
cacagguuggccgc

SEQ ID NO: 344391 - RNA, 16 nt, Bordetella pertussis
cacagguuggccgcga

SEQ ID NO: 344392 - RNA, 21 nt, Bordetella pertussis
cacaguacuuguugcgugccg

SEQ ID NO: 344393 - RNA, 16 nt, Bordetella pertussis
cacaucgcccggcagg

SEQ ID NO: 344394 - RNA, 14 nt, Bordetella pertussis
cacaucgccggcgg

SEQ ID NO: 344395 - RNA, 15 nt, Bordetella pertussis
cacaucgccggcggc

SEQ ID NO: 344396 - RNA, 19 nt, Bordetella pertussis
cacaucgccggcggcgugg

SEQ ID NO: 344397 - RNA, 22 nt, Bordetella pertussis
cacaucgccggcggcguggccg

SEQ ID NO: 344398 - RNA, 19 nt, Bordetella pertussis
cacaucggaauuggcggcg

SEQ ID NO: 344399 - RNA, 21 nt, Bordetella pertussis
cacaucggccacccggaucga

SEQ ID NO: 344400 - RNA, 16 nt, Bordetella pertussis
cacaucggcccuggca

SEQ ID NO: 344401 - RNA, 19 nt, Bordetella pertussis
cacaucgucgacgucgauc

SEQ ID NO: 344402 - RNA, 15 nt, Bordetella pertussis
cacaucgucgcgcug

SEQ ID NO: 344403 - RNA, 21 nt, Bordetella pertussis
caccaacugguagugcggcgc

SEQ ID NO: 344404 - RNA, 13 nt, Bordetella pertussis
caccaagggcgcc

SEQ ID NO: 344405 - RNA, 22 nt, Bordetella pertussis
caccaaucuugccaggcccggc

SEQ ID NO: 344406 - RNA, 23 nt, Bordetella pertussis
caccacaaggauggacuggccgc

SEQ ID NO: 344407 - RNA, 21 nt, Bordetella pertussis
caccaccaugugcuugccgca

SEQ ID NO: 344408 - RNA, 23 nt, Bordetella pertussis
caccaccaugugcuugccgcagc

SEQ ID NO: 344409 - RNA, 12 nt, Bordetella pertussis
caccaccgccga

SEQ ID NO: 344410 - RNA, 17 nt, Bordetella pertussis
caccaccuccaccgcca

SEQ ID NO: 344411 - RNA, 16 nt, Bordetella pertussis
caccaccucggugccg

SEQ ID NO: 344412 - RNA, 16 nt, Bordetella pertussis
caccacgaccggcucg

SEQ ID NO: 344413 - RNA, 18 nt, Bordetella pertussis
caccacgaccggcucggg

SEQ ID NO: 344414 - RNA, 20 nt, Bordetella pertussis
caccagcaagccggcggucc

SEQ ID NO: 344415 - RNA, 18 nt, Bordetella pertussis
caccagcacaucgacguc

SEQ ID NO: 344416 - RNA, 14 nt, Bordetella pertussis
caccagcaccgcca

SEQ ID NO: 344417 - RNA, 19 nt, Bordetella pertussis
caccagcaccaugccgaug

SEQ ID NO: 344418 - RNA, 13 nt, Bordetella pertussis
caccagcaccggc

SEQ ID NO: 344419 - RNA, 17 nt, Bordetella pertussis
caccagcaccggcagcg

SEQ ID NO: 344420 - RNA, 23 nt, Bordetella pertussis
caccagcagccccagcguccagg

SEQ ID NO: 344421 - RNA, 14 nt, Bordetella pertussis
caccagcagcgcca

SEQ ID NO: 344422 - RNA, 17 nt, Bordetella pertussis
caccagcagcgccagga

SEQ ID NO: 344423 - RNA, 14 nt, Bordetella pertussis
caccagcaggaugg

SEQ ID NO: 344424 - RNA, 13 nt, Bordetella pertussis
caccagcaugucg

SEQ ID NO: 344425 - RNA, 23 nt, Bordetella pertussis
caccagccaaaucaacgaucuag

SEQ ID NO: 344426 - RNA, 23 nt, Bordetella pertussis
caccagccauucgauggcggcgc

SEQ ID NO: 344427 - RNA, 15 nt, Bordetella pertussis
caccagcgccgacgg

SEQ ID NO: 344428 - RNA, 22 nt, Bordetella pertussis
caccagcgccugccgaucgugc

SEQ ID NO: 344429 - RNA, 13 nt, Bordetella pertussis
caccagcgcgcca

SEQ ID NO: 344430 - RNA, 15 nt, Bordetella pertussis
caccagcgcgccagc

SEQ ID NO: 344431 - RNA, 16 nt, Bordetella pertussis
caccagcgcgccagca

SEQ ID NO: 344432 - RNA, 16 nt, Bordetella pertussis
caccagcgcgccgcgc

SEQ ID NO: 344433 - RNA, 17 nt, Bordetella pertussis
caccagcgcgccgcgcg

SEQ ID NO: 344434 - RNA, 19 nt, Bordetella pertussis
caccagcgcgccgcgcgcg

SEQ ID NO: 344435 - RNA, 21 nt, Bordetella pertussis
caccagcgcgccgcgcgcggc

SEQ ID NO: 344436 - RNA, 12 nt, Bordetella pertussis
caccagcgcggc

SEQ ID NO: 344437 - RNA, 16 nt, Bordetella pertussis
caccagcgcggccagc

SEQ ID NO: 344438 - RNA, 15 nt, Bordetella pertussis
caccagcgcgucgcc

SEQ ID NO: 344439 - RNA, 17 nt, Bordetella pertussis
caccagcuugcgcgccg

SEQ ID NO: 344440 - RNA, 16 nt, Bordetella pertussis
caccaggaacgccagc

SEQ ID NO: 344441 - RNA, 22 nt, Bordetella pertussis
caccaggaagagcuggcgcugc

SEQ ID NO: 344442 - RNA, 21 nt, Bordetella pertussis
caccaggaagcgcgccugcga

SEQ ID NO: 344443 - RNA, 16 nt, Bordetella pertussis
caccaggauccccagc

SEQ ID NO: 344444 - RNA, 20 nt, Bordetella pertussis
caccaggauccccagcacau

SEQ ID NO: 344445 - RNA, 22 nt, Bordetella pertussis
caccaggccgauggcguccagc

SEQ ID NO: 344446 - RNA, 16 nt, Bordetella pertussis
caccaggccgccggcc

SEQ ID NO: 344447 - RNA, 14 nt, Bordetella pertussis
caccaggccgcggc

SEQ ID NO: 344448 - RNA, 16 nt, Bordetella pertussis
caccaggccgcggcgc

SEQ ID NO: 344449 - RNA, 12 nt, Bordetella pertussis
caccaggccggc

SEQ ID NO: 344450 - RNA, 16 nt, Bordetella pertussis
caccaggccggccagg

SEQ ID NO: 344451 - RNA, 20 nt, Bordetella pertussis
caccaggccggccagggcca

SEQ ID NO: 344452 - RNA, 14 nt, Bordetella pertussis
caccaggccgucgg

SEQ ID NO: 344453 - RNA, 17 nt, Bordetella pertussis
caccaggccgucggcca

SEQ ID NO: 344454 - RNA, 23 nt, Bordetella pertussis
caccaggccgucggccaggggca

SEQ ID NO: 344455 - RNA, 18 nt, Bordetella pertussis
caccaggccugccugaug

SEQ ID NO: 344456 - RNA, 22 nt, Bordetella pertussis
caccaggugguuggcgugcccg

SEQ ID NO: 344457 - RNA, 20 nt, Bordetella pertussis
caccaggucguacagcgccu

SEQ ID NO: 344458 - RNA, 22 nt, Bordetella pertussis
caccagguugcauccggcccgg

SEQ ID NO: 344459 - RNA, 23 nt, Bordetella pertussis
caccagguuggcgauggcgucga

SEQ ID NO: 344460 - RNA, 19 nt, Bordetella pertussis
caccagguugucggcgcca

SEQ ID NO: 344461 - RNA, 13 nt, Bordetella pertussis
caccaucagcugg

SEQ ID NO: 344462 - RNA, 23 nt, Bordetella pertussis
caccauccugccccaggaaaccg

SEQ ID NO: 344463 - RNA, 18 nt, Bordetella pertussis
caccaucgccgagccgcu

SEQ ID NO: 344464 - RNA, 19 nt, Bordetella pertussis
caccaucgccgagccgcug

SEQ ID NO: 344465 - RNA, 15 nt, Bordetella pertussis
caccaucgccgcguc

SEQ ID NO: 344466 - RNA, 16 nt, Bordetella pertussis
caccaucgccgcgucg

SEQ ID NO: 344467 - RNA, 15 nt, Bordetella pertussis
cacccacagcagcgc

SEQ ID NO: 344468 - RNA, 17 nt, Bordetella pertussis
cacccacagcagcgcgc

SEQ ID NO: 344469 - RNA, 18 nt, Bordetella pertussis
cacccacagcagcgcgcc

SEQ ID NO: 344470 - RNA, 15 nt, Bordetella pertussis
cacccaggcggcagg

SEQ ID NO: 344471 - RNA, 16 nt, Bordetella pertussis
cacccaggcggcaggc

SEQ ID NO: 344472 - RNA, 17 nt, Bordetella pertussis
cacccagggcuugacgc

SEQ ID NO: 344473 - RNA, 22 nt, Bordetella pertussis
caccccggucagcagggcgccg

SEQ ID NO: 344474 - RNA, 22 nt, Bordetella pertussis
caccccggugucgccguggcgg

SEQ ID NO: 344475 - RNA, 13 nt, Bordetella pertussis
caccccguagcgc

SEQ ID NO: 344476 - RNA, 16 nt, Bordetella pertussis
caccccgucaucgccg

SEQ ID NO: 344477 - RNA, 16 nt, Bordetella pertussis
caccgacacgcuggcg

SEQ ID NO: 344478 - RNA, 18 nt, Bordetella pertussis
caccgacacgcuggcgga

SEQ ID NO: 344479 - RNA, 19 nt, Bordetella pertussis
caccgacagcaagggcaga

SEQ ID NO: 344480 - RNA, 16 nt, Bordetella pertussis
caccgacaggaugggc

SEQ ID NO: 344481 - RNA, 19 nt, Bordetella pertussis
caccgacaugaccgcgucc

SEQ ID NO: 344482 - RNA, 16 nt, Bordetella pertussis
caccgaccagcgcgcg

SEQ ID NO: 344483 - RNA, 21 nt, Bordetella pertussis
caccgaccagcgcgcgccggc

SEQ ID NO: 344484 - RNA, 22 nt, Bordetella pertussis
caccgacuucucuuucucgggc

SEQ ID NO: 344485 - RNA, 23 nt, Bordetella pertussis
caccgacuucucuuucucgggcg

SEQ ID NO: 344486 - RNA, 22 nt, Bordetella pertussis
caccgagaccgggcgguacagg

SEQ ID NO: 344487 - RNA, 13 nt, Bordetella pertussis
caccgagacgcug

SEQ ID NO: 344488 - RNA, 16 nt, Bordetella pertussis
caccgagacgcugucg

SEQ ID NO: 344489 - RNA, 21 nt, Bordetella pertussis
caccgagccgcagguccaggc

SEQ ID NO: 344490 - RNA, 14 nt, Bordetella pertussis
caccgagcugccgc

SEQ ID NO: 344491 - RNA, 21 nt, Bordetella pertussis
caccgaggccgaguggccgcu

SEQ ID NO: 344492 - RNA, 13 nt, Bordetella pertussis
caccgagggccgg

SEQ ID NO: 344493 - RNA, 14 nt, Bordetella pertussis
caccgagggccgga

SEQ ID NO: 344494 - RNA, 23 nt, Bordetella pertussis
caccgagggccggacuggcgcgc

SEQ ID NO: 344495 - RNA, 17 nt, Bordetella pertussis
caccgaggugccggcgg

SEQ ID NO: 344496 - RNA, 12 nt, Bordetella pertussis
caccgcaucgcg

SEQ ID NO: 344497 - RNA, 14 nt, Bordetella pertussis
caccgccagcccgg

SEQ ID NO: 344498 - RNA, 20 nt, Bordetella pertussis
caccgccaugugcgccgcgc

SEQ ID NO: 344499 - RNA, 15 nt, Bordetella pertussis
caccgcccccgccgc

SEQ ID NO: 344500 - RNA, 22 nt, Bordetella pertussis
caccgccgccgccaccagcggc

SEQ ID NO: 344501 - RNA, 14 nt, Bordetella pertussis
caccgccgccgcgc

SEQ ID NO: 344502 - RNA, 13 nt, Bordetella pertussis
caccgccgccggc

SEQ ID NO: 344503 - RNA, 14 nt, Bordetella pertussis
caccgccgccggcc

SEQ ID NO: 344504 - RNA, 23 nt, Bordetella pertussis
caccgccgcggcgaugccggcca

SEQ ID NO: 344505 - RNA, 20 nt, Bordetella pertussis
caccgccgcgaccgggccga

SEQ ID NO: 344506 - RNA, 11 nt, Bordetella pertussis
caccgcgcagc

SEQ ID NO: 344507 - RNA, 15 nt, Bordetella pertussis
caccgcgccagcgcc

SEQ ID NO: 344508 - RNA, 23 nt, Bordetella pertussis
caccgcgcccagggugguggccu

SEQ ID NO: 344509 - RNA, 20 nt, Bordetella pertussis
caccgcgccgcccacgccgc

SEQ ID NO: 344510 - RNA, 16 nt, Bordetella pertussis
caccgcgccgggcguu

SEQ ID NO: 344511 - RNA, 19 nt, Bordetella pertussis
caccgcgcgcacgaccacc

SEQ ID NO: 344512 - RNA, 17 nt, Bordetella pertussis
caccgcggccuugccgg

SEQ ID NO: 344513 - RNA, 15 nt, Bordetella pertussis
caccgcggcggacca

SEQ ID NO: 344514 - RNA, 20 nt, Bordetella pertussis
caccgcggcgggcucggcgc

SEQ ID NO: 344515 - RNA, 16 nt, Bordetella pertussis
caccgcggugccgcgc

SEQ ID NO: 344516 - RNA, 21 nt, Bordetella pertussis
caccgcggugccgcgcgcggc

SEQ ID NO: 344517 - RNA, 23 nt, Bordetella pertussis
caccgcggugccgcgcgcggccg

SEQ ID NO: 344518 - RNA, 17 nt, Bordetella pertussis
caccgcuucuucgucgc

SEQ ID NO: 344519 - RNA, 20 nt, Bordetella pertussis
caccgcuucuucgucgcgcc

SEQ ID NO: 344520 - RNA, 18 nt, Bordetella pertussis
caccggaggcgccgcgga

SEQ ID NO: 344521 - RNA, 13 nt, Bordetella pertussis
caccggcgcgccu

SEQ ID NO: 344522 - RNA, 17 nt, Bordetella pertussis
caccggcgugagcgcca

SEQ ID NO: 344523 - RNA, 20 nt, Bordetella pertussis
caccggcgugagcgccaccg

SEQ ID NO: 344524 - RNA, 20 nt, Bordetella pertussis
caccggcgugcagagcacca

SEQ ID NO: 344525 - RNA, 19 nt, Bordetella pertussis
caccggcuugggcgugccc

SEQ ID NO: 344526 - RNA, 20 nt, Bordetella pertussis
caccggcuuggggcgcgccg

SEQ ID NO: 344527 - RNA, 15 nt, Bordetella pertussis
caccgggacaggcac

SEQ ID NO: 344528 - RNA, 16 nt, Bordetella pertussis
caccgggcaaucggcg

SEQ ID NO: 344529 - RNA, 22 nt, Bordetella pertussis
caccggucgccguccaggcgcc

SEQ ID NO: 344530 - RNA, 24 nt, Bordetella pertussis
caccgguugcagcgcgccaggcgc

SEQ ID NO: 344531 - RNA, 14 nt, Bordetella pertussis
caccgucgccaggg

SEQ ID NO: 344532 - RNA, 12 nt, Bordetella pertussis
caccgucgcgcg

SEQ ID NO: 344533 - RNA, 17 nt, Bordetella pertussis
caccgucgcgcgcacgc

SEQ ID NO: 344534 - RNA, 14 nt, Bordetella pertussis
caccgugcuggccg

SEQ ID NO: 344535 - RNA, 18 nt, Bordetella pertussis
caccgugcuggccgacgc

SEQ ID NO: 344536 - RNA, 19 nt, Bordetella pertussis
caccgugcuggccgacgcg

SEQ ID NO: 344537 - RNA, 22 nt, Bordetella pertussis
caccgugcuggccgacgcgcug

SEQ ID NO: 344538 - RNA, 23 nt, Bordetella pertussis
caccgugcuggccgacgcgcugg

SEQ ID NO: 344539 - RNA, 19 nt, Bordetella pertussis
caccguggcaugccaugcg

SEQ ID NO: 344540 - RNA, 17 nt, Bordetella pertussis
caccguggccacggccg

SEQ ID NO: 344541 - RNA, 19 nt, Bordetella pertussis
caccucgaacucgaacgcg

SEQ ID NO: 344542 - RNA, 17 nt, Bordetella pertussis
caccucgaucaccaccg

SEQ ID NO: 344543 - RNA, 18 nt, Bordetella pertussis
caccucggacgagacagg

SEQ ID NO: 344544 - RNA, 13 nt, Bordetella pertussis
caccucggccggg

SEQ ID NO: 344545 - RNA, 15 nt, Bordetella pertussis
caccucggccggggc

SEQ ID NO: 344546 - RNA, 14 nt, Bordetella pertussis
caccucggcgccgc

SEQ ID NO: 344547 - RNA, 18 nt, Bordetella pertussis
caccucggcgccgcggcg

SEQ ID NO: 344548 - RNA, 19 nt, Bordetella pertussis
caccucggcgccgcggcgc

SEQ ID NO: 344549 - RNA, 15 nt, Bordetella pertussis
caccucggcgucgcc

SEQ ID NO: 344550 - RNA, 19 nt, Bordetella pertussis
caccucggcgucgcccggg

SEQ ID NO: 344551 - RNA, 19 nt, Bordetella pertussis
caccucggcguggcgggga

SEQ ID NO: 344552 - RNA, 15 nt, Bordetella pertussis
caccucggggcgcgg

SEQ ID NO: 344553 - RNA, 19 nt, Bordetella pertussis
caccucggggcgcggccgg

SEQ ID NO: 344554 - RNA, 20 nt, Bordetella pertussis
caccucuucagcccggcgcg

SEQ ID NO: 344555 - RNA, 13 nt, Bordetella pertussis
caccugcaccgcc

SEQ ID NO: 344556 - RNA, 14 nt, Bordetella pertussis
caccugcaggccca

SEQ ID NO: 344557 - RNA, 17 nt, Bordetella pertussis
caccugcaggcccaccg

SEQ ID NO: 344558 - RNA, 23 nt, Bordetella pertussis
caccugcaggcccaccggcaugc

SEQ ID NO: 344559 - RNA, 16 nt, Bordetella pertussis
caccugcaggccgccg

SEQ ID NO: 344560 - RNA, 23 nt, Bordetella pertussis
caccugcaggccgccggccagcg

SEQ ID NO: 344561 - RNA, 14 nt, Bordetella pertussis
caccugccugccgc

SEQ ID NO: 344562 - RNA, 17 nt, Bordetella pertussis
caccugcucggugagcg

SEQ ID NO: 344563 - RNA, 17 nt, Bordetella pertussis
caccugcuugacguaga

SEQ ID NO: 344564 - RNA, 16 nt, Bordetella pertussis
caccuggcgcccggcg

SEQ ID NO: 344565 - RNA, 15 nt, Bordetella pertussis
caccuggcggugcgc

SEQ ID NO: 344566 - RNA, 18 nt, Bordetella pertussis
caccuggcggugcgccgc

SEQ ID NO: 344567 - RNA, 17 nt, Bordetella pertussis
caccuguucggcggcgc

SEQ ID NO: 344568 - RNA, 17 nt, Bordetella pertussis
caccuucaacaucgccc

SEQ ID NO: 344569 - RNA, 14 nt, Bordetella pertussis
caccuucgccgcgc

SEQ ID NO: 344570 - RNA, 14 nt, Bordetella pertussis
caccuucgcgcagc

SEQ ID NO: 344571 - RNA, 19 nt, Bordetella pertussis
caccuucgcgcagcggcgc

SEQ ID NO: 344572 - RNA, 21 nt, Bordetella pertussis
caccuucgcgcagcggcgcgc

SEQ ID NO: 344573 - RNA, 18 nt, Bordetella pertussis
caccuugaccuggucggc

SEQ ID NO: 344574 - RNA, 14 nt, Bordetella pertussis
caccuugcccagca

SEQ ID NO: 344575 - RNA, 17 nt, Bordetella pertussis
caccuuggcccggcggg

SEQ ID NO: 344576 - RNA, 13 nt, Bordetella pertussis
caccuugggcgcc

SEQ ID NO: 344577 - RNA, 19 nt, Bordetella pertussis
caccuuguacuggucgcgc

SEQ ID NO: 344578 - RNA, 17 nt, Bordetella pertussis
caccuugucgcgcagcg

SEQ ID NO: 344579 - RNA, 21 nt, Bordetella pertussis
caccuugucgcgcagcgccgc

SEQ ID NO: 344580 - RNA, 22 nt, Bordetella pertussis
caccuuguuggcgccggccgcg

SEQ ID NO: 344581 - RNA, 17 nt, Bordetella pertussis
caccuuucugcugcucg

SEQ ID NO: 344582 - RNA, 16 nt, Bordetella pertussis
cacgaacagcgccagg

SEQ ID NO: 344583 - RNA, 18 nt, Bordetella pertussis
cacgaacagcgccaggcu

SEQ ID NO: 344584 - RNA, 21 nt, Bordetella pertussis
cacgaacagcgccaggcucca

SEQ ID NO: 344585 - RNA, 16 nt, Bordetella pertussis
cacgaaagcgcccagg

SEQ ID NO: 344586 - RNA, 16 nt, Bordetella pertussis
cacgaacggcgcgaag

SEQ ID NO: 344587 - RNA, 24 nt, Bordetella pertussis
cacgaagcaggugaugcgcgcggc

SEQ ID NO: 344588 - RNA, 16 nt, Bordetella pertussis
cacgaagccgaugcgc

SEQ ID NO: 344589 - RNA, 14 nt, Bordetella pertussis
cacgaagcgcagca

SEQ ID NO: 344590 - RNA, 22 nt, Bordetella pertussis
cacgaaggcagcaccucggacg

SEQ ID NO: 344591 - RNA, 17 nt, Bordetella pertussis
cacgaagggcagcagca

SEQ ID NO: 344592 - RNA, 23 nt, Bordetella pertussis
cacgaagugcgcccccaugucca

SEQ ID NO: 344593 - RNA, 13 nt, Bordetella pertussis
cacgacacgccca

SEQ ID NO: 344594 - RNA, 17 nt, Bordetella pertussis
cacgacagcaucuuggc

SEQ ID NO: 344595 - RNA, 20 nt, Bordetella pertussis
cacgacagcaucuuggccgc

SEQ ID NO: 344596 - RNA, 17 nt, Bordetella pertussis
cacgaccagcaggccca

SEQ ID NO: 344597 - RNA, 13 nt, Bordetella pertussis
cacgaccaggccg

SEQ ID NO: 344598 - RNA, 15 nt, Bordetella pertussis
cacgaccgagccggc

SEQ ID NO: 344599 - RNA, 17 nt, Bordetella pertussis
cacgaccgagccggcca

SEQ ID NO: 344600 - RNA, 15 nt, Bordetella pertussis
cacgaccggcucgau

SEQ ID NO: 344601 - RNA, 23 nt, Bordetella pertussis
cacgaccggcucgaucgccgccg

SEQ ID NO: 344602 - RNA, 23 nt, Bordetella pertussis
cacgaccugcaaccccaccggca

SEQ ID NO: 344603 - RNA, 18 nt, Bordetella pertussis
cacgaccugcgcaugcgc

SEQ ID NO: 344604 - RNA, 20 nt, Bordetella pertussis
cacgacgaagaacaccauca

SEQ ID NO: 344605 - RNA, 22 nt, Bordetella pertussis
cacgacgaagguguugaccacg

SEQ ID NO: 344606 - RNA, 19 nt, Bordetella pertussis
cacgacgcgaaccaggcca

SEQ ID NO: 344607 - RNA, 17 nt, Bordetella pertussis
cacgacggucugggcca

SEQ ID NO: 344608 - RNA, 16 nt, Bordetella pertussis
cacgacguagucggcg

SEQ ID NO: 344609 - RNA, 20 nt, Bordetella pertussis
cacgacguagucggcgccca

SEQ ID NO: 344610 - RNA, 20 nt, Bordetella pertussis
cacgacgucgcgcggauccu

SEQ ID NO: 344611 - RNA, 20 nt, Bordetella pertussis
cacgacguugggcaugccga

SEQ ID NO: 344612 - RNA, 22 nt, Bordetella pertussis
cacgacuacggcggacuggccg

SEQ ID NO: 344613 - RNA, 16 nt, Bordetella pertussis
cacgagauguccaugg

SEQ ID NO: 344614 - RNA, 23 nt, Bordetella pertussis
cacgaggucuugccgaucggcgu

SEQ ID NO: 344615 - RNA, 22 nt, Bordetella pertussis
cacgauauuggcgucggccgcc

SEQ ID NO: 344616 - RNA, 15 nt, Bordetella pertussis
cacgaucaccgccgc

SEQ ID NO: 344617 - RNA, 19 nt, Bordetella pertussis
cacgaucaccgccgcggcg

SEQ ID NO: 344618 - RNA, 17 nt, Bordetella pertussis
cacgaucacgaacagcg

SEQ ID NO: 344619 - RNA, 20 nt, Bordetella pertussis
cacgaucagcauaucgucgc

SEQ ID NO: 344620 - RNA, 17 nt, Bordetella pertussis
cacgaucagcgcccagg

SEQ ID NO: 344621 - RNA, 17 nt, Bordetella pertussis
cacgaucauggucaugc

SEQ ID NO: 344622 - RNA, 22 nt, Bordetella pertussis
cacgaucgcgccggccugggcg

SEQ ID NO: 344623 - RNA, 20 nt, Bordetella pertussis
cacgaucuggccgauggccu

SEQ ID NO: 344624 - RNA, 14 nt, Bordetella pertussis
cacgaucuggcgcg

SEQ ID NO: 344625 - RNA, 18 nt, Bordetella pertussis
cacgaucuggcgcgcgac

SEQ ID NO: 344626 - RNA, 23 nt, Bordetella pertussis
cacgaugaucgcgccgacgaccg

SEQ ID NO: 344627 - RNA, 16 nt, Bordetella pertussis
cacgaugcccagggcc

SEQ ID NO: 344628 - RNA, 20 nt, Bordetella pertussis
cacgaugccgaccgagccga

SEQ ID NO: 344629 - RNA, 18 nt, Bordetella pertussis
cacgaugcgggcaucgcc

SEQ ID NO: 344630 - RNA, 19 nt, Bordetella pertussis
cacgaugcgggcaucgccc

SEQ ID NO: 344631 - RNA, 22 nt, Bordetella pertussis
cacgauggcgcaauaggccgcg

SEQ ID NO: 344632 - RNA, 23 nt, Bordetella pertussis
cacgauggcgcaauaggccgcga

SEQ ID NO: 344633 - RNA, 18 nt, Bordetella pertussis
cacgauggcgcccacggc

SEQ ID NO: 344634 - RNA, 20 nt, Bordetella pertussis
cacgauggcgcccacggccu

SEQ ID NO: 344635 - RNA, 13 nt, Bordetella pertussis
cacgauggcgccg

SEQ ID NO: 344636 - RNA, 15 nt, Bordetella pertussis
cacgauggcgccggc

SEQ ID NO: 344637 - RNA, 13 nt, Bordetella pertussis
cacgauggcgcgc

SEQ ID NO: 344638 - RNA, 15 nt, Bordetella pertussis
cacgauggccggcgc

SEQ ID NO: 344639 - RNA, 16 nt, Bordetella pertussis
cacgauggccggcgcg

SEQ ID NO: 344640 - RNA, 20 nt, Bordetella pertussis
cacgaugguaucggccgggc

SEQ ID NO: 344641 - RNA, 23 nt, Bordetella pertussis
cacgauggggccauggcacaggc

SEQ ID NO: 344642 - RNA, 22 nt, Bordetella pertussis
cacgauuccgccuacuggcgcg

SEQ ID NO: 344643 - RNA, 13 nt, Bordetella pertussis
cacgcaaggccga

SEQ ID NO: 344644 - RNA, 14 nt, Bordetella pertussis
cacgcaaggccgac

SEQ ID NO: 344645 - RNA, 23 nt, Bordetella pertussis
cacgcacagcaccugguggcgcu

SEQ ID NO: 344646 - RNA, 13 nt, Bordetella pertussis
cacgcaccaggcg

SEQ ID NO: 344647 - RNA, 15 nt, Bordetella pertussis
cacgcaccaggcgca

SEQ ID NO: 344648 - RNA, 18 nt, Bordetella pertussis
cacgcaccaggcgcacgg

SEQ ID NO: 344649 - RNA, 23 nt, Bordetella pertussis
cacgcaccaggcgcacggcggca

SEQ ID NO: 344650 - RNA, 20 nt, Bordetella pertussis
cacgcaccgcgccagcgccg

SEQ ID NO: 344651 - RNA, 13 nt, Bordetella pertussis
cacgcacugagcu

SEQ ID NO: 344652 - RNA, 14 nt, Bordetella pertussis
cacgcagcgcagga

SEQ ID NO: 344653 - RNA, 20 nt, Bordetella pertussis
cacgcaggcgggcgccgcgc

SEQ ID NO: 344654 - RNA, 23 nt, Bordetella pertussis
cacgcaugcgacaugagcugcgc

SEQ ID NO: 344655 - RNA, 15 nt, Bordetella pertussis
cacgccaucgaacuc

SEQ ID NO: 344656 - RNA, 17 nt, Bordetella pertussis
cacgccauggacgccga

SEQ ID NO: 344657 - RNA, 19 nt, Bordetella pertussis
cacgccauucauccagcgc

SEQ ID NO: 344658 - RNA, 13 nt, Bordetella pertussis
cacgccauggucu

SEQ ID NO: 344659 - RNA, 15 nt, Bordetella pertussis
cacgccauggucucg

SEQ ID NO: 344660 - RNA, 16 nt, Bordetella pertussis
cacgcccacgcgccgc

SEQ ID NO: 344661 - RNA, 18 nt, Bordetella pertussis
cacgcccagacuggcgua

SEQ ID NO: 344662 - RNA, 12 nt, Bordetella pertussis
cacgcccagccg

SEQ ID NO: 344663 - RNA, 23 nt, Bordetella pertussis
cacgcccagccgcagcaggcgcu

SEQ ID NO: 344664 - RNA, 13 nt, Bordetella pertussis
cacgcccagcgcc

SEQ ID NO: 344665 - RNA, 14 nt, Bordetella pertussis
cacgcccaggccgc

SEQ ID NO: 344666 - RNA, 19 nt, Bordetella pertussis
cacgcccagucccaggccg

SEQ ID NO: 344667 - RNA, 17 nt, Bordetella pertussis
cacgcccagcaggcuuu

SEQ ID NO: 344668 - RNA, 14 nt, Bordetella pertussis
cacgcccaucugcc

SEQ ID NO: 344669 - RNA, 20 nt, Bordetella pertussis
cacgcccauggucaggacga

SEQ ID NO: 344670 - RNA, 17 nt, Bordetella pertussis
cacgcccgccugcagca

SEQ ID NO: 344671 - RNA, 18 nt, Bordetella pertussis
cacgcccgccugcagcag

SEQ ID NO: 344672 - RNA, 19 nt, Bordetella pertussis
cacgcccgccugcagcagc

SEQ ID NO: 344673 - RNA, 15 nt, Bordetella pertussis
cacgcccgcgccgca

SEQ ID NO: 344674 - RNA, 18 nt, Bordetella pertussis
cacgcccgcggcgcccag

SEQ ID NO: 344675 - RNA, 23 nt, Bordetella pertussis
cacgcccgucccgacccccggcc

SEQ ID NO: 344676 - RNA, 22 nt, Bordetella pertussis
cacgcccgucucgcgcgccagg

SEQ ID NO: 344677 - RNA, 16 nt, Bordetella pertussis
cacgcccgugucgccg

SEQ ID NO: 344678 - RNA, 21 nt, Bordetella pertussis
cacgcccugcaccgucacgcg

SEQ ID NO: 344679 - RNA, 13 nt, Bordetella pertussis
cacgcccuggcag

SEQ ID NO: 344680 - RNA, 21 nt, Bordetella pertussis
cacgcccuggcuggcggccca

SEQ ID NO: 344681 - RNA, 14 nt, Bordetella pertussis
cacgccgaaggcgu

SEQ ID NO: 344682 - RNA, 15 nt, Bordetella pertussis
cacgccgaccggacc

SEQ ID NO: 344683 - RNA, 17 nt, Bordetella pertussis
cacgccgaccggaccgu

SEQ ID NO: 344684 - RNA, 17 nt, Bordetella pertussis
cacgccgauugaggcca

SEQ ID NO: 344685 - RNA, 14 nt, Bordetella pertussis
cacgccgcccagcg

SEQ ID NO: 344686 - RNA, 14 nt, Bordetella pertussis
cacgccgccggcca

SEQ ID NO: 344687 - RNA, 16 nt, Bordetella pertussis
cacgccgccggccagc

SEQ ID NO: 344688 - RNA, 18 nt, Bordetella pertussis
cacgccgcgccaggcauu

SEQ ID NO: 344689 - RNA, 13 nt, Bordetella pertussis
cacgccgcgccgg

SEQ ID NO: 344690 - RNA, 17 nt, Bordetella pertussis
cacgccgcgccggcgcg

SEQ ID NO: 344691 - RNA, 21 nt, Bordetella pertussis
cacgccggaccagucgaccca

SEQ ID NO: 344692 - RNA, 13 nt, Bordetella pertussis
cacgccggccacg

SEQ ID NO: 344693 - RNA, 20 nt, Bordetella pertussis
cacgccggccacgaacggcg

SEQ ID NO: 344694 - RNA, 13 nt, Bordetella pertussis
cacgccggccagc

SEQ ID NO: 344695 - RNA, 11 nt, Bordetella pertussis
cacgccggccu

SEQ ID NO: 344696 - RNA, 16 nt, Bordetella pertussis
cacgccggcgcgccgg

SEQ ID NO: 344697 - RNA, 19 nt, Bordetella pertussis
cacgccggcgcgccggccg

SEQ ID NO: 344698 - RNA, 17 nt, Bordetella pertussis
cacgccggcgcgccggg

SEQ ID NO: 344699 - RNA, 19 nt, Bordetella pertussis
cacgccggcgcgccgggcc

SEQ ID NO: 344700 - RNA, 20 nt, Bordetella pertussis
cacgccggccuugcugaacc

SEQ ID NO: 344701 - RNA, 11 nt, Bordetella pertussis
cacgccggcgg

SEQ ID NO: 344702 - RNA, 15 nt, Bordetella pertussis
cacgccggcggccau

SEQ ID NO: 344703 - RNA, 21 nt, Bordetella pertussis
cacgccggcggccaugacggg

SEQ ID NO: 344704 - RNA, 15 nt, Bordetella pertussis
cacgccggcggccca

SEQ ID NO: 344705 - RNA, 17 nt, Bordetella pertussis
cacgccggcgggcaggc

SEQ ID NO: 344706 - RNA, 20 nt, Bordetella pertussis
cacgccggcggucacgccga

SEQ ID NO: 344707 - RNA, 15 nt, Bordetella pertussis
cacgccgggcgcgcu

SEQ ID NO: 344708 - RNA, 19 nt, Bordetella pertussis
cacgccgggcgcgcugccc

SEQ ID NO: 344709 - RNA, 14 nt, Bordetella pertussis
cacgccgggcgcgg

SEQ ID NO: 344710 - RNA, 15 nt, Bordetella pertussis
cacgccgggcgcggc

SEQ ID NO: 344711 - RNA, 16 nt, Bordetella pertussis
cacgccgggcgcggcc

SEQ ID NO: 344712 - RNA, 21 nt, Bordetella pertussis
cacgccgggcgcggccgccgc

SEQ ID NO: 344713 - RNA, 18 nt, Bordetella pertussis
cacgccguggcgcaaggc

SEQ ID NO: 344714 - RNA, 13 nt, Bordetella pertussis
cacgccucgccgg

SEQ ID NO: 344715 - RNA, 19 nt, Bordetella pertussis
cacgccucgccggcccugc

SEQ ID NO: 344716 - RNA, 18 nt, Bordetella pertussis
cacgccugccgcgcccgg

SEQ ID NO: 344717 - RNA, 15 nt, Bordetella pertussis
cacgccuggccgcgc

SEQ ID NO: 344718 - RNA, 20 nt, Bordetella pertussis
cacgccuggccgcgcucagc

SEQ ID NO: 344719 - RNA, 21 nt, Bordetella pertussis
cacgccuguuuuggcgcacgc

SEQ ID NO: 344720 - RNA, 23 nt, Bordetella pertussis
cacgccuucgagcaccaugccgg

SEQ ID NO: 344721 - RNA, 16 nt, Bordetella pertussis
cacgccuucgagcugc

SEQ ID NO: 344722 - RNA, 20 nt, Bordetella pertussis
cacgccuugcucgaccaggu

SEQ ID NO: 344723 - RNA, 17 nt, Bordetella pertussis
cacgccuuguucgcgcg

SEQ ID NO: 344724 - RNA, 15 nt, Bordetella pertussis
cacgcgcaacgccgc

SEQ ID NO: 344725 - RNA, 17 nt, Bordetella pertussis
cacgcgcacgacgucgc

SEQ ID NO: 344726 - RNA, 14 nt, Bordetella pertussis
cacgcgcacggcca

SEQ ID NO: 344727 - RNA, 13 nt, Bordetella pertussis
cacgcgcagcguc

SEQ ID NO: 344728 - RNA, 20 nt, Bordetella pertussis
cacguugucgagcaggccgc

SEQ ID NO: 344729 - RNA, 16 nt, Bordetella pertussis
cacugcaaggcccgcc

SEQ ID NO: 344730 - RNA, 13 nt, Bordetella pertussis
cacugcaccugcu

SEQ ID NO: 344731 - RNA, 13 nt, Bordetella pertussis
cacugccaggcga

SEQ ID NO: 344732 - RNA, 22 nt, Bordetella pertussis
cacugccaggcgagcgccgcgc

SEQ ID NO: 344733 - RNA, 14 nt, Bordetella pertussis
cacugccaggcgcc

SEQ ID NO: 344734 - RNA, 18 nt, Bordetella pertussis
cacuggaucgccgaucgg

SEQ ID NO: 344735 - RNA, 20 nt, Bordetella pertussis
cacuggcagaccgagcgcgc

SEQ ID NO: 344736 - RNA, 15 nt, Bordetella pertussis
cacuggccagcaagc

SEQ ID NO: 344737 - RNA, 16 nt, Bordetella pertussis
cacuuccucggcgcgc

SEQ ID NO: 344738 - RNA, 18 nt, Bordetella pertussis
cacuuccuggugggcggc

SEQ ID NO: 344739 - RNA, 14 nt, Bordetella pertussis
cacuugacggccaa

SEQ ID NO: 344740 - RNA, 15 nt, Bordetella pertussis
cacuugagcagcgcc

SEQ ID NO: 344741 - RNA, 16 nt, Bordetella pertussis
cacuugccggccgccc

SEQ ID NO: 344742 - RNA, 19 nt, Bordetella pertussis
cacuugcggguccagcagg

SEQ ID NO: 344743 - RNA, 24 nt, Bordetella pertussis
cacuugcggguccagcaggauggc

SEQ ID NO: 344744 - RNA, 14 nt, Bordetella pertussis
cagaacccggccgg

SEQ ID NO: 344745 - RNA, 20 nt, Bordetella pertussis
cagaacgcugaugcgcguca

SEQ ID NO: 344746 - RNA, 20 nt, Bordetella pertussis
cagaacggaaacgcccagcc

SEQ ID NO: 344747 - RNA, 15 nt, Bordetella pertussis
cagaacggcgcggga

SEQ ID NO: 344748 - RNA, 14 nt, Bordetella pertussis
cagaaugcggcgga

SEQ ID NO: 344749 - RNA, 16 nt, Bordetella pertussis
cagacagccacgcgcg

SEQ ID NO: 344750 - RNA, 15 nt, Bordetella pertussis
cagacaggccggcaa

SEQ ID NO: 344751 - RNA, 20 nt, Bordetella pertussis
cagacauugucaagcagcgc

SEQ ID NO: 344752 - RNA, 22 nt, Bordetella pertussis
cagacauugucaagcagcgccg

SEQ ID NO: 344753 - RNA, 19 nt, Bordetella pertussis
cagacgauggugccggccg

SEQ ID NO: 344754 - RNA, 18 nt, Bordetella pertussis
cagacgcagaccacgccg

SEQ ID NO: 344755 - RNA, 19 nt, Bordetella pertussis
cagacgcagaccacgccgg

SEQ ID NO: 344756 - RNA, 22 nt, Bordetella pertussis
cagacuccaggagcucgucccc

SEQ ID NO: 344757 - RNA, 11 nt, Bordetella pertussis
cagagcgcgca

SEQ ID NO: 344758 - RNA, 19 nt, Bordetella pertussis
cagagcgggauggucgcgg

SEQ ID NO: 344759 - RNA, 21 nt, Bordetella pertussis
cagagcgggauggucgcggcc

SEQ ID NO: 344760 - RNA, 14 nt, Bordetella pertussis
cagagggcgacggc

SEQ ID NO: 344761 - RNA, 17 nt, Bordetella pertussis
cagagucugccuggcga

SEQ ID NO: 344762 - RNA, 22 nt, Bordetella pertussis
cagaguuauuuuccggacucgc

SEQ ID NO: 344763 - RNA, 15 nt, Bordetella pertussis
cagauaaaggccgca

SEQ ID NO: 344764 - RNA, 14 nt, Bordetella pertussis
cagauccacgcccg

SEQ ID NO: 344765 - RNA, 17 nt, Bordetella pertussis
cagauccacgcccgcgc

SEQ ID NO: 344766 - RNA, 16 nt, Bordetella pertussis
cagauccagcgcggcc

SEQ ID NO: 344767 - RNA, 17 nt, Bordetella pertussis
cagauccagcgcggcca

SEQ ID NO: 344768 - RNA, 14 nt, Bordetella pertussis
cagauccucgaaca

SEQ ID NO: 344769 - RNA, 19 nt, Bordetella pertussis
cagauccucgaacaggcca

SEQ ID NO: 344770 - RNA, 20 nt, Bordetella pertussis
cagauccucgaacaggccau

SEQ ID NO: 344771 - RNA, 17 nt, Bordetella pertussis
cagauccgguaugccug

SEQ ID NO: 344772 - RNA, 12 nt, Bordetella pertussis
cagaucgcggcg

SEQ ID NO: 344773 - RNA, 14 nt, Bordetella pertussis
cagaucgcggcggg

SEQ ID NO: 344774 - RNA, 22 nt, Bordetella pertussis
cagaucggcgcuggccuggccg

SEQ ID NO: 344775 - RNA, 17 nt, Bordetella pertussis
cagaugagacacggcag

SEQ ID NO: 344776 - RNA, 23 nt, Bordetella pertussis
cagaugauggucggugccgccga

SEQ ID NO: 344777 - RNA, 17 nt, Bordetella pertussis
cagaugcgacuggcggc

SEQ ID NO: 344778 - RNA, 13 nt, Bordetella pertussis
cagaugcgcagca

SEQ ID NO: 344779 - RNA, 18 nt, Bordetella pertussis
cagaugcgcagcaggcgc

SEQ ID NO: 344780 - RNA, 19 nt, Bordetella pertussis
cagaugcgcagcaggcgcg

SEQ ID NO: 344781 - RNA, 16 nt, Bordetella pertussis
cagaugcgccgcacgu

SEQ ID NO: 344782 - RNA, 13 nt, Bordetella pertussis
cagaugcgcgcca

SEQ ID NO: 344783 - RNA, 18 nt, Bordetella pertussis
cagaugcgcgccaggcgc

SEQ ID NO: 344784 - RNA, 19 nt, Bordetella pertussis
cagaugcgcgccaggcgcg

SEQ ID NO: 344785 - RNA, 20 nt, Bordetella pertussis
cagaugcgcgccaggcgcgc

SEQ ID NO: 344786 - RNA, 15 nt, Bordetella pertussis
cagauggccagcagc

SEQ ID NO: 344787 - RNA, 16 nt, Bordetella pertussis
cagauggcgccuucga

SEQ ID NO: 344788 - RNA, 17 nt, Bordetella pertussis
cagauggcguaggcggc

SEQ ID NO: 344789 - RNA, 23 nt, Bordetella pertussis
cagauggugcuccgacggcugga

SEQ ID NO: 344790 - RNA, 16 nt, Bordetella pertussis
cagauucaugggcggc

SEQ ID NO: 344791 - RNA, 17 nt, Bordetella pertussis
cagauugaugcccaugc

SEQ ID NO: 344792 - RNA, 15 nt, Bordetella pertussis
cagauugccgcgcgg

SEQ ID NO: 344793 - RNA, 17 nt, Bordetella pertussis
cagauugccgcgcggcg

SEQ ID NO: 344794 - RNA, 16 nt, Bordetella pertussis
cagauuggccaccagg

SEQ ID NO: 344795 - RNA, 15 nt, Bordetella pertussis
cagcaaaugggccgc

SEQ ID NO: 344796 - RNA, 18 nt, Bordetella pertussis
cagcaaaugggccgcagc

SEQ ID NO: 344797 - RNA, 19 nt, Bordetella pertussis
cagcaacucuuccccgucg

SEQ ID NO: 344798 - RNA, 21 nt, Bordetella pertussis
cagcaacucuuccccgucggc

SEQ ID NO: 344799 - RNA, 13 nt, Bordetella pertussis
cagcaagcgcgcc

SEQ ID NO: 344800 - RNA, 23 nt, Bordetella pertussis
cagcaagcugcugcuggaccugg

SEQ ID NO: 344801 - RNA, 17 nt, Bordetella pertussis
cagcaaggacaaggcgc

SEQ ID NO: 344802 - RNA, 14 nt, Bordetella pertussis
cagcaagggcccca

SEQ ID NO: 344803 - RNA, 19 nt, Bordetella pertussis
cagcaaggcgucggccagg

SEQ ID NO: 344804 - RNA, 20 nt, Bordetella pertussis
cagcaaggcgucggccaggc

SEQ ID NO: 344805 - RNA, 19 nt, Bordetella pertussis
cagcaagggguccguggcg

SEQ ID NO: 344806 - RNA, 22 nt, Bordetella pertussis
cagcaaggguucgggcaugucg

SEQ ID NO: 344807 - RNA, 17 nt, Bordetella pertussis
cagcaagucagcccgcg

SEQ ID NO: 344808 - RNA, 20 nt, Bordetella pertussis
cagcaagucagcccgcgucg

SEQ ID NO: 344809 - RNA, 16 nt, Bordetella pertussis
cagcaaugacgacgcc

SEQ ID NO: 344810 - RNA, 20 nt, Bordetella pertussis
cagcaaugacgacgccggcu

SEQ ID NO: 344811 - RNA, 22 nt, Bordetella pertussis
cagcaauuaugcguggccgccg

SEQ ID NO: 344812 - RNA, 16 nt, Bordetella pertussis
cagcaauucgaccggc

SEQ ID NO: 344813 - RNA, 20 nt, Bordetella pertussis
cagcaauugccccagcacga

SEQ ID NO: 344814 - RNA, 14 nt, Bordetella pertussis
cagcaccgagcugc

SEQ ID NO: 344815 - RNA, 16 nt, Bordetella pertussis
cagcaccgagcugccg

SEQ ID NO: 344816 - RNA, 23 nt, Bordetella pertussis
cagcaccgaugcgccggccuggc

SEQ ID NO: 344817 - RNA, 21 nt, Bordetella pertussis
cagcaccgccacgcgguccag

SEQ ID NO: 344818 - RNA, 23 nt, Bordetella pertussis
cagcaccgccaccguggcgucca

SEQ ID NO: 344819 - RNA, 16 nt, Bordetella pertussis
cagcaccgccaugugc

SEQ ID NO: 344820 - RNA, 14 nt, Bordetella pertussis
cagcaccgccgcca

SEQ ID NO: 344821 - RNA, 17 nt, Bordetella pertussis
cagcaccgcgcgcacga

SEQ ID NO: 344822 - RNA, 18 nt, Bordetella pertussis
cagcaccgcgaccaugcg

SEQ ID NO: 344823 - RNA, 21 nt, Bordetella pertussis
cagcaccgcgaccaugcggcc

SEQ ID NO: 344824 - RNA, 15 nt, Bordetella pertussis
cagcaccgcggcggg

SEQ ID NO: 344825 - RNA, 14 nt, Bordetella pertussis
cagcaccggcacga

SEQ ID NO: 344826 - RNA, 16 nt, Bordetella pertussis
cagcaccggcagaugg

SEQ ID NO: 344827 - RNA, 16 nt, Bordetella pertussis
cagcaccggccgccgc

SEQ ID NO: 344828 - RNA, 22 nt, Bordetella pertussis
cagcaccggccgccgcaugccg

SEQ ID NO: 344829 - RNA, 21 nt, Bordetella pertussis
cagcaccggcgugagcgccac

SEQ ID NO: 344830 - RNA, 23 nt, Bordetella pertussis
cagcaccggcgugagcgccaccg

SEQ ID NO: 344831 - RNA, 19 nt, Bordetella pertussis
cagcaccucggggcgcggc

SEQ ID NO: 344832 - RNA, 22 nt, Bordetella pertussis
cagcaccucggggcgcggccgg

SEQ ID NO: 344833 - RNA, 16 nt, Bordetella pertussis
cagcaccugcaggccg

SEQ ID NO: 344834 - RNA, 17 nt, Bordetella pertussis
cagcaccugcaggccgc

SEQ ID NO: 344835 - RNA, 13 nt, Bordetella pertussis
cagcaccugcuug

SEQ ID NO: 344836 - RNA, 14 nt, Bordetella pertussis
cagcaccugcuuga

SEQ ID NO: 344837 - RNA, 16 nt, Bordetella pertussis
cagcaccugcuugacg

SEQ ID NO: 344838 - RNA, 20 nt, Bordetella pertussis
cagcaccuucugccgccagg

SEQ ID NO: 344839 - RNA, 16 nt, Bordetella pertussis
cagcaccugguggcgc

SEQ ID NO: 344840 - RNA, 18 nt, Bordetella pertussis
cagcacgaagggcagcag

SEQ ID NO: 344841 - RNA, 18 nt, Bordetella pertussis
cagcacgacgacggccgg

SEQ ID NO: 344842 - RNA, 22 nt, Bordetella pertussis
cagcacgaucacgaacagcgcc

SEQ ID NO: 344843 - RNA, 15 nt, Bordetella pertussis
cagcacgccgcgcca

SEQ ID NO: 344844 - RNA, 14 nt, Bordetella pertussis
cagcacgccggcca

SEQ ID NO: 344845 - RNA, 18 nt, Bordetella pertussis
cagcacgccggcgggcag

SEQ ID NO: 344846 - RNA, 13 nt, Bordetella pertussis
cagcacgcgcacc

SEQ ID NO: 344847 - RNA, 14 nt, Bordetella pertussis
cagcacgcgcacca

SEQ ID NO: 344848 - RNA, 16 nt, Bordetella pertussis
cagcacgcgcaccagg

SEQ ID NO: 344849 - RNA, 19 nt, Bordetella pertussis
cagcacgcgcgccagcugg

SEQ ID NO: 344850 - RNA, 12 nt, Bordetella pertussis
cagcacgcggcg

SEQ ID NO: 344851 - RNA, 18 nt, Bordetella pertussis
cagcacgcucagcaugcg

SEQ ID NO: 344852 - RNA, 19 nt, Bordetella pertussis
cagcacgcucagcaugcgc

SEQ ID NO: 344853 - RNA, 14 nt, Bordetella pertussis
cagcacgccuucga

SEQ ID NO: 344854 - RNA, 20 nt, Bordetella pertussis
cagcacgccuugcucgacca

SEQ ID NO: 344855 - RNA, 17 nt, Bordetella pertussis
cagcacgcugcgcggcg

SEQ ID NO: 344856 - RNA, 15 nt, Bordetella pertussis
cagcacggccacggc

SEQ ID NO: 344857 - RNA, 17 nt, Bordetella pertussis
cagcacggccacggccg

SEQ ID NO: 344858 - RNA, 13 nt, Bordetella pertussis
cagcacuugccgg

SEQ ID NO: 344859 - RNA, 15 nt, Bordetella pertussis
cagcacuugccggcc

SEQ ID NO: 344860 - RNA, 18 nt, Bordetella pertussis
cagcagacccuggcgcgc

SEQ ID NO: 344861 - RNA, 14 nt, Bordetella pertussis
cagcagcacggcca

SEQ ID NO: 344862 - RNA, 15 nt, Bordetella pertussis
cagcagcacggccac

SEQ ID NO: 344863 - RNA, 17 nt, Bordetella pertussis
cagcagcacggccacga

SEQ ID NO: 344864 - RNA, 14 nt, Bordetella pertussis
cagcagcacguucu

SEQ ID NO: 344865 - RNA, 19 nt, Bordetella pertussis
cagcagcacguucuugccc

SEQ ID NO: 344866 - RNA, 15 nt, Bordetella pertussis
cagcagcacgcccau

SEQ ID NO: 344867 - RNA, 14 nt, Bordetella pertussis
cagcagcagcacgg

SEQ ID NO: 344868 - RNA, 15 nt, Bordetella pertussis
cagcagcagcacggc

SEQ ID NO: 344869 - RNA, 15 nt, Bordetella pertussis
cagcagcagcgagcc

SEQ ID NO: 344870 - RNA, 12 nt, Bordetella pertussis
cagcagcagcgc

SEQ ID NO: 344871 - RNA, 14 nt, Bordetella pertussis
cagcagcagcgccg

SEQ ID NO: 344872 - RNA, 17 nt, Bordetella pertussis
cagcagcgccggcaggc

SEQ ID NO: 344873 - RNA, 23 nt, Bordetella pertussis
cagcagcgccgguucgacgcuga

SEQ ID NO: 344874 - RNA, 13 nt, Bordetella pertussis
cagcagcagcgcc

SEQ ID NO: 344875 - RNA, 13 nt, Bordetella pertussis
cagcagcgcgccg

SEQ ID NO: 344876 - RNA, 16 nt, Bordetella pertussis
cagcagcgcggcgccg

SEQ ID NO: 344877 - RNA, 23 nt, Bordetella pertussis
cagcagcgcggcgccggccguca

SEQ ID NO: 344878 - RNA, 19 nt, Bordetella pertussis
cagcagcgcgguggccagc

SEQ ID NO: 344879 - RNA, 23 nt, Bordetella pertussis
cagcagcgcgugcagccagcggc

SEQ ID NO: 344880 - RNA, 20 nt, Bordetella pertussis
cagcagcggcagcucggcga

SEQ ID NO: 344881 - RNA, 14 nt, Bordetella pertussis
cagcagcguggcca

SEQ ID NO: 344882 - RNA, 17 nt, Bordetella pertussis
cagcagcguggccacca

SEQ ID NO: 344883 - RNA, 23 nt, Bordetella pertussis
cagcagcguggccaccaggcgcg

SEQ ID NO: 344884 - RNA, 14 nt, Bordetella pertussis
cagcagcguggccg

SEQ ID NO: 344885 - RNA, 19 nt, Bordetella pertussis
cagcagcguggccgccacc

SEQ ID NO: 344886 - RNA, 14 nt, Bordetella pertussis
cagcagcgggcuug

SEQ ID NO: 344887 - RNA, 17 nt, Bordetella pertussis
cagcagcuccucggccu

SEQ ID NO: 344888 - RNA, 19 nt, Bordetella pertussis
cagcagcucggcgaccagg

SEQ ID NO: 344889 - RNA, 20 nt, Bordetella pertussis
cagcagcucggcgaccaggc

SEQ ID NO: 344890 - RNA, 14 nt, Bordetella pertussis
cagcagcucggcga

SEQ ID NO: 344891 - RNA, 14 nt, Bordetella pertussis
cagcagcuggcgca

SEQ ID NO: 344892 - RNA, 22 nt, Bordetella pertussis
cagcagcuggcgcagcacgccg

SEQ ID NO: 344893 - RNA, 20 nt, Bordetella pertussis
cagcagcuguuccugcucgg

SEQ ID NO: 344894 - RNA, 14 nt, Bordetella pertussis
cagcagcuugccga

SEQ ID NO: 344895 - RNA, 15 nt, Bordetella pertussis
cagcagcuugccgac

SEQ ID NO: 344896 - RNA, 17 nt, Bordetella pertussis
cagcaggauggcgaaca

SEQ ID NO: 344897 - RNA, 20 nt, Bordetella pertussis
cagcaggauguccacggucg

SEQ ID NO: 344898 - RNA, 23 nt, Bordetella pertussis
cagcaggauguccacggucgccg

SEQ ID NO: 344899 - RNA, 21 nt, Bordetella pertussis
cagcaggccaggaagcggcgc

SEQ ID NO: 344900 - RNA, 12 nt, Bordetella pertussis
cagcaggcccac

SEQ ID NO: 344901 - RNA, 13 nt, Bordetella pertussis
cagcaggcccacc

SEQ ID NO: 344902 - RNA, 15 nt, Bordetella pertussis
cagcaggcccaccag

SEQ ID NO: 344903 - RNA, 14 nt, Bordetella pertussis
cagcaggcccaugc

SEQ ID NO: 344904 - RNA, 18 nt, Bordetella pertussis
cagcaggcccuccggcgc

SEQ ID NO: 344905 - RNA, 20 nt, Bordetella pertussis
cagcaggcccuccggcgcca

SEQ ID NO: 344906 - RNA, 13 nt, Bordetella pertussis
cagcaggccgcgc

SEQ ID NO: 344907 - RNA, 21 nt, Bordetella pertussis
cagcaggcuuucgcacagccg

SEQ ID NO: 344908 - RNA, 19 nt, Bordetella pertussis
cagcagggacuugggcagg

SEQ ID NO: 344909 - RNA, 14 nt, Bordetella pertussis
cagcagggccacgc

SEQ ID NO: 344910 - RNA, 22 nt, Bordetella pertussis
cagcagggccacgcccaggccg

SEQ ID NO: 344911 - RNA, 14 nt, Bordetella pertussis
cagcagggccaggc

SEQ ID NO: 344912 - RNA, 16 nt, Bordetella pertussis
cagcagggccaggccc

SEQ ID NO: 344913 - RNA, 22 nt, Bordetella pertussis
cagcagggccaggcccacggcg

SEQ ID NO: 344914 - RNA, 13 nt, Bordetella pertussis
cagcagggcgccg

SEQ ID NO: 344915 - RNA, 14 nt, Bordetella pertussis
cagcagggcgccga

SEQ ID NO: 344916 - RNA, 17 nt, Bordetella pertussis
cagcagggcggcgucga

SEQ ID NO: 344917 - RNA, 19 nt, Bordetella pertussis
cagcagggucaugaugucg

SEQ ID NO: 344918 - RNA, 14 nt, Bordetella pertussis
cagcagggucgaga

SEQ ID NO: 344919 - RNA, 16 nt, Bordetella pertussis
cagcagggucagcggc

SEQ ID NO: 344920 - RNA, 20 nt, Bordetella pertussis
cagcagggucagcggccggc

SEQ ID NO: 344921 - RNA, 16 nt, Bordetella pertussis
cagcagggucggcccc

SEQ ID NO: 344922 - RNA, 16 nt, Bordetella pertussis
cagcaguguuucggcc

SEQ ID NO: 344923 - RNA, 14 nt, Bordetella pertussis
cagcaguucggccg

SEQ ID NO: 344924 - RNA, 22 nt, Bordetella pertussis
cagcaguucggccggcggccca

SEQ ID NO: 344925 - RNA, 14 nt, Bordetella pertussis
cagcaguucggcgu

SEQ ID NO: 344926 - RNA, 15 nt, Bordetella pertussis
cagcaguucggcguc

SEQ ID NO: 344927 - RNA, 22 nt, Bordetella pertussis
cagcaguucggcgucggugccg

SEQ ID NO: 344928 - RNA, 15 nt, Bordetella pertussis
cagcaguucggucag

SEQ ID NO: 344929 - RNA, 19 nt, Bordetella pertussis
cagcaguucggucagcgcg

SEQ ID NO: 344930 - RNA, 21 nt, Bordetella pertussis
cagcaguucggucagcgcggc

SEQ ID NO: 344931 - RNA, 22 nt, Bordetella pertussis
cagcaguucggucagcgcggcg

SEQ ID NO: 344932 - RNA, 16 nt, Bordetella pertussis
cagcaguugcagcaug

SEQ ID NO: 344933 - RNA, 20 nt, Bordetella pertussis
cagcaguugcgccaguucgg

SEQ ID NO: 344934 - RNA, 19 nt, Bordetella pertussis
cagcaguuucugcaccggc

SEQ ID NO: 344935 - RNA, 24 nt, Bordetella pertussis
cagcauccagccgaucagccggcc

SEQ ID NO: 344936 - RNA, 14 nt, Bordetella pertussis
cagcauccgcgcca

SEQ ID NO: 344937 - RNA, 20 nt, Bordetella pertussis
cagcauccgcgccaggaugg

SEQ ID NO: 344938 - RNA, 18 nt, Bordetella pertussis
cagcaugccgcgguggcg

SEQ ID NO: 344939 - RNA, 20 nt, Bordetella pertussis
cagcaugccuucgacggcgg

SEQ ID NO: 344940 - RNA, 16 nt, Bordetella pertussis
cagcaugcgcgcggcc

SEQ ID NO: 344941 - RNA, 20 nt, Bordetella pertussis
cagcaugcgcgcggccucga

SEQ ID NO: 344942 - RNA, 14 nt, Bordetella pertussis
cagcaugcgcuggg

SEQ ID NO: 344943 - RNA, 16 nt, Bordetella pertussis
cagcaugcgcuggucg

SEQ ID NO: 344944 - RNA, 19 nt, Bordetella pertussis
cagcaugcgcuggucgcgc

SEQ ID NO: 344945 - RNA, 17 nt, Bordetella pertussis
cagcaugcggcccgcgc

SEQ ID NO: 344946 - RNA, 21 nt, Bordetella pertussis
cagcauggacgagcucgucgg

SEQ ID NO: 344947 - RNA, 13 nt, Bordetella pertussis
cagcauggccacc

SEQ ID NO: 344948 - RNA, 13 nt, Bordetella pertussis
cagcauggcgcca

SEQ ID NO: 344949 - RNA, 18 nt, Bordetella pertussis
cagcauggcgccagcugg

SEQ ID NO: 344950 - RNA, 14 nt, Bordetella pertussis
cagcauggcgucga

SEQ ID NO: 344951 - RNA, 17 nt, Bordetella pertussis
cagcauggucgccucga

SEQ ID NO: 344952 - RNA, 14 nt, Bordetella pertussis
cagcauggucggca

SEQ ID NO: 344953 - RNA, 17 nt, Bordetella pertussis
cagcauggucggcaugg

SEQ ID NO: 344954 - RNA, 18 nt, Bordetella pertussis
cagcauguauucaucacg

SEQ ID NO: 344955 - RNA, 18 nt, Bordetella pertussis
cagcauguccguaucgcg

SEQ ID NO: 344956 - RNA, 21 nt, Bordetella pertussis
cagcauguccguaucgcggcc

SEQ ID NO: 344957 - RNA, 12 nt, Bordetella pertussis
cagcaugucgug

SEQ ID NO: 344958 - RNA, 15 nt, Bordetella pertussis
cagcaugugcgcggc

SEQ ID NO: 344959 - RNA, 16 nt, Bordetella pertussis
cagcaugugcgcggcg

SEQ ID NO: 344960 - RNA, 20 nt, Bordetella pertussis
cagcaugugcgcggcguuga

SEQ ID NO: 344961 - RNA, 21 nt, Bordetella pertussis
cagcauucuggugcagcggcu

SEQ ID NO: 344962 - RNA, 18 nt, Bordetella pertussis
cagcauuucgcgugcgug

SEQ ID NO: 344963 - RNA, 21 nt, Bordetella pertussis
cagcauuucggcgccgccggc

SEQ ID NO: 344964 - RNA, 18 nt, Bordetella pertussis
cagcauuucucgggcgca

SEQ ID NO: 344965 - RNA, 22 nt, Bordetella pertussis
cagccaccgguugcagcgcgcc

SEQ ID NO: 344966 - RNA, 23 nt, Bordetella pertussis
cagccaccgguugcagcgcgcca

SEQ ID NO: 344967 - RNA, 14 nt, Bordetella pertussis
cagccacgccggcg

SEQ ID NO: 344968 - RNA, 16 nt, Bordetella pertussis
cagccacgccggcgcg

SEQ ID NO: 344969 - RNA, 14 nt, Bordetella pertussis
cagccacgccuggc

SEQ ID NO: 344970 - RNA, 19 nt, Bordetella pertussis
cagccacgccuggccgcgc

SEQ ID NO: 344971 - RNA, 22 nt, Bordetella pertussis
cagccacgccuggccgcgcuca

SEQ ID NO: 344972 - RNA, 12 nt, Bordetella pertussis
cagccccugcca

SEQ ID NO: 344973 - RNA, 17 nt, Bordetella pertussis
cagcccgacggccagcg

SEQ ID NO: 344974 - RNA, 20 nt, Bordetella pertussis
cagcccgauaugcagccgca

SEQ ID NO: 344975 - RNA, 15 nt, Bordetella pertussis
cagcccgaucgacgg

SEQ ID NO: 344976 - RNA, 17 nt, Bordetella pertussis
cagcccgaucgacggcc

SEQ ID NO: 344977 - RNA, 18 nt, Bordetella pertussis
cagcccgaugcgccaggc

SEQ ID NO: 344978 - RNA, 21 nt, Bordetella pertussis
cagcccgaugcgccaggccuc

SEQ ID NO: 344979 - RNA, 17 nt, Bordetella pertussis
cagcccggcgacguugc

SEQ ID NO: 344980 - RNA, 15 nt, Bordetella pertussis
cagcccggcgcgcca

SEQ ID NO: 344981 - RNA, 21 nt, Bordetella pertussis
cagcccggcgcgccacccugg

SEQ ID NO: 344982 - RNA, 13 nt, Bordetella pertussis
cagcccggcggcc

SEQ ID NO: 344983 - RNA, 15 nt, Bordetella pertussis
cagcccggcggccau

SEQ ID NO: 344984 - RNA, 21 nt, Bordetella pertussis
cagcccggcggugaccugggg

SEQ ID NO: 344985 - RNA, 13 nt, Bordetella pertussis
cagcccggcgugc

SEQ ID NO: 344986 - RNA, 18 nt, Bordetella pertussis
cagcccggcgugcccagg

SEQ ID NO: 344987 - RNA, 21 nt, Bordetella pertussis
cagcccggcgugcccagggcc

SEQ ID NO: 344988 - RNA, 22 nt, Bordetella pertussis
cagcccgggcaugcgaaagccg

SEQ ID NO: 344989 - RNA, 16 nt, Bordetella pertussis
cagcccguccuggugc

SEQ ID NO: 344990 - RNA, 19 nt, Bordetella pertussis
cagcccgugggcggcguag

SEQ ID NO: 344991 - RNA, 16 nt, Bordetella pertussis
cagcccuucgcccgca

SEQ ID NO: 344992 - RNA, 19 nt, Bordetella pertussis
cagcccuugacgcguacga

SEQ ID NO: 344993 - RNA, 16 nt, Bordetella pertussis
cagccgcaccagcgca

SEQ ID NO: 344994 - RNA, 13 nt, Bordetella pertussis
cagccgcagcagg

SEQ ID NO: 344995 - RNA, 14 nt, Bordetella pertussis
cagccgcagcaggc

SEQ ID NO: 344996 - RNA, 13 nt, Bordetella pertussis
cagccgcagccgu

SEQ ID NO: 344997 - RNA, 16 nt, Bordetella pertussis
cagccgcagccgucgc

SEQ ID NO: 344998 - RNA, 14 nt, Bordetella pertussis
cagccgcaugccgg

SEQ ID NO: 344999 - RNA, 17 nt, Bordetella pertussis
cagccgcaugccggcga

SEQ ID NO: 345000 - RNA, 14 nt, Bordetella pertussis
cagccgccagcgcc

SEQ ID NO: 345001 - RNA, 17 nt, Bordetella pertussis
cagccgccagcgccugg

SEQ ID NO: 345002 - RNA, 19 nt, Bordetella pertussis
cagccgccagcgccuggac

SEQ ID NO: 345003 - RNA, 18 nt, Bordetella pertussis
cagccgccauaggcgcgc

SEQ ID NO: 345004 - RNA, 19 nt, Bordetella pertussis
cagccgccauaggcgcgca

SEQ ID NO: 345005 - RNA, 13 nt, Bordetella pertussis
cagccgccccagc

SEQ ID NO: 345006 - RNA, 15 nt, Bordetella pertussis
cagccgccccagcag

SEQ ID NO: 345007 - RNA, 18 nt, Bordetella pertussis
cagccgccccagcagcag

SEQ ID NO: 345008 - RNA, 21 nt, Bordetella pertussis
cagccgccccagcagcagcga

SEQ ID NO: 345009 - RNA, 13 nt, Bordetella pertussis
cagccgcucgcgc

SEQ ID NO: 345010 - RNA, 14 nt, Bordetella pertussis
cagccgcucgcgcg

SEQ ID NO: 345011 - RNA, 22 nt, Bordetella pertussis
cagccgcucgcgcgaccacugg

SEQ ID NO: 345012 - RNA, 14 nt, Bordetella pertussis
cagccgcugcagau

SEQ ID NO: 345013 - RNA, 16 nt, Bordetella pertussis
cagccgcugcagcgac

SEQ ID NO: 345014 - RNA, 19 nt, Bordetella pertussis
cagccgcugacugggcgga

SEQ ID NO: 345015 - RNA, 21 nt, Bordetella pertussis
cagccgcuggcgaucaggccg

SEQ ID NO: 345016 - RNA, 22 nt, Bordetella pertussis
cagccgcuggcgaucaggccgc

SEQ ID NO: 345017 - RNA, 14 nt, Bordetella pertussis
cagccgcuggcgcg

SEQ ID NO: 345018 - RNA, 16 nt, Bordetella pertussis
cagccgcuucacgcug

SEQ ID NO: 345019 - RNA, 21 nt, Bordetella pertussis
cagccgcuugaaguaaucgcc

SEQ ID NO: 345020 - RNA, 18 nt, Bordetella pertussis
cagccgcuuggccugcgc

SEQ ID NO: 345021 - RNA, 19 nt, Bordetella pertussis
cagccgcuuggccugcgcc

SEQ ID NO: 345022 - RNA, 13 nt, Bordetella pertussis
cagccggaaacgg

SEQ ID NO: 345023 - RNA, 15 nt, Bordetella pertussis
cagccggcggccagc

SEQ ID NO: 345024 - RNA, 16 nt, Bordetella pertussis
cagccggcggccagcu

SEQ ID NO: 345025 - RNA, 19 nt, Bordetella pertussis
cagccggcggccagcuugu

SEQ ID NO: 345026 - RNA, 18 nt, Bordetella pertussis
cagccgggcggccacggc

SEQ ID NO: 345027 - RNA, 19 nt, Bordetella pertussis
cagccgggcggccacggcg

SEQ ID NO: 345028 - RNA, 16 nt, Bordetella pertussis
cagccgggcugccggc

SEQ ID NO: 345029 - RNA, 14 nt, Bordetella pertussis
cagccggggcgagc

SEQ ID NO: 345030 - RNA, 22 nt, Bordetella pertussis
cagccggggcgagcgcagccgc

SEQ ID NO: 345031 - RNA, 17 nt, Bordetella pertussis
cagccggguggucgcgc

SEQ ID NO: 345032 - RNA, 18 nt, Bordetella pertussis
cagccggguggucgcgcc

SEQ ID NO: 345033 - RNA, 14 nt, Bordetella pertussis
cagccggugcgcgg

SEQ ID NO: 345034 - RNA, 15 nt, Bordetella pertussis
cagccgguuggcgcc

SEQ ID NO: 345035 - RNA, 15 nt, Bordetella pertussis
cagccgucggcaugg

SEQ ID NO: 345036 - RNA, 17 nt, Bordetella pertussis
cagccgugccgcgcgca

SEQ ID NO: 345037 - RNA, 19 nt, Bordetella pertussis
cagccgugccgcgcgcacc

SEQ ID NO: 345038 - RNA, 21 nt, Bordetella pertussis
cagcgaacggauggucgugcg

SEQ ID NO: 345039 - RNA, 16 nt, Bordetella pertussis
cagcgaacggcccacg

SEQ ID NO: 345040 - RNA, 20 nt, Bordetella pertussis
cagcgacaacaggucguggc

SEQ ID NO: 345041 - RNA, 15 nt, Bordetella pertussis
cagcgacacggcggu

SEQ ID NO: 345042 - RNA, 20 nt, Bordetella pertussis
cagcgacagccaggccagcg

SEQ ID NO: 345043 - RNA, 22 nt, Bordetella pertussis
cagcgacagccaggccagcgcc

SEQ ID NO: 345044 - RNA, 17 nt, Bordetella pertussis
cagcgacgcgcgccggc

SEQ ID NO: 345045 - RNA, 19 nt, Bordetella pertussis
cagcgacgcgcgccggcgc

SEQ ID NO: 345046 - RNA, 15 nt, Bordetella pertussis
cagcgacuccggccg

SEQ ID NO: 345047 - RNA, 17 nt, Bordetella pertussis
cagcgacuccggccggg

SEQ ID NO: 345048 - RNA, 23 nt, Bordetella pertussis
cagcgacuccggccgggccagcg

SEQ ID NO: 345049 - RNA, 14 nt, Bordetella pertussis
cagcgacucgaaca

SEQ ID NO: 345050 - RNA, 20 nt, Bordetella pertussis
cagcgacucggucagcacga

SEQ ID NO: 345051 - RNA, 18 nt, Bordetella pertussis
cagcgaggacacgcagcu

SEQ ID NO: 345052 - RNA, 15 nt, Bordetella pertussis
cagcgaggcgcagcg

SEQ ID NO: 345053 - RNA, 19 nt, Bordetella pertussis
cagcgaggcggcaagcggc

SEQ ID NO: 345054 - RNA, 21 nt, Bordetella pertussis
cagcgaggcggcaagcggcgu

SEQ ID NO: 345055 - RNA, 19 nt, Bordetella pertussis
cagcgagguggugacgaug

SEQ ID NO: 345056 - RNA, 16 nt, Bordetella pertussis
cagcgaguagacgcag

SEQ ID NO: 345057 - RNA, 21 nt, Bordetella pertussis
cagcgaguagacgcagccgca

SEQ ID NO: 345058 - RNA, 20 nt, Bordetella pertussis
cagcgagucgaccaguucgg

SEQ ID NO: 345059 - RNA, 19 nt, Bordetella pertussis
cagcgaguuguccuggccg

SEQ ID NO: 345060 - RNA, 20 nt, Bordetella pertussis
cagcgcaccaccaccaugug

SEQ ID NO: 345061 - RNA, 19 nt, Bordetella pertussis
cagcgcaccaccagcaccg

SEQ ID NO: 345062 - RNA, 21 nt, Bordetella pertussis
cagcgcaccaccagcaccgcc

SEQ ID NO: 345063 - RNA, 15 nt, Bordetella pertussis
cagcgcaccgacggc

SEQ ID NO: 345064 - RNA, 16 nt, Bordetella pertussis
cagcgcaccgacggca

SEQ ID NO: 345065 - RNA, 22 nt, Bordetella pertussis
cagcgcaccgacggcagccccg

SEQ ID NO: 345066 - RNA, 21 nt, Bordetella pertussis
cagcgcacgauugucgucgcg

SEQ ID NO: 345067 - RNA, 15 nt, Bordetella pertussis
cagcgcacgcagcgc

SEQ ID NO: 345068 - RNA, 16 nt, Bordetella pertussis
cagcgcacgcagcgcu

SEQ ID NO: 345069 - RNA, 19 nt, Bordetella pertussis
cagcgcacgguccaggcgg

SEQ ID NO: 345070 - RNA, 13 nt, Bordetella pertussis
cagcgcacggucg

SEQ ID NO: 345071 - RNA, 22 nt, Bordetella pertussis
cagcgcacugagaaaggccgcc

SEQ ID NO: 345072 - RNA, 16 nt, Bordetella pertussis
cagcgcacugaucgcc

SEQ ID NO: 345073 - RNA, 18 nt, Bordetella pertussis
cagcgcacugaucgccgc

SEQ ID NO: 345074 - RNA, 14 nt, Bordetella pertussis
cagcgcagcgccac

SEQ ID NO: 345075 - RNA, 13 nt, Bordetella pertussis
cagcgcaggaugg

SEQ ID NO: 345076 - RNA, 21 nt, Bordetella pertussis
cagcgcaggauuuccucgccg

SEQ ID NO: 345077 - RNA, 14 nt, Bordetella pertussis
cagcgccacggcgg

SEQ ID NO: 345078 - RNA, 12 nt, Bordetella pertussis
cagcgccagcac

SEQ ID NO: 345079 - RNA, 23 nt, Bordetella pertussis
cagcgccagcaccggcacgcgcc

SEQ ID NO: 345080 - RNA, 13 nt, Bordetella pertussis
cagcgccagcagg

SEQ ID NO: 345081 - RNA, 16 nt, Bordetella pertussis
cagcgccagcccgcug

SEQ ID NO: 345082 - RNA, 17 nt, Bordetella pertussis
cagcgccagcccgcugc

SEQ ID NO: 345083 - RNA, 14 nt, Bordetella pertussis
cagcgccagccgcu

SEQ ID NO: 345084 - RNA, 19 nt, Bordetella pertussis
cagcgccaggaacagcgcc

SEQ ID NO: 345085 - RNA, 21 nt, Bordetella pertussis
cagcgccaggaacagcgccgg

SEQ ID NO: 345086 - RNA, 20 nt, Bordetella pertussis
cagcgccagcgucaggcugg

SEQ ID NO: 345087 - RNA, 14 nt, Bordetella pertussis
cagcgcccaggcga

SEQ ID NO: 345088 - RNA, 20 nt, Bordetella pertussis
cagcgcccaggcgaugccca

SEQ ID NO: 345089 - RNA, 21 nt, Bordetella pertussis
cagcgcccaggcgaugcccag

SEQ ID NO: 345090 - RNA, 23 nt, Bordetella pertussis
cagcgcccaggcgaugcccagcg

SEQ ID NO: 345091 - RNA, 14 nt, Bordetella pertussis
cagcgccccgauca

SEQ ID NO: 345092 - RNA, 14 nt, Bordetella pertussis
cagcgcccgcgcca

SEQ ID NO: 345093 - RNA, 12 nt, Bordetella pertussis
cagcgccgacga

SEQ ID NO: 345094 - RNA, 15 nt, Bordetella pertussis
cagcgccgacggcau

SEQ ID NO: 345095 - RNA, 16 nt, Bordetella pertussis
cagcgccgacggcaug

SEQ ID NO: 345096 - RNA, 17 nt, Bordetella pertussis
cagcgccgacggcaugg

SEQ ID NO: 345097 - RNA, 19 nt, Bordetella pertussis
cagcgccgacggcauggcc

SEQ ID NO: 345098 - RNA, 15 nt, Bordetella pertussis
cagcgccgagcgcca

SEQ ID NO: 345099 - RNA, 17 nt, Bordetella pertussis
cagcgccgcagcgucgc

SEQ ID NO: 345100 - RNA, 13 nt, Bordetella pertussis
cagcgccucgcgc

SEQ ID NO: 345101 - RNA, 20 nt, Bordetella pertussis
cagcgccucgcgcucgagcg

SEQ ID NO: 345102 - RNA, 14 nt, Bordetella pertussis
cagcgccucgucgc

SEQ ID NO: 345103 - RNA, 17 nt, Bordetella pertussis
cagcgccucgucgcgca

SEQ ID NO: 345104 - RNA, 22 nt, Bordetella pertussis
cagcgccucgucgcgcaacgcc

SEQ ID NO: 345105 - RNA, 12 nt, Bordetella pertussis
cagcgccugcag

SEQ ID NO: 345106 - RNA, 14 nt, Bordetella pertussis
cagcgccucgggau

SEQ ID NO: 345107 - RNA, 16 nt, Bordetella pertussis
cagcgccugcaggcgg

SEQ ID NO: 345108 - RNA, 18 nt, Bordetella pertussis
cagcgccugcauccggcc

SEQ ID NO: 345109 - RNA, 15 nt, Bordetella pertussis
cagcgccugccgcgu

SEQ ID NO: 345110 - RNA, 20 nt, Bordetella pertussis
cagcgccuggaccuggacga

SEQ ID NO: 345111 - RNA, 13 nt, Bordetella pertussis
cagcgccuggccg

SEQ ID NO: 345112 - RNA, 15 nt, Bordetella pertussis
cagcgccuggccgag

SEQ ID NO: 345113 - RNA, 16 nt, Bordetella pertussis
cagcgccuggccgagc

SEQ ID NO: 345114 - RNA, 22 nt, Bordetella pertussis
cagcgccuggccgagcgcggca

SEQ ID NO: 345115 - RNA, 20 nt, Bordetella pertussis
cagcgccuggcggcugguca

SEQ ID NO: 345116 - RNA, 23 nt, Bordetella pertussis
cagcgccuggcuucccgguccag

SEQ ID NO: 345117 - RNA, 14 nt, Bordetella pertussis
cagcgccugggcgc

SEQ ID NO: 345118 - RNA, 14 nt, Bordetella pertussis
cagcgccuugccgc

SEQ ID NO: 345119 - RNA, 16 nt, Bordetella pertussis
cagcgccuugccgccg

SEQ ID NO: 345120 - RNA, 21 nt, Bordetella pertussis
cagcgccuugccgccgugcga

SEQ ID NO: 345121 - RNA, 15 nt, Bordetella pertussis
cagcgccuugcggcg

SEQ ID NO: 345122 - RNA, 16 nt, Bordetella pertussis
cagcgccuugcggcgc

SEQ ID NO: 345123 - RNA, 12 nt, Bordetella pertussis
cagcgccuugcc

SEQ ID NO: 345124 - RNA, 20 nt, Bordetella pertussis
cagcgcgaaaacccgcggca

SEQ ID NO: 345125 - RNA, 14 nt, Bordetella pertussis
cagcgcgaacaacg

SEQ ID NO: 345126 - RNA, 20 nt, Bordetella pertussis
cagcgcgaacggcgggcgga

SEQ ID NO: 345127 - RNA, 18 nt, Bordetella pertussis
cagcgcgaaguaccagcg

SEQ ID NO: 345128 - RNA, 15 nt, Bordetella pertussis
cagcgcgaccgggca

SEQ ID NO: 345129 - RNA, 16 nt, Bordetella pertussis
cagcgcgaccgggcaa

SEQ ID NO: 345130 - RNA, 23 nt, Bordetella pertussis
cagcgcgacgaagccggaaccgc

SEQ ID NO: 345131 - RNA, 13 nt, Bordetella pertussis
cagcgcgacggcc

SEQ ID NO: 345132 - RNA, 14 nt, Bordetella pertussis
cagcgcgacggccu

SEQ ID NO: 345133 - RNA, 20 nt, Bordetella pertussis
cagcgcgacggccucguccu

SEQ ID NO: 345134 - RNA, 16 nt, Bordetella pertussis
cagcgcgaucucgcgc

SEQ ID NO: 345135 - RNA, 23 nt, Bordetella pertussis
cagcgcgauucccuggcgcgcca

SEQ ID NO: 345136 - RNA, 14 nt, Bordetella pertussis
cagcgcgcaacucc

SEQ ID NO: 345137 - RNA, 17 nt, Bordetella pertussis
cagcgcgcaacuccagc

SEQ ID NO: 345138 - RNA, 14 nt, Bordetella pertussis
cagcgcgcaggaca

SEQ ID NO: 345139 - RNA, 17 nt, Bordetella pertussis
cagcgcgcaggacaagg

SEQ ID NO: 345140 - RNA, 19 nt, Bordetella pertussis
cagcgcgcaggacaaggcg

SEQ ID NO: 345141 - RNA, 22 nt, Bordetella pertussis
cagcgcgcaggacaaggcgcgc

SEQ ID NO: 345142 - RNA, 23 nt, Bordetella pertussis
cagcgcgcaggacaaggcgcgcg

SEQ ID NO: 345143 - RNA, 14 nt, Bordetella pertussis
cagcgcgccagcgc

SEQ ID NO: 345144 - RNA, 17 nt, Bordetella pertussis
cagcgcgccagcgcgcg

SEQ ID NO: 345145 - RNA, 16 nt, Bordetella pertussis
cagcgcgccaggcgcu

SEQ ID NO: 345146 - RNA, 14 nt, Bordetella pertussis
cagcgcgccauggc

SEQ ID NO: 345147 - RNA, 18 nt, Bordetella pertussis
cagcgcgccauggccggc

SEQ ID NO: 345148 - RNA, 12 nt, Bordetella pertussis
cagcgcgcccga

SEQ ID NO: 345149 - RNA, 15 nt, Bordetella pertussis
cagcgcgcccgcuug

SEQ ID NO: 345150 - RNA, 11 nt, Bordetella pertussis
cagcgcgccga

SEQ ID NO: 345151 - RNA, 13 nt, Bordetella pertussis
cagcgcgccgaag

SEQ ID NO: 345152 - RNA, 23 nt, Bordetella pertussis
cagcgcgccgaucaccacgggca

SEQ ID NO: 345153 - RNA, 16 nt, Bordetella pertussis
cagcgcgccgccagcg

SEQ ID NO: 345154 - RNA, 23 nt, Bordetella pertussis
cagcgcgccggccagggccacca

SEQ ID NO: 345155 - RNA, 15 nt, Bordetella pertussis
cagcgcgccgcgccg

SEQ ID NO: 345156 - RNA, 16 nt, Bordetella pertussis
cagcgcgccgcgccgg

SEQ ID NO: 345157 - RNA, 11 nt, Bordetella pertussis
cagcgcgccgg

SEQ ID NO: 345158 - RNA, 22 nt, Bordetella pertussis
cagcgcgccgucgggggccggc

SEQ ID NO: 345159 - RNA, 19 nt, Bordetella pertussis
cagcgcgccugcccaggcc

SEQ ID NO: 345160 - RNA, 20 nt, Bordetella pertussis
cagcgcgcgauagauggcca

SEQ ID NO: 345161 - RNA, 20 nt, Bordetella pertussis
cagcgcgcgaucgccagcag

SEQ ID NO: 345162 - RNA, 20 nt, Bordetella pertussis
cagcgcgcgcagccgcgcca

SEQ ID NO: 345163 - RNA, 22 nt, Bordetella pertussis
cagcgcgcgccaguugcgcacc

SEQ ID NO: 345164 - RNA, 15 nt, Bordetella pertussis
cagcgcgcgaucgcc

SEQ ID NO: 345165 - RNA, 16 nt, Bordetella pertussis
cagcgcgcgccggccg

SEQ ID NO: 345166 - RNA, 17 nt, Bordetella pertussis
cagcgcgcgccggccga

SEQ ID NO: 345167 - RNA, 22 nt, Bordetella pertussis
cagcgcgcgcgaggcggcggcc

SEQ ID NO: 345168 - RNA, 20 nt, Bordetella pertussis
cagcgcgcggccggccgcgc

SEQ ID NO: 345169 - RNA, 15 nt, Bordetella pertussis
cagcgcgcggccucg

SEQ ID NO: 345170 - RNA, 15 nt, Bordetella pertussis
cagcgcgcggcgcag

SEQ ID NO: 345171 - RNA, 13 nt, Bordetella pertussis
cagcgcgcgggcg

SEQ ID NO: 345172 - RNA, 13 nt, Bordetella pertussis
cagcgcgcggggc

SEQ ID NO: 345173 - RNA, 20 nt, Bordetella pertussis
cagcgcgcggggcaggccga

SEQ ID NO: 345174 - RNA, 15 nt, Bordetella pertussis
cagcgcggcacgcug

SEQ ID NO: 345175 - RNA, 16 nt, Bordetella pertussis
cagcgcggcacgcugc

SEQ ID NO: 345176 - RNA, 16 nt, Bordetella pertussis
cagcgcggcaucggcc

SEQ ID NO: 345177 - RNA, 17 nt, Bordetella pertussis
cagcgcggcaucggcca

SEQ ID NO: 345178 - RNA, 14 nt, Bordetella pertussis
cagcgcggcaugcc

SEQ ID NO: 345179 - RNA, 17 nt, Bordetella pertussis
cagcgcggcaugccgcu

SEQ ID NO: 345180 - RNA, 17 nt, Bordetella pertussis
cagcgcggccacggccu

SEQ ID NO: 345181 - RNA, 14 nt, Bordetella pertussis
cagcgcggccagca

SEQ ID NO: 345182 - RNA, 20 nt, Bordetella pertussis
cagcgcggccagcgcgucga

SEQ ID NO: 345183 - RNA, 19 nt, Bordetella pertussis
cagcgcggccaggucggcg

SEQ ID NO: 345184 - RNA, 20 nt, Bordetella pertussis
cagcgcggccaggucggcgu

SEQ ID NO: 345185 - RNA, 18 nt, Bordetella pertussis
cagcgcggccagcaccgg

SEQ ID NO: 345186 - RNA, 21 nt, Bordetella pertussis
cagcgcggccagcaccggccg

SEQ ID NO: 345187 - RNA, 13 nt, Bordetella pertussis
cagcgcggccggc

SEQ ID NO: 345188 - RNA, 13 nt, Bordetella pertussis
cagcgcggccgcu

SEQ ID NO: 345189 - RNA, 21 nt, Bordetella pertussis
cagcgcggccgucaccgccgc

SEQ ID NO: 345190 - RNA, 20 nt, Bordetella pertussis
cagcgcggcgaaggcgcggc

SEQ ID NO: 345191 - RNA, 16 nt, Bordetella pertussis
cagcgcggcgcacagg

SEQ ID NO: 345192 - RNA, 13 nt, Bordetella pertussis
cagcgcggcgcca

SEQ ID NO: 345193 - RNA, 12 nt, Bordetella pertussis
cagcgcggcggc

SEQ ID NO: 345194 - RNA, 19 nt, Bordetella pertussis
cagcgcggcggcgaccggc

SEQ ID NO: 345195 - RNA, 21 nt, Bordetella pertussis
cagcgcggcgggcggcgcggc

SEQ ID NO: 345196 - RNA, 22 nt, Bordetella pertussis
cagcgcggcgggcggcgcggcc

SEQ ID NO: 345197 - RNA, 18 nt, Bordetella pertussis
cagcgcggcguugaccug

SEQ ID NO: 345198 - RNA, 17 nt, Bordetella pertussis
cagcgcgggccacugcg

SEQ ID NO: 345199 - RNA, 22 nt, Bordetella pertussis
cagcgcgggccacugcgccugg

SEQ ID NO: 345200 - RNA, 12 nt, Bordetella pertussis
cagcgcgggcgc

SEQ ID NO: 345201 - RNA, 13 nt, Bordetella pertussis
cagcgcgggcgca

SEQ ID NO: 345202 - RNA, 17 nt, Bordetella pertussis
cagcgcggucaugccga

SEQ ID NO: 345203 - RNA, 15 nt, Bordetella pertussis
cagcgcgguguugcg

SEQ ID NO: 345204 - RNA, 22 nt, Bordetella pertussis
cagcgcguccaggugcggcggc

SEQ ID NO: 345205 - RNA, 21 nt, Bordetella pertussis
cagcgcguccugcacguccuc

SEQ ID NO: 345206 - RNA, 23 nt, Bordetella pertussis
cagcgcguccugcacguccucga

SEQ ID NO: 345207 - RNA, 17 nt, Bordetella pertussis
cagcgcgucgagcagcg

SEQ ID NO: 345208 - RNA, 19 nt, Bordetella pertussis
cagcgcgucgagcagcgca

SEQ ID NO: 345209 - RNA, 22 nt, Bordetella pertussis
cagcgcgucgagcagcgcaucg

SEQ ID NO: 345210 - RNA, 19 nt, Bordetella pertussis
cagcgcgucgcguagcgcg

SEQ ID NO: 345211 - RNA, 22 nt, Bordetella pertussis
cagcgcgucgcguagcgcggcc

SEQ ID NO: 345212 - RNA, 20 nt, Bordetella pertussis
cagcgcgucggccaggcgcc

SEQ ID NO: 345213 - RNA, 13 nt, Bordetella pertussis
cagcgcgucggcg

SEQ ID NO: 345214 - RNA, 16 nt, Bordetella pertussis
cagcgcgucggcgccg

SEQ ID NO: 345215 - RNA, 18 nt, Bordetella pertussis
cagcgcucgggcucgcgc

SEQ ID NO: 345216 - RNA, 18 nt, Bordetella pertussis
cagcgcucuauucggcca

SEQ ID NO: 345217 - RNA, 16 nt, Bordetella pertussis
cagcgcuguccaggcc

SEQ ID NO: 345218 - RNA, 18 nt, Bordetella pertussis
cagcgcuguccaggccgg

SEQ ID NO: 345219 - RNA, 13 nt, Bordetella pertussis
cagcgcuucgggc

SEQ ID NO: 345220 - RNA, 15 nt, Bordetella pertussis
cagcgcuucgggcag

SEQ ID NO: 345221 - RNA, 18 nt, Bordetella pertussis
cagcgcuucgugcagcgc

SEQ ID NO: 345222 - RNA, 19 nt, Bordetella pertussis
cagcgcuucgugcagcgcg

SEQ ID NO: 345223 - RNA, 15 nt, Bordetella pertussis
cagcgcuugcacgcc

SEQ ID NO: 345224 - RNA, 15 nt, Bordetella pertussis
cagcggagccgcgca

SEQ ID NO: 345225 - RNA, 24 nt, Bordetella pertussis
cagcggagccgcgcacacauggcg

SEQ ID NO: 345226 - RNA, 15 nt, Bordetella pertussis
cagcggagcgacggc

SEQ ID NO: 345227 - RNA, 16 nt, Bordetella pertussis
cagcggagcgacggca

SEQ ID NO: 345228 - RNA, 18 nt, Bordetella pertussis
cagcggacguuggccgau

SEQ ID NO: 345229 - RNA, 13 nt, Bordetella pertussis
cagcggaucgccg

SEQ ID NO: 345230 - RNA, 16 nt, Bordetella pertussis
cagcggaucgccgggc

SEQ ID NO: 345231 - RNA, 18 nt, Bordetella pertussis
cagcggaugaugcggcgc

SEQ ID NO: 345232 - RNA, 20 nt, Bordetella pertussis
cagcggaugaugcggcgcca

SEQ ID NO: 345233 - RNA, 19 nt, Bordetella pertussis
cagcggauggugcucggcg

SEQ ID NO: 345234 - RNA, 17 nt, Bordetella pertussis
cagcggauugaccagcg

SEQ ID NO: 345235 - RNA, 18 nt, Bordetella pertussis
cagcggauugaccagcgc

SEQ ID NO: 345236 - RNA, 19 nt, Bordetella pertussis
cagcggauugaccagcgcg

SEQ ID NO: 345237 - RNA, 23 nt, Bordetella pertussis
cagcggauugaccagcgcggccg

SEQ ID NO: 345238 - RNA, 12 nt, Bordetella pertussis
cagcggcacgcc

SEQ ID NO: 345239 - RNA, 13 nt, Bordetella pertussis
cagcggcacgccg

SEQ ID NO: 345240 - RNA, 15 nt, Bordetella pertussis
cagcggcacgccggc

SEQ ID NO: 345241 - RNA, 18 nt, Bordetella pertussis
cagcggcacgccggcggc

SEQ ID NO: 345242 - RNA, 13 nt, Bordetella pertussis
cagcggcagcagc

SEQ ID NO: 345243 - RNA, 20 nt, Bordetella pertussis
cagcggcagcauggcgcgcg

SEQ ID NO: 345244 - RNA, 16 nt, Bordetella pertussis
cagcggcagcgcaccg

SEQ ID NO: 345245 - RNA, 14 nt, Bordetella pertussis
cagcggcagcgcgc

SEQ ID NO: 345246 - RNA, 15 nt, Bordetella pertussis
cagcggcagcgcgca

SEQ ID NO: 345247 - RNA, 13 nt, Bordetella pertussis
cagcggcagcggg

SEQ ID NO: 345248 - RNA, 14 nt, Bordetella pertussis
cagcggcaggccca

SEQ ID NO: 345249 - RNA, 14 nt, Bordetella pertussis
cagcggcaggcccu

SEQ ID NO: 345250 - RNA, 21 nt, Bordetella pertussis
cagcggcaggcuggccggcgu

SEQ ID NO: 345251 - RNA, 22 nt, Bordetella pertussis
cagcggcaggggcucgcgcccg

SEQ ID NO: 345252 - RNA, 17 nt, Bordetella pertussis
cagcggcaucacgccgg

SEQ ID NO: 345253 - RNA, 13 nt, Bordetella pertussis
cagcggcauugcc

SEQ ID NO: 345254 - RNA, 15 nt, Bordetella pertussis
cagcggccagaucgg

SEQ ID NO: 345255 - RNA, 16 nt, Bordetella pertussis
cagcggccagcgcggc

SEQ ID NO: 345256 - RNA, 17 nt, Bordetella pertussis
cagcggccagcgcggcg

SEQ ID NO: 345257 - RNA, 20 nt, Bordetella pertussis
cagcggccagcgcggcggca

SEQ ID NO: 345258 - RNA, 14 nt, Bordetella pertussis
cagcggccagucca

SEQ ID NO: 345259 - RNA, 20 nt, Bordetella pertussis
cagcggccaguccaccuuga

SEQ ID NO: 345260 - RNA, 18 nt, Bordetella pertussis
cagcggccgcugccgcgc

SEQ ID NO: 345261 - RNA, 22 nt, Bordetella pertussis
cagcggccgcugccgcgcgccg

SEQ ID NO: 345262 - RNA, 15 nt, Bordetella pertussis
cagcggccgucgccu

SEQ ID NO: 345263 - RNA, 16 nt, Bordetella pertussis
cagcggccgucgccuu

SEQ ID NO: 345264 - RNA, 23 nt, Bordetella pertussis
cagcggccgucgccuucggcggc

SEQ ID NO: 345265 - RNA, 13 nt, Bordetella pertussis
cagcggcgacggc

SEQ ID NO: 345266 - RNA, 14 nt, Bordetella pertussis
cagcggcgacggcg

SEQ ID NO: 345267 - RNA, 23 nt, Bordetella pertussis
cagcggcgacggcgccuggcgca

SEQ ID NO: 345268 - RNA, 23 nt, Bordetella pertussis
cagcggcgacugccccagcggcu

SEQ ID NO: 345269 - RNA, 16 nt, Bordetella pertussis
cagcggcgcagccggc

SEQ ID NO: 345270 - RNA, 14 nt, Bordetella pertussis
cagcggcgccagcg

SEQ ID NO: 345271 - RNA, 15 nt, Bordetella pertussis
cagcggcgccaugcg

SEQ ID NO: 345272 - RNA, 23 nt, Bordetella pertussis
cagcggcgccaugcgcaccaccg

SEQ ID NO: 345273 - RNA, 16 nt, Bordetella pertussis
cagcggcgcgacgcgc

SEQ ID NO: 345274 - RNA, 17 nt, Bordetella pertussis
cagcggcgcgacgcgcu

SEQ ID NO: 345275 - RNA, 13 nt, Bordetella pertussis
cagcggcgcgagc

SEQ ID NO: 345276 - RNA, 13 nt, Bordetella pertussis
cagcggcgcgccc

SEQ ID NO: 345277 - RNA, 16 nt, Bordetella pertussis
cagcggcgcgcgcagg

SEQ ID NO: 345278 - RNA, 13 nt, Bordetella pertussis
cagcggcgcggcg

SEQ ID NO: 345279 - RNA, 16 nt, Bordetella pertussis
cagcggcggcacgcgc

SEQ ID NO: 345280 - RNA, 20 nt, Bordetella pertussis
cagcggcggcacgcgcgccg

SEQ ID NO: 345281 - RNA, 14 nt, Bordetella pertussis
cagcggcuggccac

SEQ ID NO: 345282 - RNA, 20 nt, Bordetella pertussis
cagcggcuggccacuggccg

SEQ ID NO: 345283 - RNA, 21 nt, Bordetella pertussis
cagcggcuggccacuggccgc

SEQ ID NO: 345284 - RNA, 14 nt, Bordetella pertussis
cagcggcuggcgca

SEQ ID NO: 345285 - RNA, 16 nt, Bordetella pertussis
cagcggcuggcgcacg

SEQ ID NO: 345286 - RNA, 17 nt, Bordetella pertussis
cagcggcuggcggugcg

SEQ ID NO: 345287 - RNA, 18 nt, Bordetella pertussis
cagcggcuucaugccggc

SEQ ID NO: 345288 - RNA, 19 nt, Bordetella pertussis
cagcggcuucaugccggcg

SEQ ID NO: 345289 - RNA, 19 nt, Bordetella pertussis
cagcggcuucgagcgcgac

SEQ ID NO: 345290 - RNA, 21 nt, Bordetella pertussis
cagcgggcccgucgcgccagg

SEQ ID NO: 345291 - RNA, 19 nt, Bordetella pertussis
cagcgggccgcagcauggc

SEQ ID NO: 345292 - RNA, 16 nt, Bordetella pertussis
cagcgggccggcacca

SEQ ID NO: 345293 - RNA, 18 nt, Bordetella pertussis
cagcgggccggcaccacg

SEQ ID NO: 345294 - RNA, 17 nt, Bordetella pertussis
cagcgggcgcgcccggc

SEQ ID NO: 345295 - RNA, 22 nt, Bordetella pertussis
cagcgggcgcgcccggcgcgcc

SEQ ID NO: 345296 - RNA, 17 nt, Bordetella pertussis
cagcggugcgcggcgca

SEQ ID NO: 345297 - RNA, 20 nt, Bordetella pertussis
cagcgguucgucggcgcucu

SEQ ID NO: 345298 - RNA, 15 nt, Bordetella pertussis
cagcgucgcggcguc

SEQ ID NO: 345299 - RNA, 22 nt, Bordetella pertussis
cagcgucggcguaaggccgccg

SEQ ID NO: 345300 - RNA, 14 nt, Bordetella pertussis
cagcgugcccagcg

SEQ ID NO: 345301 - RNA, 15 nt, Bordetella pertussis
cagcgugcccagcga

SEQ ID NO: 345302 - RNA, 13 nt, Bordetella pertussis
cagcgugccgccg

SEQ ID NO: 345303 - RNA, 14 nt, Bordetella pertussis
cagcgugccgccgg

SEQ ID NO: 345304 - RNA, 15 nt, Bordetella pertussis
cagcgugccgccggc

SEQ ID NO: 345305 - RNA, 16 nt, Bordetella pertussis
cagcgugccgccggcg

SEQ ID NO: 345306 - RNA, 10 nt, Bordetella pertussis
cagcgugcgc

SEQ ID NO: 345307 - RNA, 16 nt, Bordetella pertussis
cagcgugcgccccgcc

SEQ ID NO: 345308 - RNA, 20 nt, Bordetella pertussis
cagcgugcgccccgccucga

SEQ ID NO: 345309 - RNA, 22 nt, Bordetella pertussis
cagcgugcugcguaucugaucg

SEQ ID NO: 345310 - RNA, 12 nt, Bordetella pertussis
cagcguggccac

SEQ ID NO: 345311 - RNA, 16 nt, Bordetella pertussis
cagcguggccgaggug

SEQ ID NO: 345312 - RNA, 16 nt, Bordetella pertussis
cagcguggccgccacc

SEQ ID NO: 345313 - RNA, 20 nt, Bordetella pertussis
cagcguggccgccaccagcg

SEQ ID NO: 345314 - RNA, 17 nt, Bordetella pertussis
cagcguggcgcagucga

SEQ ID NO: 345315 - RNA, 17 nt, Bordetella pertussis
cagcguggcgcgggugg

SEQ ID NO: 345316 - RNA, 20 nt, Bordetella pertussis
cagcguggcgcggguggccg

SEQ ID NO: 345317 - RNA, 14 nt, Bordetella pertussis
cagcgugggcucga

SEQ ID NO: 345318 - RNA, 20 nt, Bordetella pertussis
cagcguguagagcaggccgc

SEQ ID NO: 345319 - RNA, 22 nt, Bordetella pertussis
cagcguguagagcaggccgccc

SEQ ID NO: 345320 - RNA, 19 nt, Bordetella pertussis
cagcguguaggcggccggc

SEQ ID NO: 345321 - RNA, 20 nt, Bordetella pertussis
cagcguguaggcggccggcu

SEQ ID NO: 345322 - RNA, 13 nt, Bordetella pertussis
cagcgugucgccg

SEQ ID NO: 345323 - RNA, 17 nt, Bordetella pertussis
caggaccguccgcgacg

SEQ ID NO: 345324 - RNA, 16 nt, Bordetella pertussis
caggacgaucccggcc

SEQ ID NO: 345325 - RNA, 23 nt, Bordetella pertussis
caggacggcaucuguccgcgccg

SEQ ID NO: 345326 - RNA, 22 nt, Bordetella pertussis
caggaguucccagcgcgcgaau

SEQ ID NO: 345327 - RNA, 21 nt, Bordetella pertussis
caggaucaccguuuggccugc

SEQ ID NO: 345328 - RNA, 23 nt, Bordetella pertussis
caggaucagcuugaugccggcgu

SEQ ID NO: 345329 - RNA, 14 nt, Bordetella pertussis
caggaucaggccgg

SEQ ID NO: 345330 - RNA, 20 nt, Bordetella pertussis
caggaugcgcuggccggccg

SEQ ID NO: 345331 - RNA, 19 nt, Bordetella pertussis
caggauggagagggccugg

SEQ ID NO: 345332 - RNA, 23 nt, Bordetella pertussis
caggauggcgccagcccgcccgc

SEQ ID NO: 345333 - RNA, 21 nt, Bordetella pertussis
caggauggcgucgaccgccau

SEQ ID NO: 345334 - RNA, 18 nt, Bordetella pertussis
caggaugggcagcucgcc

SEQ ID NO: 345335 - RNA, 16 nt, Bordetella pertussis
caggaugggcgcggcg

SEQ ID NO: 345336 - RNA, 22 nt, Bordetella pertussis
caggaugggcgcggcgcgcgcc

SEQ ID NO: 345337 - RNA, 23 nt, Bordetella pertussis
caggaugggcgcggcgcgcgccg

SEQ ID NO: 345338 - RNA, 21 nt, Bordetella pertussis
caggauuucauggcaucggcu

SEQ ID NO: 345339 - RNA, 16 nt, Bordetella pertussis
caggauuuccucgccg

SEQ ID NO: 345340 - RNA, 15 nt, Bordetella pertussis
caggcaaagccugac

SEQ ID NO: 345341 - RNA, 17 nt, Bordetella pertussis
caggcaaaggcccaggc

SEQ ID NO: 345342 - RNA, 23 nt, Bordetella pertussis
caggcacgacgcgaaccaggcca

SEQ ID NO: 345343 - RNA, 12 nt, Bordetella pertussis
caggcacgccgg

SEQ ID NO: 345344 - RNA, 14 nt, Bordetella pertussis
caggcacgcgccga

SEQ ID NO: 345345 - RNA, 18 nt, Bordetella pertussis
caggcaccuuggcccggc

SEQ ID NO: 345346 - RNA, 17 nt, Bordetella pertussis
caggcacuggcgcggcg

SEQ ID NO: 345347 - RNA, 18 nt, Bordetella pertussis
caggcacucugccguggg

SEQ ID NO: 345348 - RNA, 20 nt, Bordetella pertussis
caggcagacgaugcccaggc

SEQ ID NO: 345349 - RNA, 17 nt, Bordetella pertussis
caggcagccggccccgc

SEQ ID NO: 345350 - RNA, 15 nt, Bordetella pertussis
caggcagcggccgcg

SEQ ID NO: 345351 - RNA, 16 nt, Bordetella pertussis
caggcagcggccgcgc

SEQ ID NO: 345352 - RNA, 16 nt, Bordetella pertussis
caggcaggcgcgccgg

SEQ ID NO: 345353 - RNA, 13 nt, Bordetella pertussis
caggcaggcgggc

SEQ ID NO: 345354 - RNA, 17 nt, Bordetella pertussis
caggcaguacgagcggc

SEQ ID NO: 345355 - RNA, 19 nt, Bordetella pertussis
caggcaguuggcggcgcag

SEQ ID NO: 345356 - RNA, 23 nt, Bordetella pertussis
caggcaguuggcggcgcagccgc

SEQ ID NO: 345357 - RNA, 18 nt, Bordetella pertussis
caggcagugguggugcag

SEQ ID NO: 345358 - RNA, 15 nt, Bordetella pertussis
caggccagugccugg

SEQ ID NO: 345359 - RNA, 17 nt, Bordetella pertussis
caggccagugccuggac

SEQ ID NO: 345360 - RNA, 18 nt, Bordetella pertussis
caggccagugccuggacg

SEQ ID NO: 345361 - RNA, 22 nt, Bordetella pertussis
caggccagugccuggacgcgcu

SEQ ID NO: 345362 - RNA, 22 nt, Bordetella pertussis
caggccagugauggccugcuug

SEQ ID NO: 345363 - RNA, 15 nt, Bordetella pertussis
caggccaucggcgcc

SEQ ID NO: 345364 - RNA, 16 nt, Bordetella pertussis
caggccaucggcgcca

SEQ ID NO: 345365 - RNA, 15 nt, Bordetella pertussis
caggccaugcugggc

SEQ ID NO: 345366 - RNA, 20 nt, Bordetella pertussis
caggccaugcugggccauca

SEQ ID NO: 345367 - RNA, 18 nt, Bordetella pertussis
caggccauugcuggcgcg

SEQ ID NO: 345368 - RNA, 19 nt, Bordetella pertussis
caggccauugcuggcgcga

SEQ ID NO: 345369 - RNA, 14 nt, Bordetella pertussis
caggcccaccaggg

SEQ ID NO: 345370 - RNA, 16 nt, Bordetella pertussis
caggcccaccagggac

SEQ ID NO: 345371 - RNA, 17 nt, Bordetella pertussis
caggcccaccagggcca

SEQ ID NO: 345372 - RNA, 13 nt, Bordetella pertussis
caggcccaccgca

SEQ ID NO: 345373 - RNA, 16 nt, Bordetella pertussis
caggcccaccggcaug

SEQ ID NO: 345374 - RNA, 22 nt, Bordetella pertussis
caggcccaccggcaugccgucc

SEQ ID NO: 345375 - RNA, 19 nt, Bordetella pertussis
caggcccacggcaucgccg

SEQ ID NO: 345376 - RNA, 12 nt, Bordetella pertussis
caggcccagcac

SEQ ID NO: 345377 - RNA, 19 nt, Bordetella pertussis
caggcccagcacgaugagc

SEQ ID NO: 345378 - RNA, 15 nt, Bordetella pertussis
caggcccacggcgcc

SEQ ID NO: 345379 - RNA, 14 nt, Bordetella pertussis
caggcccagcgcca

SEQ ID NO: 345380 - RNA, 15 nt, Bordetella pertussis
caggcccagcgccag

SEQ ID NO: 345381 - RNA, 13 nt, Bordetella pertussis
caggcccagcgcg

SEQ ID NO: 345382 - RNA, 15 nt, Bordetella pertussis
caggcccagcgcgcc

SEQ ID NO: 345383 - RNA, 12 nt, Bordetella pertussis
caggcccaggcg

SEQ ID NO: 345384 - RNA, 16 nt, Bordetella pertussis
caggcccaggcgaccc

SEQ ID NO: 345385 - RNA, 16 nt, Bordetella pertussis
caggcccagggccagg

SEQ ID NO: 345386 - RNA, 17 nt, Bordetella pertussis
caggcccagggccaggu

SEQ ID NO: 345387 - RNA, 13 nt, Bordetella pertussis
caggcccagggcg

SEQ ID NO: 345388 - RNA, 20 nt, Bordetella pertussis
caggcccaguucggcgcgcg

SEQ ID NO: 345389 - RNA, 13 nt, Bordetella pertussis
caggcccaguuga

SEQ ID NO: 345390 - RNA, 19 nt, Bordetella pertussis
caggcccauaugccgccgg

SEQ ID NO: 345391 - RNA, 23 nt, Bordetella pertussis
caggcccauaugccgccggccug

SEQ ID NO: 345392 - RNA, 19 nt, Bordetella pertussis
caggcccaugacgaccuug

SEQ ID NO: 345393 - RNA, 17 nt, Bordetella pertussis
caggcccaugauccgca

SEQ ID NO: 345394 - RNA, 16 nt, Bordetella pertussis
caggcccaugccgcgg

SEQ ID NO: 345395 - RNA, 13 nt, Bordetella pertussis
caggcccauggcg

SEQ ID NO: 345396 - RNA, 12 nt, Bordetella pertussis
caggccccggcc

SEQ ID NO: 345397 - RNA, 22 nt, Bordetella pertussis
caggccccggcccggcgggccg

SEQ ID NO: 345398 - RNA, 14 nt, Bordetella pertussis
caggccccggccgg

SEQ ID NO: 345399 - RNA, 20 nt, Bordetella pertussis
caggcccgaaacgcgcagca

SEQ ID NO: 345400 - RNA, 16 nt, Bordetella pertussis
caggcccgccacggcg

SEQ ID NO: 345401 - RNA, 15 nt, Bordetella pertussis
caggcccgcgcggcc

SEQ ID NO: 345402 - RNA, 16 nt, Bordetella pertussis
caggcccgcgcggcca

SEQ ID NO: 345403 - RNA, 18 nt, Bordetella pertussis
caggcccgcgcggccagc

SEQ ID NO: 345404 - RNA, 21 nt, Bordetella pertussis
caggcccgcgcggccagcgcc

SEQ ID NO: 345405 - RNA, 14 nt, Bordetella pertussis
caggcccgcggccg

SEQ ID NO: 345406 - RNA, 18 nt, Bordetella pertussis
caggcccggccgcagggc

SEQ ID NO: 345407 - RNA, 17 nt, Bordetella pertussis
caggccgaaccacagca

SEQ ID NO: 345408 - RNA, 20 nt, Bordetella pertussis
caggccgaacugggacaggc

SEQ ID NO: 345409 - RNA, 18 nt, Bordetella pertussis
caggccgaacuucagccc

SEQ ID NO: 345410 - RNA, 22 nt, Bordetella pertussis
caggccgaacuucagcccgggc

SEQ ID NO: 345411 - RNA, 20 nt, Bordetella pertussis
caggccgagaugugcggcgu

SEQ ID NO: 345412 - RNA, 18 nt, Bordetella pertussis
caggccgccacuugcggc

SEQ ID NO: 345413 - RNA, 16 nt, Bordetella pertussis
caggccgccagggccg

SEQ ID NO: 345414 - RNA, 13 nt, Bordetella pertussis
caggccgcccagc

SEQ ID NO: 345415 - RNA, 14 nt, Bordetella pertussis
caggccgcccagcg

SEQ ID NO: 345416 - RNA, 15 nt, Bordetella pertussis
caggccgccgccggu

SEQ ID NO: 345417 - RNA, 12 nt, Bordetella pertussis
caggccgccggc

SEQ ID NO: 345418 - RNA, 14 nt, Bordetella pertussis
caggccgccggcca

SEQ ID NO: 345419 - RNA, 16 nt, Bordetella pertussis
caggccgccggccagc

SEQ ID NO: 345420 - RNA, 19 nt, Bordetella pertussis
caggccgccggccagcgcc

SEQ ID NO: 345421 - RNA, 20 nt, Bordetella pertussis
caggccgccggccagcgcgg

SEQ ID NO: 345422 - RNA, 15 nt, Bordetella pertussis
caggccgccggcgcg

SEQ ID NO: 345423 - RNA, 17 nt, Bordetella pertussis
caggccgccggcgcggu

SEQ ID NO: 345424 - RNA, 15 nt, Bordetella pertussis
caggccgccggcggc

SEQ ID NO: 345425 - RNA, 15 nt, Bordetella pertussis
caggccgccggucac

SEQ ID NO: 345426 - RNA, 14 nt, Bordetella pertussis
caggccgcgccaca

SEQ ID NO: 345427 - RNA, 20 nt, Bordetella pertussis
caggccgcgccacaggcgcu

SEQ ID NO: 345428 - RNA, 21 nt, Bordetella pertussis
caggccgcgccggcucccgcg

SEQ ID NO: 345429 - RNA, 22 nt, Bordetella pertussis
caggccgcgcgcauccaggugc

SEQ ID NO: 345430 - RNA, 17 nt, Bordetella pertussis
caggccgcgcgugcggg

SEQ ID NO: 345431 - RNA, 19 nt, Bordetella pertussis
caggccgcgcgugcggggc

SEQ ID NO: 345432 - RNA, 13 nt, Bordetella pertussis
caggccgcgcugg

SEQ ID NO: 345433 - RNA, 15 nt, Bordetella pertussis
caggccgcgcagggc

SEQ ID NO: 345434 - RNA, 21 nt, Bordetella pertussis
caggccgcgcuggugcuggcc

SEQ ID NO: 345435 - RNA, 16 nt, Bordetella pertussis
caggccgcggccaggc

SEQ ID NO: 345436 - RNA, 19 nt, Bordetella pertussis
caggccgcggccaggccca

SEQ ID NO: 345437 - RNA, 14 nt, Bordetella pertussis
caggccgcggcgcc

SEQ ID NO: 345438 - RNA, 13 nt, Bordetella pertussis
caggccgcggcca

SEQ ID NO: 345439 - RNA, 13 nt, Bordetella pertussis
caggccgcugggc

SEQ ID NO: 345440 - RNA, 23 nt, Bordetella pertussis
caggccgcuucgaugcuggcggc

SEQ ID NO: 345441 - RNA, 20 nt, Bordetella pertussis
caggccggcaugcgccggcc

SEQ ID NO: 345442 - RNA, 16 nt, Bordetella pertussis
caggccggccagggcc

SEQ ID NO: 345443 - RNA, 17 nt, Bordetella pertussis
caggccggccagggcca

SEQ ID NO: 345444 - RNA, 18 nt, Bordetella pertussis
caggccggccagggccac

SEQ ID NO: 345445 - RNA, 12 nt, Bordetella pertussis
caggccgugagc

SEQ ID NO: 345446 - RNA, 20 nt, Bordetella pertussis
caggccguggcccagccgca

SEQ ID NO: 345447 - RNA, 17 nt, Bordetella pertussis
caggccguggcgcacca

SEQ ID NO: 345448 - RNA, 17 nt, Bordetella pertussis
caggccguuggccgcgc

SEQ ID NO: 345449 - RNA, 16 nt, Bordetella pertussis
caggccguuggcgcgc

SEQ ID NO: 345450 - RNA, 18 nt, Bordetella pertussis
caggccguuggcgcgccu

SEQ ID NO: 345451 - RNA, 18 nt, Bordetella pertussis
caggccguuguccuggcg

SEQ ID NO: 345452 - RNA, 21 nt, Bordetella pertussis
caggccguuguccuggcgcgc

SEQ ID NO: 345453 - RNA, 24 nt, Bordetella pertussis
caggccguuuacuccccagacgca

SEQ ID NO: 345454 - RNA, 16 nt, Bordetella pertussis
caggccugccugaugg

SEQ ID NO: 345455 - RNA, 21 nt, Bordetella pertussis
caggccucgcccgaucggccg

SEQ ID NO: 345456 - RNA, 14 nt, Bordetella pertussis
caggcgcaccagcg

SEQ ID NO: 345457 - RNA, 16 nt, Bordetella pertussis
caggcgcaccagcgcg

SEQ ID NO: 345458 - RNA, 20 nt, Bordetella pertussis
caggcgcaccagcgcgccga

SEQ ID NO: 345459 - RNA, 13 nt, Bordetella pertussis
caggcgcacgccg

SEQ ID NO: 345460 - RNA, 15 nt, Bordetella pertussis
caggcgcacggcggc

SEQ ID NO: 345461 - RNA, 23 nt, Bordetella pertussis
caggcgcagcccacucagggcgg

SEQ ID NO: 345462 - RNA, 16 nt, Bordetella pertussis
caggcgcagccgcgcg

SEQ ID NO: 345463 - RNA, 16 nt, Bordetella pertussis
caggcgcagcggcggc

SEQ ID NO: 345464 - RNA, 14 nt, Bordetella pertussis
caggcgcagcucga

SEQ ID NO: 345465 - RNA, 17 nt, Bordetella pertussis
caggcgcagcucgaccg

SEQ ID NO: 345466 - RNA, 13 nt, Bordetella pertussis
caggcgcaggccg

SEQ ID NO: 345467 - RNA, 14 nt, Bordetella pertussis
caggcgcaggccgc

SEQ ID NO: 345468 - RNA, 15 nt, Bordetella pertussis
caggcgcaggccgcg

SEQ ID NO: 345469 - RNA, 16 nt, Bordetella pertussis
caggcgcaggccgcgc

SEQ ID NO: 345470 - RNA, 18 nt, Bordetella pertussis
caggcgcaggccgcgcgc

SEQ ID NO: 345471 - RNA, 15 nt, Bordetella pertussis
caggcgcaggcgcga

SEQ ID NO: 345472 - RNA, 19 nt, Bordetella pertussis
caggcgcaguaucuggugc

SEQ ID NO: 345473 - RNA, 20 nt, Bordetella pertussis
caggcgcaucagcuuggcca

SEQ ID NO: 345474 - RNA, 17 nt, Bordetella pertussis
caggcgcaucgacagcg

SEQ ID NO: 345475 - RNA, 18 nt, Bordetella pertussis
caggcgcaucgacagcgc

SEQ ID NO: 345476 - RNA, 21 nt, Bordetella pertussis
caggcgcaucgacagcgcgcc

SEQ ID NO: 345477 - RNA, 22 nt, Bordetella pertussis
caggcgcauguccgccacgccg

SEQ ID NO: 345478 - RNA, 23 nt, Bordetella pertussis
caggcgcauguccgccacgccgg

SEQ ID NO: 345479 - RNA, 16 nt, Bordetella pertussis
caggcgcccgugcgcg

SEQ ID NO: 345480 - RNA, 19 nt, Bordetella pertussis
caggcgccgauccagggcc

SEQ ID NO: 345481 - RNA, 20 nt, Bordetella pertussis
caggcgccgauccagggccg

SEQ ID NO: 345482 - RNA, 16 nt, Bordetella pertussis
caggcgccgcacccga

SEQ ID NO: 345483 - RNA, 16 nt, Bordetella pertussis
caggcgccgcacgccg

SEQ ID NO: 345484 - RNA, 17 nt, Bordetella pertussis
caggcgccgcacgccgg

SEQ ID NO: 345485 - RNA, 13 nt, Bordetella pertussis
caggcgccgcaga

SEQ ID NO: 345486 - RNA, 21 nt, Bordetella pertussis
caggcgcccaacccaggucgc

SEQ ID NO: 345487 - RNA, 19 nt, Bordetella pertussis
caggcgcccgccaccagga

SEQ ID NO: 345488 - RNA, 18 nt, Bordetella pertussis
caggcgccgccgcccggc

SEQ ID NO: 345489 - RNA, 11 nt, Bordetella pertussis
caggcgccgcg

SEQ ID NO: 345490 - RNA, 23 nt, Bordetella pertussis
caggcgccgcguccggcgcccgc

SEQ ID NO: 345491 - RNA, 14 nt, Bordetella pertussis
caggcgccggcugg

SEQ ID NO: 345492 - RNA, 13 nt, Bordetella pertussis
caggcgccgucga

SEQ ID NO: 345493 - RNA, 15 nt, Bordetella pertussis
caggcgccucgcgac

SEQ ID NO: 345494 - RNA, 18 nt, Bordetella pertussis
caggcgccucgcgacggc

SEQ ID NO: 345495 - RNA, 22 nt, Bordetella pertussis
caggcgccugccccgccgggac

SEQ ID NO: 345496 - RNA, 19 nt, Bordetella pertussis
caggcgccuucggcgcggc

SEQ ID NO: 345497 - RNA, 20 nt, Bordetella pertussis
caggcgccuuucccgcgccg

SEQ ID NO: 345498 - RNA, 14 nt, Bordetella pertussis
caggcgcgagcgcc

SEQ ID NO: 345499 - RNA, 18 nt, Bordetella pertussis
caggcgcgagguggcgcu

SEQ ID NO: 345500 - RNA, 20 nt, Bordetella pertussis
caggcgcgagguggcgcucg

SEQ ID NO: 345501 - RNA, 13 nt, Bordetella pertussis
caggcggagucgc

SEQ ID NO: 345502 - RNA, 22 nt, Bordetella pertussis
caggcggaucucuccgaacgcg

SEQ ID NO: 345503 - RNA, 24 nt, Bordetella pertussis
caggcggaugcgguacugcggcgc

SEQ ID NO: 345504 - RNA, 15 nt, Bordetella pertussis
caggcggcaggcgcc

SEQ ID NO: 345505 - RNA, 14 nt, Bordetella pertussis
caggcggccagggc

SEQ ID NO: 345506 - RNA, 15 nt, Bordetella pertussis
caggcggccagggcc

SEQ ID NO: 345507 - RNA, 18 nt, Bordetella pertussis
caggcggccaguucgucc

SEQ ID NO: 345508 - RNA, 16 nt, Bordetella pertussis
caggcggccaucgccg

SEQ ID NO: 345509 - RNA, 15 nt, Bordetella pertussis
caggcggccgaccag

SEQ ID NO: 345510 - RNA, 16 nt, Bordetella pertussis
caggcggccgaccagc

SEQ ID NO: 345511 - RNA, 21 nt, Bordetella pertussis
caggcggccaccaccaggccc

SEQ ID NO: 345512 - RNA, 13 nt, Bordetella pertussis
caggcggcgacga

SEQ ID NO: 345513 - RNA, 16 nt, Bordetella pertussis
caggcggcgcaucagc

SEQ ID NO: 345514 - RNA, 14 nt, Bordetella pertussis
caggcggcgccggc

SEQ ID NO: 345515 - RNA, 13 nt, Bordetella pertussis
caggcggcgcggc

SEQ ID NO: 345516 - RNA, 13 nt, Bordetella pertussis
caggcggcgcucg

SEQ ID NO: 345517 - RNA, 22 nt, Bordetella pertussis
caggcggcggccuccagcaggg

SEQ ID NO: 345518 - RNA, 18 nt, Bordetella pertussis
caggcggcggcgcggcgc

SEQ ID NO: 345519 - RNA, 21 nt, Bordetella pertussis
caggcggcguaguucagccac

SEQ ID NO: 345520 - RNA, 21 nt, Bordetella pertussis
caggcggcugcccaccuugcg

SEQ ID NO: 345521 - RNA, 17 nt, Bordetella pertussis
caggcggcuggugccga

SEQ ID NO: 345522 - RNA, 19 nt, Bordetella pertussis
caggcggcuguagucgccg

SEQ ID NO: 345523 - RNA, 21 nt, Bordetella pertussis
caggcggcuguagucgccgcu

SEQ ID NO: 345524 - RNA, 18 nt, Bordetella pertussis
caggcggcuuucaugggc

SEQ ID NO: 345525 - RNA, 13 nt, Bordetella pertussis
caggcgggcgccg

SEQ ID NO: 345526 - RNA, 15 nt, Bordetella pertussis
caggcggcugaagaa

SEQ ID NO: 345527 - RNA, 20 nt, Bordetella pertussis
caggcgggguggcacagccg

SEQ ID NO: 345528 - RNA, 23 nt, Bordetella pertussis
caggcggguguagaagaacagca

SEQ ID NO: 345529 - RNA, 16 nt, Bordetella pertussis
caggcgguacaggccg

SEQ ID NO: 345530 - RNA, 21 nt, Bordetella pertussis
caggcgguacaggccggcggc

SEQ ID NO: 345531 - RNA, 17 nt, Bordetella pertussis
caggcggugccccggcc

SEQ ID NO: 345532 - RNA, 13 nt, Bordetella pertussis
caggcggugcgcg

SEQ ID NO: 345533 - RNA, 14 nt, Bordetella pertussis
caggcggugcgcgc

SEQ ID NO: 345534 - RNA, 17 nt, Bordetella pertussis
caggcggugcgcgcggc

SEQ ID NO: 345535 - RNA, 19 nt, Bordetella pertussis
caggcggugcgcgcggccg

SEQ ID NO: 345536 - RNA, 20 nt, Bordetella pertussis
caggcggugcgcgcggccga

SEQ ID NO: 345537 - RNA, 14 nt, Bordetella pertussis
caggcgguuggccu

SEQ ID NO: 345538 - RNA, 15 nt, Bordetella pertussis
caggcgguuggccuu

SEQ ID NO: 345539 - RNA, 19 nt, Bordetella pertussis
caggcgguuggccuugacg

SEQ ID NO: 345540 - RNA, 22 nt, Bordetella pertussis
caggcguacgaggaccuguggc

SEQ ID NO: 345541 - RNA, 21 nt, Bordetella pertussis
caggcguacgcuuaucgcggc

SEQ ID NO: 345542 - RNA, 22 nt, Bordetella pertussis
caggcguccaggcugccggcgu

SEQ ID NO: 345543 - RNA, 18 nt, Bordetella pertussis
caggcgucggccagcgcg

SEQ ID NO: 345544 - RNA, 17 nt, Bordetella pertussis
caggcgucggcggccca

SEQ ID NO: 345545 - RNA, 16 nt, Bordetella pertussis
caggcugaccagcgcg

SEQ ID NO: 345546 - RNA, 19 nt, Bordetella pertussis
caggcugaccagcgcgucg

SEQ ID NO: 345547 - RNA, 15 nt, Bordetella pertussis
caggcugaccagcgc

SEQ ID NO: 345548 - RNA, 14 nt, Bordetella pertussis
caggcugagcguga

SEQ ID NO: 345549 - RNA, 21 nt, Bordetella pertussis
caggcugaucacccacagcag

SEQ ID NO: 345550 - RNA, 17 nt, Bordetella pertussis
caggcugcccuggccca

SEQ ID NO: 345551 - RNA, 15 nt, Bordetella pertussis
caggcugccgccggc

SEQ ID NO: 345552 - RNA, 14 nt, Bordetella pertussis
caggcugccggcgu

SEQ ID NO: 345553 - RNA, 14 nt, Bordetella pertussis
caggcugcgcgccg

SEQ ID NO: 345554 - RNA, 18 nt, Bordetella pertussis
caggcugcgcgucggcag

SEQ ID NO: 345555 - RNA, 23 nt, Bordetella pertussis
caggcugcgcgucggcaggugca

SEQ ID NO: 345556 - RNA, 15 nt, Bordetella pertussis
caggcugggcgaaac

SEQ ID NO: 345557 - RNA, 20 nt, Bordetella pertussis
caggcugggcgaaacggcca

SEQ ID NO: 345558 - RNA, 21 nt, Bordetella pertussis
caggcugggcgaaacggccag

SEQ ID NO: 345559 - RNA, 17 nt, Bordetella pertussis
caggcuggggccgagcg

SEQ ID NO: 345560 - RNA, 18 nt, Bordetella pertussis
caggcugcgcaggcgccg

SEQ ID NO: 345561 - RNA, 23 nt, Bordetella pertussis
caggcugguggcgucgaguucga

SEQ ID NO: 345562 - RNA, 19 nt, Bordetella pertussis
caggcugucccagauggcg

SEQ ID NO: 345563 - RNA, 23 nt, Bordetella pertussis
caggcugucccagauggcgccuu

SEQ ID NO: 345564 - RNA, 17 nt, Bordetella pertussis
caggcuguggccgcggc

SEQ ID NO: 345565 - RNA, 20 nt, Bordetella pertussis
caggcuguggccgcggccca

SEQ ID NO: 345566 - RNA, 14 nt, Bordetella pertussis
caggcuugcagcaa

SEQ ID NO: 345567 - RNA, 22 nt, Bordetella pertussis
cagggcaaagaaauugggcgug

SEQ ID NO: 345568 - RNA, 13 nt, Bordetella pertussis
cagggcagcggcc

SEQ ID NO: 345569 - RNA, 18 nt, Bordetella pertussis
cagggccccuccggcgcc

SEQ ID NO: 345570 - RNA, 13 nt, Bordetella pertussis
cagggccgcagca

SEQ ID NO: 345571 - RNA, 17 nt, Bordetella pertussis
cagggccgccagcaccu

SEQ ID NO: 345572 - RNA, 23 nt, Bordetella pertussis
cagggccgccgcgcccagccgcg

SEQ ID NO: 345573 - RNA, 19 nt, Bordetella pertussis
cagggccgcgagcaugcgc

SEQ ID NO: 345574 - RNA, 20 nt, Bordetella pertussis
cagggccgcgagcaugcgca

SEQ ID NO: 345575 - RNA, 14 nt, Bordetella pertussis
cagggccgcgccgg

SEQ ID NO: 345576 - RNA, 14 nt, Bordetella pertussis
cagggccgcccagu

SEQ ID NO: 345577 - RNA, 20 nt, Bordetella pertussis
cagggccgugcccgagggcg

SEQ ID NO: 345578 - RNA, 18 nt, Bordetella pertussis
cagggccuccugcagcag

SEQ ID NO: 345579 - RNA, 23 nt, Bordetella pertussis
cagggccuccugcagcaggucgg

SEQ ID NO: 345580 - RNA, 17 nt, Bordetella pertussis
cagggcgaaggccagcg

SEQ ID NO: 345581 - RNA, 20 nt, Bordetella pertussis
cagggcgaucagcaccgcgg

SEQ ID NO: 345582 - RNA, 17 nt, Bordetella pertussis
cagggcgaugcggcggc

SEQ ID NO: 345583 - RNA, 16 nt, Bordetella pertussis
cagggcgcaacgccgg

SEQ ID NO: 345584 - RNA, 18 nt, Bordetella pertussis
cagggcgcaacgccggcc

SEQ ID NO: 345585 - RNA, 15 nt, Bordetella pertussis
cagggcgcccgccga

SEQ ID NO: 345586 - RNA, 15 nt, Bordetella pertussis
cagggcgccgcggcg

SEQ ID NO: 345587 - RNA, 12 nt, Bordetella pertussis
cagggcgccggc

SEQ ID NO: 345588 - RNA, 14 nt, Bordetella pertussis
cagggcgccggcgu

SEQ ID NO: 345589 - RNA, 19 nt, Bordetella pertussis
cagggcgcgcagcaggccc

SEQ ID NO: 345590 - RNA, 20 nt, Bordetella pertussis
cagggcgcgcagcaggccca

SEQ ID NO: 345591 - RNA, 21 nt, Bordetella pertussis
cagggcgcgcagcaggcccau

SEQ ID NO: 345592 - RNA, 21 nt, Bordetella pertussis
cagggcgcgccgcagcguggc

SEQ ID NO: 345593 - RNA, 21 nt, Bordetella pertussis
cagggcgccgaccgggccgac

SEQ ID NO: 345594 - RNA, 14 nt, Bordetella pertussis
cagggcggccaggc

SEQ ID NO: 345595 - RNA, 19 nt, Bordetella pertussis
cagggcggccggcacgccg

SEQ ID NO: 345596 - RNA, 14 nt, Bordetella pertussis
cagggcggccucga

SEQ ID NO: 345597 - RNA, 19 nt, Bordetella pertussis
cagggcggccucgacggcc

SEQ ID NO: 345598 - RNA, 20 nt, Bordetella pertussis
cagggcggccucgacggccg

SEQ ID NO: 345599 - RNA, 23 nt, Bordetella pertussis
cagggcgggggacgcccgcccgc

SEQ ID NO: 345600 - RNA, 13 nt, Bordetella pertussis
cagggcggugcgc

SEQ ID NO: 345601 - RNA, 19 nt, Bordetella pertussis
cagggcggugggcagcgcg

SEQ ID NO: 345602 - RNA, 14 nt, Bordetella pertussis
cagggcgucggccg

SEQ ID NO: 345603 - RNA, 18 nt, Bordetella pertussis
cagggcgucugcucgccg

SEQ ID NO: 345604 - RNA, 12 nt, Bordetella pertussis
cagggcgugcgg

SEQ ID NO: 345605 - RNA, 23 nt, Bordetella pertussis
cagggcugaucuugaugcggccg

SEQ ID NO: 345606 - RNA, 16 nt, Bordetella pertussis
cagggcuuccaguucg

SEQ ID NO: 345607 - RNA, 18 nt, Bordetella pertussis
cagggcuugacgcgcguu

SEQ ID NO: 345608 - RNA, 19 nt, Bordetella pertussis
cagggcuugcggcgcuggc

SEQ ID NO: 345609 - RNA, 14 nt, Bordetella pertussis
caggggcaggcgca

SEQ ID NO: 345610 - RNA, 14 nt, Bordetella pertussis
caggggcaugccgg

SEQ ID NO: 345611 - RNA, 19 nt, Bordetella pertussis
caggggccggcgcgccgcg

SEQ ID NO: 345612 - RNA, 21 nt, Bordetella pertussis
caggggccggcgcgccgcgcc

SEQ ID NO: 345613 - RNA, 16 nt, Bordetella pertussis
caggggcgcuggucga

SEQ ID NO: 345614 - RNA, 17 nt, Bordetella pertussis
caggggcucgcgcccga

SEQ ID NO: 345615 - RNA, 14 nt, Bordetella pertussis
caggggcucggcca

SEQ ID NO: 345616 - RNA, 19 nt, Bordetella pertussis
caggggcucuucgacagcg

SEQ ID NO: 345617 - RNA, 18 nt, Bordetella pertussis
cagggggacuggcacccg

SEQ ID NO: 345618 - RNA, 20 nt, Bordetella pertussis
cagggggucuggcaccugcc

SEQ ID NO: 345619 - RNA, 20 nt, Bordetella pertussis
caggggguggcggccgucgg

SEQ ID NO: 345620 - RNA, 13 nt, Bordetella pertussis
cagggucaaggcg

SEQ ID NO: 345621 - RNA, 18 nt, Bordetella pertussis
cagggucaaggcgcggcc

SEQ ID NO: 345622 - RNA, 19 nt, Bordetella pertussis
cagggucaaggcgcggccg

SEQ ID NO: 345623 - RNA, 16 nt, Bordetella pertussis
cagggucagcggccgg

SEQ ID NO: 345624 - RNA, 18 nt, Bordetella pertussis
cagggucgagaccagcag

SEQ ID NO: 345625 - RNA, 21 nt, Bordetella pertussis
cagggucgagaccagcagcgg

SEQ ID NO: 345626 - RNA, 21 nt, Bordetella pertussis
cagggucagggugucgccggg

SEQ ID NO: 345627 - RNA, 12 nt, Bordetella pertussis
caggguggccgc

SEQ ID NO: 345628 - RNA, 17 nt, Bordetella pertussis
caggguggcgcccaggu

SEQ ID NO: 345629 - RNA, 15 nt, Bordetella pertussis
caggguggcgccggc

SEQ ID NO: 345630 - RNA, 17 nt, Bordetella pertussis
caggguggcgccggcca

SEQ ID NO: 345631 - RNA, 21 nt, Bordetella pertussis
caggguggcgccggccaccgc

SEQ ID NO: 345632 - RNA, 14 nt, Bordetella pertussis
cagggugucggcca

SEQ ID NO: 345633 - RNA, 20 nt, Bordetella pertussis
cagggugucggccagggcgg

SEQ ID NO: 345634 - RNA, 23 nt, Bordetella pertussis
cagggugguggccucguaucgcc

SEQ ID NO: 345635 - RNA, 20 nt, Bordetella pertussis
cagguacccccagcggcgca

SEQ ID NO: 345636 - RNA, 17 nt, Bordetella pertussis
cagguagaccacgcgcu

SEQ ID NO: 345637 - RNA, 23 nt, Bordetella pertussis
cagguagaccacgcgcugcgcgc

SEQ ID NO: 345638 - RNA, 13 nt, Bordetella pertussis
cagguccagcgcc

SEQ ID NO: 345639 - RNA, 14 nt, Bordetella pertussis
cagguccagcgcca

SEQ ID NO: 345640 - RNA, 14 nt, Bordetella pertussis
cagguccgccggca

SEQ ID NO: 345641 - RNA, 21 nt, Bordetella pertussis
cagguccgccggcacgcgcgg

SEQ ID NO: 345642 - RNA, 23 nt, Bordetella pertussis
cagguccaugaacgccgcgcccg

SEQ ID NO: 345643 - RNA, 14 nt, Bordetella pertussis
cagguccauggcca

SEQ ID NO: 345644 - RNA, 16 nt, Bordetella pertussis
cagguccggucgcgcg

SEQ ID NO: 345645 - RNA, 23 nt, Bordetella pertussis
cagguccguguucgacgcggccg

SEQ ID NO: 345646 - RNA, 14 nt, Bordetella pertussis
cagguccuggcggc

SEQ ID NO: 345647 - RNA, 17 nt, Bordetella pertussis
caggucgaacaggcugg

SEQ ID NO: 345648 - RNA, 22 nt, Bordetella pertussis
caggucgaagcacugcaggcca

SEQ ID NO: 345649 - RNA, 21 nt, Bordetella pertussis
caggucgaccugcuugcccag

SEQ ID NO: 345650 - RNA, 20 nt, Bordetella pertussis
caggucgaguugguagcgca

SEQ ID NO: 345651 - RNA, 16 nt, Bordetella pertussis
caggucgaugccggcg

SEQ ID NO: 345652 - RNA, 17 nt, Bordetella pertussis
caggucgaugccggcgg

SEQ ID NO: 345653 - RNA, 15 nt, Bordetella pertussis
caggucggacgcgcc

SEQ ID NO: 345654 - RNA, 13 nt, Bordetella pertussis
caggucggagucg

SEQ ID NO: 345655 - RNA, 16 nt, Bordetella pertussis
caggucggccaccgcc

SEQ ID NO: 345656 - RNA, 16 nt, Bordetella pertussis
caggucggccagccgg

SEQ ID NO: 345657 - RNA, 20 nt, Bordetella pertussis
caggucggccagcgugccgg

SEQ ID NO: 345658 - RNA, 20 nt, Bordetella pertussis
caggucggccaggacggugu

SEQ ID NO: 345659 - RNA, 16 nt, Bordetella pertussis
caggucggcgcccacg

SEQ ID NO: 345660 - RNA, 19 nt, Bordetella pertussis
caggucggcgcccacgccg

SEQ ID NO: 345661 - RNA, 16 nt, Bordetella pertussis
caggucggcgcggggc

SEQ ID NO: 345662 - RNA, 13 nt, Bordetella pertussis
caggucggcgucg

SEQ ID NO: 345663 - RNA, 22 nt, Bordetella pertussis
caggucgggcacgaucaccgcc

SEQ ID NO: 345664 - RNA, 15 nt, Bordetella pertussis
caggugcuugcggcu

SEQ ID NO: 345665 - RNA, 14 nt, Bordetella pertussis
caggugcuuggcgg

SEQ ID NO: 345666 - RNA, 15 nt, Bordetella pertussis
cagguggccagcccg

SEQ ID NO: 345667 - RNA, 20 nt, Bordetella pertussis
cagguggcgcuguccggcgc

SEQ ID NO: 345668 - RNA, 23 nt, Bordetella pertussis
cagguggcgcuguccggcgcucg

SEQ ID NO: 345669 - RNA, 18 nt, Bordetella pertussis
cagguggcggacaggccc

SEQ ID NO: 345670 - RNA, 19 nt, Bordetella pertussis
cagguggcggacaggcccu

SEQ ID NO: 345671 - RNA, 14 nt, Bordetella pertussis
cagguggcggcggc

SEQ ID NO: 345672 - RNA, 18 nt, Bordetella pertussis
cagguggcgaugccgggc

SEQ ID NO: 345673 - RNA, 20 nt, Bordetella pertussis
caggugggcgcgcucagcgc

SEQ ID NO: 345674 - RNA, 18 nt, Bordetella pertussis
cagguucaugaccaucgc

SEQ ID NO: 345675 - RNA, 23 nt, Bordetella pertussis
cagguucaugaccaucgcgcacu

SEQ ID NO: 345676 - RNA, 17 nt, Bordetella pertussis
cagguucgccuggcggg

SEQ ID NO: 345677 - RNA, 21 nt, Bordetella pertussis
cagguucugcgcguccuggcg

SEQ ID NO: 345678 - RNA, 17 nt, Bordetella pertussis
cagguugaagccgacgg

SEQ ID NO: 345679 - RNA, 16 nt, Bordetella pertussis
cagguugaaggccgcg

SEQ ID NO: 345680 - RNA, 17 nt, Bordetella pertussis
cagguugagucuggaga

SEQ ID NO: 345681 - RNA, 18 nt, Bordetella pertussis
cagguugcgguaguucag

SEQ ID NO: 345682 - RNA, 14 nt, Bordetella pertussis
cagguuggccgcga

SEQ ID NO: 345683 - RNA, 19 nt, Bordetella pertussis
cagguuggcgauggcgucg

SEQ ID NO: 345684 - RNA, 19 nt, Bordetella pertussis
cagguuguccagcgcgccc

SEQ ID NO: 345685 - RNA, 20 nt, Bordetella pertussis
cagguuguccagcgcgccca

SEQ ID NO: 345686 - RNA, 23 nt, Bordetella pertussis
cagguuguccagcgcgcccagcg

SEQ ID NO: 345687 - RNA, 14 nt, Bordetella pertussis
cagguugucgcgcg

SEQ ID NO: 345688 - RNA, 15 nt, Bordetella pertussis
cagguugucggccau

SEQ ID NO: 345689 - RNA, 18 nt, Bordetella pertussis
cagguugucggccaugcg

SEQ ID NO: 345690 - RNA, 17 nt, Bordetella pertussis
caguacgaugccgucga

SEQ ID NO: 345691 - RNA, 12 nt, Bordetella pertussis
caguagcgccgg

SEQ ID NO: 345692 - RNA, 19 nt, Bordetella pertussis
caguagcguugcaguucgg

SEQ ID NO: 345693 - RNA, 14 nt, Bordetella pertussis
caguccagcgcgcc

SEQ ID NO: 345694 - RNA, 16 nt, Bordetella pertussis
caguccagcgcgccgc

SEQ ID NO: 345695 - RNA, 16 nt, Bordetella pertussis
caguccagcguggagc

SEQ ID NO: 345696 - RNA, 13 nt, Bordetella pertussis
caguccaggccgg

SEQ ID NO: 345697 - RNA, 15 nt, Bordetella pertussis
caguccaggccggcc

SEQ ID NO: 345698 - RNA, 21 nt, Bordetella pertussis
caguccccauguggggacagg

SEQ ID NO: 345699 - RNA, 18 nt, Bordetella pertussis
caguccccgcagggacag

SEQ ID NO: 345700 - RNA, 19 nt, Bordetella pertussis
cagucccgcaccgaccagc

SEQ ID NO: 345701 - RNA, 14 nt, Bordetella pertussis
cagucgaccacgcg

SEQ ID NO: 345702 - RNA, 16 nt, Bordetella pertussis
cagucgaguucgucgu

SEQ ID NO: 345703 - RNA, 17 nt, Bordetella pertussis
cagucgccgcgcccgcg

SEQ ID NO: 345704 - RNA, 17 nt, Bordetella pertussis
cagucggggccgcagcu

SEQ ID NO: 345705 - RNA, 13 nt, Bordetella pertussis
cagucggucgccg

SEQ ID NO: 345706 - RNA, 21 nt, Bordetella pertussis
cagucguccagcacgcggcgc

SEQ ID NO: 345707 - RNA, 12 nt, Bordetella pertussis
cagucgucgccg

SEQ ID NO: 345708 - RNA, 21 nt, Bordetella pertussis
cagucuccaggcucaggcggc

SEQ ID NO: 345709 - RNA, 20 nt, Bordetella pertussis
cagugcaggggguggcggcc

SEQ ID NO: 345710 - RNA, 14 nt, Bordetella pertussis
cagugcgccggcgc

SEQ ID NO: 345711 - RNA, 18 nt, Bordetella pertussis
cagugcgccggcgcggcg

SEQ ID NO: 345712 - RNA, 15 nt, Bordetella pertussis
cagugcuucgagauc

SEQ ID NO: 345713 - RNA, 23 nt, Bordetella pertussis
cagugucuaucauggccuuggca

SEQ ID NO: 345714 - RNA, 15 nt, Bordetella pertussis
cauacaaggcgcggc

SEQ ID NO: 345715 - RNA, 21 nt, Bordetella pertussis
cauacgacacgucaucguggc

SEQ ID NO: 345716 - RNA, 18 nt, Bordetella pertussis
cauacgacgcggcaugcg

SEQ ID NO: 345717 - RNA, 14 nt, Bordetella pertussis
cauacgccgccgag

SEQ ID NO: 345718 - RNA, 19 nt, Bordetella pertussis
cauacgccgauggcgcggc

SEQ ID NO: 345719 - RNA, 21 nt, Bordetella pertussis
cauacgcggguucgacgccgg

SEQ ID NO: 345720 - RNA, 21 nt, Bordetella pertussis
cauacggacgagcgcagcaag

SEQ ID NO: 345721 - RNA, 17 nt, Bordetella pertussis
cauacguagaccgcgaa

SEQ ID NO: 345722 - RNA, 18 nt, Bordetella pertussis
cauagacccacagguugg

SEQ ID NO: 345723 - RNA, 15 nt, Bordetella pertussis
cauagaccggcugca

SEQ ID NO: 345724 - RNA, 16 nt, Bordetella pertussis
cauagacgccgaccgc

SEQ ID NO: 345725 - RNA, 14 nt, Bordetella pertussis
cauagacgcgcagc

SEQ ID NO: 345726 - RNA, 23 nt, Bordetella pertussis
cauagagauuguccagcggcagc

SEQ ID NO: 345727 - RNA, 17 nt, Bordetella pertussis
cauagaucuccggcgcc

SEQ ID NO: 345728 - RNA, 13 nt, Bordetella pertussis
cauagcccggcgc

SEQ ID NO: 345729 - RNA, 14 nt, Bordetella pertussis
cauauucacagcca

SEQ ID NO: 345730 - RNA, 17 nt, Bordetella pertussis
cauauugaugcagcacg

SEQ ID NO: 345731 - RNA, 23 nt, Bordetella pertussis
cauauugaugcagcacgucggcg

SEQ ID NO: 345732 - RNA, 17 nt, Bordetella pertussis
caucaccaagggcgccg

SEQ ID NO: 345733 - RNA, 13 nt, Bordetella pertussis
caucacgagcagg

SEQ ID NO: 345734 - RNA, 21 nt, Bordetella pertussis
caucacgcggucgaugcgcac

SEQ ID NO: 345735 - RNA, 18 nt, Bordetella pertussis
caucacgcuggccgcgcc

SEQ ID NO: 345736 - RNA, 22 nt, Bordetella pertussis
caucacgcuggccgcgcccgcc

SEQ ID NO: 345737 - RNA, 14 nt, Bordetella pertussis
caucacgggcgcca

SEQ ID NO: 345738 - RNA, 16 nt, Bordetella pertussis
caucacgggcgccagc

SEQ ID NO: 345739 - RNA, 23 nt, Bordetella pertussis
caucacgggcgccagcagcgggc

SEQ ID NO: 345740 - RNA, 19 nt, Bordetella pertussis
caucacgccgguguucucg

SEQ ID NO: 345741 - RNA, 14 nt, Bordetella pertussis
caucagcauggcgu

SEQ ID NO: 345742 - RNA, 13 nt, Bordetella pertussis
caucagcgcgaac

SEQ ID NO: 345743 - RNA, 13 nt, Bordetella pertussis
caucagcgcgccc

SEQ ID NO: 345744 - RNA, 23 nt, Bordetella pertussis
caucagcggcagcacgauggcgc

SEQ ID NO: 345745 - RNA, 15 nt, Bordetella pertussis
caucagcgugccgcc

SEQ ID NO: 345746 - RNA, 21 nt, Bordetella pertussis
caucagcucgaccacggcggc

SEQ ID NO: 345747 - RNA, 17 nt, Bordetella pertussis
caucaggaacggcaugg

SEQ ID NO: 345748 - RNA, 13 nt, Bordetella pertussis
caucaggcccgac

SEQ ID NO: 345749 - RNA, 22 nt, Bordetella pertussis
caucagguccacuucaccgcug

SEQ ID NO: 345750 - RNA, 21 nt, Bordetella pertussis
caucaggugaaacagcagcgg

SEQ ID NO: 345751 - RNA, 22 nt, Bordetella pertussis
caucaggugaaacagcagcggg

SEQ ID NO: 345752 - RNA, 23 nt, Bordetella pertussis
caucaggugcaggguuggcgcgc

SEQ ID NO: 345753 - RNA, 16 nt, Bordetella pertussis
caucagguuguccagc

SEQ ID NO: 345754 - RNA, 20 nt, Bordetella pertussis
cauccagcggacgggccagg

SEQ ID NO: 345755 - RNA, 21 nt, Bordetella pertussis
cauccagcggacgggccaggc

SEQ ID NO: 345756 - RNA, 17 nt, Bordetella pertussis
cauccagcucggcgaug

SEQ ID NO: 345757 - RNA, 12 nt, Bordetella pertussis
cauccaggccgu

SEQ ID NO: 345758 - RNA, 21 nt, Bordetella pertussis
cauccaggucuacccgcgcga

SEQ ID NO: 345759 - RNA, 15 nt, Bordetella pertussis
cauccaggugccgcg

SEQ ID NO: 345760 - RNA, 14 nt, Bordetella pertussis
cauccaucuggugg

SEQ ID NO: 345761 - RNA, 15 nt, Bordetella pertussis
caucccagacagcca

SEQ ID NO: 345762 - RNA, 22 nt, Bordetella pertussis
caucccagacagccacgcgcga

SEQ ID NO: 345763 - RNA, 16 nt, Bordetella pertussis
caucccauccgcgcca

SEQ ID NO: 345764 - RNA, 19 nt, Bordetella pertussis
caucccggcgcucagcgcg

SEQ ID NO: 345765 - RNA, 19 nt, Bordetella pertussis
caucccugcuugcgcggac

SEQ ID NO: 345766 - RNA, 15 nt, Bordetella pertussis
caucccuugagcgug

SEQ ID NO: 345767 - RNA, 13 nt, Bordetella pertussis
cauccggcccagc

SEQ ID NO: 345768 - RNA, 16 nt, Bordetella pertussis
cauccggcccagcgcc

SEQ ID NO: 345769 - RNA, 17 nt, Bordetella pertussis
cauccggcccagcgcca

SEQ ID NO: 345770 - RNA, 16 nt, Bordetella pertussis
cauccggcccggugca

SEQ ID NO: 345771 - RNA, 21 nt, Bordetella pertussis
cauccggccgcacgcggccgc

SEQ ID NO: 345772 - RNA, 23 nt, Bordetella pertussis
cauccggcgcaugauggccggcc

SEQ ID NO: 345773 - RNA, 21 nt, Bordetella pertussis
cauccgguggugcugggcggc

SEQ ID NO: 345774 - RNA, 16 nt, Bordetella pertussis
cauccguccgccagga

SEQ ID NO: 345775 - RNA, 14 nt, Bordetella pertussis
cauccucaucgugc

SEQ ID NO: 345776 - RNA, 19 nt, Bordetella pertussis
cauccucaucgugcucgug

SEQ ID NO: 345777 - RNA, 14 nt, Bordetella pertussis
caucgacgcggcga

SEQ ID NO: 345778 - RNA, 14 nt, Bordetella pertussis
caucgacgggcggc

SEQ ID NO: 345779 - RNA, 22 nt, Bordetella pertussis
caucgacgucggccucgcgcag

SEQ ID NO: 345780 - RNA, 16 nt, Bordetella pertussis
caucgagcaccgccuc

SEQ ID NO: 345781 - RNA, 19 nt, Bordetella pertussis
caucgagcgccugggcggc

SEQ ID NO: 345782 - RNA, 15 nt, Bordetella pertussis
caucgccaugccggc

SEQ ID NO: 345783 - RNA, 14 nt, Bordetella pertussis
caucgccaugcugc

SEQ ID NO: 345784 - RNA, 17 nt, Bordetella pertussis
caucgccauggccacga

SEQ ID NO: 345785 - RNA, 17 nt, Bordetella pertussis
caucgccgcugcgcagc

SEQ ID NO: 345786 - RNA, 17 nt, Bordetella pertussis
caucgccugcacgaccu

SEQ ID NO: 345787 - RNA, 16 nt, Bordetella pertussis
caucgcgaugcgcagc

SEQ ID NO: 345788 - RNA, 19 nt, Bordetella pertussis
caucgcgcaagggccaguc

SEQ ID NO: 345789 - RNA, 22 nt, Bordetella pertussis
caucgcgccuucggcgcgcacg

SEQ ID NO: 345790 - RNA, 14 nt, Bordetella pertussis
caucgcgcgccgcc

SEQ ID NO: 345791 - RNA, 15 nt, Bordetella pertussis
caucgcgcgcgccgg

SEQ ID NO: 345792 - RNA, 22 nt, Bordetella pertussis
caucgcgcgcgccggcaucggc

SEQ ID NO: 345793 - RNA, 21 nt, Bordetella pertussis
caucgcggucaucggcgacga

SEQ ID NO: 345794 - RNA, 22 nt, Bordetella pertussis
caucgcgguccugaccggcggc

SEQ ID NO: 345795 - RNA, 14 nt, Bordetella pertussis
caucgcguccaggc

SEQ ID NO: 345796 - RNA, 17 nt, Bordetella pertussis
caucgcguccaggccca

SEQ ID NO: 345797 - RNA, 19 nt, Bordetella pertussis
caucgcguccaggcccagc

SEQ ID NO: 345798 - RNA, 23 nt, Bordetella pertussis
caucgcgugcagcgacuugucgc

SEQ ID NO: 345799 - RNA, 15 nt, Bordetella pertussis
caucgcuaugcagcu

SEQ ID NO: 345800 - RNA, 18 nt, Bordetella pertussis
caucggcacgggucaggc

SEQ ID NO: 345801 - RNA, 14 nt, Bordetella pertussis
caucggcaggccgg

SEQ ID NO: 345802 - RNA, 15 nt, Bordetella pertussis
caucggcaggccggc

SEQ ID NO: 345803 - RNA, 17 nt, Bordetella pertussis
caucggcaggccggcgc

SEQ ID NO: 345804 - RNA, 19 nt, Bordetella pertussis
caucggcaggccggcgcgc

SEQ ID NO: 345805 - RNA, 15 nt, Bordetella pertussis
caucggccacgcugc

SEQ ID NO: 345806 - RNA, 20 nt, Bordetella pertussis
caucggccacgcugcccugc

SEQ ID NO: 345807 - RNA, 18 nt, Bordetella pertussis
caucggccaggcgccuga

SEQ ID NO: 345808 - RNA, 13 nt, Bordetella pertussis
caucggccggcgg

SEQ ID NO: 345809 - RNA, 19 nt, Bordetella pertussis
caucggccugcaccggcgc

SEQ ID NO: 345810 - RNA, 23 nt, Bordetella pertussis
caucggccugcaccggcgcgagu

SEQ ID NO: 345811 - RNA, 21 nt, Bordetella pertussis
caucggcgccaagcggcaggc

SEQ ID NO: 345812 - RNA, 17 nt, Bordetella pertussis
caucggcgccgcgcgcu

SEQ ID NO: 345813 - RNA, 13 nt, Bordetella pertussis
caucggcgccggc

SEQ ID NO: 345814 - RNA, 13 nt, Bordetella pertussis
caucggcgccgcg

SEQ ID NO: 345815 - RNA, 16 nt, Bordetella pertussis
caucggcgcgcgcugc

SEQ ID NO: 345816 - RNA, 14 nt, Bordetella pertussis
caucggcggcaggu

SEQ ID NO: 345817 - RNA, 19 nt, Bordetella pertussis
caucggcguaccaggcagc

SEQ ID NO: 345818 - RNA, 19 nt, Bordetella pertussis
caucggcucgagcaagggc

SEQ ID NO: 345819 - RNA, 14 nt, Bordetella pertussis
caucggcuggcgca

SEQ ID NO: 345820 - RNA, 16 nt, Bordetella pertussis
caucgggauaccgcug

SEQ ID NO: 345821 - RNA, 14 nt, Bordetella pertussis
caucgggccggcgg

SEQ ID NO: 345822 - RNA, 15 nt, Bordetella pertussis
caucgggccggcggc

SEQ ID NO: 345823 - RNA, 14 nt, Bordetella pertussis
caucggucaacgcc

SEQ ID NO: 345824 - RNA, 18 nt, Bordetella pertussis
caucggugcggccggugg

SEQ ID NO: 345825 - RNA, 21 nt, Bordetella pertussis
caucggugcggccgguggcga

SEQ ID NO: 345826 - RNA, 19 nt, Bordetella pertussis
caucguacgcgugggcggc

SEQ ID NO: 345827 - RNA, 18 nt, Bordetella pertussis
caucguaguugggcgccu

SEQ ID NO: 345828 - RNA, 19 nt, Bordetella pertussis
caucguaguugggcgccuu

SEQ ID NO: 345829 - RNA, 15 nt, Bordetella pertussis
caucgucaggcaggc

SEQ ID NO: 345830 - RNA, 18 nt, Bordetella pertussis
caucgucaggcaggcgcg

SEQ ID NO: 345831 - RNA, 22 nt, Bordetella pertussis
caucgucaggcaggcgcgccgg

SEQ ID NO: 345832 - RNA, 20 nt, Bordetella pertussis
caucgucauuacccauggca

SEQ ID NO: 345833 - RNA, 19 nt, Bordetella pertussis
caucgucgaggaugcgagc

SEQ ID NO: 345834 - RNA, 14 nt, Bordetella pertussis
caucguggccgcgc

SEQ ID NO: 345835 - RNA, 15 nt, Bordetella pertussis
caucguggccgcgca

SEQ ID NO: 345836 - RNA, 14 nt, Bordetella pertussis
caucgugcgcgauc

SEQ ID NO: 345837 - RNA, 21 nt, Bordetella pertussis
caucgugcgcgaucuugccgc

SEQ ID NO: 345838 - RNA, 17 nt, Bordetella pertussis
caucgugcucgugcugg

SEQ ID NO: 345839 - RNA, 17 nt, Bordetella pertussis
caucuacagcgccuggc

SEQ ID NO: 345840 - RNA, 19 nt, Bordetella pertussis
caucucaaccacgaacacg

SEQ ID NO: 345841 - RNA, 13 nt, Bordetella pertussis
caucuccaccagc

SEQ ID NO: 345842 - RNA, 17 nt, Bordetella pertussis
caucucccgcaggccca

SEQ ID NO: 345843 - RNA, 20 nt, Bordetella pertussis
caucucgaagcgcucguccu

SEQ ID NO: 345844 - RNA, 14 nt, Bordetella pertussis
caucucgaugcggu

SEQ ID NO: 345845 - RNA, 23 nt, Bordetella pertussis
caucucgaugcggucggccgcgc

SEQ ID NO: 345846 - RNA, 20 nt, Bordetella pertussis
caucucgaugggauacgccg

SEQ ID NO: 345847 - RNA, 15 nt, Bordetella pertussis
caucucgcggcggua

SEQ ID NO: 345848 - RNA, 12 nt, Bordetella pertussis
caucugccggua

SEQ ID NO: 345849 - RNA, 12 nt, Bordetella pertussis
caucugcggcac

SEQ ID NO: 345850 - RNA, 20 nt, Bordetella pertussis
caucugcggcaccucggccg

SEQ ID NO: 345851 - RNA, 13 nt, Bordetella pertussis
caucugcggcacg

SEQ ID NO: 345852 - RNA, 21 nt, Bordetella pertussis
caucuggcgcauggccggcgu

SEQ ID NO: 345853 - RNA, 20 nt, Bordetella pertussis
caucugguugagcagcaccu

SEQ ID NO: 345854 - RNA, 22 nt, Bordetella pertussis
caucugguugagcagcaccugg

SEQ ID NO: 345855 - RNA, 18 nt, Bordetella pertussis
caucuguacggccggcuc

SEQ ID NO: 345856 - RNA, 14 nt, Bordetella pertussis
caucuucgugcugg

SEQ ID NO: 345857 - RNA, 16 nt, Bordetella pertussis
caucuugccuuggcga

SEQ ID NO: 345858 - RNA, 14 nt, Bordetella pertussis
caucuugcgccgcu

SEQ ID NO: 345859 - RNA, 15 nt, Bordetella pertussis
caugaacgcuugacg

SEQ ID NO: 345860 - RNA, 22 nt, Bordetella pertussis
caugaacgcuugacggccagga

SEQ ID NO: 345861 - RNA, 20 nt, Bordetella pertussis
caugaacggcagcgcgcgcg

SEQ ID NO: 345862 - RNA, 17 nt, Bordetella pertussis
caugaagcgguggcggc

SEQ ID NO: 345863 - RNA, 18 nt, Bordetella pertussis
caugaagcgguggcggcc

SEQ ID NO: 345864 - RNA, 17 nt, Bordetella pertussis
caugaauaugcgcccga

SEQ ID NO: 345865 - RNA, 21 nt, Bordetella pertussis
caugaccacgucgaucaggcc

SEQ ID NO: 345866 - RNA, 23 nt, Bordetella pertussis
caugaccacgucgaucaggccca

SEQ ID NO: 345867 - RNA, 14 nt, Bordetella pertussis
caugaccaucgcgc

SEQ ID NO: 345868 - RNA, 17 nt, Bordetella pertussis
caugaccgccgcgccgg

SEQ ID NO: 345869 - RNA, 22 nt, Bordetella pertussis
caugaccgccggcaccagcgcc

SEQ ID NO: 345870 - RNA, 23 nt, Bordetella pertussis
caugaccggcguguccagcggcg

SEQ ID NO: 345871 - RNA, 14 nt, Bordetella pertussis
caugaccucggccu

SEQ ID NO: 345872 - RNA, 20 nt, Bordetella pertussis
caugaccugcgacagcaccg

SEQ ID NO: 345873 - RNA, 20 nt, Bordetella pertussis
caugacgaccuugcggccgc

SEQ ID NO: 345874 - RNA, 15 nt, Bordetella pertussis
caugacgcuggucga

SEQ ID NO: 345875 - RNA, 14 nt, Bordetella pertussis
caugacggccagga

SEQ ID NO: 345876 - RNA, 20 nt, Bordetella pertussis
caugacggccaggauggcgu

SEQ ID NO: 345877 - RNA, 21 nt, Bordetella pertussis
caugacgggcggcggcgcgcg

SEQ ID NO: 345878 - RNA, 22 nt, Bordetella pertussis
caugacgggcggcggcgcgcgc

SEQ ID NO: 345879 - RNA, 13 nt, Bordetella pertussis
caugacggggccu

SEQ ID NO: 345880 - RNA, 21 nt, Bordetella pertussis
caugacggggucggggcaggc

SEQ ID NO: 345881 - RNA, 15 nt, Bordetella pertussis
caugacggggugccu

SEQ ID NO: 345882 - RNA, 20 nt, Bordetella pertussis
caugacgucgacguugcgcg

SEQ ID NO: 345883 - RNA, 20 nt, Bordetella pertussis
caugacguucuccagcgccg

SEQ ID NO: 345884 - RNA, 20 nt, Bordetella pertussis
caugacggcgucgagcacgc

SEQ ID NO: 345885 - RNA, 14 nt, Bordetella pertussis
caugaggcggcggu

SEQ ID NO: 345886 - RNA, 19 nt, Bordetella pertussis
caugaguucuggcaucagg

SEQ ID NO: 345887 - RNA, 18 nt, Bordetella pertussis
caugauacccauggccgu

SEQ ID NO: 345888 - RNA, 14 nt, Bordetella pertussis
caugaucaggccga

SEQ ID NO: 345889 - RNA, 23 nt, Bordetella pertussis
caugaucgccggcaacguggugc

SEQ ID NO: 345890 - RNA, 18 nt, Bordetella pertussis
caugaucuugccgaccgc

SEQ ID NO: 345891 - RNA, 15 nt, Bordetella pertussis
caugaucuggccgac

SEQ ID NO: 345892 - RNA, 19 nt, Bordetella pertussis
caugaucuggccgaccagc

SEQ ID NO: 345893 - RNA, 16 nt, Bordetella pertussis
caugaugcccagcgcc

SEQ ID NO: 345894 - RNA, 18 nt, Bordetella pertussis
caugaugcgcugggccag

SEQ ID NO: 345895 - RNA, 20 nt, Bordetella pertussis
caugaugcgcugggccaggc

SEQ ID NO: 345896 - RNA, 17 nt, Bordetella pertussis
caugaugcugccgggca

SEQ ID NO: 345897 - RNA, 14 nt, Bordetella pertussis
caugauggcccggg

SEQ ID NO: 345898 - RNA, 17 nt, Bordetella pertussis
caugaugucgcgggccc

SEQ ID NO: 345899 - RNA, 16 nt, Bordetella pertussis
caugcaagacaggccg

SEQ ID NO: 345900 - RNA, 17 nt, Bordetella pertussis
caugcaagacaggccgc

SEQ ID NO: 345901 - RNA, 22 nt, Bordetella pertussis
caugcaacacgaccagcaggcc

SEQ ID NO: 345902 - RNA, 14 nt, Bordetella pertussis
caugcaccagcaca

SEQ ID NO: 345903 - RNA, 22 nt, Bordetella pertussis
caugcacgacuacggcggacug

SEQ ID NO: 345904 - RNA, 22 nt, Bordetella pertussis
caugcacgauauuggcgucggc

SEQ ID NO: 345905 - RNA, 15 nt, Bordetella pertussis
caugcagccgccgcg

SEQ ID NO: 345906 - RNA, 17 nt, Bordetella pertussis
caugcaguacaggcgcg

SEQ ID NO: 345907 - RNA, 22 nt, Bordetella pertussis
caugccagcuugcaggcgccuu

SEQ ID NO: 345908 - RNA, 14 nt, Bordetella pertussis
caugccauagucgc

SEQ ID NO: 345909 - RNA, 11 nt, Bordetella pertussis
caugcccaggc

SEQ ID NO: 345910 - RNA, 12 nt, Bordetella pertussis
caugcccaggcc

SEQ ID NO: 345911 - RNA, 14 nt, Bordetella pertussis
caugcccaggccca

SEQ ID NO: 345912 - RNA, 17 nt, Bordetella pertussis
caugcccgaccgcaugg

SEQ ID NO: 345913 - RNA, 19 nt, Bordetella pertussis
caugcccgaccgcaugggc

SEQ ID NO: 345914 - RNA, 19 nt, Bordetella pertussis
caugccccauccagcggac

SEQ ID NO: 345915 - RNA, 14 nt, Bordetella pertussis
caugcccggccacc

SEQ ID NO: 345916 - RNA, 15 nt, Bordetella pertussis
caugcccggccacca

SEQ ID NO: 345917 - RNA, 18 nt, Bordetella pertussis
caugcccggccaccagcg

SEQ ID NO: 345918 - RNA, 20 nt, Bordetella pertussis
caugcccuccucggccaggu

SEQ ID NO: 345919 - RNA, 17 nt, Bordetella pertussis
caugccgaacagcaugg

SEQ ID NO: 345920 - RNA, 23 nt, Bordetella pertussis
caugccgacggauucgcccaggg

SEQ ID NO: 345921 - RNA, 23 nt, Bordetella pertussis
caugccgauguuguuggccgcca

SEQ ID NO: 345922 - RNA, 19 nt, Bordetella pertussis
caugccgccaugcagcugg

SEQ ID NO: 345923 - RNA, 20 nt, Bordetella pertussis
caugccgccaugcagcugga

SEQ ID NO: 345924 - RNA, 15 nt, Bordetella pertussis
caugccgcccgccau

SEQ ID NO: 345925 - RNA, 23 nt, Bordetella pertussis
caugccgcccgccaugcacgggc

SEQ ID NO: 345926 - RNA, 18 nt, Bordetella pertussis
caugccgcccaugccgcc

SEQ ID NO: 345927 - RNA, 14 nt, Bordetella pertussis
caugccgccccagg

SEQ ID NO: 345928 - RNA, 17 nt, Bordetella pertussis
caugccgcgcccgccuu

SEQ ID NO: 345929 - RNA, 13 nt, Bordetella pertussis
caugccgcgcgcg

SEQ ID NO: 345930 - RNA, 17 nt, Bordetella pertussis
caugccgcgcgcgcaga

SEQ ID NO: 345931 - RNA, 21 nt, Bordetella pertussis
caugccgcgggcggcgccggc

SEQ ID NO: 345932 - RNA, 14 nt, Bordetella pertussis
caugccgcgguggc

SEQ ID NO: 345933 - RNA, 17 nt, Bordetella pertussis
caugccgcugaccagca

SEQ ID NO: 345934 - RNA, 21 nt, Bordetella pertussis
caugccgcugaccagcacgau

SEQ ID NO: 345935 - RNA, 18 nt, Bordetella pertussis
caugccggaacaggcgcc

SEQ ID NO: 345936 - RNA, 19 nt, Bordetella pertussis
caugccggaacaggcgccu

SEQ ID NO: 345937 - RNA, 16 nt, Bordetella pertussis
caugccggacaagccc

SEQ ID NO: 345938 - RNA, 15 nt, Bordetella pertussis
caugccggacgcggg

SEQ ID NO: 345939 - RNA, 15 nt, Bordetella pertussis
caugccggcauaggc

SEQ ID NO: 345940 - RNA, 21 nt, Bordetella pertussis
caugccggcauaggcggcgca

SEQ ID NO: 345941 - RNA, 24 nt, Bordetella pertussis
caugccggcauaggcggcgcaggc

SEQ ID NO: 345942 - RNA, 14 nt, Bordetella pertussis
caugccggccaugc

SEQ ID NO: 345943 - RNA, 20 nt, Bordetella pertussis
caugccggggaacaggucgu

SEQ ID NO: 345944 - RNA, 22 nt, Bordetella pertussis
caugccguccacgcccagcgcc

SEQ ID NO: 345945 - RNA, 17 nt, Bordetella pertussis
caugccguccugcugcg

SEQ ID NO: 345946 - RNA, 14 nt, Bordetella pertussis
caugccgucgcgcu

SEQ ID NO: 345947 - RNA, 20 nt, Bordetella pertussis
caugccgucgcgcucggacg

SEQ ID NO: 345948 - RNA, 19 nt, Bordetella pertussis
caugccgucuggcggcagc

SEQ ID NO: 345949 - RNA, 23 nt, Bordetella pertussis
ccaaccacgagcugcagcccggc

SEQ ID NO: 345950 - RNA, 14 nt, Bordetella pertussis
ccaacccaggucgc

SEQ ID NO: 345951 - RNA, 15 nt, Bordetella pertussis
ccaaccugcuggcca

SEQ ID NO: 345952 - RNA, 17 nt, Bordetella pertussis
ccaaccugcuggccacc

SEQ ID NO: 345953 - RNA, 21 nt, Bordetella pertussis
ccaaccugguauccggcgcac

SEQ ID NO: 345954 - RNA, 22 nt, Bordetella pertussis
ccaaccuucacgacacgcccag

SEQ ID NO: 345955 - RNA, 15 nt, Bordetella pertussis
ccaacgaggacaacc

SEQ ID NO: 345956 - RNA, 11 nt, Bordetella pertussis
ccaacgcggcg

SEQ ID NO: 345957 - RNA, 21 nt, Bordetella pertussis
ccaacgcggcgucgacgcccg

SEQ ID NO: 345958 - RNA, 22 nt, Bordetella pertussis
ccaacgcggcgucgacgcccgc

SEQ ID NO: 345959 - RNA, 23 nt, Bordetella pertussis
ccaacggcuggcugggcgcgccg

SEQ ID NO: 345960 - RNA, 21 nt, Bordetella pertussis
ccaacggggacgggcgcccgc

SEQ ID NO: 345961 - RNA, 22 nt, Bordetella pertussis
ccaagauggcccagggcagcgg

SEQ ID NO: 345962 - RNA, 21 nt, Bordetella pertussis
ccaagcagacccgcgcccagc

SEQ ID NO: 345963 - RNA, 19 nt, Bordetella pertussis
ccaagcagaccuaccaggc

SEQ ID NO: 345964 - RNA, 16 nt, Bordetella pertussis
ccaagcagcgccugcc

SEQ ID NO: 345965 - RNA, 18 nt, Bordetella pertussis
ccaagggcgcgccagcac

SEQ ID NO: 345966 - RNA, 15 nt, Bordetella pertussis
ccaaggugccugucc

SEQ ID NO: 345967 - RNA, 23 nt, Bordetella pertussis
ccaaguccgguauccuggcgcgg

SEQ ID NO: 345968 - RNA, 19 nt, Bordetella pertussis
ccaauccgaucagcacgau

SEQ ID NO: 345969 - RNA, 20 nt, Bordetella pertussis
ccaauccgcgaagugccugu

SEQ ID NO: 345970 - RNA, 11 nt, Bordetella pertussis
ccaaucggcgu

SEQ ID NO: 345971 - RNA, 17 nt, Bordetella pertussis
ccaaucgggcagcacgc

SEQ ID NO: 345972 - RNA, 14 nt, Bordetella pertussis
aaagcgcccaggcc

SEQ ID NO: 345973 - RNA, 17 nt, Bordetella pertussis
ccaaucuugccaggccc

SEQ ID NO: 345974 - RNA, 20 nt, Bordetella pertussis
ccaaucuugccaggcccggc

SEQ ID NO: 345975 - RNA, 21 nt, Bordetella pertussis
ccacaaggauggacuggccgc

SEQ ID NO: 345976 - RNA, 19 nt, Bordetella pertussis
ccacacgaucagcgcccag

SEQ ID NO: 345977 - RNA, 13 nt, Bordetella pertussis
ccacacgcgcgca

SEQ ID NO: 345978 - RNA, 23 nt, Bordetella pertussis
ccacacgcgcgcaaugcgcggcg

SEQ ID NO: 345979 - RNA, 23 nt, Bordetella pertussis
ccacacgcgguagguagcgcgca

SEQ ID NO: 345980 - RNA, 16 nt, Bordetella pertussis
ccacacgggcgccugc

SEQ ID NO: 345981 - RNA, 16 nt, Bordetella pertussis
ccacacuuggccggcg

SEQ ID NO: 345982 - RNA, 16 nt, Bordetella pertussis
ccacagauuggccacc

SEQ ID NO: 345983 - RNA, 17 nt, Bordetella pertussis
ccacagauuggccacca

SEQ ID NO: 345984 - RNA, 12 nt, Bordetella pertussis
ccaccacgccca

SEQ ID NO: 345985 - RNA, 14 nt, Bordetella pertussis
ccaccacgcgcacc

SEQ ID NO: 345986 - RNA, 16 nt, Bordetella pertussis
ccaccacgcgcaccag

SEQ ID NO: 345987 - RNA, 13 nt, Bordetella pertussis
ccaccacgcuggc

SEQ ID NO: 345988 - RNA, 13 nt, Bordetella pertussis
ccaccacggcgcg

SEQ ID NO: 345989 - RNA, 17 nt, Bordetella pertussis
ccaccagccggccgccg

SEQ ID NO: 345990 - RNA, 17 nt, Bordetella pertussis
ccaccagccgggcggcc

SEQ ID NO: 345991 - RNA, 17 nt, Bordetella pertussis
ccaccagccgcccggcg

SEQ ID NO: 345992 - RNA, 14 nt, Bordetella pertussis
ccaccagccggccg

SEQ ID NO: 345993 - RNA, 16 nt, Bordetella pertussis
ccaccagcgcgccagc

SEQ ID NO: 345994 - RNA, 14 nt, Bordetella pertussis
ccaccagcggcgug

SEQ ID NO: 345995 - RNA, 15 nt, Bordetella pertussis
ccaccagcggcgugc

SEQ ID NO: 345996 - RNA, 22 nt, Bordetella pertussis
ccaccagcggcgugcggcccag

SEQ ID NO: 345997 - RNA, 23 nt, Bordetella pertussis
ccaccagcggcgugcggcccagc

SEQ ID NO: 345998 - RNA, 20 nt, Bordetella pertussis
ccaccagcggcguggcggcc

SEQ ID NO: 345999 - RNA, 15 nt, Bordetella pertussis
ccaccagcggcgccg

SEQ ID NO: 346000 - RNA, 14 nt, Bordetella pertussis
ccaccagugcgccg

SEQ ID NO: 346001 - RNA, 17 nt, Bordetella pertussis
ccaccaucagccagccg

SEQ ID NO: 346002 - RNA, 21 nt, Bordetella pertussis
ccaccaucagccagccgcuug

SEQ ID NO: 346003 - RNA, 15 nt, Bordetella pertussis
ccacccgccgccggc

SEQ ID NO: 346004 - RNA, 19 nt, Bordetella pertussis
ccacccgcauugaucgauc

SEQ ID NO: 346005 - RNA, 23 nt, Bordetella pertussis
ccacccgcauugaucgaucagcc

SEQ ID NO: 346006 - RNA, 17 nt, Bordetella pertussis
ccacccggaucgacagg

SEQ ID NO: 346007 - RNA, 22 nt, Bordetella pertussis
ccacccguaccgccacaccgcu

SEQ ID NO: 346008 - RNA, 15 nt, Bordetella pertussis
ccaccgacggcgcgg

SEQ ID NO: 346009 - RNA, 22 nt, Bordetella pertussis
ccaccgauccgaugaugcccag

SEQ ID NO: 346010 - RNA, 15 nt, Bordetella pertussis
ccaccgccagcccgg

SEQ ID NO: 346011 - RNA, 14 nt, Bordetella pertussis
ccaccgcccaggcg

SEQ ID NO: 346012 - RNA, 14 nt, Bordetella pertussis
aaaggccagcggcg

SEQ ID NO: 346013 - RNA, 18 nt, Bordetella pertussis
ccaccgcccaggcgcagc

SEQ ID NO: 346014 - RNA, 11 nt, Bordetella pertussis
ccaccgcccgc

SEQ ID NO: 346015 - RNA, 21 nt, Bordetella pertussis
ccaccgccgaugccgccauca

SEQ ID NO: 346016 - RNA, 14 nt, Bordetella pertussis
ccaccgccgcccgc

SEQ ID NO: 346017 - RNA, 18 nt, Bordetella pertussis
ccaccgccgcccgccagg

SEQ ID NO: 346018 - RNA, 21 nt, Bordetella pertussis
ccaccgccgcccgccaggcca

SEQ ID NO: 346019 - RNA, 15 nt, Bordetella pertussis
ccaccgccguggccg

SEQ ID NO: 346020 - RNA, 19 nt, Bordetella pertussis
ccaccgcgaaccaggccug

SEQ ID NO: 346021 - RNA, 16 nt, Bordetella pertussis
ccaccgcgccgcccac

SEQ ID NO: 346022 - RNA, 19 nt, Bordetella pertussis
ccaccgcggugccgcgcgc

SEQ ID NO: 346023 - RNA, 18 nt, Bordetella pertussis
ccaccggcaagccuugcg

SEQ ID NO: 346024 - RNA, 14 nt, Bordetella pertussis
ccaccggcacgccg

SEQ ID NO: 346025 - RNA, 23 nt, Bordetella pertussis
aaagggcgcaccaugcggugcgc

SEQ ID NO: 346026 - RNA, 13 nt, Bordetella pertussis
ccaccggcgcgcg

SEQ ID NO: 346027 - RNA, 14 nt, Bordetella pertussis
ccaccggcgcgcgc

SEQ ID NO: 346028 - RNA, 14 nt, Bordetella pertussis
ccaccggcgucacc

SEQ ID NO: 346029 - RNA, 20 nt, Bordetella pertussis
ccaccgucucgaacgccgcg

SEQ ID NO: 346030 - RNA, 23 nt, Bordetella pertussis
ccaccgucucgaacgccgcgucg

SEQ ID NO: 346031 - RNA, 17 nt, Bordetella pertussis
ccaccgucucgcccaug

SEQ ID NO: 346032 - RNA, 20 nt, Bordetella pertussis
ccaccgucuugcccgccagc

SEQ ID NO: 346033 - RNA, 21 nt, Bordetella pertussis
ccaccgugauauagaccagca

SEQ ID NO: 346034 - RNA, 14 nt, Bordetella pertussis
ccaccucggccucg

SEQ ID NO: 346035 - RNA, 17 nt, Bordetella pertussis
ccaccucuucagcccgg

SEQ ID NO: 346036 - RNA, 19 nt, Bordetella pertussis
ccaccucuucagcccggcg

SEQ ID NO: 346037 - RNA, 20 nt, Bordetella pertussis
ccacgaacacgaugaagaug

SEQ ID NO: 346038 - RNA, 13 nt, Bordetella pertussis
ccacgaacgccac

SEQ ID NO: 346039 - RNA, 18 nt, Bordetella pertussis
ccacgaacgccacgcccg

SEQ ID NO: 346040 - RNA, 15 nt, Bordetella pertussis
ccacgaacggcgcga

SEQ ID NO: 346041 - RNA, 22 nt, Bordetella pertussis
ccacgaagcaggugaugcgcgc

SEQ ID NO: 346042 - RNA, 13 nt, Bordetella pertussis
ccacgaaggcgau

SEQ ID NO: 346043 - RNA, 15 nt, Bordetella pertussis
ccacgaaggcgaucu

SEQ ID NO: 346044 - RNA, 13 nt, Bordetella pertussis
ccacgaaggcgcc

SEQ ID NO: 346045 - RNA, 23 nt, Bordetella pertussis
ccacgaauuccucgccgcccagc

SEQ ID NO: 346046 - RNA, 14 nt, Bordetella pertussis
ccacgauggcgcaa

SEQ ID NO: 346047 - RNA, 24 nt, Bordetella pertussis
ccacgauggcgcaauaggccgcga

SEQ ID NO: 346048 - RNA, 18 nt, Bordetella pertussis
ccacgaugucggcgcaau

SEQ ID NO: 346049 - RNA, 22 nt, Bordetella pertussis
ccacgauguugcgcaggcuguc

SEQ ID NO: 346050 - RNA, 16 nt, Bordetella pertussis
ccacgcacaccgcccg

SEQ ID NO: 346051 - RNA, 18 nt, Bordetella pertussis
ccacgcaggcgggcgccg

SEQ ID NO: 346052 - RNA, 22 nt, Bordetella pertussis
ccacgcccacuuccucggcgcg

SEQ ID NO: 346053 - RNA, 23 nt, Bordetella pertussis
ccacgcccacuuccucggcgcgc

SEQ ID NO: 346054 - RNA, 15 nt, Bordetella pertussis
ccacgcccagcgccg

SEQ ID NO: 346055 - RNA, 17 nt, Bordetella pertussis
ccacgcccagcgccggc

SEQ ID NO: 346056 - RNA, 14 nt, Bordetella pertussis
ccacgcccaggccg

SEQ ID NO: 346057 - RNA, 21 nt, Bordetella pertussis
ccacgcccaggccguggcgca

SEQ ID NO: 346058 - RNA, 22 nt, Bordetella pertussis
ccacgcccauguagaacgccag

SEQ ID NO: 346059 - RNA, 12 nt, Bordetella pertussis
ccacgcgccgcc

SEQ ID NO: 346060 - RNA, 16 nt, Bordetella pertussis
ccacgcgccgcccggg

SEQ ID NO: 346061 - RNA, 19 nt, Bordetella pertussis
ccacgcgccgcccgggccg

SEQ ID NO: 346062 - RNA, 11 nt, Bordetella pertussis
ccacgcgccgu

SEQ ID NO: 346063 - RNA, 14 nt, Bordetella pertussis
ccacgcgcgcgccg

SEQ ID NO: 346064 - RNA, 21 nt, Bordetella pertussis
ccacgcgcgcgccgccggcca

SEQ ID NO: 346065 - RNA, 21 nt, Bordetella pertussis
ccacgcgcgcuggcgcccggc

SEQ ID NO: 346066 - RNA, 15 nt, Bordetella pertussis
ccacgcgcgggcugg

SEQ ID NO: 346067 - RNA, 13 nt, Bordetella pertussis
ccacgcgcuccau

SEQ ID NO: 346068 - RNA, 23 nt, Bordetella pertussis
ccacgcgcuccaugaucucgggc

SEQ ID NO: 346069 - RNA, 17 nt, Bordetella pertussis
ccacgcgcugcgcgccg

SEQ ID NO: 346070 - RNA, 14 nt, Bordetella pertussis
ccacgcggccgugg

SEQ ID NO: 346071 - RNA, 16 nt, Bordetella pertussis
ccacgcggcgcugcug

SEQ ID NO: 346072 - RNA, 16 nt, Bordetella pertussis
ccacgcgggccggccg

SEQ ID NO: 346073 - RNA, 19 nt, Bordetella pertussis
ccacgcugcccugcugcug

SEQ ID NO: 346074 - RNA, 23 nt, Bordetella pertussis
ccacgcugcccugcugcugcagc

SEQ ID NO: 346075 - RNA, 14 nt, Bordetella pertussis
ccacgcugcgcccg

SEQ ID NO: 346076 - RNA, 17 nt, Bordetella pertussis
ccacggcaaaagccggg

SEQ ID NO: 346077 - RNA, 19 nt, Bordetella pertussis
ccacggcaaaagccggggu

SEQ ID NO: 346078 - RNA, 21 nt, Bordetella pertussis
ccacggcaaugucgcaggccg

SEQ ID NO: 346079 - RNA, 16 nt, Bordetella pertussis
ccacggcaucgccgcg

SEQ ID NO: 346080 - RNA, 17 nt, Bordetella pertussis
ccacggcaucgccgcgg

SEQ ID NO: 346081 - RNA, 18 nt, Bordetella pertussis
ccacggcaucggccagca

SEQ ID NO: 346082 - RNA, 17 nt, Bordetella pertussis
ccacggcaucggcgccg

SEQ ID NO: 346083 - RNA, 19 nt, Bordetella pertussis
ccacggcaucggcgccgcg

SEQ ID NO: 346084 - RNA, 21 nt, Bordetella pertussis
ccacggcaucggcgccgcgcg

SEQ ID NO: 346085 - RNA, 15 nt, Bordetella pertussis
ccacggccggcgcac

SEQ ID NO: 346086 - RNA, 19 nt, Bordetella pertussis
ccacggccggcgcacgccg

SEQ ID NO: 346087 - RNA, 15 nt, Bordetella pertussis
ccacggccugcccgg

SEQ ID NO: 346088 - RNA, 16 nt, Bordetella pertussis
ccacggccugcccggg

SEQ ID NO: 346089 - RNA, 17 nt, Bordetella pertussis
ccacggccugcccgggc

SEQ ID NO: 346090 - RNA, 20 nt, Bordetella pertussis
ccacggccugcccgggcggg

SEQ ID NO: 346091 - RNA, 11 nt, Bordetella pertussis
ccacggccggc

SEQ ID NO: 346092 - RNA, 13 nt, Bordetella pertussis
ccacggcgcgccc

SEQ ID NO: 346093 - RNA, 12 nt, Bordetella pertussis
ccacggcgcgcg

SEQ ID NO: 346094 - RNA, 17 nt, Bordetella pertussis
ccacggcggccaggccg

SEQ ID NO: 346095 - RNA, 20 nt, Bordetella pertussis
ccacggcggccaggccggcg

SEQ ID NO: 346096 - RNA, 23 nt, Bordetella pertussis
ccacgggcgucaccggcgagccg

SEQ ID NO: 346097 - RNA, 17 nt, Bordetella pertussis
ccacggucugcacgccg

SEQ ID NO: 346098 - RNA, 22 nt, Bordetella pertussis
ccacggucugcacgccgggcgc

SEQ ID NO: 346099 - RNA, 15 nt, Bordetella pertussis
ccacgucgcggcugg

SEQ ID NO: 346100 - RNA, 19 nt, Bordetella pertussis
ccacgucgcggcugggcaa

SEQ ID NO: 346101 - RNA, 16 nt, Bordetella pertussis
ccacgucggcggccgc

SEQ ID NO: 346102 - RNA, 23 nt, Bordetella pertussis
ccacgucgucgaugccgaccagg

SEQ ID NO: 346103 - RNA, 13 nt, Bordetella pertussis
ccacguggacagg

SEQ ID NO: 346104 - RNA, 16 nt, Bordetella pertussis
ccacguggacaggcac

SEQ ID NO: 346105 - RNA, 12 nt, Bordetella pertussis
ccacguggcgac

SEQ ID NO: 346106 - RNA, 22 nt, Bordetella pertussis
ccacguggcgacgucgggcagg

SEQ ID NO: 346107 - RNA, 17 nt, Bordetella pertussis
ccacucgaugggcgcgc

SEQ ID NO: 346108 - RNA, 18 nt, Bordetella pertussis
ccacucgaugggcgcgcg

SEQ ID NO: 346109 - RNA, 20 nt, Bordetella pertussis
ccacucgaugggcgcgcgca

SEQ ID NO: 346110 - RNA, 18 nt, Bordetella pertussis
ccacugggggacuggcac

SEQ ID NO: 346111 - RNA, 15 nt, Bordetella pertussis
ccacuucaccgcuga

SEQ ID NO: 346112 - RNA, 17 nt, Bordetella pertussis
ccagaacccggccggcg

SEQ ID NO: 346113 - RNA, 20 nt, Bordetella pertussis
ccagaacccggccggcgccg

SEQ ID NO: 346114 - RNA, 23 nt, Bordetella pertussis
ccagaacccggccggcgccggca

SEQ ID NO: 346115 - RNA, 17 nt, Bordetella pertussis
ccagaacgcugaugcgc

SEQ ID NO: 346116 - RNA, 14 nt, Bordetella pertussis
ccagaacggcgcgg

SEQ ID NO: 346117 - RNA, 16 nt, Bordetella pertussis
ccagaccugcgcgccg

SEQ ID NO: 346118 - RNA, 17 nt, Bordetella pertussis
ccagaccugcgcgccgg

SEQ ID NO: 346119 - RNA, 19 nt, Bordetella pertussis
ccagaccugcgcgccggca

SEQ ID NO: 346120 - RNA, 20 nt, Bordetella pertussis
ccagaccuggugaucgcgcg

SEQ ID NO: 346121 - RNA, 20 nt, Bordetella pertussis
ccagaccuugcgcgacggcg

SEQ ID NO: 346122 - RNA, 21 nt, Bordetella pertussis
ccagacgauggugccggccgu

SEQ ID NO: 346123 - RNA, 19 nt, Bordetella pertussis
ccagacgcagaccacgccg

SEQ ID NO: 346124 - RNA, 14 nt, Bordetella pertussis
ccagaucaggucga

SEQ ID NO: 346125 - RNA, 21 nt, Bordetella pertussis
ccagauccgguaugccugcca

SEQ ID NO: 346126 - RNA, 24 nt, Bordetella pertussis
ccagaucguugaucucgcccagca

SEQ ID NO: 346127 - RNA, 16 nt, Bordetella pertussis
ccagaucucgcguccg

SEQ ID NO: 346128 - RNA, 16 nt, Bordetella pertussis
ccagaugccggucagg

SEQ ID NO: 346129 - RNA, 23 nt, Bordetella pertussis
ccagaugcgccgcacgucggucg

SEQ ID NO: 346130 - RNA, 16 nt, Bordetella pertussis
ccagcaaaugggccgc

SEQ ID NO: 346131 - RNA, 17 nt, Bordetella pertussis
ccagcaaaugggccgca

SEQ ID NO: 346132 - RNA, 15 nt, Bordetella pertussis
ccagcaccagcgccu

SEQ ID NO: 346133 - RNA, 17 nt, Bordetella pertussis
ccagcaccagcgccugc

SEQ ID NO: 346134 - RNA, 14 nt, Bordetella pertussis
ccagcaccagggcg

SEQ ID NO: 346135 - RNA, 15 nt, Bordetella pertussis
ccagcaccagggcgc

SEQ ID NO: 346136 - RNA, 19 nt, Bordetella pertussis
ccagcaccagggcgcgcag

SEQ ID NO: 346137 - RNA, 21 nt, Bordetella pertussis
ccagcaccagggcgcgcagca

SEQ ID NO: 346138 - RNA, 13 nt, Bordetella pertussis
ccagcaccagggc

SEQ ID NO: 346139 - RNA, 14 nt, Bordetella pertussis
ccagcaccaugggc

SEQ ID NO: 346140 - RNA, 21 nt, Bordetella pertussis
ccagcaccccgucggcucagu

SEQ ID NO: 346141 - RNA, 18 nt, Bordetella pertussis
ccagcaccugcaccgaag

SEQ ID NO: 346142 - RNA, 19 nt, Bordetella pertussis
ccagcaccugcaggccgcc

SEQ ID NO: 346143 - RNA, 20 nt, Bordetella pertussis
ccagcaccugcaggccgccg

SEQ ID NO: 346144 - RNA, 22 nt, Bordetella pertussis
ccagcaccugcaggccgccggc

SEQ ID NO: 346145 - RNA, 18 nt, Bordetella pertussis
ccagcacgaagggcagca

SEQ ID NO: 346146 - RNA, 20 nt, Bordetella pertussis
ccagcacgaagggcagcagc

SEQ ID NO: 346147 - RNA, 22 nt, Bordetella pertussis
ccagcacgacgacggccggcgc

SEQ ID NO: 346148 - RNA, 18 nt, Bordetella pertussis
ccagcacgauggucagcg

SEQ ID NO: 346149 - RNA, 21 nt, Bordetella pertussis
ccagcagguccugcacgcggg

SEQ ID NO: 346150 - RNA, 12 nt, Bordetella pertussis
ccagcaggucgu

SEQ ID NO: 346151 - RNA, 21 nt, Bordetella pertussis
ccagcaguugcgccaguucgg

SEQ ID NO: 346152 - RNA, 22 nt, Bordetella pertussis
ccagcauacccugcgcgccgcc

SEQ ID NO: 346153 - RNA, 15 nt, Bordetella pertussis
ccagcaucaccagcu

SEQ ID NO: 346154 - RNA, 18 nt, Bordetella pertussis
ccagcauccgcgccagga

SEQ ID NO: 346155 - RNA, 14 nt, Bordetella pertussis
ccagcauccagccg

SEQ ID NO: 346156 - RNA, 15 nt, Bordetella pertussis
ccagcauccucacgu

SEQ ID NO: 346157 - RNA, 22 nt, Bordetella pertussis
ccagcaucgcgccuucggcgcg

SEQ ID NO: 346158 - RNA, 22 nt, Bordetella pertussis
ccagcaucggcacccagccgga

SEQ ID NO: 346159 - RNA, 20 nt, Bordetella pertussis
ccagcauuucgcgugcgugg

SEQ ID NO: 346160 - RNA, 18 nt, Bordetella pertussis
ccagcauuucucgggcgc

SEQ ID NO: 346161 - RNA, 22 nt, Bordetella pertussis
ccagccaccccgucaucgccgc

SEQ ID NO: 346162 - RNA, 17 nt, Bordetella pertussis
ccagccacgccggcgcg

SEQ ID NO: 346163 - RNA, 13 nt, Bordetella pertussis
ccagccacgcgcg

SEQ ID NO: 346164 - RNA, 14 nt, Bordetella pertussis
ccagccacgcgcgc

SEQ ID NO: 346165 - RNA, 20 nt, Bordetella pertussis
ccagccaguacaggcugccg

SEQ ID NO: 346166 - RNA, 21 nt, Bordetella pertussis
ccagccauucgauggcggcgc

SEQ ID NO: 346167 - RNA, 16 nt, Bordetella pertussis
ccagccauguucgacc

SEQ ID NO: 346168 - RNA, 15 nt, Bordetella pertussis
ccagcccaccagcgc

SEQ ID NO: 346169 - RNA, 13 nt, Bordetella pertussis
ccagcccagcccg

SEQ ID NO: 346170 - RNA, 22 nt, Bordetella pertussis
ccagcccaguugcuggcccagg

SEQ ID NO: 346171 - RNA, 21 nt, Bordetella pertussis
ccagccccaccuugcccagca

SEQ ID NO: 346172 - RNA, 14 nt, Bordetella pertussis
ccagccccacgccg

SEQ ID NO: 346173 - RNA, 15 nt, Bordetella pertussis
ccagccccgcggccg

SEQ ID NO: 346174 - RNA, 16 nt, Bordetella pertussis
ccagccccggcgcgcc

SEQ ID NO: 346175 - RNA, 17 nt, Bordetella pertussis
ccagccccugcgggccg

SEQ ID NO: 346176 - RNA, 13 nt, Bordetella pertussis
ccagcccgaggca

SEQ ID NO: 346177 - RNA, 21 nt, Bordetella pertussis
ccagcccgauaugcagccgca

SEQ ID NO: 346178 - RNA, 17 nt, Bordetella pertussis
ccagcccgccggcgcgc

SEQ ID NO: 346179 - RNA, 18 nt, Bordetella pertussis
ccagcccgccggcgcgcg

SEQ ID NO: 346180 - RNA, 20 nt, Bordetella pertussis
ccagcccgccggcgcgcgcg

SEQ ID NO: 346181 - RNA, 19 nt, Bordetella pertussis
ccagcccgaugcgccaggc

SEQ ID NO: 346182 - RNA, 21 nt, Bordetella pertussis
ccagcccgaugcgccaggccu

SEQ ID NO: 346183 - RNA, 21 nt, Bordetella pertussis
ccagcccgcggguucgcccgg

SEQ ID NO: 346184 - RNA, 14 nt, Bordetella pertussis
ccagcccgcgcgcg

SEQ ID NO: 346185 - RNA, 13 nt, Bordetella pertussis
ccagcccggcgcg

SEQ ID NO: 346186 - RNA, 22 nt, Bordetella pertussis
ccagcccggcuucgaucaugcc

SEQ ID NO: 346187 - RNA, 19 nt, Bordetella pertussis
ccagccgaucagccggcca

SEQ ID NO: 346188 - RNA, 14 nt, Bordetella pertussis
ccagccgaugccgc

SEQ ID NO: 346189 - RNA, 22 nt, Bordetella pertussis
ccagccgcagcaggcgcucggc

SEQ ID NO: 346190 - RNA, 19 nt, Bordetella pertussis
ccagccgcaugccggcgau

SEQ ID NO: 346191 - RNA, 16 nt, Bordetella pertussis
ccagccgccgcgcggc

SEQ ID NO: 346192 - RNA, 13 nt, Bordetella pertussis
ccagccgcccggc

SEQ ID NO: 346193 - RNA, 14 nt, Bordetella pertussis
ccagccgcccggcg

SEQ ID NO: 346194 - RNA, 14 nt, Bordetella pertussis
ccagccgcgccauc

SEQ ID NO: 346195 - RNA, 22 nt, Bordetella pertussis
ccagccggcccagcacgccgcg

SEQ ID NO: 346196 - RNA, 14 nt, Bordetella pertussis
ccagccggcccgac

SEQ ID NO: 346197 - RNA, 13 nt, Bordetella pertussis
ccagccggccgcc

SEQ ID NO: 346198 - RNA, 14 nt, Bordetella pertussis
ccagccggccgccg

SEQ ID NO: 346199 - RNA, 13 nt, Bordetella pertussis
ccagccgcgccag

SEQ ID NO: 346200 - RNA, 15 nt, Bordetella pertussis
ccagccggcgcgcca

SEQ ID NO: 346201 - RNA, 18 nt, Bordetella pertussis
ccagccgggucggcugau

SEQ ID NO: 346202 - RNA, 23 nt, Bordetella pertussis
ccagccgggucggcugaugcccu

SEQ ID NO: 346203 - RNA, 19 nt, Bordetella pertussis
ccagcgacgacuugaucag

SEQ ID NO: 346204 - RNA, 16 nt, Bordetella pertussis
ccagcgacuccggccg

SEQ ID NO: 346205 - RNA, 21 nt, Bordetella pertussis
ccagcgacuccggccgggcca

SEQ ID NO: 346206 - RNA, 16 nt, Bordetella pertussis
ccagcgagaccuugug

SEQ ID NO: 346207 - RNA, 13 nt, Bordetella pertussis
ccagcgcacgcag

SEQ ID NO: 346208 - RNA, 15 nt, Bordetella pertussis
ccagcgcacgcagcg

SEQ ID NO: 346209 - RNA, 20 nt, Bordetella pertussis
ccagcgcauaggacgccacc

SEQ ID NO: 346210 - RNA, 12 nt, Bordetella pertussis
ccagcgccaucg

SEQ ID NO: 346211 - RNA, 16 nt, Bordetella pertussis
ccagcgccaucggcau

SEQ ID NO: 346212 - RNA, 21 nt, Bordetella pertussis
ccagcgccaugaugucgcgcg

SEQ ID NO: 346213 - RNA, 14 nt, Bordetella pertussis
ccagcgccaguccg

SEQ ID NO: 346214 - RNA, 11 nt, Bordetella pertussis
ccagcgcccga

SEQ ID NO: 346215 - RNA, 14 nt, Bordetella pertussis
ccagcgcccaggcg

SEQ ID NO: 346216 - RNA, 21 nt, Bordetella pertussis
ccagcgccgcagcgucgcggc

SEQ ID NO: 346217 - RNA, 16 nt, Bordetella pertussis
ccagcgccgccagccg

SEQ ID NO: 346218 - RNA, 20 nt, Bordetella pertussis
ccagcgcgaucucgcgcagg

SEQ ID NO: 346219 - RNA, 20 nt, Bordetella pertussis
ccagcgcgaugucgcccaug

SEQ ID NO: 346220 - RNA, 24 nt, Bordetella pertussis
ccagcgcgauucccuggcgcgcca

SEQ ID NO: 346221 - RNA, 17 nt, Bordetella pertussis
ccagcgcgcaacccacg

SEQ ID NO: 346222 - RNA, 12 nt, Bordetella pertussis
ccagcgcgccau

SEQ ID NO: 346223 - RNA, 17 nt, Bordetella pertussis
ccagcgcgccauggccg

SEQ ID NO: 346224 - RNA, 13 nt, Bordetella pertussis
ccagcgcgcccag

SEQ ID NO: 346225 - RNA, 14 nt, Bordetella pertussis
ccagcgcgcccagc

SEQ ID NO: 346226 - RNA, 20 nt, Bordetella pertussis
ccagcgcgcccgaggcgcgc

SEQ ID NO: 346227 - RNA, 23 nt, Bordetella pertussis
ccagcgcgcccgaggcgcgcagc

SEQ ID NO: 346228 - RNA, 12 nt, Bordetella pertussis
ccagcgcgccga

SEQ ID NO: 346229 - RNA, 13 nt, Bordetella pertussis
ccagcgcgccgau

SEQ ID NO: 346230 - RNA, 18 nt, Bordetella pertussis
ccagcgcgccgaucacca

SEQ ID NO: 346231 - RNA, 13 nt, Bordetella pertussis
ccagcgcgccgcc

SEQ ID NO: 346232 - RNA, 19 nt, Bordetella pertussis
ccagcgcgccgcgcgcggc

SEQ ID NO: 346233 - RNA, 18 nt, Bordetella pertussis
ccagcgcgccugcccagg

SEQ ID NO: 346234 - RNA, 23 nt, Bordetella pertussis
ccagcgcgccugcccaggccagc

SEQ ID NO: 346235 - RNA, 14 nt, Bordetella pertussis
ccagcgcgcgaauu

SEQ ID NO: 346236 - RNA, 12 nt, Bordetella pertussis
ccagcgcgcgau

SEQ ID NO: 346237 - RNA, 16 nt, Bordetella pertussis
ccagcgcgcgaucgcc

SEQ ID NO: 346238 - RNA, 19 nt, Bordetella pertussis
ccagcgcggcgggcggcgc

SEQ ID NO: 346239 - RNA, 14 nt, Bordetella pertussis
ccagcgcggcggca

SEQ ID NO: 346240 - RNA, 14 nt, Bordetella pertussis
ccagcgcggcggcc

SEQ ID NO: 346241 - RNA, 22 nt, Bordetella pertussis
ccagcggaaguauucgcgcggc

SEQ ID NO: 346242 - RNA, 19 nt, Bordetella pertussis
ccagcggaauggggcccgc

SEQ ID NO: 346243 - RNA, 20 nt, Bordetella pertussis
ccagcggacgggccaggccg

SEQ ID NO: 346244 - RNA, 24 nt, Bordetella pertussis
ccagcggaugaugcggcgccacgc

SEQ ID NO: 346245 - RNA, 18 nt, Bordetella pertussis
ccagcggaucgccgggca

SEQ ID NO: 346246 - RNA, 18 nt, Bordetella pertussis
ccagcggcagcgcgcagg

SEQ ID NO: 346247 - RNA, 15 nt, Bordetella pertussis
ccagcggcaggacgg

SEQ ID NO: 346248 - RNA, 16 nt, Bordetella pertussis
ccagcggcaggacggg

SEQ ID NO: 346249 - RNA, 12 nt, Bordetella pertussis
ccagcggcaggc

SEQ ID NO: 346250 - RNA, 20 nt, Bordetella pertussis
ccagcggcaggggcucgcgc

SEQ ID NO: 346251 - RNA, 21 nt, Bordetella pertussis
ccagcggcaggggcucgcgcc

SEQ ID NO: 346252 - RNA, 21 nt, Bordetella pertussis
ccagcggcaggcuggccggcg

SEQ ID NO: 346253 - RNA, 22 nt, Bordetella pertussis
ccagcggcaggcuggccggcgu

SEQ ID NO: 346254 - RNA, 20 nt, Bordetella pertussis
ccagcggcgacugccccagc

SEQ ID NO: 346255 - RNA, 13 nt, Bordetella pertussis
ccagcggcgagca

SEQ ID NO: 346256 - RNA, 21 nt, Bordetella pertussis
ccagcggcgcagccggccggu

SEQ ID NO: 346257 - RNA, 14 nt, Bordetella pertussis
ccagcggcgccagc

SEQ ID NO: 346258 - RNA, 15 nt, Bordetella pertussis
ccagcggcgccgacc

SEQ ID NO: 346259 - RNA, 14 nt, Bordetella pertussis
ccagcggcgccgga

SEQ ID NO: 346260 - RNA, 22 nt, Bordetella pertussis
ccagcggcgccggaucggccgg

SEQ ID NO: 346261 - RNA, 14 nt, Bordetella pertussis
ccagcggcgcgacg

SEQ ID NO: 346262 - RNA, 16 nt, Bordetella pertussis
ccagcggcgcgacgcg

SEQ ID NO: 346263 - RNA, 17 nt, Bordetella pertussis
ccagcggcgcgacgcgc

SEQ ID NO: 346264 - RNA, 19 nt, Bordetella pertussis
ccagcggcgcgacgcgcuu

SEQ ID NO: 346265 - RNA, 23 nt, Bordetella pertussis
ccagcggcgcuuaccgcgccggc

SEQ ID NO: 346266 - RNA, 20 nt, Bordetella pertussis
ccagcggcgugaugcccagg

SEQ ID NO: 346267 - RNA, 20 nt, Bordetella pertussis
ccagcggcguggcggccagg

SEQ ID NO: 346268 - RNA, 15 nt, Bordetella pertussis
ccagcggcuggccac

SEQ ID NO: 346269 - RNA, 16 nt, Bordetella pertussis
ccagcggcuggcgcac

SEQ ID NO: 346270 - RNA, 15 nt, Bordetella pertussis
ccagcggcuggcggu

SEQ ID NO: 346271 - RNA, 14 nt, Bordetella pertussis
ccagcggggacagg

SEQ ID NO: 346272 - RNA, 15 nt, Bordetella pertussis
ccagcggugcgcggc

SEQ ID NO: 346273 - RNA, 16 nt, Bordetella pertussis
ccagcggugcgcggcg

SEQ ID NO: 346274 - RNA, 17 nt, Bordetella pertussis
ccagcgguugcgccagc

SEQ ID NO: 346275 - RNA, 18 nt, Bordetella pertussis
ccagcgguugcgccagcu

SEQ ID NO: 346276 - RNA, 15 nt, Bordetella pertussis
ccagcguaucgccgc

SEQ ID NO: 346277 - RNA, 17 nt, Bordetella pertussis
ccagcguaucgccgccg

SEQ ID NO: 346278 - RNA, 22 nt, Bordetella pertussis
ccagcguauuccccuucucggc

SEQ ID NO: 346279 - RNA, 20 nt, Bordetella pertussis
ccagcgucaccagcaggcgg

SEQ ID NO: 346280 - RNA, 13 nt, Bordetella pertussis
ccagcgucagcgc

SEQ ID NO: 346281 - RNA, 14 nt, Bordetella pertussis
ccagcgucaugcgc

SEQ ID NO: 346282 - RNA, 17 nt, Bordetella pertussis
ccagcgucaugcgcacc

SEQ ID NO: 346283 - RNA, 13 nt, Bordetella pertussis
ccagcgucauggc

SEQ ID NO: 346284 - RNA, 19 nt, Bordetella pertussis
ccagcgucauggccuggcc

SEQ ID NO: 346285 - RNA, 15 nt, Bordetella pertussis
ccagcguccaggcgg

SEQ ID NO: 346286 - RNA, 16 nt, Bordetella pertussis
ccagcguccaggcggc

SEQ ID NO: 346287 - RNA, 13 nt, Bordetella pertussis
ccagcgucggcgu

SEQ ID NO: 346288 - RNA, 14 nt, Bordetella pertussis
aaauccagcgcgcc

SEQ ID NO: 346289 - RNA, 17 nt, Bordetella pertussis
ccagcgucucgaucacg

SEQ ID NO: 346290 - RNA, 13 nt, Bordetella pertussis
ccagcgugcccag

SEQ ID NO: 346291 - RNA, 18 nt, Bordetella pertussis
ccagcgugcccagcgaga

SEQ ID NO: 346292 - RNA, 19 nt, Bordetella pertussis
ccagcgugcccagcgagau

SEQ ID NO: 346293 - RNA, 14 nt, Bordetella pertussis
ccagcguggcgcag

SEQ ID NO: 346294 - RNA, 15 nt, Bordetella pertussis
ccagcguggcgcagu

SEQ ID NO: 346295 - RNA, 15 nt, Bordetella pertussis
ccagcguggagcugc

SEQ ID NO: 346296 - RNA, 20 nt, Bordetella pertussis
ccagcguguagagcaggccg

SEQ ID NO: 346297 - RNA, 23 nt, Bordetella pertussis
ccagcguguagagcaggccgccc

SEQ ID NO: 346298 - RNA, 21 nt, Bordetella pertussis
ccagcgugucgaacaccaggu

SEQ ID NO: 346299 - RNA, 23 nt, Bordetella pertussis
ccagcguguggugaaagccgccg

SEQ ID NO: 346300 - RNA, 18 nt, Bordetella pertussis
ccagcguguaggcggccg

SEQ ID NO: 346301 - RNA, 13 nt, Bordetella pertussis
ccagcucagcgga

SEQ ID NO: 346302 - RNA, 21 nt, Bordetella pertussis
ccagcucagcggauaauggcc

SEQ ID NO: 346303 - RNA, 22 nt, Bordetella pertussis
ccagcucauggcacagcgcggc

SEQ ID NO: 346304 - RNA, 14 nt, Bordetella pertussis
ccagcuccaccggg

SEQ ID NO: 346305 - RNA, 14 nt, Bordetella pertussis
ccagcuccaggugc

SEQ ID NO: 346306 - RNA, 17 nt, Bordetella pertussis
ccagcuccaggugccag

SEQ ID NO: 346307 - RNA, 20 nt, Bordetella pertussis
ccagcuccagcuggcgcacc

SEQ ID NO: 346308 - RNA, 18 nt, Bordetella pertussis
ccagcuccccgggcguga

SEQ ID NO: 346309 - RNA, 15 nt, Bordetella pertussis
ccagcuccggcggca

SEQ ID NO: 346310 - RNA, 23 nt, Bordetella pertussis
ccagcuccggcggcagcgcgaac

SEQ ID NO: 346311 - RNA, 17 nt, Bordetella pertussis
ccagcucgacgccaucu

SEQ ID NO: 346312 - RNA, 14 nt, Bordetella pertussis
ccagcucgcggccc

SEQ ID NO: 346313 - RNA, 15 nt, Bordetella pertussis
ccagcucgcggcccu

SEQ ID NO: 346314 - RNA, 20 nt, Bordetella pertussis
ccagcucggccugcggcucg

SEQ ID NO: 346315 - RNA, 17 nt, Bordetella pertussis
ccagcucggcggccgcc

SEQ ID NO: 346316 - RNA, 17 nt, Bordetella pertussis
ccagcucggcgaugcgc

SEQ ID NO: 346317 - RNA, 21 nt, Bordetella pertussis
ccagcucuucgagcgcggcgc

SEQ ID NO: 346318 - RNA, 14 nt, Bordetella pertussis
ccagcugaccucgc

SEQ ID NO: 346319 - RNA, 18 nt, Bordetella pertussis
ccagcugaccucgcccag

SEQ ID NO: 346320 - RNA, 14 nt, Bordetella pertussis
ccagcugcaugcgc

SEQ ID NO: 346321 - RNA, 13 nt, Bordetella pertussis
ccagcugcgcccc

SEQ ID NO: 346322 - RNA, 15 nt, Bordetella pertussis
ccagcugcgcgcgag

SEQ ID NO: 346323 - RNA, 14 nt, Bordetella pertussis
ccagcugcguggcg

SEQ ID NO: 346324 - RNA, 14 nt, Bordetella pertussis
ccagcugcuucagu

SEQ ID NO: 346325 - RNA, 16 nt, Bordetella pertussis
ccagcugcuucaguuc

SEQ ID NO: 346326 - RNA, 21 nt, Bordetella pertussis
ccagcugcuucaguuccaggc

SEQ ID NO: 346327 - RNA, 18 nt, Bordetella pertussis
ccagcuggcgcaccaggc

SEQ ID NO: 346328 - RNA, 14 nt, Bordetella pertussis
ccagcuggcgcccc

SEQ ID NO: 346329 - RNA, 17 nt, Bordetella pertussis
ccagcuggcgccccuuc

SEQ ID NO: 346330 - RNA, 13 nt, Bordetella pertussis
ccagcuggcgcgu

SEQ ID NO: 346331 - RNA, 21 nt, Bordetella pertussis
ccagcuggcgcguggccgcca

SEQ ID NO: 346332 - RNA, 19 nt, Bordetella pertussis
ccagcuggcggcgcagcac

SEQ ID NO: 346333 - RNA, 22 nt, Bordetella pertussis
ccagcugggaggcgugcugcac

SEQ ID NO: 346334 - RNA, 23 nt, Bordetella pertussis
ccagcugggcgaucuucagcacc

SEQ ID NO: 346335 - RNA, 21 nt, Bordetella pertussis
ccagcugggcggcgugaccgc

SEQ ID NO: 346336 - RNA, 20 nt, Bordetella pertussis
ccagcuguccaagcgcgugg

SEQ ID NO: 346337 - RNA, 21 nt, Bordetella pertussis
ccagcuucucgcaagugcugg

SEQ ID NO: 346338 - RNA, 17 nt, Bordetella pertussis
ccagcuucugcgccugc

SEQ ID NO: 346339 - RNA, 19 nt, Bordetella pertussis
ccagcuucugcgccugcug

SEQ ID NO: 346340 - RNA, 20 nt, Bordetella pertussis
ccagcuucugcgccugcugg

SEQ ID NO: 346341 - RNA, 13 nt, Bordetella pertussis
ccagcuugaccgc

SEQ ID NO: 346342 - RNA, 20 nt, Bordetella pertussis
ccagcuugaccgccagcauc

SEQ ID NO: 346343 - RNA, 21 nt, Bordetella pertussis
ccagcuugaccuugagcacgc

SEQ ID NO: 346344 - RNA, 24 nt, Bordetella pertussis
ccagcuugaccuugagcacgcugg

SEQ ID NO: 346345 - RNA, 16 nt, Bordetella pertussis
ccagcuugacguccag

SEQ ID NO: 346346 - RNA, 20 nt, Bordetella pertussis
ccagcuugacguccagccag

SEQ ID NO: 346347 - RNA, 21 nt, Bordetella pertussis
ccagcuugagcaggcgcgagc

SEQ ID NO: 346348 - RNA, 16 nt, Bordetella pertussis
ccagcuugaugccgcc

SEQ ID NO: 346349 - RNA, 15 nt, Bordetella pertussis
ccagcuugcgcgccg

SEQ ID NO: 346350 - RNA, 16 nt, Bordetella pertussis
ccagcuugcgcgccgc

SEQ ID NO: 346351 - RNA, 17 nt, Bordetella pertussis
ccagcuugcgcgccgca

SEQ ID NO: 346352 - RNA, 15 nt, Bordetella pertussis
ccagcuugucgacca

SEQ ID NO: 346353 - RNA, 20 nt, Bordetella pertussis
ccagcuugucggccgcgcgc

SEQ ID NO: 346354 - RNA, 24 nt, Bordetella pertussis
ccagcuugucggccgcgcgcauca

SEQ ID NO: 346355 - RNA, 20 nt, Bordetella pertussis
ccaggaaaaccggcgccugg

SEQ ID NO: 346356 - RNA, 21 nt, Bordetella pertussis
ccaggaaaaccggcgccuggc

SEQ ID NO: 346357 - RNA, 16 nt, Bordetella pertussis
ccaggaaagaggccag

SEQ ID NO: 346358 - RNA, 20 nt, Bordetella pertussis
ccaggaaagaggccaggccc

SEQ ID NO: 346359 - RNA, 18 nt, Bordetella pertussis
ccaggaaagcgccgccgc

SEQ ID NO: 346360 - RNA, 17 nt, Bordetella pertussis
ccaggaacagcgccggc

SEQ ID NO: 346361 - RNA, 22 nt, Bordetella pertussis
ccaggaacagcgccggcagcgc

SEQ ID NO: 346362 - RNA, 22 nt, Bordetella pertussis
ccaggaacuugaacggcgcggc

SEQ ID NO: 346363 - RNA, 16 nt, Bordetella pertussis
ccaggaacgccagcag

SEQ ID NO: 346364 - RNA, 15 nt, Bordetella pertussis
ccaggaagcgcgccg

SEQ ID NO: 346365 - RNA, 22 nt, Bordetella pertussis
ccaggaagcgcgccgcgcgcac

SEQ ID NO: 346366 - RNA, 22 nt, Bordetella pertussis
ccaggaagcggcgcaccagcga

SEQ ID NO: 346367 - RNA, 18 nt, Bordetella pertussis
ccaggaagcgggccugcc

SEQ ID NO: 346368 - RNA, 16 nt, Bordetella pertussis
ccaggaccaggaugau

SEQ ID NO: 346369 - RNA, 17 nt, Bordetella pertussis
ccaggacguccaggccu

SEQ ID NO: 346370 - RNA, 20 nt, Bordetella pertussis
ccaggagcucguccccacgg

SEQ ID NO: 346371 - RNA, 20 nt, Bordetella pertussis
ccaggaguucccagcgcgcg

SEQ ID NO: 346372 - RNA, 21 nt, Bordetella pertussis
ccaggaguucccagcgcgcga

SEQ ID NO: 346373 - RNA, 16 nt, Bordetella pertussis
ccaggaucaccgccgc

SEQ ID NO: 346374 - RNA, 20 nt, Bordetella pertussis
ccaggaucaccgccgcgccg

SEQ ID NO: 346375 - RNA, 21 nt, Bordetella pertussis
ccaggaucgcggccagccggg

SEQ ID NO: 346376 - RNA, 13 nt, Bordetella pertussis
ccaggaucgucgu

SEQ ID NO: 346377 - RNA, 22 nt, Bordetella pertussis
ccaggaucgucgucaugaugua

SEQ ID NO: 346378 - RNA, 16 nt, Bordetella pertussis
ccaggauggcgccagc

SEQ ID NO: 346379 - RNA, 14 nt, Bordetella pertussis
ccaggaugcgcacc

SEQ ID NO: 346380 - RNA, 15 nt, Bordetella pertussis
ccaggaugcgcaccg

SEQ ID NO: 346381 - RNA, 18 nt, Bordetella pertussis
ccaggaugcgcaccggcc

SEQ ID NO: 346382 - RNA, 19 nt, Bordetella pertussis
ccaggaugcgcaccggcca

SEQ ID NO: 346383 - RNA, 19 nt, Bordetella pertussis
ccaggauggagagggccug

SEQ ID NO: 346384 - RNA, 23 nt, Bordetella pertussis
ccaggauggagagggccugguca

SEQ ID NO: 346385 - RNA, 17 nt, Bordetella pertussis
ccaggauuucauggcau

SEQ ID NO: 346386 - RNA, 21 nt, Bordetella pertussis
ccaggauuucauggcaucggc

SEQ ID NO: 346387 - RNA, 17 nt, Bordetella pertussis
ccaggcaaaggcccagg

SEQ ID NO: 346388 - RNA, 15 nt, Bordetella pertussis
ccaggcaaugcgcag

SEQ ID NO: 346389 - RNA, 16 nt, Bordetella pertussis
ccaggcaggcgggccc

SEQ ID NO: 346390 - RNA, 19 nt, Bordetella pertussis
ccaggcauucccgcccagc

SEQ ID NO: 346391 - RNA, 16 nt, Bordetella pertussis
ccaggcauucucggac

SEQ ID NO: 346392 - RNA, 13 nt, Bordetella pertussis
ccaggccgcccag

SEQ ID NO: 346393 - RNA, 14 nt, Bordetella pertussis
ccaggccgcccagc

SEQ ID NO: 346394 - RNA, 16 nt, Bordetella pertussis
ccaggccgccggcggc

SEQ ID NO: 346395 - RNA, 13 nt, Bordetella pertussis
ccaggccgccggc

SEQ ID NO: 346396 - RNA, 14 nt, Bordetella pertussis
ccaggccgccggcc

SEQ ID NO: 346397 - RNA, 15 nt, Bordetella pertussis
ccaggccgccggcca

SEQ ID NO: 346398 - RNA, 17 nt, Bordetella pertussis
ccaggccgccggccagc

SEQ ID NO: 346399 - RNA, 14 nt, Bordetella pertussis
ccaggccgccgccg

SEQ ID NO: 346400 - RNA, 18 nt, Bordetella pertussis
ccaggccgcggcgcccgg

SEQ ID NO: 346401 - RNA, 23 nt, Bordetella pertussis
ccaggccgcuuucgaccagcgac

SEQ ID NO: 346402 - RNA, 16 nt, Bordetella pertussis
ccaggccggccugcag

SEQ ID NO: 346403 - RNA, 18 nt, Bordetella pertussis
ccaggccggccuuggcca

SEQ ID NO: 346404 - RNA, 16 nt, Bordetella pertussis
ccaggccggccagggc

SEQ ID NO: 346405 - RNA, 16 nt, Bordetella pertussis
ccaggccggcgcgccg

SEQ ID NO: 346406 - RNA, 17 nt, Bordetella pertussis
ccaggccggcgcgcucg

SEQ ID NO: 346407 - RNA, 16 nt, Bordetella pertussis
ccaggccggcggcggg

SEQ ID NO: 346408 - RNA, 16 nt, Bordetella pertussis
ccaggccggcucgccg

SEQ ID NO: 346409 - RNA, 17 nt, Bordetella pertussis
ccaggccgggcgagccg

SEQ ID NO: 346410 - RNA, 20 nt, Bordetella pertussis
ccaggccggggccgcccagc

SEQ ID NO: 346411 - RNA, 16 nt, Bordetella pertussis
ccaggccggcgccagc

SEQ ID NO: 346412 - RNA, 17 nt, Bordetella pertussis
ccaggccggcgccagcc

SEQ ID NO: 346413 - RNA, 21 nt, Bordetella pertussis
ccaggccgucgagcacggggc

SEQ ID NO: 346414 - RNA, 22 nt, Bordetella pertussis
ccaggccgucgauuucggguga

SEQ ID NO: 346415 - RNA, 20 nt, Bordetella pertussis
ccaggccgucggccaggggc

SEQ ID NO: 346416 - RNA, 17 nt, Bordetella pertussis
ccaggccgugagcgccg

SEQ ID NO: 346417 - RNA, 20 nt, Bordetella pertussis
ccaggccgugagcgccgccg

SEQ ID NO: 346418 - RNA, 23 nt, Bordetella pertussis
ccaggccucggcuugcagguuga

SEQ ID NO: 346419 - RNA, 15 nt, Bordetella pertussis
ccaggccugccugau

SEQ ID NO: 346420 - RNA, 15 nt, Bordetella pertussis
ccaggcgccggcggu

SEQ ID NO: 346421 - RNA, 15 nt, Bordetella pertussis
ccaggcgccgggccg

SEQ ID NO: 346422 - RNA, 17 nt, Bordetella pertussis
ccaggcgcgcaucgcgc

SEQ ID NO: 346423 - RNA, 20 nt, Bordetella pertussis
ccaggcgcgcaucgcgcggc

SEQ ID NO: 346424 - RNA, 21 nt, Bordetella pertussis
ccaggcgcgcaucgcgcggca

SEQ ID NO: 346425 - RNA, 14 nt, Bordetella pertussis
ccaggcgcgccagc

SEQ ID NO: 346426 - RNA, 11 nt, Bordetella pertussis
ccaggcgcgca

SEQ ID NO: 346427 - RNA, 12 nt, Bordetella pertussis
ccaggcgcgcaa

SEQ ID NO: 346428 - RNA, 16 nt, Bordetella pertussis
ccaggcgcgcgccauc

SEQ ID NO: 346429 - RNA, 22 nt, Bordetella pertussis
ccaggcgcgcgccaucgacggg

SEQ ID NO: 346430 - RNA, 12 nt, Bordetella pertussis
ccaggcgcgcug

SEQ ID NO: 346431 - RNA, 14 nt, Bordetella pertussis
ccaggcgcggcgua

SEQ ID NO: 346432 - RNA, 17 nt, Bordetella pertussis
ccaggcgcgugcgcagg

SEQ ID NO: 346433 - RNA, 17 nt, Bordetella pertussis
ccaggcgcguugcgcuu

SEQ ID NO: 346434 - RNA, 12 nt, Bordetella pertussis
ccaggcgcucgc

SEQ ID NO: 346435 - RNA, 14 nt, Bordetella pertussis
ccaggcgcucgcgc

SEQ ID NO: 346436 - RNA, 18 nt, Bordetella pertussis
ccaggcgcucgcgcgcca

SEQ ID NO: 346437 - RNA, 21 nt, Bordetella pertussis
ccaggcgcucgcgcgccagca

SEQ ID NO: 346438 - RNA, 20 nt, Bordetella pertussis
ccaggcgcucgcgggugcgc

SEQ ID NO: 346439 - RNA, 18 nt, Bordetella pertussis
ccaggcuaucguggcugg

SEQ ID NO: 346440 - RNA, 15 nt, Bordetella pertussis
ccaggcucagcaggg

SEQ ID NO: 346441 - RNA, 19 nt, Bordetella pertussis
ccaggcucagcagggucga

SEQ ID NO: 346442 - RNA, 16 nt, Bordetella pertussis
ccaggcugaccagcgc

SEQ ID NO: 346443 - RNA, 18 nt, Bordetella pertussis
ccaggcugaccagcgcgu

SEQ ID NO: 346444 - RNA, 16 nt, Bordetella pertussis
ccaggcugaucaccca

SEQ ID NO: 346445 - RNA, 20 nt, Bordetella pertussis
ccaggcugcccuggcccagg

SEQ ID NO: 346446 - RNA, 23 nt, Bordetella pertussis
ccaggcugcccuggcccaggccg

SEQ ID NO: 346447 - RNA, 13 nt, Bordetella pertussis
ccaggcugccggc

SEQ ID NO: 346448 - RNA, 15 nt, Bordetella pertussis
ccaggcugccggcgu

SEQ ID NO: 346449 - RNA, 17 nt, Bordetella pertussis
ccagggcaagcgcgucg

SEQ ID NO: 346450 - RNA, 15 nt, Bordetella pertussis
ccagggcagcggcca

SEQ ID NO: 346451 - RNA, 16 nt, Bordetella pertussis
ccagggcagggcgccg

SEQ ID NO: 346452 - RNA, 15 nt, Bordetella pertussis
ccagggccacgccgg

SEQ ID NO: 346453 - RNA, 19 nt, Bordetella pertussis
ccagggccacgccggccgc

SEQ ID NO: 346454 - RNA, 17 nt, Bordetella pertussis
ccagggccaggccgccg

SEQ ID NO: 346455 - RNA, 18 nt, Bordetella pertussis
ccagggccaggccgccgc

SEQ ID NO: 346456 - RNA, 12 nt, Bordetella pertussis
ccagggccgcca

SEQ ID NO: 346457 - RNA, 14 nt, Bordetella pertussis
ccagggccgccagc

SEQ ID NO: 346458 - RNA, 16 nt, Bordetella pertussis
ccagggccgccagcac

SEQ ID NO: 346459 - RNA, 13 nt, Bordetella pertussis
ccagggccgccgc

SEQ ID NO: 346460 - RNA, 16 nt, Bordetella pertussis
ccagggccgcgccggg

SEQ ID NO: 346461 - RNA, 22 nt, Bordetella pertussis
ccagggccccuccggcgccgcc

SEQ ID NO: 346462 - RNA, 19 nt, Bordetella pertussis
ccagggccuccucggucgg

SEQ ID NO: 346463 - RNA, 19 nt, Bordetella pertussis
ccagggccugcgggccggg

SEQ ID NO: 346464 - RNA, 12 nt, Bordetella pertussis
ccagggcgcccg

SEQ ID NO: 346465 - RNA, 13 nt, Bordetella pertussis
ccagggcgcccgc

SEQ ID NO: 346466 - RNA, 13 nt, Bordetella pertussis
ccagggcgccgcg

SEQ ID NO: 346467 - RNA, 19 nt, Bordetella pertussis
ccagggcgccugccccggc

SEQ ID NO: 346468 - RNA, 20 nt, Bordetella pertussis
ccagggcgccugccccggca

SEQ ID NO: 346469 - RNA, 13 nt, Bordetella pertussis
ccagggcgcgccg

SEQ ID NO: 346470 - RNA, 15 nt, Bordetella pertussis
ccagggcgcgccgca

SEQ ID NO: 346471 - RNA, 23 nt, Bordetella pertussis
ccagggcgcggaucaugggcucg

SEQ ID NO: 346472 - RNA, 12 nt, Bordetella pertussis
ccagggcugcgg

SEQ ID NO: 346473 - RNA, 17 nt, Bordetella pertussis
ccagguacaggccgccg

SEQ ID NO: 346474 - RNA, 15 nt, Bordetella pertussis
ccagguaggcggcgc

SEQ ID NO: 346475 - RNA, 22 nt, Bordetella pertussis
ccagguaggcggcgcgcccgcc

SEQ ID NO: 346476 - RNA, 13 nt, Bordetella pertussis
ccagguaucggcc

SEQ ID NO: 346477 - RNA, 20 nt, Bordetella pertussis
ccagguaucggccagcacgu

SEQ ID NO: 346478 - RNA, 22 nt, Bordetella pertussis
ccagguauugcggggcggcgua

SEQ ID NO: 346479 - RNA, 13 nt, Bordetella pertussis
ccaggucgcgcac

SEQ ID NO: 346480 - RNA, 17 nt, Bordetella pertussis
ccaggucgcgcaccagg

SEQ ID NO: 346481 - RNA, 17 nt, Bordetella pertussis
ccaggucggacgcgccg

SEQ ID NO: 346482 - RNA, 19 nt, Bordetella pertussis
ccaggucggacgcgccggg

SEQ ID NO: 346483 - RNA, 14 nt, Bordetella pertussis
ccaggucggccacc

SEQ ID NO: 346484 - RNA, 18 nt, Bordetella pertussis
ccaggucggcggccagcg

SEQ ID NO: 346485 - RNA, 12 nt, Bordetella pertussis
ccaggucggcgu

SEQ ID NO: 346486 - RNA, 19 nt, Bordetella pertussis
ccagguggcccgcaccggg

SEQ ID NO: 346487 - RNA, 20 nt, Bordetella pertussis
ccagguggcgaugccgggca

SEQ ID NO: 346488 - RNA, 20 nt, Bordetella pertussis
ccagguggcggacaggcccu

SEQ ID NO: 346489 - RNA, 19 nt, Bordetella pertussis
ccaggugguuggcgugccc

SEQ ID NO: 346490 - RNA, 18 nt, Bordetella pertussis
ccagguugaaggccgcga

SEQ ID NO: 346491 - RNA, 16 nt, Bordetella pertussis
ccaguagcacacgccg

SEQ ID NO: 346492 - RNA, 19 nt, Bordetella pertussis
ccaguccggcagcacccag

SEQ ID NO: 346493 - RNA, 21 nt, Bordetella pertussis
ccagucgacccaccuggccac

SEQ ID NO: 346494 - RNA, 16 nt, Bordetella pertussis
ccagucgccgcgcccg

SEQ ID NO: 346495 - RNA, 15 nt, Bordetella pertussis
ccagucgccgcggua

SEQ ID NO: 346496 - RNA, 22 nt, Bordetella pertussis
ccaugcgaaugaucucgcgcuu

SEQ ID NO: 346497 - RNA, 15 nt, Bordetella pertussis
ccaugcgacagcccg

SEQ ID NO: 346498 - RNA, 23 nt, Bordetella pertussis
ccaugcgauacagcuuggcgcgc

SEQ ID NO: 346499 - RNA, 18 nt, Bordetella pertussis
ccaugcgauccagggcga

SEQ ID NO: 346500 - RNA, 21 nt, Bordetella pertussis
ccaugcgauccagggcgauca

SEQ ID NO: 346501 - RNA, 13 nt, Bordetella pertussis
ccaugcgcaccag

SEQ ID NO: 346502 - RNA, 17 nt, Bordetella pertussis
ccaugcgcacucgaccg

SEQ ID NO: 346503 - RNA, 21 nt, Bordetella pertussis
ccaugcgcacucgaccgccgg

SEQ ID NO: 346504 - RNA, 12 nt, Bordetella pertussis
ccaugcgcaugg

SEQ ID NO: 346505 - RNA, 15 nt, Bordetella pertussis
ccaugcgcauggcca

SEQ ID NO: 346506 - RNA, 18 nt, Bordetella pertussis
ccaugcgcauggccagca

SEQ ID NO: 346507 - RNA, 13 nt, Bordetella pertussis
ccaugcgccagca

SEQ ID NO: 346508 - RNA, 14 nt, Bordetella pertussis
ccaugcgccagcag

SEQ ID NO: 346509 - RNA, 15 nt, Bordetella pertussis
ccaugcgccagcagg

SEQ ID NO: 346510 - RNA, 18 nt, Bordetella pertussis
ccaugcgcccggccaccg

SEQ ID NO: 346511 - RNA, 15 nt, Bordetella pertussis
ccaugcgcgccagca

SEQ ID NO: 346512 - RNA, 13 nt, Bordetella pertussis
ccaugcgcggcac

SEQ ID NO: 346513 - RNA, 23 nt, Bordetella pertussis
ccaugcgcuggcgcaaggacgcg

SEQ ID NO: 346514 - RNA, 22 nt, Bordetella pertussis
ccaugcggcggcgggcggccgg

SEQ ID NO: 346515 - RNA, 18 nt, Bordetella pertussis
ccaugcggggacaggcac

SEQ ID NO: 346516 - RNA, 17 nt, Bordetella pertussis
ccaugcgggucaggccg

SEQ ID NO: 346517 - RNA, 20 nt, Bordetella pertussis
ccaugcgggucaggccgccg

SEQ ID NO: 346518 - RNA, 21 nt, Bordetella pertussis
ccaugcgggucaggccgccgu

SEQ ID NO: 346519 - RNA, 15 nt, Bordetella pertussis
ccaugcggugcgccg

SEQ ID NO: 346520 - RNA, 17 nt, Bordetella pertussis
ccaugcggugcgccgcg

SEQ ID NO: 346521 - RNA, 15 nt, Bordetella pertussis
ccaugcucgcgcaca

SEQ ID NO: 346522 - RNA, 22 nt, Bordetella pertussis
ccaugcucguccaucgccugca

SEQ ID NO: 346523 - RNA, 21 nt, Bordetella pertussis
aaaucgaggaaggcccgcguc

SEQ ID NO: 346524 - RNA, 14 nt, Bordetella pertussis
ccauucauccagcg

SEQ ID NO: 346525 - RNA, 14 nt, Bordetella pertussis
ccauugcagggugu

SEQ ID NO: 346526 - RNA, 14 nt, Bordetella pertussis
ccauugcgcggccu

SEQ ID NO: 346527 - RNA, 14 nt, Bordetella pertussis
ccauuuccaccacg

SEQ ID NO: 346528 - RNA, 16 nt, Bordetella pertussis
ccauuuguugggccac

SEQ ID NO: 346529 - RNA, 17 nt, Bordetella pertussis
cccaacccggcgaggcc

SEQ ID NO: 346530 - RNA, 20 nt, Bordetella pertussis
cccaacccggcgaggccgcc

SEQ ID NO: 346531 - RNA, 14 nt, Bordetella pertussis
cccaacgcggccag

SEQ ID NO: 346532 - RNA, 15 nt, Bordetella pertussis
cccaacgcggccagc

SEQ ID NO: 346533 - RNA, 14 nt, Bordetella pertussis
cccaacggcgcacc

SEQ ID NO: 346534 - RNA, 18 nt, Bordetella pertussis
cccaacggggacgggcgc

SEQ ID NO: 346535 - RNA, 19 nt, Bordetella pertussis
cccaacggggacgggcgcc

SEQ ID NO: 346536 - RNA, 18 nt, Bordetella pertussis
cccacaucgucgcgcugg

SEQ ID NO: 346537 - RNA, 19 nt, Bordetella pertussis
cccaccaccagcgcggcca

SEQ ID NO: 346538 - RNA, 17 nt, Bordetella pertussis
cccaccagccgggcggc

SEQ ID NO: 346539 - RNA, 15 nt, Bordetella pertussis
cccaccgcgaaccag

SEQ ID NO: 346540 - RNA, 14 nt, Bordetella pertussis
cccaccggcaugcc

SEQ ID NO: 346541 - RNA, 12 nt, Bordetella pertussis
cccacgcugcgc

SEQ ID NO: 346542 - RNA, 15 nt, Bordetella pertussis
cccacggcaucgccg

SEQ ID NO: 346543 - RNA, 21 nt, Bordetella pertussis
cccacggcaucgccgcgggcg

SEQ ID NO: 346544 - RNA, 15 nt, Bordetella pertussis
cccacggcguggcgc

SEQ ID NO: 346545 - RNA, 16 nt, Bordetella pertussis
cccacggggacaggca

SEQ ID NO: 346546 - RNA, 17 nt, Bordetella pertussis
cccacggggacaggcac

SEQ ID NO: 346547 - RNA, 24 nt, Bordetella pertussis
cccagaccaagcgccacagcgcca

SEQ ID NO: 346548 - RNA, 14 nt, Bordetella pertussis
cccagaccugcgcg

SEQ ID NO: 346549 - RNA, 19 nt, Bordetella pertussis
cccagaccugcgcgccggc

SEQ ID NO: 346550 - RNA, 18 nt, Bordetella pertussis
cccagacgcagaccacgc

SEQ ID NO: 346551 - RNA, 11 nt, Bordetella pertussis
cccagcacgac

SEQ ID NO: 346552 - RNA, 16 nt, Bordetella pertussis
cccagcacgcgcgcca

SEQ ID NO: 346553 - RNA, 21 nt, Bordetella pertussis
cccagcacgcgcgccagcugg

SEQ ID NO: 346554 - RNA, 18 nt, Bordetella pertussis
cccagcagauaccggcau

SEQ ID NO: 346555 - RNA, 13 nt, Bordetella pertussis
cccagcagcacgc

SEQ ID NO: 346556 - RNA, 13 nt, Bordetella pertussis
cccagcagcgcca

SEQ ID NO: 346557 - RNA, 16 nt, Bordetella pertussis
cccagcagcgccggga

SEQ ID NO: 346558 - RNA, 12 nt, Bordetella pertussis
cccagcagcggc

SEQ ID NO: 346559 - RNA, 15 nt, Bordetella pertussis
cccagcagcggcagc

SEQ ID NO: 346560 - RNA, 18 nt, Bordetella pertussis
cccagcagcggcagcagc

SEQ ID NO: 346561 - RNA, 16 nt, Bordetella pertussis
cccagcauccgcgcca

SEQ ID NO: 346562 - RNA, 12 nt, Bordetella pertussis
cccagcgcgccg

SEQ ID NO: 346563 - RNA, 19 nt, Bordetella pertussis
cccagcgcgccugcccagg

SEQ ID NO: 346564 - RNA, 18 nt, Bordetella pertussis
cccagcgcggcggccaug

SEQ ID NO: 346565 - RNA, 22 nt, Bordetella pertussis
cccagcgcgucggccagcgccg

SEQ ID NO: 346566 - RNA, 19 nt, Bordetella pertussis
cccagcgcgugggccagca

SEQ ID NO: 346567 - RNA, 14 nt, Bordetella pertussis
cccagcggcgcacc

SEQ ID NO: 346568 - RNA, 21 nt, Bordetella pertussis
cccagcggcgcaccgacagca

SEQ ID NO: 346569 - RNA, 17 nt, Bordetella pertussis
cccagcggcuggcgcac

SEQ ID NO: 346570 - RNA, 18 nt, Bordetella pertussis
cccagcggcuggcgcacg

SEQ ID NO: 346571 - RNA, 20 nt, Bordetella pertussis
cccagcggcuggcgcacgau

SEQ ID NO: 346572 - RNA, 20 nt, Bordetella pertussis
cccagcggggacaggcaccc

SEQ ID NO: 346573 - RNA, 17 nt, Bordetella pertussis
cccagcguguaggcggc

SEQ ID NO: 346574 - RNA, 19 nt, Bordetella pertussis
cccagcguguaggcggccg

SEQ ID NO: 346575 - RNA, 20 nt, Bordetella pertussis
cccagcguguaggcggccgg

SEQ ID NO: 346576 - RNA, 13 nt, Bordetella pertussis
cccagcguggcgg

SEQ ID NO: 346577 - RNA, 15 nt, Bordetella pertussis
cccagcuccagcugg

SEQ ID NO: 346578 - RNA, 19 nt, Bordetella pertussis
cccagcuccagcuggcgca

SEQ ID NO: 346579 - RNA, 13 nt, Bordetella pertussis
cccagcugggcgg

SEQ ID NO: 346580 - RNA, 20 nt, Bordetella pertussis
cccagcugggcggcgugacc

SEQ ID NO: 346581 - RNA, 14 nt, Bordetella pertussis
cccagcuggcgccc

SEQ ID NO: 346582 - RNA, 16 nt, Bordetella pertussis
cccagcuggcgccccu

SEQ ID NO: 346583 - RNA, 18 nt, Bordetella pertussis
cccagcuugaugccgccg

SEQ ID NO: 346584 - RNA, 20 nt, Bordetella pertussis
cccagcuugaugccgccgaa

SEQ ID NO: 346585 - RNA, 17 nt, Bordetella pertussis
cccagcuugucggccgc

SEQ ID NO: 346586 - RNA, 20 nt, Bordetella pertussis
cccagcuugucggccgcgcg

SEQ ID NO: 346587 - RNA, 14 nt, Bordetella pertussis
cccagggcagcggc

SEQ ID NO: 346588 - RNA, 16 nt, Bordetella pertussis
cccagggcagcggcca

SEQ ID NO: 346589 - RNA, 13 nt, Bordetella pertussis
cccagggccgcgc

SEQ ID NO: 346590 - RNA, 15 nt, Bordetella pertussis
cccagggccgcgccg

SEQ ID NO: 346591 - RNA, 17 nt, Bordetella pertussis
cccagggccgcgccggg

SEQ ID NO: 346592 - RNA, 13 nt, Bordetella pertussis
cccaggggacggc

SEQ ID NO: 346593 - RNA, 18 nt, Bordetella pertussis
cccaggggacggcgcacc

SEQ ID NO: 346594 - RNA, 19 nt, Bordetella pertussis
cccaggggacggcgcaccc

SEQ ID NO: 346595 - RNA, 17 nt, Bordetella pertussis
cccaggggccggcgcgc

SEQ ID NO: 346596 - RNA, 18 nt, Bordetella pertussis
cccaggggccggcgcgcc

SEQ ID NO: 346597 - RNA, 21 nt, Bordetella pertussis
cccagggggucagggccgccc

SEQ ID NO: 346598 - RNA, 22 nt, Bordetella pertussis
cccagguccgaaccgaccgcca

SEQ ID NO: 346599 - RNA, 17 nt, Bordetella pertussis
cccagguccgccggcac

SEQ ID NO: 346600 - RNA, 19 nt, Bordetella pertussis
cccaggucguugcgcgaag

SEQ ID NO: 346601 - RNA, 15 nt, Bordetella pertussis
cccaggucaucgcca

SEQ ID NO: 346602 - RNA, 20 nt, Bordetella pertussis
cccaggucaucgccaggcgc

SEQ ID NO: 346603 - RNA, 14 nt, Bordetella pertussis
cccaggugccggug

SEQ ID NO: 346604 - RNA, 17 nt, Bordetella pertussis
cccagguugaaggccgc

SEQ ID NO: 346605 - RNA, 17 nt, Bordetella pertussis
cccagguugcggccgcc

SEQ ID NO: 346606 - RNA, 22 nt, Bordetella pertussis
cccagguugcucgccucgauga

SEQ ID NO: 346607 - RNA, 17 nt, Bordetella pertussis
cccagucgccgcgcccg

SEQ ID NO: 346608 - RNA, 14 nt, Bordetella pertussis
cccaguuccacgcg

SEQ ID NO: 346609 - RNA, 17 nt, Bordetella pertussis
cccaguucgcgcagcag

SEQ ID NO: 346610 - RNA, 18 nt, Bordetella pertussis
cccaguucgcgcagcagc

SEQ ID NO: 346611 - RNA, 15 nt, Bordetella pertussis
cccaguucgcggccg

SEQ ID NO: 346612 - RNA, 18 nt, Bordetella pertussis
cccaguucugcagcgugc

SEQ ID NO: 346613 - RNA, 14 nt, Bordetella pertussis
cccaguucggcgac

SEQ ID NO: 346614 - RNA, 15 nt, Bordetella pertussis
cccaguucggcgcgc

SEQ ID NO: 346615 - RNA, 18 nt, Bordetella pertussis
cccaguugcuggcccagg

SEQ ID NO: 346616 - RNA, 21 nt, Bordetella pertussis
cccauagauggaaucauuggc

SEQ ID NO: 346617 - RNA, 17 nt, Bordetella pertussis
cccaucaccauggccga

SEQ ID NO: 346618 - RNA, 14 nt, Bordetella pertussis
cccauccacggcgc

SEQ ID NO: 346619 - RNA, 16 nt, Bordetella pertussis
cccauccacggcgcca

SEQ ID NO: 346620 - RNA, 19 nt, Bordetella pertussis
cccauccagcggacgggcc

SEQ ID NO: 346621 - RNA, 18 nt, Bordetella pertussis
cccaucccauccgcgcca

SEQ ID NO: 346622 - RNA, 15 nt, Bordetella pertussis
cccauccucaucgug

SEQ ID NO: 346623 - RNA, 16 nt, Bordetella pertussis
cccauccucaucgugc

SEQ ID NO: 346624 - RNA, 14 nt, Bordetella pertussis
cccauccuggccga

SEQ ID NO: 346625 - RNA, 23 nt, Bordetella pertussis
cccaugaacacuugacggccaag

SEQ ID NO: 346626 - RNA, 22 nt, Bordetella pertussis
cccaugaaggcggccagcaugc

SEQ ID NO: 346627 - RNA, 21 nt, Bordetella pertussis
cccaugacgaccuugcggccg

SEQ ID NO: 346628 - RNA, 16 nt, Bordetella pertussis
cccaugacgccggugu

SEQ ID NO: 346629 - RNA, 15 nt, Bordetella pertussis
cccaugauggugccg

SEQ ID NO: 346630 - RNA, 17 nt, Bordetella pertussis
cccaugcgcauggccag

SEQ ID NO: 346631 - RNA, 19 nt, Bordetella pertussis
cccaugcggccccucaagg

SEQ ID NO: 346632 - RNA, 19 nt, Bordetella pertussis
cccaugcggggacuggcac

SEQ ID NO: 346633 - RNA, 21 nt, Bordetella pertussis
cccaugcugaauugcgggccg

SEQ ID NO: 346634 - RNA, 23 nt, Bordetella pertussis
cccaugcugaauugcgggccggc

SEQ ID NO: 346635 - RNA, 14 nt, Bordetella pertussis
cccauggcaagcgc

SEQ ID NO: 346636 - RNA, 16 nt, Bordetella pertussis
cccauggcaagcgcaa

SEQ ID NO: 346637 - RNA, 17 nt, Bordetella pertussis
cccauggcaagcgcaau

SEQ ID NO: 346638 - RNA, 13 nt, Bordetella pertussis
cccauggccaggg

SEQ ID NO: 346639 - RNA, 16 nt, Bordetella pertussis
cccauggcgcgcagca

SEQ ID NO: 346640 - RNA, 16 nt, Bordetella pertussis
cccauggggacuggca

SEQ ID NO: 346641 - RNA, 16 nt, Bordetella pertussis
cccauguccagguagc

SEQ ID NO: 346642 - RNA, 15 nt, Bordetella pertussis
cccauucgcgcaccg

SEQ ID NO: 346643 - RNA, 18 nt, Bordetella pertussis
cccauugccucgcggcag

SEQ ID NO: 346644 - RNA, 18 nt, Bordetella pertussis
cccauuucgauggccagg

SEQ ID NO: 346645 - RNA, 12 nt, Bordetella pertussis
ccccaacgcggc

SEQ ID NO: 346646 - RNA, 16 nt, Bordetella pertussis
ccccaacgcggccagc

SEQ ID NO: 346647 - RNA, 14 nt, Bordetella pertussis
ccccaacggccuuc

SEQ ID NO: 346648 - RNA, 14 nt, Bordetella pertussis
ccccacacgcgcgc

SEQ ID NO: 346649 - RNA, 13 nt, Bordetella pertussis
ccccagcagcgcc

SEQ ID NO: 346650 - RNA, 14 nt, Bordetella pertussis
ccccagcgcccagg

SEQ ID NO: 346651 - RNA, 22 nt, Bordetella pertussis
ccccagcgcgccugcccaggcc

SEQ ID NO: 346652 - RNA, 13 nt, Bordetella pertussis
ccccagcggcgca

SEQ ID NO: 346653 - RNA, 16 nt, Bordetella pertussis
ccccagcggcuggcgc

SEQ ID NO: 346654 - RNA, 20 nt, Bordetella pertussis
ccccagcggcuggcgcacga

SEQ ID NO: 346655 - RNA, 17 nt, Bordetella pertussis
ccccaggcaggcgggcc

SEQ ID NO: 346656 - RNA, 19 nt, Bordetella pertussis
ccccagcuugucggccgcg

SEQ ID NO: 346657 - RNA, 23 nt, Bordetella pertussis
ccccagcuugucggccgcgcgca

SEQ ID NO: 346658 - RNA, 23 nt, Bordetella pertussis
ccccaggaacuugaacggcgcgg

SEQ ID NO: 346659 - RNA, 12 nt, Bordetella pertussis
ccccaugccgga

SEQ ID NO: 346660 - RNA, 15 nt, Bordetella pertussis
ccccaugcggggaca

SEQ ID NO: 346661 - RNA, 20 nt, Bordetella pertussis
ccccaugcggggacuggcac

SEQ ID NO: 346662 - RNA, 22 nt, Bordetella pertussis
ccccauggcaugcaccgcgugg

SEQ ID NO: 346663 - RNA, 18 nt, Bordetella pertussis
ccccauggggacuggcac

SEQ ID NO: 346664 - RNA, 24 nt, Bordetella pertussis
ccccauguccagguagcgccucgc

SEQ ID NO: 346665 - RNA, 20 nt, Bordetella pertussis
ccccauguggggacaggcac

SEQ ID NO: 346666 - RNA, 18 nt, Bordetella pertussis
ccccauugccucgcggca

SEQ ID NO: 346667 - RNA, 21 nt, Bordetella pertussis
ccccauugccucgcggcagug

SEQ ID NO: 346668 - RNA, 12 nt, Bordetella pertussis
cccccagcgccg

SEQ ID NO: 346669 - RNA, 15 nt, Bordetella pertussis
cccccagcggcgcac

SEQ ID NO: 346670 - RNA, 21 nt, Bordetella pertussis
ccccgcaagggggacuggcac

SEQ ID NO: 346671 - RNA, 17 nt, Bordetella pertussis
ccccgcacggggacagg

SEQ ID NO: 346672 - RNA, 20 nt, Bordetella pertussis
ccccgcacggggacuggcac

SEQ ID NO: 346673 - RNA, 18 nt, Bordetella pertussis
ccccgcagggacaggcuc

SEQ ID NO: 346674 - RNA, 11 nt, Bordetella pertussis
ccccgccaggc

SEQ ID NO: 346675 - RNA, 16 nt, Bordetella pertussis
ccccgcgucggacgcg

SEQ ID NO: 346676 - RNA, 15 nt, Bordetella pertussis
ccccgcugaccuggu

SEQ ID NO: 346677 - RNA, 20 nt, Bordetella pertussis
ccccgcugggacaggcacac

SEQ ID NO: 346678 - RNA, 22 nt, Bordetella pertussis
ccccggcaccaucgccgccugc

SEQ ID NO: 346679 - RNA, 16 nt, Bordetella pertussis
ccccggcucccgcgcc

SEQ ID NO: 346680 - RNA, 12 nt, Bordetella pertussis
ccccggucagca

SEQ ID NO: 346681 - RNA, 13 nt, Bordetella pertussis
ccccguagcgcau

SEQ ID NO: 346682 - RNA, 12 nt, Bordetella pertussis
ccccgucgaccg

SEQ ID NO: 346683 - RNA, 13 nt, Bordetella pertussis
ccccgucgaccgc

SEQ ID NO: 346684 - RNA, 14 nt, Bordetella pertussis
ccccgucggccguc

SEQ ID NO: 346685 - RNA, 17 nt, Bordetella pertussis
ccccgucggccgucugg

SEQ ID NO: 346686 - RNA, 15 nt, Bordetella pertussis
ccccgucgggacagg

SEQ ID NO: 346687 - RNA, 18 nt, Bordetella pertussis
ccccgucgggacaggcuc

SEQ ID NO: 346688 - RNA, 20 nt, Bordetella pertussis
ccccgugcggggaccggcac

SEQ ID NO: 346689 - RNA, 15 nt, Bordetella pertussis
ccccgucguccgucc

SEQ ID NO: 346690 - RNA, 20 nt, Bordetella pertussis
ccccguucggggacaggcac

SEQ ID NO: 346691 - RNA, 16 nt, Bordetella pertussis
ccccuugcggccgccg

SEQ ID NO: 346692 - RNA, 13 nt, Bordetella pertussis
ccccuuggcuucg

SEQ ID NO: 346693 - RNA, 17 nt, Bordetella pertussis
cccgaaacccagaucgc

SEQ ID NO: 346694 - RNA, 15 nt, Bordetella pertussis
cccgaaacgcgcagc

SEQ ID NO: 346695 - RNA, 20 nt, Bordetella pertussis
cccgacaccuggacccgcuc

SEQ ID NO: 346696 - RNA, 15 nt, Bordetella pertussis
cccgacagcgccccg

SEQ ID NO: 346697 - RNA, 14 nt, Bordetella pertussis
cccgacaugccgcc

SEQ ID NO: 346698 - RNA, 17 nt, Bordetella pertussis
cccgacaugccgcccca

SEQ ID NO: 346699 - RNA, 23 nt, Bordetella pertussis
cccgacaugccgccccaggcgua

SEQ ID NO: 346700 - RNA, 21 nt, Bordetella pertussis
cccgacccccggcccgcgccg

SEQ ID NO: 346701 - RNA, 19 nt, Bordetella pertussis
cccgaccgcaugggcgccg

SEQ ID NO: 346702 - RNA, 22 nt, Bordetella pertussis
cccgagauggcgcaggcgcgcg

SEQ ID NO: 346703 - RNA, 15 nt, Bordetella pertussis
cccgagcuggccggc

SEQ ID NO: 346704 - RNA, 13 nt, Bordetella pertussis
cccgaggcgcgca

SEQ ID NO: 346705 - RNA, 15 nt, Bordetella pertussis
cccgagggcgcggcg

SEQ ID NO: 346706 - RNA, 21 nt, Bordetella pertussis
cccgaguccuugacgccgccg

SEQ ID NO: 346707 - RNA, 22 nt, Bordetella pertussis
cccgaguccuugacgccgccga

SEQ ID NO: 346708 - RNA, 21 nt, Bordetella pertussis
cccgaguugaggaugcgcgcg

SEQ ID NO: 346709 - RNA, 19 nt, Bordetella pertussis
cccgaucgcgauggcccga

SEQ ID NO: 346710 - RNA, 14 nt, Bordetella pertussis
cccgaucggccggc

SEQ ID NO: 346711 - RNA, 12 nt, Bordetella pertussis
cccgaucggcgc

SEQ ID NO: 346712 - RNA, 21 nt, Bordetella pertussis
cccgaugauggauucgcgccg

SEQ ID NO: 346713 - RNA, 23 nt, Bordetella pertussis
cccgaugauggauucgcgccggc

SEQ ID NO: 346714 - RNA, 15 nt, Bordetella pertussis
cccgaugccuuggug

SEQ ID NO: 346715 - RNA, 12 nt, Bordetella pertussis
cccgaugcgcca

SEQ ID NO: 346716 - RNA, 14 nt, Bordetella pertussis
cccgcaccgaccag

SEQ ID NO: 346717 - RNA, 16 nt, Bordetella pertussis
cccgcaccgaccagcg

SEQ ID NO: 346718 - RNA, 17 nt, Bordetella pertussis
cccgcaccugaacaccg

SEQ ID NO: 346719 - RNA, 22 nt, Bordetella pertussis
cccgcaccugaacaccggcgcg

SEQ ID NO: 346720 - RNA, 15 nt, Bordetella pertussis
cccgcacgccggccu

SEQ ID NO: 346721 - RNA, 13 nt, Bordetella pertussis
cccgcacgggccg

SEQ ID NO: 346722 - RNA, 22 nt, Bordetella pertussis
cccgcacgggccgacggccucg

SEQ ID NO: 346723 - RNA, 22 nt, Bordetella pertussis
cccgcacggggacaggcacgcg

SEQ ID NO: 346724 - RNA, 13 nt, Bordetella pertussis
cccgcaucggcgu

SEQ ID NO: 346725 - RNA, 21 nt, Bordetella pertussis
cccgcaucggcguaccaggca

SEQ ID NO: 346726 - RNA, 22 nt, Bordetella pertussis
cccgcaucggcguaccaggcag

SEQ ID NO: 346727 - RNA, 20 nt, Bordetella pertussis
cccgcauggagaccggcgcc

SEQ ID NO: 346728 - RNA, 20 nt, Bordetella pertussis
cccgcaugggggcuggcgcu

SEQ ID NO: 346729 - RNA, 18 nt, Bordetella pertussis
cccgcaugucccagcgcu

SEQ ID NO: 346730 - RNA, 18 nt, Bordetella pertussis
cccgccaacacgauccac

SEQ ID NO: 346731 - RNA, 14 nt, Bordetella pertussis
cccgccaccacgcg

SEQ ID NO: 346732 - RNA, 19 nt, Bordetella pertussis
cccgccaccaggaacgcca

SEQ ID NO: 346733 - RNA, 22 nt, Bordetella pertussis
cccgccaccaggaacgccagca

SEQ ID NO: 346734 - RNA, 13 nt, Bordetella pertussis
cccgccacccagg

SEQ ID NO: 346735 - RNA, 21 nt, Bordetella pertussis
cccgccaauugcuugccuguc

SEQ ID NO: 346736 - RNA, 14 nt, Bordetella pertussis
cccgccacggcggu

SEQ ID NO: 346737 - RNA, 14 nt, Bordetella pertussis
cccgccccgugcac

SEQ ID NO: 346738 - RNA, 21 nt, Bordetella pertussis
cccgccccgugcaccaugccg

SEQ ID NO: 346739 - RNA, 19 nt, Bordetella pertussis
cccgcccgaaccggcaucc

SEQ ID NO: 346740 - RNA, 14 nt, Bordetella pertussis
cccgccgcgaucag

SEQ ID NO: 346741 - RNA, 12 nt, Bordetella pertussis
cccgccgcggca

SEQ ID NO: 346742 - RNA, 19 nt, Bordetella pertussis
cccgccggcacccggcuca

SEQ ID NO: 346743 - RNA, 16 nt, Bordetella pertussis
cccgccggcagugccu

SEQ ID NO: 346744 - RNA, 18 nt, Bordetella pertussis
cccgcgcacgcccgcgac

SEQ ID NO: 346745 - RNA, 17 nt, Bordetella pertussis
cccgcgcaccaggcgcg

SEQ ID NO: 346746 - RNA, 15 nt, Bordetella pertussis
cccgcgccaccaccg

SEQ ID NO: 346747 - RNA, 12 nt, Bordetella pertussis
cccgcgcggcca

SEQ ID NO: 346748 - RNA, 14 nt, Bordetella pertussis
cccgcgcggccagc

SEQ ID NO: 346749 - RNA, 16 nt, Bordetella pertussis
cccgcgcugccgcugc

SEQ ID NO: 346750 - RNA, 12 nt, Bordetella pertussis
cccgcgcugcgc

SEQ ID NO: 346751 - RNA, 17 nt, Bordetella pertussis
cccgcgcuggcgcagca

SEQ ID NO: 346752 - RNA, 23 nt, Bordetella pertussis
cccgcggaucggggcaacgacgc

SEQ ID NO: 346753 - RNA, 12 nt, Bordetella pertussis
cccgcggccacc

SEQ ID NO: 346754 - RNA, 20 nt, Bordetella pertussis
cccgcggccagccacgccgg

SEQ ID NO: 346755 - RNA, 13 nt, Bordetella pertussis
cccgcggccgcgg

SEQ ID NO: 346756 - RNA, 14 nt, Bordetella pertussis
cccgcggccgcggu

SEQ ID NO: 346757 - RNA, 13 nt, Bordetella pertussis
cccgcggccgcgu

SEQ ID NO: 346758 - RNA, 12 nt, Bordetella pertussis
cccgcggcgcca

SEQ ID NO: 346759 - RNA, 17 nt, Bordetella pertussis
cccgcggcgccagcgcu

SEQ ID NO: 346760 - RNA, 13 nt, Bordetella pertussis
cccgcggcgccca

SEQ ID NO: 346761 - RNA, 20 nt, Bordetella pertussis
cccgcggcccuugcgcgaag

SEQ ID NO: 346762 - RNA, 19 nt, Bordetella pertussis
cccgcggggacaggcaccc

SEQ ID NO: 346763 - RNA, 19 nt, Bordetella pertussis
cccgcggggacaggcaccu

SEQ ID NO: 346764 - RNA, 17 nt, Bordetella pertussis
cccgcggggacaggcuc

SEQ ID NO: 346765 - RNA, 18 nt, Bordetella pertussis
cccgcgggcgcccggccg

SEQ ID NO: 346766 - RNA, 14 nt, Bordetella pertussis
cccgcucggccacg

SEQ ID NO: 346767 - RNA, 14 nt, Bordetella pertussis
cccgcucggccagc

SEQ ID NO: 346768 - RNA, 15 nt, Bordetella pertussis
cccgcucggccagca

SEQ ID NO: 346769 - RNA, 22 nt, Bordetella pertussis
cccgcugaaggaccucgcgccg

SEQ ID NO: 346770 - RNA, 13 nt, Bordetella pertussis
cccgcugaccggc

SEQ ID NO: 346771 - RNA, 14 nt, Bordetella pertussis
cccgcugaccuggu

SEQ ID NO: 346772 - RNA, 12 nt, Bordetella pertussis
cccgcugccgag

SEQ ID NO: 346773 - RNA, 14 nt, Bordetella pertussis
cccggacaacgcgc

SEQ ID NO: 346774 - RNA, 18 nt, Bordetella pertussis
cccggauauggccggcgc

SEQ ID NO: 346775 - RNA, 20 nt, Bordetella pertussis
cccggauauggccggcgcgc

SEQ ID NO: 346776 - RNA, 15 nt, Bordetella pertussis
cccggaucgcacccg

SEQ ID NO: 346777 - RNA, 16 nt, Bordetella pertussis
cccggaucauccgggc

SEQ ID NO: 346778 - RNA, 21 nt, Bordetella pertussis
cccggaugcgauaucccgggc

SEQ ID NO: 346779 - RNA, 21 nt, Bordetella pertussis
cccggcggcgcgccgccgggc

SEQ ID NO: 346780 - RNA, 15 nt, Bordetella pertussis
cccggcggcgcggcg

SEQ ID NO: 346781 - RNA, 19 nt, Bordetella pertussis
cccggcgggaacaggcacc

SEQ ID NO: 346782 - RNA, 19 nt, Bordetella pertussis
cccggcggggacaggcgcc

SEQ ID NO: 346783 - RNA, 17 nt, Bordetella pertussis
cccggcggggcaggcgc

SEQ ID NO: 346784 - RNA, 12 nt, Bordetella pertussis
cccggcgggccg

SEQ ID NO: 346785 - RNA, 16 nt, Bordetella pertussis
cccggcggugaccugg

SEQ ID NO: 346786 - RNA, 17 nt, Bordetella pertussis
cccggcguauugccggg

SEQ ID NO: 346787 - RNA, 19 nt, Bordetella pertussis
cccggcgugcccagggcca

SEQ ID NO: 346788 - RNA, 12 nt, Bordetella pertussis
cccggcugcgcg

SEQ ID NO: 346789 - RNA, 19 nt, Bordetella pertussis
cccggcugcgcggccgagc

SEQ ID NO: 346790 - RNA, 20 nt, Bordetella pertussis
cccggcugggacaggcaccc

SEQ ID NO: 346791 - RNA, 11 nt, Bordetella pertussis
cccgggccguc

SEQ ID NO: 346792 - RNA, 12 nt, Bordetella pertussis
cccgggccgcug

SEQ ID NO: 346793 - RNA, 12 nt, Bordetella pertussis
cccgggcgcgcu

SEQ ID NO: 346794 - RNA, 15 nt, Bordetella pertussis
cccggguacguggcc

SEQ ID NO: 346795 - RNA, 15 nt, Bordetella pertussis
cccgggugaucaguc

SEQ ID NO: 346796 - RNA, 23 nt, Bordetella pertussis
cccgggugaucaguccgacgaca

SEQ ID NO: 346797 - RNA, 14 nt, Bordetella pertussis
cccgguaggccugg

SEQ ID NO: 346798 - RNA, 15 nt, Bordetella pertussis
cccgguaggccuggu

SEQ ID NO: 346799 - RNA, 15 nt, Bordetella pertussis
cccgguccaggccga

SEQ ID NO: 346800 - RNA, 13 nt, Bordetella pertussis
cccggugaucgag

SEQ ID NO: 346801 - RNA, 16 nt, Bordetella pertussis
cccggugcguaccagc

SEQ ID NO: 346802 - RNA, 22 nt, Bordetella pertussis
cccggugcgcgcagggcggccg

SEQ ID NO: 346803 - RNA, 23 nt, Bordetella pertussis
cccgguguaggcgggcagcggcg

SEQ ID NO: 346804 - RNA, 15 nt, Bordetella pertussis
cccgguucaaccggc

SEQ ID NO: 346805 - RNA, 13 nt, Bordetella pertussis
cccgucaucgccg

SEQ ID NO: 346806 - RNA, 19 nt, Bordetella pertussis
cccgucaucgggugcggcg

SEQ ID NO: 346807 - RNA, 14 nt, Bordetella pertussis
cccguccgggcggc

SEQ ID NO: 346808 - RNA, 17 nt, Bordetella pertussis
cccguccuuacuugcgc

SEQ ID NO: 346809 - RNA, 19 nt, Bordetella pertussis
cccguccuuggcguccggc

SEQ ID NO: 346810 - RNA, 16 nt, Bordetella pertussis
cccgucgaccgcggcg

SEQ ID NO: 346811 - RNA, 23 nt, Bordetella pertussis
cccguuccccaucaucugcggca

SEQ ID NO: 346812 - RNA, 18 nt, Bordetella pertussis
cccguugcggcgccucgg

SEQ ID NO: 346813 - RNA, 20 nt, Bordetella pertussis
cccguuggcaggccagcaug

SEQ ID NO: 346814 - RNA, 19 nt, Bordetella pertussis
cccguugucgccgcggccg

SEQ ID NO: 346815 - RNA, 14 nt, Bordetella pertussis
cccguuugcgcagc

SEQ ID NO: 346816 - RNA, 15 nt, Bordetella pertussis
cccguuugcgcagcu

SEQ ID NO: 346817 - RNA, 17 nt, Bordetella pertussis
cccuccgggucgcggca

SEQ ID NO: 346818 - RNA, 15 nt, Bordetella pertussis
cccuccucggccagg

SEQ ID NO: 346819 - RNA, 17 nt, Bordetella pertussis
cccucgaugaggccagg

SEQ ID NO: 346820 - RNA, 18 nt, Bordetella pertussis
cccucgcacggccgucaa

SEQ ID NO: 346821 - RNA, 13 nt, Bordetella pertussis
cccucgcgccacc

SEQ ID NO: 346822 - RNA, 15 nt, Bordetella pertussis
cccucgcggaugacc

SEQ ID NO: 346823 - RNA, 12 nt, Bordetella pertussis
cccucgcggccg

SEQ ID NO: 346824 - RNA, 16 nt, Bordetella pertussis
cccugcccggcgagca

SEQ ID NO: 346825 - RNA, 23 nt, Bordetella pertussis
cccugcccggcgagcauggcggu

SEQ ID NO: 346826 - RNA, 18 nt, Bordetella pertussis
cccugccgcccuggcgca

SEQ ID NO: 346827 - RNA, 15 nt, Bordetella pertussis
cccugcccgcaccau

SEQ ID NO: 346828 - RNA, 15 nt, Bordetella pertussis
cccugccgggacagg

SEQ ID NO: 346829 - RNA, 18 nt, Bordetella pertussis
cccugccuccaggcgcaa

SEQ ID NO: 346830 - RNA, 19 nt, Bordetella pertussis
cccugcgaacccgccgcga

SEQ ID NO: 346831 - RNA, 19 nt, Bordetella pertussis
cccugcgcacccgccugga

SEQ ID NO: 346832 - RNA, 14 nt, Bordetella pertussis
cccugcgccagcgc

SEQ ID NO: 346833 - RNA, 22 nt, Bordetella pertussis
cccugcgcgaggugccggacgc

SEQ ID NO: 346834 - RNA, 19 nt, Bordetella pertussis
cccugcgcgccgccggugc

SEQ ID NO: 346835 - RNA, 21 nt, Bordetella pertussis
cccugcgcguacguggcgcgg

SEQ ID NO: 346836 - RNA, 19 nt, Bordetella pertussis
cccugcgcguugagcagca

SEQ ID NO: 346837 - RNA, 18 nt, Bordetella pertussis
cccugcgcugcauacgcc

SEQ ID NO: 346838 - RNA, 13 nt, Bordetella pertussis
cccugcuggcgca

SEQ ID NO: 346839 - RNA, 23 nt, Bordetella pertussis
cccugcuugagcgaaauggcggc

SEQ ID NO: 346840 - RNA, 23 nt, Bordetella pertussis
cccuggacgucugagcgccgggg

SEQ ID NO: 346841 - RNA, 19 nt, Bordetella pertussis
cccuggagaucgccgccga

SEQ ID NO: 346842 - RNA, 18 nt, Bordetella pertussis
cccuggauggcggccgcc

SEQ ID NO: 346843 - RNA, 23 nt, Bordetella pertussis
cccuggcaagaagaucgucgacg

SEQ ID NO: 346844 - RNA, 21 nt, Bordetella pertussis
cccuggcagcuggcgcgggcg

SEQ ID NO: 346845 - RNA, 13 nt, Bordetella pertussis
cccuggcccaggc

SEQ ID NO: 346846 - RNA, 14 nt, Bordetella pertussis
cccuggccgaacgc

SEQ ID NO: 346847 - RNA, 18 nt, Bordetella pertussis
cccuggccguacauggcc

SEQ ID NO: 346848 - RNA, 13 nt, Bordetella pertussis
cccuuccuggcca

SEQ ID NO: 346849 - RNA, 15 nt, Bordetella pertussis
cccuucgacgcggcg

SEQ ID NO: 346850 - RNA, 16 nt, Bordetella pertussis
cccuucggggcagcga

SEQ ID NO: 346851 - RNA, 18 nt, Bordetella pertussis
cccuucggggcagcgaau

SEQ ID NO: 346852 - RNA, 18 nt, Bordetella pertussis
cccuugauggccgggccg

SEQ ID NO: 346853 - RNA, 19 nt, Bordetella pertussis
cccuugcgcgaacggcagg

SEQ ID NO: 346854 - RNA, 15 nt, Bordetella pertussis
cccuugcggccgccg

SEQ ID NO: 346855 - RNA, 18 nt, Bordetella pertussis
cccuugcggccgccgaac

SEQ ID NO: 346856 - RNA, 16 nt, Bordetella pertussis
cccuugcggggcgcgu

SEQ ID NO: 346857 - RNA, 22 nt, Bordetella pertussis
cccuugcucagucgggcagcgc

SEQ ID NO: 346858 - RNA, 21 nt, Bordetella pertussis
cccuugugcguuggcgcggcg

SEQ ID NO: 346859 - RNA, 13 nt, Bordetella pertussis
ccgaacaggcggu

SEQ ID NO: 346860 - RNA, 15 nt, Bordetella pertussis
ccgaaccagcgcacc

SEQ ID NO: 346861 - RNA, 15 nt, Bordetella pertussis
ccgaaccggcauccc

SEQ ID NO: 346862 - RNA, 19 nt, Bordetella pertussis
ccgaaccuuccuccgacag

SEQ ID NO: 346863 - RNA, 16 nt, Bordetella pertussis
ccgaacgcgcagcgaa

SEQ ID NO: 346864 - RNA, 17 nt, Bordetella pertussis
ccgaacggcccauccau

SEQ ID NO: 346865 - RNA, 12 nt, Bordetella pertussis
ccgaacggccgg

SEQ ID NO: 346866 - RNA, 13 nt, Bordetella pertussis
ccgaacgggcgug

SEQ ID NO: 346867 - RNA, 16 nt, Bordetella pertussis
ccgaacgggcguggcg

SEQ ID NO: 346868 - RNA, 17 nt, Bordetella pertussis
ccgaacgggcguggcgc

SEQ ID NO: 346869 - RNA, 17 nt, Bordetella pertussis
ccgaacucgcgcucggc

SEQ ID NO: 346870 - RNA, 20 nt, Bordetella pertussis
ccgaacucgcgcucggccag

SEQ ID NO: 346871 - RNA, 21 nt, Bordetella pertussis
ccgaagaucuccucgcgcgcg

SEQ ID NO: 346872 - RNA, 16 nt, Bordetella pertussis
ccgaagcaaugcagcg

SEQ ID NO: 346873 - RNA, 19 nt, Bordetella pertussis
ccgaagcaaugcagcgcga

SEQ ID NO: 346874 - RNA, 20 nt, Bordetella pertussis
ccgaagcaaugcagcgcgac

SEQ ID NO: 346875 - RNA, 16 nt, Bordetella pertussis
ccgaaggcgcggccgg

SEQ ID NO: 346876 - RNA, 15 nt, Bordetella pertussis
ccgaaggcggcgccg

SEQ ID NO: 346877 - RNA, 19 nt, Bordetella pertussis
ccgaaggugggcgaaccgc

SEQ ID NO: 346878 - RNA, 15 nt, Bordetella pertussis
ccgaauccagggcca

SEQ ID NO: 346879 - RNA, 21 nt, Bordetella pertussis
ccgaauugccgccgcugccgg

SEQ ID NO: 346880 - RNA, 14 nt, Bordetella pertussis
ccgacagauggcgc

SEQ ID NO: 346881 - RNA, 15 nt, Bordetella pertussis
ccgacagcacgcccg

SEQ ID NO: 346882 - RNA, 16 nt, Bordetella pertussis
ccgacagcacgcccgc

SEQ ID NO: 346883 - RNA, 15 nt, Bordetella pertussis
ccgacagcacauggc

SEQ ID NO: 346884 - RNA, 14 nt, Bordetella pertussis
ccgacagcgccagc

SEQ ID NO: 346885 - RNA, 15 nt, Bordetella pertussis
ccgacagcgccagcg

SEQ ID NO: 346886 - RNA, 13 nt, Bordetella pertussis
ccgacagcgcccc

SEQ ID NO: 346887 - RNA, 18 nt, Bordetella pertussis
ccgacagcgucgagcuga

SEQ ID NO: 346888 - RNA, 16 nt, Bordetella pertussis
ccgacagcucggacgg

SEQ ID NO: 346889 - RNA, 18 nt, Bordetella pertussis
ccgacaggcgcgcaggcg

SEQ ID NO: 346890 - RNA, 22 nt, Bordetella pertussis
ccgacagguaggcgccggucca

SEQ ID NO: 346891 - RNA, 20 nt, Bordetella pertussis
ccgacaugaccgcguccgcg

SEQ ID NO: 346892 - RNA, 15 nt, Bordetella pertussis
ccgaccaccagcacc

SEQ ID NO: 346893 - RNA, 21 nt, Bordetella pertussis
ccgaccacgcugggccagacc

SEQ ID NO: 346894 - RNA, 12 nt, Bordetella pertussis
ccgaccagcgcg

SEQ ID NO: 346895 - RNA, 15 nt, Bordetella pertussis
ccgaccagcgcgcgc

SEQ ID NO: 346896 - RNA, 16 nt, Bordetella pertussis
ccgaccagcucgacgc

SEQ ID NO: 346897 - RNA, 13 nt, Bordetella pertussis
ccgaccaggcccg

SEQ ID NO: 346898 - RNA, 15 nt, Bordetella pertussis
ccgaccaggcugcgc

SEQ ID NO: 346899 - RNA, 17 nt, Bordetella pertussis
ccgaccagguaucgacc

SEQ ID NO: 346900 - RNA, 21 nt, Bordetella pertussis
ccgacccccggcccgcgccgg

SEQ ID NO: 346901 - RNA, 12 nt, Bordetella pertussis
ccgaccgcgcgc

SEQ ID NO: 346902 - RNA, 18 nt, Bordetella pertussis
ccgaccggcgcgcgcguu

SEQ ID NO: 346903 - RNA, 17 nt, Bordetella pertussis
ccgaccgggccgaccag

SEQ ID NO: 346904 - RNA, 16 nt, Bordetella pertussis
ccgaccugcuggcgcg

SEQ ID NO: 346905 - RNA, 17 nt, Bordetella pertussis
ccgaccugcuggcgcgc

SEQ ID NO: 346906 - RNA, 20 nt, Bordetella pertussis
ccgaccugcuggcgcgcacc

SEQ ID NO: 346907 - RNA, 17 nt, Bordetella pertussis
ccgaccuggcgcccgac

SEQ ID NO: 346908 - RNA, 19 nt, Bordetella pertussis
ccgaccuggcgcccgacgg

SEQ ID NO: 346909 - RNA, 22 nt, Bordetella pertussis
ccgaccuggcgcccgacggcgc

SEQ ID NO: 346910 - RNA, 16 nt, Bordetella pertussis
ccgaccuccaggccca

SEQ ID NO: 346911 - RNA, 20 nt, Bordetella pertussis
ccgaccucuucguugucgcg

SEQ ID NO: 346912 - RNA, 15 nt, Bordetella pertussis
ccgaccugaucgcgc

SEQ ID NO: 346913 - RNA, 17 nt, Bordetella pertussis
ccgacgaaaugccggcg

SEQ ID NO: 346914 - RNA, 21 nt, Bordetella pertussis
ccgacgaugucgccgccgcgc

SEQ ID NO: 346915 - RNA, 15 nt, Bordetella pertussis
ccgacgcagcgcacc

SEQ ID NO: 346916 - RNA, 16 nt, Bordetella pertussis
ccgacgccgcgcgcga

SEQ ID NO: 346917 - RNA, 14 nt, Bordetella pertussis
ccgacgcgcccggg

SEQ ID NO: 346918 - RNA, 18 nt, Bordetella pertussis
ccgacgcgcccgggcuga

SEQ ID NO: 346919 - RNA, 20 nt, Bordetella pertussis
ccgacgcgcugguccgccgc

SEQ ID NO: 346920 - RNA, 12 nt, Bordetella pertussis
ccgacgcgcugu

SEQ ID NO: 346921 - RNA, 21 nt, Bordetella pertussis
ccgacgcgcuguccgaugcgc

SEQ ID NO: 346922 - RNA, 15 nt, Bordetella pertussis
ccgacgcggccagcg

SEQ ID NO: 346923 - RNA, 22 nt, Bordetella pertussis
ccgacgcggucgcccaacccgg

SEQ ID NO: 346924 - RNA, 13 nt, Bordetella pertussis
ccgacggcauggc

SEQ ID NO: 346925 - RNA, 13 nt, Bordetella pertussis
ccgacggccagcg

SEQ ID NO: 346926 - RNA, 16 nt, Bordetella pertussis
ccgacggccagcgcga

SEQ ID NO: 346927 - RNA, 17 nt, Bordetella pertussis
ccgacggccagcgcgac

SEQ ID NO: 346928 - RNA, 16 nt, Bordetella pertussis
ccgacggccucggcca

SEQ ID NO: 346929 - RNA, 18 nt, Bordetella pertussis
ccgacggcgccgugcugg

SEQ ID NO: 346930 - RNA, 16 nt, Bordetella pertussis
ccgacggcgcgcccgc

SEQ ID NO: 346931 - RNA, 23 nt, Bordetella pertussis
ccgacggcucgcgcucgcccggc

SEQ ID NO: 346932 - RNA, 21 nt, Bordetella pertussis
ccgacggggugccuguccccg

SEQ ID NO: 346933 - RNA, 23 nt, Bordetella pertussis
ccgacgguaucucagcgcgccgc

SEQ ID NO: 346934 - RNA, 22 nt, Bordetella pertussis
ccgacguagucgcgccagcggc

SEQ ID NO: 346935 - RNA, 16 nt, Bordetella pertussis
ccgacgugcugcugca

SEQ ID NO: 346936 - RNA, 19 nt, Bordetella pertussis
ccgacgugcugcugcacgu

SEQ ID NO: 346937 - RNA, 16 nt, Bordetella pertussis
ccgacguggaccgcgc

SEQ ID NO: 346938 - RNA, 18 nt, Bordetella pertussis
ccgacguggaccgcgcgg

SEQ ID NO: 346939 - RNA, 15 nt, Bordetella pertussis
ccgacucccaugacc

SEQ ID NO: 346940 - RNA, 19 nt, Bordetella pertussis
ccgacucgaaacgggcggc

SEQ ID NO: 346941 - RNA, 21 nt, Bordetella pertussis
ccgacucgaaacgggcggcgu

SEQ ID NO: 346942 - RNA, 23 nt, Bordetella pertussis
ccgacucgaaacgggcggcgucg

SEQ ID NO: 346943 - RNA, 19 nt, Bordetella pertussis
ccgacugcgcauggucgcg

SEQ ID NO: 346944 - RNA, 18 nt, Bordetella pertussis
ccgacuucaccgaggcgc

SEQ ID NO: 346945 - RNA, 20 nt, Bordetella pertussis
ccgagaaauccagcgcgccc

SEQ ID NO: 346946 - RNA, 21 nt, Bordetella pertussis
ccgagaacgccgucggggugg

SEQ ID NO: 346947 - RNA, 11 nt, Bordetella pertussis
ccgagacgcug

SEQ ID NO: 346948 - RNA, 15 nt, Bordetella pertussis
ccgagacggccgccg

SEQ ID NO: 346949 - RNA, 17 nt, Bordetella pertussis
ccgagacggccgccgac

SEQ ID NO: 346950 - RNA, 21 nt, Bordetella pertussis
ccgagacggccgccgacgccg

SEQ ID NO: 346951 - RNA, 19 nt, Bordetella pertussis
ccgagaggcugaaggggcu

SEQ ID NO: 346952 - RNA, 12 nt, Bordetella pertussis
ccgagcacagca

SEQ ID NO: 346953 - RNA, 14 nt, Bordetella pertussis
ccgcagccgucgcg

SEQ ID NO: 346954 - RNA, 21 nt, Bordetella pertussis
ccgcagcgagguggugacgau

SEQ ID NO: 346955 - RNA, 11 nt, Bordetella pertussis
ccgcagcgcca

SEQ ID NO: 346956 - RNA, 23 nt, Bordetella pertussis
ccgcagcuggacuauggccugga

SEQ ID NO: 346957 - RNA, 19 nt, Bordetella pertussis
ccgcaggcauugcgccagc

SEQ ID NO: 346958 - RNA, 22 nt, Bordetella pertussis
ccgcaggccguuggccgcgcgg

SEQ ID NO: 346959 - RNA, 16 nt, Bordetella pertussis
ccgcaggugccugucc

SEQ ID NO: 346960 - RNA, 16 nt, Bordetella pertussis
ccgcaguacccggugc

SEQ ID NO: 346961 - RNA, 13 nt, Bordetella pertussis
ccgcagugcgcgc

SEQ ID NO: 346962 - RNA, 15 nt, Bordetella pertussis
ccgcaguuccaggca

SEQ ID NO: 346963 - RNA, 21 nt, Bordetella pertussis
ccgcauaccuuggcgcccagc

SEQ ID NO: 346964 - RNA, 17 nt, Bordetella pertussis
ccgcauagacgccgacc

SEQ ID NO: 346965 - RNA, 17 nt, Bordetella pertussis
ccgcaucgcgcagcgug

SEQ ID NO: 346966 - RNA, 14 nt, Bordetella pertussis
ccgcaucgcgcgcc

SEQ ID NO: 346967 - RNA, 17 nt, Bordetella pertussis
ccgcaucgcgcgccgcc

SEQ ID NO: 346968 - RNA, 19 nt, Bordetella pertussis
ccgcaucgcgcgccgccgc

SEQ ID NO: 346969 - RNA, 15 nt, Bordetella pertussis
ccgccaccacgcgca

SEQ ID NO: 346970 - RNA, 15 nt, Bordetella pertussis
ccgccaccacggcgc

SEQ ID NO: 346971 - RNA, 14 nt, Bordetella pertussis
ccgccaccagcggc

SEQ ID NO: 346972 - RNA, 18 nt, Bordetella pertussis
ccgccaccagcggcgugg

SEQ ID NO: 346973 - RNA, 22 nt, Bordetella pertussis
ccgccaccagggcgcccgccga

SEQ ID NO: 346974 - RNA, 17 nt, Bordetella pertussis
ccgccacccaggcggca

SEQ ID NO: 346975 - RNA, 21 nt, Bordetella pertussis
ccgccacccaggcggcaggcg

SEQ ID NO: 346976 - RNA, 22 nt, Bordetella pertussis
ccgccacccagggcuugacgcg

SEQ ID NO: 346977 - RNA, 16 nt, Bordetella pertussis
ccgccacccuggcacg

SEQ ID NO: 346978 - RNA, 21 nt, Bordetella pertussis
ccgccaccgcccccgccgcca

SEQ ID NO: 346979 - RNA, 14 nt, Bordetella pertussis
ccgccaccgcgccg

SEQ ID NO: 346980 - RNA, 20 nt, Bordetella pertussis
ccgccagaucguugaucucg

SEQ ID NO: 346981 - RNA, 12 nt, Bordetella pertussis
ccgccagcgcca

SEQ ID NO: 346982 - RNA, 15 nt, Bordetella pertussis
ccgccagcgcgccgc

SEQ ID NO: 346983 - RNA, 16 nt, Bordetella pertussis
ccgccagcgcgcgcga

SEQ ID NO: 346984 - RNA, 20 nt, Bordetella pertussis
ccgccagcgcgcgcgaggcg

SEQ ID NO: 346985 - RNA, 21 nt, Bordetella pertussis
ccgccagcgcgcgcgaggcgg

SEQ ID NO: 346986 - RNA, 13 nt, Bordetella pertussis
ccgccagcgcgcc

SEQ ID NO: 346987 - RNA, 12 nt, Bordetella pertussis
ccgccaggucgg

SEQ ID NO: 346988 - RNA, 17 nt, Bordetella pertussis
ccgccaguucgucgucg

SEQ ID NO: 346989 - RNA, 21 nt, Bordetella pertussis
ccgccaguucgucgucggucg

SEQ ID NO: 346990 - RNA, 15 nt, Bordetella pertussis
ccgccauaggcgcgc

SEQ ID NO: 346991 - RNA, 20 nt, Bordetella pertussis
ccgccauaggcgcgcaccag

SEQ ID NO: 346992 - RNA, 21 nt, Bordetella pertussis
ccgccauaggcgcgcaccagc

SEQ ID NO: 346993 - RNA, 22 nt, Bordetella pertussis
ccgccaucauccuggucgacgc

SEQ ID NO: 346994 - RNA, 21 nt, Bordetella pertussis
ccgccaucauggcgucggcca

SEQ ID NO: 346995 - RNA, 22 nt, Bordetella pertussis
ccgccaucauggcgucggccac

SEQ ID NO: 346996 - RNA, 15 nt, Bordetella pertussis
ccgccauccuggccg

SEQ ID NO: 346997 - RNA, 18 nt, Bordetella pertussis
ccgcccgcacgaagcggc

SEQ ID NO: 346998 - RNA, 13 nt, Bordetella pertussis
ccgcccgcaggca

SEQ ID NO: 346999 - RNA, 13 nt, Bordetella pertussis
ccgcccgccccgg

SEQ ID NO: 347000 - RNA, 14 nt, Bordetella pertussis
ccgcccgccccggc

SEQ ID NO: 347001 - RNA, 12 nt, Bordetella pertussis
ccgcccgcccgc

SEQ ID NO: 347002 - RNA, 16 nt, Bordetella pertussis
ccgcccgcccugggca

SEQ ID NO: 347003 - RNA, 15 nt, Bordetella pertussis
ccgcccgccgccugc

SEQ ID NO: 347004 - RNA, 13 nt, Bordetella pertussis
ccgcccgccgggc

SEQ ID NO: 347005 - RNA, 15 nt, Bordetella pertussis
ccgcccgccgggccg

SEQ ID NO: 347006 - RNA, 13 nt, Bordetella pertussis
ccgcccgcgccca

SEQ ID NO: 347007 - RNA, 14 nt, Bordetella pertussis
ccgcccgcgcccag

SEQ ID NO: 347008 - RNA, 13 nt, Bordetella pertussis
ccgcccgcuccac

SEQ ID NO: 347009 - RNA, 23 nt, Bordetella pertussis
ccgcccgcuccaccagcaccggc

SEQ ID NO: 347010 - RNA, 18 nt, Bordetella pertussis
ccgcccggguuggcgucc

SEQ ID NO: 347011 - RNA, 22 nt, Bordetella pertussis
ccgcccgugccaguucacggug

SEQ ID NO: 347012 - RNA, 16 nt, Bordetella pertussis
ccgcccugccgccaag

SEQ ID NO: 347013 - RNA, 23 nt, Bordetella pertussis
ccgcccugccgccaagggcgcgc

SEQ ID NO: 347014 - RNA, 21 nt, Bordetella pertussis
ccgcccugcugcccgccgccg

SEQ ID NO: 347015 - RNA, 15 nt, Bordetella pertussis
ccgcccuggcgcagg

SEQ ID NO: 347016 - RNA, 18 nt, Bordetella pertussis
ccgcccuuggucaccgag

SEQ ID NO: 347017 - RNA, 16 nt, Bordetella pertussis
ccgccgaacgaggcgc

SEQ ID NO: 347018 - RNA, 19 nt, Bordetella pertussis
ccgccgaacgaggcgcggu

SEQ ID NO: 347019 - RNA, 22 nt, Bordetella pertussis
ccgccgaaccagcgcaccacca

SEQ ID NO: 347020 - RNA, 14 nt, Bordetella pertussis
ccgccgaacggggc

SEQ ID NO: 347021 - RNA, 18 nt, Bordetella pertussis
ccgccgaacggggccgcc

SEQ ID NO: 347022 - RNA, 19 nt, Bordetella pertussis
ccgccgaacggggccgccu

SEQ ID NO: 347023 - RNA, 14 nt, Bordetella pertussis
ccgccgaagccgcc

SEQ ID NO: 347024 - RNA, 15 nt, Bordetella pertussis
ccgccgacgaugacc

SEQ ID NO: 347025 - RNA, 14 nt, Bordetella pertussis
ccgccgacgccgcc

SEQ ID NO: 347026 - RNA, 21 nt, Bordetella pertussis
ccgccgacggcauggcggcca

SEQ ID NO: 347027 - RNA, 18 nt, Bordetella pertussis
ccgccgacguagucgcgc

SEQ ID NO: 347028 - RNA, 12 nt, Bordetella pertussis
ccgccgagucgg

SEQ ID NO: 347029 - RNA, 16 nt, Bordetella pertussis
ccgccgauaccacgcg

SEQ ID NO: 347030 - RNA, 20 nt, Bordetella pertussis
ccgccgauaccacgcgcggc

SEQ ID NO: 347031 - RNA, 21 nt, Bordetella pertussis
ccgccgauaccacgcgcggcg

SEQ ID NO: 347032 - RNA, 22 nt, Bordetella pertussis
ccgccgauccacucggccagcg

SEQ ID NO: 347033 - RNA, 15 nt, Bordetella pertussis
ccgccgauggcgcca

SEQ ID NO: 347034 - RNA, 20 nt, Bordetella pertussis
ccgccgauggcgcgcggcug

SEQ ID NO: 347035 - RNA, 16 nt, Bordetella pertussis
ccgccgaugugcggcg

SEQ ID NO: 347036 - RNA, 14 nt, Bordetella pertussis
ccgccgcaccagcc

SEQ ID NO: 347037 - RNA, 14 nt, Bordetella pertussis
ccgccgcacgggcg

SEQ ID NO: 347038 - RNA, 17 nt, Bordetella pertussis
ccgccgcacgggcgccu

SEQ ID NO: 347039 - RNA, 15 nt, Bordetella pertussis
ccgccgcagccgcca

SEQ ID NO: 347040 - RNA, 19 nt, Bordetella pertussis
ccgccgccacgcgcacggc

SEQ ID NO: 347041 - RNA, 12 nt, Bordetella pertussis
ccgccgccagca

SEQ ID NO: 347042 - RNA, 18 nt, Bordetella pertussis
ccgccgccagcacgccau

SEQ ID NO: 347043 - RNA, 15 nt, Bordetella pertussis
ccgccgcccacgccg

SEQ ID NO: 347044 - RNA, 11 nt, Bordetella pertussis
ccgccgcccgc

SEQ ID NO: 347045 - RNA, 13 nt, Bordetella pertussis
ccgccgcccggca

SEQ ID NO: 347046 - RNA, 15 nt, Bordetella pertussis
ccgccgcccuggccg

SEQ ID NO: 347047 - RNA, 18 nt, Bordetella pertussis
ccgccgcccuggccgcgc

SEQ ID NO: 347048 - RNA, 12 nt, Bordetella pertussis
ccgccgccgacg

SEQ ID NO: 347049 - RNA, 14 nt, Bordetella pertussis
ccgccgccgccacc

SEQ ID NO: 347050 - RNA, 14 nt, Bordetella pertussis
ccgccgccgcggcc

SEQ ID NO: 347051 - RNA, 15 nt, Bordetella pertussis
ccgccgccggcaauc

SEQ ID NO: 347052 - RNA, 15 nt, Bordetella pertussis
ccgccgccggcccgc

SEQ ID NO: 347053 - RNA, 15 nt, Bordetella pertussis
ccgccgccggcgaca

SEQ ID NO: 347054 - RNA, 15 nt, Bordetella pertussis
ccgccgccggcgcgg

SEQ ID NO: 347055 - RNA, 17 nt, Bordetella pertussis
ccgccgccuuggacgcg

SEQ ID NO: 347056 - RNA, 18 nt, Bordetella pertussis
ccgccgccuuggacgcgc

SEQ ID NO: 347057 - RNA, 16 nt, Bordetella pertussis
ccgccgcgaccgggcc

SEQ ID NO: 347058 - RNA, 17 nt, Bordetella pertussis
ccgccgcgaccgggccg

SEQ ID NO: 347059 - RNA, 16 nt, Bordetella pertussis
ccgccgcgcaccaccg

SEQ ID NO: 347060 - RNA, 17 nt, Bordetella pertussis
ccgccgcgcaccaccga

SEQ ID NO: 347061 - RNA, 12 nt, Bordetella pertussis
ccgccgcgcagc

SEQ ID NO: 347062 - RNA, 23 nt, Bordetella pertussis
ccgccgcgccaugcucgcgcaca

SEQ ID NO: 347063 - RNA, 13 nt, Bordetella pertussis
ccgccgcgcccag

SEQ ID NO: 347064 - RNA, 14 nt, Bordetella pertussis
ccgccgcgcccagc

SEQ ID NO: 347065 - RNA, 15 nt, Bordetella pertussis
ccgccgcgcagccga

SEQ ID NO: 347066 - RNA, 15 nt, Bordetella pertussis
ccgccgcgcccuggc

SEQ ID NO: 347067 - RNA, 12 nt, Bordetella pertussis
ccgccgcgccga

SEQ ID NO: 347068 - RNA, 12 nt, Bordetella pertussis
ccgccgcgccgc

SEQ ID NO: 347069 - RNA, 14 nt, Bordetella pertussis
ccgccgcgccgcug

SEQ ID NO: 347070 - RNA, 13 nt, Bordetella pertussis
ccgccgcgccggu

SEQ ID NO: 347071 - RNA, 14 nt, Bordetella pertussis
ccgccgcgcgccgc

SEQ ID NO: 347072 - RNA, 16 nt, Bordetella pertussis
ccgccgcgcgccgcgc

SEQ ID NO: 347073 - RNA, 13 nt, Bordetella pertussis
ccgccgcgcgcgg

SEQ ID NO: 347074 - RNA, 13 nt, Bordetella pertussis
ccgccgcgcgcug

SEQ ID NO: 347075 - RNA, 19 nt, Bordetella pertussis
ccgccgcgcggugcucggc

SEQ ID NO: 347076 - RNA, 20 nt, Bordetella pertussis
ccgccgcgcggugcucggcg

SEQ ID NO: 347077 - RNA, 14 nt, Bordetella pertussis
ccgccgcgcggcgg

SEQ ID NO: 347078 - RNA, 14 nt, Bordetella pertussis
ccgccgcgcucggc

SEQ ID NO: 347079 - RNA, 15 nt, Bordetella pertussis
ccgccgcgcucggcg

SEQ ID NO: 347080 - RNA, 12 nt, Bordetella pertussis
ccgccggcgcgc

SEQ ID NO: 347081 - RNA, 22 nt, Bordetella pertussis
ccgccggcgcgcgcgcgccgca

SEQ ID NO: 347082 - RNA, 14 nt, Bordetella pertussis
ccgccggcgcgcgg

SEQ ID NO: 347083 - RNA, 22 nt, Bordetella pertussis
ccgccggcgcgcggaugaucgc

SEQ ID NO: 347084 - RNA, 15 nt, Bordetella pertussis
ccgccggcgcggcug

SEQ ID NO: 347085 - RNA, 13 nt, Bordetella pertussis
ccgccggcgcggu

SEQ ID NO: 347086 - RNA, 19 nt, Bordetella pertussis
ccgccggcgcgguggccau

SEQ ID NO: 347087 - RNA, 20 nt, Bordetella pertussis
ccgccggcggcauucagcgc

SEQ ID NO: 347088 - RNA, 15 nt, Bordetella pertussis
ccgccggcggccugg

SEQ ID NO: 347089 - RNA, 17 nt, Bordetella pertussis
ccgccggcggccuggac

SEQ ID NO: 347090 - RNA, 14 nt, Bordetella pertussis
ccgccggcggcguc

SEQ ID NO: 347091 - RNA, 17 nt, Bordetella pertussis
ccgccggcggcgugccc

SEQ ID NO: 347092 - RNA, 18 nt, Bordetella pertussis
ccgccggcgucgcucagg

SEQ ID NO: 347093 - RNA, 12 nt, Bordetella pertussis
ccgccggcgugc

SEQ ID NO: 347094 - RNA, 17 nt, Bordetella pertussis
ccgccgggacacacgcu

SEQ ID NO: 347095 - RNA, 20 nt, Bordetella pertussis
ccgccgggacaggcaccccg

SEQ ID NO: 347096 - RNA, 21 nt, Bordetella pertussis
ccgccgggacaggcacccgcg

SEQ ID NO: 347097 - RNA, 22 nt, Bordetella pertussis
ccgccgggacaggcacccgcgc

SEQ ID NO: 347098 - RNA, 15 nt, Bordetella pertussis
ccgccgggcaugcac

SEQ ID NO: 347099 - RNA, 20 nt, Bordetella pertussis
ccgccgggcaugcaccaggc

SEQ ID NO: 347100 - RNA, 18 nt, Bordetella pertussis
ccgccgggccgcgaccac

SEQ ID NO: 347101 - RNA, 13 nt, Bordetella pertussis
ccgccgggccguc

SEQ ID NO: 347102 - RNA, 18 nt, Bordetella pertussis
ccgccgggccgucgugcg

SEQ ID NO: 347103 - RNA, 16 nt, Bordetella pertussis
ccgccgggcgcgcgcc

SEQ ID NO: 347104 - RNA, 18 nt, Bordetella pertussis
ccgccgggcgcgcgccgg

SEQ ID NO: 347105 - RNA, 19 nt, Bordetella pertussis
ccgccgggcgcgcgccggc

SEQ ID NO: 347106 - RNA, 23 nt, Bordetella pertussis
ccgccgggcgcgcgccggcggcc

SEQ ID NO: 347107 - RNA, 22 nt, Bordetella pertussis
ccgccgggcuccucgcccgacc

SEQ ID NO: 347108 - RNA, 20 nt, Bordetella pertussis
ccgccgguucggucgacgac

SEQ ID NO: 347109 - RNA, 22 nt, Bordetella pertussis
ccgccgguucggucgacgacgg

SEQ ID NO: 347110 - RNA, 17 nt, Bordetella pertussis
ccgccguagccgcugcg

SEQ ID NO: 347111 - RNA, 23 nt, Bordetella pertussis
ccgccguagccgcugcgcgcggc

SEQ ID NO: 347112 - RNA, 18 nt, Bordetella pertussis
ccgccguagcgcgccagc

SEQ ID NO: 347113 - RNA, 22 nt, Bordetella pertussis
ccgccguaggacagccccagca

SEQ ID NO: 347114 - RNA, 17 nt, Bordetella pertussis
ccgccgucaacgcccag

SEQ ID NO: 347115 - RNA, 18 nt, Bordetella pertussis
ccgccgucaacgcccagg

SEQ ID NO: 347116 - RNA, 16 nt, Bordetella pertussis
ccgccgucagcucgau

SEQ ID NO: 347117 - RNA, 19 nt, Bordetella pertussis
ccgccguugcucgcgcgca

SEQ ID NO: 347118 - RNA, 21 nt, Bordetella pertussis
ccgccguugcucgcgcgcagu

SEQ ID NO: 347119 - RNA, 21 nt, Bordetella pertussis
ccgccuaccaggugggcgcgc

SEQ ID NO: 347120 - RNA, 16 nt, Bordetella pertussis
ccgccuacuggcgcgc

SEQ ID NO: 347121 - RNA, 18 nt, Bordetella pertussis
ccgccuacuggcgcgcgc

SEQ ID NO: 347122 - RNA, 19 nt, Bordetella pertussis
ccgccuauguaggcgccgc

SEQ ID NO: 347123 - RNA, 21 nt, Bordetella pertussis
ccgccuauguaggcgccgcgc

SEQ ID NO: 347124 - RNA, 23 nt, Bordetella pertussis
ccgccucaaccuucucgaugcgc

SEQ ID NO: 347125 - RNA, 14 nt, Bordetella pertussis
ccgccucaccgcgc

SEQ ID NO: 347126 - RNA, 13 nt, Bordetella pertussis
ccgccucagcccg

SEQ ID NO: 347127 - RNA, 21 nt, Bordetella pertussis
ccgccucagcguuuccagggc

SEQ ID NO: 347128 - RNA, 22 nt, Bordetella pertussis
ccgccucagcguuuccagggcg

SEQ ID NO: 347129 - RNA, 13 nt, Bordetella pertussis
ccgccucaggccg

SEQ ID NO: 347130 - RNA, 14 nt, Bordetella pertussis
ccgccucaggccgg

SEQ ID NO: 347131 - RNA, 18 nt, Bordetella pertussis
ccgccucaggccggcgcc

SEQ ID NO: 347132 - RNA, 21 nt, Bordetella pertussis
ccgccucaggccggcgccugg

SEQ ID NO: 347133 - RNA, 20 nt, Bordetella pertussis
ccgccuccaggaugagcgcc

SEQ ID NO: 347134 - RNA, 23 nt, Bordetella pertussis
ccgccuccaggaugagcgccugc

SEQ ID NO: 347135 - RNA, 13 nt, Bordetella pertussis
ccgccuccaggcg

SEQ ID NO: 347136 - RNA, 16 nt, Bordetella pertussis
ccgccuccaggcggcg

SEQ ID NO: 347137 - RNA, 10 nt, Bordetella pertussis
ccgccugcgg

SEQ ID NO: 347138 - RNA, 16 nt, Bordetella pertussis
ccgccugcggacggcg

SEQ ID NO: 347139 - RNA, 17 nt, Bordetella pertussis
ccgccugcguggcgggc

SEQ ID NO: 347140 - RNA, 22 nt, Bordetella pertussis
ccgccugcguggcgggccgcgc

SEQ ID NO: 347141 - RNA, 23 nt, Bordetella pertussis
ccgccugcguggcgggccgcgcc

SEQ ID NO: 347142 - RNA, 18 nt, Bordetella pertussis
ccgccugcugggccgcgc

SEQ ID NO: 347143 - RNA, 19 nt, Bordetella pertussis
ccgccugcugggccgcgcu

SEQ ID NO: 347144 - RNA, 21 nt, Bordetella pertussis
ccgccugcugggccgcgcucg

SEQ ID NO: 347145 - RNA, 14 nt, Bordetella pertussis
ccgccugcugcgcc

SEQ ID NO: 347146 - RNA, 22 nt, Bordetella pertussis
ccgccuggcccacaucgucgcg

SEQ ID NO: 347147 - RNA, 16 nt, Bordetella pertussis
ccgccuggcgcggcgc

SEQ ID NO: 347148 - RNA, 20 nt, Bordetella pertussis
ccgccuggcgcggcgccugc

SEQ ID NO: 347149 - RNA, 18 nt, Bordetella pertussis
ccgccuggcuuacaggcc

SEQ ID NO: 347150 - RNA, 20 nt, Bordetella pertussis
ccgccuggcuuacaggccca

SEQ ID NO: 347151 - RNA, 22 nt, Bordetella pertussis
ccgccugguaguaaucgcgcgc

SEQ ID NO: 347152 - RNA, 19 nt, Bordetella pertussis
ccgccuggucgcuggcgcc

SEQ ID NO: 347153 - RNA, 20 nt, Bordetella pertussis
ccgccuucagcgggccggca

SEQ ID NO: 347154 - RNA, 13 nt, Bordetella pertussis
ccgccuucggcgg

SEQ ID NO: 347155 - RNA, 19 nt, Bordetella pertussis
ccgccuucgucgcgcaccc

SEQ ID NO: 347156 - RNA, 22 nt, Bordetella pertussis
ccgccuucuugaacagcucggc

SEQ ID NO: 347157 - RNA, 17 nt, Bordetella pertussis
ccgcgaaccaggccugc

SEQ ID NO: 347158 - RNA, 15 nt, Bordetella pertussis
ccgcgaaccggugcu

SEQ ID NO: 347159 - RNA, 15 nt, Bordetella pertussis
ccgcgaacgcgccgg

SEQ ID NO: 347160 - RNA, 12 nt, Bordetella pertussis
ccgcgaagcagc

SEQ ID NO: 347161 - RNA, 13 nt, Bordetella pertussis
ccgcgaagcagcc

SEQ ID NO: 347162 - RNA, 15 nt, Bordetella pertussis
ccgcgaagcagccgg

SEQ ID NO: 347163 - RNA, 22 nt, Bordetella pertussis
ccgcgaagcagccggccaaggc

SEQ ID NO: 347164 - RNA, 23 nt, Bordetella pertussis
ccgcgaagcgcgccagcagcgcc

SEQ ID NO: 347165 - RNA, 15 nt, Bordetella pertussis
ccgcgaagccgcccg

SEQ ID NO: 347166 - RNA, 17 nt, Bordetella pertussis
ccgcgaagugccugucc

SEQ ID NO: 347167 - RNA, 16 nt, Bordetella pertussis
ccgcgagcggccagcc

SEQ ID NO: 347168 - RNA, 17 nt, Bordetella pertussis
ccgcgaggcgcaggccg

SEQ ID NO: 347169 - RNA, 20 nt, Bordetella pertussis
ccgcgaggcgcaggccgacg

SEQ ID NO: 347170 - RNA, 22 nt, Bordetella pertussis
ccgcgaggcgcaggccgacgcg

SEQ ID NO: 347171 - RNA, 18 nt, Bordetella pertussis
ccgcgauauugaaggccg

SEQ ID NO: 347172 - RNA, 22 nt, Bordetella pertussis
ccgcgauauugaaggccgaggc

SEQ ID NO: 347173 - RNA, 13 nt, Bordetella pertussis
ccgcgaucagcgc

SEQ ID NO: 347174 - RNA, 13 nt, Bordetella pertussis
ccgcgaugucgcg

SEQ ID NO: 347175 - RNA, 15 nt, Bordetella pertussis
ccgcgaugucgcgcg

SEQ ID NO: 347176 - RNA, 17 nt, Bordetella pertussis
ccgcgaugucgcgcgcg

SEQ ID NO: 347177 - RNA, 15 nt, Bordetella pertussis
ccgcgauugcaggug

SEQ ID NO: 347178 - RNA, 21 nt, Bordetella pertussis
ccgcgcaaggccugcucgggc

SEQ ID NO: 347179 - RNA, 19 nt, Bordetella pertussis
ccgcgcaaggcggcccggc

SEQ ID NO: 347180 - RNA, 21 nt, Bordetella pertussis
ccgcgcacagcccgaucgacg

SEQ ID NO: 347181 - RNA, 17 nt, Bordetella pertussis
ccgcgcacagcgcggcg

SEQ ID NO: 347182 - RNA, 17 nt, Bordetella pertussis
ccgcgcacaggucgccg

SEQ ID NO: 347183 - RNA, 19 nt, Bordetella pertussis
ccgcgcaccaggcgcggcg

SEQ ID NO: 347184 - RNA, 16 nt, Bordetella pertussis
ccgcgcacccaggccc

SEQ ID NO: 347185 - RNA, 17 nt, Bordetella pertussis
ccgcgcacccaggccca

SEQ ID NO: 347186 - RNA, 18 nt, Bordetella pertussis
ccgcgcaccugggcgucg

SEQ ID NO: 347187 - RNA, 14 nt, Bordetella pertussis
ccgcgcacgcacug

SEQ ID NO: 347188 - RNA, 15 nt, Bordetella pertussis
ccgcgcacgcacuga

SEQ ID NO: 347189 - RNA, 14 nt, Bordetella pertussis
ccgcgcacgcccgc

SEQ ID NO: 347190 - RNA, 19 nt, Bordetella pertussis
ccgcgcacgggcgccuguc

SEQ ID NO: 347191 - RNA, 23 nt, Bordetella pertussis
ccgcgcacgggcgccuguccccg

SEQ ID NO: 347192 - RNA, 17 nt, Bordetella pertussis
ccgcgcagaaaccgcca

SEQ ID NO: 347193 - RNA, 13 nt, Bordetella pertussis
ccgcgcagcagca

SEQ ID NO: 347194 - RNA, 12 nt, Bordetella pertussis
ccgcgcagcccg

SEQ ID NO: 347195 - RNA, 14 nt, Bordetella pertussis
ccgcgcagcccggc

SEQ ID NO: 347196 - RNA, 16 nt, Bordetella pertussis
ccgcgcagcccggcgu

SEQ ID NO: 347197 - RNA, 23 nt, Bordetella pertussis
ccgcgcagcccggcgugcccagg

SEQ ID NO: 347198 - RNA, 15 nt, Bordetella pertussis
ccgcgcagccgacag

SEQ ID NO: 347199 - RNA, 21 nt, Bordetella pertussis
ccgcgcagccgcuucacgcug

SEQ ID NO: 347200 - RNA, 14 nt, Bordetella pertussis
ccgcgccaagggcg

SEQ ID NO: 347201 - RNA, 15 nt, Bordetella pertussis
ccgcgccacaggcgc

SEQ ID NO: 347202 - RNA, 11 nt, Bordetella pertussis
ccgcgccagcg

SEQ ID NO: 347203 - RNA, 13 nt, Bordetella pertussis
ccgcgccagcgcc

SEQ ID NO: 347204 - RNA, 15 nt, Bordetella pertussis
ccgcgccagcgccac

SEQ ID NO: 347205 - RNA, 16 nt, Bordetella pertussis
ccgcgccagcgccggc

SEQ ID NO: 347206 - RNA, 22 nt, Bordetella pertussis
ccgcgccaggcgguacaggccg

SEQ ID NO: 347207 - RNA, 16 nt, Bordetella pertussis
ccgcgccagggcgcgg

SEQ ID NO: 347208 - RNA, 23 nt, Bordetella pertussis
ccgcgccagguaggccggcgcga

SEQ ID NO: 347209 - RNA, 19 nt, Bordetella pertussis
ccgcgccaucgcgucgacg

SEQ ID NO: 347210 - RNA, 20 nt, Bordetella pertussis
ccgcgccaucgcgucgacgg

SEQ ID NO: 347211 - RNA, 22 nt, Bordetella pertussis
ccgcgcccacaggaacaggccg

SEQ ID NO: 347212 - RNA, 18 nt, Bordetella pertussis
ccgcgcccuggcgcggcg

SEQ ID NO: 347213 - RNA, 23 nt, Bordetella pertussis
ccgcgcccguccacggccugcgc

SEQ ID NO: 347214 - RNA, 14 nt, Bordetella pertussis
ccgcgccgaccggc

SEQ ID NO: 347215 - RNA, 18 nt, Bordetella pertussis
ccgcgccgacggcggcgc

SEQ ID NO: 347216 - RNA, 21 nt, Bordetella pertussis
ccgcgccgagcggggccgcgc

SEQ ID NO: 347217 - RNA, 22 nt, Bordetella pertussis
ccgcgccgaguuuccgcacccg

SEQ ID NO: 347218 - RNA, 15 nt, Bordetella pertussis
ccgcgccgcaggccg

SEQ ID NO: 347219 - RNA, 10 nt, Bordetella pertussis
ccgcgccgcc

SEQ ID NO: 347220 - RNA, 19 nt, Bordetella pertussis
ccgcgccuauaucgacggc

SEQ ID NO: 347221 - RNA, 14 nt, Bordetella pertussis
ccgcgccucggacg

SEQ ID NO: 347222 - RNA, 17 nt, Bordetella pertussis
ccgcgccucggacgccu

SEQ ID NO: 347223 - RNA, 20 nt, Bordetella pertussis
ccgcgccucggacgccuggc

SEQ ID NO: 347224 - RNA, 22 nt, Bordetella pertussis
ccgcgccucggacgccuggcgc

SEQ ID NO: 347225 - RNA, 22 nt, Bordetella pertussis
ccgcgccucguccucggugcug

SEQ ID NO: 347226 - RNA, 17 nt, Bordetella pertussis
ccgcgccuucgaggccg

SEQ ID NO: 347227 - RNA, 12 nt, Bordetella pertussis
ccgcgccuugcc

SEQ ID NO: 347228 - RNA, 17 nt, Bordetella pertussis
ccgcgcgauccggcgug

SEQ ID NO: 347229 - RNA, 12 nt, Bordetella pertussis
ccgcgcgcgcca

SEQ ID NO: 347230 - RNA, 15 nt, Bordetella pertussis
ccgcgcgcgccaggc

SEQ ID NO: 347231 - RNA, 22 nt, Bordetella pertussis
ccgcgcgcgcccgggccgucua

SEQ ID NO: 347232 - RNA, 20 nt, Bordetella pertussis
ccgcgcgcggcaaugcgcgc

SEQ ID NO: 347233 - RNA, 15 nt, Bordetella pertussis
ccgcgcgcggccggc

SEQ ID NO: 347234 - RNA, 16 nt, Bordetella pertussis
ccgcgcgcggccggca

SEQ ID NO: 347235 - RNA, 16 nt, Bordetella pertussis
ccgcgcgcggccggcg

SEQ ID NO: 347236 - RNA, 22 nt, Bordetella pertussis
ccgcgcgcggccggcgcgccgg

SEQ ID NO: 347237 - RNA, 23 nt, Bordetella pertussis
ccgcgcgcggccggcgcgccggc

SEQ ID NO: 347238 - RNA, 20 nt, Bordetella pertussis
ccgcgcgcguauggcggcgc

SEQ ID NO: 347239 - RNA, 22 nt, Bordetella pertussis
ccgcgcgcguauggcggcgccg

SEQ ID NO: 347240 - RNA, 15 nt, Bordetella pertussis
ccgcgcgcgucgccg

SEQ ID NO: 347241 - RNA, 18 nt, Bordetella pertussis
ccgcgcgcgucgccgcug

SEQ ID NO: 347242 - RNA, 14 nt, Bordetella pertussis
ccgcgcgcgugccg

SEQ ID NO: 347243 - RNA, 17 nt, Bordetella pertussis
ccgcgcgcuucaggcgc

SEQ ID NO: 347244 - RNA, 19 nt, Bordetella pertussis
ccgcgcgcuuccucgacca

SEQ ID NO: 347245 - RNA, 21 nt, Bordetella pertussis
ccgcgcgcuuccucgaccagg

SEQ ID NO: 347246 - RNA, 20 nt, Bordetella pertussis
ccgcgcgguacgcaccgccg

SEQ ID NO: 347247 - RNA, 23 nt, Bordetella pertussis
ccgcgcgguacgcaccgccgccg

SEQ ID NO: 347248 - RNA, 18 nt, Bordetella pertussis
ccgcgcgguggggcgcaa

SEQ ID NO: 347249 - RNA, 15 nt, Bordetella pertussis
ccgcgcguacgcggc

SEQ ID NO: 347250 - RNA, 17 nt, Bordetella pertussis
ccgcgcguacgcggcgc

SEQ ID NO: 347251 - RNA, 21 nt, Bordetella pertussis
ccgcgcguaugcaccgggccg

SEQ ID NO: 347252 - RNA, 13 nt, Bordetella pertussis
ccgcgcgugcuga

SEQ ID NO: 347253 - RNA, 17 nt, Bordetella pertussis
ccgcgcucagcaccagg

SEQ ID NO: 347254 - RNA, 14 nt, Bordetella pertussis
ccgcgcucaggccg

SEQ ID NO: 347255 - RNA, 16 nt, Bordetella pertussis
ccgcgcucaggccgcu

SEQ ID NO: 347256 - RNA, 21 nt, Bordetella pertussis
ccgcgcuccagggcgucggcg

SEQ ID NO: 347257 - RNA, 16 nt, Bordetella pertussis
ccgcgcucgcgccagg

SEQ ID NO: 347258 - RNA, 17 nt, Bordetella pertussis
ccgcgcucgcgccaggc

SEQ ID NO: 347259 - RNA, 22 nt, Bordetella pertussis
ccgcgcucgcgccaggccccgc

SEQ ID NO: 347260 - RNA, 20 nt, Bordetella pertussis
ccgcgcugccgcugcaggcc

SEQ ID NO: 347261 - RNA, 19 nt, Bordetella pertussis
ccgcgcugccugaaaccgc

SEQ ID NO: 347262 - RNA, 15 nt, Bordetella pertussis
ccgcgcugcgcccgc

SEQ ID NO: 347263 - RNA, 18 nt, Bordetella pertussis
ccgcgcugcggucagcug

SEQ ID NO: 347264 - RNA, 21 nt, Bordetella pertussis
ccgcgcugcggucagcugugg

SEQ ID NO: 347265 - RNA, 20 nt, Bordetella pertussis
ccgcgcugcugcaggccggc

SEQ ID NO: 347266 - RNA, 20 nt, Bordetella pertussis
ccgcgcugcugccgucggcg

SEQ ID NO: 347267 - RNA, 22 nt, Bordetella pertussis
ccgcgcugcugccgucggcguu

SEQ ID NO: 347268 - RNA, 14 nt, Bordetella pertussis
ccgcgcuggcgcag

SEQ ID NO: 347269 - RNA, 21 nt, Bordetella pertussis
ccgcgcuggcgcuggccgccc

SEQ ID NO: 347270 - RNA, 21 nt, Bordetella pertussis
ccgcgcuggcggcgcaggccg

SEQ ID NO: 347271 - RNA, 16 nt, Bordetella pertussis
ccgcgcuggcgcagca

SEQ ID NO: 347272 - RNA, 22 nt, Bordetella pertussis
ccgcgcuggcgcagcaggcgcg

SEQ ID NO: 347273 - RNA, 22 nt, Bordetella pertussis
ccgcgcuguugcuccaggccgg

SEQ ID NO: 347274 - RNA, 23 nt, Bordetella pertussis
ccgcgcuguugcuccaggccggc

SEQ ID NO: 347275 - RNA, 20 nt, Bordetella pertussis
ccgcgggcggccacgcgccg

SEQ ID NO: 347276 - RNA, 21 nt, Bordetella pertussis
ccgcgggcggccacgcgccgc

SEQ ID NO: 347277 - RNA, 15 nt, Bordetella pertussis
ccgcgggcggcgccg

SEQ ID NO: 347278 - RNA, 14 nt, Bordetella pertussis
ccgcgggcgggccg

SEQ ID NO: 347279 - RNA, 22 nt, Bordetella pertussis
ccgcgggcgugcuggcacuguc

SEQ ID NO: 347280 - RNA, 22 nt, Bordetella pertussis
ccgcgggcugcgacaggcgcag

SEQ ID NO: 347281 - RNA, 20 nt, Bordetella pertussis
ccgcggggguggacgccaag

SEQ ID NO: 347282 - RNA, 18 nt, Bordetella pertussis
ccgcggguauucgaaggc

SEQ ID NO: 347283 - RNA, 17 nt, Bordetella pertussis
ccgcgguccagcacggc

SEQ ID NO: 347284 - RNA, 24 nt, Bordetella pertussis
ccgcggucgagacgauggccgaau

SEQ ID NO: 347285 - RNA, 22 nt, Bordetella pertussis
ccgcggugcugggcuuugccug

SEQ ID NO: 347286 - RNA, 17 nt, Bordetella pertussis
ccgcggugccgcgcgcg

SEQ ID NO: 347287 - RNA, 18 nt, Bordetella pertussis
ccgcguacuuccucgacc

SEQ ID NO: 347288 - RNA, 14 nt, Bordetella pertussis
ccgcguaggccuuc

SEQ ID NO: 347289 - RNA, 17 nt, Bordetella pertussis
ccgcguaguugucggcg

SEQ ID NO: 347290 - RNA, 21 nt, Bordetella pertussis
ccgcguaguugucggcgcaga

SEQ ID NO: 347291 - RNA, 22 nt, Bordetella pertussis
ccgcgucacgauuucggccaug

SEQ ID NO: 347292 - RNA, 21 nt, Bordetella pertussis
ccgcgucauacacggcgcggg

SEQ ID NO: 347293 - RNA, 22 nt, Bordetella pertussis
ccgcgucauggcgugcgcgacc

SEQ ID NO: 347294 - RNA, 16 nt, Bordetella pertussis
ccgcguccagcgcgcg

SEQ ID NO: 347295 - RNA, 19 nt, Bordetella pertussis
ccgcgucccgugccggccg

SEQ ID NO: 347296 - RNA, 13 nt, Bordetella pertussis
ccgcguccgcccg

SEQ ID NO: 347297 - RNA, 17 nt, Bordetella pertussis
ccgcguccggcgcccgc

SEQ ID NO: 347298 - RNA, 17 nt, Bordetella pertussis
ccgcguccucggccugg

SEQ ID NO: 347299 - RNA, 18 nt, Bordetella pertussis
ccgcguccucggccuggc

SEQ ID NO: 347300 - RNA, 20 nt, Bordetella pertussis
ccgcgucgaaauaggauccc

SEQ ID NO: 347301 - RNA, 19 nt, Bordetella pertussis
ccgcgucgguggccagcca

SEQ ID NO: 347302 - RNA, 17 nt, Bordetella pertussis
ccgcgucguucaucgcc

SEQ ID NO: 347303 - RNA, 23 nt, Bordetella pertussis
ccgcgucuaccuggacgggcugg

SEQ ID NO: 347304 - RNA, 14 nt, Bordetella pertussis
ccgcgucugggccg

SEQ ID NO: 347305 - RNA, 14 nt, Bordetella pertussis
ccgcgucuucggcg

SEQ ID NO: 347306 - RNA, 17 nt, Bordetella pertussis
ccgcgugacggccgcca

SEQ ID NO: 347307 - RNA, 15 nt, Bordetella pertussis
ccgcuaccaggcgcg

SEQ ID NO: 347308 - RNA, 17 nt, Bordetella pertussis
ccgcuaccaggcgcgcg

SEQ ID NO: 347309 - RNA, 18 nt, Bordetella pertussis
ccgcuaccaggcgcgcgc

SEQ ID NO: 347310 - RNA, 19 nt, Bordetella pertussis
ccgcuaccaggcgcgcgcg

SEQ ID NO: 347311 - RNA, 23 nt, Bordetella pertussis
ccgcuaccaggcgcgcgcgcgga

SEQ ID NO: 347312 - RNA, 14 nt, Bordetella pertussis
ccgcuaccccggca

SEQ ID NO: 347313 - RNA, 22 nt, Bordetella pertussis
ccgcuacgcgggcuugcugccc

SEQ ID NO: 347314 - RNA, 14 nt, Bordetella pertussis
ccgcuccggcauga

SEQ ID NO: 347315 - RNA, 19 nt, Bordetella pertussis
ccgcucgacgucgcccugg

SEQ ID NO: 347316 - RNA, 12 nt, Bordetella pertussis
ccgcucgcgcga

SEQ ID NO: 347317 - RNA, 17 nt, Bordetella pertussis
ccgcugaaggaccucgc

SEQ ID NO: 347318 - RNA, 20 nt, Bordetella pertussis
ccgcugaaggaccucgcgcc

SEQ ID NO: 347319 - RNA, 12 nt, Bordetella pertussis
ccgcugaccggc

SEQ ID NO: 347320 - RNA, 14 nt, Bordetella pertussis
ccgcugcagcacgc

SEQ ID NO: 347321 - RNA, 20 nt, Bordetella pertussis
ccgcugcagcacgcaccagg

SEQ ID NO: 347322 - RNA, 16 nt, Bordetella pertussis
ccgcugcaugggcggc

SEQ ID NO: 347323 - RNA, 19 nt, Bordetella pertussis
ccgcugcaugggcggcccg

SEQ ID NO: 347324 - RNA, 18 nt, Bordetella pertussis
ccgcugcgggaggugccg

SEQ ID NO: 347325 - RNA, 19 nt, Bordetella pertussis
ccgcuggacgcgccgaaca

SEQ ID NO: 347326 - RNA, 21 nt, Bordetella pertussis
ccggaaagcuguccacgccga

SEQ ID NO: 347327 - RNA, 21 nt, Bordetella pertussis
ccggaacaccagcaagccggc

SEQ ID NO: 347328 - RNA, 13 nt, Bordetella pertussis
ccggaacauggcg

SEQ ID NO: 347329 - RNA, 22 nt, Bordetella pertussis
ccggaacauggcggugaaggcg

SEQ ID NO: 347330 - RNA, 22 nt, Bordetella pertussis
ccggaauagauaugggccugau

SEQ ID NO: 347331 - RNA, 23 nt, Bordetella pertussis
ccggaauagauaugggccugauc

SEQ ID NO: 347332 - RNA, 16 nt, Bordetella pertussis
ccggaaucaccgccgc

SEQ ID NO: 347333 - RNA, 23 nt, Bordetella pertussis
ccggaaucaccgccgcgaccggg

SEQ ID NO: 347334 - RNA, 13 nt, Bordetella pertussis
ccggaauccacag

SEQ ID NO: 347335 - RNA, 15 nt, Bordetella pertussis
ccggaaugcaccacg

SEQ ID NO: 347336 - RNA, 14 nt, Bordetella pertussis
ccggacaacgcgcg

SEQ ID NO: 347337 - RNA, 15 nt, Bordetella pertussis
ccggacaacgcgcgc

SEQ ID NO: 347338 - RNA, 19 nt, Bordetella pertussis
ccggacaacgcgcgccacu

SEQ ID NO: 347339 - RNA, 22 nt, Bordetella pertussis
ccggacacguacaaccgcgccg

SEQ ID NO: 347340 - RNA, 15 nt, Bordetella pertussis
ccggacccgcgccgc

SEQ ID NO: 347341 - RNA, 16 nt, Bordetella pertussis
ccggacccgcgccgca

SEQ ID NO: 347342 - RNA, 11 nt, Bordetella pertussis
ccggaccggug

SEQ ID NO: 347343 - RNA, 21 nt, Bordetella pertussis
ccggaccuugcgaggcccggc

SEQ ID NO: 347344 - RNA, 23 nt, Bordetella pertussis
ccggacgcaaaaacgcccggcgc

SEQ ID NO: 347345 - RNA, 13 nt, Bordetella pertussis
ccggacgugggcg

SEQ ID NO: 347346 - RNA, 20 nt, Bordetella pertussis
ccggacuggauauggcgccg

SEQ ID NO: 347347 - RNA, 14 nt, Bordetella pertussis
ccggacuggcgcgc

SEQ ID NO: 347348 - RNA, 15 nt, Bordetella pertussis
ccggacuggcgcgca

SEQ ID NO: 347349 - RNA, 20 nt, Bordetella pertussis
ccggacugggcgucgcucug

SEQ ID NO: 347350 - RNA, 17 nt, Bordetella pertussis
ccggagcccgucaggcg

SEQ ID NO: 347351 - RNA, 16 nt, Bordetella pertussis
ccggagcggcucgccg

SEQ ID NO: 347352 - RNA, 23 nt, Bordetella pertussis
ccggagcggcucgccgcuccggc

SEQ ID NO: 347353 - RNA, 12 nt, Bordetella pertussis
ccggaggcgccg

SEQ ID NO: 347354 - RNA, 15 nt, Bordetella pertussis
ccggaggcgcgcagc

SEQ ID NO: 347355 - RNA, 15 nt, Bordetella pertussis
ccggauaccgccgcc

SEQ ID NO: 347356 - RNA, 15 nt, Bordetella pertussis
ccggauccagccgcu

SEQ ID NO: 347357 - RNA, 14 nt, Bordetella pertussis
ccggauccagcugc

SEQ ID NO: 347358 - RNA, 22 nt, Bordetella pertussis
ccggauccagcugcgaaagcgc

SEQ ID NO: 347359 - RNA, 15 nt, Bordetella pertussis
ccggaucccaggccg

SEQ ID NO: 347360 - RNA, 23 nt, Bordetella pertussis
ccggauccugcggcgcggugucg

SEQ ID NO: 347361 - RNA, 13 nt, Bordetella pertussis
ccggaucgagcgc

SEQ ID NO: 347362 - RNA, 16 nt, Bordetella pertussis
ccggaucgagcgcggu

SEQ ID NO: 347363 - RNA, 17 nt, Bordetella pertussis
ccggaucguagugcgug

SEQ ID NO: 347364 - RNA, 21 nt, Bordetella pertussis
ccggaugcacguagcgcagca

SEQ ID NO: 347365 - RNA, 23 nt, Bordetella pertussis
ccggaugcacguagcgcagcacc

SEQ ID NO: 347366 - RNA, 20 nt, Bordetella pertussis
ccggaugccgaacugucgcg

SEQ ID NO: 347367 - RNA, 22 nt, Bordetella pertussis
ccggaugccgaacugucgcgcc

SEQ ID NO: 347368 - RNA, 14 nt, Bordetella pertussis
ccggaugcgcgugg

SEQ ID NO: 347369 - RNA, 18 nt, Bordetella pertussis
ccggaugcgcguggcgcg

SEQ ID NO: 347370 - RNA, 20 nt, Bordetella pertussis
ccggauggcuauaccgucgu

SEQ ID NO: 347371 - RNA, 21 nt, Bordetella pertussis
ccggauugcuugacgccgccg

SEQ ID NO: 347372 - RNA, 17 nt, Bordetella pertussis
ccggcaaagaucaccug

SEQ ID NO: 347373 - RNA, 11 nt, Bordetella pertussis
ccggcaagaug

SEQ ID NO: 347374 - RNA, 20 nt, Bordetella pertussis
ccggcaagaugccggccugu

SEQ ID NO: 347375 - RNA, 21 nt, Bordetella pertussis
ccggcaagaugccggccuguc

SEQ ID NO: 347376 - RNA, 19 nt, Bordetella pertussis
ccggcaagcacgaacaggu

SEQ ID NO: 347377 - RNA, 17 nt, Bordetella pertussis
ccggcaagcgcucgccg

SEQ ID NO: 347378 - RNA, 12 nt, Bordetella pertussis
ccggcaaggccg

SEQ ID NO: 347379 - RNA, 14 nt, Bordetella pertussis
ccggcaaggccgcg

SEQ ID NO: 347380 - RNA, 15 nt, Bordetella pertussis
ccggcaaggccgcga

SEQ ID NO: 347381 - RNA, 18 nt, Bordetella pertussis
ccggcaaggccgcgaacg

SEQ ID NO: 347382 - RNA, 22 nt, Bordetella pertussis
ccggcaaggggccagccuggcg

SEQ ID NO: 347383 - RNA, 17 nt, Bordetella pertussis
ccggcaaggucagcagc

SEQ ID NO: 347384 - RNA, 22 nt, Bordetella pertussis
ccggcaaggucagcagcaugcc

SEQ ID NO: 347385 - RNA, 20 nt, Bordetella pertussis
ccggcaaggugaucgaggcg

SEQ ID NO: 347386 - RNA, 22 nt, Bordetella pertussis
ccggcaaggugaucgaggcguu

SEQ ID NO: 347387 - RNA, 23 nt, Bordetella pertussis
ccggcaaucgaaaagcccgccga

SEQ ID NO: 347388 - RNA, 17 nt, Bordetella pertussis
ccggcaccacgaccggc

SEQ ID NO: 347389 - RNA, 18 nt, Bordetella pertussis
ccggcaccacgaccggcu

SEQ ID NO: 347390 - RNA, 17 nt, Bordetella pertussis
ccggcaccagcgccacg

SEQ ID NO: 347391 - RNA, 21 nt, Bordetella pertussis
ccggcaccagcgccacgccca

SEQ ID NO: 347392 - RNA, 15 nt, Bordetella pertussis
ccggcaccaucgccg

SEQ ID NO: 347393 - RNA, 22 nt, Bordetella pertussis
ccggcaccaucugcgucgcguu

SEQ ID NO: 347394 - RNA, 17 nt, Bordetella pertussis
ccggcaccaugcgcacc

SEQ ID NO: 347395 - RNA, 21 nt, Bordetella pertussis
ccggcaccaugcgcaccaggc

SEQ ID NO: 347396 - RNA, 11 nt, Bordetella pertussis
ccggcaccccg

SEQ ID NO: 347397 - RNA, 13 nt, Bordetella pertussis
ccggcaccugggc

SEQ ID NO: 347398 - RNA, 21 nt, Bordetella pertussis
ccggcaccuucuuccaggcgc

SEQ ID NO: 347399 - RNA, 12 nt, Bordetella pertussis
ccggcacgccga

SEQ ID NO: 347400 - RNA, 18 nt, Bordetella pertussis
ccggcacgccggcggcgc

SEQ ID NO: 347401 - RNA, 21 nt, Bordetella pertussis
ccggcacgccugccgcgcccg

SEQ ID NO: 347402 - RNA, 14 nt, Bordetella pertussis
ccggcacgcgccag

SEQ ID NO: 347403 - RNA, 15 nt, Bordetella pertussis
ccggcacgcgccagg

SEQ ID NO: 347404 - RNA, 14 nt, Bordetella pertussis
ccggcacgcgccga

SEQ ID NO: 347405 - RNA, 18 nt, Bordetella pertussis
ccggcacgacgaucggcc

SEQ ID NO: 347406 - RNA, 16 nt, Bordetella pertussis
ccggcacgcugaucgc

SEQ ID NO: 347407 - RNA, 17 nt, Bordetella pertussis
ccggcacgcugaucgcc

SEQ ID NO: 347408 - RNA, 19 nt, Bordetella pertussis
ccggcacgcugaucgccgg

SEQ ID NO: 347409 - RNA, 20 nt, Bordetella pertussis
ccggcacgcugaucgccggc

SEQ ID NO: 347410 - RNA, 14 nt, Bordetella pertussis
ccggcacggccggc

SEQ ID NO: 347411 - RNA, 23 nt, Bordetella pertussis
ccggcacgguucagaacgcguag

SEQ ID NO: 347412 - RNA, 18 nt, Bordetella pertussis
ccggcacguaccaggcgc

SEQ ID NO: 347413 - RNA, 19 nt, Bordetella pertussis
ccggcacguaccaggcgcu

SEQ ID NO: 347414 - RNA, 14 nt, Bordetella pertussis
ccggcacguccggc

SEQ ID NO: 347415 - RNA, 21 nt, Bordetella pertussis
ccggcagaacagcggaucgcc

SEQ ID NO: 347416 - RNA, 13 nt, Bordetella pertussis
ccggcagaucggc

SEQ ID NO: 347417 - RNA, 22 nt, Bordetella pertussis
ccggcagaucggcgcuggccug

SEQ ID NO: 347418 - RNA, 18 nt, Bordetella pertussis
ccggcagcagggauucgg

SEQ ID NO: 347419 - RNA, 20 nt, Bordetella pertussis
ccggcagcggccagcgcggc

SEQ ID NO: 347420 - RNA, 22 nt, Bordetella pertussis
ccggcagcggcgccaugcgcac

SEQ ID NO: 347421 - RNA, 21 nt, Bordetella pertussis
ccggcagcgucaauccgccgc

SEQ ID NO: 347422 - RNA, 23 nt, Bordetella pertussis
ccggcagcgucaauccgccgcca

SEQ ID NO: 347423 - RNA, 15 nt, Bordetella pertussis
ccggcaggaucugca

SEQ ID NO: 347424 - RNA, 12 nt, Bordetella pertussis
ccggcaggccgg

SEQ ID NO: 347425 - RNA, 21 nt, Bordetella pertussis
ccggcaggccggccagcaagg

SEQ ID NO: 347426 - RNA, 15 nt, Bordetella pertussis
ccggcaggccgcgcu

SEQ ID NO: 347427 - RNA, 16 nt, Bordetella pertussis
ccggcaggccgcgcug

SEQ ID NO: 347428 - RNA, 16 nt, Bordetella pertussis
ccggcagggccagcgc

SEQ ID NO: 347429 - RNA, 17 nt, Bordetella pertussis
ccggcagggccagcgcc

SEQ ID NO: 347430 - RNA, 17 nt, Bordetella pertussis
ccggcagggcggccagg

SEQ ID NO: 347431 - RNA, 15 nt, Bordetella pertussis
ccggcagggucucgg

SEQ ID NO: 347432 - RNA, 19 nt, Bordetella pertussis
ccggcagggucucggccac

SEQ ID NO: 347433 - RNA, 12 nt, Bordetella pertussis
ccggcaggguga

SEQ ID NO: 347434 - RNA, 14 nt, Bordetella pertussis
ccggcaggcgcgcc

SEQ ID NO: 347435 - RNA, 20 nt, Bordetella pertussis
ccggcaggcgcgccagcccg

SEQ ID NO: 347436 - RNA, 22 nt, Bordetella pertussis
ccggcaggucgaucuccacgaa

SEQ ID NO: 347437 - RNA, 15 nt, Bordetella pertussis
ccggcauaggcggcg

SEQ ID NO: 347438 - RNA, 13 nt, Bordetella pertussis
ccggcaucggcgg

SEQ ID NO: 347439 - RNA, 12 nt, Bordetella pertussis
ccggccagcugc

SEQ ID NO: 347440 - RNA, 12 nt, Bordetella pertussis
ccggccagcuug

SEQ ID NO: 347441 - RNA, 14 nt, Bordetella pertussis
ccggccaggcgccg

SEQ ID NO: 347442 - RNA, 18 nt, Bordetella pertussis
ccggccagggccaccacg

SEQ ID NO: 347443 - RNA, 22 nt, Bordetella pertussis
ccggccagggccacgccggccg

SEQ ID NO: 347444 - RNA, 17 nt, Bordetella pertussis
ccggccaggggcgcugg

SEQ ID NO: 347445 - RNA, 19 nt, Bordetella pertussis
ccggccaggggcgcugguc

SEQ ID NO: 347446 - RNA, 16 nt, Bordetella pertussis
ccggccauggcggccg

SEQ ID NO: 347447 - RNA, 18 nt, Bordetella pertussis
ccggccauggcggccggc

SEQ ID NO: 347448 - RNA, 17 nt, Bordetella pertussis
ccggccauggcccuugc

SEQ ID NO: 347449 - RNA, 15 nt, Bordetella pertussis
ccggccauggccgcc

SEQ ID NO: 347450 - RNA, 17 nt, Bordetella pertussis
ccggcccaaggccccgc

SEQ ID NO: 347451 - RNA, 12 nt, Bordetella pertussis
ccggcccagcac

SEQ ID NO: 347452 - RNA, 17 nt, Bordetella pertussis
ccggcccagcacgccgc

SEQ ID NO: 347453 - RNA, 13 nt, Bordetella pertussis
ccggcccagcgcc

SEQ ID NO: 347454 - RNA, 19 nt, Bordetella pertussis
ccggcccagcgccaucggc

SEQ ID NO: 347455 - RNA, 19 nt, Bordetella pertussis
ccggcccaggauggcgcca

SEQ ID NO: 347456 - RNA, 14 nt, Bordetella pertussis
ccggcccaggccgg

SEQ ID NO: 347457 - RNA, 13 nt, Bordetella pertussis
ccggcccaggcgc

SEQ ID NO: 347458 - RNA, 14 nt, Bordetella pertussis
ccggcccaggcgcg

SEQ ID NO: 347459 - RNA, 15 nt, Bordetella pertussis
ccggcccaggcgcgc

SEQ ID NO: 347460 - RNA, 22 nt, Bordetella pertussis
ccggcccaggcgcgcuggcgcu

SEQ ID NO: 347461 - RNA, 24 nt, Bordetella pertussis
ccggcccaguccaggguguccugg

SEQ ID NO: 347462 - RNA, 17 nt, Bordetella pertussis
ccggccccaccuggcgg

SEQ ID NO: 347463 - RNA, 23 nt, Bordetella pertussis
ccggccccaggaugcgcaccggc

SEQ ID NO: 347464 - RNA, 16 nt, Bordetella pertussis
ccggccccaggccggg

SEQ ID NO: 347465 - RNA, 21 nt, Bordetella pertussis
ccggccccauccucaucgugc

SEQ ID NO: 347466 - RNA, 19 nt, Bordetella pertussis
ccggcccgccccacggcga

SEQ ID NO: 347467 - RNA, 14 nt, Bordetella pertussis
ccggcccgcgcgcc

SEQ ID NO: 347468 - RNA, 20 nt, Bordetella pertussis
ccggcccggaauaccgccag

SEQ ID NO: 347469 - RNA, 13 nt, Bordetella pertussis
ccggcccggcggg

SEQ ID NO: 347470 - RNA, 17 nt, Bordetella pertussis
ccggcccggugcagccg

SEQ ID NO: 347471 - RNA, 23 nt, Bordetella pertussis
ccggccgaugacaucgccgcugc

SEQ ID NO: 347472 - RNA, 13 nt, Bordetella pertussis
ccggccgccagca

SEQ ID NO: 347473 - RNA, 23 nt, Bordetella pertussis
ccggccgccagcaaggcgucggc

SEQ ID NO: 347474 - RNA, 14 nt, Bordetella pertussis
ccggccgccagcau

SEQ ID NO: 347475 - RNA, 17 nt, Bordetella pertussis
ccggccgccagcauggc

SEQ ID NO: 347476 - RNA, 13 nt, Bordetella pertussis
ccggccgccaugg

SEQ ID NO: 347477 - RNA, 18 nt, Bordetella pertussis
ccggccgccauggccggc

SEQ ID NO: 347478 - RNA, 15 nt, Bordetella pertussis
ccggccgcccaggcg

SEQ ID NO: 347479 - RNA, 17 nt, Bordetella pertussis
ccggccgcccaggcgca

SEQ ID NO: 347480 - RNA, 23 nt, Bordetella pertussis
ccggccgcccaggcgcagccgcg

SEQ ID NO: 347481 - RNA, 15 nt, Bordetella pertussis
ccggccgccgaacga

SEQ ID NO: 347482 - RNA, 21 nt, Bordetella pertussis
ccggccgccgaacgaggcgcg

SEQ ID NO: 347483 - RNA, 14 nt, Bordetella pertussis
ccggccgccucacc

SEQ ID NO: 347484 - RNA, 13 nt, Bordetella pertussis
ccggccgccucca

SEQ ID NO: 347485 - RNA, 14 nt, Bordetella pertussis
ccggccgccuccag

SEQ ID NO: 347486 - RNA, 15 nt, Bordetella pertussis
ccggccgccuggccc

SEQ ID NO: 347487 - RNA, 17 nt, Bordetella pertussis
ccggccgcccgccugcc

SEQ ID NO: 347488 - RNA, 21 nt, Bordetella pertussis
ccggccggguugucgcccacc

SEQ ID NO: 347489 - RNA, 21 nt, Bordetella pertussis
ccggccgguggguguggccau

SEQ ID NO: 347490 - RNA, 22 nt, Bordetella pertussis
ccggccgguuccugcaaggccg

SEQ ID NO: 347491 - RNA, 17 nt, Bordetella pertussis
ccggccggugcaucggc

SEQ ID NO: 347492 - RNA, 14 nt, Bordetella pertussis
ccggccugccggcg

SEQ ID NO: 347493 - RNA, 15 nt, Bordetella pertussis
ccggccugccggcgc

SEQ ID NO: 347494 - RNA, 16 nt, Bordetella pertussis
ccggccugccggcgca

SEQ ID NO: 347495 - RNA, 17 nt, Bordetella pertussis
ccggccugccggcgcac

SEQ ID NO: 347496 - RNA, 15 nt, Bordetella pertussis
ccggccugcgccagc

SEQ ID NO: 347497 - RNA, 15 nt, Bordetella pertussis
ccggccugcgccggg

SEQ ID NO: 347498 - RNA, 18 nt, Bordetella pertussis
ccggccugcgccgggcgc

SEQ ID NO: 347499 - RNA, 15 nt, Bordetella pertussis
ccggccugcgcgccg

SEQ ID NO: 347500 - RNA, 19 nt, Bordetella pertussis
ccggccugcgggcgccgcg

SEQ ID NO: 347501 - RNA, 16 nt, Bordetella pertussis
ccggccugcgucgcca

SEQ ID NO: 347502 - RNA, 14 nt, Bordetella pertussis
ccggccuggcgcga

SEQ ID NO: 347503 - RNA, 17 nt, Bordetella pertussis
ccggccuggcgcgacgc

SEQ ID NO: 347504 - RNA, 14 nt, Bordetella pertussis
ccggccuggcgcgc

SEQ ID NO: 347505 - RNA, 17 nt, Bordetella pertussis
ccggccuggcgcgcggc

SEQ ID NO: 347506 - RNA, 20 nt, Bordetella pertussis
ccggcgaaugccggccgaua

SEQ ID NO: 347507 - RNA, 17 nt, Bordetella pertussis
ccggcgacaccgcggcc

SEQ ID NO: 347508 - RNA, 19 nt, Bordetella pertussis
ccggcgaccaccgauccga

SEQ ID NO: 347509 - RNA, 17 nt, Bordetella pertussis
ccggcgaccgacggcau

SEQ ID NO: 347510 - RNA, 20 nt, Bordetella pertussis
ccggcgaccgacggcaucgu

SEQ ID NO: 347511 - RNA, 14 nt, Bordetella pertussis
ccggcgaccgacgg

SEQ ID NO: 347512 - RNA, 14 nt, Bordetella pertussis
ccggcgacgccgcg

SEQ ID NO: 347513 - RNA, 16 nt, Bordetella pertussis
ccggcgacgccgcggu

SEQ ID NO: 347514 - RNA, 20 nt, Bordetella pertussis
ccggcgacgccgcggugcug

SEQ ID NO: 347515 - RNA, 21 nt, Bordetella pertussis
ccggcgacgccgcggugcugg

SEQ ID NO: 347516 - RNA, 17 nt, Bordetella pertussis
ccggcgagacgucggcg

SEQ ID NO: 347517 - RNA, 20 nt, Bordetella pertussis
ccggcgagacgucggcgaug

SEQ ID NO: 347518 - RNA, 16 nt, Bordetella pertussis
ccggcgacguggugug

SEQ ID NO: 347519 - RNA, 15 nt, Bordetella pertussis
ccggcgagccgaugg

SEQ ID NO: 347520 - RNA, 14 nt, Bordetella pertussis
ccggcgaggccgcc

SEQ ID NO: 347521 - RNA, 16 nt, Bordetella pertussis
ccggcgaggccgcccg

SEQ ID NO: 347522 - RNA, 17 nt, Bordetella pertussis
ccggcgaggccgcccgc

SEQ ID NO: 347523 - RNA, 14 nt, Bordetella pertussis
ccggcgaucaugcc

SEQ ID NO: 347524 - RNA, 18 nt, Bordetella pertussis
ccggcgaucaugccgccg

SEQ ID NO: 347525 - RNA, 14 nt, Bordetella pertussis
ccggcgagcauggc

SEQ ID NO: 347526 - RNA, 23 nt, Bordetella pertussis
ccggcgaugauggggucgccggg

SEQ ID NO: 347527 - RNA, 21 nt, Bordetella pertussis
ccggcgauugcgccagcgcug

SEQ ID NO: 347528 - RNA, 20 nt, Bordetella pertussis
ccggcuacagcucgccggcg

SEQ ID NO: 347529 - RNA, 13 nt, Bordetella pertussis
ccggcuaccgcgc

SEQ ID NO: 347530 - RNA, 15 nt, Bordetella pertussis
ccggcuacggcaagg

SEQ ID NO: 347531 - RNA, 12 nt, Bordetella pertussis
ccggcucagccc

SEQ ID NO: 347532 - RNA, 20 nt, Bordetella pertussis
ccggcucgcugucgugccgc

SEQ ID NO: 347533 - RNA, 16 nt, Bordetella pertussis
ccggcucggcggcauc

SEQ ID NO: 347534 - RNA, 14 nt, Bordetella pertussis
ccggcugcgcgccg

SEQ ID NO: 347535 - RNA, 14 nt, Bordetella pertussis
ccggcugcgcgcgc

SEQ ID NO: 347536 - RNA, 20 nt, Bordetella pertussis
ccggcugcgcgcgcagccag

SEQ ID NO: 347537 - RNA, 14 nt, Bordetella pertussis
ccggcugcgcggcc

SEQ ID NO: 347538 - RNA, 18 nt, Bordetella pertussis
ccggcugcuugcccagcg

SEQ ID NO: 347539 - RNA, 18 nt, Bordetella pertussis
ccggcuggauggugccgc

SEQ ID NO: 347540 - RNA, 21 nt, Bordetella pertussis
ccggcuggauggugccgccgc

SEQ ID NO: 347541 - RNA, 13 nt, Bordetella pertussis
ccggcuggcgcac

SEQ ID NO: 347542 - RNA, 14 nt, Bordetella pertussis
ccggcuggcgcacg

SEQ ID NO: 347543 - RNA, 22 nt, Bordetella pertussis
ccggcugggcggccuuggccgc

SEQ ID NO: 347544 - RNA, 17 nt, Bordetella pertussis
ccggcuugcgcaagccg

SEQ ID NO: 347545 - RNA, 19 nt, Bordetella pertussis
ccggcuugcgccagccacg

SEQ ID NO: 347546 - RNA, 15 nt, Bordetella pertussis
ccggcuuggccucgg

SEQ ID NO: 347547 - RNA, 18 nt, Bordetella pertussis
ccggcuuggggcgcgccg

SEQ ID NO: 347548 - RNA, 19 nt, Bordetella pertussis
ccggcuuggggcgcgccgc

SEQ ID NO: 347549 - RNA, 17 nt, Bordetella pertussis
ccggcuuuggacaggcg

SEQ ID NO: 347550 - RNA, 20 nt, Bordetella pertussis
ccgggaaaaagagccugucc

SEQ ID NO: 347551 - RNA, 21 nt, Bordetella pertussis
ccgggacaggcacccgcgcgc

SEQ ID NO: 347552 - RNA, 23 nt, Bordetella pertussis
ccgggacaggcacccgcgcgcag

SEQ ID NO: 347553 - RNA, 15 nt, Bordetella pertussis
ccgggacaggcaccu

SEQ ID NO: 347554 - RNA, 16 nt, Bordetella pertussis
ccgggcaaucggcgug

SEQ ID NO: 347555 - RNA, 22 nt, Bordetella pertussis
ccgggcacaccgucacgcgcaa

SEQ ID NO: 347556 - RNA, 18 nt, Bordetella pertussis
ccgggcacguaguacagc

SEQ ID NO: 347557 - RNA, 19 nt, Bordetella pertussis
ccgggcagcaccgcugcua

SEQ ID NO: 347558 - RNA, 21 nt, Bordetella pertussis
ccgggcaugcgaaagccggcc

SEQ ID NO: 347559 - RNA, 15 nt, Bordetella pertussis
ccgggccaaggugcc

SEQ ID NO: 347560 - RNA, 22 nt, Bordetella pertussis
ccgggccaugcgggucaggccg

SEQ ID NO: 347561 - RNA, 15 nt, Bordetella pertussis
ccgggcccggcgcgc

SEQ ID NO: 347562 - RNA, 16 nt, Bordetella pertussis
ccgggccgaccaggcc

SEQ ID NO: 347563 - RNA, 17 nt, Bordetella pertussis
ccgggccgaccaggccg

SEQ ID NO: 347564 - RNA, 18 nt, Bordetella pertussis
ccgggccgaccaggccgg

SEQ ID NO: 347565 - RNA, 19 nt, Bordetella pertussis
ccgggccgaccaggccggc

SEQ ID NO: 347566 - RNA, 13 nt, Bordetella pertussis
ccgggccgacgcg

SEQ ID NO: 347567 - RNA, 16 nt, Bordetella pertussis
ccgggccgacgcgccc

SEQ ID NO: 347568 - RNA, 12 nt, Bordetella pertussis
ccgggcgccggc

SEQ ID NO: 347569 - RNA, 13 nt, Bordetella pertussis
ccgggcgccgcgc

SEQ ID NO: 347570 - RNA, 14 nt, Bordetella pertussis
ccgggcgccggcgg

SEQ ID NO: 347571 - RNA, 16 nt, Bordetella pertussis
ccgggcgccugcgcca

SEQ ID NO: 347572 - RNA, 18 nt, Bordetella pertussis
ccgggcgccugcgccacc

SEQ ID NO: 347573 - RNA, 19 nt, Bordetella pertussis
ccgggcgcgcugcccagcc

SEQ ID NO: 347574 - RNA, 18 nt, Bordetella pertussis
ccgggcgcggccaggcgc

SEQ ID NO: 347575 - RNA, 22 nt, Bordetella pertussis
ccgggcgcggcccggcgucggg

SEQ ID NO: 347576 - RNA, 21 nt, Bordetella pertussis
ccgggcgcggccgccgcccgc

SEQ ID NO: 347577 - RNA, 17 nt, Bordetella pertussis
ccgggcgcggcgcccgc

SEQ ID NO: 347578 - RNA, 14 nt, Bordetella pertussis
ccgggcgcgcgccg

SEQ ID NO: 347579 - RNA, 23 nt, Bordetella pertussis
ccgggcgcguggcccgcgccgcg

SEQ ID NO: 347580 - RNA, 17 nt, Bordetella pertussis
ccgggcgcugcgccggc

SEQ ID NO: 347581 - RNA, 18 nt, Bordetella pertussis
ccgggcgcugcgccggcg

SEQ ID NO: 347582 - RNA, 22 nt, Bordetella pertussis
ccgggcgcugcgccggcggcac

SEQ ID NO: 347583 - RNA, 14 nt, Bordetella pertussis
ccgggcggaucgcc

SEQ ID NO: 347584 - RNA, 17 nt, Bordetella pertussis
ccgggcggaucgccgaa

SEQ ID NO: 347585 - RNA, 13 nt, Bordetella pertussis
ccgggcgggcaca

SEQ ID NO: 347586 - RNA, 18 nt, Bordetella pertussis
ccgggcgguccgguucgc

SEQ ID NO: 347587 - RNA, 19 nt, Bordetella pertussis
ccgggcgggucggcgaaca

SEQ ID NO: 347588 - RNA, 22 nt, Bordetella pertussis
ccgggguccugaggccaggccg

SEQ ID NO: 347589 - RNA, 13 nt, Bordetella pertussis
ccggguccagccc

SEQ ID NO: 347590 - RNA, 23 nt, Bordetella pertussis
ccggguccagccccacgccgacc

SEQ ID NO: 347591 - RNA, 15 nt, Bordetella pertussis
ccgggucccuggccc

SEQ ID NO: 347592 - RNA, 14 nt, Bordetella pertussis
ccggguccggccgc

SEQ ID NO: 347593 - RNA, 15 nt, Bordetella pertussis
ccggguccggccgcg

SEQ ID NO: 347594 - RNA, 20 nt, Bordetella pertussis
ccgggucgcugugcgcggcg

SEQ ID NO: 347595 - RNA, 23 nt, Bordetella pertussis
ccgggucgcugugcgcggcgaaa

SEQ ID NO: 347596 - RNA, 14 nt, Bordetella pertussis
ccgggucgcgcagc

SEQ ID NO: 347597 - RNA, 19 nt, Bordetella pertussis
ccgggucgucgggcggcgc

SEQ ID NO: 347598 - RNA, 18 nt, Bordetella pertussis
ccgggucuggccggccgc

SEQ ID NO: 347599 - RNA, 19 nt, Bordetella pertussis
ccgggucuggccggccgcg

SEQ ID NO: 347600 - RNA, 21 nt, Bordetella pertussis
ccgggugccuguccccgccgg

SEQ ID NO: 347601 - RNA, 22 nt, Bordetella pertussis
ccgggugccuguccccgccggg

SEQ ID NO: 347602 - RNA, 14 nt, Bordetella pertussis
ccggguggccgcgg

SEQ ID NO: 347603 - RNA, 18 nt, Bordetella pertussis
ccggguggguucgggcgu

SEQ ID NO: 347604 - RNA, 17 nt, Bordetella pertussis
ccggguggucgcgcccg

SEQ ID NO: 347605 - RNA, 18 nt, Bordetella pertussis
ccggguggucgcgcccgc

SEQ ID NO: 347606 - RNA, 23 nt, Bordetella pertussis
ccggguggucgcgcccgccgugg

SEQ ID NO: 347607 - RNA, 19 nt, Bordetella pertussis
ccgggugggcggcaucgac

SEQ ID NO: 347608 - RNA, 23 nt, Bordetella pertussis
ccggguugcaggaugcgcggcac

SEQ ID NO: 347609 - RNA, 22 nt, Bordetella pertussis
ccggguuggcgaugcucacgcc

SEQ ID NO: 347610 - RNA, 22 nt, Bordetella pertussis
ccggguugucgcccaccacgcc

SEQ ID NO: 347611 - RNA, 16 nt, Bordetella pertussis
ccgguagcccgcgugg

SEQ ID NO: 347612 - RNA, 14 nt, Bordetella pertussis
ccgguagcgcuggg

SEQ ID NO: 347613 - RNA, 13 nt, Bordetella pertussis
ccgguaggccacg

SEQ ID NO: 347614 - RNA, 16 nt, Bordetella pertussis
ccgguaggccacgcgc

SEQ ID NO: 347615 - RNA, 15 nt, Bordetella pertussis
ccgguauccuggcgc

SEQ ID NO: 347616 - RNA, 14 nt, Bordetella pertussis
ccgguaucgacgcg

SEQ ID NO: 347617 - RNA, 14 nt, Bordetella pertussis
ccgguaucgcggcg

SEQ ID NO: 347618 - RNA, 20 nt, Bordetella pertussis
ccgguaucgcggcgcaggcg

SEQ ID NO: 347619 - RNA, 14 nt, Bordetella pertussis
ccgguaugccugcc

SEQ ID NO: 347620 - RNA, 19 nt, Bordetella pertussis
ccgguaugccugccagccc

SEQ ID NO: 347621 - RNA, 23 nt, Bordetella pertussis
ccggucaaucuauacaacgcggu

SEQ ID NO: 347622 - RNA, 14 nt, Bordetella pertussis
ccggucaccgccgc

SEQ ID NO: 347623 - RNA, 16 nt, Bordetella pertussis
ccggucaccgccgccg

SEQ ID NO: 347624 - RNA, 21 nt, Bordetella pertussis
ccggucacgcugguggccacc

SEQ ID NO: 347625 - RNA, 19 nt, Bordetella pertussis
ccggucacugccgaaacgc

SEQ ID NO: 347626 - RNA, 22 nt, Bordetella pertussis
ccggucagcccaggcgggcgug

SEQ ID NO: 347627 - RNA, 23 nt, Bordetella pertussis
ccggucaggcgucguuggccgcg

SEQ ID NO: 347628 - RNA, 14 nt, Bordetella pertussis
ccgguccagaugau

SEQ ID NO: 347629 - RNA, 20 nt, Bordetella pertussis
ccggucaugcaccugcaggg

SEQ ID NO: 347630 - RNA, 22 nt, Bordetella pertussis
ccggugaucagcaggcccacca

SEQ ID NO: 347631 - RNA, 20 nt, Bordetella pertussis
ccggugaucaucgugccggg

SEQ ID NO: 347632 - RNA, 19 nt, Bordetella pertussis
ccggugaucaugccgcuga

SEQ ID NO: 347633 - RNA, 21 nt, Bordetella pertussis
ccggugaucgaguaggccggc

SEQ ID NO: 347634 - RNA, 15 nt, Bordetella pertussis
ccggugaugcccgag

SEQ ID NO: 347635 - RNA, 17 nt, Bordetella pertussis
ccggugaugcccgaggc

SEQ ID NO: 347636 - RNA, 17 nt, Bordetella pertussis
ccggugaugcggcgcgc

SEQ ID NO: 347637 - RNA, 19 nt, Bordetella pertussis
ccggugaugcggcgcgccg

SEQ ID NO: 347638 - RNA, 16 nt, Bordetella pertussis
ccggugcgauagcgcc

SEQ ID NO: 347639 - RNA, 13 nt, Bordetella pertussis
ccggugcgcagca

SEQ ID NO: 347640 - RNA, 18 nt, Bordetella pertussis
ccggugcgcagcaccagc

SEQ ID NO: 347641 - RNA, 22 nt, Bordetella pertussis
ccggugcgcagcaccagcaugu

SEQ ID NO: 347642 - RNA, 20 nt, Bordetella pertussis
ccggugcgcacauggcggau

SEQ ID NO: 347643 - RNA, 15 nt, Bordetella pertussis
ccggugcgcgcaggg

SEQ ID NO: 347644 - RNA, 23 nt, Bordetella pertussis
ccggugcgcgcagggcggccggc

SEQ ID NO: 347645 - RNA, 20 nt, Bordetella pertussis
ccggugcgcggcgcccccgc

SEQ ID NO: 347646 - RNA, 17 nt, Bordetella pertussis
ccggugcguaccagccc

SEQ ID NO: 347647 - RNA, 18 nt, Bordetella pertussis
ccggugcucggccagcgc

SEQ ID NO: 347648 - RNA, 23 nt, Bordetella pertussis
ccggugcucggccagcgcgcgcc

SEQ ID NO: 347649 - RNA, 19 nt, Bordetella pertussis
ccggugucggcccacugga

SEQ ID NO: 347650 - RNA, 16 nt, Bordetella pertussis
ccgguucggcgcggcg

SEQ ID NO: 347651 - RNA, 18 nt, Bordetella pertussis
ccgguucugcggcgcgua

SEQ ID NO: 347652 - RNA, 17 nt, Bordetella pertussis
ccgguugacgaucucgc

SEQ ID NO: 347653 - RNA, 14 nt, Bordetella pertussis
ccgguugcgcgccg

SEQ ID NO: 347654 - RNA, 15 nt, Bordetella pertussis
ccgguugcgcgccga

SEQ ID NO: 347655 - RNA, 14 nt, Bordetella pertussis
ccgguuggccagcu

SEQ ID NO: 347656 - RNA, 19 nt, Bordetella pertussis
ccgguuggcgccuuccggc

SEQ ID NO: 347657 - RNA, 21 nt, Bordetella pertussis
ccgguuggcgccuuccggcag

SEQ ID NO: 347658 - RNA, 15 nt, Bordetella pertussis
ccguagagggucugg

SEQ ID NO: 347659 - RNA, 23 nt, Bordetella pertussis
ccguagagggucuggcggccggu

SEQ ID NO: 347660 - RNA, 17 nt, Bordetella pertussis
ccguagccgcugcgcgc

SEQ ID NO: 347661 - RNA, 14 nt, Bordetella pertussis
ccguagcgcaggcg

SEQ ID NO: 347662 - RNA, 15 nt, Bordetella pertussis
ccguagcgcaggcgc

SEQ ID NO: 347663 - RNA, 22 nt, Bordetella pertussis
ccguagcgcgccagccgcgcga

SEQ ID NO: 347664 - RNA, 20 nt, Bordetella pertussis
ccguagcgguccggggcggg

SEQ ID NO: 347665 - RNA, 22 nt, Bordetella pertussis
ccguagcguuggcggccggcca

SEQ ID NO: 347666 - RNA, 19 nt, Bordetella pertussis
ccguaguccagcagcagcg

SEQ ID NO: 347667 - RNA, 24 nt, Bordetella pertussis
ccguaguccagcagcagcgccgcg

SEQ ID NO: 347668 - RNA, 16 nt, Bordetella pertussis
ccguaggugcgcgcca

SEQ ID NO: 347669 - RNA, 14 nt, Bordetella pertussis
ccguaucgcggccg

SEQ ID NO: 347670 - RNA, 20 nt, Bordetella pertussis
ccgucaacagcauggacgag

SEQ ID NO: 347671 - RNA, 15 nt, Bordetella pertussis
ccgucaccgccgccg

SEQ ID NO: 347672 - RNA, 18 nt, Bordetella pertussis
ccgucaccgccgccgcgc

SEQ ID NO: 347673 - RNA, 18 nt, Bordetella pertussis
ccgucaugaggccccugu

SEQ ID NO: 347674 - RNA, 14 nt, Bordetella pertussis
ccguccacgcccag

SEQ ID NO: 347675 - RNA, 21 nt, Bordetella pertussis
ccguccacgcccagcgccggc

SEQ ID NO: 347676 - RNA, 20 nt, Bordetella pertussis
ccguccacggccugcgcgcc

SEQ ID NO: 347677 - RNA, 16 nt, Bordetella pertussis
ccgucccugguccagc

SEQ ID NO: 347678 - RNA, 13 nt, Bordetella pertussis
ccguccgagcccg

SEQ ID NO: 347679 - RNA, 15 nt, Bordetella pertussis
ccguccgccaggacg

SEQ ID NO: 347680 - RNA, 13 nt, Bordetella pertussis
ccguccgcgacgg

SEQ ID NO: 347681 - RNA, 14 nt, Bordetella pertussis
ccguccggccgugc

SEQ ID NO: 347682 - RNA, 16 nt, Bordetella pertussis
ccgucgcacuggguuu

SEQ ID NO: 347683 - RNA, 18 nt, Bordetella pertussis
ccgucgccaaagcgcagc

SEQ ID NO: 347684 - RNA, 17 nt, Bordetella pertussis
ccgucgcgccaggccgg

SEQ ID NO: 347685 - RNA, 15 nt, Bordetella pertussis
ccgucgcgcgcacgc

SEQ ID NO: 347686 - RNA, 16 nt, Bordetella pertussis
ccgucgcgcucgagca

SEQ ID NO: 347687 - RNA, 14 nt, Bordetella pertussis
ccgucgcgcugcaa

SEQ ID NO: 347688 - RNA, 20 nt, Bordetella pertussis
ccgucggggccgauggucag

SEQ ID NO: 347689 - RNA, 15 nt, Bordetella pertussis
ccgucgggggccggc

SEQ ID NO: 347690 - RNA, 21 nt, Bordetella pertussis
ccgucgggguggcgucguccg

SEQ ID NO: 347691 - RNA, 19 nt, Bordetella pertussis
ccgucggguugccgcugca

SEQ ID NO: 347692 - RNA, 22 nt, Bordetella pertussis
ccgucggguugccgcugcaugg

SEQ ID NO: 347693 - RNA, 20 nt, Bordetella pertussis
ccgucggugguggugacguu

SEQ ID NO: 347694 - RNA, 18 nt, Bordetella pertussis
ccgucguugacggggacg

SEQ ID NO: 347695 - RNA, 22 nt, Bordetella pertussis
ccgucguugacggggacgccgg

SEQ ID NO: 347696 - RNA, 21 nt, Bordetella pertussis
ccgucucgaacgccgcgucgc

SEQ ID NO: 347697 - RNA, 14 nt, Bordetella pertussis
ccgucucgcgcgcc

SEQ ID NO: 347698 - RNA, 15 nt, Bordetella pertussis
ccgucucgcgcgcca

SEQ ID NO: 347699 - RNA, 15 nt, Bordetella pertussis
ccgucucgcccaggc

SEQ ID NO: 347700 - RNA, 13 nt, Bordetella pertussis
ccgucuggcggca

SEQ ID NO: 347701 - RNA, 21 nt, Bordetella pertussis
ccgucuggcggcagcucgcgc

SEQ ID NO: 347702 - RNA, 23 nt, Bordetella pertussis
ccgucugggcgugaaaggccagc

SEQ ID NO: 347703 - RNA, 24 nt, Bordetella pertussis
ccgucugggcgugaaaggccagcg

SEQ ID NO: 347704 - RNA, 23 nt, Bordetella pertussis
ccgucugugcgccccgcuggccg

SEQ ID NO: 347705 - RNA, 15 nt, Bordetella pertussis
ccgugagcgccgccg

SEQ ID NO: 347706 - RNA, 16 nt, Bordetella pertussis
ccgugagcgccgccgc

SEQ ID NO: 347707 - RNA, 21 nt, Bordetella pertussis
ccgugagcgccgccgccaugg

SEQ ID NO: 347708 - RNA, 19 nt, Bordetella pertussis
ccgugaucuugaugccgcc

SEQ ID NO: 347709 - RNA, 21 nt, Bordetella pertussis
ccgugaucuugaugccgccca

SEQ ID NO: 347710 - RNA, 16 nt, Bordetella pertussis
ccgugaugccgcccgc

SEQ ID NO: 347711 - RNA, 20 nt, Bordetella pertussis
ccgugaugcgcgccgcucuu

SEQ ID NO: 347712 - RNA, 15 nt, Bordetella pertussis
ccgugauggcgcggg

SEQ ID NO: 347713 - RNA, 20 nt, Bordetella pertussis
ccgugaugucgccgucggca

SEQ ID NO: 347714 - RNA, 19 nt, Bordetella pertussis
ccgugcagacggcggcugg

SEQ ID NO: 347715 - RNA, 23 nt, Bordetella pertussis
ccgugccgcgcgcaccggcuugg

SEQ ID NO: 347716 - RNA, 16 nt, Bordetella pertussis
ccgugccggccggacc

SEQ ID NO: 347717 - RNA, 22 nt, Bordetella pertussis
ccgugcgaggcgaacaggcaca

SEQ ID NO: 347718 - RNA, 16 nt, Bordetella pertussis
ccgugcgcaacgcgcg

SEQ ID NO: 347719 - RNA, 19 nt, Bordetella pertussis
ccgugcgccaacgcgucga

SEQ ID NO: 347720 - RNA, 20 nt, Bordetella pertussis
ccgugcgcggcgagccgcgc

SEQ ID NO: 347721 - RNA, 16 nt, Bordetella pertussis
ccgugcgcgggcgcgg

SEQ ID NO: 347722 - RNA, 17 nt, Bordetella pertussis
ccgugcgcgggcgcggc

SEQ ID NO: 347723 - RNA, 20 nt, Bordetella pertussis
ccgugcgcgguucaggcuug

SEQ ID NO: 347724 - RNA, 15 nt, Bordetella pertussis
ccgugcgccagcgcc

SEQ ID NO: 347725 - RNA, 13 nt, Bordetella pertussis
ccgugcgcgcccg

SEQ ID NO: 347726 - RNA, 13 nt, Bordetella pertussis
ccgugcggcgcgc

SEQ ID NO: 347727 - RNA, 16 nt, Bordetella pertussis
ccgugcggcgcgcacg

SEQ ID NO: 347728 - RNA, 15 nt, Bordetella pertussis
ccgugcggggaccgg

SEQ ID NO: 347729 - RNA, 20 nt, Bordetella pertussis
ccgugcuccagaacgcgccg

SEQ ID NO: 347730 - RNA, 20 nt, Bordetella pertussis
ccgugcgguucgucagggcc

SEQ ID NO: 347731 - RNA, 22 nt, Bordetella pertussis
ccgugcgguucgucagggccgc

SEQ ID NO: 347732 - RNA, 18 nt, Bordetella pertussis
ccgugcgugugccugucc

SEQ ID NO: 347733 - RNA, 19 nt, Bordetella pertussis
ccgugcuggccgacgcgcu

SEQ ID NO: 347734 - RNA, 21 nt, Bordetella pertussis
ccgugcuggccgacgcgcugg

SEQ ID NO: 347735 - RNA, 13 nt, Bordetella pertussis
ccgugcuggccgc

SEQ ID NO: 347736 - RNA, 22 nt, Bordetella pertussis
ccguggacgugcgcgaccgcgc

SEQ ID NO: 347737 - RNA, 22 nt, Bordetella pertussis
ccguggacgaauacgcuggcgc

SEQ ID NO: 347738 - RNA, 20 nt, Bordetella pertussis
ccguggaggcggcggccguc

SEQ ID NO: 347739 - RNA, 12 nt, Bordetella pertussis
ccguggcaugcc

SEQ ID NO: 347740 - RNA, 13 nt, Bordetella pertussis
ccguggcaugcca

SEQ ID NO: 347741 - RNA, 14 nt, Bordetella pertussis
ccguggcaugccau

SEQ ID NO: 347742 - RNA, 15 nt, Bordetella pertussis
ccguggccaagggcg

SEQ ID NO: 347743 - RNA, 20 nt, Bordetella pertussis
ccguggccaagggcgccgcg

SEQ ID NO: 347744 - RNA, 21 nt, Bordetella pertussis
ccguggccaagggcgccgcgc

SEQ ID NO: 347745 - RNA, 15 nt, Bordetella pertussis
ccguggccacggccg

SEQ ID NO: 347746 - RNA, 16 nt, Bordetella pertussis
ccguggcccagccgca

SEQ ID NO: 347747 - RNA, 15 nt, Bordetella pertussis
ccguggccggcaucg

SEQ ID NO: 347748 - RNA, 16 nt, Bordetella pertussis
ccguggccggcaucgc

SEQ ID NO: 347749 - RNA, 20 nt, Bordetella pertussis
ccguggccggcaucgcgcug

SEQ ID NO: 347750 - RNA, 21 nt, Bordetella pertussis
ccguggcgcaaggcaugcgcc

SEQ ID NO: 347751 - RNA, 22 nt, Bordetella pertussis
ccguggcgcaaggcaugcgcca

SEQ ID NO: 347752 - RNA, 17 nt, Bordetella pertussis
ccguggcgugcaggccg

SEQ ID NO: 347753 - RNA, 19 nt, Bordetella pertussis
ccguggcgugcaggccggc

SEQ ID NO: 347754 - RNA, 21 nt, Bordetella pertussis
ccguggcgugcaggccggcgg

SEQ ID NO: 347755 - RNA, 21 nt, Bordetella pertussis
ccguggcguugacggcccagc

SEQ ID NO: 347756 - RNA, 12 nt, Bordetella pertussis
ccgugggacagg

SEQ ID NO: 347757 - RNA, 14 nt, Bordetella pertussis
ccgugggcggcgua

SEQ ID NO: 347758 - RNA, 24 nt, Bordetella pertussis
ccgugggcggcguagagcgccgcg

SEQ ID NO: 347759 - RNA, 17 nt, Bordetella pertussis
ccguggucgccagcacg

SEQ ID NO: 347760 - RNA, 17 nt, Bordetella pertussis
ccgugguggggccgggc

SEQ ID NO: 347761 - RNA, 14 nt, Bordetella pertussis
ccucaccgcgccgg

SEQ ID NO: 347762 - RNA, 18 nt, Bordetella pertussis
ccucacuccauagcgccg

SEQ ID NO: 347763 - RNA, 15 nt, Bordetella pertussis
ccucagcggccgcug

SEQ ID NO: 347764 - RNA, 15 nt, Bordetella pertussis
ccuccaccgccagcc

SEQ ID NO: 347765 - RNA, 22 nt, Bordetella pertussis
ccuccagcagggacuugggcag

SEQ ID NO: 347766 - RNA, 19 nt, Bordetella pertussis
ccucccugugggggacagg

SEQ ID NO: 347767 - RNA, 17 nt, Bordetella pertussis
ccuccgacaggcgccgc

SEQ ID NO: 347768 - RNA, 18 nt, Bordetella pertussis
ccuccgacaggcgccgca

SEQ ID NO: 347769 - RNA, 12 nt, Bordetella pertussis
ccuccugccggc

SEQ ID NO: 347770 - RNA, 17 nt, Bordetella pertussis
ccuccugucaugguuuc

SEQ ID NO: 347771 - RNA, 14 nt, Bordetella pertussis
ccucgaacaggcca

SEQ ID NO: 347772 - RNA, 23 nt, Bordetella pertussis
ccucgaacaggccaucgccgccg

SEQ ID NO: 347773 - RNA, 21 nt, Bordetella pertussis
ccucgaacccgaacgcgugca

SEQ ID NO: 347774 - RNA, 20 nt, Bordetella pertussis
ccucgaagaucaacaaggcg

SEQ ID NO: 347775 - RNA, 20 nt, Bordetella pertussis
ccucgaagaucucgacgucg

SEQ ID NO: 347776 - RNA, 17 nt, Bordetella pertussis
ccucgacgaugcccugc

SEQ ID NO: 347777 - RNA, 21 nt, Bordetella pertussis
ccucgacgaugcccugcgcca

SEQ ID NO: 347778 - RNA, 18 nt, Bordetella pertussis
ccucgacgcccgggcggc

SEQ ID NO: 347779 - RNA, 23 nt, Bordetella pertussis
ccucgacgcuguagaggcgcggc

SEQ ID NO: 347780 - RNA, 15 nt, Bordetella pertussis
ccucgacggccgccg

SEQ ID NO: 347781 - RNA, 21 nt, Bordetella pertussis
ccucgacguaagugcccaggc

SEQ ID NO: 347782 - RNA, 23 nt, Bordetella pertussis
ccucgacguaagugcccaggccc

SEQ ID NO: 347783 - RNA, 18 nt, Bordetella pertussis
ccucgaugcccucgcgca

SEQ ID NO: 347784 - RNA, 14 nt, Bordetella pertussis
ccucgauggcggug

SEQ ID NO: 347785 - RNA, 16 nt, Bordetella pertussis
ccucgcaagcggccau

SEQ ID NO: 347786 - RNA, 17 nt, Bordetella pertussis
ccucgcaagcggccaug

SEQ ID NO: 347787 - RNA, 23 nt, Bordetella pertussis
ccucgcaagcggccaugcgccgc

SEQ ID NO: 347788 - RNA, 13 nt, Bordetella pertussis
ccucgcacggccg

SEQ ID NO: 347789 - RNA, 16 nt, Bordetella pertussis
ccucgcacggccguca

SEQ ID NO: 347790 - RNA, 23 nt, Bordetella pertussis
ccucgauuuccgaggccuugcuc

SEQ ID NO: 347791 - RNA, 19 nt, Bordetella pertussis
ccucgcgaaagcacgccau

SEQ ID NO: 347792 - RNA, 19 nt, Bordetella pertussis
ccucgcgcacggugcgcac

SEQ ID NO: 347793 - RNA, 15 nt, Bordetella pertussis
ccucgcgcagggcgg

SEQ ID NO: 347794 - RNA, 13 nt, Bordetella pertussis
ccucgcgcgcgau

SEQ ID NO: 347795 - RNA, 15 nt, Bordetella pertussis
ccucgcgcgcggacu

SEQ ID NO: 347796 - RNA, 21 nt, Bordetella pertussis
ccucggaggauacggccagcg

SEQ ID NO: 347797 - RNA, 18 nt, Bordetella pertussis
ccucgcgcuccagcaugu

SEQ ID NO: 347798 - RNA, 17 nt, Bordetella pertussis
ccucggcaccgaggccg

SEQ ID NO: 347799 - RNA, 21 nt, Bordetella pertussis
ccucggccaggaaagccggcg

SEQ ID NO: 347800 - RNA, 19 nt, Bordetella pertussis
ccucggcggcgucgcuggc

SEQ ID NO: 347801 - RNA, 14 nt, Bordetella pertussis
ccucggcgggcggc

SEQ ID NO: 347802 - RNA, 17 nt, Bordetella pertussis
ccucggcgguugcccgc

SEQ ID NO: 347803 - RNA, 23 nt, Bordetella pertussis
ccucggugcugcuguucgccacg

SEQ ID NO: 347804 - RNA, 14 nt, Bordetella pertussis
ccucguaggccauc

SEQ ID NO: 347805 - RNA, 23 nt, Bordetella pertussis
ccucguccguuucgucggcgcgc

SEQ ID NO: 347806 - RNA, 18 nt, Bordetella pertussis
ccucguccucgucggcga

SEQ ID NO: 347807 - RNA, 19 nt, Bordetella pertussis
ccucgugaucgaccgccag

SEQ ID NO: 347808 - RNA, 14 nt, Bordetella pertussis
ccucgugcugcugc

SEQ ID NO: 347809 - RNA, 15 nt, Bordetella pertussis
ccucguugacgccga

SEQ ID NO: 347810 - RNA, 13 nt, Bordetella pertussis
ccucguugcccgc

SEQ ID NO: 347811 - RNA, 22 nt, Bordetella pertussis
ccucuucagcccggcgcgccac

SEQ ID NO: 347812 - RNA, 19 nt, Bordetella pertussis
ccucuucguugucgcgcgc

SEQ ID NO: 347813 - RNA, 17 nt, Bordetella pertussis
ccucuuucgccgcgcgc

SEQ ID NO: 347814 - RNA, 17 nt, Bordetella pertussis
ccugaacaccggcgcgc

SEQ ID NO: 347815 - RNA, 22 nt, Bordetella pertussis
ccugaacaccggcgcgccuggc

SEQ ID NO: 347816 - RNA, 16 nt, Bordetella pertussis
ccugaaccaggccgcc

SEQ ID NO: 347817 - RNA, 13 nt, Bordetella pertussis
ccugaacgccggg

SEQ ID NO: 347818 - RNA, 19 nt, Bordetella pertussis
ccugaacuauggcgcgcgc

SEQ ID NO: 347819 - RNA, 23 nt, Bordetella pertussis
ccugaauccguaagcgcuggacg

SEQ ID NO: 347820 - RNA, 15 nt, Bordetella pertussis
ccugaaucgcccggg

SEQ ID NO: 347821 - RNA, 19 nt, Bordetella pertussis
ccugaaucgcccgggcgcc

SEQ ID NO: 347822 - RNA, 16 nt, Bordetella pertussis
ccugacgaccaaccug

SEQ ID NO: 347823 - RNA, 18 nt, Bordetella pertussis
ccugacgaccaaccugac

SEQ ID NO: 347824 - RNA, 13 nt, Bordetella pertussis
ccugacgccugcg

SEQ ID NO: 347825 - RNA, 19 nt, Bordetella pertussis
ccugacgugcgccacagca

SEQ ID NO: 347826 - RNA, 21 nt, Bordetella pertussis
ccugagcacaugcccggccac

SEQ ID NO: 347827 - RNA, 15 nt, Bordetella pertussis
ccugagcaccgccgc

SEQ ID NO: 347828 - RNA, 15 nt, Bordetella pertussis
ccugaggccaggccg

SEQ ID NO: 347829 - RNA, 19 nt, Bordetella pertussis
ccugaucaaucugaucauc

SEQ ID NO: 347830 - RNA, 22 nt, Bordetella pertussis
ccugaucaaucugaucaucuuc

SEQ ID NO: 347831 - RNA, 12 nt, Bordetella pertussis
ccugaucgcgca

SEQ ID NO: 347832 - RNA, 16 nt, Bordetella pertussis
ccugaucucgcgcacc

SEQ ID NO: 347833 - RNA, 17 nt, Bordetella pertussis
ccugaucucgcgcaccg

SEQ ID NO: 347834 - RNA, 17 nt, Bordetella pertussis
ccugauucacaggcccg

SEQ ID NO: 347835 - RNA, 23 nt, Bordetella pertussis
ccugcaaaaaacaagcucgcgca

SEQ ID NO: 347836 - RNA, 16 nt, Bordetella pertussis
ccugcaagauggcguc

SEQ ID NO: 347837 - RNA, 13 nt, Bordetella pertussis
ccugcaaggccgg

SEQ ID NO: 347838 - RNA, 23 nt, Bordetella pertussis
ccugcaaggccggcggcacgcug

SEQ ID NO: 347839 - RNA, 13 nt, Bordetella pertussis
ccugcaccgccgc

SEQ ID NO: 347840 - RNA, 15 nt, Bordetella pertussis
ccugcaccgccgcgc

SEQ ID NO: 347841 - RNA, 19 nt, Bordetella pertussis
ccugcacgauggcgccggc

SEQ ID NO: 347842 - RNA, 22 nt, Bordetella pertussis
ccugcacgauggcgccggcuuc

SEQ ID NO: 347843 - RNA, 13 nt, Bordetella pertussis
ccugcacgcgcgc

SEQ ID NO: 347844 - RNA, 14 nt, Bordetella pertussis
ccugcacgcgcgcg

SEQ ID NO: 347845 - RNA, 16 nt, Bordetella pertussis
ccugcacgcgggcgcu

SEQ ID NO: 347846 - RNA, 13 nt, Bordetella pertussis
ccugcacguccca

SEQ ID NO: 347847 - RNA, 14 nt, Bordetella pertussis
ccugcacgucccag

SEQ ID NO: 347848 - RNA, 22 nt, Bordetella pertussis
ccugcacgucccagucgccgcg

SEQ ID NO: 347849 - RNA, 23 nt, Bordetella pertussis
ccugcacgucccagucgccgcgc

SEQ ID NO: 347850 - RNA, 22 nt, Bordetella pertussis
ccugcagaccagcaccggcacg

SEQ ID NO: 347851 - RNA, 12 nt, Bordetella pertussis
ccugcagcacgc

SEQ ID NO: 347852 - RNA, 16 nt, Bordetella pertussis
ccugcagcacggccac

SEQ ID NO: 347853 - RNA, 14 nt, Bordetella pertussis
ccugcagcagcgcc

SEQ ID NO: 347854 - RNA, 16 nt, Bordetella pertussis
ccugcagcagcgccuu

SEQ ID NO: 347855 - RNA, 18 nt, Bordetella pertussis
ccugcagcaggcgcacca

SEQ ID NO: 347856 - RNA, 12 nt, Bordetella pertussis
ccugcagcauga

SEQ ID NO: 347857 - RNA, 13 nt, Bordetella pertussis
ccugcagcgcgcg

SEQ ID NO: 347858 - RNA, 14 nt, Bordetella pertussis
ccugcagcgcgcgc

SEQ ID NO: 347859 - RNA, 15 nt, Bordetella pertussis
ccugcagcgcgcgcg

SEQ ID NO: 347860 - RNA, 14 nt, Bordetella pertussis
ccugcagcgugcug

SEQ ID NO: 347861 - RNA, 15 nt, Bordetella pertussis
ccugcagcgugcugc

SEQ ID NO: 347862 - RNA, 17 nt, Bordetella pertussis
ccugcaggaaggccgcc

SEQ ID NO: 347863 - RNA, 20 nt, Bordetella pertussis
ccugcaggaaggccgccgcg

SEQ ID NO: 347864 - RNA, 14 nt, Bordetella pertussis
ccugcaggcccacc

SEQ ID NO: 347865 - RNA, 20 nt, Bordetella pertussis
ccugcaggcccaccggcaug

SEQ ID NO: 347866 - RNA, 17 nt, Bordetella pertussis
ccugcaggcccagcacg

SEQ ID NO: 347867 - RNA, 23 nt, Bordetella pertussis
ccugcaggcccagcacgcgcgcc

SEQ ID NO: 347868 - RNA, 12 nt, Bordetella pertussis
ccugcaggcccg

SEQ ID NO: 347869 - RNA, 13 nt, Bordetella pertussis
ccugcaggcccgg

SEQ ID NO: 347870 - RNA, 20 nt, Bordetella pertussis
ccugcaggcccggcgcgacg

SEQ ID NO: 347871 - RNA, 12 nt, Bordetella pertussis
ccugcaggccgc

SEQ ID NO: 347872 - RNA, 16 nt, Bordetella pertussis
ccugcaggccgggcag

SEQ ID NO: 347873 - RNA, 13 nt, Bordetella pertussis
ccugcaggcggcg

SEQ ID NO: 347874 - RNA, 18 nt, Bordetella pertussis
ccugcaggcggucgguga

SEQ ID NO: 347875 - RNA, 14 nt, Bordetella pertussis
ccugcagggcaugg

SEQ ID NO: 347876 - RNA, 21 nt, Bordetella pertussis
ccugcagggcaugggcccggg

SEQ ID NO: 347877 - RNA, 16 nt, Bordetella pertussis
ccugcagggucagccc

SEQ ID NO: 347878 - RNA, 21 nt, Bordetella pertussis
ccugcaggugccgccggcgcg

SEQ ID NO: 347879 - RNA, 16 nt, Bordetella pertussis
ccugcaguucggccgc

SEQ ID NO: 347880 - RNA, 23 nt, Bordetella pertussis
ccugcaucacgguaggcgcgucg

SEQ ID NO: 347881 - RNA, 14 nt, Bordetella pertussis
ccugcauccggccc

SEQ ID NO: 347882 - RNA, 15 nt, Bordetella pertussis
ccugcauccggccca

SEQ ID NO: 347883 - RNA, 22 nt, Bordetella pertussis
ccugccaaagacaaugccccgc

SEQ ID NO: 347884 - RNA, 20 nt, Bordetella pertussis
ccugccaagcgccgcggcca

SEQ ID NO: 347885 - RNA, 15 nt, Bordetella pertussis
ccugccaccgacaag

SEQ ID NO: 347886 - RNA, 15 nt, Bordetella pertussis
ccugccacugcaucg

SEQ ID NO: 347887 - RNA, 18 nt, Bordetella pertussis
ccugccagaacagccgcg

SEQ ID NO: 347888 - RNA, 13 nt, Bordetella pertussis
ccugccaggcgcc

SEQ ID NO: 347889 - RNA, 14 nt, Bordetella pertussis
ccugccaggcgccg

SEQ ID NO: 347890 - RNA, 15 nt, Bordetella pertussis
ccugccaggcgccgc

SEQ ID NO: 347891 - RNA, 16 nt, Bordetella pertussis
ccugccaggcgccgcg

SEQ ID NO: 347892 - RNA, 20 nt, Bordetella pertussis
ccugccagccugccacaucg

SEQ ID NO: 347893 - RNA, 17 nt, Bordetella pertussis
ccugccaguucgaugcg

SEQ ID NO: 347894 - RNA, 17 nt, Bordetella pertussis
ccugccaguugccgccg

SEQ ID NO: 347895 - RNA, 22 nt, Bordetella pertussis
ccugccaguugccgccgccggc

SEQ ID NO: 347896 - RNA, 18 nt, Bordetella pertussis
ccugccauccggccgcac

SEQ ID NO: 347897 - RNA, 19 nt, Bordetella pertussis
ccugccaugccccauccag

SEQ ID NO: 347898 - RNA, 16 nt, Bordetella pertussis
ccugccauugcgcggc

SEQ ID NO: 347899 - RNA, 21 nt, Bordetella pertussis
ccugcccaccgccgcccgcca

SEQ ID NO: 347900 - RNA, 18 nt, Bordetella pertussis
ccugccccugcggggaca

SEQ ID NO: 347901 - RNA, 19 nt, Bordetella pertussis
ccugcccgagaccgcccgc

SEQ ID NO: 347902 - RNA, 16 nt, Bordetella pertussis
ccugcccgccuggucg

SEQ ID NO: 347903 - RNA, 19 nt, Bordetella pertussis
ccugcccgggcaccagguc

SEQ ID NO: 347904 - RNA, 15 nt, Bordetella pertussis
ccugcccgggcagca

SEQ ID NO: 347905 - RNA, 12 nt, Bordetella pertussis
ccugcccgggcg

SEQ ID NO: 347906 - RNA, 15 nt, Bordetella pertussis
ccugcccugcggcuu

SEQ ID NO: 347907 - RNA, 16 nt, Bordetella pertussis
ccugcccugcggcuug

SEQ ID NO: 347908 - RNA, 23 nt, Bordetella pertussis
ccugcccugguggcagagggcga

SEQ ID NO: 347909 - RNA, 22 nt, Bordetella pertussis
ccugccgaucgugcacgcccgc

SEQ ID NO: 347910 - RNA, 23 nt, Bordetella pertussis
ccugccgaucgugcacgcccgcg

SEQ ID NO: 347911 - RNA, 12 nt, Bordetella pertussis
ccugccgcgccc

SEQ ID NO: 347912 - RNA, 15 nt, Bordetella pertussis
ccugccgcgccgacc

SEQ ID NO: 347913 - RNA, 14 nt, Bordetella pertussis
ccugccgcggccgc

SEQ ID NO: 347914 - RNA, 14 nt, Bordetella pertussis
ccugccgcgugccc

SEQ ID NO: 347915 - RNA, 23 nt, Bordetella pertussis
ccugccgcgugcccgcguccacc

SEQ ID NO: 347916 - RNA, 14 nt, Bordetella pertussis
ccugccggcgcaca

SEQ ID NO: 347917 - RNA, 14 nt, Bordetella pertussis
ccugccggcgcgcc

SEQ ID NO: 347918 - RNA, 20 nt, Bordetella pertussis
ccugccggggcacccaggcg

SEQ ID NO: 347919 - RNA, 16 nt, Bordetella pertussis
ccugccguucgcgcug

SEQ ID NO: 347920 - RNA, 22 nt, Bordetella pertussis
ccugccguucgcgcugcccacc

SEQ ID NO: 347921 - RNA, 14 nt, Bordetella pertussis
ccugccuccaggcg

SEQ ID NO: 347922 - RNA, 15 nt, Bordetella pertussis
ccugcgaacgcccgg

SEQ ID NO: 347923 - RNA, 16 nt, Bordetella pertussis
ccugcgaacgcccggc

SEQ ID NO: 347924 - RNA, 23 nt, Bordetella pertussis
ccugcgagagauagcccagcacc

SEQ ID NO: 347925 - RNA, 22 nt, Bordetella pertussis
ccugcgaggacaggggccucau

SEQ ID NO: 347926 - RNA, 23 nt, Bordetella pertussis
ccugcgaggacaggggccucaug

SEQ ID NO: 347927 - RNA, 20 nt, Bordetella pertussis
ccugcgaucaguucggcaug

SEQ ID NO: 347928 - RNA, 21 nt, Bordetella pertussis
ccugcgaucaguucggcaugg

SEQ ID NO: 347929 - RNA, 14 nt, Bordetella pertussis
ccugcgaugccggc

SEQ ID NO: 347930 - RNA, 19 nt, Bordetella pertussis
ccugcgcacccgccuggac

SEQ ID NO: 347931 - RNA, 20 nt, Bordetella pertussis
ccugcgcacccgccuggacg

SEQ ID NO: 347932 - RNA, 16 nt, Bordetella pertussis
ccugcgcaccggccgg

SEQ ID NO: 347933 - RNA, 22 nt, Bordetella pertussis
ccugcgcaucgaucagcgcgcc

SEQ ID NO: 347934 - RNA, 23 nt, Bordetella pertussis
ccugcgcaucgaucagcgcgccg

SEQ ID NO: 347935 - RNA, 17 nt, Bordetella pertussis
ccugcgccaccagcuug

SEQ ID NO: 347936 - RNA, 16 nt, Bordetella pertussis
ccugcgccaccgcaug

SEQ ID NO: 347937 - RNA, 21 nt, Bordetella pertussis
ccugcgccaccuggcgcccgg

SEQ ID NO: 347938 - RNA, 16 nt, Bordetella pertussis
ccugcgccagccgcgc

SEQ ID NO: 347939 - RNA, 20 nt, Bordetella pertussis
ccugcgccagccgcgccugc

SEQ ID NO: 347940 - RNA, 18 nt, Bordetella pertussis
ccugcgccagcgccucgc

SEQ ID NO: 347941 - RNA, 15 nt, Bordetella pertussis
ccugcgccauggcgc

SEQ ID NO: 347942 - RNA, 17 nt, Bordetella pertussis
ccugcgccauggcgcgc

SEQ ID NO: 347943 - RNA, 19 nt, Bordetella pertussis
ccugcgccauggcgcgcag

SEQ ID NO: 347944 - RNA, 20 nt, Bordetella pertussis
ccugcgccagcuccagccgc

SEQ ID NO: 347945 - RNA, 20 nt, Bordetella pertussis
ccugcgccggcauggccaau

SEQ ID NO: 347946 - RNA, 21 nt, Bordetella pertussis
ccugcgccgggcgcggccagg

SEQ ID NO: 347947 - RNA, 14 nt, Bordetella pertussis
ccugcgccgggucc

SEQ ID NO: 347948 - RNA, 22 nt, Bordetella pertussis
ccugcgccggguccggccgcgc

SEQ ID NO: 347949 - RNA, 23 nt, Bordetella pertussis
ccugcgccggguccggccgcgca

SEQ ID NO: 347950 - RNA, 16 nt, Bordetella pertussis
ccugcgccgucugcgc

SEQ ID NO: 347951 - RNA, 21 nt, Bordetella pertussis
ccugcgccgucugcgccgccg

SEQ ID NO: 347952 - RNA, 18 nt, Bordetella pertussis
ccugcgccgccgcgcgcu

SEQ ID NO: 347953 - RNA, 19 nt, Bordetella pertussis
ccugcgccgccgcgcgcug

SEQ ID NO: 347954 - RNA, 11 nt, Bordetella pertussis
ccugcgcgaaa

SEQ ID NO: 347955 - RNA, 12 nt, Bordetella pertussis
ccugcgcgccga

SEQ ID NO: 347956 - RNA, 16 nt, Bordetella pertussis
ccugcgcgccgaccag

SEQ ID NO: 347957 - RNA, 12 nt, Bordetella pertussis
ccugcgcgccgc

SEQ ID NO: 347958 - RNA, 14 nt, Bordetella pertussis
ccugcgcgccgccg

SEQ ID NO: 347959 - RNA, 21 nt, Bordetella pertussis
ccugcgcgcgagcagucgacc

SEQ ID NO: 347960 - RNA, 12 nt, Bordetella pertussis
ccugcgcgcgcu

SEQ ID NO: 347961 - RNA, 20 nt, Bordetella pertussis
ccugcgcugcauacgccgcu

SEQ ID NO: 347962 - RNA, 22 nt, Bordetella pertussis
ccugcggacggcgggcgccccg

SEQ ID NO: 347963 - RNA, 17 nt, Bordetella pertussis
ccugcggcacgaucggc

SEQ ID NO: 347964 - RNA, 22 nt, Bordetella pertussis
ccugcggcauggugugccuguc

SEQ ID NO: 347965 - RNA, 22 nt, Bordetella pertussis
ccugcggcgauuucuacgccga

SEQ ID NO: 347966 - RNA, 12 nt, Bordetella pertussis
ccugcggcgcca

SEQ ID NO: 347967 - RNA, 20 nt, Bordetella pertussis
ccugcggcgccagcgccgcg

SEQ ID NO: 347968 - RNA, 20 nt, Bordetella pertussis
ccugcggcgcggccagcacg

SEQ ID NO: 347969 - RNA, 15 nt, Bordetella pertussis
ccugcggcgcggccg

SEQ ID NO: 347970 - RNA, 14 nt, Bordetella pertussis
ccugcggcucgagg

SEQ ID NO: 347971 - RNA, 14 nt, Bordetella pertussis
ccugcgggccgggc

SEQ ID NO: 347972 - RNA, 17 nt, Bordetella pertussis
ccugcgggcgcagcgcc

SEQ ID NO: 347973 - RNA, 14 nt, Bordetella pertussis
ccugcgggccgcac

SEQ ID NO: 347974 - RNA, 16 nt, Bordetella pertussis
ccugcgggccgcacag

SEQ ID NO: 347975 - RNA, 14 nt, Bordetella pertussis
ccugcggggacagg

SEQ ID NO: 347976 - RNA, 13 nt, Bordetella pertussis
ccugcggggucug

SEQ ID NO: 347977 - RNA, 17 nt, Bordetella pertussis
ccugcggggucugcagg

SEQ ID NO: 347978 - RNA, 12 nt, Bordetella pertussis
ccugcgggugcg

SEQ ID NO: 347979 - RNA, 19 nt, Bordetella pertussis
ccugcgggugcgccugcag

SEQ ID NO: 347980 - RNA, 23 nt, Bordetella pertussis
ccugcgggugcgccugcagcgcc

SEQ ID NO: 347981 - RNA, 24 nt, Bordetella pertussis
ccugcgggugcgccugcagcgccg

SEQ ID NO: 347982 - RNA, 23 nt, Bordetella pertussis
ccugcguccagccgagccuggcg

SEQ ID NO: 347983 - RNA, 15 nt, Bordetella pertussis
ccugcgucguugccc

SEQ ID NO: 347984 - RNA, 14 nt, Bordetella pertussis
ccugcguggccgcg

SEQ ID NO: 347985 - RNA, 12 nt, Bordetella pertussis
ccugcguggccu

SEQ ID NO: 347986 - RNA, 14 nt, Bordetella pertussis
ccugcguggcgcag

SEQ ID NO: 347987 - RNA, 16 nt, Bordetella pertussis
ccugcguggcgggccg

SEQ ID NO: 347988 - RNA, 17 nt, Bordetella pertussis
ccugcgugucaggcgga

SEQ ID NO: 347989 - RNA, 20 nt, Bordetella pertussis
ccugcguugcgaucagcgcu

SEQ ID NO: 347990 - RNA, 22 nt, Bordetella pertussis
ccugcuaguacaccgucgcgcg

SEQ ID NO: 347991 - RNA, 16 nt, Bordetella pertussis
ccugcucacgccccgc

SEQ ID NO: 347992 - RNA, 21 nt, Bordetella pertussis
ccugcucccacgaacgccacg

SEQ ID NO: 347993 - RNA, 17 nt, Bordetella pertussis
ccugcucgauccgggca

SEQ ID NO: 347994 - RNA, 24 nt, Bordetella pertussis
ccugcucgaucugguuggccacau

SEQ ID NO: 347995 - RNA, 16 nt, Bordetella pertussis
ccugcucgcaggccug

SEQ ID NO: 347996 - RNA, 22 nt, Bordetella pertussis
ccugcucgcaggccugcugcag

SEQ ID NO: 347997 - RNA, 23 nt, Bordetella pertussis
ccugcucgcccacauagcggccg

SEQ ID NO: 347998 - RNA, 14 nt, Bordetella pertussis
ccugcucgcgcagc

SEQ ID NO: 347999 - RNA, 12 nt, Bordetella pertussis
ccugcucgguga

SEQ ID NO: 348000 - RNA, 21 nt, Bordetella pertussis
ccugcucggugagcggcacga

SEQ ID NO: 348001 - RNA, 23 nt, Bordetella pertussis
ccugcucggugcucuggcccgcc

SEQ ID NO: 348002 - RNA, 16 nt, Bordetella pertussis
ccugcucguagcuguc

SEQ ID NO: 348003 - RNA, 12 nt, Bordetella pertussis
ccugcugcccgc

SEQ ID NO: 348004 - RNA, 19 nt, Bordetella pertussis
ccugcugcgccuggccgcg

SEQ ID NO: 348005 - RNA, 15 nt, Bordetella pertussis
ccugcugcggcacgg

SEQ ID NO: 348006 - RNA, 16 nt, Bordetella pertussis
ccugcugcggcacggc

SEQ ID NO: 348007 - RNA, 15 nt, Bordetella pertussis
ccugcugcagcguga

SEQ ID NO: 348008 - RNA, 14 nt, Bordetella pertussis
ccugcugcugcagc

SEQ ID NO: 348009 - RNA, 13 nt, Bordetella pertussis
ccugcuggcgcag

SEQ ID NO: 348010 - RNA, 22 nt, Bordetella pertussis
ccugcuggcgcgucggcgcgcg

SEQ ID NO: 348011 - RNA, 14 nt, Bordetella pertussis
ccugcugggccgcg

SEQ ID NO: 348012 - RNA, 21 nt, Bordetella pertussis
ccugcugggguggagcgcggc

SEQ ID NO: 348013 - RNA, 21 nt, Bordetella pertussis
ccugcuugcaggaagcgcacc

SEQ ID NO: 348014 - RNA, 14 nt, Bordetella pertussis
ccugcuugcccagc

SEQ ID NO: 348015 - RNA, 15 nt, Bordetella pertussis
ccugcuugcccagca

SEQ ID NO: 348016 - RNA, 13 nt, Bordetella pertussis
ccugcuuggcgcg

SEQ ID NO: 348017 - RNA, 18 nt, Bordetella pertussis
ccugcuuggcgcgcagca

SEQ ID NO: 348018 - RNA, 17 nt, Bordetella pertussis
ccugcuuggcagccuug

SEQ ID NO: 348019 - RNA, 16 nt, Bordetella pertussis
ccugcuuugagcaggc

SEQ ID NO: 348020 - RNA, 14 nt, Bordetella pertussis
ccuggaccggcucc

SEQ ID NO: 348021 - RNA, 23 nt, Bordetella pertussis
ccuggacgaugcgcgaagcgccc

SEQ ID NO: 348022 - RNA, 19 nt, Bordetella pertussis
ccuggacgucugagcgccg

SEQ ID NO: 348023 - RNA, 21 nt, Bordetella pertussis
ccuggacgucugagcgccggg

SEQ ID NO: 348024 - RNA, 17 nt, Bordetella pertussis
ccuggagaucgccgccg

SEQ ID NO: 348025 - RNA, 20 nt, Bordetella pertussis
ccuggaucacgugccagccg

SEQ ID NO: 348026 - RNA, 16 nt, Bordetella pertussis
ccuggaugccaugccg

SEQ ID NO: 348027 - RNA, 15 nt, Bordetella pertussis
ccuggauggcggccg

SEQ ID NO: 348028 - RNA, 16 nt, Bordetella pertussis
ccuggauggcggccgc

SEQ ID NO: 348029 - RNA, 16 nt, Bordetella pertussis
ccuggaugugcgcggg

SEQ ID NO: 348030 - RNA, 22 nt, Bordetella pertussis
ccuggcaaugcguggccggcgg

SEQ ID NO: 348031 - RNA, 14 nt, Bordetella pertussis
ccuggcacgcugga

SEQ ID NO: 348032 - RNA, 22 nt, Bordetella pertussis
ccuggcaugugccaccgcccag

SEQ ID NO: 348033 - RNA, 23 nt, Bordetella pertussis
ccuggccaccaacgaaggcaucc

SEQ ID NO: 348034 - RNA, 15 nt, Bordetella pertussis
ccuggccacgcugcu

SEQ ID NO: 348035 - RNA, 16 nt, Bordetella pertussis
ccuggccacgcugcug

SEQ ID NO: 348036 - RNA, 22 nt, Bordetella pertussis
ccuggccauuccuuccgggccc

SEQ ID NO: 348037 - RNA, 19 nt, Bordetella pertussis
ccuggcccagaucugccgc

SEQ ID NO: 348038 - RNA, 14 nt, Bordetella pertussis
ccuggcccagcgca

SEQ ID NO: 348039 - RNA, 14 nt, Bordetella pertussis
ccuggcccagcucc

SEQ ID NO: 348040 - RNA, 23 nt, Bordetella pertussis
ccuggcccagcuccagcuggcgc

SEQ ID NO: 348041 - RNA, 20 nt, Bordetella pertussis
ccuggcccgaacggcccauc

SEQ ID NO: 348042 - RNA, 18 nt, Bordetella pertussis
ccuggccgaacgccgccg

SEQ ID NO: 348043 - RNA, 23 nt, Bordetella pertussis
ccuggccgagcgcggcaugcgca

SEQ ID NO: 348044 - RNA, 15 nt, Bordetella pertussis
ccuggccgccggcgg

SEQ ID NO: 348045 - RNA, 14 nt, Bordetella pertussis
ccuggccgcgccgu

SEQ ID NO: 348046 - RNA, 19 nt, Bordetella pertussis
ccuggccgcgcugaucacc

SEQ ID NO: 348047 - RNA, 12 nt, Bordetella pertussis
ccuggccggcgc

SEQ ID NO: 348048 - RNA, 13 nt, Bordetella pertussis
ccuggccggcgcc

SEQ ID NO: 348049 - RNA, 14 nt, Bordetella pertussis
ccuggccugcgccg

SEQ ID NO: 348050 - RNA, 15 nt, Bordetella pertussis
ccuggccugcgccgc

SEQ ID NO: 348051 - RNA, 18 nt, Bordetella pertussis
ccuggccugcgccgccgc

SEQ ID NO: 348052 - RNA, 18 nt, Bordetella pertussis
ccuggcgaccggcggcac

SEQ ID NO: 348053 - RNA, 15 nt, Bordetella pertussis
ccuggcgcaggccgg

SEQ ID NO: 348054 - RNA, 23 nt, Bordetella pertussis
ccuggcgcaggccggcggccagc

SEQ ID NO: 348055 - RNA, 18 nt, Bordetella pertussis
ccuggcgcccgacggcgc

SEQ ID NO: 348056 - RNA, 12 nt, Bordetella pertussis
ccuggcgcgcca

SEQ ID NO: 348057 - RNA, 13 nt, Bordetella pertussis
ccuggcgcgccag

SEQ ID NO: 348058 - RNA, 11 nt, Bordetella pertussis
ccuggcgcgcg

SEQ ID NO: 348059 - RNA, 15 nt, Bordetella pertussis
ccuggcgcgcggccu

SEQ ID NO: 348060 - RNA, 15 nt, Bordetella pertussis
ccuggcgcggcccca

SEQ ID NO: 348061 - RNA, 22 nt, Bordetella pertussis
ccuggcgcggccccaugcgcgg

SEQ ID NO: 348062 - RNA, 14 nt, Bordetella pertussis
ccuggcggacgaug

SEQ ID NO: 348063 - RNA, 18 nt, Bordetella pertussis
ccuggcggccgcccagca

SEQ ID NO: 348064 - RNA, 18 nt, Bordetella pertussis
ccuggcggcgcaguucgg

SEQ ID NO: 348065 - RNA, 18 nt, Bordetella pertussis
ccuggcgguaugcggcgc

SEQ ID NO: 348066 - RNA, 22 nt, Bordetella pertussis
ccuggcgguaugcggcgcccag

SEQ ID NO: 348067 - RNA, 16 nt, Bordetella pertussis
ccuggcggugcgccgc

SEQ ID NO: 348068 - RNA, 12 nt, Bordetella pertussis
ccuggcguggcc

SEQ ID NO: 348069 - RNA, 16 nt, Bordetella pertussis
ccuggcguucgcgcgc

SEQ ID NO: 348070 - RNA, 21 nt, Bordetella pertussis
ccuggcucagucggccuggcg

SEQ ID NO: 348071 - RNA, 18 nt, Bordetella pertussis
ccuggcucugaucgcgcu

SEQ ID NO: 348072 - RNA, 16 nt, Bordetella pertussis
ccuggcuggccagccg

SEQ ID NO: 348073 - RNA, 18 nt, Bordetella pertussis
ccuggcuggccagccggc

SEQ ID NO: 348074 - RNA, 16 nt, Bordetella pertussis
ccuggcuucccggucc

SEQ ID NO: 348075 - RNA, 18 nt, Bordetella pertussis
ccuggcuuggcggccagg

SEQ ID NO: 348076 - RNA, 17 nt, Bordetella pertussis
ccugggaggcgcugaug

SEQ ID NO: 348077 - RNA, 23 nt, Bordetella pertussis
ccugggaggcgcugaugccguac

SEQ ID NO: 348078 - RNA, 16 nt, Bordetella pertussis
ccuggcuuucgccgcg

SEQ ID NO: 348079 - RNA, 20 nt, Bordetella pertussis
ccugggcaucaacacgcugg

SEQ ID NO: 348080 - RNA, 13 nt, Bordetella pertussis
ccugggccagcag

SEQ ID NO: 348081 - RNA, 20 nt, Bordetella pertussis
ccugggccagccagcgccgc

SEQ ID NO: 348082 - RNA, 12 nt, Bordetella pertussis
ccugggccgccu

SEQ ID NO: 348083 - RNA, 14 nt, Bordetella pertussis
ccugggccgccugc

SEQ ID NO: 348084 - RNA, 14 nt, Bordetella pertussis
ccugggccgagcgc

SEQ ID NO: 348085 - RNA, 21 nt, Bordetella pertussis
ccugggcgaauccaccggcgc

SEQ ID NO: 348086 - RNA, 23 nt, Bordetella pertussis
ccugggcgcgaugggccugccca

SEQ ID NO: 348087 - RNA, 12 nt, Bordetella pertussis
ccugggcgcgcg

SEQ ID NO: 348088 - RNA, 14 nt, Bordetella pertussis
ccugggcgcgcgcc

SEQ ID NO: 348089 - RNA, 13 nt, Bordetella pertussis
ccugggcggccac

SEQ ID NO: 348090 - RNA, 12 nt, Bordetella pertussis
ccugggcgcggu

SEQ ID NO: 348091 - RNA, 15 nt, Bordetella pertussis
ccugggcggcgcgcu

SEQ ID NO: 348092 - RNA, 15 nt, Bordetella pertussis
ccugggcggcggcga

SEQ ID NO: 348093 - RNA, 22 nt, Bordetella pertussis
ccugggcgggccguugcgccug

SEQ ID NO: 348094 - RNA, 22 nt, Bordetella pertussis
ccuggggcgggcgcugcgcgaa

SEQ ID NO: 348095 - RNA, 14 nt, Bordetella pertussis
ccuggggcgugccc

SEQ ID NO: 348096 - RNA, 15 nt, Bordetella pertussis
ccuggggcgugcccu

SEQ ID NO: 348097 - RNA, 23 nt, Bordetella pertussis
ccuggggggucaaccagguaccc

SEQ ID NO: 348098 - RNA, 17 nt, Bordetella pertussis
ccugggguaggcgcggu

SEQ ID NO: 348099 - RNA, 14 nt, Bordetella pertussis
ccugggugcugccg

SEQ ID NO: 348100 - RNA, 13 nt, Bordetella pertussis
ccugguacgacag

SEQ ID NO: 348101 - RNA, 14 nt, Bordetella pertussis
ccugguacggcauc

SEQ ID NO: 348102 - RNA, 15 nt, Bordetella pertussis
ccugguacggcaucc

SEQ ID NO: 348103 - RNA, 22 nt, Bordetella pertussis
ccugguacggcaucccgacaug

SEQ ID NO: 348104 - RNA, 20 nt, Bordetella pertussis
ccugguaucccucgcccagc

SEQ ID NO: 348105 - RNA, 15 nt, Bordetella pertussis
ccugguauccggcgc

SEQ ID NO: 348106 - RNA, 16 nt, Bordetella pertussis
ccugguauccggcgca

SEQ ID NO: 348107 - RNA, 14 nt, Bordetella pertussis
ccuggucaagggcg

SEQ ID NO: 348108 - RNA, 20 nt, Bordetella pertussis
ccuggucaagggcggccaug

SEQ ID NO: 348109 - RNA, 13 nt, Bordetella pertussis
ccuggucagcgcc

SEQ ID NO: 348110 - RNA, 15 nt, Bordetella pertussis
ccuggucagcgccga

SEQ ID NO: 348111 - RNA, 18 nt, Bordetella pertussis
ccuggucagguugcgccg

SEQ ID NO: 348112 - RNA, 20 nt, Bordetella pertussis
ccuggucagguugcgccggc

SEQ ID NO: 348113 - RNA, 22 nt, Bordetella pertussis
ccuggucagguugcgccggcuc

SEQ ID NO: 348114 - RNA, 21 nt, Bordetella pertussis
ccugguaguaaucgcgcgcca

SEQ ID NO: 348115 - RNA, 19 nt, Bordetella pertussis
ccuggucaucgccaugcug

SEQ ID NO: 348116 - RNA, 23 nt, Bordetella pertussis
ccuggucaugacgggcggcggcg

SEQ ID NO: 348117 - RNA, 13 nt, Bordetella pertussis
ccugguccagcag

SEQ ID NO: 348118 - RNA, 17 nt, Bordetella pertussis
ccuggucgaccaggccg

SEQ ID NO: 348119 - RNA, 21 nt, Bordetella pertussis
ccuggucgaccaggccggugc

SEQ ID NO: 348120 - RNA, 14 nt, Bordetella pertussis
ccuggucgacgcga

SEQ ID NO: 348121 - RNA, 17 nt, Bordetella pertussis
ccuggucgagcgggcgc

SEQ ID NO: 348122 - RNA, 19 nt, Bordetella pertussis
ccuggucgagcgggcgcca

SEQ ID NO: 348123 - RNA, 15 nt, Bordetella pertussis
ccuggucgaucagcc

SEQ ID NO: 348124 - RNA, 14 nt, Bordetella pertussis
ccuggucgcgcgcc

SEQ ID NO: 348125 - RNA, 18 nt, Bordetella pertussis
ccuggucgcuggcgccgg

SEQ ID NO: 348126 - RNA, 14 nt, Bordetella pertussis
ccuggucggccuuc

SEQ ID NO: 348127 - RNA, 21 nt, Bordetella pertussis
ccuggucggggucggccacca

SEQ ID NO: 348128 - RNA, 24 nt, Bordetella pertussis
ccuggucgucgcggcccugggcca

SEQ ID NO: 348129 - RNA, 16 nt, Bordetella pertussis
ccuggucgucggccac

SEQ ID NO: 348130 - RNA, 14 nt, Bordetella pertussis
ccuggugcacgccg

SEQ ID NO: 348131 - RNA, 15 nt, Bordetella pertussis
ccuggugcacgccga

SEQ ID NO: 348132 - RNA, 20 nt, Bordetella pertussis
ccugguugaccgagcccggc

SEQ ID NO: 348133 - RNA, 22 nt, Bordetella pertussis
ccugguugaccgagcccggcac

SEQ ID NO: 348134 - RNA, 23 nt, Bordetella pertussis
ccugguugaccgagcccggcacc

SEQ ID NO: 348135 - RNA, 15 nt, Bordetella pertussis
ccugguuggccgccu

SEQ ID NO: 348136 - RNA, 17 nt, Bordetella pertussis
ccuguacaagcgcacgc

SEQ ID NO: 348137 - RNA, 14 nt, Bordetella pertussis
ccuguaugccguag

SEQ ID NO: 348138 - RNA, 20 nt, Bordetella pertussis
ccuguaugccguaggcgccg

SEQ ID NO: 348139 - RNA, 18 nt, Bordetella pertussis
cgaacgugcgcgccagcu

SEQ ID NO: 348140 - RNA, 15 nt, Bordetella pertussis
cgaacguggcggcga

SEQ ID NO: 348141 - RNA, 16 nt, Bordetella pertussis
cgaacugccggcgcgg

SEQ ID NO: 348142 - RNA, 15 nt, Bordetella pertussis
cgaacugggacaggc

SEQ ID NO: 348143 - RNA, 18 nt, Bordetella pertussis
cgaacugggacaggccca

SEQ ID NO: 348144 - RNA, 20 nt, Bordetella pertussis
cgaacugggacaggcccagc

SEQ ID NO: 348145 - RNA, 17 nt, Bordetella pertussis
cgaacugggcgucgucc

SEQ ID NO: 348146 - RNA, 21 nt, Bordetella pertussis
cgaacugggucugccccaugg

SEQ ID NO: 348147 - RNA, 23 nt, Bordetella pertussis
cgaacugucgcgccacggcuucg

SEQ ID NO: 348148 - RNA, 18 nt, Bordetella pertussis
cgaacuucagcccgggca

SEQ ID NO: 348149 - RNA, 20 nt, Bordetella pertussis
cgaacuuggcgcgguccacg

SEQ ID NO: 348150 - RNA, 21 nt, Bordetella pertussis
cgaagaaauagcccgcggcca

SEQ ID NO: 348151 - RNA, 23 nt, Bordetella pertussis
cgaagaaauagcccgcggccacc

SEQ ID NO: 348152 - RNA, 15 nt, Bordetella pertussis
cgaacuuuucgucgu

SEQ ID NO: 348153 - RNA, 17 nt, Bordetella pertussis
cgaagaccgugaucggc

SEQ ID NO: 348154 - RNA, 22 nt, Bordetella pertussis
cgaagaggguuauuuccggccg

SEQ ID NO: 348155 - RNA, 16 nt, Bordetella pertussis
cgaagaucccgccgga

SEQ ID NO: 348156 - RNA, 20 nt, Bordetella pertussis
cgaagauuuccucgcgcacc

SEQ ID NO: 348157 - RNA, 16 nt, Bordetella pertussis
cgaagcacugcaggcc

SEQ ID NO: 348158 - RNA, 20 nt, Bordetella pertussis
cgaagcacugcaggccaucg

SEQ ID NO: 348159 - RNA, 14 nt, Bordetella pertussis
cgaagaucuucggc

SEQ ID NO: 348160 - RNA, 15 nt, Bordetella pertussis
cgaagcagccggcca

SEQ ID NO: 348161 - RNA, 23 nt, Bordetella pertussis
cgaagcaggugaugcgcgcggcc

SEQ ID NO: 348162 - RNA, 23 nt, Bordetella pertussis
cgaagccaccgucucgcccauga

SEQ ID NO: 348163 - RNA, 16 nt, Bordetella pertussis
cgaagcgcagcaccgc

SEQ ID NO: 348164 - RNA, 17 nt, Bordetella pertussis
cgaagcgcaggccuucg

SEQ ID NO: 348165 - RNA, 21 nt, Bordetella pertussis
cgaagcgcccuggcguggcgc

SEQ ID NO: 348166 - RNA, 15 nt, Bordetella pertussis
cgaagcgcgccagca

SEQ ID NO: 348167 - RNA, 22 nt, Bordetella pertussis
cgaagcgcucguccuccgagac

SEQ ID NO: 348168 - RNA, 23 nt, Bordetella pertussis
cgaagcggaaacgcgcgcgcccu

SEQ ID NO: 348169 - RNA, 18 nt, Bordetella pertussis
cgaagcggaugcgccgcc

SEQ ID NO: 348170 - RNA, 15 nt, Bordetella pertussis
cgaagcgcgcgugca

SEQ ID NO: 348171 - RNA, 23 nt, Bordetella pertussis
cgaagcggcccgggugggcggca

SEQ ID NO: 348172 - RNA, 17 nt, Bordetella pertussis
cgaagcggcucaggcgc

SEQ ID NO: 348173 - RNA, 18 nt, Bordetella pertussis
cgaagcggcucaggcgcg

SEQ ID NO: 348174 - RNA, 19 nt, Bordetella pertussis
cgaagcggcucaggcgcgg

SEQ ID NO: 348175 - RNA, 15 nt, Bordetella pertussis
cgaaggaccaagucg

SEQ ID NO: 348176 - RNA, 16 nt, Bordetella pertussis
cgaaggcagcgcggcc

SEQ ID NO: 348177 - RNA, 17 nt, Bordetella pertussis
cgaaggcagcgcggccg

SEQ ID NO: 348178 - RNA, 18 nt, Bordetella pertussis
cgaaggcagcgcggccgg

SEQ ID NO: 348179 - RNA, 20 nt, Bordetella pertussis
cgaaggccgccgcgcccagc

SEQ ID NO: 348180 - RNA, 12 nt, Bordetella pertussis
cgaaggccgcgc

SEQ ID NO: 348181 - RNA, 18 nt, Bordetella pertussis
cgaaggcgaccggcaccu

SEQ ID NO: 348182 - RNA, 18 nt, Bordetella pertussis
cgaaggcgccgacggcgc

SEQ ID NO: 348183 - RNA, 13 nt, Bordetella pertussis
cgaaggcgccggc

SEQ ID NO: 348184 - RNA, 15 nt, Bordetella pertussis
cgaaggcgccggcca

SEQ ID NO: 348185 - RNA, 17 nt, Bordetella pertussis
cgaaggcgccggccagg

SEQ ID NO: 348186 - RNA, 21 nt, Bordetella pertussis
cgaaggcgccggccaggcccu

SEQ ID NO: 348187 - RNA, 13 nt, Bordetella pertussis
cgaaggcgcggcu

SEQ ID NO: 348188 - RNA, 17 nt, Bordetella pertussis
cgaaggcggccggcagg

SEQ ID NO: 348189 - RNA, 18 nt, Bordetella pertussis
cgaaggcggccggcaggc

SEQ ID NO: 348190 - RNA, 21 nt, Bordetella pertussis
cgaaggcggccggcaggccgg

SEQ ID NO: 348191 - RNA, 17 nt, Bordetella pertussis
cgaagggauagcgccgu

SEQ ID NO: 348192 - RNA, 23 nt, Bordetella pertussis
cgaagggcaccgugaugucgccg

SEQ ID NO: 348193 - RNA, 17 nt, Bordetella pertussis
cgaagggcaggucgucg

SEQ ID NO: 348194 - RNA, 23 nt, Bordetella pertussis
cgaagggcaggucgucgagccgg

SEQ ID NO: 348195 - RNA, 23 nt, Bordetella pertussis
cgaagggcugcgugcgggacagg

SEQ ID NO: 348196 - RNA, 21 nt, Bordetella pertussis
cgaaguaguuggucgagcgcu

SEQ ID NO: 348197 - RNA, 17 nt, Bordetella pertussis
cgaagucauaaaacagc

SEQ ID NO: 348198 - RNA, 22 nt, Bordetella pertussis
cgaaguauuucaggaugccgcc

SEQ ID NO: 348199 - RNA, 20 nt, Bordetella pertussis
cgaauccaccggcgcgcgca

SEQ ID NO: 348200 - RNA, 24 nt, Bordetella pertussis
cgaauccgcaacccagcagcggca

SEQ ID NO: 348201 - RNA, 14 nt, Bordetella pertussis
cgaauccggccagc

SEQ ID NO: 348202 - RNA, 22 nt, Bordetella pertussis
cgaaugcguguuccagcgccug

SEQ ID NO: 348203 - RNA, 20 nt, Bordetella pertussis
cgaauggucggccucggcga

SEQ ID NO: 348204 - RNA, 23 nt, Bordetella pertussis
cgaauugccgccgcugccggccg

SEQ ID NO: 348205 - RNA, 17 nt, Bordetella pertussis
cgacaccaaccugcugg

SEQ ID NO: 348206 - RNA, 22 nt, Bordetella pertussis
cgacacccccagggcgcgccgg

SEQ ID NO: 348207 - RNA, 17 nt, Bordetella pertussis
cgacacccggucggccc

SEQ ID NO: 348208 - RNA, 18 nt, Bordetella pertussis
cgacacccggucggccca

SEQ ID NO: 348209 - RNA, 20 nt, Bordetella pertussis
cgacacccggucggcccagg

SEQ ID NO: 348210 - RNA, 12 nt, Bordetella pertussis
cgacaccgugcg

SEQ ID NO: 348211 - RNA, 13 nt, Bordetella pertussis
cgacacggcggug

SEQ ID NO: 348212 - RNA, 22 nt, Bordetella pertussis
cgacacggcggugccgcgcacc

SEQ ID NO: 348213 - RNA, 14 nt, Bordetella pertussis
cgacacgcccagca

SEQ ID NO: 348214 - RNA, 12 nt, Bordetella pertussis
cgacacgcuggc

SEQ ID NO: 348215 - RNA, 14 nt, Bordetella pertussis
cgacacgucaucgu

SEQ ID NO: 348216 - RNA, 19 nt, Bordetella pertussis
cgacacgucaucguggccg

SEQ ID NO: 348217 - RNA, 16 nt, Bordetella pertussis
cgacagaccguagcgc

SEQ ID NO: 348218 - RNA, 22 nt, Bordetella pertussis
cgacagcaaugacgacgccggc

SEQ ID NO: 348219 - RNA, 19 nt, Bordetella pertussis
cgacagcacauggcgcgcc

SEQ ID NO: 348220 - RNA, 17 nt, Bordetella pertussis
cgacagcacgcccgcca

SEQ ID NO: 348221 - RNA, 17 nt, Bordetella pertussis
cgacagcagcaugcggc

SEQ ID NO: 348222 - RNA, 14 nt, Bordetella pertussis
cgacagcagcccgc

SEQ ID NO: 348223 - RNA, 16 nt, Bordetella pertussis
cgacagcagcccgcug

SEQ ID NO: 348224 - RNA, 20 nt, Bordetella pertussis
cgacagcagcccgcuggccg

SEQ ID NO: 348225 - RNA, 13 nt, Bordetella pertussis
cgacagcaggccg

SEQ ID NO: 348226 - RNA, 19 nt, Bordetella pertussis
cgacagcaggccggucagg

SEQ ID NO: 348227 - RNA, 14 nt, Bordetella pertussis
cgacagcagggcca

SEQ ID NO: 348228 - RNA, 17 nt, Bordetella pertussis
cgacagcagggccaggc

SEQ ID NO: 348229 - RNA, 20 nt, Bordetella pertussis
cgacagcagggccaggccca

SEQ ID NO: 348230 - RNA, 14 nt, Bordetella pertussis
cgacagcagggucg

SEQ ID NO: 348231 - RNA, 20 nt, Bordetella pertussis
cgacagcaugaacggcagcg

SEQ ID NO: 348232 - RNA, 15 nt, Bordetella pertussis
cgacagccgcgccag

SEQ ID NO: 348233 - RNA, 23 nt, Bordetella pertussis
cgacagccgcgccagcgccucca

SEQ ID NO: 348234 - RNA, 20 nt, Bordetella pertussis
cgacagcgacaacagcuugc

SEQ ID NO: 348235 - RNA, 22 nt, Bordetella pertussis
cgacagcgacaacagcuugccc

SEQ ID NO: 348236 - RNA, 17 nt, Bordetella pertussis
cgacagcgacagccagg

SEQ ID NO: 348237 - RNA, 22 nt, Bordetella pertussis
cgacagccaggccagcgccaga

SEQ ID NO: 348238 - RNA, 14 nt, Bordetella pertussis
cgacagcgccagcg

SEQ ID NO: 348239 - RNA, 15 nt, Bordetella pertussis
cgacagcgcgcagga

SEQ ID NO: 348240 - RNA, 15 nt, Bordetella pertussis
cgacagcgcgcccgc

SEQ ID NO: 348241 - RNA, 19 nt, Bordetella pertussis
cgacagcggcgagcgcggc

SEQ ID NO: 348242 - RNA, 21 nt, Bordetella pertussis
cgacaggaaggcgagcgcggc

SEQ ID NO: 348243 - RNA, 16 nt, Bordetella pertussis
cgacagcuugaugggc

SEQ ID NO: 348244 - RNA, 23 nt, Bordetella pertussis
cgacaggaacauguucacgccca

SEQ ID NO: 348245 - RNA, 16 nt, Bordetella pertussis
cgacaggaucgaaggc

SEQ ID NO: 348246 - RNA, 12 nt, Bordetella pertussis
cgacaggccgau

SEQ ID NO: 348247 - RNA, 14 nt, Bordetella pertussis
cgacaggccgaugc

SEQ ID NO: 348248 - RNA, 15 nt, Bordetella pertussis
cgacaggccgaugcu

SEQ ID NO: 348249 - RNA, 12 nt, Bordetella pertussis
cgacaggcgccg

SEQ ID NO: 348250 - RNA, 13 nt, Bordetella pertussis
cgacaggcgcgca

SEQ ID NO: 348251 - RNA, 15 nt, Bordetella pertussis
cgacaggcgcgcagg

SEQ ID NO: 348252 - RNA, 20 nt, Bordetella pertussis
cgacaggcgcgcaggcgggc

SEQ ID NO: 348253 - RNA, 13 nt, Bordetella pertussis
cgacaggcgcgcc

SEQ ID NO: 348254 - RNA, 16 nt, Bordetella pertussis
cgacaggcgcgcccgc

SEQ ID NO: 348255 - RNA, 21 nt, Bordetella pertussis
cgacaggccuggcuuggcggc

SEQ ID NO: 348256 - RNA, 14 nt, Bordetella pertussis
cgacaggcggcugu

SEQ ID NO: 348257 - RNA, 16 nt, Bordetella pertussis
cgacagggcgucgucg

SEQ ID NO: 348258 - RNA, 15 nt, Bordetella pertussis
cgacaggguccaggu

SEQ ID NO: 348259 - RNA, 23 nt, Bordetella pertussis
cgacagguagcggucgccgcggu

SEQ ID NO: 348260 - RNA, 19 nt, Bordetella pertussis
cgaccagcacgauccagcc

SEQ ID NO: 348261 - RNA, 15 nt, Bordetella pertussis
cgaccagcaggccca

SEQ ID NO: 348262 - RNA, 13 nt, Bordetella pertussis
cgaccagcccggc

SEQ ID NO: 348263 - RNA, 14 nt, Bordetella pertussis
cgaccagcccggcc

SEQ ID NO: 348264 - RNA, 18 nt, Bordetella pertussis
cgaccagcccggccgcca

SEQ ID NO: 348265 - RNA, 21 nt, Bordetella pertussis
cgaccagcccggccgccagca

SEQ ID NO: 348266 - RNA, 14 nt, Bordetella pertussis
cgaccagcgcacgg

SEQ ID NO: 348267 - RNA, 13 nt, Bordetella pertussis
cgaccaggccggc

SEQ ID NO: 348268 - RNA, 14 nt, Bordetella pertussis
cgaccaggccggcg

SEQ ID NO: 348269 - RNA, 17 nt, Bordetella pertussis
cgaccaggccggcggcg

SEQ ID NO: 348270 - RNA, 13 nt, Bordetella pertussis
cgaccaggccggu

SEQ ID NO: 348271 - RNA, 20 nt, Bordetella pertussis
cgaccaggccggugcgcaca

SEQ ID NO: 348272 - RNA, 21 nt, Bordetella pertussis
cgaccaggccggugcgcacau

SEQ ID NO: 348273 - RNA, 16 nt, Bordetella pertussis
cgaccaggcccacgac

SEQ ID NO: 348274 - RNA, 15 nt, Bordetella pertussis
cgaccaggcccgcca

SEQ ID NO: 348275 - RNA, 21 nt, Bordetella pertussis
cgaccaggcccgccacggcgc

SEQ ID NO: 348276 - RNA, 16 nt, Bordetella pertussis
cgaccaggccguggcc

SEQ ID NO: 348277 - RNA, 20 nt, Bordetella pertussis
cgaccaggccguggcccagc

SEQ ID NO: 348278 - RNA, 20 nt, Bordetella pertussis
cgaccaggcgggcaucgccc

SEQ ID NO: 348279 - RNA, 22 nt, Bordetella pertussis
cgaccaggcgggcaucgcccac

SEQ ID NO: 348280 - RNA, 18 nt, Bordetella pertussis
cgaccaggcugcgcgccg

SEQ ID NO: 348281 - RNA, 23 nt, Bordetella pertussis
cgaccaggcugcgcgccggcgcc

SEQ ID NO: 348282 - RNA, 21 nt, Bordetella pertussis
cgaccagguaucgacccaggc

SEQ ID NO: 348283 - RNA, 23 nt, Bordetella pertussis
cgaccagguaucgacccaggccg

SEQ ID NO: 348284 - RNA, 22 nt, Bordetella pertussis
cgaccaggucgaagcacugcag

SEQ ID NO: 348285 - RNA, 14 nt, Bordetella pertussis
cgaccaggucgggc

SEQ ID NO: 348286 - RNA, 15 nt, Bordetella pertussis
cgaccaggucgggca

SEQ ID NO: 348287 - RNA, 17 nt, Bordetella pertussis
cgaccaggugcgggccg

SEQ ID NO: 348288 - RNA, 21 nt, Bordetella pertussis
cgaccaggugcgggccgcuca

SEQ ID NO: 348289 - RNA, 15 nt, Bordetella pertussis
cgaccaguucggcca

SEQ ID NO: 348290 - RNA, 18 nt, Bordetella pertussis
cgaccaguucggccagca

SEQ ID NO: 348291 - RNA, 17 nt, Bordetella pertussis
cgaccaucauggccagg

SEQ ID NO: 348292 - RNA, 18 nt, Bordetella pertussis
cgacccaggccggcgcca

SEQ ID NO: 348293 - RNA, 20 nt, Bordetella pertussis
cgaccccgccgugccgggcc

SEQ ID NO: 348294 - RNA, 21 nt, Bordetella pertussis
cgaccccgccgugccgggccu

SEQ ID NO: 348295 - RNA, 21 nt, Bordetella pertussis
cgacccgcugaaggaccucgc

SEQ ID NO: 348296 - RNA, 20 nt, Bordetella pertussis
cgacccgcucggccacgcgc

SEQ ID NO: 348297 - RNA, 14 nt, Bordetella pertussis
cgacccugcccggc

SEQ ID NO: 348298 - RNA, 20 nt, Bordetella pertussis
cgacccuuucauuucggcgc

SEQ ID NO: 348299 - RNA, 22 nt, Bordetella pertussis
cgacccuuucauuucggcgccg

SEQ ID NO: 348300 - RNA, 16 nt, Bordetella pertussis
cgaccgaaaagcccac

SEQ ID NO: 348301 - RNA, 18 nt, Bordetella pertussis
cgacccuguacaagcgca

SEQ ID NO: 348302 - RNA, 21 nt, Bordetella pertussis
cgaccgaaccgauccagcccg

SEQ ID NO: 348303 - RNA, 22 nt, Bordetella pertussis
cgaccgacagcacauggcgcgc

SEQ ID NO: 348304 - RNA, 15 nt, Bordetella pertussis
cgaccgagccggcca

SEQ ID NO: 348305 - RNA, 22 nt, Bordetella pertussis
cgaccgagccggccagcgccug

SEQ ID NO: 348306 - RNA, 19 nt, Bordetella pertussis
cgaccgauucgcgcaccga

SEQ ID NO: 348307 - RNA, 13 nt, Bordetella pertussis
cgaccgcacgaug

SEQ ID NO: 348308 - RNA, 20 nt, Bordetella pertussis
cgaccgcacgauggcgcgcg

SEQ ID NO: 348309 - RNA, 16 nt, Bordetella pertussis
cgaccgcauagcgcau

SEQ ID NO: 348310 - RNA, 14 nt, Bordetella pertussis
cgaccgcaugcggc

SEQ ID NO: 348311 - RNA, 15 nt, Bordetella pertussis
cgaccgcaugggcgc

SEQ ID NO: 348312 - RNA, 14 nt, Bordetella pertussis
cgaccgccagcagg

SEQ ID NO: 348313 - RNA, 16 nt, Bordetella pertussis
cgaccgccagcaggcc

SEQ ID NO: 348314 - RNA, 17 nt, Bordetella pertussis
cgaccgccagcaggccc

SEQ ID NO: 348315 - RNA, 12 nt, Bordetella pertussis
cgaccgccacga

SEQ ID NO: 348316 - RNA, 14 nt, Bordetella pertussis
cgaccgccgccacg

SEQ ID NO: 348317 - RNA, 15 nt, Bordetella pertussis
cgaccgccgccacgc

SEQ ID NO: 348318 - RNA, 18 nt, Bordetella pertussis
cgaccgccgccuuggacg

SEQ ID NO: 348319 - RNA, 22 nt, Bordetella pertussis
cgaccgcgcggcgcugcacgcg

SEQ ID NO: 348320 - RNA, 22 nt, Bordetella pertussis
cgaccgcguaguugucggcgca

SEQ ID NO: 348321 - RNA, 17 nt, Bordetella pertussis
cgaccgcgggcgcgcgc

SEQ ID NO: 348322 - RNA, 22 nt, Bordetella pertussis
cgaccgcgggcgcgcgccccgc

SEQ ID NO: 348323 - RNA, 13 nt, Bordetella pertussis
cgaccggcgccgg

SEQ ID NO: 348324 - RNA, 14 nt, Bordetella pertussis
cgaccggcgccggc

SEQ ID NO: 348325 - RNA, 12 nt, Bordetella pertussis
cgaccggcgcga

SEQ ID NO: 348326 - RNA, 15 nt, Bordetella pertussis
cgaccggcgcgcgcg

SEQ ID NO: 348327 - RNA, 19 nt, Bordetella pertussis
cgaccggcucgaucgccgc

SEQ ID NO: 348328 - RNA, 15 nt, Bordetella pertussis
cgaccgggccgacca

SEQ ID NO: 348329 - RNA, 18 nt, Bordetella pertussis
cgaccgggccgaccaggc

SEQ ID NO: 348330 - RNA, 13 nt, Bordetella pertussis
cgaccuccaggcc

SEQ ID NO: 348331 - RNA, 15 nt, Bordetella pertussis
cgaccuccaggccca

SEQ ID NO: 348332 - RNA, 18 nt, Bordetella pertussis
cgaccuccaggcccaggc

SEQ ID NO: 348333 - RNA, 20 nt, Bordetella pertussis
cgaccugaucgcgcagcgcc

SEQ ID NO: 348334 - RNA, 21 nt, Bordetella pertussis
cgaccucuucguugucgcgcg

SEQ ID NO: 348335 - RNA, 22 nt, Bordetella pertussis
cgaccucuucguugucgcgcgc

SEQ ID NO: 348336 - RNA, 15 nt, Bordetella pertussis
cgacgaacacgcgcg

SEQ ID NO: 348337 - RNA, 19 nt, Bordetella pertussis
cgacgaacacgcgcgccgc

SEQ ID NO: 348338 - RNA, 17 nt, Bordetella pertussis
cgacgaacccgggcgug

SEQ ID NO: 348339 - RNA, 20 nt, Bordetella pertussis
cgacgaacugaucggcaagg

SEQ ID NO: 348340 - RNA, 18 nt, Bordetella pertussis
cgacgaccccgccgugcc

SEQ ID NO: 348341 - RNA, 19 nt, Bordetella pertussis
cgacgaccccgccgugccg

SEQ ID NO: 348342 - RNA, 19 nt, Bordetella pertussis
cgacgaagcccgugucggc

SEQ ID NO: 348343 - RNA, 17 nt, Bordetella pertussis
cgacgaccgaaccgauc

SEQ ID NO: 348344 - RNA, 12 nt, Bordetella pertussis
cgacgacggcaa

SEQ ID NO: 348345 - RNA, 14 nt, Bordetella pertussis
cgacgagcgcacca

SEQ ID NO: 348346 - RNA, 22 nt, Bordetella pertussis
cgacgaggagccggcgggcggc

SEQ ID NO: 348347 - RNA, 22 nt, Bordetella pertussis
cgacgaggccgaguagcggcgc

SEQ ID NO: 348348 - RNA, 14 nt, Bordetella pertussis
cgacgagggcgcca

SEQ ID NO: 348349 - RNA, 19 nt, Bordetella pertussis
cgacgaggggguguucucc

SEQ ID NO: 348350 - RNA, 13 nt, Bordetella pertussis
cgacgauccggcg

SEQ ID NO: 348351 - RNA, 15 nt, Bordetella pertussis
cgacgauccggcgac

SEQ ID NO: 348352 - RNA, 19 nt, Bordetella pertussis
cgacgauccggcgaccgac

SEQ ID NO: 348353 - RNA, 14 nt, Bordetella pertussis
cgacgaucuggucc

SEQ ID NO: 348354 - RNA, 15 nt, Bordetella pertussis
cgacgaucugguccu

SEQ ID NO: 348355 - RNA, 17 nt, Bordetella pertussis
cgacgaucugguccugg

SEQ ID NO: 348356 - RNA, 18 nt, Bordetella pertussis
cgacgaucuccacccccg

SEQ ID NO: 348357 - RNA, 18 nt, Bordetella pertussis
cgacgaucucgcggcugg

SEQ ID NO: 348358 - RNA, 16 nt, Bordetella pertussis
cgacgaugccgcccac

SEQ ID NO: 348359 - RNA, 19 nt, Bordetella pertussis
cgacgaugccgcccacgcc

SEQ ID NO: 348360 - RNA, 15 nt, Bordetella pertussis
cgacgaugccgccgc

SEQ ID NO: 348361 - RNA, 20 nt, Bordetella pertussis
cgacgaugcccugcgccagc

SEQ ID NO: 348362 - RNA, 21 nt, Bordetella pertussis
cgacgaugcccugcgccagcg

SEQ ID NO: 348363 - RNA, 17 nt, Bordetella pertussis
cgacgcaaucggcgaag

SEQ ID NO: 348364 - RNA, 15 nt, Bordetella pertussis
cgacgcagcagccgc

SEQ ID NO: 348365 - RNA, 19 nt, Bordetella pertussis
cgacgcagccuucguccug

SEQ ID NO: 348366 - RNA, 12 nt, Bordetella pertussis
cgacgcaggcgc

SEQ ID NO: 348367 - RNA, 15 nt, Bordetella pertussis
cgacgcaggcgccgc

SEQ ID NO: 348368 - RNA, 17 nt, Bordetella pertussis
cgacgcauauccaggcg

SEQ ID NO: 348369 - RNA, 18 nt, Bordetella pertussis
cgacgcauauccaggcgg

SEQ ID NO: 348370 - RNA, 22 nt, Bordetella pertussis
cgacgcauauccaggcggcgcu

SEQ ID NO: 348371 - RNA, 19 nt, Bordetella pertussis
cgacgcccagccugccggc

SEQ ID NO: 348372 - RNA, 22 nt, Bordetella pertussis
cgacgcccagccugccggcggc

SEQ ID NO: 348373 - RNA, 16 nt, Bordetella pertussis
cgacgcccgcgcccag

SEQ ID NO: 348374 - RNA, 15 nt, Bordetella pertussis
cgacgcccuggccuu

SEQ ID NO: 348375 - RNA, 13 nt, Bordetella pertussis
cgacgccgccacg

SEQ ID NO: 348376 - RNA, 21 nt, Bordetella pertussis
cgacgccgccacgcuggccgc

SEQ ID NO: 348377 - RNA, 12 nt, Bordetella pertussis
cgacgccgcgcg

SEQ ID NO: 348378 - RNA, 21 nt, Bordetella pertussis
cgacgccggcuuucagcgccg

SEQ ID NO: 348379 - RNA, 22 nt, Bordetella pertussis
cgacgccggcuuucagcgccga

SEQ ID NO: 348380 - RNA, 14 nt, Bordetella pertussis
cgacgccggcagcg

SEQ ID NO: 348381 - RNA, 14 nt, Bordetella pertussis
cgacgccggcgacg

SEQ ID NO: 348382 - RNA, 22 nt, Bordetella pertussis
cgacgccugcgccauggcgcgc

SEQ ID NO: 348383 - RNA, 17 nt, Bordetella pertussis
cgacgccuggaccggcu

SEQ ID NO: 348384 - RNA, 13 nt, Bordetella pertussis
cgacgcgacgcga

SEQ ID NO: 348385 - RNA, 18 nt, Bordetella pertussis
cgacgcgacgcgggcggc

SEQ ID NO: 348386 - RNA, 15 nt, Bordetella pertussis
cgacgcgaugcccgc

SEQ ID NO: 348387 - RNA, 12 nt, Bordetella pertussis
cgacgcgcccgg

SEQ ID NO: 348388 - RNA, 22 nt, Bordetella pertussis
cgacgcgcccucaguccagcug

SEQ ID NO: 348389 - RNA, 23 nt, Bordetella pertussis
cgacgcgccgggccacgagcagu

SEQ ID NO: 348390 - RNA, 11 nt, Bordetella pertussis
cgacgcgcgcc

SEQ ID NO: 348391 - RNA, 14 nt, Bordetella pertussis
cgacgcgcgccggc

SEQ ID NO: 348392 - RNA, 16 nt, Bordetella pertussis
cgacgcgcugguccgc

SEQ ID NO: 348393 - RNA, 19 nt, Bordetella pertussis
cgacgcggacuucgcccgg

SEQ ID NO: 348394 - RNA, 13 nt, Bordetella pertussis
cgacgcggccgug

SEQ ID NO: 348395 - RNA, 14 nt, Bordetella pertussis
cgacgcggccgugg

SEQ ID NO: 348396 - RNA, 15 nt, Bordetella pertussis
cgacgcggccgugga

SEQ ID NO: 348397 - RNA, 12 nt, Bordetella pertussis
cgacgcggcggc

SEQ ID NO: 348398 - RNA, 14 nt, Bordetella pertussis
cgacgcggccagcg

SEQ ID NO: 348399 - RNA, 22 nt, Bordetella pertussis
cgacgcggcguacuggcgcggc

SEQ ID NO: 348400 - RNA, 18 nt, Bordetella pertussis
cgacgcgggcggccgacg

SEQ ID NO: 348401 - RNA, 15 nt, Bordetella pertussis
cgacgcggucgccca

SEQ ID NO: 348402 - RNA, 23 nt, Bordetella pertussis
cgacgcggucgcccaacccggcg

SEQ ID NO: 348403 - RNA, 21 nt, Bordetella pertussis
cgacgcguuguucgggccggc

SEQ ID NO: 348404 - RNA, 18 nt, Bordetella pertussis
cgacgucggugacggcgu

SEQ ID NO: 348405 - RNA, 14 nt, Bordetella pertussis
cgacgucguagugc

SEQ ID NO: 348406 - RNA, 21 nt, Bordetella pertussis
cgacgucguagugcgcgccgc

SEQ ID NO: 348407 - RNA, 22 nt, Bordetella pertussis
cgacgucuugcugccguccuug

SEQ ID NO: 348408 - RNA, 13 nt, Bordetella pertussis
cgacgugcgccgc

SEQ ID NO: 348409 - RNA, 14 nt, Bordetella pertussis
cgacgugcgccgca

SEQ ID NO: 348410 - RNA, 19 nt, Bordetella pertussis
cgacgugcugcugcacgug

SEQ ID NO: 348411 - RNA, 21 nt, Bordetella pertussis
cgacguggaccgcgcgguggc

SEQ ID NO: 348412 - RNA, 14 nt, Bordetella pertussis
cgacgugucggcca

SEQ ID NO: 348413 - RNA, 16 nt, Bordetella pertussis
cgacgugucggccacc

SEQ ID NO: 348414 - RNA, 20 nt, Bordetella pertussis
cgacgugucggccaccacga

SEQ ID NO: 348415 - RNA, 16 nt, Bordetella pertussis
cgacguuaugcucgcg

SEQ ID NO: 348416 - RNA, 13 nt, Bordetella pertussis
cgacuccggccgg

SEQ ID NO: 348417 - RNA, 20 nt, Bordetella pertussis
cgacucgaaacgggcggcgu

SEQ ID NO: 348418 - RNA, 22 nt, Bordetella pertussis
cgacucgaaacgggcggcgucg

SEQ ID NO: 348419 - RNA, 19 nt, Bordetella pertussis
cgacuuccgcuuccggccg

SEQ ID NO: 348420 - RNA, 16 nt, Bordetella pertussis
cgacuuccugggugcg

SEQ ID NO: 348421 - RNA, 16 nt, Bordetella pertussis
cgacuucggccgacau

SEQ ID NO: 348422 - RNA, 17 nt, Bordetella pertussis
cgacuucggcggccaug

SEQ ID NO: 348423 - RNA, 17 nt, Bordetella pertussis
cgacuucgucgggcucg

SEQ ID NO: 348424 - RNA, 22 nt, Bordetella pertussis
cgacuugggcaguucgcccggc

SEQ ID NO: 348425 - RNA, 16 nt, Bordetella pertussis
cgacuugucgcgcccg

SEQ ID NO: 348426 - RNA, 17 nt, Bordetella pertussis
cgacuugucgcgcccga

SEQ ID NO: 348427 - RNA, 18 nt, Bordetella pertussis
cgacuugucgcgcccgaa

SEQ ID NO: 348428 - RNA, 14 nt, Bordetella pertussis
cgagaaccaggcca

SEQ ID NO: 348429 - RNA, 19 nt, Bordetella pertussis
cgagaccgggcgguacagg

SEQ ID NO: 348430 - RNA, 22 nt, Bordetella pertussis
cgagaccgggcgguacaggucg

SEQ ID NO: 348431 - RNA, 22 nt, Bordetella pertussis
cgagaccuucggccaaucggcc

SEQ ID NO: 348432 - RNA, 18 nt, Bordetella pertussis
cgagacgaaggcgccggc

SEQ ID NO: 348433 - RNA, 22 nt, Bordetella pertussis
cgagacgaaggcgccggccagg

SEQ ID NO: 348434 - RNA, 17 nt, Bordetella pertussis
cgagacgcugucgcgcc

SEQ ID NO: 348435 - RNA, 20 nt, Bordetella pertussis
cgagacgcugucgcgcccgg

SEQ ID NO: 348436 - RNA, 21 nt, Bordetella pertussis
cgagacgcugucgcgcccggu

SEQ ID NO: 348437 - RNA, 23 nt, Bordetella pertussis
cgagacgcugucgcgcccggucu

SEQ ID NO: 348438 - RNA, 13 nt, Bordetella pertussis
cgagacggccgcc

SEQ ID NO: 348439 - RNA, 17 nt, Bordetella pertussis
cgagacgcgcucgcgcg

SEQ ID NO: 348440 - RNA, 19 nt, Bordetella pertussis
cgagagcugcgucuugagc

SEQ ID NO: 348441 - RNA, 23 nt, Bordetella pertussis
cgagagcugcgucuugagcaggu

SEQ ID NO: 348442 - RNA, 19 nt, Bordetella pertussis
cgagaguuucggcgacgac

SEQ ID NO: 348443 - RNA, 17 nt, Bordetella pertussis
cgagauaggcggccagg

SEQ ID NO: 348444 - RNA, 18 nt, Bordetella pertussis
cgagauaggcggccaggc

SEQ ID NO: 348445 - RNA, 14 nt, Bordetella pertussis
cgagaugccgauga

SEQ ID NO: 348446 - RNA, 19 nt, Bordetella pertussis
cgagaugccgaugauggcc

SEQ ID NO: 348447 - RNA, 22 nt, Bordetella pertussis
cgagaugccguucuugcccgag

SEQ ID NO: 348448 - RNA, 24 nt, Bordetella pertussis
cgagauggccuuuuccaggcgugc

SEQ ID NO: 348449 - RNA, 21 nt, Bordetella pertussis
cgagcaaaggacacgcgcgag

SEQ ID NO: 348450 - RNA, 16 nt, Bordetella pertussis
cgagcacgcggcgcgg

SEQ ID NO: 348451 - RNA, 19 nt, Bordetella pertussis
cgagcacuucgagcgacgg

SEQ ID NO: 348452 - RNA, 21 nt, Bordetella pertussis
cgagcacuucgagcgacggca

SEQ ID NO: 348453 - RNA, 20 nt, Bordetella pertussis
aacaccaggguggcgccggc

SEQ ID NO: 348454 - RNA, 15 nt, Bordetella pertussis
cgagcagcgcaucga

SEQ ID NO: 348455 - RNA, 12 nt, Bordetella pertussis
cgagcaggcccg

SEQ ID NO: 348456 - RNA, 12 nt, Bordetella pertussis
cgagcaggccgc

SEQ ID NO: 348457 - RNA, 14 nt, Bordetella pertussis
cgagcaggccgccg

SEQ ID NO: 348458 - RNA, 17 nt, Bordetella pertussis
cgagcaggccgccgccg

SEQ ID NO: 348459 - RNA, 21 nt, Bordetella pertussis
cgagcaggccgccggggaggc

SEQ ID NO: 348460 - RNA, 16 nt, Bordetella pertussis
cgagcaggcgcaggcc

SEQ ID NO: 348461 - RNA, 17 nt, Bordetella pertussis
cgagcaggcgcaggccg

SEQ ID NO: 348462 - RNA, 23 nt, Bordetella pertussis
cgagcaggcgcaggccgcgcgca

SEQ ID NO: 348463 - RNA, 14 nt, Bordetella pertussis
cgagcaggcgcgcg

SEQ ID NO: 348464 - RNA, 23 nt, Bordetella pertussis
cgagcagggcaucaccaucgaug

SEQ ID NO: 348465 - RNA, 18 nt, Bordetella pertussis
cgagcaucauggcgcgcg

SEQ ID NO: 348466 - RNA, 15 nt, Bordetella pertussis
cgagcaucccggcgc

SEQ ID NO: 348467 - RNA, 16 nt, Bordetella pertussis
cgagcaucccggcgcu

SEQ ID NO: 348468 - RNA, 20 nt, Bordetella pertussis
cgagcaucuggcgcauggcc

SEQ ID NO: 348469 - RNA, 13 nt, Bordetella pertussis
cgagcaugcgcag

SEQ ID NO: 348470 - RNA, 14 nt, Bordetella pertussis
cgagcaugcgcagc

SEQ ID NO: 348471 - RNA, 15 nt, Bordetella pertussis
cgagcaugcgggcca

SEQ ID NO: 348472 - RNA, 18 nt, Bordetella pertussis
cgagcaugcgggccaugu

SEQ ID NO: 348473 - RNA, 20 nt, Bordetella pertussis
cgagcauggcgguggccagc

SEQ ID NO: 348474 - RNA, 15 nt, Bordetella pertussis
cgagcauugccgcgg

SEQ ID NO: 348475 - RNA, 17 nt, Bordetella pertussis
cgagcauugccgcggca

SEQ ID NO: 348476 - RNA, 17 nt, Bordetella pertussis
cgagcccgccaucgcca

SEQ ID NO: 348477 - RNA, 20 nt, Bordetella pertussis
cgagcccgccaucgccagga

SEQ ID NO: 348478 - RNA, 20 nt, Bordetella pertussis
cgagcccgcgucagacgcgc

SEQ ID NO: 348479 - RNA, 21 nt, Bordetella pertussis
cgagcccgcgucagacgcgcu

SEQ ID NO: 348480 - RNA, 17 nt, Bordetella pertussis
cgagcccggcaccaugc

SEQ ID NO: 348481 - RNA, 13 nt, Bordetella pertussis
cgagccgacgcuc

SEQ ID NO: 348482 - RNA, 13 nt, Bordetella pertussis
cgagccgauggca

SEQ ID NO: 348483 - RNA, 16 nt, Bordetella pertussis
cgagccgauggcaugg

SEQ ID NO: 348484 - RNA, 23 nt, Bordetella pertussis
cgagccgauggcauggggcaggc

SEQ ID NO: 348485 - RNA, 21 nt, Bordetella pertussis
cgagccgcagaacagcagcgu

SEQ ID NO: 348486 - RNA, 23 nt, Bordetella pertussis
cgagccgcagaacagcagcguga

SEQ ID NO: 348487 - RNA, 20 nt, Bordetella pertussis
cgagccgcagguccaggccu

SEQ ID NO: 348488 - RNA, 12 nt, Bordetella pertussis
cgagccgcccac

SEQ ID NO: 348489 - RNA, 16 nt, Bordetella pertussis
cgagccgcccacgggc

SEQ ID NO: 348490 - RNA, 19 nt, Bordetella pertussis
cgagccgcccacgggcgcc

SEQ ID NO: 348491 - RNA, 20 nt, Bordetella pertussis
cgagccgccccggcgcggcg

SEQ ID NO: 348492 - RNA, 19 nt, Bordetella pertussis
cgagccgcgcgcaugcgcc

SEQ ID NO: 348493 - RNA, 18 nt, Bordetella pertussis
cgagccggacgugggcgc

SEQ ID NO: 348494 - RNA, 14 nt, Bordetella pertussis
cgagccggccagcg

SEQ ID NO: 348495 - RNA, 17 nt, Bordetella pertussis
cgagccggccagcgccu

SEQ ID NO: 348496 - RNA, 21 nt, Bordetella pertussis
cgagccggccagcgccugggc

SEQ ID NO: 348497 - RNA, 14 nt, Bordetella pertussis
cgagccggccgcgc

SEQ ID NO: 348498 - RNA, 15 nt, Bordetella pertussis
cgagccgggccacgc

SEQ ID NO: 348499 - RNA, 20 nt, Bordetella pertussis
cgagccgggccacgcgcaca

SEQ ID NO: 348500 - RNA, 15 nt, Bordetella pertussis
cgagccgggcgccga

SEQ ID NO: 348501 - RNA, 18 nt, Bordetella pertussis
cgagccgguacagccagg

SEQ ID NO: 348502 - RNA, 19 nt, Bordetella pertussis
cgagccgguacagccaggc

SEQ ID NO: 348503 - RNA, 21 nt, Bordetella pertussis
cgagccgguacagccaggcca

SEQ ID NO: 348504 - RNA, 22 nt, Bordetella pertussis
cgagccgguacagccaggccag

SEQ ID NO: 348505 - RNA, 23 nt, Bordetella pertussis
cgagccgguacagccaggccagc

SEQ ID NO: 348506 - RNA, 21 nt, Bordetella pertussis
cgagccgggcaccgagccgca

SEQ ID NO: 348507 - RNA, 15 nt, Bordetella pertussis
cgagccggugggcgc

SEQ ID NO: 348508 - RNA, 18 nt, Bordetella pertussis
cgagccuaugaagacgcg

SEQ ID NO: 348509 - RNA, 19 nt, Bordetella pertussis
cgagccuaugaagacgcgc

SEQ ID NO: 348510 - RNA, 23 nt, Bordetella pertussis
cgagccuaugaagacgcgcucgc

SEQ ID NO: 348511 - RNA, 21 nt, Bordetella pertussis
cgagccucacuccauagcgcc

SEQ ID NO: 348512 - RNA, 22 nt, Bordetella pertussis
cgagccucacuccauagcgccg

SEQ ID NO: 348513 - RNA, 16 nt, Bordetella pertussis
cgagccuucggccggc

SEQ ID NO: 348514 - RNA, 16 nt, Bordetella pertussis
cgagcgcaagcaccgc

SEQ ID NO: 348515 - RNA, 14 nt, Bordetella pertussis
cgagcgcaccaugg

SEQ ID NO: 348516 - RNA, 16 nt, Bordetella pertussis
cgagcgcaccauggcg

SEQ ID NO: 348517 - RNA, 19 nt, Bordetella pertussis
cgagcgcaccauggcgccc

SEQ ID NO: 348518 - RNA, 22 nt, Bordetella pertussis
cgagcgcaccauggcgcccacg

SEQ ID NO: 348519 - RNA, 22 nt, Bordetella pertussis
cgagcgcaccccggccgacggc

SEQ ID NO: 348520 - RNA, 23 nt, Bordetella pertussis
cgagcgcaccccggccgacggca

SEQ ID NO: 348521 - RNA, 22 nt, Bordetella pertussis
cgagcgcagccgcuccagccac

SEQ ID NO: 348522 - RNA, 17 nt, Bordetella pertussis
cgagcgcacaggcggcg

SEQ ID NO: 348523 - RNA, 15 nt, Bordetella pertussis
cgagcgccgccaggc

SEQ ID NO: 348524 - RNA, 20 nt, Bordetella pertussis
cgagcgccgcgcuccagggc

SEQ ID NO: 348525 - RNA, 16 nt, Bordetella pertussis
cgagcgccgggcgccg

SEQ ID NO: 348526 - RNA, 22 nt, Bordetella pertussis
cgagcgccgggcgccgcgcccc

SEQ ID NO: 348527 - RNA, 23 nt, Bordetella pertussis
cgagcgccucgcgcuccaugggc

SEQ ID NO: 348528 - RNA, 15 nt, Bordetella pertussis
cgagcgccugcgcca

SEQ ID NO: 348529 - RNA, 11 nt, Bordetella pertussis
cgagcgcgccc

SEQ ID NO: 348530 - RNA, 20 nt, Bordetella pertussis
cgagcgcgaaauccagcgcg

SEQ ID NO: 348531 - RNA, 14 nt, Bordetella pertussis
cgagcgcgacagca

SEQ ID NO: 348532 - RNA, 17 nt, Bordetella pertussis
cgagcgcgacagcacca

SEQ ID NO: 348533 - RNA, 14 nt, Bordetella pertussis
cgagcgcgagcagg

SEQ ID NO: 348534 - RNA, 15 nt, Bordetella pertussis
cgagcgcgagcaggg

SEQ ID NO: 348535 - RNA, 12 nt, Bordetella pertussis
cgagcgcgcgca

SEQ ID NO: 348536 - RNA, 22 nt, Bordetella pertussis
cgagcgcgcgcaugcgcacgcg

SEQ ID NO: 348537 - RNA, 15 nt, Bordetella pertussis
cgagcgcggcauagc

SEQ ID NO: 348538 - RNA, 14 nt, Bordetella pertussis
cgagcgcggcaugc

SEQ ID NO: 348539 - RNA, 16 nt, Bordetella pertussis
cgagcgcggcaugcgc

SEQ ID NO: 348540 - RNA, 22 nt, Bordetella pertussis
cgagcgcggcaugcgcaugcug

SEQ ID NO: 348541 - RNA, 12 nt, Bordetella pertussis
cgagcgcggcca

SEQ ID NO: 348542 - RNA, 17 nt, Bordetella pertussis
cgagcgcggccaggcgc

SEQ ID NO: 348543 - RNA, 17 nt, Bordetella pertussis
cgagcgcggcgcgcgcc

SEQ ID NO: 348544 - RNA, 18 nt, Bordetella pertussis
cgagcgcggcgcgcgcca

SEQ ID NO: 348545 - RNA, 20 nt, Bordetella pertussis
cgagcgcggcgcgcgccagg

SEQ ID NO: 348546 - RNA, 23 nt, Bordetella pertussis
cgagcgcggcgauacgcgccgcc

SEQ ID NO: 348547 - RNA, 20 nt, Bordetella pertussis
cgagcgcguggaaccgccgc

SEQ ID NO: 348548 - RNA, 15 nt, Bordetella pertussis
cgagcgcucccgcca

SEQ ID NO: 348549 - RNA, 16 nt, Bordetella pertussis
cgagcggcagcagcga

SEQ ID NO: 348550 - RNA, 21 nt, Bordetella pertussis
cgagcggccagccugccgcgg

SEQ ID NO: 348551 - RNA, 23 nt, Bordetella pertussis
cgagcggccagccugccgcggcc

SEQ ID NO: 348552 - RNA, 20 nt, Bordetella pertussis
cgagcggcgccagucgcgca

SEQ ID NO: 348553 - RNA, 18 nt, Bordetella pertussis
cgagcgggccagcgcggc

SEQ ID NO: 348554 - RNA, 20 nt, Bordetella pertussis
cgagcgggccagcgcggcca

SEQ ID NO: 348555 - RNA, 20 nt, Bordetella pertussis
cgagcggcggcuucgcgcag

SEQ ID NO: 348556 - RNA, 15 nt, Bordetella pertussis
cgagcggcgugcgcg

SEQ ID NO: 348557 - RNA, 12 nt, Bordetella pertussis
cgagcgggcgcc

SEQ ID NO: 348558 - RNA, 21 nt, Bordetella pertussis
cgagcgugccgggaugcugcu

SEQ ID NO: 348559 - RNA, 22 nt, Bordetella pertussis
cgagcguguugcgugcgagcag

SEQ ID NO: 348560 - RNA, 18 nt, Bordetella pertussis
cgagcuccucgagcgugg

SEQ ID NO: 348561 - RNA, 17 nt, Bordetella pertussis
cgagcucgauggcuucg

SEQ ID NO: 348562 - RNA, 14 nt, Bordetella pertussis
cgagcugcgcggcu

SEQ ID NO: 348563 - RNA, 18 nt, Bordetella pertussis
cgagcugcucgagcaugc

SEQ ID NO: 348564 - RNA, 21 nt, Bordetella pertussis
cgagcuggcccacgcccaugu

SEQ ID NO: 348565 - RNA, 16 nt, Bordetella pertussis
cgagcuggccggcgac

SEQ ID NO: 348566 - RNA, 20 nt, Bordetella pertussis
cgagcuggcuggccagcggg

SEQ ID NO: 348567 - RNA, 23 nt, Bordetella pertussis
cgagcugguagacaugcucgaug

SEQ ID NO: 348568 - RNA, 14 nt, Bordetella pertussis
cgaggaaccagccg

SEQ ID NO: 348569 - RNA, 20 nt, Bordetella pertussis
cgaggaaccagccgucggca

SEQ ID NO: 348570 - RNA, 14 nt, Bordetella pertussis
cgaggacgaccaac

SEQ ID NO: 348571 - RNA, 18 nt, Bordetella pertussis
cgaggacgaccuugcugg

SEQ ID NO: 348572 - RNA, 19 nt, Bordetella pertussis
cgaggaccugaccaucgaa

SEQ ID NO: 348573 - RNA, 18 nt, Bordetella pertussis
cgaggaccugaccgugca

SEQ ID NO: 348574 - RNA, 19 nt, Bordetella pertussis
cgaggcaaucagccccagg

SEQ ID NO: 348575 - RNA, 22 nt, Bordetella pertussis
cgaggcaaucagccccaggcgc

SEQ ID NO: 348576 - RNA, 14 nt, Bordetella pertussis
cgaggcacaaggcc

SEQ ID NO: 348577 - RNA, 22 nt, Bordetella pertussis
cgaggcagaaguggucgcgcag

SEQ ID NO: 348578 - RNA, 23 nt, Bordetella pertussis
cgaggccacggcaaugucgcagg

SEQ ID NO: 348579 - RNA, 14 nt, Bordetella pertussis
cgaggcugcgcgcg

SEQ ID NO: 348580 - RNA, 17 nt, Bordetella pertussis
cgaggcugcgcgcgcca

SEQ ID NO: 348581 - RNA, 18 nt, Bordetella pertussis
cgaggcugcgcgcgccag

SEQ ID NO: 348582 - RNA, 20 nt, Bordetella pertussis
cgaggcugcgcgcgccagcg

SEQ ID NO: 348583 - RNA, 22 nt, Bordetella pertussis
cgaggcuuuuuuucgccgggcg

SEQ ID NO: 348584 - RNA, 16 nt, Bordetella pertussis
cgagggacaccgcagg

SEQ ID NO: 348585 - RNA, 17 nt, Bordetella pertussis
cgagguaagugggcugc

SEQ ID NO: 348586 - RNA, 21 nt, Bordetella pertussis
cgagguaagugggcugcggcg

SEQ ID NO: 348587 - RNA, 17 nt, Bordetella pertussis
cgagguagggcgcggcc

SEQ ID NO: 348588 - RNA, 20 nt, Bordetella pertussis
cgagguagggcgcggccagg

SEQ ID NO: 348589 - RNA, 22 nt, Bordetella pertussis
cgagguauuggccuugcccagg

SEQ ID NO: 348590 - RNA, 13 nt, Bordetella pertussis
cgagguccaggcg

SEQ ID NO: 348591 - RNA, 19 nt, Bordetella pertussis
cgagguccgcauggguucg

SEQ ID NO: 348592 - RNA, 16 nt, Bordetella pertussis
cgagguccugcucggu

SEQ ID NO: 348593 - RNA, 14 nt, Bordetella pertussis
cgaggucgcccuug

SEQ ID NO: 348594 - RNA, 12 nt, Bordetella pertussis
cgaggucggcgg

SEQ ID NO: 348595 - RNA, 20 nt, Bordetella pertussis
cgagguguagaacucggccg

SEQ ID NO: 348596 - RNA, 16 nt, Bordetella pertussis
cgagguugcaggccag

SEQ ID NO: 348597 - RNA, 17 nt, Bordetella pertussis
cgagguugcaggccagg

SEQ ID NO: 348598 - RNA, 16 nt, Bordetella pertussis
cgagguuuccgccaug

SEQ ID NO: 348599 - RNA, 17 nt, Bordetella pertussis
cgaguccuugacgccgc

SEQ ID NO: 348600 - RNA, 19 nt, Bordetella pertussis
cgaguccuugacgccgccg

SEQ ID NO: 348601 - RNA, 20 nt, Bordetella pertussis
cgaguccuugacgccgccga

SEQ ID NO: 348602 - RNA, 20 nt, Bordetella pertussis
cgagugggcggccuugccgg

SEQ ID NO: 348603 - RNA, 17 nt, Bordetella pertussis
cgaguucggcgcgcccg

SEQ ID NO: 348604 - RNA, 18 nt, Bordetella pertussis
cgaguucggcgcgcccgc

SEQ ID NO: 348605 - RNA, 22 nt, Bordetella pertussis
cgaguugaggaugcgcgcggcc

SEQ ID NO: 348606 - RNA, 16 nt, Bordetella pertussis
cgaguuguccuggccg

SEQ ID NO: 348607 - RNA, 13 nt, Bordetella pertussis
cgaguugcucgga

SEQ ID NO: 348608 - RNA, 16 nt, Bordetella pertussis
cgaguuugcgguccau

SEQ ID NO: 348609 - RNA, 18 nt, Bordetella pertussis
cgauacagcuuggcgcgc

SEQ ID NO: 348610 - RNA, 21 nt, Bordetella pertussis
cgauacagcuuggcgcgcgga

SEQ ID NO: 348611 - RNA, 14 nt, Bordetella pertussis
cgauacaggcgcuc

SEQ ID NO: 348612 - RNA, 23 nt, Bordetella pertussis
cgauaccaacugccugcagcgcg

SEQ ID NO: 348613 - RNA, 17 nt, Bordetella pertussis
cgauaccgucgcgcucg

SEQ ID NO: 348614 - RNA, 18 nt, Bordetella pertussis
cgauaccgucgcgcucga

SEQ ID NO: 348615 - RNA, 17 nt, Bordetella pertussis
cgauacgacacgccgcg

SEQ ID NO: 348616 - RNA, 14 nt, Bordetella pertussis
cgauacgccgggcg

SEQ ID NO: 348617 - RNA, 15 nt, Bordetella pertussis
cgauauccagguagg

SEQ ID NO: 348618 - RNA, 17 nt, Bordetella pertussis
cgauauccagguaggcg

SEQ ID NO: 348619 - RNA, 12 nt, Bordetella pertussis
cgauaucccaug

SEQ ID NO: 348620 - RNA, 23 nt, Bordetella pertussis
cgauauccuugcgcucgcccagc

SEQ ID NO: 348621 - RNA, 19 nt, Bordetella pertussis
cgauaugcagccgcaccag

SEQ ID NO: 348622 - RNA, 17 nt, Bordetella pertussis
cgauaugggcggccucg

SEQ ID NO: 348623 - RNA, 17 nt, Bordetella pertussis
cgauauuggcgucggcc

SEQ ID NO: 348624 - RNA, 22 nt, Bordetella pertussis
cgauauuggcgucggccgccgu

SEQ ID NO: 348625 - RNA, 19 nt, Bordetella pertussis
cgauauugguguugccggc

SEQ ID NO: 348626 - RNA, 23 nt, Bordetella pertussis
cgauauugguguugccggccagg

SEQ ID NO: 348627 - RNA, 18 nt, Bordetella pertussis
cgaucugcugggccgggu

SEQ ID NO: 348628 - RNA, 13 nt, Bordetella pertussis
cgaucuggcgcgc

SEQ ID NO: 348629 - RNA, 21 nt, Bordetella pertussis
cgaucuggcgcgcgaccaggc

SEQ ID NO: 348630 - RNA, 14 nt, Bordetella pertussis
cgaucugggccucg

SEQ ID NO: 348631 - RNA, 12 nt, Bordetella pertussis
cgaucuggccga

SEQ ID NO: 348632 - RNA, 18 nt, Bordetella pertussis
cgaucugguccugggccg

SEQ ID NO: 348633 - RNA, 16 nt, Bordetella pertussis
cgaucuucagcaccag

SEQ ID NO: 348634 - RNA, 16 nt, Bordetella pertussis
cgaucuucucgacggc

SEQ ID NO: 348635 - RNA, 21 nt, Bordetella pertussis
cgaucuucuggacuugcggca

SEQ ID NO: 348636 - RNA, 16 nt, Bordetella pertussis
cgaucuucugggcggc

SEQ ID NO: 348637 - RNA, 14 nt, Bordetella pertussis
cgaucuugccggcc

SEQ ID NO: 348638 - RNA, 17 nt, Bordetella pertussis
cgaucuugccggccugg

SEQ ID NO: 348639 - RNA, 14 nt, Bordetella pertussis
cgaugaacagcggc

SEQ ID NO: 348640 - RNA, 20 nt, Bordetella pertussis
cgaugaacagcggcacgccg

SEQ ID NO: 348641 - RNA, 15 nt, Bordetella pertussis
cgaugaccggcaagc

SEQ ID NO: 348642 - RNA, 14 nt, Bordetella pertussis
cgaugaccggccag

SEQ ID NO: 348643 - RNA, 16 nt, Bordetella pertussis
cgaugaccggccaggc

SEQ ID NO: 348644 - RNA, 20 nt, Bordetella pertussis
cgaugaccggccaggcgcgg

SEQ ID NO: 348645 - RNA, 23 nt, Bordetella pertussis
cgaugaccgggucgucgggcggc

SEQ ID NO: 348646 - RNA, 18 nt, Bordetella pertussis
cgaugaccucgcgcugca

SEQ ID NO: 348647 - RNA, 15 nt, Bordetella pertussis
cgaugaccucggcga

SEQ ID NO: 348648 - RNA, 19 nt, Bordetella pertussis
cgaugaccucggcgagcgc

SEQ ID NO: 348649 - RNA, 21 nt, Bordetella pertussis
cgaugaccucggcgagcgccu

SEQ ID NO: 348650 - RNA, 17 nt, Bordetella pertussis
cgaugaccugggccugg

SEQ ID NO: 348651 - RNA, 13 nt, Bordetella pertussis
cgaugaggccgau

SEQ ID NO: 348652 - RNA, 19 nt, Bordetella pertussis
cgaugaucacgcgcuccgg

SEQ ID NO: 348653 - RNA, 17 nt, Bordetella pertussis
cgaugaucgccucgggg

SEQ ID NO: 348654 - RNA, 14 nt, Bordetella pertussis
cgaugaucgcgccg

SEQ ID NO: 348655 - RNA, 19 nt, Bordetella pertussis
cgaugaucgcgccgacgac

SEQ ID NO: 348656 - RNA, 20 nt, Bordetella pertussis
cgaugaucgcgccgacgacc

SEQ ID NO: 348657 - RNA, 18 nt, Bordetella pertussis
cgaugaugugguagccgc

SEQ ID NO: 348658 - RNA, 16 nt, Bordetella pertussis
cgaugcaauagcgccc

SEQ ID NO: 348659 - RNA, 14 nt, Bordetella pertussis
cgaugcacccaggc

SEQ ID NO: 348660 - RNA, 19 nt, Bordetella pertussis
cgaugcauucggcggccgg

SEQ ID NO: 348661 - RNA, 15 nt, Bordetella pertussis
cgaugcccugcgcca

SEQ ID NO: 348662 - RNA, 17 nt, Bordetella pertussis
cgaugcccugcgccagc

SEQ ID NO: 348663 - RNA, 22 nt, Bordetella pertussis
cgaugcccugcgccagcgccuc

SEQ ID NO: 348664 - RNA, 20 nt, Bordetella pertussis
cgaugccgaacaaaccgucg

SEQ ID NO: 348665 - RNA, 14 nt, Bordetella pertussis
cgaugccgaacucg

SEQ ID NO: 348666 - RNA, 15 nt, Bordetella pertussis
cgaugccgaccgagc

SEQ ID NO: 348667 - RNA, 21 nt, Bordetella pertussis
cgaugccgauacgucgcagca

SEQ ID NO: 348668 - RNA, 19 nt, Bordetella pertussis
cgaugccgccaucauccug

SEQ ID NO: 348669 - RNA, 14 nt, Bordetella pertussis
cgaugccgccaugc

SEQ ID NO: 348670 - RNA, 17 nt, Bordetella pertussis
cgaugccgccaugcgcc

SEQ ID NO: 348671 - RNA, 15 nt, Bordetella pertussis
cgaugccgcccacgc

SEQ ID NO: 348672 - RNA, 21 nt, Bordetella pertussis
cgaugccgcagauggccagca

SEQ ID NO: 348673 - RNA, 13 nt, Bordetella pertussis
cgaugcgccaggc

SEQ ID NO: 348674 - RNA, 17 nt, Bordetella pertussis
cgaugcgccaggccucg

SEQ ID NO: 348675 - RNA, 21 nt, Bordetella pertussis
cgaugcgccaggcgcucggcg

SEQ ID NO: 348676 - RNA, 21 nt, Bordetella pertussis
cgaugcgccaguccagcgcgc

SEQ ID NO: 348677 - RNA, 18 nt, Bordetella pertussis
cgaugcgccgcaccagcg

SEQ ID NO: 348678 - RNA, 18 nt, Bordetella pertussis
cgaugcgccggccuggcg

SEQ ID NO: 348679 - RNA, 20 nt, Bordetella pertussis
cgaugcgcgaagcgcccugg

SEQ ID NO: 348680 - RNA, 14 nt, Bordetella pertussis
cgaugcgcgccacg

SEQ ID NO: 348681 - RNA, 13 nt, Bordetella pertussis
cgaugcgcgcgcg

SEQ ID NO: 348682 - RNA, 12 nt, Bordetella pertussis
cgaugcgcgcgu

SEQ ID NO: 348683 - RNA, 13 nt, Bordetella pertussis
cgaugcgcgcgug

SEQ ID NO: 348684 - RNA, 17 nt, Bordetella pertussis
cgaugcgcgcgugcagc

SEQ ID NO: 348685 - RNA, 20 nt, Bordetella pertussis
cgaugcgcgcgugcagcgcc

SEQ ID NO: 348686 - RNA, 23 nt, Bordetella pertussis
cgaugcgcgcgugcagcgccgcg

SEQ ID NO: 348687 - RNA, 14 nt, Bordetella pertussis
cgaugcgcggcccg

SEQ ID NO: 348688 - RNA, 16 nt, Bordetella pertussis
cgaugcgcggcccggc

SEQ ID NO: 348689 - RNA, 18 nt, Bordetella pertussis
cgaugcgcggcccggccg

SEQ ID NO: 348690 - RNA, 22 nt, Bordetella pertussis
cgaugcgcugcuggaggccggc

SEQ ID NO: 348691 - RNA, 14 nt, Bordetella pertussis
cgaugcgcuugccg

SEQ ID NO: 348692 - RNA, 18 nt, Bordetella pertussis
cgaugcgcuugccgaccu

SEQ ID NO: 348693 - RNA, 13 nt, Bordetella pertussis
cgaugcuggcgcg

SEQ ID NO: 348694 - RNA, 15 nt, Bordetella pertussis
cgaugcuggcgcgga

SEQ ID NO: 348695 - RNA, 13 nt, Bordetella pertussis
cgaugcuggcggc

SEQ ID NO: 348696 - RNA, 17 nt, Bordetella pertussis
cgaugcuggcggcaucg

SEQ ID NO: 348697 - RNA, 18 nt, Bordetella pertussis
cgauggaaaugccgucca

SEQ ID NO: 348698 - RNA, 19 nt, Bordetella pertussis
cgauggaacucguuggcca

SEQ ID NO: 348699 - RNA, 22 nt, Bordetella pertussis
cgauggaacucguuggccagcg

SEQ ID NO: 348700 - RNA, 20 nt, Bordetella pertussis
cgauggaaucgucgaccagc

SEQ ID NO: 348701 - RNA, 15 nt, Bordetella pertussis
cgauggccgccagcg

SEQ ID NO: 348702 - RNA, 14 nt, Bordetella pertussis
cgauggccgccagc

SEQ ID NO: 348703 - RNA, 15 nt, Bordetella pertussis
cgauggccgcgccca

SEQ ID NO: 348704 - RNA, 19 nt, Bordetella pertussis
cgauggccucgcugccagg

SEQ ID NO: 348705 - RNA, 23 nt, Bordetella pertussis
cgauggccucgcugccagggugc

SEQ ID NO: 348706 - RNA, 19 nt, Bordetella pertussis
cgauggccgggagcggcca

SEQ ID NO: 348707 - RNA, 20 nt, Bordetella pertussis
cgauggccgggagcggccag

SEQ ID NO: 348708 - RNA, 22 nt, Bordetella pertussis
cgauggccggggcgucgucgcg

SEQ ID NO: 348709 - RNA, 16 nt, Bordetella pertussis
cgauggccugugcggc

SEQ ID NO: 348710 - RNA, 21 nt, Bordetella pertussis
cgauggcgauguaggccaggu

SEQ ID NO: 348711 - RNA, 20 nt, Bordetella pertussis
cgauggcgcaauaggccgcg

SEQ ID NO: 348712 - RNA, 14 nt, Bordetella pertussis
cgauggcgcccacg

SEQ ID NO: 348713 - RNA, 18 nt, Bordetella pertussis
cgauggcgcccacggccu

SEQ ID NO: 348714 - RNA, 23 nt, Bordetella pertussis
cgauggcgcccacggccuguccg

SEQ ID NO: 348715 - RNA, 13 nt, Bordetella pertussis
cgauggcgccggc

SEQ ID NO: 348716 - RNA, 17 nt, Bordetella pertussis
cgauggcgccggccagc

SEQ ID NO: 348717 - RNA, 18 nt, Bordetella pertussis
cgauggcgccggccagcg

SEQ ID NO: 348718 - RNA, 15 nt, Bordetella pertussis
cgauggcgcgcggcu

SEQ ID NO: 348719 - RNA, 24 nt, Bordetella pertussis
cgauggcgcggccggaggccgccc

SEQ ID NO: 348720 - RNA, 16 nt, Bordetella pertussis
cgauggcgcgucgccg

SEQ ID NO: 348721 - RNA, 22 nt, Bordetella pertussis
cgauggcgcgucgccgcgccgu

SEQ ID NO: 348722 - RNA, 13 nt, Bordetella pertussis
cgauggcgcggcc

SEQ ID NO: 348723 - RNA, 22 nt, Bordetella pertussis
cgauggcggcaucuugccuugg

SEQ ID NO: 348724 - RNA, 15 nt, Bordetella pertussis
cgauggcggccaggg

SEQ ID NO: 348725 - RNA, 20 nt, Bordetella pertussis
cgauggcggccagggcaagc

SEQ ID NO: 348726 - RNA, 19 nt, Bordetella pertussis
cgauggcgggguuggccgc

SEQ ID NO: 348727 - RNA, 22 nt, Bordetella pertussis
cgauggcgggguuggccgccag

SEQ ID NO: 348728 - RNA, 14 nt, Bordetella pertussis
cgauggcguccagc

SEQ ID NO: 348729 - RNA, 17 nt, Bordetella pertussis
cgauggcuucgcgcaca

SEQ ID NO: 348730 - RNA, 14 nt, Bordetella pertussis
cgauggcuuggcgc

SEQ ID NO: 348731 - RNA, 13 nt, Bordetella pertussis
cgauggggcagcc

SEQ ID NO: 348732 - RNA, 18 nt, Bordetella pertussis
cgaugggguagucggcca

SEQ ID NO: 348733 - RNA, 20 nt, Bordetella pertussis
cgaugggguagucggccacc

SEQ ID NO: 348734 - RNA, 14 nt, Bordetella pertussis
cgauggucagcaug

SEQ ID NO: 348735 - RNA, 20 nt, Bordetella pertussis
cgauggucaguccgcccagc

SEQ ID NO: 348736 - RNA, 21 nt, Bordetella pertussis
cgauggucaguccgcccagcc

SEQ ID NO: 348737 - RNA, 21 nt, Bordetella pertussis
cgauggucggccggaugcgca

SEQ ID NO: 348738 - RNA, 18 nt, Bordetella pertussis
cgauggucuugccgccgu

SEQ ID NO: 348739 - RNA, 16 nt, Bordetella pertussis
cgauggugcauucguc

SEQ ID NO: 348740 - RNA, 15 nt, Bordetella pertussis
cgauggugccggccg

SEQ ID NO: 348741 - RNA, 16 nt, Bordetella pertussis
cgauggugccggccgu

SEQ ID NO: 348742 - RNA, 16 nt, Bordetella pertussis
cgaugguggauccgcc

SEQ ID NO: 348743 - RNA, 23 nt, Bordetella pertussis
cgaugguggcguucucgacccgc

SEQ ID NO: 348744 - RNA, 15 nt, Bordetella pertussis
cgauguagcccaugg

SEQ ID NO: 348745 - RNA, 17 nt, Bordetella pertussis
cgauguagagggucugg

SEQ ID NO: 348746 - RNA, 23 nt, Bordetella pertussis
cgauguagaucuggcgcgucagg

SEQ ID NO: 348747 - RNA, 17 nt, Bordetella pertussis
cgauguccacgaaggcg

SEQ ID NO: 348748 - RNA, 17 nt, Bordetella pertussis
cgauguccagcgccagc

SEQ ID NO: 348749 - RNA, 21 nt, Bordetella pertussis
cgauguccugguugccgagga

SEQ ID NO: 348750 - RNA, 22 nt, Bordetella pertussis
cgauguccugguugccgaggac

SEQ ID NO: 348751 - RNA, 15 nt, Bordetella pertussis
cgaugucgaacagcu

SEQ ID NO: 348752 - RNA, 15 nt, Bordetella pertussis
cgaugucgaauuccg

SEQ ID NO: 348753 - RNA, 15 nt, Bordetella pertussis
cgaugucgcccaugc

SEQ ID NO: 348754 - RNA, 14 nt, Bordetella pertussis
cgaugucgccgccg

SEQ ID NO: 348755 - RNA, 20 nt, Bordetella pertussis
cgaugucgccgccgcgcacc

SEQ ID NO: 348756 - RNA, 17 nt, Bordetella pertussis
cgaugucgccgccugcg

SEQ ID NO: 348757 - RNA, 16 nt, Bordetella pertussis
cgaugucgcgcgcgcu

SEQ ID NO: 348758 - RNA, 22 nt, Bordetella pertussis
cgaugucgaggaucaugucguc

SEQ ID NO: 348759 - RNA, 21 nt, Bordetella pertussis
cgaugucguccagcuccaggu

SEQ ID NO: 348760 - RNA, 19 nt, Bordetella pertussis
cgaugucgugaucgccagc

SEQ ID NO: 348761 - RNA, 18 nt, Bordetella pertussis
cgaugugcaugccgucgc

SEQ ID NO: 348762 - RNA, 14 nt, Bordetella pertussis
cgauguggccgucg

SEQ ID NO: 348763 - RNA, 21 nt, Bordetella pertussis
cgauguggcgcuggcggcugc

SEQ ID NO: 348764 - RNA, 17 nt, Bordetella pertussis
cgauguuacagaugggc

SEQ ID NO: 348765 - RNA, 18 nt, Bordetella pertussis
cgauguucacgcgcaagc

SEQ ID NO: 348766 - RNA, 14 nt, Bordetella pertussis
cgauguucggaugc

SEQ ID NO: 348767 - RNA, 16 nt, Bordetella pertussis
cgauguuguuggccgc

SEQ ID NO: 348768 - RNA, 21 nt, Bordetella pertussis
cgauguuguuggccgccagcc

SEQ ID NO: 348769 - RNA, 15 nt, Bordetella pertussis
cgauguugcgcaggc

SEQ ID NO: 348770 - RNA, 16 nt, Bordetella pertussis
cgauuccagcgccgcc

SEQ ID NO: 348771 - RNA, 13 nt, Bordetella pertussis
cgauucccuggcg

SEQ ID NO: 348772 - RNA, 15 nt, Bordetella pertussis
cgauucccuggcgcg

SEQ ID NO: 348773 - RNA, 13 nt, Bordetella pertussis
cgauucgcgcuug

SEQ ID NO: 348774 - RNA, 23 nt, Bordetella pertussis
cgauucgcgcuugaaaugcgugg

SEQ ID NO: 348775 - RNA, 19 nt, Bordetella pertussis
cgauucuuuccuggccggc

SEQ ID NO: 348776 - RNA, 20 nt, Bordetella pertussis
cgauucuuuccuggccggcg

SEQ ID NO: 348777 - RNA, 18 nt, Bordetella pertussis
cgauugaccagcaccagc

SEQ ID NO: 348778 - RNA, 19 nt, Bordetella pertussis
cgauugaccagcaccagcg

SEQ ID NO: 348779 - RNA, 21 nt, Bordetella pertussis
cgauugaguucgcgcgccggc

SEQ ID NO: 348780 - RNA, 14 nt, Bordetella pertussis
cgauugcagguggc

SEQ ID NO: 348781 - RNA, 20 nt, Bordetella pertussis
cgauugccuggucgaaguag

SEQ ID NO: 348782 - RNA, 13 nt, Bordetella pertussis
cgauugcggcccg

SEQ ID NO: 348783 - RNA, 15 nt, Bordetella pertussis
cgauugcggcccgcg

SEQ ID NO: 348784 - RNA, 18 nt, Bordetella pertussis
cgauugucgucgcgcgag

SEQ ID NO: 348785 - RNA, 19 nt, Bordetella pertussis
cgauugucgucgcgcgaga

SEQ ID NO: 348786 - RNA, 18 nt, Bordetella pertussis
cgcaaaccgacgcggcca

SEQ ID NO: 348787 - RNA, 19 nt, Bordetella pertussis
cgcaaaccgacgcggccag

SEQ ID NO: 348788 - RNA, 13 nt, Bordetella pertussis
cgcaaaccugccg

SEQ ID NO: 348789 - RNA, 23 nt, Bordetella pertussis
cgcaaacgggggcaggccgcggu

SEQ ID NO: 348790 - RNA, 20 nt, Bordetella pertussis
cgcaaccagggagccguucu

SEQ ID NO: 348791 - RNA, 14 nt, Bordetella pertussis
cgcaaccaggggcg

SEQ ID NO: 348792 - RNA, 23 nt, Bordetella pertussis
cgcaaccaggggcggcgcggcgc

SEQ ID NO: 348793 - RNA, 14 nt, Bordetella pertussis
cgcaacccaccccc

SEQ ID NO: 348794 - RNA, 17 nt, Bordetella pertussis
cgcaacccacccccagc

SEQ ID NO: 348795 - RNA, 23 nt, Bordetella pertussis
cgcaacccacggcguggcgcgcc

SEQ ID NO: 348796 - RNA, 21 nt, Bordetella pertussis
cgcaacccagcagcggcagca

SEQ ID NO: 348797 - RNA, 16 nt, Bordetella pertussis
cgcaaccggucggccg

SEQ ID NO: 348798 - RNA, 18 nt, Bordetella pertussis
cgcaaccggucggccggc

SEQ ID NO: 348799 - RNA, 15 nt, Bordetella pertussis
cgcaaccgucgaccg

SEQ ID NO: 348800 - RNA, 17 nt, Bordetella pertussis
cgcaaccgucgaccggc

SEQ ID NO: 348801 - RNA, 21 nt, Bordetella pertussis
cgcaaccgucgaccggcccgc

SEQ ID NO: 348802 - RNA, 14 nt, Bordetella pertussis
cgcaacgcaugcgc

SEQ ID NO: 348803 - RNA, 17 nt, Bordetella pertussis
cgcaacgcaugcgcgau

SEQ ID NO: 348804 - RNA, 13 nt, Bordetella pertussis
cgcaacgccagca

SEQ ID NO: 348805 - RNA, 15 nt, Bordetella pertussis
cgcaacgccgccacc

SEQ ID NO: 348806 - RNA, 19 nt, Bordetella pertussis
cgcaacgccgcccguccgg

SEQ ID NO: 348807 - RNA, 23 nt, Bordetella pertussis
cgcaacgccgcccguccgggcgg

SEQ ID NO: 348808 - RNA, 22 nt, Bordetella pertussis
cgcaacgccgccggcagggcca

SEQ ID NO: 348809 - RNA, 17 nt, Bordetella pertussis
cgcaacgccgggccgcg

SEQ ID NO: 348810 - RNA, 20 nt, Bordetella pertussis
cgcaacgccgggccgcgccg

SEQ ID NO: 348811 - RNA, 18 nt, Bordetella pertussis
cgcaccaccagcaccgcc

SEQ ID NO: 348812 - RNA, 13 nt, Bordetella pertussis
cgcaccaccgccg

SEQ ID NO: 348813 - RNA, 13 nt, Bordetella pertussis
cgcaccaccuggc

SEQ ID NO: 348814 - RNA, 15 nt, Bordetella pertussis
cgcaccagguuggcg

SEQ ID NO: 348815 - RNA, 20 nt, Bordetella pertussis
cgcaccagguuggcgauggc

SEQ ID NO: 348816 - RNA, 12 nt, Bordetella pertussis
cgcaccaguccc

SEQ ID NO: 348817 - RNA, 21 nt, Bordetella pertussis
cgcaccaggucgcggugcgcc

SEQ ID NO: 348818 - RNA, 16 nt, Bordetella pertussis
cgcaccaucgccgagc

SEQ ID NO: 348819 - RNA, 21 nt, Bordetella pertussis
cgcaccaugccgauggcggug

SEQ ID NO: 348820 - RNA, 18 nt, Bordetella pertussis
cgcaccaugcggugcgcc

SEQ ID NO: 348821 - RNA, 15 nt, Bordetella pertussis
cgcaccauggcgccc

SEQ ID NO: 348822 - RNA, 16 nt, Bordetella pertussis
cgcaccauggcgccca

SEQ ID NO: 348823 - RNA, 12 nt, Bordetella pertussis
cgcaccaugugc

SEQ ID NO: 348824 - RNA, 18 nt, Bordetella pertussis
cgcaccccggugucgccg

SEQ ID NO: 348825 - RNA, 23 nt, Bordetella pertussis
cgcaccccggugucgccguggcg

SEQ ID NO: 348826 - RNA, 17 nt, Bordetella pertussis
cgcaccccggccgacgg

SEQ ID NO: 348827 - RNA, 24 nt, Bordetella pertussis
cgcacccgaugacggggcggcgcc

SEQ ID NO: 348828 - RNA, 16 nt, Bordetella pertussis
cgcacccgccuggacg

SEQ ID NO: 348829 - RNA, 20 nt, Bordetella pertussis
cgcacccgccuggacggcga

SEQ ID NO: 348830 - RNA, 21 nt, Bordetella pertussis
cgcacccgccuggacggcgag

SEQ ID NO: 348831 - RNA, 18 nt, Bordetella pertussis
cgcacccgguauccgcgc

SEQ ID NO: 348832 - RNA, 14 nt, Bordetella pertussis
cgcacccgucccug

SEQ ID NO: 348833 - RNA, 15 nt, Bordetella pertussis
cgcacccgucccugg

SEQ ID NO: 348834 - RNA, 17 nt, Bordetella pertussis
cgcacccugcaggccgg

SEQ ID NO: 348835 - RNA, 19 nt, Bordetella pertussis
cgcaccgacagcaagggca

SEQ ID NO: 348836 - RNA, 17 nt, Bordetella pertussis
cgcaccgaggugccggc

SEQ ID NO: 348837 - RNA, 19 nt, Bordetella pertussis
cgcaccgaggugccggcgg

SEQ ID NO: 348838 - RNA, 20 nt, Bordetella pertussis
cgcaccgaggugccggcggu

SEQ ID NO: 348839 - RNA, 16 nt, Bordetella pertussis
cgcaccgcaugggcca

SEQ ID NO: 348840 - RNA, 15 nt, Bordetella pertussis
cgcaccgccgccggc

SEQ ID NO: 348841 - RNA, 20 nt, Bordetella pertussis
cgcaccgccgccggcccgga

SEQ ID NO: 348842 - RNA, 14 nt, Bordetella pertussis
cgcaccgcgccagc

SEQ ID NO: 348843 - RNA, 18 nt, Bordetella pertussis
cgcaccgcgccagcgccg

SEQ ID NO: 348844 - RNA, 20 nt, Bordetella pertussis
cgcaccgcuucuucgucgcg

SEQ ID NO: 348845 - RNA, 22 nt, Bordetella pertussis
cgcaccgcuucuucgucgcgcc

SEQ ID NO: 348846 - RNA, 16 nt, Bordetella pertussis
cgcaccggaggcgccg

SEQ ID NO: 348847 - RNA, 14 nt, Bordetella pertussis
cgcacgaagccgau

SEQ ID NO: 348848 - RNA, 20 nt, Bordetella pertussis
cgcacgaaguacucgccggc

SEQ ID NO: 348849 - RNA, 24 nt, Bordetella pertussis
cgcacgacagcaucuuggccgcca

SEQ ID NO: 348850 - RNA, 14 nt, Bordetella pertussis
cgcacgaucgcgcc

SEQ ID NO: 348851 - RNA, 15 nt, Bordetella pertussis
cgcacgaucgcgccg

SEQ ID NO: 348852 - RNA, 20 nt, Bordetella pertussis
cgcacgaugccgaccgagcc

SEQ ID NO: 348853 - RNA, 13 nt, Bordetella pertussis
cgcacgauggcgc

SEQ ID NO: 348854 - RNA, 19 nt, Bordetella pertussis
cgcacgauggggcagccau

SEQ ID NO: 348855 - RNA, 20 nt, Bordetella pertussis
cgcacgauugucgucgcgcg

SEQ ID NO: 348856 - RNA, 16 nt, Bordetella pertussis
cgcacgcaccgcgcca

SEQ ID NO: 348857 - RNA, 18 nt, Bordetella pertussis
cgcacgcaccgcgccagc

SEQ ID NO: 348858 - RNA, 19 nt, Bordetella pertussis
cgcacgcaccgcgccagcg

SEQ ID NO: 348859 - RNA, 17 nt, Bordetella pertussis
cgcacgcccgccugcag

SEQ ID NO: 348860 - RNA, 15 nt, Bordetella pertussis
cgcacgcccgcgacg

SEQ ID NO: 348861 - RNA, 12 nt, Bordetella pertussis
cgcacgcccaga

SEQ ID NO: 348862 - RNA, 13 nt, Bordetella pertussis
cgcacgccgggcg

SEQ ID NO: 348863 - RNA, 16 nt, Bordetella pertussis
cgcacgccgggcgcgg

SEQ ID NO: 348864 - RNA, 19 nt, Bordetella pertussis
cgcacgccgggcgcggccg

SEQ ID NO: 348865 - RNA, 18 nt, Bordetella pertussis
cgcacgccggucgccagc

SEQ ID NO: 348866 - RNA, 14 nt, Bordetella pertussis
cgcacgccggccug

SEQ ID NO: 348867 - RNA, 19 nt, Bordetella pertussis
cgcacgccggccugcgcca

SEQ ID NO: 348868 - RNA, 13 nt, Bordetella pertussis
cgcacgcgcagca

SEQ ID NO: 348869 - RNA, 16 nt, Bordetella pertussis
cgcacgcgcagcacgc

SEQ ID NO: 348870 - RNA, 18 nt, Bordetella pertussis
cgcacgcgcggcagcgcc

SEQ ID NO: 348871 - RNA, 14 nt, Bordetella pertussis
cgcacgcggccgcg

SEQ ID NO: 348872 - RNA, 20 nt, Bordetella pertussis
cgcacgcggccgcgggccgc

SEQ ID NO: 348873 - RNA, 21 nt, Bordetella pertussis
cgcacgcggccgcgggccgcu

SEQ ID NO: 348874 - RNA, 13 nt, Bordetella pertussis
cgcacgcuggcau

SEQ ID NO: 348875 - RNA, 20 nt, Bordetella pertussis
cgcacgcuggcaucgucgcg

SEQ ID NO: 348876 - RNA, 17 nt, Bordetella pertussis
cgcacgcuggcgcccgc

SEQ ID NO: 348877 - RNA, 15 nt, Bordetella pertussis
cgcacggacagcccg

SEQ ID NO: 348878 - RNA, 13 nt, Bordetella pertussis
cgcacggccagca

SEQ ID NO: 348879 - RNA, 13 nt, Bordetella pertussis
cgcacggccguca

SEQ ID NO: 348880 - RNA, 22 nt, Bordetella pertussis
cgcacggccgucaacagcaugg

SEQ ID NO: 348881 - RNA, 19 nt, Bordetella pertussis
cgcacgguggcgccgucgc

SEQ ID NO: 348882 - RNA, 16 nt, Bordetella pertussis
cgcacgugacgccggc

SEQ ID NO: 348883 - RNA, 19 nt, Bordetella pertussis
cgcacgugacgccggcgaa

SEQ ID NO: 348884 - RNA, 20 nt, Bordetella pertussis
cgcacgugacgccggcgaau

SEQ ID NO: 348885 - RNA, 16 nt, Bordetella pertussis
cgcacuggguggccag

SEQ ID NO: 348886 - RNA, 17 nt, Bordetella pertussis
cgcacuggguggccagc

SEQ ID NO: 348887 - RNA, 21 nt, Bordetella pertussis
cgcacuggguggccagcgccg

SEQ ID NO: 348888 - RNA, 16 nt, Bordetella pertussis
cgcagaaaccgccaca

SEQ ID NO: 348889 - RNA, 19 nt, Bordetella pertussis
cgcagaaaccgccacagcg

SEQ ID NO: 348890 - RNA, 21 nt, Bordetella pertussis
cgcagaaauggaugcgcgccc

SEQ ID NO: 348891 - RNA, 15 nt, Bordetella pertussis
cgcagaacagcagcg

SEQ ID NO: 348892 - RNA, 22 nt, Bordetella pertussis
cgcagaagcagccgcgcggccg

SEQ ID NO: 348893 - RNA, 13 nt, Bordetella pertussis
cgcagaccacgcc

SEQ ID NO: 348894 - RNA, 16 nt, Bordetella pertussis
cgcagaccacgccggc

SEQ ID NO: 348895 - RNA, 17 nt, Bordetella pertussis
cgcagcauggcgccagc

SEQ ID NO: 348896 - RNA, 18 nt, Bordetella pertussis
cgcagcauggcgccagcu

SEQ ID NO: 348897 - RNA, 19 nt, Bordetella pertussis
cgcagcauggcgccagcug

SEQ ID NO: 348898 - RNA, 17 nt, Bordetella pertussis
cgcagcaucuugcgccg

SEQ ID NO: 348899 - RNA, 21 nt, Bordetella pertussis
cgcagcaucuugcgccgcugc

SEQ ID NO: 348900 - RNA, 18 nt, Bordetella pertussis
cgcagcaugagcugaugc

SEQ ID NO: 348901 - RNA, 20 nt, Bordetella pertussis
cgcagccacagcgcguggcc

SEQ ID NO: 348902 - RNA, 13 nt, Bordetella pertussis
cgcagccgccagc

SEQ ID NO: 348903 - RNA, 16 nt, Bordetella pertussis
cgcagccgccagcgcc

SEQ ID NO: 348904 - RNA, 15 nt, Bordetella pertussis
cgcagccgcccggca

SEQ ID NO: 348905 - RNA, 14 nt, Bordetella pertussis
cgcagccgcuccag

SEQ ID NO: 348906 - RNA, 16 nt, Bordetella pertussis
cgcagcgacucgaaca

SEQ ID NO: 348907 - RNA, 12 nt, Bordetella pertussis
cgcagcgaggcc

SEQ ID NO: 348908 - RNA, 13 nt, Bordetella pertussis
cgcagcgcaccga

SEQ ID NO: 348909 - RNA, 14 nt, Bordetella pertussis
cgcagcgcaccgac

SEQ ID NO: 348910 - RNA, 14 nt, Bordetella pertussis
cgcagcgcagcgcc

SEQ ID NO: 348911 - RNA, 21 nt, Bordetella pertussis
cgcagcgcaggauuuccucgc

SEQ ID NO: 348912 - RNA, 13 nt, Bordetella pertussis
cgcagcgcccagg

SEQ ID NO: 348913 - RNA, 14 nt, Bordetella pertussis
cgcagcgcccaggc

SEQ ID NO: 348914 - RNA, 17 nt, Bordetella pertussis
cgcagcgcccaggcgaa

SEQ ID NO: 348915 - RNA, 13 nt, Bordetella pertussis
cgcagcgccugca

SEQ ID NO: 348916 - RNA, 14 nt, Bordetella pertussis
cgcagcgccugcag

SEQ ID NO: 348917 - RNA, 18 nt, Bordetella pertussis
cgcagcgccugcaggcgg

SEQ ID NO: 348918 - RNA, 20 nt, Bordetella pertussis
cgcagcgccuggccgagcgc

SEQ ID NO: 348919 - RNA, 16 nt, Bordetella pertussis
cgcagcgcgaccgggc

SEQ ID NO: 348920 - RNA, 13 nt, Bordetella pertussis
cgcagcgccgcuu

SEQ ID NO: 348921 - RNA, 18 nt, Bordetella pertussis
cgcagcgcggcacgcugc

SEQ ID NO: 348922 - RNA, 22 nt, Bordetella pertussis
cgcagcgcucauguucgggcgc

SEQ ID NO: 348923 - RNA, 13 nt, Bordetella pertussis
cgcagcggcaggc

SEQ ID NO: 348924 - RNA, 22 nt, Bordetella pertussis
cgcagcggcaggcccugccgcc

SEQ ID NO: 348925 - RNA, 15 nt, Bordetella pertussis
cgcagcggcgcgcgc

SEQ ID NO: 348926 - RNA, 17 nt, Bordetella pertussis
cgcagcgggcccgucgc

SEQ ID NO: 348927 - RNA, 18 nt, Bordetella pertussis
cgcagcgggcccgucgcg

SEQ ID NO: 348928 - RNA, 17 nt, Bordetella pertussis
cgcagcgggugaucacg

SEQ ID NO: 348929 - RNA, 22 nt, Bordetella pertussis
cgcagcgucgcggcgucgaccg

SEQ ID NO: 348930 - RNA, 19 nt, Bordetella pertussis
cgcagcgucugcgcaucga

SEQ ID NO: 348931 - RNA, 15 nt, Bordetella pertussis
cgcagcgugaccgac

SEQ ID NO: 348932 - RNA, 24 nt, Bordetella pertussis
cgcagcgugaccgacaggccuggc

SEQ ID NO: 348933 - RNA, 17 nt, Bordetella pertussis
cgcagcguggcggcgac

SEQ ID NO: 348934 - RNA, 18 nt, Bordetella pertussis
cgcagcguuacgcgacca

SEQ ID NO: 348935 - RNA, 20 nt, Bordetella pertussis
cgcagcguuucaccgcugga

SEQ ID NO: 348936 - RNA, 18 nt, Bordetella pertussis
cgcagcucccccacgccg

SEQ ID NO: 348937 - RNA, 20 nt, Bordetella pertussis
cgcagcuccgggucgagcgc

SEQ ID NO: 348938 - RNA, 19 nt, Bordetella pertussis
cgcagcucgaccgucagca

SEQ ID NO: 348939 - RNA, 16 nt, Bordetella pertussis
cgcagcucguggcgcg

SEQ ID NO: 348940 - RNA, 23 nt, Bordetella pertussis
cgcagcugccugagcaccgccgc

SEQ ID NO: 348941 - RNA, 24 nt, Bordetella pertussis
cgcagcugccugagcaccgccgcg

SEQ ID NO: 348942 - RNA, 21 nt, Bordetella pertussis
cgcagcuggacuauggccugg

SEQ ID NO: 348943 - RNA, 18 nt, Bordetella pertussis
cgcagcuucuaucugccg

SEQ ID NO: 348944 - RNA, 20 nt, Bordetella pertussis
cgcagcuucuaucugccgcg

SEQ ID NO: 348945 - RNA, 14 nt, Bordetella pertussis
cgcagcuugcccgc

SEQ ID NO: 348946 - RNA, 17 nt, Bordetella pertussis
cgcagcuugcccgcgcg

SEQ ID NO: 348947 - RNA, 22 nt, Bordetella pertussis
cgcagcuugcccgcgcgcacgu

SEQ ID NO: 348948 - RNA, 17 nt, Bordetella pertussis
cgcaggccgcgccggcu

SEQ ID NO: 348949 - RNA, 13 nt, Bordetella pertussis
cgcaggccgcggc

SEQ ID NO: 348950 - RNA, 17 nt, Bordetella pertussis
cgcaggccgcggccagg

SEQ ID NO: 348951 - RNA, 21 nt, Bordetella pertussis
cgcaggccgcggccaggccca

SEQ ID NO: 348952 - RNA, 14 nt, Bordetella pertussis
cgcaggccggcggc

SEQ ID NO: 348953 - RNA, 18 nt, Bordetella pertussis
cgcaggccggcggccagc

SEQ ID NO: 348954 - RNA, 13 nt, Bordetella pertussis
cgcaggccugcgg

SEQ ID NO: 348955 - RNA, 15 nt, Bordetella pertussis
cgcaggccugcugca

SEQ ID NO: 348956 - RNA, 16 nt, Bordetella pertussis
cgcaggccuucgucga

SEQ ID NO: 348957 - RNA, 18 nt, Bordetella pertussis
cgcaggcgauuccggggu

SEQ ID NO: 348958 - RNA, 16 nt, Bordetella pertussis
cgcaggcgccgccccg

SEQ ID NO: 348959 - RNA, 13 nt, Bordetella pertussis
cgcaggcgcgcca

SEQ ID NO: 348960 - RNA, 15 nt, Bordetella pertussis
cgcaggcgcgcgccu

SEQ ID NO: 348961 - RNA, 13 nt, Bordetella pertussis
cgcaggcgcugca

SEQ ID NO: 348962 - RNA, 20 nt, Bordetella pertussis
cgcaggcgcguggccacggc

SEQ ID NO: 348963 - RNA, 13 nt, Bordetella pertussis
cgcaggcggcggc

SEQ ID NO: 348964 - RNA, 17 nt, Bordetella pertussis
cgcaggcggcggccucc

SEQ ID NO: 348965 - RNA, 22 nt, Bordetella pertussis
cgcaggcggcggccuccagcag

SEQ ID NO: 348966 - RNA, 21 nt, Bordetella pertussis
cgcaggcgggcgauauccauc

SEQ ID NO: 348967 - RNA, 17 nt, Bordetella pertussis
cgcaggcgggcgccgcg

SEQ ID NO: 348968 - RNA, 23 nt, Bordetella pertussis
cgcaggcgggcgccgcgcccggc

SEQ ID NO: 348969 - RNA, 13 nt, Bordetella pertussis
cgcaggcgugccc

SEQ ID NO: 348970 - RNA, 16 nt, Bordetella pertussis
cgcaggcgugcccuug

SEQ ID NO: 348971 - RNA, 18 nt, Bordetella pertussis
cgcaggcgugcgcgggcg

SEQ ID NO: 348972 - RNA, 20 nt, Bordetella pertussis
cgcaggcguucgcaccaguc

SEQ ID NO: 348973 - RNA, 18 nt, Bordetella pertussis
cgcaggcguuucgccagg

SEQ ID NO: 348974 - RNA, 19 nt, Bordetella pertussis
cgcaggggauugccgcgcg

SEQ ID NO: 348975 - RNA, 16 nt, Bordetella pertussis
cgcaggguuuccgaca

SEQ ID NO: 348976 - RNA, 19 nt, Bordetella pertussis
cgcagguauuccgccguca

SEQ ID NO: 348977 - RNA, 17 nt, Bordetella pertussis
cgcauucgucgcugccg

SEQ ID NO: 348978 - RNA, 22 nt, Bordetella pertussis
cgcauugaucgaucagccagcc

SEQ ID NO: 348979 - RNA, 13 nt, Bordetella pertussis
cgcauugccgccg

SEQ ID NO: 348980 - RNA, 19 nt, Bordetella pertussis
cgcauugccgccgcccugc

SEQ ID NO: 348981 - RNA, 16 nt, Bordetella pertussis
cgcauugccgucggcc

SEQ ID NO: 348982 - RNA, 14 nt, Bordetella pertussis
cgcauuggccgccg

SEQ ID NO: 348983 - RNA, 17 nt, Bordetella pertussis
cgcauuggccgccgcca

SEQ ID NO: 348984 - RNA, 18 nt, Bordetella pertussis
cgcauuggugagcacgcg

SEQ ID NO: 348985 - RNA, 18 nt, Bordetella pertussis
cgccaaaaggcagcaggc

SEQ ID NO: 348986 - RNA, 20 nt, Bordetella pertussis
cgccaaagcgcagcgugacc

SEQ ID NO: 348987 - RNA, 16 nt, Bordetella pertussis
cgccaagaccgcggcc

SEQ ID NO: 348988 - RNA, 13 nt, Bordetella pertussis
cgccaagcagacc

SEQ ID NO: 348989 - RNA, 16 nt, Bordetella pertussis
cgccaagcggcaggcg

SEQ ID NO: 348990 - RNA, 18 nt, Bordetella pertussis
cgccaagcggcaggcggc

SEQ ID NO: 348991 - RNA, 13 nt, Bordetella pertussis
cgccaagcugcug

SEQ ID NO: 348992 - RNA, 20 nt, Bordetella pertussis
cgccaagcugcuggccggcc

SEQ ID NO: 348993 - RNA, 13 nt, Bordetella pertussis
cgccaaucggcgu

SEQ ID NO: 348994 - RNA, 17 nt, Bordetella pertussis
cgccaaucugccgcuga

SEQ ID NO: 348995 - RNA, 19 nt, Bordetella pertussis
cgccaaucugccgcugacc

SEQ ID NO: 348996 - RNA, 22 nt, Bordetella pertussis
cgccaaucugccgcugaccggc

SEQ ID NO: 348997 - RNA, 14 nt, Bordetella pertussis
cgccaccacggcgc

SEQ ID NO: 348998 - RNA, 16 nt, Bordetella pertussis
cgccaccagaucgaua

SEQ ID NO: 348999 - RNA, 19 nt, Bordetella pertussis
cgccaccagcagcgccagg

SEQ ID NO: 349000 - RNA, 13 nt, Bordetella pertussis
cgccaccagcggc

SEQ ID NO: 349001 - RNA, 13 nt, Bordetella pertussis
cgccaccagcgcg

SEQ ID NO: 349002 - RNA, 20 nt, Bordetella pertussis
cgccaccagcuugcgcgccg

SEQ ID NO: 349003 - RNA, 14 nt, Bordetella pertussis
cgccaccaggccga

SEQ ID NO: 349004 - RNA, 18 nt, Bordetella pertussis
cgccaccaggccgauggc

SEQ ID NO: 349005 - RNA, 16 nt, Bordetella pertussis
cgccaccagugcgccg

SEQ ID NO: 349006 - RNA, 20 nt, Bordetella pertussis
cgccaccagugcgccggcgg

SEQ ID NO: 349007 - RNA, 22 nt, Bordetella pertussis
cgccaccagugcgccggcggcg

SEQ ID NO: 349008 - RNA, 14 nt, Bordetella pertussis
cgccacccaggcgg

SEQ ID NO: 349009 - RNA, 23 nt, Bordetella pertussis
cgccacccaggcggcaggcgccg

SEQ ID NO: 349010 - RNA, 20 nt, Bordetella pertussis
cgccaccggucgccguccag

SEQ ID NO: 349011 - RNA, 21 nt, Bordetella pertussis
cgccaccggucgccguccagg

SEQ ID NO: 349012 - RNA, 18 nt, Bordetella pertussis
cgccaccgugauggcgcg

SEQ ID NO: 349013 - RNA, 13 nt, Bordetella pertussis
cgccaccguggcc

SEQ ID NO: 349014 - RNA, 20 nt, Bordetella pertussis
cgccaccucggcgucgcccg

SEQ ID NO: 349015 - RNA, 15 nt, Bordetella pertussis
cgccaccuggcgccc

SEQ ID NO: 349016 - RNA, 16 nt, Bordetella pertussis
cgccaccuggcgcccg

SEQ ID NO: 349017 - RNA, 20 nt, Bordetella pertussis
cgccaccuggcgcccggcgg

SEQ ID NO: 349018 - RNA, 22 nt, Bordetella pertussis
cgccaccugggccgccugcugg

SEQ ID NO: 349019 - RNA, 20 nt, Bordetella pertussis
cgccacgacguagucggcgc

SEQ ID NO: 349020 - RNA, 21 nt, Bordetella pertussis
cgccacgacguagucggcgcc

SEQ ID NO: 349021 - RNA, 17 nt, Bordetella pertussis
cgccacgcccgucccga

SEQ ID NO: 349022 - RNA, 18 nt, Bordetella pertussis
cgccacgcccgucucgcg

SEQ ID NO: 349023 - RNA, 14 nt, Bordetella pertussis
cgccacgcccuggc

SEQ ID NO: 349024 - RNA, 20 nt, Bordetella pertussis
cgccacgcccuggcagcugg

SEQ ID NO: 349025 - RNA, 21 nt, Bordetella pertussis
cgccacgcccuggcagcuggc

SEQ ID NO: 349026 - RNA, 14 nt, Bordetella pertussis
cgccacgccggcca

SEQ ID NO: 349027 - RNA, 16 nt, Bordetella pertussis
cgccacgccggccacg

SEQ ID NO: 349028 - RNA, 17 nt, Bordetella pertussis
cgccacgccggccacga

SEQ ID NO: 349029 - RNA, 15 nt, Bordetella pertussis
cgccacgccggccag

SEQ ID NO: 349030 - RNA, 17 nt, Bordetella pertussis
cgccacgccggccagcu

SEQ ID NO: 349031 - RNA, 19 nt, Bordetella pertussis
cgccacgccgucagcgaca

SEQ ID NO: 349032 - RNA, 12 nt, Bordetella pertussis
cgccacgcgcac

SEQ ID NO: 349033 - RNA, 18 nt, Bordetella pertussis
cgccacgcgcacggccag

SEQ ID NO: 349034 - RNA, 12 nt, Bordetella pertussis
cgccacgcgcgg

SEQ ID NO: 349035 - RNA, 13 nt, Bordetella pertussis
cgccacgcgggcc

SEQ ID NO: 349036 - RNA, 14 nt, Bordetella pertussis
cgccacgcgggccg

SEQ ID NO: 349037 - RNA, 18 nt, Bordetella pertussis
cgccacgcuggccgcgcu

SEQ ID NO: 349038 - RNA, 22 nt, Bordetella pertussis
cgccacggcgaugaacagcggc

SEQ ID NO: 349039 - RNA, 23 nt, Bordetella pertussis
cgccacggcgaugaacagcggca

SEQ ID NO: 349040 - RNA, 19 nt, Bordetella pertussis
cgccacggcgucgccggcc

SEQ ID NO: 349041 - RNA, 20 nt, Bordetella pertussis
cgccacggcgucgccggcca

SEQ ID NO: 349042 - RNA, 23 nt, Bordetella pertussis
cgccacggcgucgccggccaggc

SEQ ID NO: 349043 - RNA, 20 nt, Bordetella pertussis
cgccacggcuucgcccagcg

SEQ ID NO: 349044 - RNA, 17 nt, Bordetella pertussis
cgccacgggcccgcgca

SEQ ID NO: 349045 - RNA, 19 nt, Bordetella pertussis
cgccacgggcccgcgcaga

SEQ ID NO: 349046 - RNA, 21 nt, Bordetella pertussis
cgccacgggcgucaccggcga

SEQ ID NO: 349047 - RNA, 17 nt, Bordetella pertussis
cgccacggucugcacgc

SEQ ID NO: 349048 - RNA, 14 nt, Bordetella pertussis
cgccacguccagca

SEQ ID NO: 349049 - RNA, 17 nt, Bordetella pertussis
cgccacguccagcacgg

SEQ ID NO: 349050 - RNA, 18 nt, Bordetella pertussis
cgccacguccagcacggc

SEQ ID NO: 349051 - RNA, 20 nt, Bordetella pertussis
cgccacguccagcacggccg

SEQ ID NO: 349052 - RNA, 24 nt, Bordetella pertussis
cgccacguccagcacggccgcggc

SEQ ID NO: 349053 - RNA, 22 nt, Bordetella pertussis
cgccacgucgaccucgagcacc

SEQ ID NO: 349054 - RNA, 14 nt, Bordetella pertussis
cgccacgugcacga

SEQ ID NO: 349055 - RNA, 16 nt, Bordetella pertussis
cgccacguugaagcgc

SEQ ID NO: 349056 - RNA, 13 nt, Bordetella pertussis
cgccacugccagg

SEQ ID NO: 349057 - RNA, 15 nt, Bordetella pertussis
cgccacugccaggcg

SEQ ID NO: 349058 - RNA, 13 nt, Bordetella pertussis
cgccacuuccuug

SEQ ID NO: 349059 - RNA, 19 nt, Bordetella pertussis
cgccacuucgccucggcgg

SEQ ID NO: 349060 - RNA, 21 nt, Bordetella pertussis
cgccacuucgccucggcgguu

SEQ ID NO: 349061 - RNA, 17 nt, Bordetella pertussis
cgccacuugcaggccgc

SEQ ID NO: 349062 - RNA, 19 nt, Bordetella pertussis
cgccacuugcaggccgcga

SEQ ID NO: 349063 - RNA, 19 nt, Bordetella pertussis
cgccagaaagcgcggccgg

SEQ ID NO: 349064 - RNA, 19 nt, Bordetella pertussis
cgccagaacgacagcgaca

SEQ ID NO: 349065 - RNA, 18 nt, Bordetella pertussis
cgccagaugcgccgcacg

SEQ ID NO: 349066 - RNA, 15 nt, Bordetella pertussis
cgccagcaaggcggc

SEQ ID NO: 349067 - RNA, 18 nt, Bordetella pertussis
cgccagcaaggcggcaaa

SEQ ID NO: 349068 - RNA, 23 nt, Bordetella pertussis
cgccagcaaggcgucggccaggc

SEQ ID NO: 349069 - RNA, 17 nt, Bordetella pertussis
cgccagcaccggcacgc

SEQ ID NO: 349070 - RNA, 13 nt, Bordetella pertussis
cgccagcacgcca

SEQ ID NO: 349071 - RNA, 17 nt, Bordetella pertussis
cgccagcacgcgcagcu

SEQ ID NO: 349072 - RNA, 12 nt, Bordetella pertussis
cgccagcacggc

SEQ ID NO: 349073 - RNA, 16 nt, Bordetella pertussis
cgccagcacgguggcg

SEQ ID NO: 349074 - RNA, 22 nt, Bordetella pertussis
cgccagcacgguggcgcccggc

SEQ ID NO: 349075 - RNA, 20 nt, Bordetella pertussis
cgccagcagaugauccggac

SEQ ID NO: 349076 - RNA, 21 nt, Bordetella pertussis
cgccagcagcacgucguagcg

SEQ ID NO: 349077 - RNA, 12 nt, Bordetella pertussis
cgccagcagcgc

SEQ ID NO: 349078 - RNA, 14 nt, Bordetella pertussis
cgccagcagcgccg

SEQ ID NO: 349079 - RNA, 13 nt, Bordetella pertussis
cgccagcagcggg

SEQ ID NO: 349080 - RNA, 14 nt, Bordetella pertussis
cgccagcagcgggc

SEQ ID NO: 349081 - RNA, 22 nt, Bordetella pertussis
cgccagcagcucggcgaccagg

SEQ ID NO: 349082 - RNA, 12 nt, Bordetella pertussis
cgccagcaggcc

SEQ ID NO: 349083 - RNA, 19 nt, Bordetella pertussis
cgccagcaggcccugggcg

SEQ ID NO: 349084 - RNA, 23 nt, Bordetella pertussis
cgccagcaggcccugggcgaggu

SEQ ID NO: 349085 - RNA, 15 nt, Bordetella pertussis
cgccagcaggcgaaa

SEQ ID NO: 349086 - RNA, 14 nt, Bordetella pertussis
cgccagcaggcgcu

SEQ ID NO: 349087 - RNA, 21 nt, Bordetella pertussis
cgccagcagggucagcggccg

SEQ ID NO: 349088 - RNA, 23 nt, Bordetella pertussis
cgccagcagggucagcggccggc

SEQ ID NO: 349089 - RNA, 12 nt, Bordetella pertussis
cgccagcaugac

SEQ ID NO: 349090 - RNA, 22 nt, Bordetella pertussis
cgccagcaugaucaugccgcug

SEQ ID NO: 349091 - RNA, 23 nt, Bordetella pertussis
cgccagcaugaucaugccgcugc

SEQ ID NO: 349092 - RNA, 16 nt, Bordetella pertussis
cgccagcaugcgcgcg

SEQ ID NO: 349093 - RNA, 23 nt, Bordetella pertussis
cgccagcaugcgcgcggccucga

SEQ ID NO: 349094 - RNA, 15 nt, Bordetella pertussis
cgccagcauggcggc

SEQ ID NO: 349095 - RNA, 19 nt, Bordetella pertussis
cgccagcauggcggccagg

SEQ ID NO: 349096 - RNA, 20 nt, Bordetella pertussis
cgccagcauggcggccaggc

SEQ ID NO: 349097 - RNA, 21 nt, Bordetella pertussis
cgccagcauggcggccaggcg

SEQ ID NO: 349098 - RNA, 23 nt, Bordetella pertussis
cgccagcauggcggccaggcgcg

SEQ ID NO: 349099 - RNA, 17 nt, Bordetella pertussis
cgccagcauggcgucga

SEQ ID NO: 349100 - RNA, 23 nt, Bordetella pertussis
cgccagcaugacggggucggggc

SEQ ID NO: 349101 - RNA, 16 nt, Bordetella pertussis
cgccagccaccccguc

SEQ ID NO: 349102 - RNA, 20 nt, Bordetella pertussis
cgccagccaccccgucaucg

SEQ ID NO: 349103 - RNA, 23 nt, Bordetella pertussis
cgccagccaccccgucaucgccg

SEQ ID NO: 349104 - RNA, 15 nt, Bordetella pertussis
cgccagccacgcgcg

SEQ ID NO: 349105 - RNA, 17 nt, Bordetella pertussis
cgccagccagcgcaugc

SEQ ID NO: 349106 - RNA, 15 nt, Bordetella pertussis
cgccagcccgacggc

SEQ ID NO: 349107 - RNA, 17 nt, Bordetella pertussis
cgccagcccgacggcca

SEQ ID NO: 349108 - RNA, 18 nt, Bordetella pertussis
cgccagcccgacggccag

SEQ ID NO: 349109 - RNA, 20 nt, Bordetella pertussis
cgccagcccgacggccagcg

SEQ ID NO: 349110 - RNA, 23 nt, Bordetella pertussis
cgccagcccgaggcacaaggccg

SEQ ID NO: 349111 - RNA, 14 nt, Bordetella pertussis
cgccagcccgcccg

SEQ ID NO: 349112 - RNA, 17 nt, Bordetella pertussis
cgccagcccgccggcgc

SEQ ID NO: 349113 - RNA, 16 nt, Bordetella pertussis
cgccagcccgcugccg

SEQ ID NO: 349114 - RNA, 13 nt, Bordetella pertussis
cgccagccgcgcg

SEQ ID NO: 349115 - RNA, 17 nt, Bordetella pertussis
cgccagccgcgcgaaca

SEQ ID NO: 349116 - RNA, 17 nt, Bordetella pertussis
cgccagccgcgcgaccu

SEQ ID NO: 349117 - RNA, 13 nt, Bordetella pertussis
cgccagccgcucc

SEQ ID NO: 349118 - RNA, 13 nt, Bordetella pertussis
cgccagccgcugg

SEQ ID NO: 349119 - RNA, 16 nt, Bordetella pertussis
cgccagccgcuggcgc

SEQ ID NO: 349120 - RNA, 12 nt, Bordetella pertussis
cgccagccgcuu

SEQ ID NO: 349121 - RNA, 13 nt, Bordetella pertussis
cgccagccggccc

SEQ ID NO: 349122 - RNA, 16 nt, Bordetella pertussis
cgccagccggcccagc

SEQ ID NO: 349123 - RNA, 17 nt, Bordetella pertussis
cgccagccggcccagca

SEQ ID NO: 349124 - RNA, 19 nt, Bordetella pertussis
cgccagccguugcgccagc

SEQ ID NO: 349125 - RNA, 21 nt, Bordetella pertussis
cgccagcgaaauacgcgacag

SEQ ID NO: 349126 - RNA, 12 nt, Bordetella pertussis
cgccagcgacga

SEQ ID NO: 349127 - RNA, 12 nt, Bordetella pertussis
cgccagcgccau

SEQ ID NO: 349128 - RNA, 16 nt, Bordetella pertussis
cgccagcgccccggcg

SEQ ID NO: 349129 - RNA, 22 nt, Bordetella pertussis
cgccagcgccgcgcgcgugccg

SEQ ID NO: 349130 - RNA, 16 nt, Bordetella pertussis
cgccagcgccggcgcg

SEQ ID NO: 349131 - RNA, 14 nt, Bordetella pertussis
cgccagcgccucgc

SEQ ID NO: 349132 - RNA, 17 nt, Bordetella pertussis
cgccagcgccuggguca

SEQ ID NO: 349133 - RNA, 22 nt, Bordetella pertussis
cgccagcgccugggucaggucg

SEQ ID NO: 349134 - RNA, 21 nt, Bordetella pertussis
cgccagcgcgaaaacccgcgg

SEQ ID NO: 349135 - RNA, 17 nt, Bordetella pertussis
cgccagcgcggccagcg

SEQ ID NO: 349136 - RNA, 15 nt, Bordetella pertussis
cgccagcgcgcgcga

SEQ ID NO: 349137 - RNA, 19 nt, Bordetella pertussis
cgccagcgcggcgggccgg

SEQ ID NO: 349138 - RNA, 15 nt, Bordetella pertussis
cgccagcgcggcuug

SEQ ID NO: 349139 - RNA, 16 nt, Bordetella pertussis
cgccagcgcggcuugg

SEQ ID NO: 349140 - RNA, 13 nt, Bordetella pertussis
cgccagcgcgucg

SEQ ID NO: 349141 - RNA, 15 nt, Bordetella pertussis
cgccagcgcgucgcg

SEQ ID NO: 349142 - RNA, 19 nt, Bordetella pertussis
cgccagcgcgucguccagc

SEQ ID NO: 349143 - RNA, 17 nt, Bordetella pertussis
cgccagcgcuguccagg

SEQ ID NO: 349144 - RNA, 18 nt, Bordetella pertussis
cgccagcgcuguccaggc

SEQ ID NO: 349145 - RNA, 21 nt, Bordetella pertussis
cgccagcgcuguccaggccgg

SEQ ID NO: 349146 - RNA, 22 nt, Bordetella pertussis
cgccagcgcuguccaggccggg

SEQ ID NO: 349147 - RNA, 23 nt, Bordetella pertussis
cgccagcgcuucgggcagcucgc

SEQ ID NO: 349148 - RNA, 24 nt, Bordetella pertussis
cgccagcggauggugcucggcgau

SEQ ID NO: 349149 - RNA, 15 nt, Bordetella pertussis
cgccagcggcagcgc

SEQ ID NO: 349150 - RNA, 19 nt, Bordetella pertussis
cgccagcggcagcgcgcag

SEQ ID NO: 349151 - RNA, 21 nt, Bordetella pertussis
cgccagcggcauugcccaggu

SEQ ID NO: 349152 - RNA, 19 nt, Bordetella pertussis
cgccagcggccgucgccuu

SEQ ID NO: 349153 - RNA, 22 nt, Bordetella pertussis
cgccagcggcgacugccccagc

SEQ ID NO: 349154 - RNA, 23 nt, Bordetella pertussis
cgccagcggcugcuugagcagcc

SEQ ID NO: 349155 - RNA, 18 nt, Bordetella pertussis
cgccagcggcuggcgccg

SEQ ID NO: 349156 - RNA, 19 nt, Bordetella pertussis
cgccagcguaucgccgccg

SEQ ID NO: 349157 - RNA, 20 nt, Bordetella pertussis
cgccagcguggccgaggugc

SEQ ID NO: 349158 - RNA, 17 nt, Bordetella pertussis
cgccagcuccagccgca

SEQ ID NO: 349159 - RNA, 18 nt, Bordetella pertussis
cgccagcucgcgcagcag

SEQ ID NO: 349160 - RNA, 21 nt, Bordetella pertussis
cgccagcucgcguugcaccgc

SEQ ID NO: 349161 - RNA, 14 nt, Bordetella pertussis
cgccagcucggcca

SEQ ID NO: 349162 - RNA, 15 nt, Bordetella pertussis
cgccagcucggccaa

SEQ ID NO: 349163 - RNA, 16 nt, Bordetella pertussis
cgccagcucggccaag

SEQ ID NO: 349164 - RNA, 17 nt, Bordetella pertussis
cgccagcucggccugcg

SEQ ID NO: 349165 - RNA, 21 nt, Bordetella pertussis
cgccagcucuucgagcgcggc

SEQ ID NO: 349166 - RNA, 22 nt, Bordetella pertussis
cgccagcucuucgagcgcggcg

SEQ ID NO: 349167 - RNA, 12 nt, Bordetella pertussis
cgccagcugacc

SEQ ID NO: 349168 - RNA, 22 nt, Bordetella pertussis
cgccagcugaccucgcccaggc

SEQ ID NO: 349169 - RNA, 17 nt, Bordetella pertussis
cgccagcugcgcagcga

SEQ ID NO: 349170 - RNA, 19 nt, Bordetella pertussis
cgccagcuggaccgccugg

SEQ ID NO: 349171 - RNA, 13 nt, Bordetella pertussis
cgccagcugggcg

SEQ ID NO: 349172 - RNA, 15 nt, Bordetella pertussis
cgccagcuugcgcgc

SEQ ID NO: 349173 - RNA, 16 nt, Bordetella pertussis
cgccagcuuggccagg

SEQ ID NO: 349174 - RNA, 16 nt, Bordetella pertussis
cgccaggaacagcgcc

SEQ ID NO: 349175 - RNA, 22 nt, Bordetella pertussis
cgccaggaacagcgccggcagc

SEQ ID NO: 349176 - RNA, 20 nt, Bordetella pertussis
cgccaggaagaucggcccgg

SEQ ID NO: 349177 - RNA, 21 nt, Bordetella pertussis
cgccaggaagaucggcccggc

SEQ ID NO: 349178 - RNA, 23 nt, Bordetella pertussis
cgccaggaagaucggcccggcgc

SEQ ID NO: 349179 - RNA, 18 nt, Bordetella pertussis
cgccaggaagccgugcgc

SEQ ID NO: 349180 - RNA, 18 nt, Bordetella pertussis
cgccaggaagcgggccug

SEQ ID NO: 349181 - RNA, 22 nt, Bordetella pertussis
cgccaggauggccacgaccacc

SEQ ID NO: 349182 - RNA, 23 nt, Bordetella pertussis
cgccaggauggccacgaccacca

SEQ ID NO: 349183 - RNA, 20 nt, Bordetella pertussis
cgccaggcaaaggcccaggc

SEQ ID NO: 349184 - RNA, 22 nt, Bordetella pertussis
cgccaggcauucucggacaggu

SEQ ID NO: 349185 - RNA, 22 nt, Bordetella pertussis
cgccaggcauugaagcuggcgc

SEQ ID NO: 349186 - RNA, 22 nt, Bordetella pertussis
cgccaggccaaaaaaaaccggc

SEQ ID NO: 349187 - RNA, 15 nt, Bordetella pertussis
cgccaggccccgccg

SEQ ID NO: 349188 - RNA, 17 nt, Bordetella pertussis
cgccaggccccgccggg

SEQ ID NO: 349189 - RNA, 19 nt, Bordetella pertussis
cgccaggccccgccgggcc

SEQ ID NO: 349190 - RNA, 20 nt, Bordetella pertussis
cgccaggccccgccgggccg

SEQ ID NO: 349191 - RNA, 14 nt, Bordetella pertussis
cgccaggccgcgca

SEQ ID NO: 349192 - RNA, 16 nt, Bordetella pertussis
cgccaggccggcggcg

SEQ ID NO: 349193 - RNA, 12 nt, Bordetella pertussis
cgccaggccuuc

SEQ ID NO: 349194 - RNA, 22 nt, Bordetella pertussis
cgccaggccuucgacguccagc

SEQ ID NO: 349195 - RNA, 19 nt, Bordetella pertussis
cgccaggcgcgaucgaacg

SEQ ID NO: 349196 - RNA, 13 nt, Bordetella pertussis
cgccaggcgcgca

SEQ ID NO: 349197 - RNA, 22 nt, Bordetella pertussis
cgccaggcgcgcaucgcgcggc

SEQ ID NO: 349198 - RNA, 20 nt, Bordetella pertussis
cgccaggcgcauguccgcca

SEQ ID NO: 349199 - RNA, 19 nt, Bordetella pertussis
cgccaggcgcucggcguug

SEQ ID NO: 349200 - RNA, 18 nt, Bordetella pertussis
cgccaggcgguacaggcc

SEQ ID NO: 349201 - RNA, 20 nt, Bordetella pertussis
cgccaggcgguacaggccgg

SEQ ID NO: 349202 - RNA, 19 nt, Bordetella pertussis
cgccaggcugaaugccgcc

SEQ ID NO: 349203 - RNA, 19 nt, Bordetella pertussis
cgccaggcguugaccuggu

SEQ ID NO: 349204 - RNA, 12 nt, Bordetella pertussis
cgccaggcuguc

SEQ ID NO: 349205 - RNA, 17 nt, Bordetella pertussis
cgccagggccaggccgc

SEQ ID NO: 349206 - RNA, 18 nt, Bordetella pertussis
cgccagggccaggccgcc

SEQ ID NO: 349207 - RNA, 19 nt, Bordetella pertussis
cgccagggccaggccgccg

SEQ ID NO: 349208 - RNA, 20 nt, Bordetella pertussis
cgccagggccaggccgccgc

SEQ ID NO: 349209 - RNA, 14 nt, Bordetella pertussis
cgccagggccaugu

SEQ ID NO: 349210 - RNA, 22 nt, Bordetella pertussis
cgccagggccauguggcgcagc

SEQ ID NO: 349211 - RNA, 14 nt, Bordetella pertussis
cgccagggccccuc

SEQ ID NO: 349212 - RNA, 15 nt, Bordetella pertussis
cgccagggccccucc

SEQ ID NO: 349213 - RNA, 19 nt, Bordetella pertussis
cgccagggccccuccggcg

SEQ ID NO: 349214 - RNA, 15 nt, Bordetella pertussis
cgccagggccgagcc

SEQ ID NO: 349215 - RNA, 16 nt, Bordetella pertussis
cgccagggcgaugacc

SEQ ID NO: 349216 - RNA, 13 nt, Bordetella pertussis
cgccagggcgccg

SEQ ID NO: 349217 - RNA, 15 nt, Bordetella pertussis
cgccagggcgcggau

SEQ ID NO: 349218 - RNA, 15 nt, Bordetella pertussis
cgccagggcggggcc

SEQ ID NO: 349219 - RNA, 16 nt, Bordetella pertussis
cgccagggcggggccg

SEQ ID NO: 349220 - RNA, 16 nt, Bordetella pertussis
cgccagggucugcugg

SEQ ID NO: 349221 - RNA, 21 nt, Bordetella pertussis
cgccagggucugcuggucgcg

SEQ ID NO: 349222 - RNA, 17 nt, Bordetella pertussis
cgccagguagcgggugg

SEQ ID NO: 349223 - RNA, 19 nt, Bordetella pertussis
cgccagguaggccggcgcg

SEQ ID NO: 349224 - RNA, 20 nt, Bordetella pertussis
cgccaggucggccaccgccg

SEQ ID NO: 349225 - RNA, 21 nt, Bordetella pertussis
cgccaggucggccaccgccgu

SEQ ID NO: 349226 - RNA, 23 nt, Bordetella pertussis
cgccaggucggccaccgccgugg

SEQ ID NO: 349227 - RNA, 16 nt, Bordetella pertussis
cgccaggucggccagc

SEQ ID NO: 349228 - RNA, 19 nt, Bordetella pertussis
cgccaggucggccagccgg

SEQ ID NO: 349229 - RNA, 22 nt, Bordetella pertussis
cgccaggucggccagccggccg

SEQ ID NO: 349230 - RNA, 18 nt, Bordetella pertussis
cgccaggugggccaggua

SEQ ID NO: 349231 - RNA, 16 nt, Bordetella pertussis
cgccagguucgccugg

SEQ ID NO: 349232 - RNA, 17 nt, Bordetella pertussis
cgccagguucgccuggc

SEQ ID NO: 349233 - RNA, 20 nt, Bordetella pertussis
cgccagguugcgguaguuca

SEQ ID NO: 349234 - RNA, 14 nt, Bordetella pertussis
cgccaguccagcgc

SEQ ID NO: 349235 - RNA, 18 nt, Bordetella pertussis
cgccaguccagcgcgccg

SEQ ID NO: 349236 - RNA, 21 nt, Bordetella pertussis
cgccaguccccaugcggggac

SEQ ID NO: 349237 - RNA, 16 nt, Bordetella pertussis
cgccagucgcgcagca

SEQ ID NO: 349238 - RNA, 16 nt, Bordetella pertussis
cgccaguucaaggcgc

SEQ ID NO: 349239 - RNA, 22 nt, Bordetella pertussis
cgccaguucgaguuccgcgacg

SEQ ID NO: 349240 - RNA, 16 nt, Bordetella pertussis
cgccaguugcgcaccg

SEQ ID NO: 349241 - RNA, 16 nt, Bordetella pertussis
cgccaguugcggggcg

SEQ ID NO: 349242 - RNA, 22 nt, Bordetella pertussis
cgccaguuguagguccaguaca

SEQ ID NO: 349243 - RNA, 14 nt, Bordetella pertussis
cgccauacccgguc

SEQ ID NO: 349244 - RNA, 22 nt, Bordetella pertussis
cgccauaccgaucuacgacgcc

SEQ ID NO: 349245 - RNA, 20 nt, Bordetella pertussis
cgccauacugcaugauggcc

SEQ ID NO: 349246 - RNA, 15 nt, Bordetella pertussis
cgccauaggcgcgca

SEQ ID NO: 349247 - RNA, 18 nt, Bordetella pertussis
cgccauaggcgcgcacca

SEQ ID NO: 349248 - RNA, 14 nt, Bordetella pertussis
cgccauagcugcgc

SEQ ID NO: 349249 - RNA, 21 nt, Bordetella pertussis
cgccauauugaugcagcacgu

SEQ ID NO: 349250 - RNA, 23 nt, Bordetella pertussis
cgccaucauggcgucggccacgu

SEQ ID NO: 349251 - RNA, 17 nt, Bordetella pertussis
cgccauccggcgcauga

SEQ ID NO: 349252 - RNA, 21 nt, Bordetella pertussis
cgccaucgacgcuugccggcg

SEQ ID NO: 349253 - RNA, 23 nt, Bordetella pertussis
cgccaucgacgcuugccggcgau

SEQ ID NO: 349254 - RNA, 15 nt, Bordetella pertussis
cgccaucgacgggcg

SEQ ID NO: 349255 - RNA, 17 nt, Bordetella pertussis
cgccaucgacgggcggc

SEQ ID NO: 349256 - RNA, 18 nt, Bordetella pertussis
cgccaucgacgggcggcu

SEQ ID NO: 349257 - RNA, 13 nt, Bordetella pertussis
cgccaucgccagg

SEQ ID NO: 349258 - RNA, 16 nt, Bordetella pertussis
cgccaucgcgucgacg

SEQ ID NO: 349259 - RNA, 18 nt, Bordetella pertussis
cgccaucggucucuucga

SEQ ID NO: 349260 - RNA, 19 nt, Bordetella pertussis
cgccaucgucguagcgcca

SEQ ID NO: 349261 - RNA, 22 nt, Bordetella pertussis
cgccaucuaccugucgggcggc

SEQ ID NO: 349262 - RNA, 14 nt, Bordetella pertussis
cgccaucugcugcg

SEQ ID NO: 349263 - RNA, 16 nt, Bordetella pertussis
cgccaucuugcaggcg

SEQ ID NO: 349264 - RNA, 19 nt, Bordetella pertussis
cgccaucuugcaggcgcca

SEQ ID NO: 349265 - RNA, 17 nt, Bordetella pertussis
cgccaugaaagcgaaca

SEQ ID NO: 349266 - RNA, 21 nt, Bordetella pertussis
cgccaugaacgcuugacggcc

SEQ ID NO: 349267 - RNA, 20 nt, Bordetella pertussis
cgccaugaacucgcgcucgg

SEQ ID NO: 349268 - RNA, 18 nt, Bordetella pertussis
cgccaugacaugcgggcc

SEQ ID NO: 349269 - RNA, 14 nt, Bordetella pertussis
cgccaugacgcugg

SEQ ID NO: 349270 - RNA, 18 nt, Bordetella pertussis
cgccaugacgcuggucga

SEQ ID NO: 349271 - RNA, 18 nt, Bordetella pertussis
cgccaugaugucgcgcgc

SEQ ID NO: 349272 - RNA, 20 nt, Bordetella pertussis
cgccaugaugucgcgcgccu

SEQ ID NO: 349273 - RNA, 22 nt, Bordetella pertussis
cgccaugaugucgcgcgccugc

SEQ ID NO: 349274 - RNA, 14 nt, Bordetella pertussis
cgccaugcagcugg

SEQ ID NO: 349275 - RNA, 22 nt, Bordetella pertussis
cgccaugcagcuggauggccug

SEQ ID NO: 349276 - RNA, 13 nt, Bordetella pertussis
cgccaugccgcgc

SEQ ID NO: 349277 - RNA, 14 nt, Bordetella pertussis
cgccaugccgcgcc

SEQ ID NO: 349278 - RNA, 16 nt, Bordetella pertussis
cgccaugccgcgcccg

SEQ ID NO: 349279 - RNA, 17 nt, Bordetella pertussis
cgccaugaucgccggca

SEQ ID NO: 349280 - RNA, 18 nt, Bordetella pertussis
cgccaugaucgccggcaa

SEQ ID NO: 349281 - RNA, 14 nt, Bordetella pertussis
cgccaugccggccc

SEQ ID NO: 349282 - RNA, 14 nt, Bordetella pertussis
cgccaugcgccagc

SEQ ID NO: 349283 - RNA, 15 nt, Bordetella pertussis
cgccaugcgccagca

SEQ ID NO: 349284 - RNA, 16 nt, Bordetella pertussis
cgccaugcgccagcag

SEQ ID NO: 349285 - RNA, 15 nt, Bordetella pertussis
cgccaugcgcccggc

SEQ ID NO: 349286 - RNA, 16 nt, Bordetella pertussis
cgccaugcgcccggcc

SEQ ID NO: 349287 - RNA, 21 nt, Bordetella pertussis
cgccaugcgcccggccaccgc

SEQ ID NO: 349288 - RNA, 20 nt, Bordetella pertussis
cgccaugcgacagcccggga

SEQ ID NO: 349289 - RNA, 16 nt, Bordetella pertussis
cgccaugcgcauggcc

SEQ ID NO: 349290 - RNA, 18 nt, Bordetella pertussis
cgccaugcgcauggccag

SEQ ID NO: 349291 - RNA, 15 nt, Bordetella pertussis
cgccaugcggcuggc

SEQ ID NO: 349292 - RNA, 18 nt, Bordetella pertussis
cgccaugcggcuggccga

SEQ ID NO: 349293 - RNA, 23 nt, Bordetella pertussis
cgccaugcucgcgcacagcgcgc

SEQ ID NO: 349294 - RNA, 15 nt, Bordetella pertussis
cgccaugcggcgcca

SEQ ID NO: 349295 - RNA, 22 nt, Bordetella pertussis
cgccaugcugccaaccgcgacg

SEQ ID NO: 349296 - RNA, 16 nt, Bordetella pertussis
cgccaugcuggccgcc

SEQ ID NO: 349297 - RNA, 17 nt, Bordetella pertussis
cgccaugcuggccgccg

SEQ ID NO: 349298 - RNA, 17 nt, Bordetella pertussis
cgccauggaggcgcagc

SEQ ID NO: 349299 - RNA, 19 nt, Bordetella pertussis
cgccauggaggcgcagcgc

SEQ ID NO: 349300 - RNA, 21 nt, Bordetella pertussis
cgccauggaggcgcagcgcgg

SEQ ID NO: 349301 - RNA, 13 nt, Bordetella pertussis
cgccauggccggc

SEQ ID NO: 349302 - RNA, 14 nt, Bordetella pertussis
cgccauggccggcc

SEQ ID NO: 349303 - RNA, 15 nt, Bordetella pertussis
cgccauggccggccg

SEQ ID NO: 349304 - RNA, 17 nt, Bordetella pertussis
cgccauggccggcguug

SEQ ID NO: 349305 - RNA, 14 nt, Bordetella pertussis
cgccauggcgcgca

SEQ ID NO: 349306 - RNA, 16 nt, Bordetella pertussis
cgccauggcgcgcaga

SEQ ID NO: 349307 - RNA, 13 nt, Bordetella pertussis
cgccauggcgcug

SEQ ID NO: 349308 - RNA, 12 nt, Bordetella pertussis
cgccauggcggc

SEQ ID NO: 349309 - RNA, 14 nt, Bordetella pertussis
cgccauggcggccg

SEQ ID NO: 349310 - RNA, 20 nt, Bordetella pertussis
cgccauggcggccgccgcca

SEQ ID NO: 349311 - RNA, 17 nt, Bordetella pertussis
cgccauggucucgucca

SEQ ID NO: 349312 - RNA, 21 nt, Bordetella pertussis
cgccauggugaacggccccgc

SEQ ID NO: 349313 - RNA, 20 nt, Bordetella pertussis
cgccauguauaacguggcgc

SEQ ID NO: 349314 - RNA, 21 nt, Bordetella pertussis
cgccauguauaacguggcgcg

SEQ ID NO: 349315 - RNA, 23 nt, Bordetella pertussis
cgccauguauaacguggcgcgca

SEQ ID NO: 349316 - RNA, 14 nt, Bordetella pertussis
cgccaugugcgccg

SEQ ID NO: 349317 - RNA, 18 nt, Bordetella pertussis
cgccaugugcgccgcgcc

SEQ ID NO: 349318 - RNA, 15 nt, Bordetella pertussis
cgccauguggcgacg

SEQ ID NO: 349319 - RNA, 23 nt, Bordetella pertussis
cgccauguucagcuucagccugg

SEQ ID NO: 349320 - RNA, 20 nt, Bordetella pertussis
cgccauugccacggcgggcc

SEQ ID NO: 349321 - RNA, 23 nt, Bordetella pertussis
cgccauugccacggcgggccggc

SEQ ID NO: 349322 - RNA, 14 nt, Bordetella pertussis
cgccauugcacgcg

SEQ ID NO: 349323 - RNA, 23 nt, Bordetella pertussis
cgccauugcggggauguuccggc

SEQ ID NO: 349324 - RNA, 15 nt, Bordetella pertussis
cgcccaacccggcga

SEQ ID NO: 349325 - RNA, 19 nt, Bordetella pertussis
cgcccaacccggcgaggcc

SEQ ID NO: 349326 - RNA, 21 nt, Bordetella pertussis
cgcccaagucgaguucggcgc

SEQ ID NO: 349327 - RNA, 21 nt, Bordetella pertussis
cgcccaaucgggcagcacgcg

SEQ ID NO: 349328 - RNA, 23 nt, Bordetella pertussis
cgcccaaucgggcagcacgcgca

SEQ ID NO: 349329 - RNA, 21 nt, Bordetella pertussis
cgcccacauagaccggcugca

SEQ ID NO: 349330 - RNA, 16 nt, Bordetella pertussis
cgcccacauagcggcc

SEQ ID NO: 349331 - RNA, 17 nt, Bordetella pertussis
cgcccacauagcggccg

SEQ ID NO: 349332 - RNA, 21 nt, Bordetella pertussis
cgcccaccaccagcgcggcca

SEQ ID NO: 349333 - RNA, 22 nt, Bordetella pertussis
cgcccaccaugagcacgcccca

SEQ ID NO: 349334 - RNA, 16 nt, Bordetella pertussis
cgcccaccgagacgcu

SEQ ID NO: 349335 - RNA, 14 nt, Bordetella pertussis
cgcccaccgugacc

SEQ ID NO: 349336 - RNA, 17 nt, Bordetella pertussis
cgcccaccgugaccagc

SEQ ID NO: 349337 - RNA, 17 nt, Bordetella pertussis
cgcccacgaucaccacg

SEQ ID NO: 349338 - RNA, 13 nt, Bordetella pertussis
cgcccacgcacau

SEQ ID NO: 349339 - RNA, 23 nt, Bordetella pertussis
cgcccacgccgaauacgcucagg

SEQ ID NO: 349340 - RNA, 18 nt, Bordetella pertussis
cgcccacgccgccuggcc

SEQ ID NO: 349341 - RNA, 13 nt, Bordetella pertussis
cgcccacgccgcu

SEQ ID NO: 349342 - RNA, 16 nt, Bordetella pertussis
cgcccacgcgccgcca

SEQ ID NO: 349343 - RNA, 18 nt, Bordetella pertussis
cgcccacgcgccgccagg

SEQ ID NO: 349344 - RNA, 14 nt, Bordetella pertussis
cgcccacggccgca

SEQ ID NO: 349345 - RNA, 16 nt, Bordetella pertussis
cgcccacggccgcaug

SEQ ID NO: 349346 - RNA, 14 nt, Bordetella pertussis
cgcccacugccagg

SEQ ID NO: 349347 - RNA, 17 nt, Bordetella pertussis
cgcccacugccaggcga

SEQ ID NO: 349348 - RNA, 21 nt, Bordetella pertussis
cgcccacugccaggcgagcgc

SEQ ID NO: 349349 - RNA, 23 nt, Bordetella pertussis
cgcccacugccaggcgagcgccg

SEQ ID NO: 349350 - RNA, 15 nt, Bordetella pertussis
cgcccagaaugcggc

SEQ ID NO: 349351 - RNA, 17 nt, Bordetella pertussis
cgcccagauggccgaau

SEQ ID NO: 349352 - RNA, 19 nt, Bordetella pertussis
cgcccagcaccucgacgca

SEQ ID NO: 349353 - RNA, 21 nt, Bordetella pertussis
cgcccagcaccucgacgcagc

SEQ ID NO: 349354 - RNA, 14 nt, Bordetella pertussis
cgcccagcagcgcc

SEQ ID NO: 349355 - RNA, 17 nt, Bordetella pertussis
cgcccagcagcgccacc

SEQ ID NO: 349356 - RNA, 16 nt, Bordetella pertussis
cgccgacuucagacag

SEQ ID NO: 349357 - RNA, 16 nt, Bordetella pertussis
cgccgagaaauccagc

SEQ ID NO: 349358 - RNA, 20 nt, Bordetella pertussis
cgccgagaaauccagcgcgc

SEQ ID NO: 349359 - RNA, 23 nt, Bordetella pertussis
cgccgagaaauccagcgcgccca

SEQ ID NO: 349360 - RNA, 21 nt, Bordetella pertussis
cgccgagaagauuucccagag

SEQ ID NO: 349361 - RNA, 14 nt, Bordetella pertussis
cgccgagauggacg

SEQ ID NO: 349362 - RNA, 15 nt, Bordetella pertussis
cgccgaggcggucga

SEQ ID NO: 349363 - RNA, 19 nt, Bordetella pertussis
cgccgaggcggugggcagg

SEQ ID NO: 349364 - RNA, 16 nt, Bordetella pertussis
cgccgagggccgcgcg

SEQ ID NO: 349365 - RNA, 15 nt, Bordetella pertussis
cgccgauaccacgcg

SEQ ID NO: 349366 - RNA, 17 nt, Bordetella pertussis
cgccgauaccacgcgcg

SEQ ID NO: 349367 - RNA, 19 nt, Bordetella pertussis
cgccgauaccacgcgcggc

SEQ ID NO: 349368 - RNA, 22 nt, Bordetella pertussis
cgccgaucaccacgggcacgau

SEQ ID NO: 349369 - RNA, 17 nt, Bordetella pertussis
cgccgaucagcaggucg

SEQ ID NO: 349370 - RNA, 22 nt, Bordetella pertussis
cgccgaucagcaggucggcgcg

SEQ ID NO: 349371 - RNA, 24 nt, Bordetella pertussis
cgccgaucagcaggucggcgcggc

SEQ ID NO: 349372 - RNA, 23 nt, Bordetella pertussis
cgccgauccagcccaccgcgaac

SEQ ID NO: 349373 - RNA, 17 nt, Bordetella pertussis
cgccgauugaggccagc

SEQ ID NO: 349374 - RNA, 18 nt, Bordetella pertussis
cgccgauugaggccagca

SEQ ID NO: 349375 - RNA, 18 nt, Bordetella pertussis
cgccgauuucgccgccgc

SEQ ID NO: 349376 - RNA, 16 nt, Bordetella pertussis
cgccgcaacgccgccg

SEQ ID NO: 349377 - RNA, 16 nt, Bordetella pertussis
cgccgcaacgccgggc

SEQ ID NO: 349378 - RNA, 14 nt, Bordetella pertussis
cgccgcaagacggc

SEQ ID NO: 349379 - RNA, 16 nt, Bordetella pertussis
cgccgcaagacggcgu

SEQ ID NO: 349380 - RNA, 16 nt, Bordetella pertussis
cgccgcaacaggcagc

SEQ ID NO: 349381 - RNA, 23 nt, Bordetella pertussis
cgccgcaauagaucauccaggug

SEQ ID NO: 349382 - RNA, 13 nt, Bordetella pertussis
cgccgcacaucgu

SEQ ID NO: 349383 - RNA, 18 nt, Bordetella pertussis
cgccgcacaucgucgacg

SEQ ID NO: 349384 - RNA, 16 nt, Bordetella pertussis
cgccgcaccagccuga

SEQ ID NO: 349385 - RNA, 16 nt, Bordetella pertussis
cgccgcaccagcgccg

SEQ ID NO: 349386 - RNA, 15 nt, Bordetella pertussis
cgccgcaccagcggc

SEQ ID NO: 349387 - RNA, 17 nt, Bordetella pertussis
cgccgcaccagcggcga

SEQ ID NO: 349388 - RNA, 13 nt, Bordetella pertussis
cgccgcacgggcg

SEQ ID NO: 349389 - RNA, 15 nt, Bordetella pertussis
cgccgcagauggcgu

SEQ ID NO: 349390 - RNA, 14 nt, Bordetella pertussis
cgccgcagcaccuc

SEQ ID NO: 349391 - RNA, 14 nt, Bordetella pertussis
cgccgcagccgcca

SEQ ID NO: 349392 - RNA, 17 nt, Bordetella pertussis
cgccgcagccgccagcg

SEQ ID NO: 349393 - RNA, 22 nt, Bordetella pertussis
cgccgcagccgccagcgccugg

SEQ ID NO: 349394 - RNA, 16 nt, Bordetella pertussis
cgccgcagcgucgcgg

SEQ ID NO: 349395 - RNA, 21 nt, Bordetella pertussis
cgccgcagcgucgcggcgucg

SEQ ID NO: 349396 - RNA, 22 nt, Bordetella pertussis
cgccgcagcgucgcggcgucga

SEQ ID NO: 349397 - RNA, 16 nt, Bordetella pertussis
cgccgcagcguggcgu

SEQ ID NO: 349398 - RNA, 20 nt, Bordetella pertussis
cgccgcagugcgcgcgcccc

SEQ ID NO: 349399 - RNA, 22 nt, Bordetella pertussis
cgccgcagugcgcgcgccccca

SEQ ID NO: 349400 - RNA, 20 nt, Bordetella pertussis
cgccgcaucauguaaggcgc

SEQ ID NO: 349401 - RNA, 15 nt, Bordetella pertussis
cgccgcaugccgggc

SEQ ID NO: 349402 - RNA, 16 nt, Bordetella pertussis
cgccgcaugccgggcu

SEQ ID NO: 349403 - RNA, 12 nt, Bordetella pertussis
cgccgcaugcgg

SEQ ID NO: 349404 - RNA, 14 nt, Bordetella pertussis
cgccgcaugcggcg

SEQ ID NO: 349405 - RNA, 14 nt, Bordetella pertussis
cgccgcaugggcgc

SEQ ID NO: 349406 - RNA, 16 nt, Bordetella pertussis
cgccgcaugggcgcgc

SEQ ID NO: 349407 - RNA, 22 nt, Bordetella pertussis
cgccgcauuuccucgaccagcg

SEQ ID NO: 349408 - RNA, 14 nt, Bordetella pertussis
cgccgccacaggcu

SEQ ID NO: 349409 - RNA, 20 nt, Bordetella pertussis
cgccgccaccagggcgcccg

SEQ ID NO: 349410 - RNA, 23 nt, Bordetella pertussis
cgccgccaccucggcgucgcccg

SEQ ID NO: 349411 - RNA, 16 nt, Bordetella pertussis
cgccgccacgcgcacg

SEQ ID NO: 349412 - RNA, 14 nt, Bordetella pertussis
cgccgccacgcugg

SEQ ID NO: 349413 - RNA, 18 nt, Bordetella pertussis
cgccgccacgcuggccgc

SEQ ID NO: 349414 - RNA, 20 nt, Bordetella pertussis
cgccgccacgcuggccgcgc

SEQ ID NO: 349415 - RNA, 12 nt, Bordetella pertussis
cgccgccagcac

SEQ ID NO: 349416 - RNA, 14 nt, Bordetella pertussis
cgccgccagcacgc

SEQ ID NO: 349417 - RNA, 18 nt, Bordetella pertussis
cgccgccagcacgccauu

SEQ ID NO: 349418 - RNA, 15 nt, Bordetella pertussis
cgccgccagcagcgc

SEQ ID NO: 349419 - RNA, 18 nt, Bordetella pertussis
cgccgccagcagcgccgg

SEQ ID NO: 349420 - RNA, 20 nt, Bordetella pertussis
cgccgccagcauggcggcca

SEQ ID NO: 349421 - RNA, 21 nt, Bordetella pertussis
cgccgccagccgcuggcgcgc

SEQ ID NO: 349422 - RNA, 18 nt, Bordetella pertussis
cgccgccagcgcgccgcc

SEQ ID NO: 349423 - RNA, 20 nt, Bordetella pertussis
cgccgccagcgcgcgcgagg

SEQ ID NO: 349424 - RNA, 20 nt, Bordetella pertussis
cgccgccaggaaaagccgcc

SEQ ID NO: 349425 - RNA, 13 nt, Bordetella pertussis
cgccgccagcgcg

SEQ ID NO: 349426 - RNA, 18 nt, Bordetella pertussis
cgccgccaggcgcgaucg

SEQ ID NO: 349427 - RNA, 22 nt, Bordetella pertussis
cgccgccauagcugcgccaauu

SEQ ID NO: 349428 - RNA, 13 nt, Bordetella pertussis
cgccgccaugcca

SEQ ID NO: 349429 - RNA, 18 nt, Bordetella pertussis
cgccgccauggcggcgcc

SEQ ID NO: 349430 - RNA, 14 nt, Bordetella pertussis
cgccgccauggucg

SEQ ID NO: 349431 - RNA, 16 nt, Bordetella pertussis
cgccgccauggucgcg

SEQ ID NO: 349432 - RNA, 21 nt, Bordetella pertussis
cgccgccauggucgcgaccac

SEQ ID NO: 349433 - RNA, 14 nt, Bordetella pertussis
cgccgcccaccacc

SEQ ID NO: 349434 - RNA, 15 nt, Bordetella pertussis
cgccgcccaccacca

SEQ ID NO: 349435 - RNA, 14 nt, Bordetella pertussis
cgccgcccacgccg

SEQ ID NO: 349436 - RNA, 15 nt, Bordetella pertussis
cgccgcccacggcga

SEQ ID NO: 349437 - RNA, 13 nt, Bordetella pertussis
cgccgcccagccg

SEQ ID NO: 349438 - RNA, 14 nt, Bordetella pertussis
cgccgcccagccgg

SEQ ID NO: 349439 - RNA, 19 nt, Bordetella pertussis
cgccgcccagccggccgau

SEQ ID NO: 349440 - RNA, 14 nt, Bordetella pertussis
cgccgcccagcgcg

SEQ ID NO: 349441 - RNA, 17 nt, Bordetella pertussis
cgccgcccacgccgcug

SEQ ID NO: 349442 - RNA, 15 nt, Bordetella pertussis
cgccgcccaugcgca

SEQ ID NO: 349443 - RNA, 17 nt, Bordetella pertussis
cgccgcccccgcccagc

SEQ ID NO: 349444 - RNA, 16 nt, Bordetella pertussis
cgccgccccgucaucg

SEQ ID NO: 349445 - RNA, 15 nt, Bordetella pertussis
cgccgcccgacagca

SEQ ID NO: 349446 - RNA, 13 nt, Bordetella pertussis
cgccgcccgcacg

SEQ ID NO: 349447 - RNA, 12 nt, Bordetella pertussis
cgccgcccgcag

SEQ ID NO: 349448 - RNA, 13 nt, Bordetella pertussis
cgccgcccgcccg

SEQ ID NO: 349449 - RNA, 20 nt, Bordetella pertussis
cgccgcccgcccgccgccug

SEQ ID NO: 349450 - RNA, 15 nt, Bordetella pertussis
cgccgcccgcggcca

SEQ ID NO: 349451 - RNA, 18 nt, Bordetella pertussis
cgccgcccgcggccagcc

SEQ ID NO: 349452 - RNA, 13 nt, Bordetella pertussis
cgccgcccggccg

SEQ ID NO: 349453 - RNA, 16 nt, Bordetella pertussis
cgccgcccggccggcc

SEQ ID NO: 349454 - RNA, 14 nt, Bordetella pertussis
cgccgcccugcugc

SEQ ID NO: 349455 - RNA, 15 nt, Bordetella pertussis
cgccgcccugcugcc

SEQ ID NO: 349456 - RNA, 16 nt, Bordetella pertussis
cgccgcccugcugccc

SEQ ID NO: 349457 - RNA, 18 nt, Bordetella pertussis
cgccgcccugcugcccgc

SEQ ID NO: 349458 - RNA, 20 nt, Bordetella pertussis
cgccgcccuugcgccaguug

SEQ ID NO: 349459 - RNA, 16 nt, Bordetella pertussis
cgccgccgaagccgcc

SEQ ID NO: 349460 - RNA, 24 nt, Bordetella pertussis
cgccgccgaagccgccgccgucaa

SEQ ID NO: 349461 - RNA, 21 nt, Bordetella pertussis
cgccgccgaccucgucgggcu

SEQ ID NO: 349462 - RNA, 23 nt, Bordetella pertussis
cgccgccgacggcauggcggcca

SEQ ID NO: 349463 - RNA, 17 nt, Bordetella pertussis
cgccgccgauggcgcca

SEQ ID NO: 349464 - RNA, 17 nt, Bordetella pertussis
cgccgccgcagccgcca

SEQ ID NO: 349465 - RNA, 12 nt, Bordetella pertussis
cgccgccgccau

SEQ ID NO: 349466 - RNA, 13 nt, Bordetella pertussis
cgccgccgcccac

SEQ ID NO: 349467 - RNA, 13 nt, Bordetella pertussis
cgccgccgcccgc

SEQ ID NO: 349468 - RNA, 14 nt, Bordetella pertussis
cgccgccgcccgca

SEQ ID NO: 349469 - RNA, 15 nt, Bordetella pertussis
cgccgccgcccggca

SEQ ID NO: 349470 - RNA, 15 nt, Bordetella pertussis
cgccgccggcaaucg

SEQ ID NO: 349471 - RNA, 12 nt, Bordetella pertussis
cgccgccggcac

SEQ ID NO: 349472 - RNA, 14 nt, Bordetella pertussis
cgccgccggcacgu

SEQ ID NO: 349473 - RNA, 20 nt, Bordetella pertussis
cgccgccggcagggccagcg

SEQ ID NO: 349474 - RNA, 22 nt, Bordetella pertussis
cgccgccggcagggccagcgcc

SEQ ID NO: 349475 - RNA, 12 nt, Bordetella pertussis
cgccgccggcca

SEQ ID NO: 349476 - RNA, 15 nt, Bordetella pertussis
cgccgccggccagcu

SEQ ID NO: 349477 - RNA, 20 nt, Bordetella pertussis
cgccgccggccagcugcaug

SEQ ID NO: 349478 - RNA, 15 nt, Bordetella pertussis
cgccgccggccauca

SEQ ID NO: 349479 - RNA, 13 nt, Bordetella pertussis
cgccgccggccca

SEQ ID NO: 349480 - RNA, 15 nt, Bordetella pertussis
cgccgccggcccagg

SEQ ID NO: 349481 - RNA, 22 nt, Bordetella pertussis
cgccgccggcccaggauggcgc

SEQ ID NO: 349482 - RNA, 13 nt, Bordetella pertussis
cgccgccggcccg

SEQ ID NO: 349483 - RNA, 16 nt, Bordetella pertussis
cgccgccggcccgcca

SEQ ID NO: 349484 - RNA, 14 nt, Bordetella pertussis
cgccgccggcccgg

SEQ ID NO: 349485 - RNA, 19 nt, Bordetella pertussis
cgccgccggccugcugcag

SEQ ID NO: 349486 - RNA, 17 nt, Bordetella pertussis
cgccgccggcgcacccg

SEQ ID NO: 349487 - RNA, 12 nt, Bordetella pertussis
cgccgccugcgc

SEQ ID NO: 349488 - RNA, 18 nt, Bordetella pertussis
cgccgccugcggcgcggc

SEQ ID NO: 349489 - RNA, 20 nt, Bordetella pertussis
cgccgccugcggcgcggccg

SEQ ID NO: 349490 - RNA, 16 nt, Bordetella pertussis
cgccgccuggcccaca

SEQ ID NO: 349491 - RNA, 14 nt, Bordetella pertussis
cgccgccuggcccg

SEQ ID NO: 349492 - RNA, 15 nt, Bordetella pertussis
cgccgccuggcccga

SEQ ID NO: 349493 - RNA, 17 nt, Bordetella pertussis
cgccgccuggcccgaac

SEQ ID NO: 349494 - RNA, 17 nt, Bordetella pertussis
cgccgccuuggacgcgc

SEQ ID NO: 349495 - RNA, 19 nt, Bordetella pertussis
cgccgcgacaaauagccga

SEQ ID NO: 349496 - RNA, 21 nt, Bordetella pertussis
cgccgcgacacaaggcggccg

SEQ ID NO: 349497 - RNA, 14 nt, Bordetella pertussis
cgccgcgaccgggc

SEQ ID NO: 349498 - RNA, 14 nt, Bordetella pertussis
cgccgcgagcgccg

SEQ ID NO: 349499 - RNA, 22 nt, Bordetella pertussis
cgccgcgaucagcgcggccgcu

SEQ ID NO: 349500 - RNA, 15 nt, Bordetella pertussis
cgccgcgccgcccgc

SEQ ID NO: 349501 - RNA, 15 nt, Bordetella pertussis
cgccgcgccgcuggc

SEQ ID NO: 349502 - RNA, 17 nt, Bordetella pertussis
cgccgcgccggaucguc

SEQ ID NO: 349503 - RNA, 17 nt, Bordetella pertussis
cgccgcgccgggcgcgc

SEQ ID NO: 349504 - RNA, 20 nt, Bordetella pertussis
cgccgcgccggggcggcgca

SEQ ID NO: 349505 - RNA, 23 nt, Bordetella pertussis
cgccgcgccggggcggcgcagca

SEQ ID NO: 349506 - RNA, 15 nt, Bordetella pertussis
cgccgcgccggucag

SEQ ID NO: 349507 - RNA, 13 nt, Bordetella pertussis
cgccgcgccggug

SEQ ID NO: 349508 - RNA, 17 nt, Bordetella pertussis
cgccgcgccgguggcca

SEQ ID NO: 349509 - RNA, 20 nt, Bordetella pertussis
cgccgcgccgguggccagca

SEQ ID NO: 349510 - RNA, 21 nt, Bordetella pertussis
cgccgcgccguacagggccgc

SEQ ID NO: 349511 - RNA, 23 nt, Bordetella pertussis
cgccgcgccguacagggccgcga

SEQ ID NO: 349512 - RNA, 15 nt, Bordetella pertussis
cgccgcgcgacagcc

SEQ ID NO: 349513 - RNA, 19 nt, Bordetella pertussis
cgccgcgcgacagccgcgc

SEQ ID NO: 349514 - RNA, 18 nt, Bordetella pertussis
cgccgcgcgcacggcgcc

SEQ ID NO: 349515 - RNA, 11 nt, Bordetella pertussis
cgccgcgcgcc

SEQ ID NO: 349516 - RNA, 21 nt, Bordetella pertussis
cgccgcgcgccauccggcgca

SEQ ID NO: 349517 - RNA, 12 nt, Bordetella pertussis
cgccgcgcgccg

SEQ ID NO: 349518 - RNA, 14 nt, Bordetella pertussis
cgccgcgcgccgcg

SEQ ID NO: 349519 - RNA, 15 nt, Bordetella pertussis
cgccgcgcgccgcgc

SEQ ID NO: 349520 - RNA, 18 nt, Bordetella pertussis
cgccgcgcgccgcggccu

SEQ ID NO: 349521 - RNA, 14 nt, Bordetella pertussis
cgccgcgcgcgacg

SEQ ID NO: 349522 - RNA, 15 nt, Bordetella pertussis
cgccgcgcgcgacgc

SEQ ID NO: 349523 - RNA, 17 nt, Bordetella pertussis
cgccgcgcgcgacgcga

SEQ ID NO: 349524 - RNA, 13 nt, Bordetella pertussis
cgccgcgcgcggc

SEQ ID NO: 349525 - RNA, 14 nt, Bordetella pertussis
cgccgcgcgcggca

SEQ ID NO: 349526 - RNA, 15 nt, Bordetella pertussis
cgccgcgcuucgucg

SEQ ID NO: 349527 - RNA, 18 nt, Bordetella pertussis
cgccgcgcuucgucggcg

SEQ ID NO: 349528 - RNA, 14 nt, Bordetella pertussis
cgccgcggaucgug

SEQ ID NO: 349529 - RNA, 19 nt, Bordetella pertussis
cgccgcggcaagccgcggc

SEQ ID NO: 349530 - RNA, 13 nt, Bordetella pertussis
cgccgcggcaggc

SEQ ID NO: 349531 - RNA, 18 nt, Bordetella pertussis
cgccgcggcaggccccgg

SEQ ID NO: 349532 - RNA, 22 nt, Bordetella pertussis
cgccgcggcaggccccggcccg

SEQ ID NO: 349533 - RNA, 14 nt, Bordetella pertussis
cgccgcuccggcau

SEQ ID NO: 349534 - RNA, 16 nt, Bordetella pertussis
cgccgcucgacgucgc

SEQ ID NO: 349535 - RNA, 18 nt, Bordetella pertussis
cgccgcucgacgucgccc

SEQ ID NO: 349536 - RNA, 21 nt, Bordetella pertussis
cgccgcucgacgucgcccugg

SEQ ID NO: 349537 - RNA, 15 nt, Bordetella pertussis
cgccgcugaugcugg

SEQ ID NO: 349538 - RNA, 18 nt, Bordetella pertussis
cgccgcugaugcuggcau

SEQ ID NO: 349539 - RNA, 13 nt, Bordetella pertussis
cgccgcugauggc

SEQ ID NO: 349540 - RNA, 12 nt, Bordetella pertussis
cgccgcugccgg

SEQ ID NO: 349541 - RNA, 17 nt, Bordetella pertussis
cgccgcugccggccgac

SEQ ID NO: 349542 - RNA, 21 nt, Bordetella pertussis
cgccgcugccggccgaccggc

SEQ ID NO: 349543 - RNA, 17 nt, Bordetella pertussis
cgccgcugcgcagcagc

SEQ ID NO: 349544 - RNA, 19 nt, Bordetella pertussis
cgccgcugcgcuugaccgc

SEQ ID NO: 349545 - RNA, 19 nt, Bordetella pertussis
cgccgcuggacagauccag

SEQ ID NO: 349546 - RNA, 22 nt, Bordetella pertussis
cgccgcuggacagauccagcgc

SEQ ID NO: 349547 - RNA, 14 nt, Bordetella pertussis
cgccgcuggccacg

SEQ ID NO: 349548 - RNA, 17 nt, Bordetella pertussis
cgccgcuggcggccgcg

SEQ ID NO: 349549 - RNA, 13 nt, Bordetella pertussis
cgccgcuggcguc

SEQ ID NO: 349550 - RNA, 18 nt, Bordetella pertussis
cgccgcuggcguccaggu

SEQ ID NO: 349551 - RNA, 18 nt, Bordetella pertussis
cgccgcuggcgucgcgcu

SEQ ID NO: 349552 - RNA, 14 nt, Bordetella pertussis
cgccggacaucagc

SEQ ID NO: 349553 - RNA, 13 nt, Bordetella pertussis
cgccggaccaguc

SEQ ID NO: 349554 - RNA, 13 nt, Bordetella pertussis
cgccggaucggcc

SEQ ID NO: 349555 - RNA, 16 nt, Bordetella pertussis
cgccggaucggccggc

SEQ ID NO: 349556 - RNA, 16 nt, Bordetella pertussis
cgccggaugcgcgugg

SEQ ID NO: 349557 - RNA, 12 nt, Bordetella pertussis
cgccggcagcgc

SEQ ID NO: 349558 - RNA, 14 nt, Bordetella pertussis
cgccggcaggcgcg

SEQ ID NO: 349559 - RNA, 16 nt, Bordetella pertussis
cgccggcaggcgcgcc

SEQ ID NO: 349560 - RNA, 20 nt, Bordetella pertussis
cgccggcaggcgcgccagcc

SEQ ID NO: 349561 - RNA, 12 nt, Bordetella pertussis
cgccggcagggc

SEQ ID NO: 349562 - RNA, 14 nt, Bordetella pertussis
cgccggcagggcca

SEQ ID NO: 349563 - RNA, 17 nt, Bordetella pertussis
cgccggcagggccagcg

SEQ ID NO: 349564 - RNA, 20 nt, Bordetella pertussis
cgccggcagggccagcgcca

SEQ ID NO: 349565 - RNA, 22 nt, Bordetella pertussis
cgccggcagggccagcgccagc

SEQ ID NO: 349566 - RNA, 23 nt, Bordetella pertussis
cgccggcagggccagcgccagca

SEQ ID NO: 349567 - RNA, 15 nt, Bordetella pertussis
cgccggcagggcggc

SEQ ID NO: 349568 - RNA, 17 nt, Bordetella pertussis
cgccggcagggcggcca

SEQ ID NO: 349569 - RNA, 18 nt, Bordetella pertussis
cgccggcagggcggccag

SEQ ID NO: 349570 - RNA, 19 nt, Bordetella pertussis
cgccggcagggcggccagg

SEQ ID NO: 349571 - RNA, 23 nt, Bordetella pertussis
cgccggcagggcggccaggccgg

SEQ ID NO: 349572 - RNA, 21 nt, Bordetella pertussis
cgccggcccaaggccccgcga

SEQ ID NO: 349573 - RNA, 16 nt, Bordetella pertussis
cgccggcccaggcgcg

SEQ ID NO: 349574 - RNA, 20 nt, Bordetella pertussis
cgccggcccaggcgcgcugg

SEQ ID NO: 349575 - RNA, 21 nt, Bordetella pertussis
cgccggcccaggcgcgcuggc

SEQ ID NO: 349576 - RNA, 15 nt, Bordetella pertussis
cgccggcccgccacg

SEQ ID NO: 349577 - RNA, 22 nt, Bordetella pertussis
cgccggcccgccacgcgggccg

SEQ ID NO: 349578 - RNA, 15 nt, Bordetella pertussis
cgccggcccgccucg

SEQ ID NO: 349579 - RNA, 16 nt, Bordetella pertussis
cgccggcccgccucga

SEQ ID NO: 349580 - RNA, 22 nt, Bordetella pertussis
cgccggccggugcaucggccgg

SEQ ID NO: 349581 - RNA, 20 nt, Bordetella pertussis
cgccggccucuucgucgccg

SEQ ID NO: 349582 - RNA, 22 nt, Bordetella pertussis
cgccggccucuucgucgccggc

SEQ ID NO: 349583 - RNA, 15 nt, Bordetella pertussis
cgccggccugacgcg

SEQ ID NO: 349584 - RNA, 16 nt, Bordetella pertussis
cgccggccugacgcgc

SEQ ID NO: 349585 - RNA, 13 nt, Bordetella pertussis
cgccggccugcgc

SEQ ID NO: 349586 - RNA, 18 nt, Bordetella pertussis
cgccggccugcgccagcu

SEQ ID NO: 349587 - RNA, 15 nt, Bordetella pertussis
cgccggccugcgccg

SEQ ID NO: 349588 - RNA, 20 nt, Bordetella pertussis
cgccggccugcucgccggcc

SEQ ID NO: 349589 - RNA, 23 nt, Bordetella pertussis
cgccggccugcucgccggccagc

SEQ ID NO: 349590 - RNA, 14 nt, Bordetella pertussis
cgccggccuggcgc

SEQ ID NO: 349591 - RNA, 15 nt, Bordetella pertussis
cgccggccuggcgcg

SEQ ID NO: 349592 - RNA, 21 nt, Bordetella pertussis
cgccggccuggcgcgcggccu

SEQ ID NO: 349593 - RNA, 15 nt, Bordetella pertussis
cgccggccuugccgu

SEQ ID NO: 349594 - RNA, 14 nt, Bordetella pertussis
cgccggccuugcug

SEQ ID NO: 349595 - RNA, 17 nt, Bordetella pertussis
cgccggcgaaugccggc

SEQ ID NO: 349596 - RNA, 19 nt, Bordetella pertussis
cgccggcgaaugccggccg

SEQ ID NO: 349597 - RNA, 21 nt, Bordetella pertussis
cgccggcgaaugccggccgau

SEQ ID NO: 349598 - RNA, 14 nt, Bordetella pertussis
cgccggcgacgccg

SEQ ID NO: 349599 - RNA, 23 nt, Bordetella pertussis
cgccggcgagacgucggcgaugg

SEQ ID NO: 349600 - RNA, 19 nt, Bordetella pertussis
cgccggcgauauggccagg

SEQ ID NO: 349601 - RNA, 15 nt, Bordetella pertussis
cgccggcgaugacgg

SEQ ID NO: 349602 - RNA, 14 nt, Bordetella pertussis
cgccggcgauggcg

SEQ ID NO: 349603 - RNA, 15 nt, Bordetella pertussis
cgccggcgccgggca

SEQ ID NO: 349604 - RNA, 19 nt, Bordetella pertussis
cgccggcgccuuggccugg

SEQ ID NO: 349605 - RNA, 12 nt, Bordetella pertussis
cgccggcgcgcg

SEQ ID NO: 349606 - RNA, 16 nt, Bordetella pertussis
cgccggcgcgcgaucu

SEQ ID NO: 349607 - RNA, 19 nt, Bordetella pertussis
cgccggcgcgcgcgcgccg

SEQ ID NO: 349608 - RNA, 22 nt, Bordetella pertussis
cgccggcgcgcggaugaucgcg

SEQ ID NO: 349609 - RNA, 13 nt, Bordetella pertussis
cgccggcgcggcg

SEQ ID NO: 349610 - RNA, 13 nt, Bordetella pertussis
cgccggcgcggcu

SEQ ID NO: 349611 - RNA, 14 nt, Bordetella pertussis
cgccggcgcggcug

SEQ ID NO: 349612 - RNA, 23 nt, Bordetella pertussis
cgccggcgcgguggccaugcugg

SEQ ID NO: 349613 - RNA, 12 nt, Bordetella pertussis
cgccggcgcggc

SEQ ID NO: 349614 - RNA, 20 nt, Bordetella pertussis
cgccggcgcugcugucgcgc

SEQ ID NO: 349615 - RNA, 14 nt, Bordetella pertussis
cgccgggccgcgac

SEQ ID NO: 349616 - RNA, 13 nt, Bordetella pertussis
cgccgggccgcgc

SEQ ID NO: 349617 - RNA, 16 nt, Bordetella pertussis
cgccgggccgcgccca

SEQ ID NO: 349618 - RNA, 15 nt, Bordetella pertussis
cgccgggccgcgccg

SEQ ID NO: 349619 - RNA, 13 nt, Bordetella pertussis
cgccgggccgcua

SEQ ID NO: 349620 - RNA, 14 nt, Bordetella pertussis
cgccggcggcgucg

SEQ ID NO: 349621 - RNA, 16 nt, Bordetella pertussis
cgccggcggcgugccc

SEQ ID NO: 349622 - RNA, 22 nt, Bordetella pertussis
cgccgggccgucgugcgccugg

SEQ ID NO: 349623 - RNA, 20 nt, Bordetella pertussis
cgccgggccuagcccggcgc

SEQ ID NO: 349624 - RNA, 22 nt, Bordetella pertussis
cgccgggcgaaccgguggccau

SEQ ID NO: 349625 - RNA, 14 nt, Bordetella pertussis
cgccgggcgacggc

SEQ ID NO: 349626 - RNA, 16 nt, Bordetella pertussis
cgccgggcgcgccggc

SEQ ID NO: 349627 - RNA, 13 nt, Bordetella pertussis
cgccgggcgcgcg

SEQ ID NO: 349628 - RNA, 16 nt, Bordetella pertussis
cgccgggcgcgcgccg

SEQ ID NO: 349629 - RNA, 17 nt, Bordetella pertussis
cgccgggcgcgcgccgg

SEQ ID NO: 349630 - RNA, 20 nt, Bordetella pertussis
cgccgggcgcgcugcccagc

SEQ ID NO: 349631 - RNA, 12 nt, Bordetella pertussis
cgccgggcgcgg

SEQ ID NO: 349632 - RNA, 15 nt, Bordetella pertussis
cgccgggcgcggcca

SEQ ID NO: 349633 - RNA, 20 nt, Bordetella pertussis
cgccgggcgcggccaggcgc

SEQ ID NO: 349634 - RNA, 22 nt, Bordetella pertussis
cgccgggcgcggcccggcgucg

SEQ ID NO: 349635 - RNA, 15 nt, Bordetella pertussis
cgccgggcgcggccg

SEQ ID NO: 349636 - RNA, 14 nt, Bordetella pertussis
cgccgggcgcgugg

SEQ ID NO: 349637 - RNA, 17 nt, Bordetella pertussis
cgccgggcggaucgccg

SEQ ID NO: 349638 - RNA, 19 nt, Bordetella pertussis
cgccgggcggcgccgucga

SEQ ID NO: 349639 - RNA, 15 nt, Bordetella pertussis
cgccgggcggcgcgg

SEQ ID NO: 349640 - RNA, 16 nt, Bordetella pertussis
cgccgggcggcgcggg

SEQ ID NO: 349641 - RNA, 18 nt, Bordetella pertussis
cgccgggcgggucggcga

SEQ ID NO: 349642 - RNA, 20 nt, Bordetella pertussis
cgccgggcuggauccggcgc

SEQ ID NO: 349643 - RNA, 21 nt, Bordetella pertussis
cgccgggcuggauccggcgcu

SEQ ID NO: 349644 - RNA, 17 nt, Bordetella pertussis
cgccgggcuguccgcca

SEQ ID NO: 349645 - RNA, 17 nt, Bordetella pertussis
cgccggggcgcaccggc

SEQ ID NO: 349646 - RNA, 21 nt, Bordetella pertussis
cgccggggcgcaccggcacgc

SEQ ID NO: 349647 - RNA, 17 nt, Bordetella pertussis
cgccggggcgccggugu

SEQ ID NO: 349648 - RNA, 17 nt, Bordetella pertussis
cgccggggcggcgcagc

SEQ ID NO: 349649 - RNA, 18 nt, Bordetella pertussis
cgccggggcggcgcagca

SEQ ID NO: 349650 - RNA, 21 nt, Bordetella pertussis
cgccggggcggcggcgcccgc

SEQ ID NO: 349651 - RNA, 22 nt, Bordetella pertussis
cgccggggcggcggcgcccgca

SEQ ID NO: 349652 - RNA, 14 nt, Bordetella pertussis
cgccggggcggcuc

SEQ ID NO: 349653 - RNA, 13 nt, Bordetella pertussis
cgccggggcgugg

SEQ ID NO: 349654 - RNA, 20 nt, Bordetella pertussis
cgccggggcguggccgcagu

SEQ ID NO: 349655 - RNA, 18 nt, Bordetella pertussis
cgccggggucagcgccgg

SEQ ID NO: 349656 - RNA, 19 nt, Bordetella pertussis
cgccggggucagcgccggc

SEQ ID NO: 349657 - RNA, 18 nt, Bordetella pertussis
cgccgggggcguugcggu

SEQ ID NO: 349658 - RNA, 21 nt, Bordetella pertussis
cgccggggggcgcacgccgcg

SEQ ID NO: 349659 - RNA, 13 nt, Bordetella pertussis
cgccggguccggc

SEQ ID NO: 349660 - RNA, 15 nt, Bordetella pertussis
cgccggguccggccg

SEQ ID NO: 349661 - RNA, 16 nt, Bordetella pertussis
cgccgggucgccggug

SEQ ID NO: 349662 - RNA, 19 nt, Bordetella pertussis
cgccgggucgcugugcgcg

SEQ ID NO: 349663 - RNA, 21 nt, Bordetella pertussis
cgccgggucgcugugcgcggc

SEQ ID NO: 349664 - RNA, 22 nt, Bordetella pertussis
cgccgggucgcugugcgcggcg

SEQ ID NO: 349665 - RNA, 20 nt, Bordetella pertussis
cgccggguguuccggcgcgc

SEQ ID NO: 349666 - RNA, 22 nt, Bordetella pertussis
cgccggguugccgggauccacg

SEQ ID NO: 349667 - RNA, 15 nt, Bordetella pertussis
cgccggguuucucga

SEQ ID NO: 349668 - RNA, 22 nt, Bordetella pertussis
cgccgguagcgcugggcgccag

SEQ ID NO: 349669 - RNA, 16 nt, Bordetella pertussis
cgccggucaccgccgc

SEQ ID NO: 349670 - RNA, 21 nt, Bordetella pertussis
cgccggucacugccgaaacgc

SEQ ID NO: 349671 - RNA, 15 nt, Bordetella pertussis
cgccggucacguacu

SEQ ID NO: 349672 - RNA, 15 nt, Bordetella pertussis
cgccgguccagcgcc

SEQ ID NO: 349673 - RNA, 23 nt, Bordetella pertussis
cgccgguccgacgguagccgggu

SEQ ID NO: 349674 - RNA, 15 nt, Bordetella pertussis
cgccggucgccagcg

SEQ ID NO: 349675 - RNA, 18 nt, Bordetella pertussis
cgccggugauaugcgcca

SEQ ID NO: 349676 - RNA, 19 nt, Bordetella pertussis
cgccggugauaugcgccag

SEQ ID NO: 349677 - RNA, 15 nt, Bordetella pertussis
cgccggugcaccagg

SEQ ID NO: 349678 - RNA, 17 nt, Bordetella pertussis
cgccggugcaccaggcc

SEQ ID NO: 349679 - RNA, 18 nt, Bordetella pertussis
cgccggugcaccaggcca

SEQ ID NO: 349680 - RNA, 17 nt, Bordetella pertussis
cgccguaaucggcgucg

SEQ ID NO: 349681 - RNA, 15 nt, Bordetella pertussis
cgccguacagggccg

SEQ ID NO: 349682 - RNA, 15 nt, Bordetella pertussis
cgccguaccagcgcg

SEQ ID NO: 349683 - RNA, 16 nt, Bordetella pertussis
cgccguaccagcgcga

SEQ ID NO: 349684 - RNA, 19 nt, Bordetella pertussis
cgccguaccugcagcaggc

SEQ ID NO: 349685 - RNA, 14 nt, Bordetella pertussis
cgccguacugggca

SEQ ID NO: 349686 - RNA, 16 nt, Bordetella pertussis
cgccguacugggcacc

SEQ ID NO: 349687 - RNA, 19 nt, Bordetella pertussis
cgccguacugggcaccacg

SEQ ID NO: 349688 - RNA, 20 nt, Bordetella pertussis
cgccguagccgcugcgcgcg

SEQ ID NO: 349689 - RNA, 14 nt, Bordetella pertussis
cgccguagcgcgcc

SEQ ID NO: 349690 - RNA, 15 nt, Bordetella pertussis
cgccguagcgcgcca

SEQ ID NO: 349691 - RNA, 16 nt, Bordetella pertussis
cgccguagcgcgccag

SEQ ID NO: 349692 - RNA, 17 nt, Bordetella pertussis
cgccguagcgcgccagc

SEQ ID NO: 349693 - RNA, 19 nt, Bordetella pertussis
cgccguagcgcgccagccg

SEQ ID NO: 349694 - RNA, 23 nt, Bordetella pertussis
cgccguagcgcgccagccgcgcg

SEQ ID NO: 349695 - RNA, 14 nt, Bordetella pertussis
cgccguaggacagc

SEQ ID NO: 349696 - RNA, 22 nt, Bordetella pertussis
cgccguaggacagccccagcag

SEQ ID NO: 349697 - RNA, 23 nt, Bordetella pertussis
cgccguaggacagccccagcagc

SEQ ID NO: 349698 - RNA, 21 nt, Bordetella pertussis
cgccguaggcuugcagcuugc

SEQ ID NO: 349699 - RNA, 23 nt, Bordetella pertussis
cgccguauagcgguacucgcgcg

SEQ ID NO: 349700 - RNA, 16 nt, Bordetella pertussis
cgccguccagcgcggc

SEQ ID NO: 349701 - RNA, 19 nt, Bordetella pertussis
cgccguccagcgcggcaug

SEQ ID NO: 349702 - RNA, 15 nt, Bordetella pertussis
cgccguccaggcgcc

SEQ ID NO: 349703 - RNA, 17 nt, Bordetella pertussis
cgccguccaggcgccgc

SEQ ID NO: 349704 - RNA, 13 nt, Bordetella pertussis
cgccguccagcgc

SEQ ID NO: 349705 - RNA, 15 nt, Bordetella pertussis
cgccgucgacgucgg

SEQ ID NO: 349706 - RNA, 16 nt, Bordetella pertussis
cgccgucgagcauccc

SEQ ID NO: 349707 - RNA, 21 nt, Bordetella pertussis
cgccgucgaucccaucgcgcg

SEQ ID NO: 349708 - RNA, 15 nt, Bordetella pertussis
cgccgucgcccuggc

SEQ ID NO: 349709 - RNA, 14 nt, Bordetella pertussis
cgccgucgcgcugu

SEQ ID NO: 349710 - RNA, 20 nt, Bordetella pertussis
cgccgucgcggaccuccugg

SEQ ID NO: 349711 - RNA, 12 nt, Bordetella pertussis
cgccuccaggcg

SEQ ID NO: 349712 - RNA, 19 nt, Bordetella pertussis
cgccucccauugcgcggcc

SEQ ID NO: 349713 - RNA, 21 nt, Bordetella pertussis
cgccucccauugcgcggccag

SEQ ID NO: 349714 - RNA, 22 nt, Bordetella pertussis
cgccuccagcgcggcgggcggc

SEQ ID NO: 349715 - RNA, 23 nt, Bordetella pertussis
cgccucgaagaucucgacgucgu

SEQ ID NO: 349716 - RNA, 16 nt, Bordetella pertussis
cgccucgacgaugccc

SEQ ID NO: 349717 - RNA, 14 nt, Bordetella pertussis
cgccucgacgcccg

SEQ ID NO: 349718 - RNA, 20 nt, Bordetella pertussis
cgccucgacgcccgggcggc

SEQ ID NO: 349719 - RNA, 17 nt, Bordetella pertussis
cgccucggcgguugccc

SEQ ID NO: 349720 - RNA, 19 nt, Bordetella pertussis
cgccucggcgguugcccgc

SEQ ID NO: 349721 - RNA, 15 nt, Bordetella pertussis
cgccucggcuugcgc

SEQ ID NO: 349722 - RNA, 19 nt, Bordetella pertussis
cgccucggcuugcgcggcg

SEQ ID NO: 349723 - RNA, 20 nt, Bordetella pertussis
cgccucggcuugcgcggcgc

SEQ ID NO: 349724 - RNA, 18 nt, Bordetella pertussis
cgccucgggcacggccag

SEQ ID NO: 349725 - RNA, 19 nt, Bordetella pertussis
cgccucgggcacggccagc

SEQ ID NO: 349726 - RNA, 14 nt, Bordetella pertussis
cgccucgggcgcaa

SEQ ID NO: 349727 - RNA, 19 nt, Bordetella pertussis
cgccucgggcgcaacgucg

SEQ ID NO: 349728 - RNA, 19 nt, Bordetella pertussis
cgccucguauucgcccgga

SEQ ID NO: 349729 - RNA, 22 nt, Bordetella pertussis
cgccucguccugcaggcggcgc

SEQ ID NO: 349730 - RNA, 12 nt, Bordetella pertussis
cgccucgucgcg

SEQ ID NO: 349731 - RNA, 13 nt, Bordetella pertussis
cgccugagcugcc

SEQ ID NO: 349732 - RNA, 20 nt, Bordetella pertussis
cgccugcaaguccagcgugg

SEQ ID NO: 349733 - RNA, 14 nt, Bordetella pertussis
cgccugcaccgccg

SEQ ID NO: 349734 - RNA, 17 nt, Bordetella pertussis
cgccugcaccgccgcgc

SEQ ID NO: 349735 - RNA, 18 nt, Bordetella pertussis
cgccugcaccgccgcgcg

SEQ ID NO: 349736 - RNA, 15 nt, Bordetella pertussis
cgccugcaccgccgc

SEQ ID NO: 349737 - RNA, 16 nt, Bordetella pertussis
cgccugcacgaccugc

SEQ ID NO: 349738 - RNA, 19 nt, Bordetella pertussis
cgccugcacgaccugcgca

SEQ ID NO: 349739 - RNA, 20 nt, Bordetella pertussis
cgccugcccgcaacgccgcc

SEQ ID NO: 349740 - RNA, 18 nt, Bordetella pertussis
cgccugcccgcacgggcc

SEQ ID NO: 349741 - RNA, 21 nt, Bordetella pertussis
cgccugccgaucgugcacgcc

SEQ ID NO: 349742 - RNA, 15 nt, Bordetella pertussis
cgccugccgcauccc

SEQ ID NO: 349743 - RNA, 22 nt, Bordetella pertussis
cgccugccgcaucccgcccccg

SEQ ID NO: 349744 - RNA, 15 nt, Bordetella pertussis
cgccugccgcgcccg

SEQ ID NO: 349745 - RNA, 20 nt, Bordetella pertussis
cgccugccgcgcccggcggc

SEQ ID NO: 349746 - RNA, 13 nt, Bordetella pertussis
cgccugccgcgug

SEQ ID NO: 349747 - RNA, 16 nt, Bordetella pertussis
cgccugccgcgugccc

SEQ ID NO: 349748 - RNA, 17 nt, Bordetella pertussis
cgccugccgcgugcccg

SEQ ID NO: 349749 - RNA, 19 nt, Bordetella pertussis
cgccugccgcgugcccgcg

SEQ ID NO: 349750 - RNA, 15 nt, Bordetella pertussis
cgccugccggccugg

SEQ ID NO: 349751 - RNA, 16 nt, Bordetella pertussis
cgccugccugccgagc

SEQ ID NO: 349752 - RNA, 23 nt, Bordetella pertussis
cgccugcgagagauagcccagca

SEQ ID NO: 349753 - RNA, 13 nt, Bordetella pertussis
cgccugcgccacc

SEQ ID NO: 349754 - RNA, 16 nt, Bordetella pertussis
cgccugcgccaccugg

SEQ ID NO: 349755 - RNA, 19 nt, Bordetella pertussis
cgccugcgccaccuggcgc

SEQ ID NO: 349756 - RNA, 14 nt, Bordetella pertussis
cgccugcgccagcc

SEQ ID NO: 349757 - RNA, 15 nt, Bordetella pertussis
cgccugcgccagccg

SEQ ID NO: 349758 - RNA, 20 nt, Bordetella pertussis
cgccugcgccauggcgcgca

SEQ ID NO: 349759 - RNA, 22 nt, Bordetella pertussis
cgccugcgccauguggcgacgc

SEQ ID NO: 349760 - RNA, 15 nt, Bordetella pertussis
cgccugcgccgaggc

SEQ ID NO: 349761 - RNA, 18 nt, Bordetella pertussis
cgccugcgccgaggcggg

SEQ ID NO: 349762 - RNA, 23 nt, Bordetella pertussis
cgccugcgccgaggcgggcagca

SEQ ID NO: 349763 - RNA, 15 nt, Bordetella pertussis
cgccugcgccaggug

SEQ ID NO: 349764 - RNA, 23 nt, Bordetella pertussis
cgccugcgccggguccggccgcg

SEQ ID NO: 349765 - RNA, 20 nt, Bordetella pertussis
cgccugcugggccgcgcucg

SEQ ID NO: 349766 - RNA, 14 nt, Bordetella pertussis
cgccugcuggucgg

SEQ ID NO: 349767 - RNA, 15 nt, Bordetella pertussis
cgccugcuggucggc

SEQ ID NO: 349768 - RNA, 17 nt, Bordetella pertussis
cgccugcuggucggccu

SEQ ID NO: 349769 - RNA, 16 nt, Bordetella pertussis
cgccugcuggucggcg

SEQ ID NO: 349770 - RNA, 13 nt, Bordetella pertussis
cgccuggaccggc

SEQ ID NO: 349771 - RNA, 14 nt, Bordetella pertussis
cgccuggaccggcu

SEQ ID NO: 349772 - RNA, 16 nt, Bordetella pertussis
cgccuggacggcgagg

SEQ ID NO: 349773 - RNA, 19 nt, Bordetella pertussis
cgccuggacggcgaggagg

SEQ ID NO: 349774 - RNA, 14 nt, Bordetella pertussis
cgccuggcacgacg

SEQ ID NO: 349775 - RNA, 17 nt, Bordetella pertussis
cgccuggcacgacgugg

SEQ ID NO: 349776 - RNA, 21 nt, Bordetella pertussis
cgccuggcccacaucgucgcg

SEQ ID NO: 349777 - RNA, 13 nt, Bordetella pertussis
cgccuggcccaug

SEQ ID NO: 349778 - RNA, 19 nt, Bordetella pertussis
cgccuggcccgaacggccc

SEQ ID NO: 349779 - RNA, 18 nt, Bordetella pertussis
cgccuggccgagcgcggc

SEQ ID NO: 349780 - RNA, 14 nt, Bordetella pertussis
cgccuggccgccca

SEQ ID NO: 349781 - RNA, 16 nt, Bordetella pertussis
cgccuggccgcccagc

SEQ ID NO: 349782 - RNA, 22 nt, Bordetella pertussis
cgccuggccgcccagcgccugc

SEQ ID NO: 349783 - RNA, 13 nt, Bordetella pertussis
cgccuggccgcgc

SEQ ID NO: 349784 - RNA, 21 nt, Bordetella pertussis
cgccuggccagauagcccagg

SEQ ID NO: 349785 - RNA, 15 nt, Bordetella pertussis
cgccuggccggcuug

SEQ ID NO: 349786 - RNA, 23 nt, Bordetella pertussis
cgccuggccguagcguuggcggc

SEQ ID NO: 349787 - RNA, 18 nt, Bordetella pertussis
cgccuggcgccgcgcccg

SEQ ID NO: 349788 - RNA, 15 nt, Bordetella pertussis
cgccuggcgcgccca

SEQ ID NO: 349789 - RNA, 16 nt, Bordetella pertussis
cgccuggcgcgcccac

SEQ ID NO: 349790 - RNA, 15 nt, Bordetella pertussis
cgccuggcgggccug

SEQ ID NO: 349791 - RNA, 16 nt, Bordetella pertussis
cgccuggcgggccugg

SEQ ID NO: 349792 - RNA, 19 nt, Bordetella pertussis
cgccuggcgggccugggcg

SEQ ID NO: 349793 - RNA, 21 nt, Bordetella pertussis
cgccuggcgggccugggcguc

SEQ ID NO: 349794 - RNA, 21 nt, Bordetella pertussis
cgccuggcuucccgguccagg

SEQ ID NO: 349795 - RNA, 22 nt, Bordetella pertussis
cgccuggcuucccgguccaggc

SEQ ID NO: 349796 - RNA, 23 nt, Bordetella pertussis
cgccuggcuucccgguccaggcc

SEQ ID NO: 349797 - RNA, 18 nt, Bordetella pertussis
cgccuggcuuucgccgcg

SEQ ID NO: 349798 - RNA, 14 nt, Bordetella pertussis
cgccugggcgcgga

SEQ ID NO: 349799 - RNA, 15 nt, Bordetella pertussis
cgccugggcggccac

SEQ ID NO: 349800 - RNA, 17 nt, Bordetella pertussis
cgccugggcggccacgu

SEQ ID NO: 349801 - RNA, 14 nt, Bordetella pertussis
cgccuggggcgggc

SEQ ID NO: 349802 - RNA, 14 nt, Bordetella pertussis
cgccuggggcgugc

SEQ ID NO: 349803 - RNA, 19 nt, Bordetella pertussis
cgccugggguaggcgcggu

SEQ ID NO: 349804 - RNA, 18 nt, Bordetella pertussis
cgccugggucaggucggc

SEQ ID NO: 349805 - RNA, 14 nt, Bordetella pertussis
cgccugggcggcgc

SEQ ID NO: 349806 - RNA, 17 nt, Bordetella pertussis
cgccuggucgcuggcgc

SEQ ID NO: 349807 - RNA, 15 nt, Bordetella pertussis
cgccuggucgacgcc

SEQ ID NO: 349808 - RNA, 21 nt, Bordetella pertussis
cgccuggucgacgccggcgac

SEQ ID NO: 349809 - RNA, 16 nt, Bordetella pertussis
cgccuguaucagcgcc

SEQ ID NO: 349810 - RNA, 14 nt, Bordetella pertussis
cgccugucccaggc

SEQ ID NO: 349811 - RNA, 17 nt, Bordetella pertussis
cgccuguccccgcugcg

SEQ ID NO: 349812 - RNA, 19 nt, Bordetella pertussis
cgccuguccccgcugcggc

SEQ ID NO: 349813 - RNA, 20 nt, Bordetella pertussis
cgccuguccccgcugcggca

SEQ ID NO: 349814 - RNA, 20 nt, Bordetella pertussis
cgccuguccccgcugggaca

SEQ ID NO: 349815 - RNA, 19 nt, Bordetella pertussis
cgccugucccgcugggggc

SEQ ID NO: 349816 - RNA, 15 nt, Bordetella pertussis
cgccugugccagcug

SEQ ID NO: 349817 - RNA, 21 nt, Bordetella pertussis
cgccuguuuuggcgcacgccg

SEQ ID NO: 349818 - RNA, 13 nt, Bordetella pertussis
cgccuuacgcggc

SEQ ID NO: 349819 - RNA, 14 nt, Bordetella pertussis
cgccuuacgcggcg

SEQ ID NO: 349820 - RNA, 17 nt, Bordetella pertussis
cgccuucagcgggccgg

SEQ ID NO: 349821 - RNA, 20 nt, Bordetella pertussis
cgccuucagcgggccggcac

SEQ ID NO: 349822 - RNA, 14 nt, Bordetella pertussis
cgccuucaucgucg

SEQ ID NO: 349823 - RNA, 15 nt, Bordetella pertussis
cgccuuccggcagcg

SEQ ID NO: 349824 - RNA, 18 nt, Bordetella pertussis
cgccuuccggcagcggcc

SEQ ID NO: 349825 - RNA, 17 nt, Bordetella pertussis
cgccuuccggccccaug

SEQ ID NO: 349826 - RNA, 15 nt, Bordetella pertussis
cgccuuccugggcgc

SEQ ID NO: 349827 - RNA, 19 nt, Bordetella pertussis
cgccuuccugggcgccggc

SEQ ID NO: 349828 - RNA, 16 nt, Bordetella pertussis
cgccuucgaggccggc

SEQ ID NO: 349829 - RNA, 23 nt, Bordetella pertussis
cgccuucgaucuucucgccgcgc

SEQ ID NO: 349830 - RNA, 14 nt, Bordetella pertussis
cgccuucgcugacg

SEQ ID NO: 349831 - RNA, 15 nt, Bordetella pertussis
cgccuucgcugacgc

SEQ ID NO: 349832 - RNA, 18 nt, Bordetella pertussis
cgccuucggcaggcgccg

SEQ ID NO: 349833 - RNA, 21 nt, Bordetella pertussis
cgccuucggcaggcgccggcu

SEQ ID NO: 349834 - RNA, 18 nt, Bordetella pertussis
cgccuucggcgcgcgccg

SEQ ID NO: 349835 - RNA, 18 nt, Bordetella pertussis
cgccuucggcggcgggcu

SEQ ID NO: 349836 - RNA, 19 nt, Bordetella pertussis
cgccuucgucgcgcacccg

SEQ ID NO: 349837 - RNA, 23 nt, Bordetella pertussis
cgccuucuugaacagcucggccc

SEQ ID NO: 349838 - RNA, 19 nt, Bordetella pertussis
cgccuugacgaucucggcg

SEQ ID NO: 349839 - RNA, 22 nt, Bordetella pertussis
cgccuugacgaucucggcguug

SEQ ID NO: 349840 - RNA, 11 nt, Bordetella pertussis
cgccuugccgc

SEQ ID NO: 349841 - RNA, 16 nt, Bordetella pertussis
cgccuugccgccgcgc

SEQ ID NO: 349842 - RNA, 18 nt, Bordetella pertussis
cgccuugccuuccaggaa

SEQ ID NO: 349843 - RNA, 18 nt, Bordetella pertussis
cgccuugccuugcgcggc

SEQ ID NO: 349844 - RNA, 20 nt, Bordetella pertussis
cgccuugccuugcgcggcca

SEQ ID NO: 349845 - RNA, 13 nt, Bordetella pertussis
cgccuugcgcggc

SEQ ID NO: 349846 - RNA, 16 nt, Bordetella pertussis
cgccuuggcgcgcaga

SEQ ID NO: 349847 - RNA, 17 nt, Bordetella pertussis
cgccuuguucgcgcgcg

SEQ ID NO: 349848 - RNA, 16 nt, Bordetella pertussis
cgccuuucccgcgccg

SEQ ID NO: 349849 - RNA, 14 nt, Bordetella pertussis
cgcgaaagcacgcc

SEQ ID NO: 349850 - RNA, 15 nt, Bordetella pertussis
cgcgaaacggccggg

SEQ ID NO: 349851 - RNA, 18 nt, Bordetella pertussis
cgcgaaagcgcugcgccg

SEQ ID NO: 349852 - RNA, 14 nt, Bordetella pertussis
cgcgaaagcggcgu

SEQ ID NO: 349853 - RNA, 22 nt, Bordetella pertussis
cgcgaaagcggcgugugcccag

SEQ ID NO: 349854 - RNA, 16 nt, Bordetella pertussis
cgcgaacaccggcagg

SEQ ID NO: 349855 - RNA, 18 nt, Bordetella pertussis
cgcgaacagauccacgcc

SEQ ID NO: 349856 - RNA, 14 nt, Bordetella pertussis
cgcgaaccaggcca

SEQ ID NO: 349857 - RNA, 15 nt, Bordetella pertussis
cgcgaaccaggccac

SEQ ID NO: 349858 - RNA, 17 nt, Bordetella pertussis
cgcgaaccaggccugcg

SEQ ID NO: 349859 - RNA, 16 nt, Bordetella pertussis
cgcgaaccccuccggc

SEQ ID NO: 349860 - RNA, 20 nt, Bordetella pertussis
cgcgaacccgaucgcgaugg

SEQ ID NO: 349861 - RNA, 16 nt, Bordetella pertussis
cgcgaacgcgcgccgg

SEQ ID NO: 349862 - RNA, 19 nt, Bordetella pertussis
cgcgaacgcgcgccggcca

SEQ ID NO: 349863 - RNA, 12 nt, Bordetella pertussis
cgcgaacgcggc

SEQ ID NO: 349864 - RNA, 13 nt, Bordetella pertussis
cgcgaacgcggcc

SEQ ID NO: 349865 - RNA, 13 nt, Bordetella pertussis
cgcgaacgcgccg

SEQ ID NO: 349866 - RNA, 21 nt, Bordetella pertussis
cgcgaacggcaggugcacgca

SEQ ID NO: 349867 - RNA, 14 nt, Bordetella pertussis
cgcgaacgggcagc

SEQ ID NO: 349868 - RNA, 21 nt, Bordetella pertussis
cgcgaacuuggccaugccaac

SEQ ID NO: 349869 - RNA, 23 nt, Bordetella pertussis
cgcgaacuuggccaugccaacgg

SEQ ID NO: 349870 - RNA, 20 nt, Bordetella pertussis
cgcgaagcggaaacgcgcgc

SEQ ID NO: 349871 - RNA, 21 nt, Bordetella pertussis
cgcgaagcggaaacgcgcgcg

SEQ ID NO: 349872 - RNA, 14 nt, Bordetella pertussis
cgcgaaggccgccc

SEQ ID NO: 349873 - RNA, 20 nt, Bordetella pertussis
cgcgaaguaccagcgcacgu

SEQ ID NO: 349874 - RNA, 18 nt, Bordetella pertussis
cgcgacacaaggcggccg

SEQ ID NO: 349875 - RNA, 14 nt, Bordetella pertussis
cgcgacacgcagca

SEQ ID NO: 349876 - RNA, 14 nt, Bordetella pertussis
cgcgacagccgcgc

SEQ ID NO: 349877 - RNA, 21 nt, Bordetella pertussis
cgcgacagccgcgccagcgcc

SEQ ID NO: 349878 - RNA, 22 nt, Bordetella pertussis
cgcgacagccgcgccagcgccu

SEQ ID NO: 349879 - RNA, 16 nt, Bordetella pertussis
cgcgacagcaggccgg

SEQ ID NO: 349880 - RNA, 20 nt, Bordetella pertussis
cgcgacagcgcugguggcca

SEQ ID NO: 349881 - RNA, 19 nt, Bordetella pertussis
cgcgacaggcggugcgcgc

SEQ ID NO: 349882 - RNA, 21 nt, Bordetella pertussis
cgcgacaggcggugcgcgcgg

SEQ ID NO: 349883 - RNA, 13 nt, Bordetella pertussis
cgcgaccaccagc

SEQ ID NO: 349884 - RNA, 14 nt, Bordetella pertussis
cgcgaccaccagca

SEQ ID NO: 349885 - RNA, 16 nt, Bordetella pertussis
cgcgaccaccagcacc

SEQ ID NO: 349886 - RNA, 14 nt, Bordetella pertussis
cgcgaccaccguga

SEQ ID NO: 349887 - RNA, 23 nt, Bordetella pertussis
cgcgaccacgaccuuggcggccg

SEQ ID NO: 349888 - RNA, 14 nt, Bordetella pertussis
cgcgaccacggucu

SEQ ID NO: 349889 - RNA, 16 nt, Bordetella pertussis
cgcgaccacggucugg

SEQ ID NO: 349890 - RNA, 20 nt, Bordetella pertussis
cgcgaccacuggcagaccga

SEQ ID NO: 349891 - RNA, 20 nt, Bordetella pertussis
cgcgaccagcuucugcgccu

SEQ ID NO: 349892 - RNA, 22 nt, Bordetella pertussis
cgcgacccagaacccggccggc

SEQ ID NO: 349893 - RNA, 23 nt, Bordetella pertussis
cgcgacccauaguugcaugaugu

SEQ ID NO: 349894 - RNA, 17 nt, Bordetella pertussis
cgcgacccgauagccgc

SEQ ID NO: 349895 - RNA, 12 nt, Bordetella pertussis
cgcgaccgccgc

SEQ ID NO: 349896 - RNA, 14 nt, Bordetella pertussis
cgcgaccgccgccu

SEQ ID NO: 349897 - RNA, 19 nt, Bordetella pertussis
cgcgaccgccuccagcgcg

SEQ ID NO: 349898 - RNA, 22 nt, Bordetella pertussis
cgcgaccgccuccagcgcggcg

SEQ ID NO: 349899 - RNA, 23 nt, Bordetella pertussis
cgcgaccgccuccagcgcggcgg

SEQ ID NO: 349900 - RNA, 14 nt, Bordetella pertussis
cgcgaccgcgcggc

SEQ ID NO: 349901 - RNA, 20 nt, Bordetella pertussis
cgcgaccgcgcggcgcugca

SEQ ID NO: 349902 - RNA, 13 nt, Bordetella pertussis
cgcgaccuccggc

SEQ ID NO: 349903 - RNA, 15 nt, Bordetella pertussis
cgcgaccuccggcaa

SEQ ID NO: 349904 - RNA, 15 nt, Bordetella pertussis
cgcgaccucggcggc

SEQ ID NO: 349905 - RNA, 22 nt, Bordetella pertussis
cgcgaccugcgggcgcagcgcc

SEQ ID NO: 349906 - RNA, 18 nt, Bordetella pertussis
cgcgacgccagcgcgcca

SEQ ID NO: 349907 - RNA, 22 nt, Bordetella pertussis
cgcgacgcccuggccuucgacc

SEQ ID NO: 349908 - RNA, 14 nt, Bordetella pertussis
cgcgacgccugcgc

SEQ ID NO: 349909 - RNA, 16 nt, Bordetella pertussis
cgcgacgccugcgcca

SEQ ID NO: 349910 - RNA, 18 nt, Bordetella pertussis
cgcgacgcgacgcgggcg

SEQ ID NO: 349911 - RNA, 15 nt, Bordetella pertussis
cgcgacgcgggcggc

SEQ ID NO: 349912 - RNA, 17 nt, Bordetella pertussis
cgcgacgcgggcggccg

SEQ ID NO: 349913 - RNA, 18 nt, Bordetella pertussis
cgcgacgcgggcggccga

SEQ ID NO: 349914 - RNA, 21 nt, Bordetella pertussis
cgcgacgcgggcggccgacgg

SEQ ID NO: 349915 - RNA, 16 nt, Bordetella pertussis
cgcgagcagucgacca

SEQ ID NO: 349916 - RNA, 19 nt, Bordetella pertussis
cgcgagcagucgaccacgc

SEQ ID NO: 349917 - RNA, 14 nt, Bordetella pertussis
cgcgagcaugcgca

SEQ ID NO: 349918 - RNA, 17 nt, Bordetella pertussis
cgcgagcaugcgcagcg

SEQ ID NO: 349919 - RNA, 18 nt, Bordetella pertussis
cgcgagcaugcgcagcgc

SEQ ID NO: 349920 - RNA, 22 nt, Bordetella pertussis
cgcgagcccaucaggugggccg

SEQ ID NO: 349921 - RNA, 14 nt, Bordetella pertussis
cgcgagccgcccac

SEQ ID NO: 349922 - RNA, 23 nt, Bordetella pertussis
cgcgagcccgcgucagacgcgcu

SEQ ID NO: 349923 - RNA, 19 nt, Bordetella pertussis
cgcgagcgcaagcaccgcc

SEQ ID NO: 349924 - RNA, 22 nt, Bordetella pertussis
cgcgagcgcacaggcggcgccg

SEQ ID NO: 349925 - RNA, 12 nt, Bordetella pertussis
cgcgagcgccgg

SEQ ID NO: 349926 - RNA, 14 nt, Bordetella pertussis
cgcgagcggccagc

SEQ ID NO: 349927 - RNA, 11 nt, Bordetella pertussis
cgcgagcugcg

SEQ ID NO: 349928 - RNA, 16 nt, Bordetella pertussis
cgcgagcugcgcgacc

SEQ ID NO: 349929 - RNA, 15 nt, Bordetella pertussis
cgcgagcugcgcggc

SEQ ID NO: 349930 - RNA, 18 nt, Bordetella pertussis
cgcgagcugcgcggcuuu

SEQ ID NO: 349931 - RNA, 16 nt, Bordetella pertussis
cgcgaggcgcaggccg

SEQ ID NO: 349932 - RNA, 18 nt, Bordetella pertussis
cgcgaggcgcaggccgac

SEQ ID NO: 349933 - RNA, 20 nt, Bordetella pertussis
cgcgaggcgcaggccgacgc

SEQ ID NO: 349934 - RNA, 16 nt, Bordetella pertussis
cgcgaggcggcggccg

SEQ ID NO: 349935 - RNA, 15 nt, Bordetella pertussis
cgcgagggcaucagc

SEQ ID NO: 349936 - RNA, 16 nt, Bordetella pertussis
cgcgaggugccggacg

SEQ ID NO: 349937 - RNA, 17 nt, Bordetella pertussis
cgcgaggugccggacgc

SEQ ID NO: 349938 - RNA, 16 nt, Bordetella pertussis
cgcgagguggcgcucg

SEQ ID NO: 349939 - RNA, 22 nt, Bordetella pertussis
cgcgagguggcgcucgcgccca

SEQ ID NO: 349940 - RNA, 22 nt, Bordetella pertussis
cgcgaggugggcggcagcaggc

SEQ ID NO: 349941 - RNA, 23 nt, Bordetella pertussis
cgcgaggugggcggcagcaggcg

SEQ ID NO: 349942 - RNA, 21 nt, Bordetella pertussis
cgcgaucagcgcggccgcuug

SEQ ID NO: 349943 - RNA, 16 nt, Bordetella pertussis
cgcgauccagcagcgu

SEQ ID NO: 349944 - RNA, 14 nt, Bordetella pertussis
cgcgaucucgcgca

SEQ ID NO: 349945 - RNA, 16 nt, Bordetella pertussis
cgcgaucucgggcagg

SEQ ID NO: 349946 - RNA, 23 nt, Bordetella pertussis
cgcgaucucgggcaggucggcca

SEQ ID NO: 349947 - RNA, 17 nt, Bordetella pertussis
cgcgaucucguggccca

SEQ ID NO: 349948 - RNA, 19 nt, Bordetella pertussis
cgcgaucucguggcccagc

SEQ ID NO: 349949 - RNA, 14 nt, Bordetella pertussis
cgcgaugggccugc

SEQ ID NO: 349950 - RNA, 21 nt, Bordetella pertussis
cgcgaugggccugcccauggc

SEQ ID NO: 349951 - RNA, 14 nt, Bordetella pertussis
cgcgauguccagcu

SEQ ID NO: 349952 - RNA, 16 nt, Bordetella pertussis
cgcgauguccagcucc

SEQ ID NO: 349953 - RNA, 17 nt, Bordetella pertussis
cgcgauguccagcucca

SEQ ID NO: 349954 - RNA, 21 nt, Bordetella pertussis
cgcgaugucgaauuccgggac

SEQ ID NO: 349955 - RNA, 17 nt, Bordetella pertussis
cgcgaugucgcccaugc

SEQ ID NO: 349956 - RNA, 14 nt, Bordetella pertussis
cgcgaugucgcgcg

SEQ ID NO: 349957 - RNA, 13 nt, Bordetella pertussis
cgcgaugugacgg

SEQ ID NO: 349958 - RNA, 14 nt, Bordetella pertussis
cgcgaugugacggc

SEQ ID NO: 349959 - RNA, 15 nt, Bordetella pertussis
cgcgaugugacggcu

SEQ ID NO: 349960 - RNA, 18 nt, Bordetella pertussis
cgcgauguucaggccggc

SEQ ID NO: 349961 - RNA, 21 nt, Bordetella pertussis
cgcgauucccuggcgcgccag

SEQ ID NO: 349962 - RNA, 22 nt, Bordetella pertussis
cgcgauugaguucgcgcgccgg

SEQ ID NO: 349963 - RNA, 23 nt, Bordetella pertussis
cgcgauugaguucgcgcgccggc

SEQ ID NO: 349964 - RNA, 18 nt, Bordetella pertussis
cgcgcaaaccgacgcggc

SEQ ID NO: 349965 - RNA, 20 nt, Bordetella pertussis
cgcgcaaaccgacgcggcca

SEQ ID NO: 349966 - RNA, 18 nt, Bordetella pertussis
cgcgcaacacgcgcgacg

SEQ ID NO: 349967 - RNA, 15 nt, Bordetella pertussis
cgcgcaacaggucgu

SEQ ID NO: 349968 - RNA, 20 nt, Bordetella pertussis
cgcgcaacauggugaccggg

SEQ ID NO: 349969 - RNA, 14 nt, Bordetella pertussis
cgcgcaacgcaugc

SEQ ID NO: 349970 - RNA, 13 nt, Bordetella pertussis
cgcgcacccgcag

SEQ ID NO: 349971 - RNA, 17 nt, Bordetella pertussis
cgcgcacccgcaggccg

SEQ ID NO: 349972 - RNA, 23 nt, Bordetella pertussis
cgcgcacccgcaggccguuggcc

SEQ ID NO: 349973 - RNA, 12 nt, Bordetella pertussis
cgcgcacccgca

SEQ ID NO: 349974 - RNA, 16 nt, Bordetella pertussis
cgcgcaccgccugcug

SEQ ID NO: 349975 - RNA, 21 nt, Bordetella pertussis
cgcgcaccugggaggggccgg

SEQ ID NO: 349976 - RNA, 13 nt, Bordetella pertussis
cgcgcaccugggc

SEQ ID NO: 349977 - RNA, 16 nt, Bordetella pertussis
cgcgcaccugggcguc

SEQ ID NO: 349978 - RNA, 19 nt, Bordetella pertussis
cgcgcaccugcugcggcac

SEQ ID NO: 349979 - RNA, 19 nt, Bordetella pertussis
cgcgcaccuguucggcggc

SEQ ID NO: 349980 - RNA, 20 nt, Bordetella pertussis
cgcgcaccuguucggcggcg

SEQ ID NO: 349981 - RNA, 16 nt, Bordetella pertussis
cgcgcagacgggcccg

SEQ ID NO: 349982 - RNA, 19 nt, Bordetella pertussis
cgcgcagaucccaggcgcu

SEQ ID NO: 349983 - RNA, 23 nt, Bordetella pertussis
cgcgcagaucccaggcgcucagc

SEQ ID NO: 349984 - RNA, 12 nt, Bordetella pertussis
cgcgcagcaacc

SEQ ID NO: 349985 - RNA, 20 nt, Bordetella pertussis
cgcgcagcaagucagcccgc

SEQ ID NO: 349986 - RNA, 13 nt, Bordetella pertussis
cgcgcagcaccgc

SEQ ID NO: 349987 - RNA, 15 nt, Bordetella pertussis
cgcgcagcaccgcca

SEQ ID NO: 349988 - RNA, 17 nt, Bordetella pertussis
cgcgcagcaccggcgug

SEQ ID NO: 349989 - RNA, 13 nt, Bordetella pertussis
cgcgcagcacgcc

SEQ ID NO: 349990 - RNA, 14 nt, Bordetella pertussis
cgcgcagcacgccg

SEQ ID NO: 349991 - RNA, 12 nt, Bordetella pertussis
cgcgcagcaccu

SEQ ID NO: 349992 - RNA, 19 nt, Bordetella pertussis
cgcgcagcagcuugccgac

SEQ ID NO: 349993 - RNA, 20 nt, Bordetella pertussis
cgcgcagcagcuugccgacc

SEQ ID NO: 349994 - RNA, 13 nt, Bordetella pertussis
cgcgcagcagcgc

SEQ ID NO: 349995 - RNA, 18 nt, Bordetella pertussis
cgcgcagcaggcccaugc

SEQ ID NO: 349996 - RNA, 14 nt, Bordetella pertussis
cgcgcagcaggccg

SEQ ID NO: 349997 - RNA, 17 nt, Bordetella pertussis
cgcgcagccacagcgcg

SEQ ID NO: 349998 - RNA, 12 nt, Bordetella pertussis
cgcgcagccagg

SEQ ID NO: 349999 - RNA, 13 nt, Bordetella pertussis
cgcgcagccaggu

SEQ ID NO: 350000 - RNA, 19 nt, Bordetella pertussis
cgcgcagcgucucgcccac

SEQ ID NO: 350001 - RNA, 16 nt, Bordetella pertussis
cgcgcagcguggcggc

SEQ ID NO: 350002 - RNA, 22 nt, Bordetella pertussis
cgcgcagcguggcggcgacggc

SEQ ID NO: 350003 - RNA, 22 nt, Bordetella pertussis
cgcgcagcucccccacgccgcc

SEQ ID NO: 350004 - RNA, 22 nt, Bordetella pertussis
cgcgcagcugccugagcaccgc

SEQ ID NO: 350005 - RNA, 14 nt, Bordetella pertussis
cgcgcagcuugccc

SEQ ID NO: 350006 - RNA, 20 nt, Bordetella pertussis
cgcgcaggacaaggcgcgcg

SEQ ID NO: 350007 - RNA, 19 nt, Bordetella pertussis
cgcgcaggauuucaucgcc

SEQ ID NO: 350008 - RNA, 19 nt, Bordetella pertussis
cgcgcaggcaguuggcggc

SEQ ID NO: 350009 - RNA, 22 nt, Bordetella pertussis
cgcgcaggcccuugaucaggcg

SEQ ID NO: 350010 - RNA, 21 nt, Bordetella pertussis
cgcgcaucacgcuggccgcgc

SEQ ID NO: 350011 - RNA, 22 nt, Bordetella pertussis
cgcgcaucacgcuggccgcgcc

SEQ ID NO: 350012 - RNA, 20 nt, Bordetella pertussis
cgcgcaucgccgaacagggu

SEQ ID NO: 350013 - RNA, 13 nt, Bordetella pertussis
cgcgcaucgcgcg

SEQ ID NO: 350014 - RNA, 14 nt, Bordetella pertussis
cgcgcaucgcgcgg

SEQ ID NO: 350015 - RNA, 22 nt, Bordetella pertussis
cgcgcaucgcgcggcaugggca

SEQ ID NO: 350016 - RNA, 16 nt, Bordetella pertussis
cgcgccacggcgucgc

SEQ ID NO: 350017 - RNA, 18 nt, Bordetella pertussis
cgcgccagaacgacagcg

SEQ ID NO: 350018 - RNA, 21 nt, Bordetella pertussis
cgcgccagaacgacagcgaca

SEQ ID NO: 350019 - RNA, 16 nt, Bordetella pertussis
cgcgccagcagcgccg

SEQ ID NO: 350020 - RNA, 13 nt, Bordetella pertussis
cgcgccagcccgc

SEQ ID NO: 350021 - RNA, 14 nt, Bordetella pertussis
cgcgccagcccgcc

SEQ ID NO: 350022 - RNA, 15 nt, Bordetella pertussis
cgcgccagcccgccg

SEQ ID NO: 350023 - RNA, 17 nt, Bordetella pertussis
cgcgccagcccgccgcu

SEQ ID NO: 350024 - RNA, 12 nt, Bordetella pertussis
cgcgccagcccu

SEQ ID NO: 350025 - RNA, 17 nt, Bordetella pertussis
cgcgccagccgcgcgac

SEQ ID NO: 350026 - RNA, 21 nt, Bordetella pertussis
cgcgccagccgcgcgaccuug

SEQ ID NO: 350027 - RNA, 15 nt, Bordetella pertussis
cgcgccagccgcugc

SEQ ID NO: 350028 - RNA, 12 nt, Bordetella pertussis
cgcgccagcgcc

SEQ ID NO: 350029 - RNA, 16 nt, Bordetella pertussis
cgcgccagcgccacgc

SEQ ID NO: 350030 - RNA, 14 nt, Bordetella pertussis
cgcgccaucgacgg

SEQ ID NO: 350031 - RNA, 15 nt, Bordetella pertussis
cgcgccaucgcgucg

SEQ ID NO: 350032 - RNA, 19 nt, Bordetella pertussis
cgcgccaucgcgucgacgg

SEQ ID NO: 350033 - RNA, 13 nt, Bordetella pertussis
cgcgccagcgcca

SEQ ID NO: 350034 - RNA, 18 nt, Bordetella pertussis
cgcgccaugaacucgcgc

SEQ ID NO: 350035 - RNA, 21 nt, Bordetella pertussis
cgcgccaugaacucgcgcucg

SEQ ID NO: 350036 - RNA, 21 nt, Bordetella pertussis
cgcgccaugcaacacgaccag

SEQ ID NO: 350037 - RNA, 23 nt, Bordetella pertussis
cgcgccaugcaacacgaccagca

SEQ ID NO: 350038 - RNA, 16 nt, Bordetella pertussis
cgcgccaugcucgcgc

SEQ ID NO: 350039 - RNA, 17 nt, Bordetella pertussis
cgcgccauggccggccg

SEQ ID NO: 350040 - RNA, 19 nt, Bordetella pertussis
cgcgccauggccggccgcc

SEQ ID NO: 350041 - RNA, 19 nt, Bordetella pertussis
cgcgccauugccacggcgg

SEQ ID NO: 350042 - RNA, 20 nt, Bordetella pertussis
cgcgccauugccacggcggg

SEQ ID NO: 350043 - RNA, 14 nt, Bordetella pertussis
cgcgcccaccaggg

SEQ ID NO: 350044 - RNA, 21 nt, Bordetella pertussis
cgcgcccaccagggugccgcc

SEQ ID NO: 350045 - RNA, 20 nt, Bordetella pertussis
cgcgcccaccgagacgcugu

SEQ ID NO: 350046 - RNA, 20 nt, Bordetella pertussis
cgcgccccgcuucgggccgg

SEQ ID NO: 350047 - RNA, 16 nt, Bordetella pertussis
cgcgccccuagcgccg

SEQ ID NO: 350048 - RNA, 18 nt, Bordetella pertussis
cgcgccccuagcgccgcg

SEQ ID NO: 350049 - RNA, 19 nt, Bordetella pertussis
cgcgccccuagcgccgcgc

SEQ ID NO: 350050 - RNA, 20 nt, Bordetella pertussis
cgcgccccuagcgccgcgcc

SEQ ID NO: 350051 - RNA, 21 nt, Bordetella pertussis
cgcgccccuagcgccgcgcca

SEQ ID NO: 350052 - RNA, 20 nt, Bordetella pertussis
cgcgcccgaggcgcgcagca

SEQ ID NO: 350053 - RNA, 21 nt, Bordetella pertussis
cgcgcccgcaacgggccggcc

SEQ ID NO: 350054 - RNA, 14 nt, Bordetella pertussis
cgcgcccgcaggcg

SEQ ID NO: 350055 - RNA, 19 nt, Bordetella pertussis
cgcgcccgcaggcggcggc

SEQ ID NO: 350056 - RNA, 14 nt, Bordetella pertussis
cgcgcccgccgcgc

SEQ ID NO: 350057 - RNA, 23 nt, Bordetella pertussis
cgcgcccgccgcgucggcgccga

SEQ ID NO: 350058 - RNA, 16 nt, Bordetella pertussis
cgcgcccugcacgcgc

SEQ ID NO: 350059 - RNA, 14 nt, Bordetella pertussis
cgcgcccugcuuga

SEQ ID NO: 350060 - RNA, 19 nt, Bordetella pertussis
cgcgcccuggcgcggcggc

SEQ ID NO: 350061 - RNA, 21 nt, Bordetella pertussis
cgcgcccuggcgcggcggcgu

SEQ ID NO: 350062 - RNA, 19 nt, Bordetella pertussis
cgcgccgaaaugcacgacg

SEQ ID NO: 350063 - RNA, 13 nt, Bordetella pertussis
cgcgccgaagcgc

SEQ ID NO: 350064 - RNA, 18 nt, Bordetella pertussis
cgcgccgaagcgcaggcc

SEQ ID NO: 350065 - RNA, 22 nt, Bordetella pertussis
cgcgccgaagcgcaggccuucg

SEQ ID NO: 350066 - RNA, 21 nt, Bordetella pertussis
cgcgccgaaguugcggccgug

SEQ ID NO: 350067 - RNA, 15 nt, Bordetella pertussis
cgcgccgaacaccag

SEQ ID NO: 350068 - RNA, 15 nt, Bordetella pertussis
cgcgccgaccaccug

SEQ ID NO: 350069 - RNA, 16 nt, Bordetella pertussis
cgcgccgaccacgcug

SEQ ID NO: 350070 - RNA, 17 nt, Bordetella pertussis
cgcgccgaccacgcugg

SEQ ID NO: 350071 - RNA, 21 nt, Bordetella pertussis
cgcgccgaucaccacgggcac

SEQ ID NO: 350072 - RNA, 17 nt, Bordetella pertussis
cgcgccgaugcgccagg

SEQ ID NO: 350073 - RNA, 21 nt, Bordetella pertussis
cgcgccgcaauagaucaucca

SEQ ID NO: 350074 - RNA, 23 nt, Bordetella pertussis
cgcgccgcaauagaucauccagg

SEQ ID NO: 350075 - RNA, 14 nt, Bordetella pertussis
cgcgccgcacgcuc

SEQ ID NO: 350076 - RNA, 17 nt, Bordetella pertussis
cgcgccgcagcguggcg

SEQ ID NO: 350077 - RNA, 12 nt, Bordetella pertussis
cgcgccgcaggc

SEQ ID NO: 350078 - RNA, 20 nt, Bordetella pertussis
cgcgccgccggugcaccagg

SEQ ID NO: 350079 - RNA, 23 nt, Bordetella pertussis
cgcgccgccucgauugaccagca

SEQ ID NO: 350080 - RNA, 22 nt, Bordetella pertussis
cgcgccgccucgcgcuccagca

SEQ ID NO: 350081 - RNA, 13 nt, Bordetella pertussis
cgcgccgccuggc

SEQ ID NO: 350082 - RNA, 12 nt, Bordetella pertussis
cgcgccgcgacg

SEQ ID NO: 350083 - RNA, 13 nt, Bordetella pertussis
cgcgccgcgaugg

SEQ ID NO: 350084 - RNA, 13 nt, Bordetella pertussis
cgcgccgcgcaga

SEQ ID NO: 350085 - RNA, 15 nt, Bordetella pertussis
cgcgccgcgcugccc

SEQ ID NO: 350086 - RNA, 19 nt, Bordetella pertussis
cgcgccgcgcugcccgaga

SEQ ID NO: 350087 - RNA, 16 nt, Bordetella pertussis
cgcgccgcgccgguca

SEQ ID NO: 350088 - RNA, 13 nt, Bordetella pertussis
cgcgccgcgcgca

SEQ ID NO: 350089 - RNA, 16 nt, Bordetella pertussis
cgcgccgcgcgcacgg

SEQ ID NO: 350090 - RNA, 18 nt, Bordetella pertussis
cgcgccgcgcgcggcggc

SEQ ID NO: 350091 - RNA, 20 nt, Bordetella pertussis
cgcgccgcggcaagccgcgg

SEQ ID NO: 350092 - RNA, 14 nt, Bordetella pertussis
cgcgccgcggcacg

SEQ ID NO: 350093 - RNA, 21 nt, Bordetella pertussis
cgcgccgcggcgggcuuggcg

SEQ ID NO: 350094 - RNA, 18 nt, Bordetella pertussis
cgcgccgcgggcugcgac

SEQ ID NO: 350095 - RNA, 11 nt, Bordetella pertussis
cgcgccggccg

SEQ ID NO: 350096 - RNA, 15 nt, Bordetella pertussis
cgcgccggccgacag

SEQ ID NO: 350097 - RNA, 14 nt, Bordetella pertussis
cgcgccggccgacg

SEQ ID NO: 350098 - RNA, 15 nt, Bordetella pertussis
cgcgccggccgacgg

SEQ ID NO: 350099 - RNA, 16 nt, Bordetella pertussis
cgcgccggccgacggc

SEQ ID NO: 350100 - RNA, 18 nt, Bordetella pertussis
cgcgccggccgacggcgc

SEQ ID NO: 350101 - RNA, 19 nt, Bordetella pertussis
cgcgccggccgacggcgcu

SEQ ID NO: 350102 - RNA, 12 nt, Bordetella pertussis
cgcgccgcgccg

SEQ ID NO: 350103 - RNA, 13 nt, Bordetella pertussis
cgcgccgcggcgg

SEQ ID NO: 350104 - RNA, 17 nt, Bordetella pertussis
cgcgccggccgccagca

SEQ ID NO: 350105 - RNA, 11 nt, Bordetella pertussis
cgcgccggccu

SEQ ID NO: 350106 - RNA, 18 nt, Bordetella pertussis
cgcgccggccugggcggc

SEQ ID NO: 350107 - RNA, 21 nt, Bordetella pertussis
cgcgccggccugggcggcggc

SEQ ID NO: 350108 - RNA, 13 nt, Bordetella pertussis
cgcgccggcgccg

SEQ ID NO: 350109 - RNA, 15 nt, Bordetella pertussis
cgcgccggcgccggc

SEQ ID NO: 350110 - RNA, 13 nt, Bordetella pertussis
cgcgccggcgccu

SEQ ID NO: 350111 - RNA, 15 nt, Bordetella pertussis
cgcgccggcgccuug

SEQ ID NO: 350112 - RNA, 14 nt, Bordetella pertussis
cgcgccggcggcaa

SEQ ID NO: 350113 - RNA, 17 nt, Bordetella pertussis
cgcgccggcggccugca

SEQ ID NO: 350114 - RNA, 13 nt, Bordetella pertussis
cgcgccggcggcc

SEQ ID NO: 350115 - RNA, 17 nt, Bordetella pertussis
cgcgccggcuaccgcgc

SEQ ID NO: 350116 - RNA, 18 nt, Bordetella pertussis
cgcgccggcuaccgcgcc

SEQ ID NO: 350117 - RNA, 21 nt, Bordetella pertussis
cgcgccgggcccggccacggc

SEQ ID NO: 350118 - RNA, 22 nt, Bordetella pertussis
cgcgccgggcccggccacggcc

SEQ ID NO: 350119 - RNA, 13 nt, Bordetella pertussis
cgcgccgggccgg

SEQ ID NO: 350120 - RNA, 15 nt, Bordetella pertussis
cgcgccgggccggcg

SEQ ID NO: 350121 - RNA, 14 nt, Bordetella pertussis
cgcgccgggccuag

SEQ ID NO: 350122 - RNA, 18 nt, Bordetella pertussis
cgcgccggcucccgcgcu

SEQ ID NO: 350123 - RNA, 20 nt, Bordetella pertussis
cgcgccggcucccgcgcugc

SEQ ID NO: 350124 - RNA, 15 nt, Bordetella pertussis
cgcgccggcucgaac

SEQ ID NO: 350125 - RNA, 20 nt, Bordetella pertussis
cgcgccggcucguacggcgu

SEQ ID NO: 350126 - RNA, 23 nt, Bordetella pertussis
cgcgccggcugaauuggcgccca

SEQ ID NO: 350127 - RNA, 17 nt, Bordetella pertussis
cgcgccggggcggcucg

SEQ ID NO: 350128 - RNA, 12 nt, Bordetella pertussis
cgcgcugguccg

SEQ ID NO: 350129 - RNA, 14 nt, Bordetella pertussis
cgcgcuggugcugg

SEQ ID NO: 350130 - RNA, 18 nt, Bordetella pertussis
cgcgcuguaggcgccggc

SEQ ID NO: 350131 - RNA, 21 nt, Bordetella pertussis
cgcgcuguaggcgccggcgcc

SEQ ID NO: 350132 - RNA, 21 nt, Bordetella pertussis
cgcgcuguugcuccaggccgg

SEQ ID NO: 350133 - RNA, 19 nt, Bordetella pertussis
cgcgcuguucaucaacaug

SEQ ID NO: 350134 - RNA, 16 nt, Bordetella pertussis
cgcgcuucacccugga

SEQ ID NO: 350135 - RNA, 17 nt, Bordetella pertussis
cgcgcuucagugcucgg

SEQ ID NO: 350136 - RNA, 17 nt, Bordetella pertussis
cgcgcuucuuggcgacc

SEQ ID NO: 350137 - RNA, 20 nt, Bordetella pertussis
cgcgcuucuuggcgaccagg

SEQ ID NO: 350138 - RNA, 20 nt, Bordetella pertussis
cgcgcuugaacuccgcggcg

SEQ ID NO: 350139 - RNA, 16 nt, Bordetella pertussis
cgcgcuugacguccag

SEQ ID NO: 350140 - RNA, 20 nt, Bordetella pertussis
cgcgcuugacguccagcgac

SEQ ID NO: 350141 - RNA, 15 nt, Bordetella pertussis
cgcgcuugagcggcu

SEQ ID NO: 350142 - RNA, 17 nt, Bordetella pertussis
cgcgcuugagcggcucg

SEQ ID NO: 350143 - RNA, 19 nt, Bordetella pertussis
cgcgcuugagcggcucgcc

SEQ ID NO: 350144 - RNA, 22 nt, Bordetella pertussis
cgcgcuugagcggcucgccucc

SEQ ID NO: 350145 - RNA, 13 nt, Bordetella pertussis
cgcgcuugaggcu

SEQ ID NO: 350146 - RNA, 13 nt, Bordetella pertussis
cgcgcuugcgcgc

SEQ ID NO: 350147 - RNA, 15 nt, Bordetella pertussis
cgcgcuugcgcgcca

SEQ ID NO: 350148 - RNA, 16 nt, Bordetella pertussis
cgcgcuugcgcgccac

SEQ ID NO: 350149 - RNA, 17 nt, Bordetella pertussis
cgcgcuugcgcgccacg

SEQ ID NO: 350150 - RNA, 14 nt, Bordetella pertussis
cgcgcuugcucggu

SEQ ID NO: 350151 - RNA, 14 nt, Bordetella pertussis
cgcgcuugggacgc

SEQ ID NO: 350152 - RNA, 20 nt, Bordetella pertussis
cgcggaagcugacgaaacgc

SEQ ID NO: 350153 - RNA, 21 nt, Bordetella pertussis
cgcggaagucgggcaccagca

SEQ ID NO: 350154 - RNA, 23 nt, Bordetella pertussis
cgcggacgccauggcggcggcca

SEQ ID NO: 350155 - RNA, 17 nt, Bordetella pertussis
cgcggacuucgcccggg

SEQ ID NO: 350156 - RNA, 18 nt, Bordetella pertussis
cgcggaggagguggcugg

SEQ ID NO: 350157 - RNA, 23 nt, Bordetella pertussis
cgcggaggagguuuuccuggagc

SEQ ID NO: 350158 - RNA, 16 nt, Bordetella pertussis
cgcggaggugucgccg

SEQ ID NO: 350159 - RNA, 15 nt, Bordetella pertussis
cgcggaucgaaaccg

SEQ ID NO: 350160 - RNA, 12 nt, Bordetella pertussis
cgcggauccagc

SEQ ID NO: 350161 - RNA, 14 nt, Bordetella pertussis
cgcggauccagcca

SEQ ID NO: 350162 - RNA, 19 nt, Bordetella pertussis
cgcggaugaccugcgccag

SEQ ID NO: 350163 - RNA, 22 nt, Bordetella pertussis
cgcggaugaccugcgccaggug

SEQ ID NO: 350164 - RNA, 18 nt, Bordetella pertussis
cgcggaugaccuggugca

SEQ ID NO: 350165 - RNA, 17 nt, Bordetella pertussis
cgcggaugccguccacg

SEQ ID NO: 350166 - RNA, 21 nt, Bordetella pertussis
cgcggaugccguccacgccgc

SEQ ID NO: 350167 - RNA, 23 nt, Bordetella pertussis
cgcggaugccguccacgccgcgc

SEQ ID NO: 350168 - RNA, 24 nt, Bordetella pertussis
cgcggauugccguccuggcgaccg

SEQ ID NO: 350169 - RNA, 20 nt, Bordetella pertussis
cgcggcaaauggggcggccg

SEQ ID NO: 350170 - RNA, 15 nt, Bordetella pertussis
cgcggcacgcugcug

SEQ ID NO: 350171 - RNA, 14 nt, Bordetella pertussis
cgcggcagcccggc

SEQ ID NO: 350172 - RNA, 16 nt, Bordetella pertussis
cgcggcagcccggcac

SEQ ID NO: 350173 - RNA, 14 nt, Bordetella pertussis
cgcggcagcgccgg

SEQ ID NO: 350174 - RNA, 15 nt, Bordetella pertussis
cgcggcagcgccggg

SEQ ID NO: 350175 - RNA, 21 nt, Bordetella pertussis
cgcggcaggccccggcccggc

SEQ ID NO: 350176 - RNA, 17 nt, Bordetella pertussis
cgcggcauagcccaggc

SEQ ID NO: 350177 - RNA, 20 nt, Bordetella pertussis
cgcggcauagcccaggccgc

SEQ ID NO: 350178 - RNA, 22 nt, Bordetella pertussis
cgcggcauagcccaggccgccg

SEQ ID NO: 350179 - RNA, 22 nt, Bordetella pertussis
cgcggcagguucugcgcguccu

SEQ ID NO: 350180 - RNA, 15 nt, Bordetella pertussis
cgcggcaugccgcug

SEQ ID NO: 350181 - RNA, 18 nt, Bordetella pertussis
cgcggcauggcgccgcgc

SEQ ID NO: 350182 - RNA, 19 nt, Bordetella pertussis
cgcggcauggcgccgcgcc

SEQ ID NO: 350183 - RNA, 14 nt, Bordetella pertussis
cgcggcaucggcca

SEQ ID NO: 350184 - RNA, 14 nt, Bordetella pertussis
cgcggccaauggcc

SEQ ID NO: 350185 - RNA, 17 nt, Bordetella pertussis
cgcggccacggccugcc

SEQ ID NO: 350186 - RNA, 18 nt, Bordetella pertussis
cgcggccagaccuugcgc

SEQ ID NO: 350187 - RNA, 14 nt, Bordetella pertussis
cgcggccagcacga

SEQ ID NO: 350188 - RNA, 13 nt, Bordetella pertussis
cgcggccagcagc

SEQ ID NO: 350189 - RNA, 11 nt, Bordetella pertussis
cgcggccagca

SEQ ID NO: 350190 - RNA, 12 nt, Bordetella pertussis
cgcggccagcca

SEQ ID NO: 350191 - RNA, 17 nt, Bordetella pertussis
cgcggccagccacgccg

SEQ ID NO: 350192 - RNA, 18 nt, Bordetella pertussis
cgcggccagccacgccgg

SEQ ID NO: 350193 - RNA, 14 nt, Bordetella pertussis
cgcggccagccggg

SEQ ID NO: 350194 - RNA, 14 nt, Bordetella pertussis
cgcggccagcgccg

SEQ ID NO: 350195 - RNA, 17 nt, Bordetella pertussis
cgcggccagcgccgcgc

SEQ ID NO: 350196 - RNA, 16 nt, Bordetella pertussis
cgcggccaggcccaug

SEQ ID NO: 350197 - RNA, 21 nt, Bordetella pertussis
cgcggccaggcccaugccgcc

SEQ ID NO: 350198 - RNA, 12 nt, Bordetella pertussis
cgcggccaggcg

SEQ ID NO: 350199 - RNA, 14 nt, Bordetella pertussis
cgcggccaggcgcg

SEQ ID NO: 350200 - RNA, 22 nt, Bordetella pertussis
cgcggccaggcgcgugcgcagg

SEQ ID NO: 350201 - RNA, 14 nt, Bordetella pertussis
cgcggccaggcgcu

SEQ ID NO: 350202 - RNA, 19 nt, Bordetella pertussis
cgcggccagggcugcggcg

SEQ ID NO: 350203 - RNA, 19 nt, Bordetella pertussis
cgcggccagggugccccgc

SEQ ID NO: 350204 - RNA, 20 nt, Bordetella pertussis
cgcggccagcgcgucgagca

SEQ ID NO: 350205 - RNA, 23 nt, Bordetella pertussis
cgcggccagcggaugaugcggcg

SEQ ID NO: 350206 - RNA, 14 nt, Bordetella pertussis
cgcggccaggucgg

SEQ ID NO: 350207 - RNA, 21 nt, Bordetella pertussis
cgcggccaguucgacgcccau

SEQ ID NO: 350208 - RNA, 22 nt, Bordetella pertussis
cgcggccaguucgacgcccaug

SEQ ID NO: 350209 - RNA, 14 nt, Bordetella pertussis
cgcggccaugccgg

SEQ ID NO: 350210 - RNA, 24 nt, Bordetella pertussis
cgcggccaugccggguugcaggau

SEQ ID NO: 350211 - RNA, 22 nt, Bordetella pertussis
cgcggccauguccagcagcuug

SEQ ID NO: 350212 - RNA, 15 nt, Bordetella pertussis
cgcggcccacggcca

SEQ ID NO: 350213 - RNA, 16 nt, Bordetella pertussis
cgcggcccacggccag

SEQ ID NO: 350214 - RNA, 19 nt, Bordetella pertussis
cgcggcccacggccagcac

SEQ ID NO: 350215 - RNA, 17 nt, Bordetella pertussis
cgcggcccagcgcggcg

SEQ ID NO: 350216 - RNA, 21 nt, Bordetella pertussis
cgcggcccagcgcggcggcca

SEQ ID NO: 350217 - RNA, 17 nt, Bordetella pertussis
cgcggccgagcgggcca

SEQ ID NO: 350218 - RNA, 20 nt, Bordetella pertussis
cgcggccgagcgggccagcg

SEQ ID NO: 350219 - RNA, 21 nt, Bordetella pertussis
cgcggccgagcgggccagcgc

SEQ ID NO: 350220 - RNA, 15 nt, Bordetella pertussis
cgcggccgaggccag

SEQ ID NO: 350221 - RNA, 17 nt, Bordetella pertussis
cgcggccgaggccagcg

SEQ ID NO: 350222 - RNA, 21 nt, Bordetella pertussis
cgcggccgaggccagcgugcc

SEQ ID NO: 350223 - RNA, 23 nt, Bordetella pertussis
cgcggccgaggccagcgugccca

SEQ ID NO: 350224 - RNA, 20 nt, Bordetella pertussis
cgcggccccggcucccgcgc

SEQ ID NO: 350225 - RNA, 18 nt, Bordetella pertussis
cgcggccgacccgaaccg

SEQ ID NO: 350226 - RNA, 21 nt, Bordetella pertussis
cgcggccgacguggaccgcgc

SEQ ID NO: 350227 - RNA, 19 nt, Bordetella pertussis
cgcggccgccagcccgagg

SEQ ID NO: 350228 - RNA, 21 nt, Bordetella pertussis
cgcggccgauguuuuccuggg

SEQ ID NO: 350229 - RNA, 12 nt, Bordetella pertussis
cgcggccgcccc

SEQ ID NO: 350230 - RNA, 14 nt, Bordetella pertussis
cgcggccgccccca

SEQ ID NO: 350231 - RNA, 22 nt, Bordetella pertussis
cgcggccgcccccagcgcgccu

SEQ ID NO: 350232 - RNA, 23 nt, Bordetella pertussis
cgcggccgccgcccgccucaggc

SEQ ID NO: 350233 - RNA, 13 nt, Bordetella pertussis
cgcggccgcgcag

SEQ ID NO: 350234 - RNA, 12 nt, Bordetella pertussis
cgcggccucggc

SEQ ID NO: 350235 - RNA, 23 nt, Bordetella pertussis
cgcggccgccguaaucggcgucg

SEQ ID NO: 350236 - RNA, 16 nt, Bordetella pertussis
cgcggccugcagacca

SEQ ID NO: 350237 - RNA, 18 nt, Bordetella pertussis
cgcggccugcagaccagc

SEQ ID NO: 350238 - RNA, 19 nt, Bordetella pertussis
cgcggccugcagaccagca

SEQ ID NO: 350239 - RNA, 23 nt, Bordetella pertussis
cgcggccugcagaccagcaccgg

SEQ ID NO: 350240 - RNA, 13 nt, Bordetella pertussis
cgcggccugcgcg

SEQ ID NO: 350241 - RNA, 14 nt, Bordetella pertussis
cgcggccugcuccg

SEQ ID NO: 350242 - RNA, 16 nt, Bordetella pertussis
cgcggccugcuccggc

SEQ ID NO: 350243 - RNA, 13 nt, Bordetella pertussis
cgcggccugggcg

SEQ ID NO: 350244 - RNA, 14 nt, Bordetella pertussis
cgcggccuucccaa

SEQ ID NO: 350245 - RNA, 18 nt, Bordetella pertussis
cgcggccuucaccccgcc

SEQ ID NO: 350246 - RNA, 15 nt, Bordetella pertussis
cgcggcgagcacggc

SEQ ID NO: 350247 - RNA, 17 nt, Bordetella pertussis
cgcggcgagcacggccu

SEQ ID NO: 350248 - RNA, 22 nt, Bordetella pertussis
cgcggcgagcacggccugcucg

SEQ ID NO: 350249 - RNA, 13 nt, Bordetella pertussis
cgcggcgcaggcc

SEQ ID NO: 350250 - RNA, 17 nt, Bordetella pertussis
cgcggcgcaggccugcg

SEQ ID NO: 350251 - RNA, 19 nt, Bordetella pertussis
cgcggcgcaggccugcggc

SEQ ID NO: 350252 - RNA, 14 nt, Bordetella pertussis
cgcggcgcagcgca

SEQ ID NO: 350253 - RNA, 16 nt, Bordetella pertussis
cgcggcgcagguccac

SEQ ID NO: 350254 - RNA, 20 nt, Bordetella pertussis
cgcggcgcagguccaccgcc

SEQ ID NO: 350255 - RNA, 20 nt, Bordetella pertussis
cgcggcgcauuggccaacgg

SEQ ID NO: 350256 - RNA, 12 nt, Bordetella pertussis
cgcggcgccagc

SEQ ID NO: 350257 - RNA, 13 nt, Bordetella pertussis
cgcggcgccagcg

SEQ ID NO: 350258 - RNA, 14 nt, Bordetella pertussis
cgcggcgccagcgc

SEQ ID NO: 350259 - RNA, 13 nt, Bordetella pertussis
aacagcagcggaa

SEQ ID NO: 350260 - RNA, 23 nt, Bordetella pertussis
cgcggcgccgcauuuccucgacc

SEQ ID NO: 350261 - RNA, 13 nt, Bordetella pertussis
cgcggcgccgccg

SEQ ID NO: 350262 - RNA, 15 nt, Bordetella pertussis
cgcggcgccgccggc

SEQ ID NO: 350263 - RNA, 17 nt, Bordetella pertussis
cgcggcgccgccggcgg

SEQ ID NO: 350264 - RNA, 12 nt, Bordetella pertussis
cgcggcgccgcg

SEQ ID NO: 350265 - RNA, 20 nt, Bordetella pertussis
cgcggcgccggccuccagca

SEQ ID NO: 350266 - RNA, 15 nt, Bordetella pertussis
cgcggcggcagcgcg

SEQ ID NO: 350267 - RNA, 13 nt, Bordetella pertussis
cgcggcgccgcug

SEQ ID NO: 350268 - RNA, 13 nt, Bordetella pertussis
cgcggcggccggu

SEQ ID NO: 350269 - RNA, 21 nt, Bordetella pertussis
cgcggcggccuugugcgccag

SEQ ID NO: 350270 - RNA, 13 nt, Bordetella pertussis
cgcggcggcgacc

SEQ ID NO: 350271 - RNA, 14 nt, Bordetella pertussis
cgcggcggcggcca

SEQ ID NO: 350272 - RNA, 14 nt, Bordetella pertussis
cgcggcggugccug

SEQ ID NO: 350273 - RNA, 21 nt, Bordetella pertussis
cgcggcggcggccaugacggc

SEQ ID NO: 350274 - RNA, 22 nt, Bordetella pertussis
cgcggcggcggccaugacggcc

SEQ ID NO: 350275 - RNA, 16 nt, Bordetella pertussis
cgcggcguacuggcgc

SEQ ID NO: 350276 - RNA, 16 nt, Bordetella pertussis
cgcggcguccgcgccg

SEQ ID NO: 350277 - RNA, 17 nt, Bordetella pertussis
cgcggcguccgcgccga

SEQ ID NO: 350278 - RNA, 18 nt, Bordetella pertussis
cgcggcguccgcgccgaa

SEQ ID NO: 350279 - RNA, 19 nt, Bordetella pertussis
cgcggcgucgacgcccgcg

SEQ ID NO: 350280 - RNA, 20 nt, Bordetella pertussis
cgcggcgucgacgcccgcgc

SEQ ID NO: 350281 - RNA, 14 nt, Bordetella pertussis
cgcggcgucgaugu

SEQ ID NO: 350282 - RNA, 23 nt, Bordetella pertussis
cgcggcucgccggccgcgcccag

SEQ ID NO: 350283 - RNA, 19 nt, Bordetella pertussis
cgcggcucagagcuugccg

SEQ ID NO: 350284 - RNA, 12 nt, Bordetella pertussis
cgcggcugcggg

SEQ ID NO: 350285 - RNA, 19 nt, Bordetella pertussis
cgcggcugcgggccggcgc

SEQ ID NO: 350286 - RNA, 22 nt, Bordetella pertussis
cgcggcugcgggccggcgccgg

SEQ ID NO: 350287 - RNA, 12 nt, Bordetella pertussis
cgcggcugcugg

SEQ ID NO: 350288 - RNA, 14 nt, Bordetella pertussis
cgcggcugcugggc

SEQ ID NO: 350289 - RNA, 18 nt, Bordetella pertussis
cgcggcugcugggcaugg

SEQ ID NO: 350290 - RNA, 22 nt, Bordetella pertussis
cgcggcuggggcugcugggccg

SEQ ID NO: 350291 - RNA, 21 nt, Bordetella pertussis
cgcggcuguccuggcguggcc

SEQ ID NO: 350292 - RNA, 19 nt, Bordetella pertussis
cgcggcuugcagcggacgg

SEQ ID NO: 350293 - RNA, 17 nt, Bordetella pertussis
cgcggcuugccgcggcg

SEQ ID NO: 350294 - RNA, 22 nt, Bordetella pertussis
cgcgggauucugcugcaugccg

SEQ ID NO: 350295 - RNA, 18 nt, Bordetella pertussis
cgcgggcaaagcccagca

SEQ ID NO: 350296 - RNA, 20 nt, Bordetella pertussis
cgcgggcaaagcccagcaag

SEQ ID NO: 350297 - RNA, 17 nt, Bordetella pertussis
cgcgggcagugcgccgg

SEQ ID NO: 350298 - RNA, 23 nt, Bordetella pertussis
cgcgggcgauuugccgcagcccg

SEQ ID NO: 350299 - RNA, 17 nt, Bordetella pertussis
cgcgggcgcccggccgg

SEQ ID NO: 350300 - RNA, 16 nt, Bordetella pertussis
cgcgggcgcggcaggc

SEQ ID NO: 350301 - RNA, 18 nt, Bordetella pertussis
cgcgggcgcggcaggcgg

SEQ ID NO: 350302 - RNA, 19 nt, Bordetella pertussis
cgcgguaaugacgcagccg

SEQ ID NO: 350303 - RNA, 21 nt, Bordetella pertussis
cgcgguaaugacgcagccgcc

SEQ ID NO: 350304 - RNA, 18 nt, Bordetella pertussis
cgcgguacgcaccgccgc

SEQ ID NO: 350305 - RNA, 15 nt, Bordetella pertussis
cgcgguacgcccagc

SEQ ID NO: 350306 - RNA, 16 nt, Bordetella pertussis
cgcgguacgcccagcu

SEQ ID NO: 350307 - RNA, 20 nt, Bordetella pertussis
cgcggucaugccgaacagca

SEQ ID NO: 350308 - RNA, 22 nt, Bordetella pertussis
cgcgguccaccucgucguccag

SEQ ID NO: 350309 - RNA, 14 nt, Bordetella pertussis
cgcgguccagcaag

SEQ ID NO: 350310 - RNA, 15 nt, Bordetella pertussis
cgcgguccagcacca

SEQ ID NO: 350311 - RNA, 17 nt, Bordetella pertussis
cgcgguccagcaccagg

SEQ ID NO: 350312 - RNA, 20 nt, Bordetella pertussis
cgcgguccagcacggcgagg

SEQ ID NO: 350313 - RNA, 13 nt, Bordetella pertussis
cgcgguccagccc

SEQ ID NO: 350314 - RNA, 14 nt, Bordetella pertussis
cgcgguccagcccc

SEQ ID NO: 350315 - RNA, 13 nt, Bordetella pertussis
cgcgguccacgcc

SEQ ID NO: 350316 - RNA, 16 nt, Bordetella pertussis
cgcgguccacgccggg

SEQ ID NO: 350317 - RNA, 17 nt, Bordetella pertussis
cgcgguccacgcgggca

SEQ ID NO: 350318 - RNA, 23 nt, Bordetella pertussis
cgcgguccauggugaugcugucg

SEQ ID NO: 350319 - RNA, 19 nt, Bordetella pertussis
cgcgguccgcagcgcucgc

SEQ ID NO: 350320 - RNA, 16 nt, Bordetella pertussis
cgcgguccugaccggc

SEQ ID NO: 350321 - RNA, 22 nt, Bordetella pertussis
cgcggucgacgaaauagccgac

SEQ ID NO: 350322 - RNA, 16 nt, Bordetella pertussis
cgcggucguagcggau

SEQ ID NO: 350323 - RNA, 14 nt, Bordetella pertussis
cgcggucggugcaa

SEQ ID NO: 350324 - RNA, 19 nt, Bordetella pertussis
cgcggucggugcaaugccc

SEQ ID NO: 350325 - RNA, 22 nt, Bordetella pertussis
cgcggucggugcaaugcccagu

SEQ ID NO: 350326 - RNA, 23 nt, Bordetella pertussis
cgcggucugcgguccgaugucga

SEQ ID NO: 350327 - RNA, 17 nt, Bordetella pertussis
cgcggugcaagcggccg

SEQ ID NO: 350328 - RNA, 16 nt, Bordetella pertussis
cgcggugcaucucggc

SEQ ID NO: 350329 - RNA, 19 nt, Bordetella pertussis
cgcggugucgccgccgcgc

SEQ ID NO: 350330 - RNA, 19 nt, Bordetella pertussis
cgcguacgcggcgcggucg

SEQ ID NO: 350331 - RNA, 15 nt, Bordetella pertussis
cgcguacguggcgcg

SEQ ID NO: 350332 - RNA, 17 nt, Bordetella pertussis
cgcguacguggcgcggc

SEQ ID NO: 350333 - RNA, 19 nt, Bordetella pertussis
cgcguacguggcgcggcug

SEQ ID NO: 350334 - RNA, 21 nt, Bordetella pertussis
cgcguacuuccucgaccagcc

SEQ ID NO: 350335 - RNA, 16 nt, Bordetella pertussis
cgcguagcgcggccgg

SEQ ID NO: 350336 - RNA, 17 nt, Bordetella pertussis
cgcguagcgcggccggg

SEQ ID NO: 350337 - RNA, 13 nt, Bordetella pertussis
cgcguaggcgcgc

SEQ ID NO: 350338 - RNA, 18 nt, Bordetella pertussis
cgcguaggcggucagcug

SEQ ID NO: 350339 - RNA, 14 nt, Bordetella pertussis
cgcgucaggccggg

SEQ ID NO: 350340 - RNA, 20 nt, Bordetella pertussis
cgcgucaguugggcgcgccc

SEQ ID NO: 350341 - RNA, 21 nt, Bordetella pertussis
cgcgucaguugggcgcgccca

SEQ ID NO: 350342 - RNA, 22 nt, Bordetella pertussis
cgcgucaguugggcgcgcccag

SEQ ID NO: 350343 - RNA, 22 nt, Bordetella pertussis
cgcgucauacacggcgcgggcg

SEQ ID NO: 350344 - RNA, 19 nt, Bordetella pertussis
cgcgucauacgacgcggca

SEQ ID NO: 350345 - RNA, 16 nt, Bordetella pertussis
cgcguccaagcagacc

SEQ ID NO: 350346 - RNA, 22 nt, Bordetella pertussis
cgcguccaagcagacccgcgcc

SEQ ID NO: 350347 - RNA, 12 nt, Bordetella pertussis
cgcguccaggcc

SEQ ID NO: 350348 - RNA, 13 nt, Bordetella pertussis
cgcguccaggccc

SEQ ID NO: 350349 - RNA, 14 nt, Bordetella pertussis
cgcguccaggccca

SEQ ID NO: 350350 - RNA, 16 nt, Bordetella pertussis
cgcguccaggcccagc

SEQ ID NO: 350351 - RNA, 14 nt, Bordetella pertussis
cgcguccaggcccu

SEQ ID NO: 350352 - RNA, 20 nt, Bordetella pertussis
cgcguccaggcccuggcggc

SEQ ID NO: 350353 - RNA, 23 nt, Bordetella pertussis
cgcguccaggcccuggcggcgca

SEQ ID NO: 350354 - RNA, 16 nt, Bordetella pertussis
cgcguccagcgcgcgg

SEQ ID NO: 350355 - RNA, 12 nt, Bordetella pertussis
cgcguccgcgac

SEQ ID NO: 350356 - RNA, 13 nt, Bordetella pertussis
cgcguccgcgacg

SEQ ID NO: 350357 - RNA, 16 nt, Bordetella pertussis
cgcguccgcgacgcug

SEQ ID NO: 350358 - RNA, 19 nt, Bordetella pertussis
cgcgucccgugccggccgg

SEQ ID NO: 350359 - RNA, 18 nt, Bordetella pertussis
cgcguccgcucaugccgg

SEQ ID NO: 350360 - RNA, 23 nt, Bordetella pertussis
cgcguccggugcgauagcgccgc

SEQ ID NO: 350361 - RNA, 24 nt, Bordetella pertussis
cgcguccggugcgauagcgccgcg

SEQ ID NO: 350362 - RNA, 14 nt, Bordetella pertussis
cgcguccucggcca

SEQ ID NO: 350363 - RNA, 21 nt, Bordetella pertussis
cgcguccucggccagccgggc

SEQ ID NO: 350364 - RNA, 16 nt, Bordetella pertussis
cgcguccucggccugg

SEQ ID NO: 350365 - RNA, 17 nt, Bordetella pertussis
cgcguccucggccuggc

SEQ ID NO: 350366 - RNA, 18 nt, Bordetella pertussis
cgcguccucggccuggcc

SEQ ID NO: 350367 - RNA, 22 nt, Bordetella pertussis
cgcguccugccaguugccgccg

SEQ ID NO: 350368 - RNA, 14 nt, Bordetella pertussis
cgcguccugcgcca

SEQ ID NO: 350369 - RNA, 16 nt, Bordetella pertussis
cgcguccugcgccagu

SEQ ID NO: 350370 - RNA, 19 nt, Bordetella pertussis
cgcguccugggccgagcgc

SEQ ID NO: 350371 - RNA, 21 nt, Bordetella pertussis
cgcguccugggccgagcgcgc

SEQ ID NO: 350372 - RNA, 23 nt, Bordetella pertussis
cgcguccugggccgagcgcgcca

SEQ ID NO: 350373 - RNA, 17 nt, Bordetella pertussis
cgcguccuucgucggcg

SEQ ID NO: 350374 - RNA, 13 nt, Bordetella pertussis
cgcgucgacagca

SEQ ID NO: 350375 - RNA, 18 nt, Bordetella pertussis
cgcgucgacagcaugaac

SEQ ID NO: 350376 - RNA, 15 nt, Bordetella pertussis
cgcgucgacggugcg

SEQ ID NO: 350377 - RNA, 18 nt, Bordetella pertussis
cgcgucgacggugcgcgc

SEQ ID NO: 350378 - RNA, 17 nt, Bordetella pertussis
cgcgucgagcaggccgg

SEQ ID NO: 350379 - RNA, 21 nt, Bordetella pertussis
cgcgucgauggagucggucag

SEQ ID NO: 350380 - RNA, 21 nt, Bordetella pertussis
cgcgucgcacuggguggccag

SEQ ID NO: 350381 - RNA, 18 nt, Bordetella pertussis
cgcgucggccaaggccgg

SEQ ID NO: 350382 - RNA, 20 nt, Bordetella pertussis
cgcgucggccaaggccggcg

SEQ ID NO: 350383 - RNA, 14 nt, Bordetella pertussis
cgcgucggccagcg

SEQ ID NO: 350384 - RNA, 15 nt, Bordetella pertussis
cgcgucggccugcca

SEQ ID NO: 350385 - RNA, 16 nt, Bordetella pertussis
cgcgucggcgccgaug

SEQ ID NO: 350386 - RNA, 16 nt, Bordetella pertussis
cgcgucggcgcgcgcg

SEQ ID NO: 350387 - RNA, 16 nt, Bordetella pertussis
cgcgucggcgcggucg

SEQ ID NO: 350388 - RNA, 22 nt, Bordetella pertussis
cgcgugacgauauccaggcgcg

SEQ ID NO: 350389 - RNA, 23 nt, Bordetella pertussis
cgcgugagaaaagugaucaccgc

SEQ ID NO: 350390 - RNA, 13 nt, Bordetella pertussis
cgcgugauggaga

SEQ ID NO: 350391 - RNA, 15 nt, Bordetella pertussis
cgcgugcacgaccug

SEQ ID NO: 350392 - RNA, 17 nt, Bordetella pertussis
cgcgugcacgaccugcc

SEQ ID NO: 350393 - RNA, 19 nt, Bordetella pertussis
cgcgugcagccagcggccg

SEQ ID NO: 350394 - RNA, 15 nt, Bordetella pertussis
cgcgugcagcgccgc

SEQ ID NO: 350395 - RNA, 14 nt, Bordetella pertussis
cgcgugcaggccgc

SEQ ID NO: 350396 - RNA, 20 nt, Bordetella pertussis
cgcgugcagguaggacggcg

SEQ ID NO: 350397 - RNA, 14 nt, Bordetella pertussis
cgcgugccagcagg

SEQ ID NO: 350398 - RNA, 23 nt, Bordetella pertussis
cgcgugccagcaggucgcgcacg

SEQ ID NO: 350399 - RNA, 16 nt, Bordetella pertussis
cgcgugccgcaggcca

SEQ ID NO: 350400 - RNA, 17 nt, Bordetella pertussis
cgcgugccgcaggccag

SEQ ID NO: 350401 - RNA, 20 nt, Bordetella pertussis
cgcgugccgcaggccagccc

SEQ ID NO: 350402 - RNA, 22 nt, Bordetella pertussis
cgcgugccgcaggccagcccgc

SEQ ID NO: 350403 - RNA, 15 nt, Bordetella pertussis
cgcgugcgcgcgcca

SEQ ID NO: 350404 - RNA, 14 nt, Bordetella pertussis
cgcgugcgcggccg

SEQ ID NO: 350405 - RNA, 13 nt, Bordetella pertussis
cgcgugcggaugc

SEQ ID NO: 350406 - RNA, 19 nt, Bordetella pertussis
cgcgugcggaugcagcagc

SEQ ID NO: 350407 - RNA, 21 nt, Bordetella pertussis
cgcgugcucaucggcaggccg

SEQ ID NO: 350408 - RNA, 14 nt, Bordetella pertussis
cgcguucgccgcag

SEQ ID NO: 350409 - RNA, 17 nt, Bordetella pertussis
cgcguucgccgcagccg

SEQ ID NO: 350410 - RNA, 16 nt, Bordetella pertussis
cgcguucucagccgcc

SEQ ID NO: 350411 - RNA, 15 nt, Bordetella pertussis
cgcguucgggcggca

SEQ ID NO: 350412 - RNA, 17 nt, Bordetella pertussis
cgcguucgggcggcagg

SEQ ID NO: 350413 - RNA, 19 nt, Bordetella pertussis
cgcguuguucgggccggcu

SEQ ID NO: 350414 - RNA, 23 nt, Bordetella pertussis
cgcguuguucgggccggcugccg

SEQ ID NO: 350415 - RNA, 14 nt, Bordetella pertussis
cgcguuucggucag

SEQ ID NO: 350416 - RNA, 17 nt, Bordetella pertussis
cgcuaaauacgcuggcu

SEQ ID NO: 350417 - RNA, 16 nt, Bordetella pertussis
cgcuaaccgcucguca

SEQ ID NO: 350418 - RNA, 17 nt, Bordetella pertussis
cgcuaaccgcucgucau

SEQ ID NO: 350419 - RNA, 19 nt, Bordetella pertussis
cgcuaaccgcucgucauga

SEQ ID NO: 350420 - RNA, 23 nt, Bordetella pertussis
cgcuaagcacaagcgcguggccg

SEQ ID NO: 350421 - RNA, 18 nt, Bordetella pertussis
cgcuacagcgucacggca

SEQ ID NO: 350422 - RNA, 18 nt, Bordetella pertussis
cgcuacagggugccgcgc

SEQ ID NO: 350423 - RNA, 20 nt, Bordetella pertussis
cgcuacagggugccgcgccg

SEQ ID NO: 350424 - RNA, 14 nt, Bordetella pertussis
cgcuaccaggcgcg

SEQ ID NO: 350425 - RNA, 12 nt, Bordetella pertussis
cgcuaccccggc

SEQ ID NO: 350426 - RNA, 16 nt, Bordetella pertussis
cgcuaccccggcagcg

SEQ ID NO: 350427 - RNA, 19 nt, Bordetella pertussis
cgcuaccccggcagcguca

SEQ ID NO: 350428 - RNA, 14 nt, Bordetella pertussis
cgcuacccugccca

SEQ ID NO: 350429 - RNA, 17 nt, Bordetella pertussis
cgcuaccgcuucccugg

SEQ ID NO: 350430 - RNA, 20 nt, Bordetella pertussis
cgcuacgacgagaucgcgcc

SEQ ID NO: 350431 - RNA, 20 nt, Bordetella pertussis
cgcucaccgagggccggacu

SEQ ID NO: 350432 - RNA, 14 nt, Bordetella pertussis
cgcucacgcccgug

SEQ ID NO: 350433 - RNA, 20 nt, Bordetella pertussis
cgcucacgcccgugucgccg

SEQ ID NO: 350434 - RNA, 14 nt, Bordetella pertussis
cgcucagagcccca

SEQ ID NO: 350435 - RNA, 18 nt, Bordetella pertussis
cgcucagagccccaggaa

SEQ ID NO: 350436 - RNA, 16 nt, Bordetella pertussis
cgcucagcaccaggcc

SEQ ID NO: 350437 - RNA, 21 nt, Bordetella pertussis
cgcucagcaugcgcugggcgg

SEQ ID NO: 350438 - RNA, 15 nt, Bordetella pertussis
cgcucagccgugccg

SEQ ID NO: 350439 - RNA, 19 nt, Bordetella pertussis
cgcucagcgacgcgcgccg

SEQ ID NO: 350440 - RNA, 18 nt, Bordetella pertussis
cgcucagcgcggcgcggc

SEQ ID NO: 350441 - RNA, 20 nt, Bordetella pertussis
cgcucagcgcggcgcggcca

SEQ ID NO: 350442 - RNA, 22 nt, Bordetella pertussis
cgcucagcgcggcgcggccagc

SEQ ID NO: 350443 - RNA, 20 nt, Bordetella pertussis
cgcucagcguacagaggucg

SEQ ID NO: 350444 - RNA, 18 nt, Bordetella pertussis
cgcucaggaaccagcggc

SEQ ID NO: 350445 - RNA, 22 nt, Bordetella pertussis
cgcucaggaaccagcggcuggc

SEQ ID NO: 350446 - RNA, 22 nt, Bordetella pertussis
cgcucaggccgcugggcacauc

SEQ ID NO: 350447 - RNA, 15 nt, Bordetella pertussis
cgcucagggggcgcc

SEQ ID NO: 350448 - RNA, 15 nt, Bordetella pertussis
cgcucaggguacggc

SEQ ID NO: 350449 - RNA, 19 nt, Bordetella pertussis
cgcucaggguacggcgaug

SEQ ID NO: 350450 - RNA, 21 nt, Bordetella pertussis
cgcucaggguacggcgaugcc

SEQ ID NO: 350451 - RNA, 16 nt, Bordetella pertussis
cgcucagguagaccac

SEQ ID NO: 350452 - RNA, 17 nt, Bordetella pertussis
cgcuccauggcgccggc

SEQ ID NO: 350453 - RNA, 21 nt, Bordetella pertussis
cgcuccauggcgccggcggcc

SEQ ID NO: 350454 - RNA, 22 nt, Bordetella pertussis
cgcuccccgugcggggaccggc

SEQ ID NO: 350455 - RNA, 21 nt, Bordetella pertussis
cgcuccuccccaacggggacg

SEQ ID NO: 350456 - RNA, 17 nt, Bordetella pertussis
cgcuccucgcgcgcgga

SEQ ID NO: 350457 - RNA, 16 nt, Bordetella pertussis
cgcuccugcucggcga

SEQ ID NO: 350458 - RNA, 17 nt, Bordetella pertussis
cgcucgaaaaagcccug

SEQ ID NO: 350459 - RNA, 23 nt, Bordetella pertussis
cgcucgaaaaagcccugcguggc

SEQ ID NO: 350460 - RNA, 14 nt, Bordetella pertussis
cgcucgaagcgcau

SEQ ID NO: 350461 - RNA, 15 nt, Bordetella pertussis
cgcucgaaggcgccg

SEQ ID NO: 350462 - RNA, 21 nt, Bordetella pertussis
cgcucgaauggcugcgcgccg

SEQ ID NO: 350463 - RNA, 23 nt, Bordetella pertussis
cgcugaucaccaaacaccaggaa

SEQ ID NO: 350464 - RNA, 21 nt, Bordetella pertussis
cgcugaucagguccaugaacg

SEQ ID NO: 350465 - RNA, 18 nt, Bordetella pertussis
cgcugauccuggcucuga

SEQ ID NO: 350466 - RNA, 16 nt, Bordetella pertussis
cgcugaucggccgacu

SEQ ID NO: 350467 - RNA, 18 nt, Bordetella pertussis
cgcugaucuuccugggcg

SEQ ID NO: 350468 - RNA, 15 nt, Bordetella pertussis
cgcugaugcgcggcg

SEQ ID NO: 350469 - RNA, 16 nt, Bordetella pertussis
cgcugaugcgcgucag

SEQ ID NO: 350470 - RNA, 13 nt, Bordetella pertussis
cgcugaugcuggc

SEQ ID NO: 350471 - RNA, 15 nt, Bordetella pertussis
cgcugauggccgcca

SEQ ID NO: 350472 - RNA, 18 nt, Bordetella pertussis
cgcugauggccgccagcg

SEQ ID NO: 350473 - RNA, 19 nt, Bordetella pertussis
cgcugauguggcugagauc

SEQ ID NO: 350474 - RNA, 17 nt, Bordetella pertussis
cgcugcaauugcgcggc

SEQ ID NO: 350475 - RNA, 21 nt, Bordetella pertussis
cgcugcaauugcgcggccaug

SEQ ID NO: 350476 - RNA, 24 nt, Bordetella pertussis
cgcugcaauugcgcggccaugccg

SEQ ID NO: 350477 - RNA, 21 nt, Bordetella pertussis
cgcugcacagggaccaccccg

SEQ ID NO: 350478 - RNA, 12 nt, Bordetella pertussis
cgcugcacgcgg

SEQ ID NO: 350479 - RNA, 23 nt, Bordetella pertussis
cgcugcagaucaucgagcaccgc

SEQ ID NO: 350480 - RNA, 18 nt, Bordetella pertussis
cgcugcagcacgcaccag

SEQ ID NO: 350481 - RNA, 21 nt, Bordetella pertussis
cgcugcagcacgcaccaggcg

SEQ ID NO: 350482 - RNA, 20 nt, Bordetella pertussis
cgcugcagccauucggccac

SEQ ID NO: 350483 - RNA, 21 nt, Bordetella pertussis
cgcugcagccauucggccacu

SEQ ID NO: 350484 - RNA, 13 nt, Bordetella pertussis
cgcugcagcauga

SEQ ID NO: 350485 - RNA, 21 nt, Bordetella pertussis
cgcugcaggaucgcggccagc

SEQ ID NO: 350486 - RNA, 22 nt, Bordetella pertussis
cgcugcaggaucgcggccagcg

SEQ ID NO: 350487 - RNA, 12 nt, Bordetella pertussis
cgcugcaggccc

SEQ ID NO: 350488 - RNA, 15 nt, Bordetella pertussis
cgcugcaugggcggc

SEQ ID NO: 350489 - RNA, 21 nt, Bordetella pertussis
cgcugcaugggcggcccgcuc

SEQ ID NO: 350490 - RNA, 12 nt, Bordetella pertussis
cgcugccagcca

SEQ ID NO: 350491 - RNA, 21 nt, Bordetella pertussis
cgcugccaguuguaguggugu

SEQ ID NO: 350492 - RNA, 17 nt, Bordetella pertussis
cgcugcccagcaugggg

SEQ ID NO: 350493 - RNA, 12 nt, Bordetella pertussis
cgcugcccagcc

SEQ ID NO: 350494 - RNA, 14 nt, Bordetella pertussis
cgcugcccagccac

SEQ ID NO: 350495 - RNA, 22 nt, Bordetella pertussis
cgcugcccagcgucagcugggc

SEQ ID NO: 350496 - RNA, 15 nt, Bordetella pertussis
cgcugcccgacgacg

SEQ ID NO: 350497 - RNA, 20 nt, Bordetella pertussis
cgcugcccgucgcuggcgcg

SEQ ID NO: 350498 - RNA, 14 nt, Bordetella pertussis
cgcugcccugcugc

SEQ ID NO: 350499 - RNA, 23 nt, Bordetella pertussis
cgcugcccuggaucaggaugggc

SEQ ID NO: 350500 - RNA, 22 nt, Bordetella pertussis
cgcugccgaccagcacgggaug

SEQ ID NO: 350501 - RNA, 19 nt, Bordetella pertussis
cgcugccgagacggccgcc

SEQ ID NO: 350502 - RNA, 13 nt, Bordetella pertussis
cgcugccgcgcga

SEQ ID NO: 350503 - RNA, 13 nt, Bordetella pertussis
cgcugccgcugca

SEQ ID NO: 350504 - RNA, 11 nt, Bordetella pertussis
cgcugccggcg

SEQ ID NO: 350505 - RNA, 17 nt, Bordetella pertussis
cgcugccggcgcccuug

SEQ ID NO: 350506 - RNA, 13 nt, Bordetella pertussis
cgcugccggcgcc

SEQ ID NO: 350507 - RNA, 20 nt, Bordetella pertussis
cgcugccggcguccugcggc

SEQ ID NO: 350508 - RNA, 16 nt, Bordetella pertussis
cgcugccgggcucggc

SEQ ID NO: 350509 - RNA, 20 nt, Bordetella pertussis
cgcugccgggcucggccacc

SEQ ID NO: 350510 - RNA, 14 nt, Bordetella pertussis
cgcugccugccggc

SEQ ID NO: 350511 - RNA, 15 nt, Bordetella pertussis
cgcugccugccggcc

SEQ ID NO: 350512 - RNA, 18 nt, Bordetella pertussis
cgcugccugccggccggc

SEQ ID NO: 350513 - RNA, 22 nt, Bordetella pertussis
cgcugccugccggccggccagu

SEQ ID NO: 350514 - RNA, 17 nt, Bordetella pertussis
cgcugccuucggguugc

SEQ ID NO: 350515 - RNA, 18 nt, Bordetella pertussis
cgcugcgaaaaagcccgc

SEQ ID NO: 350516 - RNA, 19 nt, Bordetella pertussis
cgcugcgaaacagcagcgg

SEQ ID NO: 350517 - RNA, 19 nt, Bordetella pertussis
cgcugcgacagcagcaugc

SEQ ID NO: 350518 - RNA, 12 nt, Bordetella pertussis
cgcugcgcacgc

SEQ ID NO: 350519 - RNA, 14 nt, Bordetella pertussis
cgcugcgcagcagg

SEQ ID NO: 350520 - RNA, 21 nt, Bordetella pertussis
cgcugcgcaggcgcgcggggg

SEQ ID NO: 350521 - RNA, 15 nt, Bordetella pertussis
cgcugcgccggcggc

SEQ ID NO: 350522 - RNA, 19 nt, Bordetella pertussis
cgcugcgccuuggcgcgca

SEQ ID NO: 350523 - RNA, 21 nt, Bordetella pertussis
cgcugcgccuuggcgcgcaga

SEQ ID NO: 350524 - RNA, 19 nt, Bordetella pertussis
cgcugcgcgaacgcggcca

SEQ ID NO: 350525 - RNA, 17 nt, Bordetella pertussis
cgcugcgcgaugcgcgc

SEQ ID NO: 350526 - RNA, 15 nt, Bordetella pertussis
cgcugcgcgcggccu

SEQ ID NO: 350527 - RNA, 14 nt, Bordetella pertussis
cgcugcgcggcggc

SEQ ID NO: 350528 - RNA, 13 nt, Bordetella pertussis
cgcugcgcgccgc

SEQ ID NO: 350529 - RNA, 15 nt, Bordetella pertussis
cgcugcgcuggccgc

SEQ ID NO: 350530 - RNA, 13 nt, Bordetella pertussis
cgcugcggcaagg

SEQ ID NO: 350531 - RNA, 21 nt, Bordetella pertussis
cgcugcggucgcgaucgucga

SEQ ID NO: 350532 - RNA, 16 nt, Bordetella pertussis
cgcugcguccaccacc

SEQ ID NO: 350533 - RNA, 23 nt, Bordetella pertussis
cgcugcguccaccaccaggccgg

SEQ ID NO: 350534 - RNA, 19 nt, Bordetella pertussis
cgcugcucgaaacgcugga

SEQ ID NO: 350535 - RNA, 18 nt, Bordetella pertussis
cgcugcucgacagcagcc

SEQ ID NO: 350536 - RNA, 21 nt, Bordetella pertussis
cgcugcugaccgacggccugg

SEQ ID NO: 350537 - RNA, 16 nt, Bordetella pertussis
cgcugcugcaggccgg

SEQ ID NO: 350538 - RNA, 17 nt, Bordetella pertussis
cgcugcugcaggccggc

SEQ ID NO: 350539 - RNA, 13 nt, Bordetella pertussis
cgcugcugcuggc

SEQ ID NO: 350540 - RNA, 18 nt, Bordetella pertussis
cgcugcugcuggcugccc

SEQ ID NO: 350541 - RNA, 21 nt, Bordetella pertussis
cgcugcuggccaagcgcgccg

SEQ ID NO: 350542 - RNA, 16 nt, Bordetella pertussis
cgcugcuggccggcca

SEQ ID NO: 350543 - RNA, 18 nt, Bordetella pertussis
cgcugcuggccggccagc

SEQ ID NO: 350544 - RNA, 15 nt, Bordetella pertussis
cgcugcugucgcgcg

SEQ ID NO: 350545 - RNA, 21 nt, Bordetella pertussis
cgcuggaaacuaaaucgcggc

SEQ ID NO: 350546 - RNA, 21 nt, Bordetella pertussis
cgcuggaagacguggcccgcg

SEQ ID NO: 350547 - RNA, 19 nt, Bordetella pertussis
cgcuggaauauggcguccg

SEQ ID NO: 350548 - RNA, 22 nt, Bordetella pertussis
cgcuggacagauccagcgcggc

SEQ ID NO: 350549 - RNA, 22 nt, Bordetella pertussis
cgcuggacaugggcaagccgau

SEQ ID NO: 350550 - RNA, 22 nt, Bordetella pertussis
cgcuggaccgggaauggcgccg

SEQ ID NO: 350551 - RNA, 16 nt, Bordetella pertussis
cgcuggacgcccuggc

SEQ ID NO: 350552 - RNA, 20 nt, Bordetella pertussis
cgcuggacgcccuggcgcag

SEQ ID NO: 350553 - RNA, 14 nt, Bordetella pertussis
cgcuggacgcgccg

SEQ ID NO: 350554 - RNA, 18 nt, Bordetella pertussis
cgcuggacgucggugugg

SEQ ID NO: 350555 - RNA, 15 nt, Bordetella pertussis
cgcuggagauggcgc

SEQ ID NO: 350556 - RNA, 14 nt, Bordetella pertussis
cgcuggagcgcggc

SEQ ID NO: 350557 - RNA, 21 nt, Bordetella pertussis
cgcuggagcgcggcggcguga

SEQ ID NO: 350558 - RNA, 21 nt, Bordetella pertussis
cgcuggccagccgcucgcgcg

SEQ ID NO: 350559 - RNA, 17 nt, Bordetella pertussis
cgcuggccaucaccgcc

SEQ ID NO: 350560 - RNA, 21 nt, Bordetella pertussis
cgcuggcccacucggugcgcg

SEQ ID NO: 350561 - RNA, 12 nt, Bordetella pertussis
cgcuggcccggg

SEQ ID NO: 350562 - RNA, 18 nt, Bordetella pertussis
cgcuggcccgucaugggc

SEQ ID NO: 350563 - RNA, 20 nt, Bordetella pertussis
cgcuggccgaucugcugggc

SEQ ID NO: 350564 - RNA, 18 nt, Bordetella pertussis
cgcuggccgccauggcgc

SEQ ID NO: 350565 - RNA, 20 nt, Bordetella pertussis
cgcuggccgccauggcgcug

SEQ ID NO: 350566 - RNA, 22 nt, Bordetella pertussis
cgcuggccgccauggcgcuggc

SEQ ID NO: 350567 - RNA, 13 nt, Bordetella pertussis
cgcuggccgcccg

SEQ ID NO: 350568 - RNA, 23 nt, Bordetella pertussis
cgcuggccgcccgcggccugcag

SEQ ID NO: 350569 - RNA, 20 nt, Bordetella pertussis
cgcuggccgcgcuggcggcg

SEQ ID NO: 350570 - RNA, 22 nt, Bordetella pertussis
cgcuggccgcgcuggcggcgca

SEQ ID NO: 350571 - RNA, 20 nt, Bordetella pertussis
cgcuggccggacgcaaccgg

SEQ ID NO: 350572 - RNA, 17 nt, Bordetella pertussis
cgcuggccggccgcgug

SEQ ID NO: 350573 - RNA, 16 nt, Bordetella pertussis
cgcuggccugccgcgc

SEQ ID NO: 350574 - RNA, 22 nt, Bordetella pertussis
cgcuggccugccgcgccgaccg

SEQ ID NO: 350575 - RNA, 23 nt, Bordetella pertussis
cgcuggccugccgcgccgaccgg

SEQ ID NO: 350576 - RNA, 15 nt, Bordetella pertussis
cgcuggccuggccgc

SEQ ID NO: 350577 - RNA, 22 nt, Bordetella pertussis
cgcuggccuggccgccggcggc

SEQ ID NO: 350578 - RNA, 15 nt, Bordetella pertussis
cgcuggcgagcaugg

SEQ ID NO: 350579 - RNA, 18 nt, Bordetella pertussis
cgcuggcgaucacggcca

SEQ ID NO: 350580 - RNA, 14 nt, Bordetella pertussis
cgcuggcgaucagg

SEQ ID NO: 350581 - RNA, 17 nt, Bordetella pertussis
cgcuggcgaucaggccg

SEQ ID NO: 350582 - RNA, 20 nt, Bordetella pertussis
cgcuggcgaucaggccgccc

SEQ ID NO: 350583 - RNA, 17 nt, Bordetella pertussis
cgcuggcgaugcgggcc

SEQ ID NO: 350584 - RNA, 18 nt, Bordetella pertussis
cgcuggcgaugcgggcca

SEQ ID NO: 350585 - RNA, 19 nt, Bordetella pertussis
cgcuggcgaugcgggccac

SEQ ID NO: 350586 - RNA, 13 nt, Bordetella pertussis
cgcuggcgcagca

SEQ ID NO: 350587 - RNA, 23 nt, Bordetella pertussis
cgcuggcgcagcaggcgcgcggc

SEQ ID NO: 350588 - RNA, 17 nt, Bordetella pertussis
cgcuggcgccgcgcgcc

SEQ ID NO: 350589 - RNA, 23 nt, Bordetella pertussis
cgcuggcgcgagaaccaggccac

SEQ ID NO: 350590 - RNA, 12 nt, Bordetella pertussis
cgcuggcgcgcc

SEQ ID NO: 350591 - RNA, 15 nt, Bordetella pertussis
cgcuggcgcgccgcc

SEQ ID NO: 350592 - RNA, 20 nt, Bordetella pertussis
cgcuggcgcgcgacggcgcc

SEQ ID NO: 350593 - RNA, 15 nt, Bordetella pertussis
cgcuggcgcgucugg

SEQ ID NO: 350594 - RNA, 15 nt, Bordetella pertussis
cgcuggcggcacacg

SEQ ID NO: 350595 - RNA, 18 nt, Bordetella pertussis
cgcuggcggcgcaggccg

SEQ ID NO: 350596 - RNA, 19 nt, Bordetella pertussis
cgcuggcggcgcaggccgc

SEQ ID NO: 350597 - RNA, 16 nt, Bordetella pertussis
cgcuggcggcugcgcg

SEQ ID NO: 350598 - RNA, 11 nt, Bordetella pertussis
cgcuggcgucc

SEQ ID NO: 350599 - RNA, 20 nt, Bordetella pertussis
cgcuggcguccagccugccc

SEQ ID NO: 350600 - RNA, 23 nt, Bordetella pertussis
cgcuggcguucagcgggcgcgcc

SEQ ID NO: 350601 - RNA, 18 nt, Bordetella pertussis
cgcuggcuaucgccucga

SEQ ID NO: 350602 - RNA, 14 nt, Bordetella pertussis
cgcuggcuggacgc

SEQ ID NO: 350603 - RNA, 22 nt, Bordetella pertussis
cgcuggcuggacgcgcgcggcg

SEQ ID NO: 350604 - RNA, 13 nt, Bordetella pertussis
cgcuggcugggcc

SEQ ID NO: 350605 - RNA, 17 nt, Bordetella pertussis
cgcuggcugggccugcu

SEQ ID NO: 350606 - RNA, 16 nt, Bordetella pertussis
cgcuggcugugcccgc

SEQ ID NO: 350607 - RNA, 14 nt, Bordetella pertussis
cgcuggcuucggcg

SEQ ID NO: 350608 - RNA, 15 nt, Bordetella pertussis
cgcugggacaggcac

SEQ ID NO: 350609 - RNA, 20 nt, Bordetella pertussis
cgcugggacaggcacaccgg

SEQ ID NO: 350610 - RNA, 22 nt, Bordetella pertussis
cgcugggauggguacgccggcc

SEQ ID NO: 350611 - RNA, 23 nt, Bordetella pertussis
cgcugggcacauccagcgccagc

SEQ ID NO: 350612 - RNA, 15 nt, Bordetella pertussis
cgcugggcaggcugg

SEQ ID NO: 350613 - RNA, 18 nt, Bordetella pertussis
cgcugggcaggcuggcgc

SEQ ID NO: 350614 - RNA, 14 nt, Bordetella pertussis
cgcugggcaugggc

SEQ ID NO: 350615 - RNA, 20 nt, Bordetella pertussis
cgcugggcaugggcggcccg

SEQ ID NO: 350616 - RNA, 15 nt, Bordetella pertussis
cgcugggccagaccg

SEQ ID NO: 350617 - RNA, 19 nt, Bordetella pertussis
cgcugggccagaccgcgcg

SEQ ID NO: 350618 - RNA, 18 nt, Bordetella pertussis
cgcugggccagcaucggc

SEQ ID NO: 350619 - RNA, 21 nt, Bordetella pertussis
cgcugggccagcaucggcacc

SEQ ID NO: 350620 - RNA, 13 nt, Bordetella pertussis
cgcugggccaggc

SEQ ID NO: 350621 - RNA, 15 nt, Bordetella pertussis
cgcugggccaggccg

SEQ ID NO: 350622 - RNA, 15 nt, Bordetella pertussis
cgcugggcgccagca

SEQ ID NO: 350623 - RNA, 16 nt, Bordetella pertussis
cgcugggcgccagcag

SEQ ID NO: 350624 - RNA, 15 nt, Bordetella pertussis
cgcugggcguggcgc

SEQ ID NO: 350625 - RNA, 16 nt, Bordetella pertussis
cgcugggcguggcgcg

SEQ ID NO: 350626 - RNA, 15 nt, Bordetella pertussis
cgcuggggcagcagg

SEQ ID NO: 350627 - RNA, 18 nt, Bordetella pertussis
cgcugguaaagggcgcgg

SEQ ID NO: 350628 - RNA, 17 nt, Bordetella pertussis
cgcugguaguaggccac

SEQ ID NO: 350629 - RNA, 19 nt, Bordetella pertussis
cgcugguaguaggccacug

SEQ ID NO: 350630 - RNA, 14 nt, Bordetella pertussis
cgcuggucgcgcag

SEQ ID NO: 350631 - RNA, 20 nt, Bordetella pertussis
cgcuggucgagagccugggc

SEQ ID NO: 350632 - RNA, 21 nt, Bordetella pertussis
cgcuggucgagagccugggcg

SEQ ID NO: 350633 - RNA, 18 nt, Bordetella pertussis
cgcuggugaucugcugcg

SEQ ID NO: 350634 - RNA, 15 nt, Bordetella pertussis
cgcugguggccacca

SEQ ID NO: 350635 - RNA, 15 nt, Bordetella pertussis
cgcugguggccagau

SEQ ID NO: 350636 - RNA, 17 nt, Bordetella pertussis
cgcuggugcuggccgaa

SEQ ID NO: 350637 - RNA, 20 nt, Bordetella pertussis
cgcuguagaggcgcggcucg

SEQ ID NO: 350638 - RNA, 14 nt, Bordetella pertussis
cgcuguaggcgccg

SEQ ID NO: 350639 - RNA, 18 nt, Bordetella pertussis
cgcuguaggcgccggcgc

SEQ ID NO: 350640 - RNA, 14 nt, Bordetella pertussis
cgcuguccggcgcu

SEQ ID NO: 350641 - RNA, 21 nt, Bordetella pertussis
cgcuguccggcgcucgccccg

SEQ ID NO: 350642 - RNA, 13 nt, Bordetella pertussis
cgcugucgaccuc

SEQ ID NO: 350643 - RNA, 13 nt, Bordetella pertussis
cgcugucgcgccc

SEQ ID NO: 350644 - RNA, 13 nt, Bordetella pertussis
cgcugucgugccg

SEQ ID NO: 350645 - RNA, 17 nt, Bordetella pertussis
cgcugucgugccgcacg

SEQ ID NO: 350646 - RNA, 21 nt, Bordetella pertussis
cgcugucgugccgcacggugg

SEQ ID NO: 350647 - RNA, 20 nt, Bordetella pertussis
cgcugugcgacgauccggcg

SEQ ID NO: 350648 - RNA, 15 nt, Bordetella pertussis
cgcuguggacgccgc

SEQ ID NO: 350649 - RNA, 22 nt, Bordetella pertussis
cgcuguggacgccgccggccca

SEQ ID NO: 350650 - RNA, 14 nt, Bordetella pertussis
cgcuguuccagcca

SEQ ID NO: 350651 - RNA, 18 nt, Bordetella pertussis
cgcuguucgauacggcca

SEQ ID NO: 350652 - RNA, 20 nt, Bordetella pertussis
cgcuguucgauacggccacg

SEQ ID NO: 350653 - RNA, 13 nt, Bordetella pertussis
cgcuguucggcga

SEQ ID NO: 350654 - RNA, 16 nt, Bordetella pertussis
cgcuguucgggcgcgg

SEQ ID NO: 350655 - RNA, 20 nt, Bordetella pertussis
cgcuguucgggcgcggugcg

SEQ ID NO: 350656 - RNA, 21 nt, Bordetella pertussis
cgcuguucgggcgcggugcgc

SEQ ID NO: 350657 - RNA, 15 nt, Bordetella pertussis
cgcuguucggggcag

SEQ ID NO: 350658 - RNA, 20 nt, Bordetella pertussis
cgcuguucuucggcaaccgc

SEQ ID NO: 350659 - RNA, 23 nt, Bordetella pertussis
cgcuguucuucggcaaccgcgcc

SEQ ID NO: 350660 - RNA, 18 nt, Bordetella pertussis
cgcuguugcccaccagcc

SEQ ID NO: 350661 - RNA, 19 nt, Bordetella pertussis
cgcuguugcuccaggccgg

SEQ ID NO: 350662 - RNA, 20 nt, Bordetella pertussis
cgcuguugcuccaggccggc

SEQ ID NO: 350663 - RNA, 20 nt, Bordetella pertussis
cgcuguuggccggcgcgccc

SEQ ID NO: 350664 - RNA, 18 nt, Bordetella pertussis
cgcuguuggucaggucga

SEQ ID NO: 350665 - RNA, 19 nt, Bordetella pertussis
cgcuuacaucaaggccgau

SEQ ID NO: 350666 - RNA, 15 nt, Bordetella pertussis
cgcuuaccgcgccgg

SEQ ID NO: 350667 - RNA, 14 nt, Bordetella pertussis
cgcuuaucgcggcg

SEQ ID NO: 350668 - RNA, 23 nt, Bordetella pertussis
cgcuuaucgcggcgcggcgcagg

SEQ ID NO: 350669 - RNA, 17 nt, Bordetella pertussis
cgcuucacccuggaugc

SEQ ID NO: 350670 - RNA, 14 nt, Bordetella pertussis
cgcuucaggcgccg

SEQ ID NO: 350671 - RNA, 16 nt, Bordetella pertussis
cgcuucagugcucggg

SEQ ID NO: 350672 - RNA, 19 nt, Bordetella pertussis
cgcuuccgagaaggcggug

SEQ ID NO: 350673 - RNA, 15 nt, Bordetella pertussis
cgcuuccggcaugac

SEQ ID NO: 350674 - RNA, 15 nt, Bordetella pertussis
cgcuuccucgaccag

SEQ ID NO: 350675 - RNA, 16 nt, Bordetella pertussis
cgcuuccucgaccagg

SEQ ID NO: 350676 - RNA, 13 nt, Bordetella pertussis
cgcuuccugcugc

SEQ ID NO: 350677 - RNA, 15 nt, Bordetella pertussis
cgcuucggccugcgc

SEQ ID NO: 350678 - RNA, 13 nt, Bordetella pertussis
cgcuucggcggcc

SEQ ID NO: 350679 - RNA, 16 nt, Bordetella pertussis
cgcuucggcggccgcg

SEQ ID NO: 350680 - RNA, 19 nt, Bordetella pertussis
cgcuucgggcagcucgcgc

SEQ ID NO: 350681 - RNA, 20 nt, Bordetella pertussis
cgcuucgggccggauggccg

SEQ ID NO: 350682 - RNA, 23 nt, Bordetella pertussis
cgcuucggucagcugcuguuggc

SEQ ID NO: 350683 - RNA, 15 nt, Bordetella pertussis
cgcuucgguggcgcg

SEQ ID NO: 350684 - RNA, 14 nt, Bordetella pertussis
cgcuucgucggccg

SEQ ID NO: 350685 - RNA, 16 nt, Bordetella pertussis
cgcuucgucggccgcc

SEQ ID NO: 350686 - RNA, 18 nt, Bordetella pertussis
cgcuucguccugaucgag

SEQ ID NO: 350687 - RNA, 18 nt, Bordetella pertussis
cgcuucucacugcccgcg

SEQ ID NO: 350688 - RNA, 21 nt, Bordetella pertussis
cgcuucugccagacggccagc

SEQ ID NO: 350689 - RNA, 17 nt, Bordetella pertussis
cgcuucucggugcgccg

SEQ ID NO: 350690 - RNA, 19 nt, Bordetella pertussis
cgcuugaaguaaucgcccg

SEQ ID NO: 350691 - RNA, 14 nt, Bordetella pertussis
cgcuugacggccaa

SEQ ID NO: 350692 - RNA, 20 nt, Bordetella pertussis
cgcuugacggccaagacgcg

SEQ ID NO: 350693 - RNA, 15 nt, Bordetella pertussis
cgcuugacguccagc

SEQ ID NO: 350694 - RNA, 16 nt, Bordetella pertussis
cgcuugacguccagcg

SEQ ID NO: 350695 - RNA, 19 nt, Bordetella pertussis
cgcuugccgaccuccaggc

SEQ ID NO: 350696 - RNA, 22 nt, Bordetella pertussis
cgcuugccgaccuccaggccca

SEQ ID NO: 350697 - RNA, 20 nt, Bordetella pertussis
cgcuugcccgucaugcgccg

SEQ ID NO: 350698 - RNA, 21 nt, Bordetella pertussis
cgcuugcccgucaugcgccgc

SEQ ID NO: 350699 - RNA, 17 nt, Bordetella pertussis
cgcuugcgcagggcggg

SEQ ID NO: 350700 - RNA, 12 nt, Bordetella pertussis
cgcuugcgcaug

SEQ ID NO: 350701 - RNA, 18 nt, Bordetella pertussis
cgcuugcgcauggccggu

SEQ ID NO: 350702 - RNA, 13 nt, Bordetella pertussis
cgcuugcgcgcca

SEQ ID NO: 350703 - RNA, 19 nt, Bordetella pertussis
cgcuugcgcgccacgucga

SEQ ID NO: 350704 - RNA, 23 nt, Bordetella pertussis
cgcuugcgcgccacgucgaccuc

SEQ ID NO: 350705 - RNA, 18 nt, Bordetella pertussis
cgcuugcgcucggugugg

SEQ ID NO: 350706 - RNA, 18 nt, Bordetella pertussis
cgcuugcgcuuggcaggc

SEQ ID NO: 350707 - RNA, 20 nt, Bordetella pertussis
cgcuugcggccggcgcugau

SEQ ID NO: 350708 - RNA, 16 nt, Bordetella pertussis
cgcuugcggccgucga

SEQ ID NO: 350709 - RNA, 14 nt, Bordetella pertussis
cgcuuggccagcug

SEQ ID NO: 350710 - RNA, 18 nt, Bordetella pertussis
cgcuuggccagcuggcgc

SEQ ID NO: 350711 - RNA, 19 nt, Bordetella pertussis
cgcuuggcccugcagcggc

SEQ ID NO: 350712 - RNA, 12 nt, Bordetella pertussis
cgcuugggccgc

SEQ ID NO: 350713 - RNA, 14 nt, Bordetella pertussis
cgcuugggccgcgc

SEQ ID NO: 350714 - RNA, 15 nt, Bordetella pertussis
cgcuugucgaugacg

SEQ ID NO: 350715 - RNA, 16 nt, Bordetella pertussis
cgcuugucgaugacgc

SEQ ID NO: 350716 - RNA, 15 nt, Bordetella pertussis
cgcuuucucccgccg

SEQ ID NO: 350717 - RNA, 19 nt, Bordetella pertussis
cgcuuuuccccgcccagcg

SEQ ID NO: 350718 - RNA, 19 nt, Bordetella pertussis
cgcuuuuuucuccagcgcc

SEQ ID NO: 350719 - RNA, 22 nt, Bordetella pertussis
cgcuuuuuucuccagcgccagc

SEQ ID NO: 350720 - RNA, 15 nt, Bordetella pertussis
cggaaaacagcacca

SEQ ID NO: 350721 - RNA, 23 nt, Bordetella pertussis
cggaaaacagcaccagcaugcgc

SEQ ID NO: 350722 - RNA, 20 nt, Bordetella pertussis
cggaaacacguccagcgccg

SEQ ID NO: 350723 - RNA, 19 nt, Bordetella pertussis
cggaaacggaaacugccau

SEQ ID NO: 350724 - RNA, 19 nt, Bordetella pertussis
cggaaauccuagucaugcg

SEQ ID NO: 350725 - RNA, 19 nt, Bordetella pertussis
cggaacaccagcaagccgg

SEQ ID NO: 350726 - RNA, 22 nt, Bordetella pertussis
cggaacaccagcaagccggcgg

SEQ ID NO: 350727 - RNA, 23 nt, Bordetella pertussis
cggaacauggcggugaaggcgcc

SEQ ID NO: 350728 - RNA, 21 nt, Bordetella pertussis
cggaagacauggcgcgcgcca

SEQ ID NO: 350729 - RNA, 23 nt, Bordetella pertussis
cggaagacauggcgcgcgccagc

SEQ ID NO: 350730 - RNA, 21 nt, Bordetella pertussis
cggaauccuggcgacggccug

SEQ ID NO: 350731 - RNA, 23 nt, Bordetella pertussis
cggaaugcggcgacagggcgucg

SEQ ID NO: 350732 - RNA, 14 nt, Bordetella pertussis
cggaauggucaagc

SEQ ID NO: 350733 - RNA, 17 nt, Bordetella pertussis
cggaauggucaagcggc

SEQ ID NO: 350734 - RNA, 14 nt, Bordetella pertussis
cggacaacgcgcgc

SEQ ID NO: 350735 - RNA, 16 nt, Bordetella pertussis
cggacaacgcgcgcca

SEQ ID NO: 350736 - RNA, 17 nt, Bordetella pertussis
cggacacguacaaccgc

SEQ ID NO: 350737 - RNA, 20 nt, Bordetella pertussis
cggacacguacaaccgcgcc

SEQ ID NO: 350738 - RNA, 18 nt, Bordetella pertussis
cggacagaugccguccug

SEQ ID NO: 350739 - RNA, 15 nt, Bordetella pertussis
cggacagcccgcgcu

SEQ ID NO: 350740 - RNA, 22 nt, Bordetella pertussis
cggcacccgcuaccccggcagc

SEQ ID NO: 350741 - RNA, 15 nt, Bordetella pertussis
cggcaccgaggccga

SEQ ID NO: 350742 - RNA, 19 nt, Bordetella pertussis
cggcaccucggccggggcg

SEQ ID NO: 350743 - RNA, 16 nt, Bordetella pertussis
cggcaccucggcgccg

SEQ ID NO: 350744 - RNA, 20 nt, Bordetella pertussis
cggcaccucggcgccgcggc

SEQ ID NO: 350745 - RNA, 21 nt, Bordetella pertussis
cggcaccucggcgccgcggcg

SEQ ID NO: 350746 - RNA, 14 nt, Bordetella pertussis
cggcaccugcugcu

SEQ ID NO: 350747 - RNA, 24 nt, Bordetella pertussis
cggcaccugcugcuugaccuuggc

SEQ ID NO: 350748 - RNA, 20 nt, Bordetella pertussis
cggcaccuucgcgcagcggc

SEQ ID NO: 350749 - RNA, 21 nt, Bordetella pertussis
cggcaccuucgcgcagcggcg

SEQ ID NO: 350750 - RNA, 19 nt, Bordetella pertussis
cggcaccuucuuccaggcg

SEQ ID NO: 350751 - RNA, 20 nt, Bordetella pertussis
cggcacgaaaagccgcggcc

SEQ ID NO: 350752 - RNA, 21 nt, Bordetella pertussis
cggcacgaaaagccgcggccg

SEQ ID NO: 350753 - RNA, 15 nt, Bordetella pertussis
aacaggcagcugcgc

SEQ ID NO: 350754 - RNA, 21 nt, Bordetella pertussis
aacaggcgcgccagccgcgcg

SEQ ID NO: 350755 - RNA, 19 nt, Bordetella pertussis
aacaggcugguggcgucga

SEQ ID NO: 350756 - RNA, 19 nt, Bordetella pertussis
cggcacgaucggcgccugg

SEQ ID NO: 350757 - RNA, 24 nt, Bordetella pertussis
cggcacgcacagcaugcgcugguc

SEQ ID NO: 350758 - RNA, 20 nt, Bordetella pertussis
cggcacgauuuccgcuacca

SEQ ID NO: 350759 - RNA, 21 nt, Bordetella pertussis
cggcacgauuuccgcuaccag

SEQ ID NO: 350760 - RNA, 19 nt, Bordetella pertussis
cggcacgcccagccgcagc

SEQ ID NO: 350761 - RNA, 15 nt, Bordetella pertussis
cggcacgccggcggc

SEQ ID NO: 350762 - RNA, 18 nt, Bordetella pertussis
cggcacgccggcggcgcu

SEQ ID NO: 350763 - RNA, 17 nt, Bordetella pertussis
cggcacgccucgccggc

SEQ ID NO: 350764 - RNA, 14 nt, Bordetella pertussis
cggcacgcgcgccg

SEQ ID NO: 350765 - RNA, 16 nt, Bordetella pertussis
cggcacgcgcgccggc

SEQ ID NO: 350766 - RNA, 17 nt, Bordetella pertussis
cggcacgcgcgccggca

SEQ ID NO: 350767 - RNA, 18 nt, Bordetella pertussis
cggcacgcgcgccggcag

SEQ ID NO: 350768 - RNA, 12 nt, Bordetella pertussis
cggcacgcgcgg

SEQ ID NO: 350769 - RNA, 17 nt, Bordetella pertussis
cggcacgcugaucgccg

SEQ ID NO: 350770 - RNA, 13 nt, Bordetella pertussis
cggcacgcugcgc

SEQ ID NO: 350771 - RNA, 19 nt, Bordetella pertussis
cggcacgcugcgcaggcgc

SEQ ID NO: 350772 - RNA, 20 nt, Bordetella pertussis
cggcacgcugcgcaggcgcg

SEQ ID NO: 350773 - RNA, 13 nt, Bordetella pertussis
cggcacggccagc

SEQ ID NO: 350774 - RNA, 18 nt, Bordetella pertussis
cggcacggccagcggcga

SEQ ID NO: 350775 - RNA, 15 nt, Bordetella pertussis
cggcacggccggcca

SEQ ID NO: 350776 - RNA, 17 nt, Bordetella pertussis
cggcacggccggccagg

SEQ ID NO: 350777 - RNA, 18 nt, Bordetella pertussis
cggcacggccggccaggc

SEQ ID NO: 350778 - RNA, 20 nt, Bordetella pertussis
cggcacggccggccaggcgc

SEQ ID NO: 350779 - RNA, 22 nt, Bordetella pertussis
cggcacggccggccaggcgccg

SEQ ID NO: 350780 - RNA, 20 nt, Bordetella pertussis
cggcacgggucaggcugcgg

SEQ ID NO: 350781 - RNA, 22 nt, Bordetella pertussis
cggcacgggucaggcugcggcg

SEQ ID NO: 350782 - RNA, 19 nt, Bordetella pertussis
cggcacgguggcgaaggcc

SEQ ID NO: 350783 - RNA, 21 nt, Bordetella pertussis
cggcacgguggcgaaggccgc

SEQ ID NO: 350784 - RNA, 13 nt, Bordetella pertussis
cggcacgucauug

SEQ ID NO: 350785 - RNA, 17 nt, Bordetella pertussis
cggcacguccggcacgg

SEQ ID NO: 350786 - RNA, 21 nt, Bordetella pertussis
cggcacguccggcacggcggc

SEQ ID NO: 350787 - RNA, 18 nt, Bordetella pertussis
cggcacguaccaggcgcu

SEQ ID NO: 350788 - RNA, 15 nt, Bordetella pertussis
cggcacgucgggcag

SEQ ID NO: 350789 - RNA, 16 nt, Bordetella pertussis
cggcacgucgggcagg

SEQ ID NO: 350790 - RNA, 20 nt, Bordetella pertussis
cggcacgucgggcaggaugg

SEQ ID NO: 350791 - RNA, 20 nt, Bordetella pertussis
cggcacgucgguggugacca

SEQ ID NO: 350792 - RNA, 22 nt, Bordetella pertussis
cggcacgucgguggugaccacg

SEQ ID NO: 350793 - RNA, 18 nt, Bordetella pertussis
cggcacgugauaguccac

SEQ ID NO: 350794 - RNA, 14 nt, Bordetella pertussis
cggcacgugccgga

SEQ ID NO: 350795 - RNA, 17 nt, Bordetella pertussis
cggcacguugucgagca

SEQ ID NO: 350796 - RNA, 20 nt, Bordetella pertussis
cggcacguugucgagcaggc

SEQ ID NO: 350797 - RNA, 22 nt, Bordetella pertussis
cggcacguugucgagcaggccg

SEQ ID NO: 350798 - RNA, 22 nt, Bordetella pertussis
cggcacugaugcuggucagccu

SEQ ID NO: 350799 - RNA, 18 nt, Bordetella pertussis
cggcagaacagcggaucg

SEQ ID NO: 350800 - RNA, 18 nt, Bordetella pertussis
cggcagacgaucauccag

SEQ ID NO: 350801 - RNA, 23 nt, Bordetella pertussis
cggcagaucggcgcuggccuggc

SEQ ID NO: 350802 - RNA, 22 nt, Bordetella pertussis
cggcagauggugcuccgacggc

SEQ ID NO: 350803 - RNA, 15 nt, Bordetella pertussis
cggcagcacgauggc

SEQ ID NO: 350804 - RNA, 18 nt, Bordetella pertussis
cggcagcacgauggcgcc

SEQ ID NO: 350805 - RNA, 20 nt, Bordetella pertussis
cggcagcacgauggcgccca

SEQ ID NO: 350806 - RNA, 22 nt, Bordetella pertussis
cggcagcacgauggcgcccacg

SEQ ID NO: 350807 - RNA, 15 nt, Bordetella pertussis
cggcagcagcagcgc

SEQ ID NO: 350808 - RNA, 16 nt, Bordetella pertussis
cggcagcagcagcgcg

SEQ ID NO: 350809 - RNA, 16 nt, Bordetella pertussis
cggcagcagcagcgug

SEQ ID NO: 350810 - RNA, 20 nt, Bordetella pertussis
cggcagcagcagcgugcggu

SEQ ID NO: 350811 - RNA, 17 nt, Bordetella pertussis
cggcagcagcgagaaca

SEQ ID NO: 350812 - RNA, 23 nt, Bordetella pertussis
cggcagcagcgagaacagccaca

SEQ ID NO: 350813 - RNA, 16 nt, Bordetella pertussis
cggcagcagcgcgccg

SEQ ID NO: 350814 - RNA, 13 nt, Bordetella pertussis
cggcagcaggcgc

SEQ ID NO: 350815 - RNA, 22 nt, Bordetella pertussis
cggcagcagggccacgcccagg

SEQ ID NO: 350816 - RNA, 16 nt, Bordetella pertussis
cggcagcauggcgcgc

SEQ ID NO: 350817 - RNA, 11 nt, Bordetella pertussis
cggcagcccca

SEQ ID NO: 350818 - RNA, 13 nt, Bordetella pertussis
cggcagccccagc

SEQ ID NO: 350819 - RNA, 14 nt, Bordetella pertussis
cggcagccccagcg

SEQ ID NO: 350820 - RNA, 19 nt, Bordetella pertussis
cggcagccccagcgcccag

SEQ ID NO: 350821 - RNA, 18 nt, Bordetella pertussis
cggcagccccgggugcag

SEQ ID NO: 350822 - RNA, 13 nt, Bordetella pertussis
cggcagccggcca

SEQ ID NO: 350823 - RNA, 18 nt, Bordetella pertussis
cggcagccggccauggcc

SEQ ID NO: 350824 - RNA, 14 nt, Bordetella pertussis
cggcagcgacucgc

SEQ ID NO: 350825 - RNA, 20 nt, Bordetella pertussis
cggcagcgacucgccgugcu

SEQ ID NO: 350826 - RNA, 17 nt, Bordetella pertussis
cggcagcgaggcgcagc

SEQ ID NO: 350827 - RNA, 22 nt, Bordetella pertussis
cggcagcgcaaaacgcaugacc

SEQ ID NO: 350828 - RNA, 15 nt, Bordetella pertussis
cggcagcgccggguc

SEQ ID NO: 350829 - RNA, 16 nt, Bordetella pertussis
cggcagcgcgaacggc

SEQ ID NO: 350830 - RNA, 14 nt, Bordetella pertussis
cggcagcgcgaccg

SEQ ID NO: 350831 - RNA, 15 nt, Bordetella pertussis
cggcagcgcgaccgg

SEQ ID NO: 350832 - RNA, 16 nt, Bordetella pertussis
cggcagcgcgaccggc

SEQ ID NO: 350833 - RNA, 17 nt, Bordetella pertussis
cggcagcgcgaccggcg

SEQ ID NO: 350834 - RNA, 19 nt, Bordetella pertussis
cggcagcgcgaccggcgcg

SEQ ID NO: 350835 - RNA, 13 nt, Bordetella pertussis
cggcagcgccuug

SEQ ID NO: 350836 - RNA, 19 nt, Bordetella pertussis
cggcagcgccuugccuucc

SEQ ID NO: 350837 - RNA, 12 nt, Bordetella pertussis
cggcagcgcgca

SEQ ID NO: 350838 - RNA, 15 nt, Bordetella pertussis
cggcagcgcgcagga

SEQ ID NO: 350839 - RNA, 18 nt, Bordetella pertussis
cggcagcgcgcaggacaa

SEQ ID NO: 350840 - RNA, 22 nt, Bordetella pertussis
cggcagcgcgcaggacaaggcg

SEQ ID NO: 350841 - RNA, 15 nt, Bordetella pertussis
cggcagcggccagcg

SEQ ID NO: 350842 - RNA, 19 nt, Bordetella pertussis
cggcagcggccagcgcggc

SEQ ID NO: 350843 - RNA, 13 nt, Bordetella pertussis
cggcagcggcgcc

SEQ ID NO: 350844 - RNA, 14 nt, Bordetella pertussis
cggcagcggcgcca

SEQ ID NO: 350845 - RNA, 16 nt, Bordetella pertussis
cggcagcguaucgccc

SEQ ID NO: 350846 - RNA, 19 nt, Bordetella pertussis
cggcagcguaucgcccgcg

SEQ ID NO: 350847 - RNA, 20 nt, Bordetella pertussis
cggcagcguaucgcccgcgc

SEQ ID NO: 350848 - RNA, 12 nt, Bordetella pertussis
cggcaggccggc

SEQ ID NO: 350849 - RNA, 16 nt, Bordetella pertussis
cggcaggccggccagc

SEQ ID NO: 350850 - RNA, 17 nt, Bordetella pertussis
cggcaggccggccagca

SEQ ID NO: 350851 - RNA, 16 nt, Bordetella pertussis
cggcaggcgccgccgc

SEQ ID NO: 350852 - RNA, 16 nt, Bordetella pertussis
cggcaggcgccugccc

SEQ ID NO: 350853 - RNA, 14 nt, Bordetella pertussis
cggcaggcgcgagg

SEQ ID NO: 350854 - RNA, 19 nt, Bordetella pertussis
cggcaggcgcgccagcccg

SEQ ID NO: 350855 - RNA, 15 nt, Bordetella pertussis
cggcaggcuggccgg

SEQ ID NO: 350856 - RNA, 18 nt, Bordetella pertussis
cggcaggcuggccggcgu

SEQ ID NO: 350857 - RNA, 14 nt, Bordetella pertussis
cggcagggccagcg

SEQ ID NO: 350858 - RNA, 21 nt, Bordetella pertussis
cggcaggugcagaaaccccag

SEQ ID NO: 350859 - RNA, 20 nt, Bordetella pertussis
cggcaggugcgccagcacgg

SEQ ID NO: 350860 - RNA, 21 nt, Bordetella pertussis
cggcagguucugcgcguccug

SEQ ID NO: 350861 - RNA, 22 nt, Bordetella pertussis
cggcagguucugcgcguccugg

SEQ ID NO: 350862 - RNA, 23 nt, Bordetella pertussis
cggcagguucugcgcguccuggc

SEQ ID NO: 350863 - RNA, 22 nt, Bordetella pertussis
cggcagguugaaguugcucggc

SEQ ID NO: 350864 - RNA, 22 nt, Bordetella pertussis
cggcagugggcggugaccaugc

SEQ ID NO: 350865 - RNA, 21 nt, Bordetella pertussis
cggcagugucaggaugcccug

SEQ ID NO: 350866 - RNA, 22 nt, Bordetella pertussis
cggcagugucaggaugcccugg

SEQ ID NO: 350867 - RNA, 14 nt, Bordetella pertussis
cggcaucgcgcuga

SEQ ID NO: 350868 - RNA, 14 nt, Bordetella pertussis
cggcaucggccacg

SEQ ID NO: 350869 - RNA, 13 nt, Bordetella pertussis
cggcaucggccag

SEQ ID NO: 350870 - RNA, 14 nt, Bordetella pertussis
cggcaucggcgccg

SEQ ID NO: 350871 - RNA, 18 nt, Bordetella pertussis
cggcaucggcgccgcgcg

SEQ ID NO: 350872 - RNA, 15 nt, Bordetella pertussis
cggcaucucgcggcg

SEQ ID NO: 350873 - RNA, 15 nt, Bordetella pertussis
cggcaugaagcgcag

SEQ ID NO: 350874 - RNA, 17 nt, Bordetella pertussis
cggcaugaagcgcagca

SEQ ID NO: 350875 - RNA, 20 nt, Bordetella pertussis
cggcaugaccgcggacgcca

SEQ ID NO: 350876 - RNA, 18 nt, Bordetella pertussis
cggcaucuguccgcgccg

SEQ ID NO: 350877 - RNA, 13 nt, Bordetella pertussis
cggcaugauggcc

SEQ ID NO: 350878 - RNA, 15 nt, Bordetella pertussis
cggcaugauggcccg

SEQ ID NO: 350879 - RNA, 16 nt, Bordetella pertussis
cggcaugccguccacg

SEQ ID NO: 350880 - RNA, 20 nt, Bordetella pertussis
cggcaugccguccacgccca

SEQ ID NO: 350881 - RNA, 17 nt, Bordetella pertussis
cggcaugcgcaugcugg

SEQ ID NO: 350882 - RNA, 20 nt, Bordetella pertussis
cggcauggccaaugccauug

SEQ ID NO: 350883 - RNA, 21 nt, Bordetella pertussis
cggccaacagcucgcgccagg

SEQ ID NO: 350884 - RNA, 24 nt, Bordetella pertussis
cggccaacagcucgcgccagggcc

SEQ ID NO: 350885 - RNA, 17 nt, Bordetella pertussis
cggccaaccccgagggc

SEQ ID NO: 350886 - RNA, 23 nt, Bordetella pertussis
cggccaaccccgagggcgcggcg

SEQ ID NO: 350887 - RNA, 19 nt, Bordetella pertussis
cggccaacccucgcacggc

SEQ ID NO: 350888 - RNA, 14 nt, Bordetella pertussis
cggccaacggcugg

SEQ ID NO: 350889 - RNA, 21 nt, Bordetella pertussis
cggccaagacgcggggacagg

SEQ ID NO: 350890 - RNA, 14 nt, Bordetella pertussis
cggccaagcagcgc

SEQ ID NO: 350891 - RNA, 15 nt, Bordetella pertussis
cggccaagcagcgcc

SEQ ID NO: 350892 - RNA, 14 nt, Bordetella pertussis
cggccaagcuccag

SEQ ID NO: 350893 - RNA, 16 nt, Bordetella pertussis
cggccaagcuccagga

SEQ ID NO: 350894 - RNA, 14 nt, Bordetella pertussis
cggccaaggcaagc

SEQ ID NO: 350895 - RNA, 19 nt, Bordetella pertussis
cggccaaggcaagcagcga

SEQ ID NO: 350896 - RNA, 23 nt, Bordetella pertussis
cggccaaggcauuggcgccgcgc

SEQ ID NO: 350897 - RNA, 17 nt, Bordetella pertussis
cggccaaggccggcgcg

SEQ ID NO: 350898 - RNA, 15 nt, Bordetella pertussis
cggccaaucggccug

SEQ ID NO: 350899 - RNA, 17 nt, Bordetella pertussis
cggccaaucggccugcu

SEQ ID NO: 350900 - RNA, 14 nt, Bordetella pertussis
cggccaauggccgg

SEQ ID NO: 350901 - RNA, 12 nt, Bordetella pertussis
cggccaccagcg

SEQ ID NO: 350902 - RNA, 14 nt, Bordetella pertussis
cggccaccagcggc

SEQ ID NO: 350903 - RNA, 18 nt, Bordetella pertussis
cggccaccagcggcgccg

SEQ ID NO: 350904 - RNA, 22 nt, Bordetella pertussis
cggccaccagcguguagagcag

SEQ ID NO: 350905 - RNA, 12 nt, Bordetella pertussis
cggccaccaggc

SEQ ID NO: 350906 - RNA, 15 nt, Bordetella pertussis
cggccaccaggccgu

SEQ ID NO: 350907 - RNA, 16 nt, Bordetella pertussis
cggccagcaagcgcgc

SEQ ID NO: 350908 - RNA, 12 nt, Bordetella pertussis
cggccagcaccg

SEQ ID NO: 350909 - RNA, 16 nt, Bordetella pertussis
cggccagcaccggccg

SEQ ID NO: 350910 - RNA, 19 nt, Bordetella pertussis
cggccagcaccggccgccg

SEQ ID NO: 350911 - RNA, 15 nt, Bordetella pertussis
cggccagcacgccgg

SEQ ID NO: 350912 - RNA, 20 nt, Bordetella pertussis
cggccagcacgccggcgggc

SEQ ID NO: 350913 - RNA, 15 nt, Bordetella pertussis
cggccagcacgggcg

SEQ ID NO: 350914 - RNA, 14 nt, Bordetella pertussis
cggccagccggccg

SEQ ID NO: 350915 - RNA, 14 nt, Bordetella pertussis
cggccagcacgccg

SEQ ID NO: 350916 - RNA, 18 nt, Bordetella pertussis
cggccagccggcgcgcca

SEQ ID NO: 350917 - RNA, 15 nt, Bordetella pertussis
cggccagccgggcga

SEQ ID NO: 350918 - RNA, 13 nt, Bordetella pertussis
cggccagccgggc

SEQ ID NO: 350919 - RNA, 17 nt, Bordetella pertussis
cggccagccugugcgcc

SEQ ID NO: 350920 - RNA, 19 nt, Bordetella pertussis
cggccagccugccgcggcc

SEQ ID NO: 350921 - RNA, 17 nt, Bordetella pertussis
cggccagcgaggccgcu

SEQ ID NO: 350922 - RNA, 21 nt, Bordetella pertussis
cggccagcgccaguccgcgcu

SEQ ID NO: 350923 - RNA, 14 nt, Bordetella pertussis
cggccagcgccggc

SEQ ID NO: 350924 - RNA, 16 nt, Bordetella pertussis
cggccagcgccggcgc

SEQ ID NO: 350925 - RNA, 19 nt, Bordetella pertussis
cggccagcgccggcgcgcg

SEQ ID NO: 350926 - RNA, 14 nt, Bordetella pertussis
cggccagcgccugg

SEQ ID NO: 350927 - RNA, 16 nt, Bordetella pertussis
cggccagcgccugggc

SEQ ID NO: 350928 - RNA, 15 nt, Bordetella pertussis
cggccagcgcgacgg

SEQ ID NO: 350929 - RNA, 12 nt, Bordetella pertussis
cggccagcgcgc

SEQ ID NO: 350930 - RNA, 13 nt, Bordetella pertussis
cggccagcgcgcc

SEQ ID NO: 350931 - RNA, 14 nt, Bordetella pertussis
cggccagcgcgccc

SEQ ID NO: 350932 - RNA, 15 nt, Bordetella pertussis
cggccagcgcgcccu

SEQ ID NO: 350933 - RNA, 13 nt, Bordetella pertussis
cggccagcgccga

SEQ ID NO: 350934 - RNA, 22 nt, Bordetella pertussis
cggccagcgcgccgccagcgcg

SEQ ID NO: 350935 - RNA, 19 nt, Bordetella pertussis
cggccagcgcgccggccag

SEQ ID NO: 350936 - RNA, 20 nt, Bordetella pertussis
cggccagcgcgccggccagg

SEQ ID NO: 350937 - RNA, 16 nt, Bordetella pertussis
cggccagcgcgcgcca

SEQ ID NO: 350938 - RNA, 14 nt, Bordetella pertussis
cggccagcgcgcgg

SEQ ID NO: 350939 - RNA, 20 nt, Bordetella pertussis
cggccagcgcgcggccggcc

SEQ ID NO: 350940 - RNA, 17 nt, Bordetella pertussis
cggccagcgcgcggcgc

SEQ ID NO: 350941 - RNA, 20 nt, Bordetella pertussis
cggccagcgcgcggcgcagc

SEQ ID NO: 350942 - RNA, 14 nt, Bordetella pertussis
cggccagcgcggca

SEQ ID NO: 350943 - RNA, 19 nt, Bordetella pertussis
cggccagcgcggcaucggc

SEQ ID NO: 350944 - RNA, 14 nt, Bordetella pertussis
cggccagcgcggcg

SEQ ID NO: 350945 - RNA, 14 nt, Bordetella pertussis
cggccagcgugccg

SEQ ID NO: 350946 - RNA, 16 nt, Bordetella pertussis
cggccagcugcaugcg

SEQ ID NO: 350947 - RNA, 17 nt, Bordetella pertussis
cggccagcugcaugcgc

SEQ ID NO: 350948 - RNA, 18 nt, Bordetella pertussis
cggccagcugcaugcgca

SEQ ID NO: 350949 - RNA, 21 nt, Bordetella pertussis
cggccagcugcaugcgcacgg

SEQ ID NO: 350950 - RNA, 18 nt, Bordetella pertussis
cggccagcuugaccgcca

SEQ ID NO: 350951 - RNA, 15 nt, Bordetella pertussis
cggccagcuugagca

SEQ ID NO: 350952 - RNA, 22 nt, Bordetella pertussis
cggccagcuugagcaggcgcga

SEQ ID NO: 350953 - RNA, 17 nt, Bordetella pertussis
cggccaggaaagccggc

SEQ ID NO: 350954 - RNA, 18 nt, Bordetella pertussis
cggccagcuuguagcggc

SEQ ID NO: 350955 - RNA, 20 nt, Bordetella pertussis
cggccagcuuguagcggcca

SEQ ID NO: 350956 - RNA, 17 nt, Bordetella pertussis
cggccaggacgaucccg

SEQ ID NO: 350957 - RNA, 20 nt, Bordetella pertussis
cggccaggacgaucccggcc

SEQ ID NO: 350958 - RNA, 17 nt, Bordetella pertussis
cggccaggacggcaucu

SEQ ID NO: 350959 - RNA, 18 nt, Bordetella pertussis
cggccaggacggugucgc

SEQ ID NO: 350960 - RNA, 20 nt, Bordetella pertussis
cggccaggaucgcggccagc

SEQ ID NO: 350961 - RNA, 13 nt, Bordetella pertussis
cggccaggauggc

SEQ ID NO: 350962 - RNA, 20 nt, Bordetella pertussis
cggccaggauggcguugccg

SEQ ID NO: 350963 - RNA, 22 nt, Bordetella pertussis
cggccaggauggcguugccggc

SEQ ID NO: 350964 - RNA, 11 nt, Bordetella pertussis
aacaucgcgca

SEQ ID NO: 350965 - RNA, 14 nt, Bordetella pertussis
cggccaggucgcgc

SEQ ID NO: 350966 - RNA, 20 nt, Bordetella pertussis
cggccaggucggcgucgucg

SEQ ID NO: 350967 - RNA, 22 nt, Bordetella pertussis
cggccaggucggcgucgucgug

SEQ ID NO: 350968 - RNA, 23 nt, Bordetella pertussis
cggccaggucggcggccagcgcg

SEQ ID NO: 350969 - RNA, 18 nt, Bordetella pertussis
cggccaggugcgccaugc

SEQ ID NO: 350970 - RNA, 20 nt, Bordetella pertussis
cggccaguacgucggacagg

SEQ ID NO: 350971 - RNA, 21 nt, Bordetella pertussis
cggccaguacgucggacaggg

SEQ ID NO: 350972 - RNA, 14 nt, Bordetella pertussis
cggccauccggcca

SEQ ID NO: 350973 - RNA, 18 nt, Bordetella pertussis
cggccauccggccacgca

SEQ ID NO: 350974 - RNA, 24 nt, Bordetella pertussis
cggccaucgaagccagauaaaggc

SEQ ID NO: 350975 - RNA, 20 nt, Bordetella pertussis
cggccaucgccauggccacg

SEQ ID NO: 350976 - RNA, 15 nt, Bordetella pertussis
cggccaucgccgcca

SEQ ID NO: 350977 - RNA, 15 nt, Bordetella pertussis
cggccauggcggccg

SEQ ID NO: 350978 - RNA, 16 nt, Bordetella pertussis
cggccauggcggccgg

SEQ ID NO: 350979 - RNA, 21 nt, Bordetella pertussis
cggccauggcggccggcguug

SEQ ID NO: 350980 - RNA, 17 nt, Bordetella pertussis
cggccauggcggugaaa

SEQ ID NO: 350981 - RNA, 17 nt, Bordetella pertussis
cggccauguagauggcc

SEQ ID NO: 350982 - RNA, 15 nt, Bordetella pertussis
cggccaugugcgcca

SEQ ID NO: 350983 - RNA, 14 nt, Bordetella pertussis
cggcccacagcgcc

SEQ ID NO: 350984 - RNA, 15 nt, Bordetella pertussis
cggcccacagcgccc

SEQ ID NO: 350985 - RNA, 17 nt, Bordetella pertussis
cggcccaaggccccgcg

SEQ ID NO: 350986 - RNA, 19 nt, Bordetella pertussis
cggcccaaggccccgcgac

SEQ ID NO: 350987 - RNA, 16 nt, Bordetella pertussis
cggcccagcgccaucg

SEQ ID NO: 350988 - RNA, 16 nt, Bordetella pertussis
cggcccagcgcggcgg

SEQ ID NO: 350989 - RNA, 13 nt, Bordetella pertussis
cggcccagcggca

SEQ ID NO: 350990 - RNA, 15 nt, Bordetella pertussis
cggcccagcggcaaa

SEQ ID NO: 350991 - RNA, 18 nt, Bordetella pertussis
cggcccagcguggcggug

SEQ ID NO: 350992 - RNA, 18 nt, Bordetella pertussis
cggcccagcucuggucca

SEQ ID NO: 350993 - RNA, 21 nt, Bordetella pertussis
cggcccagcucugguccaggc

SEQ ID NO: 350994 - RNA, 22 nt, Bordetella pertussis
cggcccagcucugguccaggcg

SEQ ID NO: 350995 - RNA, 17 nt, Bordetella pertussis
cggcccaggauggcgcc

SEQ ID NO: 350996 - RNA, 12 nt, Bordetella pertussis
cggcccaggccg

SEQ ID NO: 350997 - RNA, 13 nt, Bordetella pertussis
cggcccaggccgg

SEQ ID NO: 350998 - RNA, 15 nt, Bordetella pertussis
cggcccaggccgggc

SEQ ID NO: 350999 - RNA, 18 nt, Bordetella pertussis
cggcccaggcguccaggc

SEQ ID NO: 351000 - RNA, 17 nt, Bordetella pertussis
cggcccaggucaucgcc

SEQ ID NO: 351001 - RNA, 15 nt, Bordetella pertussis
cggcccaguccaggg

SEQ ID NO: 351002 - RNA, 23 nt, Bordetella pertussis
cggccccgcaaggggccggcgcc

SEQ ID NO: 351003 - RNA, 22 nt, Bordetella pertussis
cggccccgccagggcggggccg

SEQ ID NO: 351004 - RNA, 19 nt, Bordetella pertussis
cggccccgcgucggcgaag

SEQ ID NO: 351005 - RNA, 21 nt, Bordetella pertussis
cggccccggcaccaucgccgc

SEQ ID NO: 351006 - RNA, 18 nt, Bordetella pertussis
cggccccggccgcccccg

SEQ ID NO: 351007 - RNA, 22 nt, Bordetella pertussis
cggccccguugucgccgcggcc

SEQ ID NO: 351008 - RNA, 23 nt, Bordetella pertussis
cggccccguugucgccgcggccg

SEQ ID NO: 351009 - RNA, 11 nt, Bordetella pertussis
cggcccgccac

SEQ ID NO: 351010 - RNA, 21 nt, Bordetella pertussis
cggcccgccacgcgggccggc

SEQ ID NO: 351011 - RNA, 13 nt, Bordetella pertussis
cggcccgccaggg

SEQ ID NO: 351012 - RNA, 15 nt, Bordetella pertussis
cggcccgccgacugg

SEQ ID NO: 351013 - RNA, 16 nt, Bordetella pertussis
cggcccgccucgagcg

SEQ ID NO: 351014 - RNA, 13 nt, Bordetella pertussis
cggcccgcgccgg

SEQ ID NO: 351015 - RNA, 12 nt, Bordetella pertussis
cggcccgcgccg

SEQ ID NO: 351016 - RNA, 22 nt, Bordetella pertussis
cggcccgcgcgucuucaguuga

SEQ ID NO: 351017 - RNA, 13 nt, Bordetella pertussis
cggcccgcgcugu

SEQ ID NO: 351018 - RNA, 19 nt, Bordetella pertussis
cggcccgcggccuuggucg

SEQ ID NO: 351019 - RNA, 18 nt, Bordetella pertussis
cggcccgcuccaggcggc

SEQ ID NO: 351020 - RNA, 20 nt, Bordetella pertussis
cggcccgcuccaggcggcca

SEQ ID NO: 351021 - RNA, 21 nt, Bordetella pertussis
cggcccggaauaccgccagcu

SEQ ID NO: 351022 - RNA, 17 nt, Bordetella pertussis
cggcccggugcagccgc

SEQ ID NO: 351023 - RNA, 18 nt, Bordetella pertussis
cggcccggugcagccgcc

SEQ ID NO: 351024 - RNA, 19 nt, Bordetella pertussis
cggcccggugcagccgccg

SEQ ID NO: 351025 - RNA, 19 nt, Bordetella pertussis
cggcccgugcgcaacgcgc

SEQ ID NO: 351026 - RNA, 19 nt, Bordetella pertussis
cggcccguuccacaggcga

SEQ ID NO: 351027 - RNA, 15 nt, Bordetella pertussis
cggcccguuggcagg

SEQ ID NO: 351028 - RNA, 19 nt, Bordetella pertussis
cggcccguuggcaggccag

SEQ ID NO: 351029 - RNA, 21 nt, Bordetella pertussis
cggcccguuggcaggccagca

SEQ ID NO: 351030 - RNA, 19 nt, Bordetella pertussis
cggccgaaaccgccgcggc

SEQ ID NO: 351031 - RNA, 16 nt, Bordetella pertussis
cggccgaagcgcaagc

SEQ ID NO: 351032 - RNA, 20 nt, Bordetella pertussis
cggccgaagcgcaagcccag

SEQ ID NO: 351033 - RNA, 22 nt, Bordetella pertussis
cggccgaagcgcaagcccaggc

SEQ ID NO: 351034 - RNA, 15 nt, Bordetella pertussis
cggccgaaccgcgca

SEQ ID NO: 351035 - RNA, 21 nt, Bordetella pertussis
cggccgaugacaucgccgcug

SEQ ID NO: 351036 - RNA, 17 nt, Bordetella pertussis
cggccgcaagcuggccg

SEQ ID NO: 351037 - RNA, 14 nt, Bordetella pertussis
cggccgccaccugg

SEQ ID NO: 351038 - RNA, 14 nt, Bordetella pertussis
cggccgccagcccg

SEQ ID NO: 351039 - RNA, 15 nt, Bordetella pertussis
cggccgccagccggc

SEQ ID NO: 351040 - RNA, 18 nt, Bordetella pertussis
cggccgccagccggccca

SEQ ID NO: 351041 - RNA, 14 nt, Bordetella pertussis
cggccgccagcgcc

SEQ ID NO: 351042 - RNA, 12 nt, Bordetella pertussis
cggccgccaggu

SEQ ID NO: 351043 - RNA, 22 nt, Bordetella pertussis
cggccgccagguagcggguggc

SEQ ID NO: 351044 - RNA, 16 nt, Bordetella pertussis
cggccgccaggucggc

SEQ ID NO: 351045 - RNA, 12 nt, Bordetella pertussis
cggccgccagcc

SEQ ID NO: 351046 - RNA, 18 nt, Bordetella pertussis
cggccgccauggccggcg

SEQ ID NO: 351047 - RNA, 21 nt, Bordetella pertussis
cggccgccauggccggcguug

SEQ ID NO: 351048 - RNA, 12 nt, Bordetella pertussis
cggccgcccagg

SEQ ID NO: 351049 - RNA, 19 nt, Bordetella pertussis
cggccgcccaggcgcagcc

SEQ ID NO: 351050 - RNA, 19 nt, Bordetella pertussis
cggccgccuugacgguggc

SEQ ID NO: 351051 - RNA, 22 nt, Bordetella pertussis
cggccgcgacgcuacagcguca

SEQ ID NO: 351052 - RNA, 23 nt, Bordetella pertussis
cggccgcgaucgaguggugcgcg

SEQ ID NO: 351053 - RNA, 14 nt, Bordetella pertussis
cggccgcgcaaggc

SEQ ID NO: 351054 - RNA, 21 nt, Bordetella pertussis
cggccgcgcaccugcugcggc

SEQ ID NO: 351055 - RNA, 23 nt, Bordetella pertussis
cggccgcgcaggauuucaucgcc

SEQ ID NO: 351056 - RNA, 12 nt, Bordetella pertussis
cggccgcgccca

SEQ ID NO: 351057 - RNA, 12 nt, Bordetella pertussis
cggccgcgcccg

SEQ ID NO: 351058 - RNA, 13 nt, Bordetella pertussis
cggccgcgcccga

SEQ ID NO: 351059 - RNA, 14 nt, Bordetella pertussis
cggccgcgcccgag

SEQ ID NO: 351060 - RNA, 21 nt, Bordetella pertussis
cggccgcgcccgcaacgggcc

SEQ ID NO: 351061 - RNA, 15 nt, Bordetella pertussis
cggccgcgcgcgcca

SEQ ID NO: 351062 - RNA, 20 nt, Bordetella pertussis
cggccgcgcgcuucaggcgc

SEQ ID NO: 351063 - RNA, 14 nt, Bordetella pertussis
cggccgcgcggccg

SEQ ID NO: 351064 - RNA, 17 nt, Bordetella pertussis
cggccgcgcggccguca

SEQ ID NO: 351065 - RNA, 22 nt, Bordetella pertussis
cggccgcggaagucgggcacca

SEQ ID NO: 351066 - RNA, 24 nt, Bordetella pertussis
cggccgcggaagucgggcaccagc

SEQ ID NO: 351067 - RNA, 15 nt, Bordetella pertussis
cggccgcggccggca

SEQ ID NO: 351068 - RNA, 17 nt, Bordetella pertussis
cggccgcggccggcacg

SEQ ID NO: 351069 - RNA, 17 nt, Bordetella pertussis
cggccgcgucggccuca

SEQ ID NO: 351070 - RNA, 13 nt, Bordetella pertussis
cggccgcggccgg

SEQ ID NO: 351071 - RNA, 18 nt, Bordetella pertussis
cggccgcguggccgcgcu

SEQ ID NO: 351072 - RNA, 20 nt, Bordetella pertussis
cggccgcguggccgcgcugc

SEQ ID NO: 351073 - RNA, 19 nt, Bordetella pertussis
cggccgcugccgcgcgccg

SEQ ID NO: 351074 - RNA, 14 nt, Bordetella pertussis
cggccggcaccagg

SEQ ID NO: 351075 - RNA, 14 nt, Bordetella pertussis
cggccggcacgccc

SEQ ID NO: 351076 - RNA, 13 nt, Bordetella pertussis
cggccggcacggc

SEQ ID NO: 351077 - RNA, 14 nt, Bordetella pertussis
cggccggcacggcc

SEQ ID NO: 351078 - RNA, 15 nt, Bordetella pertussis
cggccggcacggccg

SEQ ID NO: 351079 - RNA, 16 nt, Bordetella pertussis
cggccggcacggccgg

SEQ ID NO: 351080 - RNA, 17 nt, Bordetella pertussis
cggccggcacggccggc

SEQ ID NO: 351081 - RNA, 19 nt, Bordetella pertussis
cggccggcacggccggcca

SEQ ID NO: 351082 - RNA, 13 nt, Bordetella pertussis
cggccggcagcgc

SEQ ID NO: 351083 - RNA, 15 nt, Bordetella pertussis
cggccggcagcgccu

SEQ ID NO: 351084 - RNA, 14 nt, Bordetella pertussis
cggccggcagcgcg

SEQ ID NO: 351085 - RNA, 14 nt, Bordetella pertussis
cggccggcagcggc

SEQ ID NO: 351086 - RNA, 16 nt, Bordetella pertussis
cggccggcagcggcgc

SEQ ID NO: 351087 - RNA, 15 nt, Bordetella pertussis
cggccggcaggucga

SEQ ID NO: 351088 - RNA, 13 nt, Bordetella pertussis
cggccggccaggc

SEQ ID NO: 351089 - RNA, 15 nt, Bordetella pertussis
cggccggccaggcgc

SEQ ID NO: 351090 - RNA, 13 nt, Bordetella pertussis
cggccggccagua

SEQ ID NO: 351091 - RNA, 22 nt, Bordetella pertussis
cggccggccaguacgucggaca

SEQ ID NO: 351092 - RNA, 15 nt, Bordetella pertussis
cggccggcccgugcg

SEQ ID NO: 351093 - RNA, 14 nt, Bordetella pertussis
cggccggccagcca

SEQ ID NO: 351094 - RNA, 14 nt, Bordetella pertussis
cggccggccgcgcc

SEQ ID NO: 351095 - RNA, 14 nt, Bordetella pertussis
cggccggccgggca

SEQ ID NO: 351096 - RNA, 22 nt, Bordetella pertussis
cggccggccugcuuggccgcgu

SEQ ID NO: 351097 - RNA, 15 nt, Bordetella pertussis
cggccugccggcgca

SEQ ID NO: 351098 - RNA, 17 nt, Bordetella pertussis
cggccugccggcgcaca

SEQ ID NO: 351099 - RNA, 19 nt, Bordetella pertussis
cggccugccggcgcgccuc

SEQ ID NO: 351100 - RNA, 18 nt, Bordetella pertussis
cggccugcgccaccagcu

SEQ ID NO: 351101 - RNA, 15 nt, Bordetella pertussis
cggccugcgccagcu

SEQ ID NO: 351102 - RNA, 18 nt, Bordetella pertussis
cggccugcgccagcucca

SEQ ID NO: 351103 - RNA, 18 nt, Bordetella pertussis
cggccugcgccggcaugg

SEQ ID NO: 351104 - RNA, 20 nt, Bordetella pertussis
cggccugcgccggcauggcc

SEQ ID NO: 351105 - RNA, 16 nt, Bordetella pertussis
cggccugcgccgggcg

SEQ ID NO: 351106 - RNA, 20 nt, Bordetella pertussis
cggccugcgccgggcgcggc

SEQ ID NO: 351107 - RNA, 12 nt, Bordetella pertussis
cggccugcgcgc

SEQ ID NO: 351108 - RNA, 16 nt, Bordetella pertussis
cggccugcgcgucccg

SEQ ID NO: 351109 - RNA, 18 nt, Bordetella pertussis
cggccugcggcucgagga

SEQ ID NO: 351110 - RNA, 16 nt, Bordetella pertussis
cggccugcucgcaggc

SEQ ID NO: 351111 - RNA, 20 nt, Bordetella pertussis
cggccugcucgcaggccugc

SEQ ID NO: 351112 - RNA, 20 nt, Bordetella pertussis
cggccugcucgccggccagc

SEQ ID NO: 351113 - RNA, 15 nt, Bordetella pertussis
cggccugcgucgcca

SEQ ID NO: 351114 - RNA, 17 nt, Bordetella pertussis
cggccuggaacauggcc

SEQ ID NO: 351115 - RNA, 14 nt, Bordetella pertussis
cggccuggccgcgc

SEQ ID NO: 351116 - RNA, 15 nt, Bordetella pertussis
cggccuggccgcgcg

SEQ ID NO: 351117 - RNA, 18 nt, Bordetella pertussis
cggccuggccgcgcgccu

SEQ ID NO: 351118 - RNA, 19 nt, Bordetella pertussis
cggccuggccgcgcgccug

SEQ ID NO: 351119 - RNA, 12 nt, Bordetella pertussis
cggccuggccgg

SEQ ID NO: 351120 - RNA, 22 nt, Bordetella pertussis
cggccuggccggggaagccgcc

SEQ ID NO: 351121 - RNA, 14 nt, Bordetella pertussis
cggccuggcgcgac

SEQ ID NO: 351122 - RNA, 15 nt, Bordetella pertussis
cggccuggcgcgacg

SEQ ID NO: 351123 - RNA, 14 nt, Bordetella pertussis
cggccuggcgcgca

SEQ ID NO: 351124 - RNA, 17 nt, Bordetella pertussis
cggccuggcgcgcaucg

SEQ ID NO: 351125 - RNA, 24 nt, Bordetella pertussis
cggccuugagcaucugcggcacga

SEQ ID NO: 351126 - RNA, 19 nt, Bordetella pertussis
cggccuggccccaggcgcc

SEQ ID NO: 351127 - RNA, 21 nt, Bordetella pertussis
cggccuggccccaggcgcccg

SEQ ID NO: 351128 - RNA, 14 nt, Bordetella pertussis
cggccuugccggcc

SEQ ID NO: 351129 - RNA, 22 nt, Bordetella pertussis
cggccuugccgguggacggcca

SEQ ID NO: 351130 - RNA, 18 nt, Bordetella pertussis
cggccuugcgggccggcu

SEQ ID NO: 351131 - RNA, 15 nt, Bordetella pertussis
cggcgaaagcgucgg

SEQ ID NO: 351132 - RNA, 14 nt, Bordetella pertussis
cggcgaacagcgcg

SEQ ID NO: 351133 - RNA, 17 nt, Bordetella pertussis
cggcgaacugggcgucg

SEQ ID NO: 351134 - RNA, 13 nt, Bordetella pertussis
cggcgaagccgca

SEQ ID NO: 351135 - RNA, 14 nt, Bordetella pertussis
cggcgaagccgcag

SEQ ID NO: 351136 - RNA, 16 nt, Bordetella pertussis
cggcgaagccgcagcg

SEQ ID NO: 351137 - RNA, 18 nt, Bordetella pertussis
cggcgaagccgcagcggc

SEQ ID NO: 351138 - RNA, 13 nt, Bordetella pertussis
cggcgaagccggc

SEQ ID NO: 351139 - RNA, 20 nt, Bordetella pertussis
cggcgaagccggcacgccug

SEQ ID NO: 351140 - RNA, 18 nt, Bordetella pertussis
cggcgaaggucuggucgc

SEQ ID NO: 351141 - RNA, 15 nt, Bordetella pertussis
cggcgaaguccugca

SEQ ID NO: 351142 - RNA, 15 nt, Bordetella pertussis
cggcgaagugcccgc

SEQ ID NO: 351143 - RNA, 23 nt, Bordetella pertussis
cggcgaagugcccgcuggccaug

SEQ ID NO: 351144 - RNA, 16 nt, Bordetella pertussis
cggcgacaccgcggcc

SEQ ID NO: 351145 - RNA, 13 nt, Bordetella pertussis
cggcgacagcgau

SEQ ID NO: 351146 - RNA, 15 nt, Bordetella pertussis
cggcgaccaggccca

SEQ ID NO: 351147 - RNA, 12 nt, Bordetella pertussis
cggcgaccaggu

SEQ ID NO: 351148 - RNA, 22 nt, Bordetella pertussis
cggcgaccaggugcgggccgcu

SEQ ID NO: 351149 - RNA, 16 nt, Bordetella pertussis
cggcgaccgacggcau

SEQ ID NO: 351150 - RNA, 18 nt, Bordetella pertussis
cggcgaccgacggcaucg

SEQ ID NO: 351151 - RNA, 15 nt, Bordetella pertussis
cggcgaccggcgccg

SEQ ID NO: 351152 - RNA, 17 nt, Bordetella pertussis
cggcgaccggcgccggc

SEQ ID NO: 351153 - RNA, 18 nt, Bordetella pertussis
cggcgaccggcgccggcu

SEQ ID NO: 351154 - RNA, 20 nt, Bordetella pertussis
cggcgacgacuacgcgcugg

SEQ ID NO: 351155 - RNA, 18 nt, Bordetella pertussis
cggcgacgaucccgacga

SEQ ID NO: 351156 - RNA, 18 nt, Bordetella pertussis
cggcgacgaugccgcaga

SEQ ID NO: 351157 - RNA, 16 nt, Bordetella pertussis
cggcgacgcagcacgg

SEQ ID NO: 351158 - RNA, 17 nt, Bordetella pertussis
cggcgacgcagcacggc

SEQ ID NO: 351159 - RNA, 18 nt, Bordetella pertussis
cggcgacgccgcggugcu

SEQ ID NO: 351160 - RNA, 20 nt, Bordetella pertussis
cggcgacggcgccuggcgca

SEQ ID NO: 351161 - RNA, 13 nt, Bordetella pertussis
cggcgacggcgcc

SEQ ID NO: 351162 - RNA, 16 nt, Bordetella pertussis
cggcgacggcgucggc

SEQ ID NO: 351163 - RNA, 17 nt, Bordetella pertussis
cggcgacggcgucggcc

SEQ ID NO: 351164 - RNA, 22 nt, Bordetella pertussis
cggcgacggucaggggcaggcg

SEQ ID NO: 351165 - RNA, 15 nt, Bordetella pertussis
cggcgacguuggcga

SEQ ID NO: 351166 - RNA, 17 nt, Bordetella pertussis
cggcgacguuggcgaau

SEQ ID NO: 351167 - RNA, 19 nt, Bordetella pertussis
cggcgacugccccagcggc

SEQ ID NO: 351168 - RNA, 20 nt, Bordetella pertussis
cggcgacugccccagcggcu

SEQ ID NO: 351169 - RNA, 21 nt, Bordetella pertussis
cggcgacuucgccgaugacca

SEQ ID NO: 351170 - RNA, 15 nt, Bordetella pertussis
cggcgacuucggcgg

SEQ ID NO: 351171 - RNA, 16 nt, Bordetella pertussis
cggcgacuucggcggc

SEQ ID NO: 351172 - RNA, 16 nt, Bordetella pertussis
cggcgagacgucggcg

SEQ ID NO: 351173 - RNA, 17 nt, Bordetella pertussis
cggcgagacgucggcga

SEQ ID NO: 351174 - RNA, 21 nt, Bordetella pertussis
cggcgagacgucggcgauggc

SEQ ID NO: 351175 - RNA, 13 nt, Bordetella pertussis
cggcgagcacggc

SEQ ID NO: 351176 - RNA, 19 nt, Bordetella pertussis
cggcgagcacggccugcuc

SEQ ID NO: 351177 - RNA, 20 nt, Bordetella pertussis
cggcgagcauggcgguggcc

SEQ ID NO: 351178 - RNA, 21 nt, Bordetella pertussis
cggcgagcauggcgguggcca

SEQ ID NO: 351179 - RNA, 15 nt, Bordetella pertussis
cggcgagccgauggc

SEQ ID NO: 351180 - RNA, 21 nt, Bordetella pertussis
cggcgagccgcgcgcaugcgc

SEQ ID NO: 351181 - RNA, 14 nt, Bordetella pertussis
cggcgagccgggca

SEQ ID NO: 351182 - RNA, 18 nt, Bordetella pertussis
cggcgagccgggcaccga

SEQ ID NO: 351183 - RNA, 15 nt, Bordetella pertussis
cggcgagcgccgcca

SEQ ID NO: 351184 - RNA, 17 nt, Bordetella pertussis
cggcgagcgccgccagg

SEQ ID NO: 351185 - RNA, 19 nt, Bordetella pertussis
cggcgagcgccgccaggcc

SEQ ID NO: 351186 - RNA, 20 nt, Bordetella pertussis
cggcgagcgccgccaggccg

SEQ ID NO: 351187 - RNA, 22 nt, Bordetella pertussis
cggcgagcgccgccaggccguc

SEQ ID NO: 351188 - RNA, 23 nt, Bordetella pertussis
cggcgagcgccgccaggccgucg

SEQ ID NO: 351189 - RNA, 21 nt, Bordetella pertussis
cggcgagcgcggcgcgcgcca

SEQ ID NO: 351190 - RNA, 15 nt, Bordetella pertussis
cggcgagcuggcccu

SEQ ID NO: 351191 - RNA, 17 nt, Bordetella pertussis
cggcgagcuggcccugg

SEQ ID NO: 351192 - RNA, 20 nt, Bordetella pertussis
cggcgaggaggugcgccgcu

SEQ ID NO: 351193 - RNA, 17 nt, Bordetella pertussis
cggcgaggaugccgcgc

SEQ ID NO: 351194 - RNA, 14 nt, Bordetella pertussis
cggcgaggccgccc

SEQ ID NO: 351195 - RNA, 18 nt, Bordetella pertussis
cggcgagguugcaggcca

SEQ ID NO: 351196 - RNA, 20 nt, Bordetella pertussis
cggcgagguugcaggccagg

SEQ ID NO: 351197 - RNA, 22 nt, Bordetella pertussis
cggcgagguugcaggccaggcu

SEQ ID NO: 351198 - RNA, 21 nt, Bordetella pertussis
cggcgauacgcgccgccuggc

SEQ ID NO: 351199 - RNA, 16 nt, Bordetella pertussis
cggcgauauggccagg

SEQ ID NO: 351200 - RNA, 17 nt, Bordetella pertussis
cggcgauauggccaggg

SEQ ID NO: 351201 - RNA, 22 nt, Bordetella pertussis
cggcgauauccagguaggcggc

SEQ ID NO: 351202 - RNA, 19 nt, Bordetella pertussis
cggcgauccgccgcggcca

SEQ ID NO: 351203 - RNA, 21 nt, Bordetella pertussis
cggcgauccgccgcggccagc

SEQ ID NO: 351204 - RNA, 23 nt, Bordetella pertussis
cggcgauccgccgcggccagcgc

SEQ ID NO: 351205 - RNA, 16 nt, Bordetella pertussis
cggcgaucauggcgug

SEQ ID NO: 351206 - RNA, 17 nt, Bordetella pertussis
cggcgaugcgcgagcgc

SEQ ID NO: 351207 - RNA, 20 nt, Bordetella pertussis
cggcgaugcgcggggccggu

SEQ ID NO: 351208 - RNA, 14 nt, Bordetella pertussis
cggcgaugcgggcc

SEQ ID NO: 351209 - RNA, 16 nt, Bordetella pertussis
cggcgaugcgggcggc

SEQ ID NO: 351210 - RNA, 14 nt, Bordetella pertussis
cggcgauggcccgg

SEQ ID NO: 351211 - RNA, 16 nt, Bordetella pertussis
cggcgauggcccggua

SEQ ID NO: 351212 - RNA, 14 nt, Bordetella pertussis
cggcgauggccgac

SEQ ID NO: 351213 - RNA, 15 nt, Bordetella pertussis
cggcgauggccgaca

SEQ ID NO: 351214 - RNA, 19 nt, Bordetella pertussis
cggcgauugcgccagcgcu

SEQ ID NO: 351215 - RNA, 16 nt, Bordetella pertussis
cggcgcaacgggccga

SEQ ID NO: 351216 - RNA, 18 nt, Bordetella pertussis
cggcgcaacccggccucg

SEQ ID NO: 351217 - RNA, 16 nt, Bordetella pertussis
cggcgcaaccggcccg

SEQ ID NO: 351218 - RNA, 18 nt, Bordetella pertussis
cggcgcaauccaaccugg

SEQ ID NO: 351219 - RNA, 12 nt, Bordetella pertussis
cggcgcacgccg

SEQ ID NO: 351220 - RNA, 16 nt, Bordetella pertussis
cggcgcacgccggacc

SEQ ID NO: 351221 - RNA, 17 nt, Bordetella pertussis
cggcgcacgccggacca

SEQ ID NO: 351222 - RNA, 22 nt, Bordetella pertussis
cggcgcagauggcggcgaugcc

SEQ ID NO: 351223 - RNA, 19 nt, Bordetella pertussis
cggcgcagcaucuugcgcc

SEQ ID NO: 351224 - RNA, 13 nt, Bordetella pertussis
cggcgcagcccag

SEQ ID NO: 351225 - RNA, 14 nt, Bordetella pertussis
cggcgcagccgcca

SEQ ID NO: 351226 - RNA, 23 nt, Bordetella pertussis
cggcgcagccgccauaggcgcgc

SEQ ID NO: 351227 - RNA, 12 nt, Bordetella pertussis
cggcgcagccgg

SEQ ID NO: 351228 - RNA, 15 nt, Bordetella pertussis
cggcgcagucgcgca

SEQ ID NO: 351229 - RNA, 17 nt, Bordetella pertussis
cggcgcagucgcgcacg

SEQ ID NO: 351230 - RNA, 18 nt, Bordetella pertussis
cggcgcagucgcgcacga

SEQ ID NO: 351231 - RNA, 18 nt, Bordetella pertussis
cggcgcaguuccggcggg

SEQ ID NO: 351232 - RNA, 15 nt, Bordetella pertussis
cggcgcaucagcgcg

SEQ ID NO: 351233 - RNA, 19 nt, Bordetella pertussis
cggcgcaucagcgcgcccg

SEQ ID NO: 351234 - RNA, 14 nt, Bordetella pertussis
cggcgcaucggcgc

SEQ ID NO: 351235 - RNA, 15 nt, Bordetella pertussis
cggcgcaucggcgcc

SEQ ID NO: 351236 - RNA, 17 nt, Bordetella pertussis
cggcgcaucggcgccag

SEQ ID NO: 351237 - RNA, 18 nt, Bordetella pertussis
cggcgcaucggcgccagu

SEQ ID NO: 351238 - RNA, 17 nt, Bordetella pertussis
cggcgcaugcagccgca

SEQ ID NO: 351239 - RNA, 23 nt, Bordetella pertussis
cggcgcauugccgucggccgcgc

SEQ ID NO: 351240 - RNA, 20 nt, Bordetella pertussis
cggcgccaagcggcaggcgg

SEQ ID NO: 351241 - RNA, 22 nt, Bordetella pertussis
cggcgccaccccguagcgcauc

SEQ ID NO: 351242 - RNA, 16 nt, Bordetella pertussis
cggcgccagcaugcgc

SEQ ID NO: 351243 - RNA, 12 nt, Bordetella pertussis
cggcgccagcca

SEQ ID NO: 351244 - RNA, 14 nt, Bordetella pertussis
cggcgccagccaga

SEQ ID NO: 351245 - RNA, 23 nt, Bordetella pertussis
cggcgccagcgcuucgggcagcu

SEQ ID NO: 351246 - RNA, 16 nt, Bordetella pertussis
cggcgccagcgccccg

SEQ ID NO: 351247 - RNA, 17 nt, Bordetella pertussis
cggcgccagcgccccgg

SEQ ID NO: 351248 - RNA, 18 nt, Bordetella pertussis
cggcgccagcgccccggc

SEQ ID NO: 351249 - RNA, 14 nt, Bordetella pertussis
cggcgccagcgccg

SEQ ID NO: 351250 - RNA, 22 nt, Bordetella pertussis
cggcgcccucuuucgccgcgcg

SEQ ID NO: 351251 - RNA, 14 nt, Bordetella pertussis
cggcgccagccgcu

SEQ ID NO: 351252 - RNA, 15 nt, Bordetella pertussis
cggcgcccugcaggg

SEQ ID NO: 351253 - RNA, 14 nt, Bordetella pertussis
cggcgcccugcgcg

SEQ ID NO: 351254 - RNA, 23 nt, Bordetella pertussis
cggcgcccugcgcguacguggcg

SEQ ID NO: 351255 - RNA, 22 nt, Bordetella pertussis
cggcgcccuugaugccgucggc

SEQ ID NO: 351256 - RNA, 13 nt, Bordetella pertussis
cggcgccgaccag

SEQ ID NO: 351257 - RNA, 12 nt, Bordetella pertussis
cggcgccgacgc

SEQ ID NO: 351258 - RNA, 14 nt, Bordetella pertussis
cggcgccgacgcgc

SEQ ID NO: 351259 - RNA, 14 nt, Bordetella pertussis
cggcgccgaggcgg

SEQ ID NO: 351260 - RNA, 20 nt, Bordetella pertussis
cggcgccgaucagcaggucg

SEQ ID NO: 351261 - RNA, 21 nt, Bordetella pertussis
cggcgccgaucagcaggucgg

SEQ ID NO: 351262 - RNA, 23 nt, Bordetella pertussis
cggcgccgaucagcaggucggcg

SEQ ID NO: 351263 - RNA, 16 nt, Bordetella pertussis
cggcgccgauccggcg

SEQ ID NO: 351264 - RNA, 14 nt, Bordetella pertussis
cggcgccgccccuu

SEQ ID NO: 351265 - RNA, 15 nt, Bordetella pertussis
cggcgccggccucca

SEQ ID NO: 351266 - RNA, 19 nt, Bordetella pertussis
cggcgccggccuccagcau

SEQ ID NO: 351267 - RNA, 21 nt, Bordetella pertussis
cggcgccggccuccagcaucg

SEQ ID NO: 351268 - RNA, 11 nt, Bordetella pertussis
cggcgccggcg

SEQ ID NO: 351269 - RNA, 13 nt, Bordetella pertussis
cggcgccggcgac

SEQ ID NO: 351270 - RNA, 14 nt, Bordetella pertussis
cggcgccggccucc

SEQ ID NO: 351271 - RNA, 16 nt, Bordetella pertussis
cggcgccggcgcgccg

SEQ ID NO: 351272 - RNA, 15 nt, Bordetella pertussis
cggcgccggcggcgc

SEQ ID NO: 351273 - RNA, 15 nt, Bordetella pertussis
cggcgccggcgucca

SEQ ID NO: 351274 - RNA, 17 nt, Bordetella pertussis
cggcgccgggcgacggc

SEQ ID NO: 351275 - RNA, 22 nt, Bordetella pertussis
cggcgccgggcgacggcgugcu

SEQ ID NO: 351276 - RNA, 22 nt, Bordetella pertussis
cggcgccuauugcgacgccgcc

SEQ ID NO: 351277 - RNA, 20 nt, Bordetella pertussis
cggcgccucgaacguccgcc

SEQ ID NO: 351278 - RNA, 22 nt, Bordetella pertussis
cggcgccugccugccgagcgcu

SEQ ID NO: 351279 - RNA, 14 nt, Bordetella pertussis
cggcgccugcgcgc

SEQ ID NO: 351280 - RNA, 12 nt, Bordetella pertussis
cggcgccugcgg

SEQ ID NO: 351281 - RNA, 14 nt, Bordetella pertussis
cggcgccugcggca

SEQ ID NO: 351282 - RNA, 17 nt, Bordetella pertussis
cggcgccugcggcaugg

SEQ ID NO: 351283 - RNA, 12 nt, Bordetella pertussis
cggcgccugcgu

SEQ ID NO: 351284 - RNA, 17 nt, Bordetella pertussis
cggcgccugcgucguug

SEQ ID NO: 351285 - RNA, 14 nt, Bordetella pertussis
cggcgccuggucgc

SEQ ID NO: 351286 - RNA, 17 nt, Bordetella pertussis
cggcgccuggucgcgcg

SEQ ID NO: 351287 - RNA, 13 nt, Bordetella pertussis
cggcgccuggccc

SEQ ID NO: 351288 - RNA, 20 nt, Bordetella pertussis
cggcgccuggccgcccagcg

SEQ ID NO: 351289 - RNA, 22 nt, Bordetella pertussis
cggcgccuggccgcccagcgcc

SEQ ID NO: 351290 - RNA, 17 nt, Bordetella pertussis
cggcgccuggcgcauga

SEQ ID NO: 351291 - RNA, 13 nt, Bordetella pertussis
cggcgccuggggc

SEQ ID NO: 351292 - RNA, 19 nt, Bordetella pertussis
cggcgccuggggcgugccc

SEQ ID NO: 351293 - RNA, 14 nt, Bordetella pertussis
cggcgccuuggccu

SEQ ID NO: 351294 - RNA, 16 nt, Bordetella pertussis
cggcgccuuggccugg

SEQ ID NO: 351295 - RNA, 15 nt, Bordetella pertussis
cggcgcgaacaccgg

SEQ ID NO: 351296 - RNA, 17 nt, Bordetella pertussis
cggcgcgaacggcagcu

SEQ ID NO: 351297 - RNA, 23 nt, Bordetella pertussis
cggcgcgaacggcuugauggcga

SEQ ID NO: 351298 - RNA, 15 nt, Bordetella pertussis
cggcgcgacaggcgg

SEQ ID NO: 351299 - RNA, 16 nt, Bordetella pertussis
cggcgcgacaggcggu

SEQ ID NO: 351300 - RNA, 18 nt, Bordetella pertussis
cggcgcgcagcagacgcu

SEQ ID NO: 351301 - RNA, 17 nt, Bordetella pertussis
cggcgcgcagcgccugc

SEQ ID NO: 351302 - RNA, 23 nt, Bordetella pertussis
cggcgcgcauccgguggugcugg

SEQ ID NO: 351303 - RNA, 14 nt, Bordetella pertussis
cggcgcgccacccu

SEQ ID NO: 351304 - RNA, 15 nt, Bordetella pertussis
cggcgcgccagcgcg

SEQ ID NO: 351305 - RNA, 17 nt, Bordetella pertussis
cggcgcgccagcgcggc

SEQ ID NO: 351306 - RNA, 19 nt, Bordetella pertussis
cggcgcgccagcgcggcca

SEQ ID NO: 351307 - RNA, 21 nt, Bordetella pertussis
cggcgcgccagcgcggccagc

SEQ ID NO: 351308 - RNA, 17 nt, Bordetella pertussis
cggcgcgcccaccaggg

SEQ ID NO: 351309 - RNA, 13 nt, Bordetella pertussis
cggcgcgcccagc

SEQ ID NO: 351310 - RNA, 17 nt, Bordetella pertussis
cggcgcgcgcaggcgcu

SEQ ID NO: 351311 - RNA, 17 nt, Bordetella pertussis
cggcgcgcgccggcucg

SEQ ID NO: 351312 - RNA, 14 nt, Bordetella pertussis
cggcgcgcgccugc

SEQ ID NO: 351313 - RNA, 11 nt, Bordetella pertussis
cggcgcgcgcg

SEQ ID NO: 351314 - RNA, 15 nt, Bordetella pertussis
cggcgcgcgcgacca

SEQ ID NO: 351315 - RNA, 19 nt, Bordetella pertussis
cggcgcgcgccaggcccag

SEQ ID NO: 351316 - RNA, 13 nt, Bordetella pertussis
cggcgcgcgcgcg

SEQ ID NO: 351317 - RNA, 16 nt, Bordetella pertussis
cggcgcgcgcgcgccg

SEQ ID NO: 351318 - RNA, 23 nt, Bordetella pertussis
cggcgcgcgcguugaucaucggc

SEQ ID NO: 351319 - RNA, 13 nt, Bordetella pertussis
cggcgcgcggccg

SEQ ID NO: 351320 - RNA, 16 nt, Bordetella pertussis
cggcgcgcggccgugu

SEQ ID NO: 351321 - RNA, 17 nt, Bordetella pertussis
cggcgcgcucggcgccg

SEQ ID NO: 351322 - RNA, 16 nt, Bordetella pertussis
cggcgcgcucuccgaa

SEQ ID NO: 351323 - RNA, 15 nt, Bordetella pertussis
cggcgcgcuggacgu

SEQ ID NO: 351324 - RNA, 23 nt, Bordetella pertussis
cggcgcgcuuggucagcaucagc

SEQ ID NO: 351325 - RNA, 13 nt, Bordetella pertussis
cggcgcggaucga

SEQ ID NO: 351326 - RNA, 23 nt, Bordetella pertussis
cggcgcggcagccuggggcgagg

SEQ ID NO: 351327 - RNA, 18 nt, Bordetella pertussis
cggcgcggcgggcgcugg

SEQ ID NO: 351328 - RNA, 14 nt, Bordetella pertussis
cggcgcggcugccc

SEQ ID NO: 351329 - RNA, 21 nt, Bordetella pertussis
cggcgcggcugcugggcaugg

SEQ ID NO: 351330 - RNA, 13 nt, Bordetella pertussis
cggcgcgggcacu

SEQ ID NO: 351331 - RNA, 23 nt, Bordetella pertussis
cggcgcgggcacucggccauggu

SEQ ID NO: 351332 - RNA, 17 nt, Bordetella pertussis
cggcgcgggcgcaggcg

SEQ ID NO: 351333 - RNA, 13 nt, Bordetella pertussis
cggcgcgggcggu

SEQ ID NO: 351334 - RNA, 21 nt, Bordetella pertussis
cggcgcguucucagccgcccg

SEQ ID NO: 351335 - RNA, 22 nt, Bordetella pertussis
cggcgcguucucagccgcccgc

SEQ ID NO: 351336 - RNA, 22 nt, Bordetella pertussis
cggcgcuacagggugccgcgcc

SEQ ID NO: 351337 - RNA, 23 nt, Bordetella pertussis
cggcgcuacagggugccgcgccg

SEQ ID NO: 351338 - RNA, 24 nt, Bordetella pertussis
cggcgcuacagggugccgcgccgg

SEQ ID NO: 351339 - RNA, 23 nt, Bordetella pertussis
cggcgcucagcgacgcgcgccgg

SEQ ID NO: 351340 - RNA, 14 nt, Bordetella pertussis
cggcgcucagcgcg

SEQ ID NO: 351341 - RNA, 15 nt, Bordetella pertussis
cggcgcucagcgcgc

SEQ ID NO: 351342 - RNA, 16 nt, Bordetella pertussis
cggcgcucagcgcgcc

SEQ ID NO: 351343 - RNA, 17 nt, Bordetella pertussis
cggcgcucagcgcgccg

SEQ ID NO: 351344 - RNA, 19 nt, Bordetella pertussis
cggcgcucagcgcgccgag

SEQ ID NO: 351345 - RNA, 22 nt, Bordetella pertussis
cggcgcucaggaaccagcggcu

SEQ ID NO: 351346 - RNA, 17 nt, Bordetella pertussis
cggcgcucaucaucgcg

SEQ ID NO: 351347 - RNA, 14 nt, Bordetella pertussis
cggcgcucgccccg

SEQ ID NO: 351348 - RNA, 16 nt, Bordetella pertussis
cggcgcucgcgcaccg

SEQ ID NO: 351349 - RNA, 21 nt, Bordetella pertussis
cggcgcucuugguggugccug

SEQ ID NO: 351350 - RNA, 18 nt, Bordetella pertussis
cggcgcugcggucgcgau

SEQ ID NO: 351351 - RNA, 19 nt, Bordetella pertussis
cggcgcugcuggccggcca

SEQ ID NO: 351352 - RNA, 22 nt, Bordetella pertussis
cggcgcugcugucgcgcgacug

SEQ ID NO: 351353 - RNA, 16 nt, Bordetella pertussis
cggcgcuggccaucac

SEQ ID NO: 351354 - RNA, 20 nt, Bordetella pertussis
cggcgcuggccaucaccgcc

SEQ ID NO: 351355 - RNA, 14 nt, Bordetella pertussis
cggcgcuggccugg

SEQ ID NO: 351356 - RNA, 17 nt, Bordetella pertussis
cggcgcuggccuggccg

SEQ ID NO: 351357 - RNA, 20 nt, Bordetella pertussis
cggcgcuggccuggccgccg

SEQ ID NO: 351358 - RNA, 23 nt, Bordetella pertussis
cggcgcuggcgagcauggcaucg

SEQ ID NO: 351359 - RNA, 14 nt, Bordetella pertussis
cggcgcuggcgccg

SEQ ID NO: 351360 - RNA, 14 nt, Bordetella pertussis
cggcgcuggcgcgc

SEQ ID NO: 351361 - RNA, 18 nt, Bordetella pertussis
cggcgcuggcuggacgcg

SEQ ID NO: 351362 - RNA, 22 nt, Bordetella pertussis
cggcgcuggcuggacgcgcgcg

SEQ ID NO: 351363 - RNA, 14 nt, Bordetella pertussis
cggcgcuggcuucg

SEQ ID NO: 351364 - RNA, 13 nt, Bordetella pertussis
cggcgcugggcgc

SEQ ID NO: 351365 - RNA, 14 nt, Bordetella pertussis
cggcgcugggcgca

SEQ ID NO: 351366 - RNA, 15 nt, Bordetella pertussis
cggcgcugggcgcau

SEQ ID NO: 351367 - RNA, 19 nt, Bordetella pertussis
cggcgcugggcgcauuggc

SEQ ID NO: 351368 - RNA, 14 nt, Bordetella pertussis
cggcggacugcgcc

SEQ ID NO: 351369 - RNA, 15 nt, Bordetella pertussis
cggcggacugcgccg

SEQ ID NO: 351370 - RNA, 17 nt, Bordetella pertussis
cggcggacugcgccgca

SEQ ID NO: 351371 - RNA, 15 nt, Bordetella pertussis
cggcggacuggccgc

SEQ ID NO: 351372 - RNA, 19 nt, Bordetella pertussis
cggcggacuggccgcgccg

SEQ ID NO: 351373 - RNA, 21 nt, Bordetella pertussis
cggcggacuggccgcgccgcu

SEQ ID NO: 351374 - RNA, 20 nt, Bordetella pertussis
cggcggaucacccagcggcu

SEQ ID NO: 351375 - RNA, 22 nt, Bordetella pertussis
cggcggaucacccagcggcugg

SEQ ID NO: 351376 - RNA, 16 nt, Bordetella pertussis
cggcggaucggcgugg

SEQ ID NO: 351377 - RNA, 17 nt, Bordetella pertussis
cggcggauucaggcgau

SEQ ID NO: 351378 - RNA, 18 nt, Bordetella pertussis
cggcggcauacauccucg

SEQ ID NO: 351379 - RNA, 21 nt, Bordetella pertussis
cggcggcaucguucaggcgca

SEQ ID NO: 351380 - RNA, 13 nt, Bordetella pertussis
cggcggcaugcgc

SEQ ID NO: 351381 - RNA, 15 nt, Bordetella pertussis
cggcggcaugcgcca

SEQ ID NO: 351382 - RNA, 22 nt, Bordetella pertussis
cggcggcaugcgccagccagcg

SEQ ID NO: 351383 - RNA, 14 nt, Bordetella pertussis
cggcggcaugcugg

SEQ ID NO: 351384 - RNA, 18 nt, Bordetella pertussis
cggcggccacgaccggcu

SEQ ID NO: 351385 - RNA, 20 nt, Bordetella pertussis
cggcggccacgaccggcucg

SEQ ID NO: 351386 - RNA, 17 nt, Bordetella pertussis
cggcggcccacagcgcc

SEQ ID NO: 351387 - RNA, 22 nt, Bordetella pertussis
cggcggccgaagcgcaagccca

SEQ ID NO: 351388 - RNA, 17 nt, Bordetella pertussis
cggcguacaggugcugg

SEQ ID NO: 351389 - RNA, 14 nt, Bordetella pertussis
cggcguaccaggca

SEQ ID NO: 351390 - RNA, 20 nt, Bordetella pertussis
cggcguaccaggcagccggc

SEQ ID NO: 351391 - RNA, 15 nt, Bordetella pertussis
cggcguacugcugca

SEQ ID NO: 351392 - RNA, 20 nt, Bordetella pertussis
cggcguacuggcgcggcggc

SEQ ID NO: 351393 - RNA, 17 nt, Bordetella pertussis
cggcgucacgcggccgg

SEQ ID NO: 351394 - RNA, 18 nt, Bordetella pertussis
cggcgucacgcggccggg

SEQ ID NO: 351395 - RNA, 15 nt, Bordetella pertussis
cggcgucaggccguc

SEQ ID NO: 351396 - RNA, 14 nt, Bordetella pertussis
cggcgucagcgccc

SEQ ID NO: 351397 - RNA, 15 nt, Bordetella pertussis
cggcguccugccgcg

SEQ ID NO: 351398 - RNA, 17 nt, Bordetella pertussis
cggcguccugccgcgac

SEQ ID NO: 351399 - RNA, 18 nt, Bordetella pertussis
cggcguccugccgcgacc

SEQ ID NO: 351400 - RNA, 17 nt, Bordetella pertussis
cggcgucgaaggccgcc

SEQ ID NO: 351401 - RNA, 19 nt, Bordetella pertussis
cggcgucgaaggccgccgg

SEQ ID NO: 351402 - RNA, 21 nt, Bordetella pertussis
cggcgucgaacagcagcuugg

SEQ ID NO: 351403 - RNA, 12 nt, Bordetella pertussis
cggcgucgaccg

SEQ ID NO: 351404 - RNA, 21 nt, Bordetella pertussis
cggcgucgaccgcgggcgcgc

SEQ ID NO: 351405 - RNA, 14 nt, Bordetella pertussis
cggcgucgccgcgc

SEQ ID NO: 351406 - RNA, 17 nt, Bordetella pertussis
cggcgucgccgcgcacg

SEQ ID NO: 351407 - RNA, 17 nt, Bordetella pertussis
cggcgucgccggccagg

SEQ ID NO: 351408 - RNA, 22 nt, Bordetella pertussis
cggcgucgcguccuucgucggc

SEQ ID NO: 351409 - RNA, 13 nt, Bordetella pertussis
cggcgucggcgcc

SEQ ID NO: 351410 - RNA, 15 nt, Bordetella pertussis
cggcgucggcgcccg

SEQ ID NO: 351411 - RNA, 20 nt, Bordetella pertussis
cggcgucuggagcggccugg

SEQ ID NO: 351412 - RNA, 14 nt, Bordetella pertussis
cggcgucugguaca

SEQ ID NO: 351413 - RNA, 13 nt, Bordetella pertussis
cggcgugaacgcg

SEQ ID NO: 351414 - RNA, 12 nt, Bordetella pertussis
cggcgugcccaa

SEQ ID NO: 351415 - RNA, 14 nt, Bordetella pertussis
cggcgugcccaaug

SEQ ID NO: 351416 - RNA, 12 nt, Bordetella pertussis
cggcgugcccag

SEQ ID NO: 351417 - RNA, 13 nt, Bordetella pertussis
cggcgugcccagg

SEQ ID NO: 351418 - RNA, 21 nt, Bordetella pertussis
cggcgugcccaguuucgcgac

SEQ ID NO: 351419 - RNA, 19 nt, Bordetella pertussis
cggcgugcgcgugcaugug

SEQ ID NO: 351420 - RNA, 13 nt, Bordetella pertussis
cggcgugcgcugg

SEQ ID NO: 351421 - RNA, 13 nt, Bordetella pertussis
cggcgugcugagg

SEQ ID NO: 351422 - RNA, 16 nt, Bordetella pertussis
cggcgugcugcccgcg

SEQ ID NO: 351423 - RNA, 18 nt, Bordetella pertussis
cggcgugcugcccgcgug

SEQ ID NO: 351424 - RNA, 20 nt, Bordetella pertussis
cggcgugcugcgcguggcca

SEQ ID NO: 351425 - RNA, 13 nt, Bordetella pertussis
cggcgugcugcgg

SEQ ID NO: 351426 - RNA, 15 nt, Bordetella pertussis
cggcguguagagcug

SEQ ID NO: 351427 - RNA, 16 nt, Bordetella pertussis
cggcgugugcccagca

SEQ ID NO: 351428 - RNA, 17 nt, Bordetella pertussis
cggcgugugcccagcac

SEQ ID NO: 351429 - RNA, 19 nt, Bordetella pertussis
cggcgugugcccagcacca

SEQ ID NO: 351430 - RNA, 21 nt, Bordetella pertussis
cggcgugugcccagcaccagg

SEQ ID NO: 351431 - RNA, 14 nt, Bordetella pertussis
cggcguguucagcg

SEQ ID NO: 351432 - RNA, 17 nt, Bordetella pertussis
cggcguguucagcgcgc

SEQ ID NO: 351433 - RNA, 20 nt, Bordetella pertussis
cggcguguucagcgcgcgcg

SEQ ID NO: 351434 - RNA, 16 nt, Bordetella pertussis
cggcguuccuggcgcu

SEQ ID NO: 351435 - RNA, 16 nt, Bordetella pertussis
cggcguuccugggcac

SEQ ID NO: 351436 - RNA, 16 nt, Bordetella pertussis
cggcguucugcagcgc

SEQ ID NO: 351437 - RNA, 17 nt, Bordetella pertussis
cggcguucugcagcgcg

SEQ ID NO: 351438 - RNA, 14 nt, Bordetella pertussis
cggcguucuggcgc

SEQ ID NO: 351439 - RNA, 18 nt, Bordetella pertussis
cggcguucuggcgcagca

SEQ ID NO: 351440 - RNA, 17 nt, Bordetella pertussis
cggcguucuucagcgcg

SEQ ID NO: 351441 - RNA, 21 nt, Bordetella pertussis
cggcguugaaauccacuugcg

SEQ ID NO: 351442 - RNA, 20 nt, Bordetella pertussis
cggcguugccgaagcgucgg

SEQ ID NO: 351443 - RNA, 15 nt, Bordetella pertussis
cggcguugcggcagc

SEQ ID NO: 351444 - RNA, 18 nt, Bordetella pertussis
cggcguugcggcagcggc

SEQ ID NO: 351445 - RNA, 16 nt, Bordetella pertussis
cggcguugcggcgcca

SEQ ID NO: 351446 - RNA, 13 nt, Bordetella pertussis
cggcguuggccgg

SEQ ID NO: 351447 - RNA, 17 nt, Bordetella pertussis
cggcguugugccggcgc

SEQ ID NO: 351448 - RNA, 21 nt, Bordetella pertussis
cggcguugucauuuccagaac

SEQ ID NO: 351449 - RNA, 21 nt, Bordetella pertussis
cggcuacagcucgccggcgau

SEQ ID NO: 351450 - RNA, 16 nt, Bordetella pertussis
cggcuaccacgugguc

SEQ ID NO: 351451 - RNA, 19 nt, Bordetella pertussis
cggcuaccacguggucugg

SEQ ID NO: 351452 - RNA, 16 nt, Bordetella pertussis
cggcuaggcgcagcag

SEQ ID NO: 351453 - RNA, 13 nt, Bordetella pertussis
cggcuauccgcgg

SEQ ID NO: 351454 - RNA, 18 nt, Bordetella pertussis
cggcuauccgcggguucg

SEQ ID NO: 351455 - RNA, 22 nt, Bordetella pertussis
cggcuauccgcggguucggcgg

SEQ ID NO: 351456 - RNA, 15 nt, Bordetella pertussis
cggcuauaccgggcu

SEQ ID NO: 351457 - RNA, 18 nt, Bordetella pertussis
cggcuauaccgggcuggu

SEQ ID NO: 351458 - RNA, 23 nt, Bordetella pertussis
cggcucagccccccguaggcggc

SEQ ID NO: 351459 - RNA, 18 nt, Bordetella pertussis
cggcucauucggcgcgcu

SEQ ID NO: 351460 - RNA, 20 nt, Bordetella pertussis
cggcucauucggcgcgcucg

SEQ ID NO: 351461 - RNA, 21 nt, Bordetella pertussis
cggcucagccucgagguggcg

SEQ ID NO: 351462 - RNA, 22 nt, Bordetella pertussis
cggcuccagcucagcagcgcca

SEQ ID NO: 351463 - RNA, 13 nt, Bordetella pertussis
cggcuccaggccg

SEQ ID NO: 351464 - RNA, 14 nt, Bordetella pertussis
cggcuccaggccgc

SEQ ID NO: 351465 - RNA, 19 nt, Bordetella pertussis
cggcuccccuggucagggc

SEQ ID NO: 351466 - RNA, 17 nt, Bordetella pertussis
cggcuccgccauugcgc

SEQ ID NO: 351467 - RNA, 20 nt, Bordetella pertussis
cggcuccgauagcggcgccg

SEQ ID NO: 351468 - RNA, 17 nt, Bordetella pertussis
cggcuccugcuggcgcg

SEQ ID NO: 351469 - RNA, 21 nt, Bordetella pertussis
cggcuccugcuggcgcgucgg

SEQ ID NO: 351470 - RNA, 13 nt, Bordetella pertussis
cggcucgagcggc

SEQ ID NO: 351471 - RNA, 18 nt, Bordetella pertussis
cggcucgagcggcagcag

SEQ ID NO: 351472 - RNA, 23 nt, Bordetella pertussis
cggcucgagcggcagcagcgaga

SEQ ID NO: 351473 - RNA, 14 nt, Bordetella pertussis
cggcucgagcuccu

SEQ ID NO: 351474 - RNA, 17 nt, Bordetella pertussis
cggcucgacgccguacu

SEQ ID NO: 351475 - RNA, 18 nt, Bordetella pertussis
cggcucgccgcuccggca

SEQ ID NO: 351476 - RNA, 17 nt, Bordetella pertussis
cggcucgccggccgcgc

SEQ ID NO: 351477 - RNA, 14 nt, Bordetella pertussis
cggcucgccgcgca

SEQ ID NO: 351478 - RNA, 20 nt, Bordetella pertussis
cggcucgccuccccaggcca

SEQ ID NO: 351479 - RNA, 22 nt, Bordetella pertussis
cggcucgccuccccaggccagc

SEQ ID NO: 351480 - RNA, 19 nt, Bordetella pertussis
cggcucgcgcucgcccggc

SEQ ID NO: 351481 - RNA, 15 nt, Bordetella pertussis
cggcucggaccuggc

SEQ ID NO: 351482 - RNA, 13 nt, Bordetella pertussis
cggcucggcggca

SEQ ID NO: 351483 - RNA, 16 nt, Bordetella pertussis
cggcucggcggcaucg

SEQ ID NO: 351484 - RNA, 15 nt, Bordetella pertussis
cggcucgucgaacag

SEQ ID NO: 351485 - RNA, 16 nt, Bordetella pertussis
cggcucgucgaacagc

SEQ ID NO: 351486 - RNA, 19 nt, Bordetella pertussis
cggcucgucgaacagcauc

SEQ ID NO: 351487 - RNA, 22 nt, Bordetella pertussis
cggcucgucgaacagcaucagc

SEQ ID NO: 351488 - RNA, 22 nt, Bordetella pertussis
cggcugcccucggucagcgcca

SEQ ID NO: 351489 - RNA, 23 nt, Bordetella pertussis
cggcugccgcggauugccguccu

SEQ ID NO: 351490 - RNA, 21 nt, Bordetella pertussis
cggcugccguuuucgaucagg

SEQ ID NO: 351491 - RNA, 13 nt, Bordetella pertussis
cggcugcgcgccg

SEQ ID NO: 351492 - RNA, 17 nt, Bordetella pertussis
cggcugcgcgcgcagcc

SEQ ID NO: 351493 - RNA, 17 nt, Bordetella pertussis
cggcugcuugagcagcc

SEQ ID NO: 351494 - RNA, 18 nt, Bordetella pertussis
cggcuggagauacuggcc

SEQ ID NO: 351495 - RNA, 20 nt, Bordetella pertussis
cggcuggagauacuggccga

SEQ ID NO: 351496 - RNA, 21 nt, Bordetella pertussis
cggcuggaugaaaucgaggaa

SEQ ID NO: 351497 - RNA, 18 nt, Bordetella pertussis
cggcuggauggugccgcc

SEQ ID NO: 351498 - RNA, 23 nt, Bordetella pertussis
cggcuggauggugccgccgcccg

SEQ ID NO: 351499 - RNA, 21 nt, Bordetella pertussis
cggcuggccacuggccgcgcu

SEQ ID NO: 351500 - RNA, 14 nt, Bordetella pertussis
cggcuggccgauca

SEQ ID NO: 351501 - RNA, 22 nt, Bordetella pertussis
cggcuggugccgacggcgcggg

SEQ ID NO: 351502 - RNA, 21 nt, Bordetella pertussis
cggcugguggugccgcgcacg

SEQ ID NO: 351503 - RNA, 16 nt, Bordetella pertussis
cggcuguagucgccgc

SEQ ID NO: 351504 - RNA, 14 nt, Bordetella pertussis
cggcuuccagcagc

SEQ ID NO: 351505 - RNA, 19 nt, Bordetella pertussis
cggcuuccagcagcaugcc

SEQ ID NO: 351506 - RNA, 19 nt, Bordetella pertussis
cggcuucgaccacgcggcg

SEQ ID NO: 351507 - RNA, 17 nt, Bordetella pertussis
cggcuucgagcgcgacg

SEQ ID NO: 351508 - RNA, 18 nt, Bordetella pertussis
cggcuucgagcgcgacga

SEQ ID NO: 351509 - RNA, 15 nt, Bordetella pertussis
cggcuucgcccagcg

SEQ ID NO: 351510 - RNA, 16 nt, Bordetella pertussis
cggcuucgcccagcgc

SEQ ID NO: 351511 - RNA, 15 nt, Bordetella pertussis
cggcuucguucaagc

SEQ ID NO: 351512 - RNA, 17 nt, Bordetella pertussis
cggcuugaccacggcca

SEQ ID NO: 351513 - RNA, 19 nt, Bordetella pertussis
cggcuugaccacggccagc

SEQ ID NO: 351514 - RNA, 19 nt, Bordetella pertussis
cggcuugauaugggcgagc

SEQ ID NO: 351515 - RNA, 23 nt, Bordetella pertussis
cggcuugauggcgauguccagcg

SEQ ID NO: 351516 - RNA, 20 nt, Bordetella pertussis
cggcuugcagcggacggcgc

SEQ ID NO: 351517 - RNA, 21 nt, Bordetella pertussis
cggcuugcagcggacggcgcg

SEQ ID NO: 351518 - RNA, 21 nt, Bordetella pertussis
cgggacaggcacccgaugguc

SEQ ID NO: 351519 - RNA, 16 nt, Bordetella pertussis
cgggacaggcaccuuu

SEQ ID NO: 351520 - RNA, 16 nt, Bordetella pertussis
cgggacaggcgccaca

SEQ ID NO: 351521 - RNA, 17 nt, Bordetella pertussis
cgggaccgaacaccacc

SEQ ID NO: 351522 - RNA, 13 nt, Bordetella pertussis
cgggaccggcgcg

SEQ ID NO: 351523 - RNA, 20 nt, Bordetella pertussis
cgggagccuguccccgccgg

SEQ ID NO: 351524 - RNA, 21 nt, Bordetella pertussis
cgggagccuguccccgccggg

SEQ ID NO: 351525 - RNA, 15 nt, Bordetella pertussis
cgggauccggcagca

SEQ ID NO: 351526 - RNA, 15 nt, Bordetella pertussis
cgggauccgugcggc

SEQ ID NO: 351527 - RNA, 22 nt, Bordetella pertussis
cgggauccgugcggcgcgcacg

SEQ ID NO: 351528 - RNA, 22 nt, Bordetella pertussis
cgggaucgggcagcuuggcgcg

SEQ ID NO: 351529 - RNA, 22 nt, Bordetella pertussis
cgggaucguggcgccgcgggcc

SEQ ID NO: 351530 - RNA, 21 nt, Bordetella pertussis
cgggaucugcaugccgaccac

SEQ ID NO: 351531 - RNA, 15 nt, Bordetella pertussis
cgggaucugcgagcc

SEQ ID NO: 351532 - RNA, 17 nt, Bordetella pertussis
cgggaugccccgcccgc

SEQ ID NO: 351533 - RNA, 15 nt, Bordetella pertussis
cgggcaaacggcggc

SEQ ID NO: 351534 - RNA, 22 nt, Bordetella pertussis
cgggcaaacggcggcaggccgc

SEQ ID NO: 351535 - RNA, 15 nt, Bordetella pertussis
cgggcaacaaggcca

SEQ ID NO: 351536 - RNA, 14 nt, Bordetella pertussis
cgggcaccagcacu

SEQ ID NO: 351537 - RNA, 20 nt, Bordetella pertussis
cgggcaccaugcgcgagggc

SEQ ID NO: 351538 - RNA, 18 nt, Bordetella pertussis
cgggcaccgacacgcugg

SEQ ID NO: 351539 - RNA, 14 nt, Bordetella pertussis
cgggcacgauggcc

SEQ ID NO: 351540 - RNA, 18 nt, Bordetella pertussis
cgggcacgauggccgcgc

SEQ ID NO: 351541 - RNA, 12 nt, Bordetella pertussis
cgggcacggcca

SEQ ID NO: 351542 - RNA, 18 nt, Bordetella pertussis
cgggcacggccagcacca

SEQ ID NO: 351543 - RNA, 15 nt, Bordetella pertussis
cgggcagcuuggcgc

SEQ ID NO: 351544 - RNA, 21 nt, Bordetella pertussis
cgggcagcuuggcgcgccgga

SEQ ID NO: 351545 - RNA, 13 nt, Bordetella pertussis
cgggcaggcccag

SEQ ID NO: 351546 - RNA, 17 nt, Bordetella pertussis
cgggcaggcccagccag

SEQ ID NO: 351547 - RNA, 12 nt, Bordetella pertussis
cgggcaggccgc

SEQ ID NO: 351548 - RNA, 17 nt, Bordetella pertussis
cgggcaggccgcgcugg

SEQ ID NO: 351549 - RNA, 16 nt, Bordetella pertussis
cgggcaggcucagccc

SEQ ID NO: 351550 - RNA, 20 nt, Bordetella pertussis
cgggcaggcucagcccggcg

SEQ ID NO: 351551 - RNA, 19 nt, Bordetella pertussis
cgggcagggcgggggacgc

SEQ ID NO: 351552 - RNA, 14 nt, Bordetella pertussis
cgggcagggcuucc

SEQ ID NO: 351553 - RNA, 12 nt, Bordetella pertussis
cgggcaggucgg

SEQ ID NO: 351554 - RNA, 16 nt, Bordetella pertussis
cgggcaggucggcgcg

SEQ ID NO: 351555 - RNA, 19 nt, Bordetella pertussis
cgggcaugcgaaagccggc

SEQ ID NO: 351556 - RNA, 18 nt, Bordetella pertussis
cgggcauggcccggcucg

SEQ ID NO: 351557 - RNA, 21 nt, Bordetella pertussis
cgggcauggcccggcucgccg

SEQ ID NO: 351558 - RNA, 17 nt, Bordetella pertussis
cgggcauugccggagca

SEQ ID NO: 351559 - RNA, 21 nt, Bordetella pertussis
cgggcauugccggagcagcag

SEQ ID NO: 351560 - RNA, 22 nt, Bordetella pertussis
cgggcauugccggagcagcagc

SEQ ID NO: 351561 - RNA, 21 nt, Bordetella pertussis
cgggcauugggcagcggacgg

SEQ ID NO: 351562 - RNA, 13 nt, Bordetella pertussis
cgggccacgccgg

SEQ ID NO: 351563 - RNA, 15 nt, Bordetella pertussis
cgggccacgccggcc

SEQ ID NO: 351564 - RNA, 16 nt, Bordetella pertussis
cgggccacgccggccg

SEQ ID NO: 351565 - RNA, 20 nt, Bordetella pertussis
cgggccacgccggccggggu

SEQ ID NO: 351566 - RNA, 14 nt, Bordetella pertussis
cgggccacugcgcc

SEQ ID NO: 351567 - RNA, 19 nt, Bordetella pertussis
cgggccacugcgccugggc

SEQ ID NO: 351568 - RNA, 16 nt, Bordetella pertussis
cgggccagaccuggug

SEQ ID NO: 351569 - RNA, 20 nt, Bordetella pertussis
cgggcccgcaucgcgcgccg

SEQ ID NO: 351570 - RNA, 12 nt, Bordetella pertussis
cgggcccgcgcc

SEQ ID NO: 351571 - RNA, 13 nt, Bordetella pertussis
cgggcccgcgccg

SEQ ID NO: 351572 - RNA, 14 nt, Bordetella pertussis
cgggcccgcucggc

SEQ ID NO: 351573 - RNA, 16 nt, Bordetella pertussis
cgggcccgcucggcca

SEQ ID NO: 351574 - RNA, 19 nt, Bordetella pertussis
cgggcccgcucggccagca

SEQ ID NO: 351575 - RNA, 17 nt, Bordetella pertussis
cgggcccggccacggcc

SEQ ID NO: 351576 - RNA, 16 nt, Bordetella pertussis
cgggcccgucgcgcca

SEQ ID NO: 351577 - RNA, 18 nt, Bordetella pertussis
cgggcccgucgcgccagg

SEQ ID NO: 351578 - RNA, 21 nt, Bordetella pertussis
cgggcccgucgcgccaggccg

SEQ ID NO: 351579 - RNA, 15 nt, Bordetella pertussis
cgggccgcagcaugg

SEQ ID NO: 351580 - RNA, 16 nt, Bordetella pertussis
cgggccgcgaccacgg

SEQ ID NO: 351581 - RNA, 13 nt, Bordetella pertussis
cgggccgcgccca

SEQ ID NO: 351582 - RNA, 14 nt, Bordetella pertussis
cgggccgcgcccac

SEQ ID NO: 351583 - RNA, 20 nt, Bordetella pertussis
cgggccgcgccccuagcgcc

SEQ ID NO: 351584 - RNA, 13 nt, Bordetella pertussis
cgggccgcgccgc

SEQ ID NO: 351585 - RNA, 16 nt, Bordetella pertussis
cgggccgcuggcccgg

SEQ ID NO: 351586 - RNA, 17 nt, Bordetella pertussis
cgggccgcuggcccggg

SEQ ID NO: 351587 - RNA, 14 nt, Bordetella pertussis
cgggccggcaccac

SEQ ID NO: 351588 - RNA, 18 nt, Bordetella pertussis
cgggccggcaccacgacc

SEQ ID NO: 351589 - RNA, 15 nt, Bordetella pertussis
cgggccggccgccgg

SEQ ID NO: 351590 - RNA, 14 nt, Bordetella pertussis
cgggccggccugcg

SEQ ID NO: 351591 - RNA, 15 nt, Bordetella pertussis
cgggccggcgccggu

SEQ ID NO: 351592 - RNA, 16 nt, Bordetella pertussis
cgggccggcgcgccug

SEQ ID NO: 351593 - RNA, 20 nt, Bordetella pertussis
cgggccggcuacagcucgcc

SEQ ID NO: 351594 - RNA, 14 nt, Bordetella pertussis
cgggccggcugccg

SEQ ID NO: 351595 - RNA, 14 nt, Bordetella pertussis
cgggccggcugggc

SEQ ID NO: 351596 - RNA, 16 nt, Bordetella pertussis
cgggccgggcaggccg

SEQ ID NO: 351597 - RNA, 19 nt, Bordetella pertussis
cgggccgggcaggccgcgc

SEQ ID NO: 351598 - RNA, 20 nt, Bordetella pertussis
cgggccgggcaggccgcgcu

SEQ ID NO: 351599 - RNA, 13 nt, Bordetella pertussis
cgggccggccgcc

SEQ ID NO: 351600 - RNA, 18 nt, Bordetella pertussis
cgggccgguuucggccug

SEQ ID NO: 351601 - RNA, 20 nt, Bordetella pertussis
cgggccgguuucggccugca

SEQ ID NO: 351602 - RNA, 16 nt, Bordetella pertussis
cgggccgucgccgcgc

SEQ ID NO: 351603 - RNA, 18 nt, Bordetella pertussis
cgggccgucgccgcgcgg

SEQ ID NO: 351604 - RNA, 15 nt, Bordetella pertussis
cgggccgucgugcgc

SEQ ID NO: 351605 - RNA, 17 nt, Bordetella pertussis
cgggccgugcgccgggc

SEQ ID NO: 351606 - RNA, 18 nt, Bordetella pertussis
cgggccguggcgauccag

SEQ ID NO: 351607 - RNA, 20 nt, Bordetella pertussis
cgggccuacuugccggcgcu

SEQ ID NO: 351608 - RNA, 18 nt, Bordetella pertussis
cgggccuagcccggcgcc

SEQ ID NO: 351609 - RNA, 19 nt, Bordetella pertussis
cgggccuagcccggcgcca

SEQ ID NO: 351610 - RNA, 20 nt, Bordetella pertussis
cgggccuagcccggcgccac

SEQ ID NO: 351611 - RNA, 16 nt, Bordetella pertussis
cgggccucgacgggga

SEQ ID NO: 351612 - RNA, 13 nt, Bordetella pertussis
cgggccugcagca

SEQ ID NO: 351613 - RNA, 21 nt, Bordetella pertussis
cgggccugcaguucggccgcc

SEQ ID NO: 351614 - RNA, 14 nt, Bordetella pertussis
cgggccugccgcgc

SEQ ID NO: 351615 - RNA, 18 nt, Bordetella pertussis
cgggcgacaggcgcgccc

SEQ ID NO: 351616 - RNA, 17 nt, Bordetella pertussis
cgggcgacuccagcccg

SEQ ID NO: 351617 - RNA, 18 nt, Bordetella pertussis
cgggcgacuccagcccga

SEQ ID NO: 351618 - RNA, 20 nt, Bordetella pertussis
cgggcgagaucagccaccgg

SEQ ID NO: 351619 - RNA, 12 nt, Bordetella pertussis
cgggcgagaugg

SEQ ID NO: 351620 - RNA, 21 nt, Bordetella pertussis
cgggcgauuugccgcagcccg

SEQ ID NO: 351621 - RNA, 16 nt, Bordetella pertussis
cgggcgcaagccagca

SEQ ID NO: 351622 - RNA, 17 nt, Bordetella pertussis
cgggcgcaagccagcac

SEQ ID NO: 351623 - RNA, 14 nt, Bordetella pertussis
cgggcgcaagcgcg

SEQ ID NO: 351624 - RNA, 17 nt, Bordetella pertussis
cgggcgcaagcgcgccg

SEQ ID NO: 351625 - RNA, 21 nt, Bordetella pertussis
cgggcgcacaguugcaggcca

SEQ ID NO: 351626 - RNA, 22 nt, Bordetella pertussis
cgggcgcacaguugcaggccau

SEQ ID NO: 351627 - RNA, 14 nt, Bordetella pertussis
cgggcgcagcgccg

SEQ ID NO: 351628 - RNA, 18 nt, Bordetella pertussis
cgggcgcauugccgccaa

SEQ ID NO: 351629 - RNA, 12 nt, Bordetella pertussis
cgggcgccagca

SEQ ID NO: 351630 - RNA, 16 nt, Bordetella pertussis
cgggcgccagcagcgg

SEQ ID NO: 351631 - RNA, 21 nt, Bordetella pertussis
cgggcgccagcagcgggcugg

SEQ ID NO: 351632 - RNA, 13 nt, Bordetella pertussis
cgggcgcccagcg

SEQ ID NO: 351633 - RNA, 21 nt, Bordetella pertussis
cgggcgccccgaucggcgccg

SEQ ID NO: 351634 - RNA, 18 nt, Bordetella pertussis
cgggcgcccgcgcgcgag

SEQ ID NO: 351635 - RNA, 16 nt, Bordetella pertussis
cgggcgcccggccggc

SEQ ID NO: 351636 - RNA, 19 nt, Bordetella pertussis
cgggcgcccggccggccuu

SEQ ID NO: 351637 - RNA, 17 nt, Bordetella pertussis
cgggcgccgcaacgccg

SEQ ID NO: 351638 - RNA, 13 nt, Bordetella pertussis
cgggcgccgcgcc

SEQ ID NO: 351639 - RNA, 18 nt, Bordetella pertussis
cgggcgccggcgcccggc

SEQ ID NO: 351640 - RNA, 20 nt, Bordetella pertussis
cgggcgccggcgucacgcgg

SEQ ID NO: 351641 - RNA, 18 nt, Bordetella pertussis
cgggcgccucguccugca

SEQ ID NO: 351642 - RNA, 13 nt, Bordetella pertussis
cgggcgccugccg

SEQ ID NO: 351643 - RNA, 19 nt, Bordetella pertussis
cgggcgccugccgcauccc

SEQ ID NO: 351644 - RNA, 12 nt, Bordetella pertussis
cgggcgccugcg

SEQ ID NO: 351645 - RNA, 14 nt, Bordetella pertussis
cgggcgccugcgcc

SEQ ID NO: 351646 - RNA, 15 nt, Bordetella pertussis
cgggcgccugcgcca

SEQ ID NO: 351647 - RNA, 21 nt, Bordetella pertussis
cgggcgccugcggcaggccgc

SEQ ID NO: 351648 - RNA, 22 nt, Bordetella pertussis
cgggcgccugcggcaggccgca

SEQ ID NO: 351649 - RNA, 13 nt, Bordetella pertussis
cgggcgcuugccg

SEQ ID NO: 351650 - RNA, 12 nt, Bordetella pertussis
cgggcggcguug

SEQ ID NO: 351651 - RNA, 22 nt, Bordetella pertussis
cgggcggcugcccgggcugcug

SEQ ID NO: 351652 - RNA, 14 nt, Bordetella pertussis
cgggcggcugcugg

SEQ ID NO: 351653 - RNA, 15 nt, Bordetella pertussis
cgggcggcugcuggc

SEQ ID NO: 351654 - RNA, 22 nt, Bordetella pertussis
cgggcgggaaguggaaccgcgg

SEQ ID NO: 351655 - RNA, 21 nt, Bordetella pertussis
cgggcggggugaucugcgcca

SEQ ID NO: 351656 - RNA, 19 nt, Bordetella pertussis
cgggcgggucggcgaacag

SEQ ID NO: 351657 - RNA, 16 nt, Bordetella pertussis
cgggcggguucguggc

SEQ ID NO: 351658 - RNA, 17 nt, Bordetella pertussis
cgggcgguacaggucga

SEQ ID NO: 351659 - RNA, 15 nt, Bordetella pertussis
cgggcggucggcgcg

SEQ ID NO: 351660 - RNA, 19 nt, Bordetella pertussis
cgggcggugcggccucggc

SEQ ID NO: 351661 - RNA, 15 nt, Bordetella pertussis
cgggcgucaccggcg

SEQ ID NO: 351662 - RNA, 14 nt, Bordetella pertussis
cgggcgugcuggca

SEQ ID NO: 351663 - RNA, 15 nt, Bordetella pertussis
cgggcguggcgcagg

SEQ ID NO: 351664 - RNA, 19 nt, Bordetella pertussis
cgggcguuugcccuucgcg

SEQ ID NO: 351665 - RNA, 22 nt, Bordetella pertussis
cgggcguuugcccuucgcggcu

SEQ ID NO: 351666 - RNA, 20 nt, Bordetella pertussis
cgggcguuuuugcguccggc

SEQ ID NO: 351667 - RNA, 14 nt, Bordetella pertussis
cgggcucgcgcgcg

SEQ ID NO: 351668 - RNA, 17 nt, Bordetella pertussis
cgggcucggccaccaug

SEQ ID NO: 351669 - RNA, 14 nt, Bordetella pertussis
cgggcucggcgccg

SEQ ID NO: 351670 - RNA, 22 nt, Bordetella pertussis
cgggcucgggaaugaugcagcu

SEQ ID NO: 351671 - RNA, 24 nt, Bordetella pertussis
cggggucaauccgcccguugcggc

SEQ ID NO: 351672 - RNA, 17 nt, Bordetella pertussis
cggggucagcgccggca

SEQ ID NO: 351673 - RNA, 16 nt, Bordetella pertussis
cgggguccugaggcca

SEQ ID NO: 351674 - RNA, 21 nt, Bordetella pertussis
cgggguccugaggccaggccg

SEQ ID NO: 351675 - RNA, 15 nt, Bordetella pertussis
cggggucggccacca

SEQ ID NO: 351676 - RNA, 17 nt, Bordetella pertussis
cggggucggccaccacc

SEQ ID NO: 351677 - RNA, 12 nt, Bordetella pertussis
cggggugccugu

SEQ ID NO: 351678 - RNA, 15 nt, Bordetella pertussis
cggggugugccgaug

SEQ ID NO: 351679 - RNA, 20 nt, Bordetella pertussis
aacauuggguacgacggccg

SEQ ID NO: 351680 - RNA, 17 nt, Bordetella pertussis
aaccacgagcugcagcc

SEQ ID NO: 351681 - RNA, 18 nt, Bordetella pertussis
cgggucaaguccggcgcc

SEQ ID NO: 351682 - RNA, 19 nt, Bordetella pertussis
cgggucaaguccggcgccg

SEQ ID NO: 351683 - RNA, 16 nt, Bordetella pertussis
cgggucacccgccgca

SEQ ID NO: 351684 - RNA, 17 nt, Bordetella pertussis
cgggucacccgccgcac

SEQ ID NO: 351685 - RNA, 22 nt, Bordetella pertussis
cgggucagccuugcuccggcgu

SEQ ID NO: 351686 - RNA, 17 nt, Bordetella pertussis
cgggucaggcugcggcg

SEQ ID NO: 351687 - RNA, 19 nt, Bordetella pertussis
cgggucaggcugcggcgga

SEQ ID NO: 351688 - RNA, 13 nt, Bordetella pertussis
cggguccagcccc

SEQ ID NO: 351689 - RNA, 19 nt, Bordetella pertussis
cggguccagccccacgccg

SEQ ID NO: 351690 - RNA, 14 nt, Bordetella pertussis
cggguccaggcccg

SEQ ID NO: 351691 - RNA, 13 nt, Bordetella pertussis
cggguccggccgc

SEQ ID NO: 351692 - RNA, 15 nt, Bordetella pertussis
cgggucgagcgccga

SEQ ID NO: 351693 - RNA, 14 nt, Bordetella pertussis
cgggucgaggucga

SEQ ID NO: 351694 - RNA, 16 nt, Bordetella pertussis
cgggucgaggucgaug

SEQ ID NO: 351695 - RNA, 19 nt, Bordetella pertussis
cgggucgaguugcgcgcca

SEQ ID NO: 351696 - RNA, 19 nt, Bordetella pertussis
cgggucgccgguggugucg

SEQ ID NO: 351697 - RNA, 15 nt, Bordetella pertussis
cgggucgcgcagcag

SEQ ID NO: 351698 - RNA, 18 nt, Bordetella pertussis
cgggucgcgcagcagggc

SEQ ID NO: 351699 - RNA, 22 nt, Bordetella pertussis
cgggucgcgcagcagggccugg

SEQ ID NO: 351700 - RNA, 14 nt, Bordetella pertussis
cgggucgcggcacg

SEQ ID NO: 351701 - RNA, 19 nt, Bordetella pertussis
cgggucgcugugcgcggcg

SEQ ID NO: 351702 - RNA, 17 nt, Bordetella pertussis
cgggucggcgaacagcg

SEQ ID NO: 351703 - RNA, 19 nt, Bordetella pertussis
cgggucggcgaacagcgcg

SEQ ID NO: 351704 - RNA, 23 nt, Bordetella pertussis
cgggucggcgaacagcgcguucg

SEQ ID NO: 351705 - RNA, 15 nt, Bordetella pertussis
cgggucgggcgucug

SEQ ID NO: 351706 - RNA, 17 nt, Bordetella pertussis
cgggucgucccagcgca

SEQ ID NO: 351707 - RNA, 19 nt, Bordetella pertussis
cgggucgucccagcgcacg

SEQ ID NO: 351708 - RNA, 16 nt, Bordetella pertussis
cgggucgucgggcggc

SEQ ID NO: 351709 - RNA, 18 nt, Bordetella pertussis
cgggucuccacgaagucg

SEQ ID NO: 351710 - RNA, 16 nt, Bordetella pertussis
aaccagccgccgccau

SEQ ID NO: 351711 - RNA, 12 nt, Bordetella pertussis
aaccaggccgcc

SEQ ID NO: 351712 - RNA, 16 nt, Bordetella pertussis
aaccaguugcgggccu

SEQ ID NO: 351713 - RNA, 22 nt, Bordetella pertussis
cgggugaccuuggucgggucca

SEQ ID NO: 351714 - RNA, 17 nt, Bordetella pertussis
cgggugaggggccagcc

SEQ ID NO: 351715 - RNA, 19 nt, Bordetella pertussis
cgggugaggggccagccug

SEQ ID NO: 351716 - RNA, 21 nt, Bordetella pertussis
cgggugauauuggcgaacgug

SEQ ID NO: 351717 - RNA, 19 nt, Bordetella pertussis
cgggugaucacggccguca

SEQ ID NO: 351718 - RNA, 17 nt, Bordetella pertussis
cgggugaugcugcagcg

SEQ ID NO: 351719 - RNA, 20 nt, Bordetella pertussis
cgggugauggauuucgaccg

SEQ ID NO: 351720 - RNA, 21 nt, Bordetella pertussis
cgggugcagguccggucgcgc

SEQ ID NO: 351721 - RNA, 21 nt, Bordetella pertussis
cgggugccuguccccacaggg

SEQ ID NO: 351722 - RNA, 22 nt, Bordetella pertussis
cgggugcgcagcacaugggcgc

SEQ ID NO: 351723 - RNA, 17 nt, Bordetella pertussis
cgggugcgccugcagcg

SEQ ID NO: 351724 - RNA, 19 nt, Bordetella pertussis
cgggugcugcagcgcacca

SEQ ID NO: 351725 - RNA, 22 nt, Bordetella pertussis
cggguggauggucuugccgaug

SEQ ID NO: 351726 - RNA, 22 nt, Bordetella pertussis
cggguggccgauuccagcgccg

SEQ ID NO: 351727 - RNA, 23 nt, Bordetella pertussis
cggguggccgauuccagcgccgc

SEQ ID NO: 351728 - RNA, 16 nt, Bordetella pertussis
cgggugggcgcgccgc

SEQ ID NO: 351729 - RNA, 14 nt, Bordetella pertussis
cggguggucgcgcc

SEQ ID NO: 351730 - RNA, 22 nt, Bordetella pertussis
cggguggucgcgcccgccgugg

SEQ ID NO: 351731 - RNA, 21 nt, Bordetella pertussis
cggguguggggggucaggccg

SEQ ID NO: 351732 - RNA, 20 nt, Bordetella pertussis
cggguguuccggcgcgcggu

SEQ ID NO: 351733 - RNA, 17 nt, Bordetella pertussis
cggguguugucaugcga

SEQ ID NO: 351734 - RNA, 13 nt, Bordetella pertussis
cggguucgacgcc

SEQ ID NO: 351735 - RNA, 20 nt, Bordetella pertussis
cggguugcaggaugcgcggc

SEQ ID NO: 351736 - RNA, 14 nt, Bordetella pertussis
cggguugcggcagc

SEQ ID NO: 351737 - RNA, 18 nt, Bordetella pertussis
cggguugcggcagcgccg

SEQ ID NO: 351738 - RNA, 13 nt, Bordetella pertussis
cggguuggcgaug

SEQ ID NO: 351739 - RNA, 19 nt, Bordetella pertussis
cggguuggcguccaggcgc

SEQ ID NO: 351740 - RNA, 19 nt, Bordetella pertussis
cggguugugcccgcccggg

SEQ ID NO: 351741 - RNA, 18 nt, Bordetella pertussis
aacccacccccagcagca

SEQ ID NO: 351742 - RNA, 20 nt, Bordetella pertussis
aacccacggcguggcgcgcc

SEQ ID NO: 351743 - RNA, 15 nt, Bordetella pertussis
cggguuucggcaucu

SEQ ID NO: 351744 - RNA, 21 nt, Bordetella pertussis
cggguuugcccaguacgaugc

SEQ ID NO: 351745 - RNA, 23 nt, Bordetella pertussis
cggguuuuccuuuugcgcggccg

SEQ ID NO: 351746 - RNA, 17 nt, Bordetella pertussis
cgguaaccgacgcagcg

SEQ ID NO: 351747 - RNA, 12 nt, Bordetella pertussis
cgguaaccggcg

SEQ ID NO: 351748 - RNA, 21 nt, Bordetella pertussis
cgguaagcguccgcgcgccgc

SEQ ID NO: 351749 - RNA, 19 nt, Bordetella pertussis
cgguaaggcgcuugcgcag

SEQ ID NO: 351750 - RNA, 19 nt, Bordetella pertussis
cgguaaugacgcagccgcc

SEQ ID NO: 351751 - RNA, 22 nt, Bordetella pertussis
cgguaaugacgcagccgcccgg

SEQ ID NO: 351752 - RNA, 16 nt, Bordetella pertussis
cgguacaccugacgcg

SEQ ID NO: 351753 - RNA, 16 nt, Bordetella pertussis
cgguacagccaggcca

SEQ ID NO: 351754 - RNA, 15 nt, Bordetella pertussis
cgguacaggccggcg

SEQ ID NO: 351755 - RNA, 17 nt, Bordetella pertussis
cgguacaggccggcggc

SEQ ID NO: 351756 - RNA, 21 nt, Bordetella pertussis
cgguacauacgugguggugcg

SEQ ID NO: 351757 - RNA, 20 nt, Bordetella pertussis
cgguacaggcugccgucggc

SEQ ID NO: 351758 - RNA, 15 nt, Bordetella pertussis
cgguacugcggcgcc

SEQ ID NO: 351759 - RNA, 16 nt, Bordetella pertussis
cgguacugcggcgccu

SEQ ID NO: 351760 - RNA, 14 nt, Bordetella pertussis
cgguagcccgcgug

SEQ ID NO: 351761 - RNA, 16 nt, Bordetella pertussis
cgguagccgggucugg

SEQ ID NO: 351762 - RNA, 23 nt, Bordetella pertussis
cgguagccgggucuggccggccg

SEQ ID NO: 351763 - RNA, 17 nt, Bordetella pertussis
cgguagcgccccucgcg

SEQ ID NO: 351764 - RNA, 12 nt, Bordetella pertussis
cgguagcgcugg

SEQ ID NO: 351765 - RNA, 21 nt, Bordetella pertussis
cgguagcgcugggcgccagca

SEQ ID NO: 351766 - RNA, 23 nt, Bordetella pertussis
cgguagcgcucguccaugccggc

SEQ ID NO: 351767 - RNA, 14 nt, Bordetella pertussis
cgguaggcccagca

SEQ ID NO: 351768 - RNA, 15 nt, Bordetella pertussis
cgguaggcgcccgac

SEQ ID NO: 351769 - RNA, 12 nt, Bordetella pertussis
cgguaggcgcgu

SEQ ID NO: 351770 - RNA, 16 nt, Bordetella pertussis
cgguagggcgauggcg

SEQ ID NO: 351771 - RNA, 21 nt, Bordetella pertussis
cgguauccacguagcgcacga

SEQ ID NO: 351772 - RNA, 15 nt, Bordetella pertussis
cgguauccaggucga

SEQ ID NO: 351773 - RNA, 22 nt, Bordetella pertussis
cgguaucccaccugcagccaga

SEQ ID NO: 351774 - RNA, 13 nt, Bordetella pertussis
cgguauccgcgca

SEQ ID NO: 351775 - RNA, 15 nt, Bordetella pertussis
cgguauccuggcgcg

SEQ ID NO: 351776 - RNA, 17 nt, Bordetella pertussis
cgguauccuggcgcgga

SEQ ID NO: 351777 - RNA, 16 nt, Bordetella pertussis
cgguaucgacgcgcgu

SEQ ID NO: 351778 - RNA, 20 nt, Bordetella pertussis
cgguaucgcggcgcaggcgg

SEQ ID NO: 351779 - RNA, 21 nt, Bordetella pertussis
cgguaucgcggcgcaggcggg

SEQ ID NO: 351780 - RNA, 14 nt, Bordetella pertussis
cgguaucgcgucgg

SEQ ID NO: 351781 - RNA, 23 nt, Bordetella pertussis
cgguaucgggcaacaaggccacg

SEQ ID NO: 351782 - RNA, 22 nt, Bordetella pertussis
cgguaugcggcgcccaggccca

SEQ ID NO: 351783 - RNA, 23 nt, Bordetella pertussis
cgguauggcggcaacgugcaggc

SEQ ID NO: 351784 - RNA, 21 nt, Bordetella pertussis
cgguauuccucgacgauggcg

SEQ ID NO: 351785 - RNA, 19 nt, Bordetella pertussis
cgguauucgcgcuggcgcg

SEQ ID NO: 351786 - RNA, 18 nt, Bordetella pertussis
cgguauucggcgaccagg

SEQ ID NO: 351787 - RNA, 17 nt, Bordetella pertussis
cgguauugcacggugcc

SEQ ID NO: 351788 - RNA, 16 nt, Bordetella pertussis
cggucaaugcggcggc

SEQ ID NO: 351789 - RNA, 19 nt, Bordetella pertussis
cggucaccgucccguagcg

SEQ ID NO: 351790 - RNA, 17 nt, Bordetella pertussis
cggucacgccgaugacc

SEQ ID NO: 351791 - RNA, 18 nt, Bordetella pertussis
cggucacguucagcgccg

SEQ ID NO: 351792 - RNA, 23 nt, Bordetella pertussis
cggucacugccgaaacgcuggcg

SEQ ID NO: 351793 - RNA, 17 nt, Bordetella pertussis
cggucagcaaccccagc

SEQ ID NO: 351794 - RNA, 18 nt, Bordetella pertussis
cggucagcaaccccagca

SEQ ID NO: 351795 - RNA, 19 nt, Bordetella pertussis
cggucagcaaccccagcag

SEQ ID NO: 351796 - RNA, 22 nt, Bordetella pertussis
cggucagcaaccccagcagcgc

SEQ ID NO: 351797 - RNA, 17 nt, Bordetella pertussis
cggucagcagggcgccg

SEQ ID NO: 351798 - RNA, 21 nt, Bordetella pertussis
cggucagcagggcgccgacga

SEQ ID NO: 351799 - RNA, 13 nt, Bordetella pertussis
cggucagcaugaa

SEQ ID NO: 351800 - RNA, 14 nt, Bordetella pertussis
cggucagcgcggcg

SEQ ID NO: 351801 - RNA, 17 nt, Bordetella pertussis
cggucagcgcggcgccg

SEQ ID NO: 351802 - RNA, 22 nt, Bordetella pertussis
cggucagcuggaacgcgccgcu

SEQ ID NO: 351803 - RNA, 20 nt, Bordetella pertussis
cggucagcuugccgcccagg

SEQ ID NO: 351804 - RNA, 16 nt, Bordetella pertussis
cggucaggcgucguug

SEQ ID NO: 351805 - RNA, 17 nt, Bordetella pertussis
cggucagucgggacggc

SEQ ID NO: 351806 - RNA, 19 nt, Bordetella pertussis
cggucagucgggacggcgc

SEQ ID NO: 351807 - RNA, 19 nt, Bordetella pertussis
cggucauagacggcgucgg

SEQ ID NO: 351808 - RNA, 17 nt, Bordetella pertussis
cggucaucacgcggucg

SEQ ID NO: 351809 - RNA, 16 nt, Bordetella pertussis
cggucaucggcgacga

SEQ ID NO: 351810 - RNA, 13 nt, Bordetella pertussis
cggucauguccag

SEQ ID NO: 351811 - RNA, 21 nt, Bordetella pertussis
cggucauguccagcgccaggc

SEQ ID NO: 351812 - RNA, 15 nt, Bordetella pertussis
cgguccacgcccugg

SEQ ID NO: 351813 - RNA, 19 nt, Bordetella pertussis
cgguccacgccggguugcg

SEQ ID NO: 351814 - RNA, 13 nt, Bordetella pertussis
cgguccagacggg

SEQ ID NO: 351815 - RNA, 15 nt, Bordetella pertussis
cgguccagcaaggcg

SEQ ID NO: 351816 - RNA, 14 nt, Bordetella pertussis
cgguccagcaccag

SEQ ID NO: 351817 - RNA, 22 nt, Bordetella pertussis
cgguccagcaccagggcgcgca

SEQ ID NO: 351818 - RNA, 14 nt, Bordetella pertussis
cgguccagcacggc

SEQ ID NO: 351819 - RNA, 15 nt, Bordetella pertussis
cgguccagcgcccga

SEQ ID NO: 351820 - RNA, 13 nt, Bordetella pertussis
cgguccaggccga

SEQ ID NO: 351821 - RNA, 21 nt, Bordetella pertussis
cgguccaugcgaaagcggcca

SEQ ID NO: 351822 - RNA, 19 nt, Bordetella pertussis
cgguccccagauccgcaag

SEQ ID NO: 351823 - RNA, 18 nt, Bordetella pertussis
cgguccgaugucgaggau

SEQ ID NO: 351824 - RNA, 16 nt, Bordetella pertussis
cgguccgcagcgcucg

SEQ ID NO: 351825 - RNA, 20 nt, Bordetella pertussis
cgguccgcucgaggccaggc

SEQ ID NO: 351826 - RNA, 17 nt, Bordetella pertussis
cgguccugaccggcggc

SEQ ID NO: 351827 - RNA, 14 nt, Bordetella pertussis
cgguccugcgcgcc

SEQ ID NO: 351828 - RNA, 15 nt, Bordetella pertussis
cgguccugcgcgccg

SEQ ID NO: 351829 - RNA, 16 nt, Bordetella pertussis
cgguccugcgcgccga

SEQ ID NO: 351830 - RNA, 16 nt, Bordetella pertussis
cgguccugcugaucca

SEQ ID NO: 351831 - RNA, 12 nt, Bordetella pertussis
cgguccugguaa

SEQ ID NO: 351832 - RNA, 20 nt, Bordetella pertussis
cggucgaugaagcccgagcg

SEQ ID NO: 351833 - RNA, 17 nt, Bordetella pertussis
cggucgaugaccagcca

SEQ ID NO: 351834 - RNA, 14 nt, Bordetella pertussis
cggucgauguccag

SEQ ID NO: 351835 - RNA, 16 nt, Bordetella pertussis
cggucgauguccagcg

SEQ ID NO: 351836 - RNA, 19 nt, Bordetella pertussis
cggucgauguccagcgcca

SEQ ID NO: 351837 - RNA, 14 nt, Bordetella pertussis
cggucgaugcgcac

SEQ ID NO: 351838 - RNA, 17 nt, Bordetella pertussis
cggucgcauuggccgcc

SEQ ID NO: 351839 - RNA, 14 nt, Bordetella pertussis
cgguucaaccggcg

SEQ ID NO: 351840 - RNA, 17 nt, Bordetella pertussis
cgguucagcgcgccagc

SEQ ID NO: 351841 - RNA, 17 nt, Bordetella pertussis
cgguucgcauagcgccg

SEQ ID NO: 351842 - RNA, 20 nt, Bordetella pertussis
cgguucgcccaccaccagcg

SEQ ID NO: 351843 - RNA, 23 nt, Bordetella pertussis
cgguucgcccaccaccagcggcg

SEQ ID NO: 351844 - RNA, 13 nt, Bordetella pertussis
cgguucgccgucg

SEQ ID NO: 351845 - RNA, 19 nt, Bordetella pertussis
cgguucgccgugcagggcc

SEQ ID NO: 351846 - RNA, 20 nt, Bordetella pertussis
cgguucgccgugcagggcca

SEQ ID NO: 351847 - RNA, 17 nt, Bordetella pertussis
cgguucgggcggguucg

SEQ ID NO: 351848 - RNA, 19 nt, Bordetella pertussis
cgguucguagccgguaucg

SEQ ID NO: 351849 - RNA, 21 nt, Bordetella pertussis
cgguucguccucgucggccau

SEQ ID NO: 351850 - RNA, 16 nt, Bordetella pertussis
cgguucgucagggccg

SEQ ID NO: 351851 - RNA, 16 nt, Bordetella pertussis
cgguugagcgccaggg

SEQ ID NO: 351852 - RNA, 19 nt, Bordetella pertussis
cgguugaucagggccgcca

SEQ ID NO: 351853 - RNA, 14 nt, Bordetella pertussis
cgguugcgaggcgg

SEQ ID NO: 351854 - RNA, 19 nt, Bordetella pertussis
cgguuucggccugcaggcc

SEQ ID NO: 351855 - RNA, 18 nt, Bordetella pertussis
cgguuugguagcaggcgc

SEQ ID NO: 351856 - RNA, 19 nt, Bordetella pertussis
cgguuugguagcaggcgcg

SEQ ID NO: 351857 - RNA, 18 nt, Bordetella pertussis
cgguuuuuucuugccggc

SEQ ID NO: 351858 - RNA, 18 nt, Bordetella pertussis
cguaacaggacagccgcu

SEQ ID NO: 351859 - RNA, 16 nt, Bordetella pertussis
cguacaaccgcgccga

SEQ ID NO: 351860 - RNA, 15 nt, Bordetella pertussis
cguacagccgcggca

SEQ ID NO: 351861 - RNA, 13 nt, Bordetella pertussis
cguacagccugcc

SEQ ID NO: 351862 - RNA, 14 nt, Bordetella pertussis
cguacagccugccc

SEQ ID NO: 351863 - RNA, 17 nt, Bordetella pertussis
cguacagcgaaggggcg

SEQ ID NO: 351864 - RNA, 15 nt, Bordetella pertussis
cguacagggccgcga

SEQ ID NO: 351865 - RNA, 15 nt, Bordetella pertussis
cguacauggccaggu

SEQ ID NO: 351866 - RNA, 20 nt, Bordetella pertussis
cguaccaguacaccggcgug

SEQ ID NO: 351867 - RNA, 15 nt, Bordetella pertussis
cguaccugcagcagg

SEQ ID NO: 351868 - RNA, 21 nt, Bordetella pertussis
cguacgaagcaaacaggcugc

SEQ ID NO: 351869 - RNA, 14 nt, Bordetella pertussis
cguacgacggggug

SEQ ID NO: 351870 - RNA, 21 nt, Bordetella pertussis
cguacgcggcgcggucggcgg

SEQ ID NO: 351871 - RNA, 20 nt, Bordetella pertussis
cguacguaccaggccgucga

SEQ ID NO: 351872 - RNA, 12 nt, Bordetella pertussis
cguacguggcgc

SEQ ID NO: 351873 - RNA, 15 nt, Bordetella pertussis
cguacguggcgcggc

SEQ ID NO: 351874 - RNA, 16 nt, Bordetella pertussis
cguacguggcgcggcu

SEQ ID NO: 351875 - RNA, 23 nt, Bordetella pertussis
cguacuccaucuguucggcgccg

SEQ ID NO: 351876 - RNA, 14 nt, Bordetella pertussis
cguacucgaucgcc

SEQ ID NO: 351877 - RNA, 20 nt, Bordetella pertussis
cguacucgccggucgcggcg

SEQ ID NO: 351878 - RNA, 15 nt, Bordetella pertussis
cguacucgccgucga

SEQ ID NO: 351879 - RNA, 15 nt, Bordetella pertussis
cguacuucucgucgc

SEQ ID NO: 351880 - RNA, 24 nt, Bordetella pertussis
cguacuucucgucgcgcauggacg

SEQ ID NO: 351881 - RNA, 18 nt, Bordetella pertussis
cguacuuccucgaccagc

SEQ ID NO: 351882 - RNA, 17 nt, Bordetella pertussis
cguagaaagccagugcc

SEQ ID NO: 351883 - RNA, 20 nt, Bordetella pertussis
cguagaacacgucgaucagc

SEQ ID NO: 351884 - RNA, 20 nt, Bordetella pertussis
cguagaacuucacgccgagg

SEQ ID NO: 351885 - RNA, 18 nt, Bordetella pertussis
cguagaugcgggucggcg

SEQ ID NO: 351886 - RNA, 12 nt, Bordetella pertussis
cguagcccaggu

SEQ ID NO: 351887 - RNA, 20 nt, Bordetella pertussis
cguagcccagguccagcgcc

SEQ ID NO: 351888 - RNA, 21 nt, Bordetella pertussis
cguagcccagguccagcgcca

SEQ ID NO: 351889 - RNA, 15 nt, Bordetella pertussis
cguagccggccaggu

SEQ ID NO: 351890 - RNA, 13 nt, Bordetella pertussis
cguagccggccag

SEQ ID NO: 351891 - RNA, 14 nt, Bordetella pertussis
cguagccggccagg

SEQ ID NO: 351892 - RNA, 21 nt, Bordetella pertussis
cguagccggugcgcagcacca

SEQ ID NO: 351893 - RNA, 21 nt, Bordetella pertussis
cguagccguccucgcgggccu

SEQ ID NO: 351894 - RNA, 15 nt, Bordetella pertussis
cguagcgcaggcgcu

SEQ ID NO: 351895 - RNA, 13 nt, Bordetella pertussis
cguagcgccagcg

SEQ ID NO: 351896 - RNA, 21 nt, Bordetella pertussis
cguagcgccagcguucggcca

SEQ ID NO: 351897 - RNA, 23 nt, Bordetella pertussis
cguagcgccagcguucggccacc

SEQ ID NO: 351898 - RNA, 13 nt, Bordetella pertussis
cguagcgcggccg

SEQ ID NO: 351899 - RNA, 19 nt, Bordetella pertussis
cguagcgcggccgggucgg

SEQ ID NO: 351900 - RNA, 18 nt, Bordetella pertussis
cguagcgcguggccagca

SEQ ID NO: 351901 - RNA, 20 nt, Bordetella pertussis
cguagcgcguggccagcacg

SEQ ID NO: 351902 - RNA, 15 nt, Bordetella pertussis
cguagcgcugcagcc

SEQ ID NO: 351903 - RNA, 16 nt, Bordetella pertussis
cguagcgcugcagcca

SEQ ID NO: 351904 - RNA, 18 nt, Bordetella pertussis
aacccagcagcggcagca

SEQ ID NO: 351905 - RNA, 19 nt, Bordetella pertussis
aaccccaggggacggcgca

SEQ ID NO: 351906 - RNA, 18 nt, Bordetella pertussis
cguaggcaaagcgcggcu

SEQ ID NO: 351907 - RNA, 19 nt, Bordetella pertussis
cguaggcaaagcgcggcug

SEQ ID NO: 351908 - RNA, 20 nt, Bordetella pertussis
cguaggcgagguccaggcgg

SEQ ID NO: 351909 - RNA, 17 nt, Bordetella pertussis
cguaguacagcagcagc

SEQ ID NO: 351910 - RNA, 16 nt, Bordetella pertussis
cguaguagcccaggcc

SEQ ID NO: 351911 - RNA, 19 nt, Bordetella pertussis
cguaucaacuuccagcgcc

SEQ ID NO: 351912 - RNA, 21 nt, Bordetella pertussis
cguaucaacuuccagcgcccg

SEQ ID NO: 351913 - RNA, 12 nt, Bordetella pertussis
cguaucgccuga

SEQ ID NO: 351914 - RNA, 18 nt, Bordetella pertussis
cguaucgccugacguucg

SEQ ID NO: 351915 - RNA, 18 nt, Bordetella pertussis
cguaucgcccgcgcggua

SEQ ID NO: 351916 - RNA, 13 nt, Bordetella pertussis
cguaucgccgccg

SEQ ID NO: 351917 - RNA, 20 nt, Bordetella pertussis
aacccgccauccuggccgcc

SEQ ID NO: 351918 - RNA, 17 nt, Bordetella pertussis
aacccgcccacgcggcg

SEQ ID NO: 351919 - RNA, 13 nt, Bordetella pertussis
aacccgccggcca

SEQ ID NO: 351920 - RNA, 18 nt, Bordetella pertussis
aacccggcaaucccggcg

SEQ ID NO: 351921 - RNA, 19 nt, Bordetella pertussis
cgucaccagcaggcggccg

SEQ ID NO: 351922 - RNA, 13 nt, Bordetella pertussis
cgucaccaucgcc

SEQ ID NO: 351923 - RNA, 15 nt, Bordetella pertussis
cgucaccccgcccug

SEQ ID NO: 351924 - RNA, 17 nt, Bordetella pertussis
cgucaccgacgccagca

SEQ ID NO: 351925 - RNA, 14 nt, Bordetella pertussis
cgucaccgccgccg

SEQ ID NO: 351926 - RNA, 16 nt, Bordetella pertussis
cgucaccggcgagccg

SEQ ID NO: 351927 - RNA, 16 nt, Bordetella pertussis
cgucacgaaagcgccc

SEQ ID NO: 351928 - RNA, 19 nt, Bordetella pertussis
cgucacgaaagcgcccagg

SEQ ID NO: 351929 - RNA, 23 nt, Bordetella pertussis
cgucacgcacagcaccugguggc

SEQ ID NO: 351930 - RNA, 17 nt, Bordetella pertussis
cgucacgauuucggcca

SEQ ID NO: 351931 - RNA, 19 nt, Bordetella pertussis
cgucacgauuucggccaug

SEQ ID NO: 351932 - RNA, 13 nt, Bordetella pertussis
cgucacgcgcugg

SEQ ID NO: 351933 - RNA, 13 nt, Bordetella pertussis
cgucacgcggccg

SEQ ID NO: 351934 - RNA, 14 nt, Bordetella pertussis
cgucacgcggccgg

SEQ ID NO: 351935 - RNA, 17 nt, Bordetella pertussis
cgucacgcggccgggca

SEQ ID NO: 351936 - RNA, 16 nt, Bordetella pertussis
cgucacgcgcaaggcg

SEQ ID NO: 351937 - RNA, 15 nt, Bordetella pertussis
cgucaucgccgcggc

SEQ ID NO: 351938 - RNA, 17 nt, Bordetella pertussis
cgucaucggugcggccg

SEQ ID NO: 351939 - RNA, 18 nt, Bordetella pertussis
cgucaucggugcggccgg

SEQ ID NO: 351940 - RNA, 19 nt, Bordetella pertussis
cgucaucggugcggccggu

SEQ ID NO: 351941 - RNA, 20 nt, Bordetella pertussis
cgucaucggugcggccggug

SEQ ID NO: 351942 - RNA, 14 nt, Bordetella pertussis
cgucaucguggccg

SEQ ID NO: 351943 - RNA, 22 nt, Bordetella pertussis
cgucaucguggccgcgcaaggc

SEQ ID NO: 351944 - RNA, 21 nt, Bordetella pertussis
cgucaucugcggaaacagauu

SEQ ID NO: 351945 - RNA, 17 nt, Bordetella pertussis
cgucaugaucccgcgcc

SEQ ID NO: 351946 - RNA, 17 nt, Bordetella pertussis
cgucaugauguagccca

SEQ ID NO: 351947 - RNA, 17 nt, Bordetella pertussis
cgucaugcgccgcagca

SEQ ID NO: 351948 - RNA, 16 nt, Bordetella pertussis
cgucaugcgccguccu

SEQ ID NO: 351949 - RNA, 15 nt, Bordetella pertussis
cgucauggccuggcc

SEQ ID NO: 351950 - RNA, 21 nt, Bordetella pertussis
cgucauggccuggcccagcuc

SEQ ID NO: 351951 - RNA, 22 nt, Bordetella pertussis
cgucauggccuggcccagcucc

SEQ ID NO: 351952 - RNA, 13 nt, Bordetella pertussis
cgucauggcgccg

SEQ ID NO: 351953 - RNA, 15 nt, Bordetella pertussis
cgucauggcggcagg

SEQ ID NO: 351954 - RNA, 19 nt, Bordetella pertussis
cgucauguccgagucgaac

SEQ ID NO: 351955 - RNA, 17 nt, Bordetella pertussis
cgucaugugcugcggca

SEQ ID NO: 351956 - RNA, 21 nt, Bordetella pertussis
cgucauggucgaccagcagcc

SEQ ID NO: 351957 - RNA, 20 nt, Bordetella pertussis
cgucauuacccauggcaccg

SEQ ID NO: 351958 - RNA, 20 nt, Bordetella pertussis
cgucauugcaucgcagcaga

SEQ ID NO: 351959 - RNA, 23 nt, Bordetella pertussis
cguccaaaacagacaggccggca

SEQ ID NO: 351960 - RNA, 23 nt, Bordetella pertussis
cguccagcagcaggaacaggcug

SEQ ID NO: 351961 - RNA, 17 nt, Bordetella pertussis
cguccagccgagccugg

SEQ ID NO: 351962 - RNA, 18 nt, Bordetella pertussis
cguccagccgagccuggc

SEQ ID NO: 351963 - RNA, 15 nt, Bordetella pertussis
cguccagccugcccg

SEQ ID NO: 351964 - RNA, 19 nt, Bordetella pertussis
cguccagcgacuccggccg

SEQ ID NO: 351965 - RNA, 23 nt, Bordetella pertussis
cguccagcgacuccggccgggcc

SEQ ID NO: 351966 - RNA, 15 nt, Bordetella pertussis
cguccagcgccacca

SEQ ID NO: 351967 - RNA, 13 nt, Bordetella pertussis
cguccagcgcgcg

SEQ ID NO: 351968 - RNA, 23 nt, Bordetella pertussis
cguccagcgcggcaugccgcugc

SEQ ID NO: 351969 - RNA, 14 nt, Bordetella pertussis
cguccagcgcggcg

SEQ ID NO: 351970 - RNA, 17 nt, Bordetella pertussis
cguccagcgcggcgcca

SEQ ID NO: 351971 - RNA, 16 nt, Bordetella pertussis
cguccagcggcgcgac

SEQ ID NO: 351972 - RNA, 17 nt, Bordetella pertussis
cguccagcggcgcgacg

SEQ ID NO: 351973 - RNA, 15 nt, Bordetella pertussis
cguccagcgucaugc

SEQ ID NO: 351974 - RNA, 19 nt, Bordetella pertussis
cguccaggaagcagcccag

SEQ ID NO: 351975 - RNA, 20 nt, Bordetella pertussis
cguccaggaagcagcccagc

SEQ ID NO: 351976 - RNA, 14 nt, Bordetella pertussis
cguccaggcccagc

SEQ ID NO: 351977 - RNA, 17 nt, Bordetella pertussis
cguccaggcccagcgcg

SEQ ID NO: 351978 - RNA, 12 nt, Bordetella pertussis
cguccaggcgcc

SEQ ID NO: 351979 - RNA, 13 nt, Bordetella pertussis
cguccaggcgccg

SEQ ID NO: 351980 - RNA, 17 nt, Bordetella pertussis
cguccaggcgccgcacg

SEQ ID NO: 351981 - RNA, 13 nt, Bordetella pertussis
cguccaggcgcgc

SEQ ID NO: 351982 - RNA, 14 nt, Bordetella pertussis
cguccaggcgcgcc

SEQ ID NO: 351983 - RNA, 21 nt, Bordetella pertussis
cguccaggcgcgccagccgcu

SEQ ID NO: 351984 - RNA, 13 nt, Bordetella pertussis
cguccaggcggcc

SEQ ID NO: 351985 - RNA, 17 nt, Bordetella pertussis
cguccaggcggccaucg

SEQ ID NO: 351986 - RNA, 20 nt, Bordetella pertussis
cguccaucgccugcacgacc

SEQ ID NO: 351987 - RNA, 18 nt, Bordetella pertussis
cguccaucuggaccgcgc

SEQ ID NO: 351988 - RNA, 19 nt, Bordetella pertussis
cguccaucuggaccgcgcg

SEQ ID NO: 351989 - RNA, 17 nt, Bordetella pertussis
cguccaugcagguggca

SEQ ID NO: 351990 - RNA, 18 nt, Bordetella pertussis
cguccauuagggcccagc

SEQ ID NO: 351991 - RNA, 12 nt, Bordetella pertussis
cgucccagcgca

SEQ ID NO: 351992 - RNA, 23 nt, Bordetella pertussis
cguccgcgacgguccugcgcgcc

SEQ ID NO: 351993 - RNA, 12 nt, Bordetella pertussis
cguccgcgcgcc

SEQ ID NO: 351994 - RNA, 13 nt, Bordetella pertussis
cguccgcgcgccg

SEQ ID NO: 351995 - RNA, 15 nt, Bordetella pertussis
cguccgcgcgccgcu

SEQ ID NO: 351996 - RNA, 14 nt, Bordetella pertussis
cguccgcgccgaac

SEQ ID NO: 351997 - RNA, 14 nt, Bordetella pertussis
cguccggccccagg

SEQ ID NO: 351998 - RNA, 16 nt, Bordetella pertussis
cguccggccgugccgc

SEQ ID NO: 351999 - RNA, 20 nt, Bordetella pertussis
cguccggcgcccgccgccgg

SEQ ID NO: 352000 - RNA, 22 nt, Bordetella pertussis
cguccggcgcccgccgccgggc

SEQ ID NO: 352001 - RNA, 12 nt, Bordetella pertussis
cguccggcgcgc

SEQ ID NO: 352002 - RNA, 13 nt, Bordetella pertussis
cguccggcgcgcg

SEQ ID NO: 352003 - RNA, 15 nt, Bordetella pertussis
cguccggcgcgcgca

SEQ ID NO: 352004 - RNA, 14 nt, Bordetella pertussis
cguccggcgcgucg

SEQ ID NO: 352005 - RNA, 18 nt, Bordetella pertussis
cguccggcgggccgcugu

SEQ ID NO: 352006 - RNA, 22 nt, Bordetella pertussis
cguccgggccgguuucggccug

SEQ ID NO: 352007 - RNA, 17 nt, Bordetella pertussis
cguccucaggcccgcgg

SEQ ID NO: 352008 - RNA, 22 nt, Bordetella pertussis
cguccucaggcccgcggcgcca

SEQ ID NO: 352009 - RNA, 17 nt, Bordetella pertussis
cguccucgaugacgacg

SEQ ID NO: 352010 - RNA, 14 nt, Bordetella pertussis
cguccucggcacgg

SEQ ID NO: 352011 - RNA, 15 nt, Bordetella pertussis
cguccucggccacgu

SEQ ID NO: 352012 - RNA, 15 nt, Bordetella pertussis
cguccucggccagcc

SEQ ID NO: 352013 - RNA, 15 nt, Bordetella pertussis
cguccucgucggcga

SEQ ID NO: 352014 - RNA, 21 nt, Bordetella pertussis
cgucgaacagcuucuccaugc

SEQ ID NO: 352015 - RNA, 22 nt, Bordetella pertussis
cgucgaacagcuucuccaugcg

SEQ ID NO: 352016 - RNA, 14 nt, Bordetella pertussis
cgucgaacagcauc

SEQ ID NO: 352017 - RNA, 16 nt, Bordetella pertussis
cgucgaacggccgggc

SEQ ID NO: 352018 - RNA, 15 nt, Bordetella pertussis
cgucgaacuuguucu

SEQ ID NO: 352019 - RNA, 16 nt, Bordetella pertussis
cgucgaagccggcgcc

SEQ ID NO: 352020 - RNA, 17 nt, Bordetella pertussis
cgucgaagccggcgcca

SEQ ID NO: 352021 - RNA, 18 nt, Bordetella pertussis
cgucgaagccggugaugc

SEQ ID NO: 352022 - RNA, 17 nt, Bordetella pertussis
cgucgaacuccucgacg

SEQ ID NO: 352023 - RNA, 15 nt, Bordetella pertussis
cgucgaaggcgcgcu

SEQ ID NO: 352024 - RNA, 22 nt, Bordetella pertussis
cgucgaaggcgcgcuccagcau

SEQ ID NO: 352025 - RNA, 15 nt, Bordetella pertussis
cgucgaaggcggccg

SEQ ID NO: 352026 - RNA, 17 nt, Bordetella pertussis
cgucgaaggcggccggc

SEQ ID NO: 352027 - RNA, 18 nt, Bordetella pertussis
cgucgaaggcggccggca

SEQ ID NO: 352028 - RNA, 23 nt, Bordetella pertussis
cgucgaauuccaguugcgcgccg

SEQ ID NO: 352029 - RNA, 21 nt, Bordetella pertussis
cgucgacaccaaccugcuggc

SEQ ID NO: 352030 - RNA, 14 nt, Bordetella pertussis
cgucgaccgcgaag

SEQ ID NO: 352031 - RNA, 21 nt, Bordetella pertussis
cgucgaccgcgaagcgcgcca

SEQ ID NO: 352032 - RNA, 19 nt, Bordetella pertussis
cgucgaccgccucgacgcc

SEQ ID NO: 352033 - RNA, 14 nt, Bordetella pertussis
cgucgacggugcgc

SEQ ID NO: 352034 - RNA, 18 nt, Bordetella pertussis
cgucgacggugcgcgcca

SEQ ID NO: 352035 - RNA, 21 nt, Bordetella pertussis
cgucgacguccugguggaccu

SEQ ID NO: 352036 - RNA, 17 nt, Bordetella pertussis
cgucgacgucgaucgag

SEQ ID NO: 352037 - RNA, 14 nt, Bordetella pertussis
cgucgacgucggug

SEQ ID NO: 352038 - RNA, 19 nt, Bordetella pertussis
cgucgacuucgacccggac

SEQ ID NO: 352039 - RNA, 19 nt, Bordetella pertussis
cgucgacguugcgcgacag

SEQ ID NO: 352040 - RNA, 15 nt, Bordetella pertussis
cgucgagcaccguga

SEQ ID NO: 352041 - RNA, 21 nt, Bordetella pertussis
cgucgagcaccgugaccugcg

SEQ ID NO: 352042 - RNA, 16 nt, Bordetella pertussis
cgucgagcacgcggcg

SEQ ID NO: 352043 - RNA, 13 nt, Bordetella pertussis
cgucgagcacggg

SEQ ID NO: 352044 - RNA, 16 nt, Bordetella pertussis
cgucgagcaggccggc

SEQ ID NO: 352045 - RNA, 17 nt, Bordetella pertussis
cgucgagcaggccggcg

SEQ ID NO: 352046 - RNA, 13 nt, Bordetella pertussis
cgucgagccgggc

SEQ ID NO: 352047 - RNA, 17 nt, Bordetella pertussis
cgucgagccgggcgccg

SEQ ID NO: 352048 - RNA, 24 nt, Bordetella pertussis
cgucgagccgggcgccgauccagc

SEQ ID NO: 352049 - RNA, 22 nt, Bordetella pertussis
cgucgagcgcgaaauccagcgc

SEQ ID NO: 352050 - RNA, 14 nt, Bordetella pertussis
cgucgagcgcgacg

SEQ ID NO: 352051 - RNA, 15 nt, Bordetella pertussis
cgucgagcgcgacgc

SEQ ID NO: 352052 - RNA, 13 nt, Bordetella pertussis
cgucgagcgcggc

SEQ ID NO: 352053 - RNA, 17 nt, Bordetella pertussis
cgucgagcgcggccagg

SEQ ID NO: 352054 - RNA, 18 nt, Bordetella pertussis
cgucgaggaucaaggccc

SEQ ID NO: 352055 - RNA, 13 nt, Bordetella pertussis
cgucgaggaugcg

SEQ ID NO: 352056 - RNA, 16 nt, Bordetella pertussis
cgucgaggucagcggc

SEQ ID NO: 352057 - RNA, 16 nt, Bordetella pertussis
cgucgaucagccacgu

SEQ ID NO: 352058 - RNA, 18 nt, Bordetella pertussis
cgucgaucagcgcgggcc

SEQ ID NO: 352059 - RNA, 21 nt, Bordetella pertussis
cgucgaucaggcccagcacga

SEQ ID NO: 352060 - RNA, 14 nt, Bordetella pertussis
cgucgaucauggcg

SEQ ID NO: 352061 - RNA, 15 nt, Bordetella pertussis
cgucgaugaccagcg

SEQ ID NO: 352062 - RNA, 16 nt, Bordetella pertussis
cgucgaugaccagcgc

SEQ ID NO: 352063 - RNA, 18 nt, Bordetella pertussis
cgucgaugaccagcgccg

SEQ ID NO: 352064 - RNA, 16 nt, Bordetella pertussis
cgucgcaaaccugccg

SEQ ID NO: 352065 - RNA, 13 nt, Bordetella pertussis
cgucgcaaagccg

SEQ ID NO: 352066 - RNA, 22 nt, Bordetella pertussis
cgucgcaaagccggaauccugg

SEQ ID NO: 352067 - RNA, 13 nt, Bordetella pertussis
cgucgccagcgcg

SEQ ID NO: 352068 - RNA, 22 nt, Bordetella pertussis
cgucgccagggcgaugaccggc

SEQ ID NO: 352069 - RNA, 14 nt, Bordetella pertussis
cgucgccaugcggc

SEQ ID NO: 352070 - RNA, 17 nt, Bordetella pertussis
cgucgccaugcggcugg

SEQ ID NO: 352071 - RNA, 18 nt, Bordetella pertussis
cgucgccaugcggcuggc

SEQ ID NO: 352072 - RNA, 21 nt, Bordetella pertussis
cgucgccaugcggcuggccga

SEQ ID NO: 352073 - RNA, 12 nt, Bordetella pertussis
cgucgcccacau

SEQ ID NO: 352074 - RNA, 23 nt, Bordetella pertussis
cgucgcccacauagaccggcugc

SEQ ID NO: 352075 - RNA, 15 nt, Bordetella pertussis
cgucgccgcgcacga

SEQ ID NO: 352076 - RNA, 12 nt, Bordetella pertussis
cgucgccgcgcc

SEQ ID NO: 352077 - RNA, 14 nt, Bordetella pertussis
cgucgccgcgccgu

SEQ ID NO: 352078 - RNA, 19 nt, Bordetella pertussis
cgucgccgcuggccagccg

SEQ ID NO: 352079 - RNA, 15 nt, Bordetella pertussis
cgucgccggccaggc

SEQ ID NO: 352080 - RNA, 16 nt, Bordetella pertussis
cgucgccggccaggca

SEQ ID NO: 352081 - RNA, 15 nt, Bordetella pertussis
cgucgccggcguucu

SEQ ID NO: 352082 - RNA, 14 nt, Bordetella pertussis
cgucgccggcguug

SEQ ID NO: 352083 - RNA, 21 nt, Bordetella pertussis
cgucgcgauuuccaugacggu

SEQ ID NO: 352084 - RNA, 13 nt, Bordetella pertussis
cgucgcgcagcag

SEQ ID NO: 352085 - RNA, 14 nt, Bordetella pertussis
cgucgcgcauggac

SEQ ID NO: 352086 - RNA, 13 nt, Bordetella pertussis
cgucgcgccaggc

SEQ ID NO: 352087 - RNA, 17 nt, Bordetella pertussis
cgucgcgccaggccggc

SEQ ID NO: 352088 - RNA, 20 nt, Bordetella pertussis
cgucgcgcgagaauggcgcg

SEQ ID NO: 352089 - RNA, 11 nt, Bordetella pertussis
cgucgcgcgcc

SEQ ID NO: 352090 - RNA, 12 nt, Bordetella pertussis
cgucgcgcgcca

SEQ ID NO: 352091 - RNA, 20 nt, Bordetella pertussis
cgucgcgcggauccuugacg

SEQ ID NO: 352092 - RNA, 14 nt, Bordetella pertussis
cgucgcgcggcggc

SEQ ID NO: 352093 - RNA, 15 nt, Bordetella pertussis
cgucgcgcucggacg

SEQ ID NO: 352094 - RNA, 19 nt, Bordetella pertussis
cgucgcgcucggacgccgc

SEQ ID NO: 352095 - RNA, 18 nt, Bordetella pertussis
cgucgcggcccugggcca

SEQ ID NO: 352096 - RNA, 23 nt, Bordetella pertussis
cgucgcucaggguacggcgaugc

SEQ ID NO: 352097 - RNA, 17 nt, Bordetella pertussis
cgucgcucugcgcggca

SEQ ID NO: 352098 - RNA, 14 nt, Bordetella pertussis
cgucgcugccgcgc

SEQ ID NO: 352099 - RNA, 15 nt, Bordetella pertussis
cgucgcugcgcggcg

SEQ ID NO: 352100 - RNA, 17 nt, Bordetella pertussis
cgucgcugcuggcggcg

SEQ ID NO: 352101 - RNA, 18 nt, Bordetella pertussis
cgucgcugcuggcggcgc

SEQ ID NO: 352102 - RNA, 20 nt, Bordetella pertussis
cgucgcugcuggcggcgcug

SEQ ID NO: 352103 - RNA, 12 nt, Bordetella pertussis
cgucgcugcggc

SEQ ID NO: 352104 - RNA, 14 nt, Bordetella pertussis
cgucgcugcggccg

SEQ ID NO: 352105 - RNA, 14 nt, Bordetella pertussis
cgucgcuggcagcc

SEQ ID NO: 352106 - RNA, 18 nt, Bordetella pertussis
cgucggcaaccgucgcca

SEQ ID NO: 352107 - RNA, 19 nt, Bordetella pertussis
cgucggcaauaucgaucag

SEQ ID NO: 352108 - RNA, 13 nt, Bordetella pertussis
cgucggcaugggu

SEQ ID NO: 352109 - RNA, 14 nt, Bordetella pertussis
cgucggccaaggcc

SEQ ID NO: 352110 - RNA, 18 nt, Bordetella pertussis
cgucggccaaggccggcg

SEQ ID NO: 352111 - RNA, 18 nt, Bordetella pertussis
cgucgucgaugaugacga

SEQ ID NO: 352112 - RNA, 16 nt, Bordetella pertussis
cgucgucgccaccgcc

SEQ ID NO: 352113 - RNA, 14 nt, Bordetella pertussis
cgucgucgccgucg

SEQ ID NO: 352114 - RNA, 23 nt, Bordetella pertussis
cgucgugcccucgggaaacaggc

SEQ ID NO: 352115 - RNA, 20 nt, Bordetella pertussis
cgucgucgcgguccagcacc

SEQ ID NO: 352116 - RNA, 18 nt, Bordetella pertussis
cgucgugcgccuggcggc

SEQ ID NO: 352117 - RNA, 17 nt, Bordetella pertussis
cgucguggggcgcggcg

SEQ ID NO: 352118 - RNA, 19 nt, Bordetella pertussis
cgucguggggcgcggcggc

SEQ ID NO: 352119 - RNA, 13 nt, Bordetella pertussis
cgucguugcgccg

SEQ ID NO: 352120 - RNA, 14 nt, Bordetella pertussis
cgucguuggccgcg

SEQ ID NO: 352121 - RNA, 13 nt, Bordetella pertussis
cgucugagcgccg

SEQ ID NO: 352122 - RNA, 18 nt, Bordetella pertussis
cgucugcccgcgguccag

SEQ ID NO: 352123 - RNA, 21 nt, Bordetella pertussis
cgucugcccgcgguccagcac

SEQ ID NO: 352124 - RNA, 15 nt, Bordetella pertussis
cgucugcccgugcgu

SEQ ID NO: 352125 - RNA, 13 nt, Bordetella pertussis
cgucugcgcaucg

SEQ ID NO: 352126 - RNA, 14 nt, Bordetella pertussis
cgucugcgccgccg

SEQ ID NO: 352127 - RNA, 20 nt, Bordetella pertussis
cgucuggagcggccuggccc

SEQ ID NO: 352128 - RNA, 18 nt, Bordetella pertussis
cgucuggcacgcuugccg

SEQ ID NO: 352129 - RNA, 22 nt, Bordetella pertussis
cgucuggcggcagcucgcgcug

SEQ ID NO: 352130 - RNA, 22 nt, Bordetella pertussis
cgucuguaucguugucgcgccg

SEQ ID NO: 352131 - RNA, 23 nt, Bordetella pertussis
cgucugugcgccccgcuggccgu

SEQ ID NO: 352132 - RNA, 20 nt, Bordetella pertussis
cgucuucaguugacgccggc

SEQ ID NO: 352133 - RNA, 14 nt, Bordetella pertussis
cgucuucgaccagg

SEQ ID NO: 352134 - RNA, 15 nt, Bordetella pertussis
cgucuucgaccaggu

SEQ ID NO: 352135 - RNA, 16 nt, Bordetella pertussis
cgucuucgaccagguc

SEQ ID NO: 352136 - RNA, 16 nt, Bordetella pertussis
cgucuucggcgcggcg

SEQ ID NO: 352137 - RNA, 16 nt, Bordetella pertussis
cgucuugcccgccagc

SEQ ID NO: 352138 - RNA, 17 nt, Bordetella pertussis
cgucuugcccgccagcg

SEQ ID NO: 352139 - RNA, 18 nt, Bordetella pertussis
cgucuugcccgccagcgc

SEQ ID NO: 352140 - RNA, 12 nt, Bordetella pertussis
cgucuugaggau

SEQ ID NO: 352141 - RNA, 16 nt, Bordetella pertussis
cgucuuuucguccucg

SEQ ID NO: 352142 - RNA, 16 nt, Bordetella pertussis
cgugaaaggccagcgg

SEQ ID NO: 352143 - RNA, 21 nt, Bordetella pertussis
cgugaacgccccggccgaucg

SEQ ID NO: 352144 - RNA, 14 nt, Bordetella pertussis
cgugaacugguccu

SEQ ID NO: 352145 - RNA, 21 nt, Bordetella pertussis
cgugaagcccauggcguaggc

SEQ ID NO: 352146 - RNA, 17 nt, Bordetella pertussis
cgugaagccuucggucg

SEQ ID NO: 352147 - RNA, 17 nt, Bordetella pertussis
cgugaagcgccgcgccu

SEQ ID NO: 352148 - RNA, 21 nt, Bordetella pertussis
cgugaaugcgccuggcguuca

SEQ ID NO: 352149 - RNA, 18 nt, Bordetella pertussis
aaccgaauuccggcucgg

SEQ ID NO: 352150 - RNA, 12 nt, Bordetella pertussis
aaccgacgcggc

SEQ ID NO: 352151 - RNA, 13 nt, Bordetella pertussis
aaccgauggugcc

SEQ ID NO: 352152 - RNA, 16 nt, Bordetella pertussis
cgugaccgacaggccu

SEQ ID NO: 352153 - RNA, 17 nt, Bordetella pertussis
cgugaccgacaggccug

SEQ ID NO: 352154 - RNA, 19 nt, Bordetella pertussis
cgugaccgacaggccuggc

SEQ ID NO: 352155 - RNA, 21 nt, Bordetella pertussis
cgugaccggacuguccacgca

SEQ ID NO: 352156 - RNA, 16 nt, Bordetella pertussis
cgugaccugcgucugc

SEQ ID NO: 352157 - RNA, 21 nt, Bordetella pertussis
cgugacgcgcggguccaggcc

SEQ ID NO: 352158 - RNA, 19 nt, Bordetella pertussis
cgugacgauauccaggcgc

SEQ ID NO: 352159 - RNA, 20 nt, Bordetella pertussis
cgugacgauauccaggcgcg

SEQ ID NO: 352160 - RNA, 13 nt, Bordetella pertussis
cgugacgcuggcc

SEQ ID NO: 352161 - RNA, 17 nt, Bordetella pertussis
cgugacgcuggcccugu

SEQ ID NO: 352162 - RNA, 16 nt, Bordetella pertussis
cgugacggccgccacg

SEQ ID NO: 352163 - RNA, 18 nt, Bordetella pertussis
cgugacggccgccacgcc

SEQ ID NO: 352164 - RNA, 19 nt, Bordetella pertussis
cgugacggcggcgcgcgga

SEQ ID NO: 352165 - RNA, 14 nt, Bordetella pertussis
cgugacuucggccg

SEQ ID NO: 352166 - RNA, 15 nt, Bordetella pertussis
cgugacuucggccgc

SEQ ID NO: 352167 - RNA, 16 nt, Bordetella pertussis
cgugacuucggccgcc

SEQ ID NO: 352168 - RNA, 20 nt, Bordetella pertussis
cgugacuucggccgccagcc

SEQ ID NO: 352169 - RNA, 21 nt, Bordetella pertussis
cgugacuucggccgccagccg

SEQ ID NO: 352170 - RNA, 15 nt, Bordetella pertussis
cgugagcacgacguu

SEQ ID NO: 352171 - RNA, 12 nt, Bordetella pertussis
cgugagcgccac

SEQ ID NO: 352172 - RNA, 17 nt, Bordetella pertussis
cgugagcgccgccgcca

SEQ ID NO: 352173 - RNA, 14 nt, Bordetella pertussis
cgugaggucgcgcg

SEQ ID NO: 352174 - RNA, 17 nt, Bordetella pertussis
cgugaggucgcgcguac

SEQ ID NO: 352175 - RNA, 16 nt, Bordetella pertussis
cgugauauagaccagc

SEQ ID NO: 352176 - RNA, 19 nt, Bordetella pertussis
cgugauauagaccagcagc

SEQ ID NO: 352177 - RNA, 20 nt, Bordetella pertussis
cgugaucgaccgccagcagg

SEQ ID NO: 352178 - RNA, 14 nt, Bordetella pertussis
cgugaucgccagcg

SEQ ID NO: 352179 - RNA, 16 nt, Bordetella pertussis
cgugaucgccagcgcc

SEQ ID NO: 352180 - RNA, 23 nt, Bordetella pertussis
cgugaucgccagcgccgggguca

SEQ ID NO: 352181 - RNA, 22 nt, Bordetella pertussis
cgugaucggcgcaaccggcccg

SEQ ID NO: 352182 - RNA, 14 nt, Bordetella pertussis
cgugaugcccaggc

SEQ ID NO: 352183 - RNA, 17 nt, Bordetella pertussis
cgugaugcccaggcccu

SEQ ID NO: 352184 - RNA, 18 nt, Bordetella pertussis
cgugaugccccagguccg

SEQ ID NO: 352185 - RNA, 21 nt, Bordetella pertussis
cgugaugccccagguccgccg

SEQ ID NO: 352186 - RNA, 18 nt, Bordetella pertussis
cgugaugccgaccaggcc

SEQ ID NO: 352187 - RNA, 15 nt, Bordetella pertussis
cgugaugccgcccgc

SEQ ID NO: 352188 - RNA, 17 nt, Bordetella pertussis
cgugaugccgucgagcg

SEQ ID NO: 352189 - RNA, 22 nt, Bordetella pertussis
cgugaucuugaugccgcccagc

SEQ ID NO: 352190 - RNA, 23 nt, Bordetella pertussis
cgugaucuugaugccgcccagca

SEQ ID NO: 352191 - RNA, 14 nt, Bordetella pertussis
cgugaugcgcgccg

SEQ ID NO: 352192 - RNA, 15 nt, Bordetella pertussis
cgugaugcgcgccgc

SEQ ID NO: 352193 - RNA, 16 nt, Bordetella pertussis
cgugaugucgccgucg

SEQ ID NO: 352194 - RNA, 18 nt, Bordetella pertussis
cgugaugucgccgucggc

SEQ ID NO: 352195 - RNA, 19 nt, Bordetella pertussis
cgugaugucgccgucggca

SEQ ID NO: 352196 - RNA, 16 nt, Bordetella pertussis
cgugcaccaugccgac

SEQ ID NO: 352197 - RNA, 14 nt, Bordetella pertussis
cgugcacgaccugc

SEQ ID NO: 352198 - RNA, 23 nt, Bordetella pertussis
cgugcacgcccgcggcgcccagc

SEQ ID NO: 352199 - RNA, 19 nt, Bordetella pertussis
cgugcacgcguaugcccug

SEQ ID NO: 352200 - RNA, 16 nt, Bordetella pertussis
cgugcagacggcggcu

SEQ ID NO: 352201 - RNA, 17 nt, Bordetella pertussis
cgugcagagcaccacgg

SEQ ID NO: 352202 - RNA, 12 nt, Bordetella pertussis
cgugcagauggc

SEQ ID NO: 352203 - RNA, 20 nt, Bordetella pertussis
cgugcagcaagcccaccggg

SEQ ID NO: 352204 - RNA, 22 nt, Bordetella pertussis
cgugcagcaagcccaccgggcc

SEQ ID NO: 352205 - RNA, 19 nt, Bordetella pertussis
cgugcagccagcggccgau

SEQ ID NO: 352206 - RNA, 14 nt, Bordetella pertussis
cgugcagccauucg

SEQ ID NO: 352207 - RNA, 21 nt, Bordetella pertussis
cgugcagccauucggccaggu

SEQ ID NO: 352208 - RNA, 14 nt, Bordetella pertussis
cgugcagcaggggc

SEQ ID NO: 352209 - RNA, 20 nt, Bordetella pertussis
cgugcagcgcgugggccagu

SEQ ID NO: 352210 - RNA, 23 nt, Bordetella pertussis
cgugcagcgcgugggccaguccg

SEQ ID NO: 352211 - RNA, 15 nt, Bordetella pertussis
cgugcagcgccgcgc

SEQ ID NO: 352212 - RNA, 16 nt, Bordetella pertussis
cgugcagcgccgcgcg

SEQ ID NO: 352213 - RNA, 14 nt, Bordetella pertussis
cgugcagcgugggc

SEQ ID NO: 352214 - RNA, 24 nt, Bordetella pertussis
cgugcaggccaacgggauccggca

SEQ ID NO: 352215 - RNA, 14 nt, Bordetella pertussis
cgugcaggcccggg

SEQ ID NO: 352216 - RNA, 15 nt, Bordetella pertussis
cgugcaggauggcgu

SEQ ID NO: 352217 - RNA, 16 nt, Bordetella pertussis
cgugcaggccggcggc

SEQ ID NO: 352218 - RNA, 22 nt, Bordetella pertussis
cgugcaucccaauuggccgccc

SEQ ID NO: 352219 - RNA, 17 nt, Bordetella pertussis
cgugccagcaggucgcg

SEQ ID NO: 352220 - RNA, 21 nt, Bordetella pertussis
cgugccagcaggucgcgcacg

SEQ ID NO: 352221 - RNA, 20 nt, Bordetella pertussis
cgugccauacagcaaggaca

SEQ ID NO: 352222 - RNA, 22 nt, Bordetella pertussis
cgugccauacagcaaggacaag

SEQ ID NO: 352223 - RNA, 23 nt, Bordetella pertussis
cgugcccaaugucaccgacgcca

SEQ ID NO: 352224 - RNA, 19 nt, Bordetella pertussis
cgugccauggacgccggua

SEQ ID NO: 352225 - RNA, 11 nt, Bordetella pertussis
cgugcccaggg

SEQ ID NO: 352226 - RNA, 14 nt, Bordetella pertussis
cgugcccagggcca

SEQ ID NO: 352227 - RNA, 17 nt, Bordetella pertussis
cgugcccagggccacga

SEQ ID NO: 352228 - RNA, 19 nt, Bordetella pertussis
cgugcccaguuucgcgacc

SEQ ID NO: 352229 - RNA, 16 nt, Bordetella pertussis
cgugccccgcaugcgc

SEQ ID NO: 352230 - RNA, 20 nt, Bordetella pertussis
cgugcccgacggacuggcug

SEQ ID NO: 352231 - RNA, 17 nt, Bordetella pertussis
cgugcccgcguccacca

SEQ ID NO: 352232 - RNA, 20 nt, Bordetella pertussis
cgugcccgcguccaccaagg

SEQ ID NO: 352233 - RNA, 16 nt, Bordetella pertussis
cgugcccggcgggccg

SEQ ID NO: 352234 - RNA, 17 nt, Bordetella pertussis
cgugcccguugccgcgc

SEQ ID NO: 352235 - RNA, 23 nt, Bordetella pertussis
cgugcccucgggaaacaggccca

SEQ ID NO: 352236 - RNA, 15 nt, Bordetella pertussis
cgugcccugcggcgc

SEQ ID NO: 352237 - RNA, 23 nt, Bordetella pertussis
cgugcccugcggcgcggccagca

SEQ ID NO: 352238 - RNA, 15 nt, Bordetella pertussis
cgugccgacgaugcc

SEQ ID NO: 352239 - RNA, 17 nt, Bordetella pertussis
cgugccgcacgguggcg

SEQ ID NO: 352240 - RNA, 18 nt, Bordetella pertussis
cgugccgcacgguggcgc

SEQ ID NO: 352241 - RNA, 19 nt, Bordetella pertussis
cgugccgcagaugucaguc

SEQ ID NO: 352242 - RNA, 14 nt, Bordetella pertussis
cgugccgcaggcca

SEQ ID NO: 352243 - RNA, 16 nt, Bordetella pertussis
cgugccgcaggccagc

SEQ ID NO: 352244 - RNA, 16 nt, Bordetella pertussis
cgugccgccggcgcgu

SEQ ID NO: 352245 - RNA, 18 nt, Bordetella pertussis
cgugccgcgcaggucggc

SEQ ID NO: 352246 - RNA, 19 nt, Bordetella pertussis
cgugccgcgcaggucggcg

SEQ ID NO: 352247 - RNA, 19 nt, Bordetella pertussis
cgugccgcggcgcggcccg

SEQ ID NO: 352248 - RNA, 15 nt, Bordetella pertussis
cgugccggccggacc

SEQ ID NO: 352249 - RNA, 17 nt, Bordetella pertussis
cgugccgggaugcugcu

SEQ ID NO: 352250 - RNA, 12 nt, Bordetella pertussis
cgugccgggccu

SEQ ID NO: 352251 - RNA, 18 nt, Bordetella pertussis
cgugccggugacgacgcg

SEQ ID NO: 352252 - RNA, 17 nt, Bordetella pertussis
cgugccgucgggcgccg

SEQ ID NO: 352253 - RNA, 19 nt, Bordetella pertussis
cgugccucaacuggccggc

SEQ ID NO: 352254 - RNA, 20 nt, Bordetella pertussis
cgugccucaacuggccggcc

SEQ ID NO: 352255 - RNA, 22 nt, Bordetella pertussis
cgugccucaacuggccggccug

SEQ ID NO: 352256 - RNA, 23 nt, Bordetella pertussis
cgugccucaacuggccggccugg

SEQ ID NO: 352257 - RNA, 11 nt, Bordetella pertussis
cgugcgaggcc

SEQ ID NO: 352258 - RNA, 15 nt, Bordetella pertussis
cgugcgaggccacgg

SEQ ID NO: 352259 - RNA, 16 nt, Bordetella pertussis
cgugcgaggccacggc

SEQ ID NO: 352260 - RNA, 17 nt, Bordetella pertussis
cgugcgaggccacggca

SEQ ID NO: 352261 - RNA, 22 nt, Bordetella pertussis
cgugcgacgcaugucagcgccu

SEQ ID NO: 352262 - RNA, 17 nt, Bordetella pertussis
cgugcgcaacgcgcgcg

SEQ ID NO: 352263 - RNA, 19 nt, Bordetella pertussis
cgugcgcacgcguucgggc

SEQ ID NO: 352264 - RNA, 14 nt, Bordetella pertussis
cgugcgcaggcgcg

SEQ ID NO: 352265 - RNA, 20 nt, Bordetella pertussis
cgugcgcauacagggcggug

SEQ ID NO: 352266 - RNA, 15 nt, Bordetella pertussis
cgugcgcaucagcgc

SEQ ID NO: 352267 - RNA, 16 nt, Bordetella pertussis
cgugcgcaucagcgca

SEQ ID NO: 352268 - RNA, 16 nt, Bordetella pertussis
cgugcgccagcgccag

SEQ ID NO: 352269 - RNA, 14 nt, Bordetella pertussis
cgugcgccgcauca

SEQ ID NO: 352270 - RNA, 18 nt, Bordetella pertussis
cgugcgcccauggcgcgc

SEQ ID NO: 352271 - RNA, 16 nt, Bordetella pertussis
cgugcgccugcugguc

SEQ ID NO: 352272 - RNA, 13 nt, Bordetella pertussis
cgugcgccuggcg

SEQ ID NO: 352273 - RNA, 16 nt, Bordetella pertussis
cgugcgccuggcggcu

SEQ ID NO: 352274 - RNA, 20 nt, Bordetella pertussis
cgugcgcgagggcuucgacu

SEQ ID NO: 352275 - RNA, 13 nt, Bordetella pertussis
cgugcgcgcccga

SEQ ID NO: 352276 - RNA, 15 nt, Bordetella pertussis
cgugcgcgcccgaug

SEQ ID NO: 352277 - RNA, 17 nt, Bordetella pertussis
cgugcggccgcagcagu

SEQ ID NO: 352278 - RNA, 13 nt, Bordetella pertussis
cgugcggccgcag

SEQ ID NO: 352279 - RNA, 18 nt, Bordetella pertussis
cgugcgggacggccaggg

SEQ ID NO: 352280 - RNA, 16 nt, Bordetella pertussis
cgugcggggcggcagg

SEQ ID NO: 352281 - RNA, 20 nt, Bordetella pertussis
cgugcggggcggcaggucgc

SEQ ID NO: 352282 - RNA, 19 nt, Bordetella pertussis
cgugcgggccugcaguucg

SEQ ID NO: 352283 - RNA, 16 nt, Bordetella pertussis
cgugcgggugccuguc

SEQ ID NO: 352284 - RNA, 16 nt, Bordetella pertussis
cgugcugcugcaggcg

SEQ ID NO: 352285 - RNA, 17 nt, Bordetella pertussis
cgugcuggccaucuaug

SEQ ID NO: 352286 - RNA, 13 nt, Bordetella pertussis
cgugcuggccgac

SEQ ID NO: 352287 - RNA, 14 nt, Bordetella pertussis
cgugcuggccgacg

SEQ ID NO: 352288 - RNA, 15 nt, Bordetella pertussis
aaccgcagcgccacc

SEQ ID NO: 352289 - RNA, 19 nt, Bordetella pertussis
aaccgcagcgccaccggcu

SEQ ID NO: 352290 - RNA, 18 nt, Bordetella pertussis
aaccgcgccucguccucg

SEQ ID NO: 352291 - RNA, 18 nt, Bordetella pertussis
cguggacgugcgcgaccg

SEQ ID NO: 352292 - RNA, 23 nt, Bordetella pertussis
cguggacuucguguucgcggccg

SEQ ID NO: 352293 - RNA, 14 nt, Bordetella pertussis
cguggcgacgucgg

SEQ ID NO: 352294 - RNA, 21 nt, Bordetella pertussis
cguggcgcaaggcaugcgcca

SEQ ID NO: 352295 - RNA, 14 nt, Bordetella pertussis
cguggcgcaccagg

SEQ ID NO: 352296 - RNA, 22 nt, Bordetella pertussis
cguggcgcagucgagcaccgcg

SEQ ID NO: 352297 - RNA, 14 nt, Bordetella pertussis
cguggcgccgaagg

SEQ ID NO: 352298 - RNA, 20 nt, Bordetella pertussis
cguggcgccgaaggcggcgc

SEQ ID NO: 352299 - RNA, 23 nt, Bordetella pertussis
cguggcgcgcaaccaggggcggc

SEQ ID NO: 352300 - RNA, 23 nt, Bordetella pertussis
cguggcgcgcacacuggccagca

SEQ ID NO: 352301 - RNA, 14 nt, Bordetella pertussis
cguggcgcgcaccu

SEQ ID NO: 352302 - RNA, 14 nt, Bordetella pertussis
cguggcgcgccucc

SEQ ID NO: 352303 - RNA, 21 nt, Bordetella pertussis
cguggcgcgccuccagcucca

SEQ ID NO: 352304 - RNA, 14 nt, Bordetella pertussis
cguggcgcgcgccg

SEQ ID NO: 352305 - RNA, 20 nt, Bordetella pertussis
cguggcgcggguggccggau

SEQ ID NO: 352306 - RNA, 14 nt, Bordetella pertussis
cguggcgcgccagc

SEQ ID NO: 352307 - RNA, 18 nt, Bordetella pertussis
cguggcgcgccagcgcca

SEQ ID NO: 352308 - RNA, 21 nt, Bordetella pertussis
cguggcgcuccaugcggcggc

SEQ ID NO: 352309 - RNA, 13 nt, Bordetella pertussis
cguggcggccaca

SEQ ID NO: 352310 - RNA, 16 nt, Bordetella pertussis
cguggcggccaggccg

SEQ ID NO: 352311 - RNA, 17 nt, Bordetella pertussis
cguggcggccaggccgg

SEQ ID NO: 352312 - RNA, 16 nt, Bordetella pertussis
cguggcggcgcagcgc

SEQ ID NO: 352313 - RNA, 17 nt, Bordetella pertussis
cguggcggcgcagcgcc

SEQ ID NO: 352314 - RNA, 18 nt, Bordetella pertussis
cguggcggcgcagcgccc

SEQ ID NO: 352315 - RNA, 19 nt, Bordetella pertussis
cguggcggcgcagcgccca

SEQ ID NO: 352316 - RNA, 17 nt, Bordetella pertussis
cguggcgggccgcgccg

SEQ ID NO: 352317 - RNA, 19 nt, Bordetella pertussis
cguggcgggccgcgccgcg

SEQ ID NO: 352318 - RNA, 20 nt, Bordetella pertussis
cguggcgggccgcgccgcgg

SEQ ID NO: 352319 - RNA, 17 nt, Bordetella pertussis
cguggcuucagggcuga

SEQ ID NO: 352320 - RNA, 14 nt, Bordetella pertussis
cgugggacaggcac

SEQ ID NO: 352321 - RNA, 21 nt, Bordetella pertussis
cgugggacaggcacccugccg

SEQ ID NO: 352322 - RNA, 12 nt, Bordetella pertussis
cgugggccagca

SEQ ID NO: 352323 - RNA, 16 nt, Bordetella pertussis
cgugggccaguccgca

SEQ ID NO: 352324 - RNA, 20 nt, Bordetella pertussis
cgugggccaguccgcagcgc

SEQ ID NO: 352325 - RNA, 15 nt, Bordetella pertussis
cguggucgucccgca

SEQ ID NO: 352326 - RNA, 15 nt, Bordetella pertussis
cguggucgugcuggc

SEQ ID NO: 352327 - RNA, 16 nt, Bordetella pertussis
cguggugggcaccgug

SEQ ID NO: 352328 - RNA, 22 nt, Bordetella pertussis
cguggugggccacucgaugggc

SEQ ID NO: 352329 - RNA, 19 nt, Bordetella pertussis
cguggugugcgaggacgac

SEQ ID NO: 352330 - RNA, 21 nt, Bordetella pertussis
cguguucagcgcgcgcgccga

SEQ ID NO: 352331 - RNA, 17 nt, Bordetella pertussis
cguguucgagcaggcgc

SEQ ID NO: 352332 - RNA, 15 nt, Bordetella pertussis
cguguucgacgcggc

SEQ ID NO: 352333 - RNA, 14 nt, Bordetella pertussis
cguguucgcggccg

SEQ ID NO: 352334 - RNA, 16 nt, Bordetella pertussis
cguguugccaggcgau

SEQ ID NO: 352335 - RNA, 19 nt, Bordetella pertussis
cguguugcgugcgagcaga

SEQ ID NO: 352336 - RNA, 16 nt, Bordetella pertussis
cguguuguucagguug

SEQ ID NO: 352337 - RNA, 18 nt, Bordetella pertussis
cguuaugguucggccucg

SEQ ID NO: 352338 - RNA, 14 nt, Bordetella pertussis
cguucacgcgcagc

SEQ ID NO: 352339 - RNA, 15 nt, Bordetella pertussis
cguucacgcgcagcg

SEQ ID NO: 352340 - RNA, 22 nt, Bordetella pertussis
cguucacgccggcgcgccgggc

SEQ ID NO: 352341 - RNA, 19 nt, Bordetella pertussis
cguucagcgggcgcgcccg

SEQ ID NO: 352342 - RNA, 22 nt, Bordetella pertussis
cguucagcgggcgcgcccggcg

SEQ ID NO: 352343 - RNA, 16 nt, Bordetella pertussis
cguucagcgccggcau

SEQ ID NO: 352344 - RNA, 14 nt, Bordetella pertussis
cguucagggcgccg

SEQ ID NO: 352345 - RNA, 20 nt, Bordetella pertussis
cguuccccaucaucugcggc

SEQ ID NO: 352346 - RNA, 19 nt, Bordetella pertussis
cguucccuacccgccgggc

SEQ ID NO: 352347 - RNA, 13 nt, Bordetella pertussis
cguuccggccgcg

SEQ ID NO: 352348 - RNA, 18 nt, Bordetella pertussis
cguuccggccgcgccagc

SEQ ID NO: 352349 - RNA, 19 nt, Bordetella pertussis
cguucggggcgucgcugcu

SEQ ID NO: 352350 - RNA, 21 nt, Bordetella pertussis
cguucggugcgcagcggcagg

SEQ ID NO: 352351 - RNA, 15 nt, Bordetella pertussis
cguucgucgcgcagc

SEQ ID NO: 352352 - RNA, 21 nt, Bordetella pertussis
cguucuggcagugcgccuggc

SEQ ID NO: 352353 - RNA, 23 nt, Bordetella pertussis
cguucuggcgcagcaaggcgcgc

SEQ ID NO: 352354 - RNA, 14 nt, Bordetella pertussis
cguucuucagcgcg

SEQ ID NO: 352355 - RNA, 17 nt, Bordetella pertussis
cguucuuccgcacgccg

SEQ ID NO: 352356 - RNA, 15 nt, Bordetella pertussis
cguugaaguccggau

SEQ ID NO: 352357 - RNA, 16 nt, Bordetella pertussis
cguugaccgccucgau

SEQ ID NO: 352358 - RNA, 18 nt, Bordetella pertussis
cguugaccgccucgaugc

SEQ ID NO: 352359 - RNA, 20 nt, Bordetella pertussis
cguugaccggcuggcgcacg

SEQ ID NO: 352360 - RNA, 15 nt, Bordetella pertussis
cguugaccuugccga

SEQ ID NO: 352361 - RNA, 16 nt, Bordetella pertussis
cguugacggcccagcu

SEQ ID NO: 352362 - RNA, 22 nt, Bordetella pertussis
cguugacucuaguucuauauag

SEQ ID NO: 352363 - RNA, 17 nt, Bordetella pertussis
cguugaucuggccgucg

SEQ ID NO: 352364 - RNA, 21 nt, Bordetella pertussis
cguugaugaugaucggcgcca

SEQ ID NO: 352365 - RNA, 14 nt, Bordetella pertussis
cguugauggggccg

SEQ ID NO: 352366 - RNA, 18 nt, Bordetella pertussis
cguugauggggccgcgcc

SEQ ID NO: 352367 - RNA, 18 nt, Bordetella pertussis
cguugccgaagcgucggc

SEQ ID NO: 352368 - RNA, 23 nt, Bordetella pertussis
cguugccgaagcgucggccugca

SEQ ID NO: 352369 - RNA, 14 nt, Bordetella pertussis
cguugccgcgcgcg

SEQ ID NO: 352370 - RNA, 16 nt, Bordetella pertussis
cguugccgcgcgcgua

SEQ ID NO: 352371 - RNA, 11 nt, Bordetella pertussis
cguugccggcc

SEQ ID NO: 352372 - RNA, 13 nt, Bordetella pertussis
cguugccggccag

SEQ ID NO: 352373 - RNA, 16 nt, Bordetella pertussis
cguugcgcaagccgcc

SEQ ID NO: 352374 - RNA, 19 nt, Bordetella pertussis
cguugcgcaagccgcccgc

SEQ ID NO: 352375 - RNA, 20 nt, Bordetella pertussis
cguugcgcaagccgcccgcg

SEQ ID NO: 352376 - RNA, 15 nt, Bordetella pertussis
cuacggcggcggcca

SEQ ID NO: 352377 - RNA, 16 nt, Bordetella pertussis
cuacggcuggccgucg

SEQ ID NO: 352378 - RNA, 23 nt, Bordetella pertussis
cuagccaccgauaucgauaccaa

SEQ ID NO: 352379 - RNA, 14 nt, Bordetella pertussis
cuagcccggcgcca

SEQ ID NO: 352380 - RNA, 16 nt, Bordetella pertussis
cuagcccggcgccacc

SEQ ID NO: 352381 - RNA, 18 nt, Bordetella pertussis
cuauacaacgcgguggcg

SEQ ID NO: 352382 - RNA, 15 nt, Bordetella pertussis
cuaucaucaggccca

SEQ ID NO: 352383 - RNA, 14 nt, Bordetella pertussis
cuaucugccgcgca

SEQ ID NO: 352384 - RNA, 18 nt, Bordetella pertussis
cuaucuuucgggcgcggg

SEQ ID NO: 352385 - RNA, 21 nt, Bordetella pertussis
cuaugaagacgcgcucgccgu

SEQ ID NO: 352386 - RNA, 14 nt, Bordetella pertussis
cuauguaggcgccg

SEQ ID NO: 352387 - RNA, 23 nt, Bordetella pertussis
cuaugugcaggccaccgacggcg

SEQ ID NO: 352388 - RNA, 14 nt, Bordetella pertussis
cuauugcgacgccg

SEQ ID NO: 352389 - RNA, 16 nt, Bordetella pertussis
cuauugcgacgccgcc

SEQ ID NO: 352390 - RNA, 23 nt, Bordetella pertussis
cuauuuccagggcgucgcggcgu

SEQ ID NO: 352391 - RNA, 21 nt, Bordetella pertussis
cucaaccgcgcguaucggcgc

SEQ ID NO: 352392 - RNA, 17 nt, Bordetella pertussis
cucaaccucgacgcgca

SEQ ID NO: 352393 - RNA, 19 nt, Bordetella pertussis
cucaaccucgacgcgcauu

SEQ ID NO: 352394 - RNA, 19 nt, Bordetella pertussis
cucaagaagaagccgggcu

SEQ ID NO: 352395 - RNA, 15 nt, Bordetella pertussis
cucaccgccgcccgc

SEQ ID NO: 352396 - RNA, 17 nt, Bordetella pertussis
cucaccgcgccgggcgu

SEQ ID NO: 352397 - RNA, 22 nt, Bordetella pertussis
cucacgaugcgaucgucgcugc

SEQ ID NO: 352398 - RNA, 12 nt, Bordetella pertussis
cucacggggcug

SEQ ID NO: 352399 - RNA, 21 nt, Bordetella pertussis
cucacggggcugucgcgcgca

SEQ ID NO: 352400 - RNA, 17 nt, Bordetella pertussis
cucacugcccgcgccgu

SEQ ID NO: 352401 - RNA, 18 nt, Bordetella pertussis
cucagcaccaggccgccg

SEQ ID NO: 352402 - RNA, 13 nt, Bordetella pertussis
cucagcagcgcca

SEQ ID NO: 352403 - RNA, 22 nt, Bordetella pertussis
cucagcagcgccagggccaggc

SEQ ID NO: 352404 - RNA, 22 nt, Bordetella pertussis
cucagcagggucgagaccagca

SEQ ID NO: 352405 - RNA, 13 nt, Bordetella pertussis
cucagcccgcguu

SEQ ID NO: 352406 - RNA, 16 nt, Bordetella pertussis
cucagcccggcgaggu

SEQ ID NO: 352407 - RNA, 20 nt, Bordetella pertussis
cucagcccuugacgcguacg

SEQ ID NO: 352408 - RNA, 22 nt, Bordetella pertussis
cucaggcgcggauugaugucgc

SEQ ID NO: 352409 - RNA, 15 nt, Bordetella pertussis
cucauucggcgcgcu

SEQ ID NO: 352410 - RNA, 13 nt, Bordetella pertussis
cuccacgccgccg

SEQ ID NO: 352411 - RNA, 22 nt, Bordetella pertussis
cuccacggaauggucaagcggc

SEQ ID NO: 352412 - RNA, 16 nt, Bordetella pertussis
cuccacgugcggcagg

SEQ ID NO: 352413 - RNA, 23 nt, Bordetella pertussis
cuccagcgccggcagccccagcg

SEQ ID NO: 352414 - RNA, 13 nt, Bordetella pertussis
cuccagcgcgccg

SEQ ID NO: 352415 - RNA, 15 nt, Bordetella pertussis
cuccagcgcggcggg

SEQ ID NO: 352416 - RNA, 13 nt, Bordetella pertussis
cuccagcgcgucg

SEQ ID NO: 352417 - RNA, 18 nt, Bordetella pertussis
cuccagcgcgucggccag

SEQ ID NO: 352418 - RNA, 19 nt, Bordetella pertussis
cuccagcgcgucggccagg

SEQ ID NO: 352419 - RNA, 20 nt, Bordetella pertussis
cuccagcgcgucggccaggc

SEQ ID NO: 352420 - RNA, 20 nt, Bordetella pertussis
cuccagcgcuucgugcagcg

SEQ ID NO: 352421 - RNA, 19 nt, Bordetella pertussis
cuccagcgucauggccugg

SEQ ID NO: 352422 - RNA, 20 nt, Bordetella pertussis
cuccagcgucauggccuggc

SEQ ID NO: 352423 - RNA, 19 nt, Bordetella pertussis
cuccagcucagcagcgcca

SEQ ID NO: 352424 - RNA, 24 nt, Bordetella pertussis
cuccagcucagcagcgccagggcc

SEQ ID NO: 352425 - RNA, 19 nt, Bordetella pertussis
cuccaggaaagcgccgccg

SEQ ID NO: 352426 - RNA, 15 nt, Bordetella pertussis
cuccagcuggcgcac

SEQ ID NO: 352427 - RNA, 17 nt, Bordetella pertussis
cuccagcuggcgcacca

SEQ ID NO: 352428 - RNA, 14 nt, Bordetella pertussis
cuccaggcccaggc

SEQ ID NO: 352429 - RNA, 16 nt, Bordetella pertussis
cuccaggccgcccagc

SEQ ID NO: 352430 - RNA, 18 nt, Bordetella pertussis
cuccaggccgcccagccg

SEQ ID NO: 352431 - RNA, 13 nt, Bordetella pertussis
cuccaggcggcgg

SEQ ID NO: 352432 - RNA, 21 nt, Bordetella pertussis
cuccaggcucaggcggccagg

SEQ ID NO: 352433 - RNA, 24 nt, Bordetella pertussis
cuccaggcucaggcggccagggcc

SEQ ID NO: 352434 - RNA, 17 nt, Bordetella pertussis
cuccauagcgccgcucg

SEQ ID NO: 352435 - RNA, 19 nt, Bordetella pertussis
cuccaucuguucggcgccg

SEQ ID NO: 352436 - RNA, 14 nt, Bordetella pertussis
cuccaugcggcggc

SEQ ID NO: 352437 - RNA, 17 nt, Bordetella pertussis
cuccaugcggcggcggg

SEQ ID NO: 352438 - RNA, 13 nt, Bordetella pertussis
cuccauggcgccg

SEQ ID NO: 352439 - RNA, 15 nt, Bordetella pertussis
cuccauggcgccggc

SEQ ID NO: 352440 - RNA, 23 nt, Bordetella pertussis
cuccauguaaaaacccggccugc

SEQ ID NO: 352441 - RNA, 18 nt, Bordetella pertussis
cucccagaaacuggcgcu

SEQ ID NO: 352442 - RNA, 14 nt, Bordetella pertussis
cucccagaccugcg

SEQ ID NO: 352443 - RNA, 19 nt, Bordetella pertussis
cucccauugcgcggccagg

SEQ ID NO: 352444 - RNA, 18 nt, Bordetella pertussis
cuccgcuaucauccgcgc

SEQ ID NO: 352445 - RNA, 19 nt, Bordetella pertussis
cuccgcuaucauccgcgca

SEQ ID NO: 352446 - RNA, 18 nt, Bordetella pertussis
cuccggauaccgccgccg

SEQ ID NO: 352447 - RNA, 14 nt, Bordetella pertussis
cuccggcugcgcgc

SEQ ID NO: 352448 - RNA, 16 nt, Bordetella pertussis
cuccggcugcgcgcgc

SEQ ID NO: 352449 - RNA, 14 nt, Bordetella pertussis
cuccggcuugccga

SEQ ID NO: 352450 - RNA, 14 nt, Bordetella pertussis
cuccgggucgagcg

SEQ ID NO: 352451 - RNA, 12 nt, Bordetella pertussis
cuccgggucgcg

SEQ ID NO: 352452 - RNA, 17 nt, Bordetella pertussis
cuccgggucgcggcacg

SEQ ID NO: 352453 - RNA, 21 nt, Bordetella pertussis
cuccgguacgccugcaccgcc

SEQ ID NO: 352454 - RNA, 19 nt, Bordetella pertussis
cuccuccccaacggggacg

SEQ ID NO: 352455 - RNA, 13 nt, Bordetella pertussis
cuccucgacgucg

SEQ ID NO: 352456 - RNA, 14 nt, Bordetella pertussis
cuccucgacgucgc

SEQ ID NO: 352457 - RNA, 14 nt, Bordetella pertussis
cuccucgagcgugg

SEQ ID NO: 352458 - RNA, 14 nt, Bordetella pertussis
cuccugcucggcga

SEQ ID NO: 352459 - RNA, 20 nt, Bordetella pertussis
cuccuggacgaugcgcgaag

SEQ ID NO: 352460 - RNA, 23 nt, Bordetella pertussis
cuccugcuggcgcgucggcgcgc

SEQ ID NO: 352461 - RNA, 16 nt, Bordetella pertussis
cuccugguugaccgag

SEQ ID NO: 352462 - RNA, 22 nt, Bordetella pertussis
cuccugguugaccgagcccggc

SEQ ID NO: 352463 - RNA, 18 nt, Bordetella pertussis
cuccugugggggcgcggc

SEQ ID NO: 352464 - RNA, 14 nt, Bordetella pertussis
cuccuugagcacgu

SEQ ID NO: 352465 - RNA, 20 nt, Bordetella pertussis
cuccuugagcacguccagcg

SEQ ID NO: 352466 - RNA, 14 nt, Bordetella pertussis
cucgaagaucucga

SEQ ID NO: 352467 - RNA, 19 nt, Bordetella pertussis
cucgaaggcgccgacggcg

SEQ ID NO: 352468 - RNA, 17 nt, Bordetella pertussis
cucgacccgcucggcca

SEQ ID NO: 352469 - RNA, 20 nt, Bordetella pertussis
cucgacguaagugcccaggc

SEQ ID NO: 352470 - RNA, 16 nt, Bordetella pertussis
cucgacgucgcccugg

SEQ ID NO: 352471 - RNA, 13 nt, Bordetella pertussis
cucgaggccaggc

SEQ ID NO: 352472 - RNA, 21 nt, Bordetella pertussis
cucgaggcgcuggcguccagc

SEQ ID NO: 352473 - RNA, 16 nt, Bordetella pertussis
cucgauccgggccugg

SEQ ID NO: 352474 - RNA, 14 nt, Bordetella pertussis
cucgaucgccgccg

SEQ ID NO: 352475 - RNA, 16 nt, Bordetella pertussis
cucgaucgccgccggc

SEQ ID NO: 352476 - RNA, 16 nt, Bordetella pertussis
cucgaugaccagcagc

SEQ ID NO: 352477 - RNA, 23 nt, Bordetella pertussis
cucgcacaguucgugcaccagcc

SEQ ID NO: 352478 - RNA, 16 nt, Bordetella pertussis
cucgcacggccgucaa

SEQ ID NO: 352479 - RNA, 20 nt, Bordetella pertussis
cucgcaggaauccuggugcc

SEQ ID NO: 352480 - RNA, 16 nt, Bordetella pertussis
cucgcaucggccugca

SEQ ID NO: 352481 - RNA, 13 nt, Bordetella pertussis
cucgcccucgcgc

SEQ ID NO: 352482 - RNA, 17 nt, Bordetella pertussis
cucgcccugcuggcgca

SEQ ID NO: 352483 - RNA, 18 nt, Bordetella pertussis
cucgcccuugagcacggc

SEQ ID NO: 352484 - RNA, 19 nt, Bordetella pertussis
cucgcccuugcggcgaggc

SEQ ID NO: 352485 - RNA, 22 nt, Bordetella pertussis
cucgcccuugcggcgaggcuuu

SEQ ID NO: 352486 - RNA, 17 nt, Bordetella pertussis
cucgccgaacugccggc

SEQ ID NO: 352487 - RNA, 20 nt, Bordetella pertussis
cucgccgaacugccggcgcg

SEQ ID NO: 352488 - RNA, 12 nt, Bordetella pertussis
cucgccgcccag

SEQ ID NO: 352489 - RNA, 17 nt, Bordetella pertussis
cucgccgcgcacgggcg

SEQ ID NO: 352490 - RNA, 15 nt, Bordetella pertussis
cucgccgcgccagcu

SEQ ID NO: 352491 - RNA, 15 nt, Bordetella pertussis
cucgccgcgcgacag

SEQ ID NO: 352492 - RNA, 16 nt, Bordetella pertussis
cucgccgcuccggcau

SEQ ID NO: 352493 - RNA, 14 nt, Bordetella pertussis
cucgccggccagcg

SEQ ID NO: 352494 - RNA, 18 nt, Bordetella pertussis
cucgccggcccugccgcc

SEQ ID NO: 352495 - RNA, 23 nt, Bordetella pertussis
cucgccggcccugccgcccuggc

SEQ ID NO: 352496 - RNA, 14 nt, Bordetella pertussis
cucgccggccgcgc

SEQ ID NO: 352497 - RNA, 16 nt, Bordetella pertussis
cucgccggcgcgcagg

SEQ ID NO: 352498 - RNA, 17 nt, Bordetella pertussis
cucgccggcgcgcaggc

SEQ ID NO: 352499 - RNA, 13 nt, Bordetella pertussis
cucgccggucgcg

SEQ ID NO: 352500 - RNA, 20 nt, Bordetella pertussis
cucgccguucuucgaucgcc

SEQ ID NO: 352501 - RNA, 17 nt, Bordetella pertussis
cucgccuccccaggcca

SEQ ID NO: 352502 - RNA, 20 nt, Bordetella pertussis
cucgccuccccaggccagcu

SEQ ID NO: 352503 - RNA, 17 nt, Bordetella pertussis
cucgcgcccgagcgcca

SEQ ID NO: 352504 - RNA, 13 nt, Bordetella pertussis
cucgcggccgucg

SEQ ID NO: 352505 - RNA, 20 nt, Bordetella pertussis
cucgcgggccuggcggaucu

SEQ ID NO: 352506 - RNA, 17 nt, Bordetella pertussis
cucgcgggccuuggcca

SEQ ID NO: 352507 - RNA, 16 nt, Bordetella pertussis
cucgcgggugcgcagc

SEQ ID NO: 352508 - RNA, 17 nt, Bordetella pertussis
cucgcgggugcgcagca

SEQ ID NO: 352509 - RNA, 15 nt, Bordetella pertussis
cucgcuugcccgugc

SEQ ID NO: 352510 - RNA, 23 nt, Bordetella pertussis
cucggacaggucggcgcccacgc

SEQ ID NO: 352511 - RNA, 14 nt, Bordetella pertussis
cucggagcccagug

SEQ ID NO: 352512 - RNA, 19 nt, Bordetella pertussis
cucggcaaacggcuggacg

SEQ ID NO: 352513 - RNA, 14 nt, Bordetella pertussis
cucggcacggccag

SEQ ID NO: 352514 - RNA, 19 nt, Bordetella pertussis
cucggcauccagcucggcg

SEQ ID NO: 352515 - RNA, 23 nt, Bordetella pertussis
cucggccauguucuucaggcucc

SEQ ID NO: 352516 - RNA, 17 nt, Bordetella pertussis
cucggcccauugcggca

SEQ ID NO: 352517 - RNA, 14 nt, Bordetella pertussis
cucggccggcaggu

SEQ ID NO: 352518 - RNA, 20 nt, Bordetella pertussis
cucggccucgcggcgcagca

SEQ ID NO: 352519 - RNA, 11 nt, Bordetella pertussis
cucggccugcg

SEQ ID NO: 352520 - RNA, 13 nt, Bordetella pertussis
cucggccugcggu

SEQ ID NO: 352521 - RNA, 17 nt, Bordetella pertussis
cucggccuggccccagg

SEQ ID NO: 352522 - RNA, 14 nt, Bordetella pertussis
cucggccugggcgc

SEQ ID NO: 352523 - RNA, 16 nt, Bordetella pertussis
cucggccugggcgcga

SEQ ID NO: 352524 - RNA, 14 nt, Bordetella pertussis
cucggcggccagcg

SEQ ID NO: 352525 - RNA, 15 nt, Bordetella pertussis
cucggcggccagcgc

SEQ ID NO: 352526 - RNA, 17 nt, Bordetella pertussis
cucggcgguugcccgcc

SEQ ID NO: 352527 - RNA, 13 nt, Bordetella pertussis
cucuacuggcuga

SEQ ID NO: 352528 - RNA, 17 nt, Bordetella pertussis
cucuaugucgccggcca

SEQ ID NO: 352529 - RNA, 19 nt, Bordetella pertussis
cucuaugucgccggccagu

SEQ ID NO: 352530 - RNA, 22 nt, Bordetella pertussis
cucugcaccuugggcgccugcg

SEQ ID NO: 352531 - RNA, 18 nt, Bordetella pertussis
cucuggaucgugcccagc

SEQ ID NO: 352532 - RNA, 18 nt, Bordetella pertussis
cucuggcacaccagcgcc

SEQ ID NO: 352533 - RNA, 16 nt, Bordetella pertussis
cucuggcugacgaugu

SEQ ID NO: 352534 - RNA, 13 nt, Bordetella pertussis
cucugguccaggc

SEQ ID NO: 352535 - RNA, 17 nt, Bordetella pertussis
cucuucaaaaccaugga

SEQ ID NO: 352536 - RNA, 16 nt, Bordetella pertussis
cucuuggcgccggacu

SEQ ID NO: 352537 - RNA, 21 nt, Bordetella pertussis
cucuugguggugccugcuugc

SEQ ID NO: 352538 - RNA, 18 nt, Bordetella pertussis
cugaaccaggccgccagg

SEQ ID NO: 352539 - RNA, 16 nt, Bordetella pertussis
cugaacgaauaaucgc

SEQ ID NO: 352540 - RNA, 15 nt, Bordetella pertussis
cugaacgacgguaca

SEQ ID NO: 352541 - RNA, 16 nt, Bordetella pertussis
cugaacgccucgggcu

SEQ ID NO: 352542 - RNA, 16 nt, Bordetella pertussis
cugaacgccgcgcugc

SEQ ID NO: 352543 - RNA, 14 nt, Bordetella pertussis
cugaacguggcguc

SEQ ID NO: 352544 - RNA, 19 nt, Bordetella pertussis
cugaacguguaggucagcg

SEQ ID NO: 352545 - RNA, 22 nt, Bordetella pertussis
cugaacguguaggucagcgccu

SEQ ID NO: 352546 - RNA, 18 nt, Bordetella pertussis
cugaaggaccucgcgccg

SEQ ID NO: 352547 - RNA, 13 nt, Bordetella pertussis
cugaagguggcgu

SEQ ID NO: 352548 - RNA, 19 nt, Bordetella pertussis
cugaaguaguacucgccgu

SEQ ID NO: 352549 - RNA, 13 nt, Bordetella pertussis
cugaccaccggga

SEQ ID NO: 352550 - RNA, 21 nt, Bordetella pertussis
cugaccagcagcaccgugccg

SEQ ID NO: 352551 - RNA, 16 nt, Bordetella pertussis
cugaccagcgcgucgc

SEQ ID NO: 352552 - RNA, 19 nt, Bordetella pertussis
cugaccagcgcgucgcacu

SEQ ID NO: 352553 - RNA, 18 nt, Bordetella pertussis
cugaccgacggccuggag

SEQ ID NO: 352554 - RNA, 20 nt, Bordetella pertussis
cugaccgacggccuggaggc

SEQ ID NO: 352555 - RNA, 15 nt, Bordetella pertussis
cugaccgacgugcgc

SEQ ID NO: 352556 - RNA, 17 nt, Bordetella pertussis
cugaccgacgugcgccg

SEQ ID NO: 352557 - RNA, 14 nt, Bordetella pertussis
cugaccggcggcgc

SEQ ID NO: 352558 - RNA, 15 nt, Bordetella pertussis
cugaccggcggcgcu

SEQ ID NO: 352559 - RNA, 15 nt, Bordetella pertussis
cugaccggcggcguc

SEQ ID NO: 352560 - RNA, 16 nt, Bordetella pertussis
cugaccggcggcgucu

SEQ ID NO: 352561 - RNA, 20 nt, Bordetella pertussis
cugaccggcguauggcccgc

SEQ ID NO: 352562 - RNA, 20 nt, Bordetella pertussis
cugaccggcuauaccgggcu

SEQ ID NO: 352563 - RNA, 20 nt, Bordetella pertussis
cugaccggcuucccguggcu

SEQ ID NO: 352564 - RNA, 16 nt, Bordetella pertussis
cugaccguccauggcg

SEQ ID NO: 352565 - RNA, 15 nt, Bordetella pertussis
cugaccuauucgucg

SEQ ID NO: 352566 - RNA, 19 nt, Bordetella pertussis
cugaccugcacgauggcgc

SEQ ID NO: 352567 - RNA, 20 nt, Bordetella pertussis
cugacgaaacgcgcguccuu

SEQ ID NO: 352568 - RNA, 21 nt, Bordetella pertussis
cugacgaaacgcgcguccuug

SEQ ID NO: 352569 - RNA, 19 nt, Bordetella pertussis
cugacgauguucaggccau

SEQ ID NO: 352570 - RNA, 13 nt, Bordetella pertussis
cugacgccugcgc

SEQ ID NO: 352571 - RNA, 16 nt, Bordetella pertussis
cugacgcgcaagcggc

SEQ ID NO: 352572 - RNA, 18 nt, Bordetella pertussis
cugacgcguucuucagcu

SEQ ID NO: 352573 - RNA, 19 nt, Bordetella pertussis
cugacgcucauccaggcgc

SEQ ID NO: 352574 - RNA, 15 nt, Bordetella pertussis
cugacggacuggugc

SEQ ID NO: 352575 - RNA, 13 nt, Bordetella pertussis
cugacggcuacac

SEQ ID NO: 352576 - RNA, 19 nt, Bordetella pertussis
cugacggcuacacccugcu

SEQ ID NO: 352577 - RNA, 23 nt, Bordetella pertussis
cugacgggucacccgccgcacca

SEQ ID NO: 352578 - RNA, 23 nt, Bordetella pertussis
cugacgugcgccacagcaugacc

SEQ ID NO: 352579 - RNA, 21 nt, Bordetella pertussis
cugacguucggggcgucgcug

SEQ ID NO: 352580 - RNA, 22 nt, Bordetella pertussis
cugacguucggggcgucgcugc

SEQ ID NO: 352581 - RNA, 15 nt, Bordetella pertussis
cugacugcggugccu

SEQ ID NO: 352582 - RNA, 22 nt, Bordetella pertussis
cugacugugcagccacgccugg

SEQ ID NO: 352583 - RNA, 20 nt, Bordetella pertussis
cugagaucguccagcgacuc

SEQ ID NO: 352584 - RNA, 22 nt, Bordetella pertussis
cugagaucguccagcgacuccg

SEQ ID NO: 352585 - RNA, 13 nt, Bordetella pertussis
cugagcaccagca

SEQ ID NO: 352586 - RNA, 14 nt, Bordetella pertussis
cugagcaccagcag

SEQ ID NO: 352587 - RNA, 16 nt, Bordetella pertussis
cugagcaccagcagcc

SEQ ID NO: 352588 - RNA, 14 nt, Bordetella pertussis
cugagcaccgccgc

SEQ ID NO: 352589 - RNA, 17 nt, Bordetella pertussis
cugagcacaugcccggc

SEQ ID NO: 352590 - RNA, 18 nt, Bordetella pertussis
cugagccaggcgcccggc

SEQ ID NO: 352591 - RNA, 19 nt, Bordetella pertussis
cugagccauuccggcuggu

SEQ ID NO: 352592 - RNA, 18 nt, Bordetella pertussis
cugagccgauacaggcgc

SEQ ID NO: 352593 - RNA, 16 nt, Bordetella pertussis
cugagcgacaugucgc

SEQ ID NO: 352594 - RNA, 20 nt, Bordetella pertussis
cugagcgacaugucgccgcg

SEQ ID NO: 352595 - RNA, 14 nt, Bordetella pertussis
cugagcgccggggu

SEQ ID NO: 352596 - RNA, 23 nt, Bordetella pertussis
cugagcugccaggcuaucguggc

SEQ ID NO: 352597 - RNA, 23 nt, Bordetella pertussis
cugaucacccacagcagcgcgcc

SEQ ID NO: 352598 - RNA, 14 nt, Bordetella pertussis
cugaucaccgccgg

SEQ ID NO: 352599 - RNA, 22 nt, Bordetella pertussis
cugauccgcaccggcgugcgcu

SEQ ID NO: 352600 - RNA, 19 nt, Bordetella pertussis
cugauccucgccagcggca

SEQ ID NO: 352601 - RNA, 14 nt, Bordetella pertussis
cugaucgccggcgc

SEQ ID NO: 352602 - RNA, 15 nt, Bordetella pertussis
cugaucgccggcgcc

SEQ ID NO: 352603 - RNA, 14 nt, Bordetella pertussis
cugaucgcgcagcg

SEQ ID NO: 352604 - RNA, 16 nt, Bordetella pertussis
cugaucgcgcagcgcc

SEQ ID NO: 352605 - RNA, 19 nt, Bordetella pertussis
cugaucuugaugcggccgu

SEQ ID NO: 352606 - RNA, 17 nt, Bordetella pertussis
cugaucuuucagcgcga

SEQ ID NO: 352607 - RNA, 14 nt, Bordetella pertussis
cugaugcaggccug

SEQ ID NO: 352608 - RNA, 22 nt, Bordetella pertussis
cugaugccguaccaggugcgca

SEQ ID NO: 352609 - RNA, 14 nt, Bordetella pertussis
cugaugcgcggcgg

SEQ ID NO: 352610 - RNA, 18 nt, Bordetella pertussis
cugaugcgcgucaggcga

SEQ ID NO: 352611 - RNA, 20 nt, Bordetella pertussis
cugaugcgcgucaggcgagc

SEQ ID NO: 352612 - RNA, 16 nt, Bordetella pertussis
cugaugcuggucagcc

SEQ ID NO: 352613 - RNA, 19 nt, Bordetella pertussis
cugaugcuggucagccugg

SEQ ID NO: 352614 - RNA, 13 nt, Bordetella pertussis
cugauggccgcca

SEQ ID NO: 352615 - RNA, 18 nt, Bordetella pertussis
cugauggccgccagcggc

SEQ ID NO: 352616 - RNA, 16 nt, Bordetella pertussis
cugauucccaggcccg

SEQ ID NO: 352617 - RNA, 21 nt, Bordetella pertussis
cugauucccaggcccggccgc

SEQ ID NO: 352618 - RNA, 22 nt, Bordetella pertussis
cugauucacaggcccgcgcggc

SEQ ID NO: 352619 - RNA, 23 nt, Bordetella pertussis
cugauucacaggcccgcgcggcc

SEQ ID NO: 352620 - RNA, 16 nt, Bordetella pertussis
cugcaaccagcucagc

SEQ ID NO: 352621 - RNA, 16 nt, Bordetella pertussis
cugcaaggcccgcccg

SEQ ID NO: 352622 - RNA, 13 nt, Bordetella pertussis
cugcaaggccggc

SEQ ID NO: 352623 - RNA, 17 nt, Bordetella pertussis
cugcaaggccggcggca

SEQ ID NO: 352624 - RNA, 17 nt, Bordetella pertussis
cugcaaggccugcugca

SEQ ID NO: 352625 - RNA, 23 nt, Bordetella pertussis
cugcaagauuucauggcgucugc

SEQ ID NO: 352626 - RNA, 15 nt, Bordetella pertussis
cugcaagguggcgug

SEQ ID NO: 352627 - RNA, 22 nt, Bordetella pertussis
cugcaagguggcgugcagcagg

SEQ ID NO: 352628 - RNA, 14 nt, Bordetella pertussis
cugcaaguccagcg

SEQ ID NO: 352629 - RNA, 21 nt, Bordetella pertussis
cugcaagucuucuucagcaug

SEQ ID NO: 352630 - RNA, 20 nt, Bordetella pertussis
cugcaauugcgcggccaugc

SEQ ID NO: 352631 - RNA, 21 nt, Bordetella pertussis
cugcacccacacuuggccggc

SEQ ID NO: 352632 - RNA, 22 nt, Bordetella pertussis
cugcacccacacuuggccggcg

SEQ ID NO: 352633 - RNA, 14 nt, Bordetella pertussis
cugcaccggcgcca

SEQ ID NO: 352634 - RNA, 18 nt, Bordetella pertussis
cugcaccggcgccacggc

SEQ ID NO: 352635 - RNA, 22 nt, Bordetella pertussis
cugcaccggcuugucgaccagu

SEQ ID NO: 352636 - RNA, 16 nt, Bordetella pertussis
cugcaccgccgcgcgg

SEQ ID NO: 352637 - RNA, 14 nt, Bordetella pertussis
cugcaccgucacgc

SEQ ID NO: 352638 - RNA, 12 nt, Bordetella pertussis
cugcaccugccu

SEQ ID NO: 352639 - RNA, 21 nt, Bordetella pertussis
cugcaccuugggcgccugcgg

SEQ ID NO: 352640 - RNA, 23 nt, Bordetella pertussis
cugcaccuuguacuggucgcgca

SEQ ID NO: 352641 - RNA, 13 nt, Bordetella pertussis
cugcacgaccugc

SEQ ID NO: 352642 - RNA, 23 nt, Bordetella pertussis
cugcacgaagcggaugcgccgcc

SEQ ID NO: 352643 - RNA, 22 nt, Bordetella pertussis
cugcacgacgggauugccguca

SEQ ID NO: 352644 - RNA, 13 nt, Bordetella pertussis
cugcacgaggcgc

SEQ ID NO: 352645 - RNA, 20 nt, Bordetella pertussis
cugcacgaggcgcucggccu

SEQ ID NO: 352646 - RNA, 13 nt, Bordetella pertussis
cugcacgccgggc

SEQ ID NO: 352647 - RNA, 18 nt, Bordetella pertussis
cugcacgccgggcgcgcu

SEQ ID NO: 352648 - RNA, 13 nt, Bordetella pertussis
cugcacgcgcgcg

SEQ ID NO: 352649 - RNA, 14 nt, Bordetella pertussis
cugcacgcgcgcgg

SEQ ID NO: 352650 - RNA, 18 nt, Bordetella pertussis
cugcacgcgcgcgggcgc

SEQ ID NO: 352651 - RNA, 17 nt, Bordetella pertussis
cugcacgcggccgcgca

SEQ ID NO: 352652 - RNA, 14 nt, Bordetella pertussis
cugcacgcgggcca

SEQ ID NO: 352653 - RNA, 19 nt, Bordetella pertussis
cugcacgcgguccacgccg

SEQ ID NO: 352654 - RNA, 21 nt, Bordetella pertussis
cugcacgcucuugagcgcggc

SEQ ID NO: 352655 - RNA, 13 nt, Bordetella pertussis
cugcacgauggcg

SEQ ID NO: 352656 - RNA, 18 nt, Bordetella pertussis
cugcacgauggcgccggc

SEQ ID NO: 352657 - RNA, 19 nt, Bordetella pertussis
cugcacgauggcgccggcu

SEQ ID NO: 352658 - RNA, 21 nt, Bordetella pertussis
cugcacgauggcgccggcuuc

SEQ ID NO: 352659 - RNA, 17 nt, Bordetella pertussis
cugcacgcagcgcagga

SEQ ID NO: 352660 - RNA, 23 nt, Bordetella pertussis
cugcacggccuugucgcgcccga

SEQ ID NO: 352661 - RNA, 21 nt, Bordetella pertussis
cugcacggcggaaugcggcga

SEQ ID NO: 352662 - RNA, 17 nt, Bordetella pertussis
cugcacggugggcagca

SEQ ID NO: 352663 - RNA, 15 nt, Bordetella pertussis
cugcacuugcgaacg

SEQ ID NO: 352664 - RNA, 19 nt, Bordetella pertussis
cugcacuugcgaacggccg

SEQ ID NO: 352665 - RNA, 20 nt, Bordetella pertussis
cugcacuugcgaacggccgc

SEQ ID NO: 352666 - RNA, 18 nt, Bordetella pertussis
cugcagaucaucggcgcc

SEQ ID NO: 352667 - RNA, 19 nt, Bordetella pertussis
cugcagaucaucggcgcca

SEQ ID NO: 352668 - RNA, 23 nt, Bordetella pertussis
cugcagcacggccacggccggca

SEQ ID NO: 352669 - RNA, 14 nt, Bordetella pertussis
cugcagcagcgccu

SEQ ID NO: 352670 - RNA, 23 nt, Bordetella pertussis
cugcagcagcggcagcucggcga

SEQ ID NO: 352671 - RNA, 13 nt, Bordetella pertussis
cugcagcaggcgc

SEQ ID NO: 352672 - RNA, 20 nt, Bordetella pertussis
cugcagcaggcgcaccagcg

SEQ ID NO: 352673 - RNA, 12 nt, Bordetella pertussis
cugcagcaugaa

SEQ ID NO: 352674 - RNA, 18 nt, Bordetella pertussis
cugcagccacuggaacag

SEQ ID NO: 352675 - RNA, 20 nt, Bordetella pertussis
cugcagccauucggccacuu

SEQ ID NO: 352676 - RNA, 14 nt, Bordetella pertussis
cugcagcccggcca

SEQ ID NO: 352677 - RNA, 15 nt, Bordetella pertussis
cugcagcccggccag

SEQ ID NO: 352678 - RNA, 22 nt, Bordetella pertussis
cugcagcgugauggggccgggc

SEQ ID NO: 352679 - RNA, 12 nt, Bordetella pertussis
cugcagcgugcu

SEQ ID NO: 352680 - RNA, 14 nt, Bordetella pertussis
cugcagcggccagu

SEQ ID NO: 352681 - RNA, 20 nt, Bordetella pertussis
cugcagcugcuugcccaggc

SEQ ID NO: 352682 - RNA, 23 nt, Bordetella pertussis
cugcagcugcuugcccaggccgg

SEQ ID NO: 352683 - RNA, 18 nt, Bordetella pertussis
cugcagcuugcgcgccag

SEQ ID NO: 352684 - RNA, 19 nt, Bordetella pertussis
cugcaggaagccugcgcgc

SEQ ID NO: 352685 - RNA, 13 nt, Bordetella pertussis
cugcaggcccagc

SEQ ID NO: 352686 - RNA, 15 nt, Bordetella pertussis
cugcaggcccagcac

SEQ ID NO: 352687 - RNA, 19 nt, Bordetella pertussis
cugcaggcccagcacgcgc

SEQ ID NO: 352688 - RNA, 23 nt, Bordetella pertussis
cugcaggcccagcacgcgcgcca

SEQ ID NO: 352689 - RNA, 20 nt, Bordetella pertussis
cugcaggaucgcggccagcg

SEQ ID NO: 352690 - RNA, 17 nt, Bordetella pertussis
cugcaggcccggcgcga

SEQ ID NO: 352691 - RNA, 12 nt, Bordetella pertussis
cugcaggccgaa

SEQ ID NO: 352692 - RNA, 21 nt, Bordetella pertussis
cugcaggccgccggccagcgc

SEQ ID NO: 352693 - RNA, 15 nt, Bordetella pertussis
cugcaggccggcgcg

SEQ ID NO: 352694 - RNA, 17 nt, Bordetella pertussis
cugcaggccggcgcgca

SEQ ID NO: 352695 - RNA, 14 nt, Bordetella pertussis
cugcaggccgggca

SEQ ID NO: 352696 - RNA, 17 nt, Bordetella pertussis
cugcaggcgcugcgcau

SEQ ID NO: 352697 - RNA, 14 nt, Bordetella pertussis
cugcaggcggcgca

SEQ ID NO: 352698 - RNA, 17 nt, Bordetella pertussis
cugcagggccuggaagc

SEQ ID NO: 352699 - RNA, 14 nt, Bordetella pertussis
cugcagggucagcc

SEQ ID NO: 352700 - RNA, 20 nt, Bordetella pertussis
cugcaggugccgccggcgcg

SEQ ID NO: 352701 - RNA, 22 nt, Bordetella pertussis
cugcaggugccgccggcgcggc

SEQ ID NO: 352702 - RNA, 14 nt, Bordetella pertussis
cugcaggugccugu

SEQ ID NO: 352703 - RNA, 17 nt, Bordetella pertussis
cugcaguucggccgcca

SEQ ID NO: 352704 - RNA, 22 nt, Bordetella pertussis
cugcaguuugaguacgacgccg

SEQ ID NO: 352705 - RNA, 18 nt, Bordetella pertussis
cugcauacccauggccaa

SEQ ID NO: 352706 - RNA, 22 nt, Bordetella pertussis
cugcaucacgguaggcgcgucg

SEQ ID NO: 352707 - RNA, 19 nt, Bordetella pertussis
cugcauccggcccagcgcc

SEQ ID NO: 352708 - RNA, 16 nt, Bordetella pertussis
cugcaugaccgccgcc

SEQ ID NO: 352709 - RNA, 17 nt, Bordetella pertussis
cugcaugaccgccgcca

SEQ ID NO: 352710 - RNA, 22 nt, Bordetella pertussis
cugcaugaccgccgccagcagc

SEQ ID NO: 352711 - RNA, 15 nt, Bordetella pertussis
cugcaugauggcccg

SEQ ID NO: 352712 - RNA, 19 nt, Bordetella pertussis
cugcaugccccaacggcgc

SEQ ID NO: 352713 - RNA, 23 nt, Bordetella pertussis
cugcaugccccaacggcgcaccg

SEQ ID NO: 352714 - RNA, 15 nt, Bordetella pertussis
cugcaugcgcgaacg

SEQ ID NO: 352715 - RNA, 20 nt, Bordetella pertussis
cugcaugcgcgaacgcgcgc

SEQ ID NO: 352716 - RNA, 21 nt, Bordetella pertussis
cugcaugcgcgaacgcgcgcc

SEQ ID NO: 352717 - RNA, 22 nt, Bordetella pertussis
cugcaugcgcgaacgcgcgccg

SEQ ID NO: 352718 - RNA, 23 nt, Bordetella pertussis
cugcaugcgcgaacgcgcgccgg

SEQ ID NO: 352719 - RNA, 12 nt, Bordetella pertussis
cugcaugucgua

SEQ ID NO: 352720 - RNA, 19 nt, Bordetella pertussis
cugcaugucguacaggccg

SEQ ID NO: 352721 - RNA, 12 nt, Bordetella pertussis
cugccaagcgcc

SEQ ID NO: 352722 - RNA, 18 nt, Bordetella pertussis
cugccaauagcgguggcg

SEQ ID NO: 352723 - RNA, 22 nt, Bordetella pertussis
cugccacacgcgguagguagcg

SEQ ID NO: 352724 - RNA, 21 nt, Bordetella pertussis
cugccacagcgugacggcggc

SEQ ID NO: 352725 - RNA, 15 nt, Bordetella pertussis
cugccacaucacgcc

SEQ ID NO: 352726 - RNA, 16 nt, Bordetella pertussis
cugccaccagcgcgcc

SEQ ID NO: 352727 - RNA, 17 nt, Bordetella pertussis
cugccaccagcgcgcca

SEQ ID NO: 352728 - RNA, 21 nt, Bordetella pertussis
cugccaccagcgcgccagcag

SEQ ID NO: 352729 - RNA, 16 nt, Bordetella pertussis
cugccacaucgaaggc

SEQ ID NO: 352730 - RNA, 14 nt, Bordetella pertussis
cugccagaacagcc

SEQ ID NO: 352731 - RNA, 18 nt, Bordetella pertussis
cugccagaacagccgcga

SEQ ID NO: 352732 - RNA, 20 nt, Bordetella pertussis
cugccagaacagccgcgagg

SEQ ID NO: 352733 - RNA, 15 nt, Bordetella pertussis
cugccagacggccag

SEQ ID NO: 352734 - RNA, 20 nt, Bordetella pertussis
cugccagacggccagcgcgc

SEQ ID NO: 352735 - RNA, 15 nt, Bordetella pertussis
cugccagcccaccag

SEQ ID NO: 352736 - RNA, 19 nt, Bordetella pertussis
cugccagcccaccagcgcc

SEQ ID NO: 352737 - RNA, 20 nt, Bordetella pertussis
cugccagcccaccagcgcca

SEQ ID NO: 352738 - RNA, 16 nt, Bordetella pertussis
cugccaggcgagcgcc

SEQ ID NO: 352739 - RNA, 21 nt, Bordetella pertussis
cugccaggcgccgcguccggc

SEQ ID NO: 352740 - RNA, 19 nt, Bordetella pertussis
cugccagggugcaccaggu

SEQ ID NO: 352741 - RNA, 15 nt, Bordetella pertussis
cugccaguaggcgcc

SEQ ID NO: 352742 - RNA, 16 nt, Bordetella pertussis
cugccaguugaaccgc

SEQ ID NO: 352743 - RNA, 19 nt, Bordetella pertussis
cugccaguugccgccgccg

SEQ ID NO: 352744 - RNA, 19 nt, Bordetella pertussis
cugccaguuguaguggugu

SEQ ID NO: 352745 - RNA, 17 nt, Bordetella pertussis
cugccauccucgucgcg

SEQ ID NO: 352746 - RNA, 15 nt, Bordetella pertussis
cugccaugccgcgcg

SEQ ID NO: 352747 - RNA, 16 nt, Bordetella pertussis
cugccaugccgcgcgc

SEQ ID NO: 352748 - RNA, 18 nt, Bordetella pertussis
cugccauggccccgggcg

SEQ ID NO: 352749 - RNA, 22 nt, Bordetella pertussis
cugccauucgucguagccgccg

SEQ ID NO: 352750 - RNA, 15 nt, Bordetella pertussis
cugccauugcgcggc

SEQ ID NO: 352751 - RNA, 23 nt, Bordetella pertussis
cugcccaccgccgcccgccaggc

SEQ ID NO: 352752 - RNA, 16 nt, Bordetella pertussis
cugcccaccgccgugg

SEQ ID NO: 352753 - RNA, 21 nt, Bordetella pertussis
cugcccaccgccguggccggc

SEQ ID NO: 352754 - RNA, 13 nt, Bordetella pertussis
cugcccagccaca

SEQ ID NO: 352755 - RNA, 15 nt, Bordetella pertussis
cugcccaggccagcg

SEQ ID NO: 352756 - RNA, 16 nt, Bordetella pertussis
cugcccaggccagcgc

SEQ ID NO: 352757 - RNA, 18 nt, Bordetella pertussis
cugcccauggcaagcgca

SEQ ID NO: 352758 - RNA, 14 nt, Bordetella pertussis
cugcccauggccug

SEQ ID NO: 352759 - RNA, 16 nt, Bordetella pertussis
cugcccauggccugca

SEQ ID NO: 352760 - RNA, 20 nt, Bordetella pertussis
cugcccauucccgcccugac

SEQ ID NO: 352761 - RNA, 22 nt, Bordetella pertussis
cugcccauucccgcccugacgc

SEQ ID NO: 352762 - RNA, 19 nt, Bordetella pertussis
cugccccagcuugucggcc

SEQ ID NO: 352763 - RNA, 23 nt, Bordetella pertussis
cugccccagcuugucggccgcgc

SEQ ID NO: 352764 - RNA, 13 nt, Bordetella pertussis
cugccccauccca

SEQ ID NO: 352765 - RNA, 15 nt, Bordetella pertussis
cugccccagcggcug

SEQ ID NO: 352766 - RNA, 20 nt, Bordetella pertussis
cugccccagcggcuggcgca

SEQ ID NO: 352767 - RNA, 23 nt, Bordetella pertussis
cugccccagcggcuggcgcacga

SEQ ID NO: 352768 - RNA, 16 nt, Bordetella pertussis
cugccccgccugcgcc

SEQ ID NO: 352769 - RNA, 17 nt, Bordetella pertussis
cugccccgccugcgcca

SEQ ID NO: 352770 - RNA, 22 nt, Bordetella pertussis
cugccccuauaccccguacuug

SEQ ID NO: 352771 - RNA, 19 nt, Bordetella pertussis
cugcccgaagcgcagcacc

SEQ ID NO: 352772 - RNA, 23 nt, Bordetella pertussis
cugcccgaagcgcagcaccaggu

SEQ ID NO: 352773 - RNA, 14 nt, Bordetella pertussis
cugcccgaagcggc

SEQ ID NO: 352774 - RNA, 19 nt, Bordetella pertussis
cugcccgaagcggcccggg

SEQ ID NO: 352775 - RNA, 22 nt, Bordetella pertussis
cugcccgaagcggcccgggugg

SEQ ID NO: 352776 - RNA, 14 nt, Bordetella pertussis
cugcccgacggcgc

SEQ ID NO: 352777 - RNA, 15 nt, Bordetella pertussis
cugcccgacggcgcc

SEQ ID NO: 352778 - RNA, 17 nt, Bordetella pertussis
cugcccgacggcgccga

SEQ ID NO: 352779 - RNA, 15 nt, Bordetella pertussis
cugcccgccuggucg

SEQ ID NO: 352780 - RNA, 19 nt, Bordetella pertussis
cugcccgccuggucgcugg

SEQ ID NO: 352781 - RNA, 24 nt, Bordetella pertussis
cugcccgccuggucgcuggcgccg

SEQ ID NO: 352782 - RNA, 23 nt, Bordetella pertussis
cugcccggcagggugacgggcug

SEQ ID NO: 352783 - RNA, 14 nt, Bordetella pertussis
cugcccgggcacca

SEQ ID NO: 352784 - RNA, 16 nt, Bordetella pertussis
cugcccgucuauggcc

SEQ ID NO: 352785 - RNA, 20 nt, Bordetella pertussis
cugcccgucuauggccugca

SEQ ID NO: 352786 - RNA, 15 nt, Bordetella pertussis
cugcccgucuuggcg

SEQ ID NO: 352787 - RNA, 13 nt, Bordetella pertussis
cugcccgugcggg

SEQ ID NO: 352788 - RNA, 20 nt, Bordetella pertussis
cugcccgugcgugugccugu

SEQ ID NO: 352789 - RNA, 16 nt, Bordetella pertussis
cugcccguucacgcgc

SEQ ID NO: 352790 - RNA, 22 nt, Bordetella pertussis
cugcccguucacgcgcagcguc

SEQ ID NO: 352791 - RNA, 13 nt, Bordetella pertussis
cugcccgucgggc

SEQ ID NO: 352792 - RNA, 20 nt, Bordetella pertussis
cugcccgucgggcaggucgg

SEQ ID NO: 352793 - RNA, 15 nt, Bordetella pertussis
cugcccucgggcgac

SEQ ID NO: 352794 - RNA, 16 nt, Bordetella pertussis
cugcccucgggcgaca

SEQ ID NO: 352795 - RNA, 18 nt, Bordetella pertussis
cugcccucggucagcgcc

SEQ ID NO: 352796 - RNA, 16 nt, Bordetella pertussis
cugcccucgcccgugc

SEQ ID NO: 352797 - RNA, 23 nt, Bordetella pertussis
cugcccugcggcuugggcccggc

SEQ ID NO: 352798 - RNA, 22 nt, Bordetella pertussis
cugcccuggacgucugagcgcc

SEQ ID NO: 352799 - RNA, 16 nt, Bordetella pertussis
cugcccuggcccaggc

SEQ ID NO: 352800 - RNA, 14 nt, Bordetella pertussis
cugccgaaacgcug

SEQ ID NO: 352801 - RNA, 20 nt, Bordetella pertussis
cuggagaucgccgccgaagc

SEQ ID NO: 352802 - RNA, 12 nt, Bordetella pertussis
cuggagaugggu

SEQ ID NO: 352803 - RNA, 23 nt, Bordetella pertussis
cuggagauggguacagcgcgccc

SEQ ID NO: 352804 - RNA, 19 nt, Bordetella pertussis
cuggagcgccacgccguca

SEQ ID NO: 352805 - RNA, 14 nt, Bordetella pertussis
cuggagcgcggcgg

SEQ ID NO: 352806 - RNA, 11 nt, Bordetella pertussis
cuggaggccgg

SEQ ID NO: 352807 - RNA, 13 nt, Bordetella pertussis
cuggagucgggcu

SEQ ID NO: 352808 - RNA, 21 nt, Bordetella pertussis
cuggaucacgugccagccgaa

SEQ ID NO: 352809 - RNA, 15 nt, Bordetella pertussis
cuggaucaggauggg

SEQ ID NO: 352810 - RNA, 20 nt, Bordetella pertussis
cuggcaaucgggguggcgcc

SEQ ID NO: 352811 - RNA, 17 nt, Bordetella pertussis
cuggcaaugcguggccg

SEQ ID NO: 352812 - RNA, 18 nt, Bordetella pertussis
cuggcaaugcguggccgg

SEQ ID NO: 352813 - RNA, 17 nt, Bordetella pertussis
cuggcaaugguccagca

SEQ ID NO: 352814 - RNA, 18 nt, Bordetella pertussis
cuggcaaugguccagcag

SEQ ID NO: 352815 - RNA, 13 nt, Bordetella pertussis
cuggcacaccagc

SEQ ID NO: 352816 - RNA, 16 nt, Bordetella pertussis
cuggcacaccagcgcc

SEQ ID NO: 352817 - RNA, 14 nt, Bordetella pertussis
cuggcaccgcgacg

SEQ ID NO: 352818 - RNA, 20 nt, Bordetella pertussis
cuggcaccgcgacgaccccg

SEQ ID NO: 352819 - RNA, 21 nt, Bordetella pertussis
cuggcaccggccaagcuccag

SEQ ID NO: 352820 - RNA, 15 nt, Bordetella pertussis
cuggccaagcgcgcc

SEQ ID NO: 352821 - RNA, 17 nt, Bordetella pertussis
cuggccaagcgcgccgg

SEQ ID NO: 352822 - RNA, 17 nt, Bordetella pertussis
cuggccacaagcggccc

SEQ ID NO: 352823 - RNA, 16 nt, Bordetella pertussis
cuggccaccgucgcca

SEQ ID NO: 352824 - RNA, 13 nt, Bordetella pertussis
cuggccacgcugc

SEQ ID NO: 352825 - RNA, 19 nt, Bordetella pertussis
cuggccacguugucgcgcg

SEQ ID NO: 352826 - RNA, 17 nt, Bordetella pertussis
cuggccacuggccgcgc

SEQ ID NO: 352827 - RNA, 18 nt, Bordetella pertussis
cuggccagauagcccagg

SEQ ID NO: 352828 - RNA, 23 nt, Bordetella pertussis
cuggccagccggcccagcaugcc

SEQ ID NO: 352829 - RNA, 14 nt, Bordetella pertussis
cuggcccaggccga

SEQ ID NO: 352830 - RNA, 22 nt, Bordetella pertussis
cuggcccaguucgcgcagcagc

SEQ ID NO: 352831 - RNA, 14 nt, Bordetella pertussis
cuggccccaggcgc

SEQ ID NO: 352832 - RNA, 21 nt, Bordetella pertussis
cuggcccgccagcaaggcggc

SEQ ID NO: 352833 - RNA, 23 nt, Bordetella pertussis
cuggcccgccagcaaggcggcaa

SEQ ID NO: 352834 - RNA, 16 nt, Bordetella pertussis
cuggcccgcgcgagcg

SEQ ID NO: 352835 - RNA, 18 nt, Bordetella pertussis
cuggcccggcaccgucca

SEQ ID NO: 352836 - RNA, 15 nt, Bordetella pertussis
cuggcccuggcagac

SEQ ID NO: 352837 - RNA, 21 nt, Bordetella pertussis
cuggcccuuggucugcaggcu

SEQ ID NO: 352838 - RNA, 18 nt, Bordetella pertussis
cuggccgccugcugcgcc

SEQ ID NO: 352839 - RNA, 19 nt, Bordetella pertussis
cuggccgccugcugcgccg

SEQ ID NO: 352840 - RNA, 12 nt, Bordetella pertussis
cuggccgcgaca

SEQ ID NO: 352841 - RNA, 11 nt, Bordetella pertussis
cuggccgcgcc

SEQ ID NO: 352842 - RNA, 18 nt, Bordetella pertussis
cuggccgcgccgcuggcg

SEQ ID NO: 352843 - RNA, 20 nt, Bordetella pertussis
cuggccgcgccgcuggcggc

SEQ ID NO: 352844 - RNA, 17 nt, Bordetella pertussis
cuggccgcgcuggcggc

SEQ ID NO: 352845 - RNA, 20 nt, Bordetella pertussis
cuggccgcgcuggcggcgca

SEQ ID NO: 352846 - RNA, 13 nt, Bordetella pertussis
cuggccgcgccgu

SEQ ID NO: 352847 - RNA, 13 nt, Bordetella pertussis
cuggccggccaac

SEQ ID NO: 352848 - RNA, 14 nt, Bordetella pertussis
cuggccggccaaca

SEQ ID NO: 352849 - RNA, 23 nt, Bordetella pertussis
cuggccggccaacagcucgcgcc

SEQ ID NO: 352850 - RNA, 14 nt, Bordetella pertussis
cuggccggccgcgu

SEQ ID NO: 352851 - RNA, 16 nt, Bordetella pertussis
cuggccggccuggcgc

SEQ ID NO: 352852 - RNA, 16 nt, Bordetella pertussis
cuggccggcguggccu

SEQ ID NO: 352853 - RNA, 17 nt, Bordetella pertussis
cuggccugccgcgccga

SEQ ID NO: 352854 - RNA, 19 nt, Bordetella pertussis
cuggccugccgcgccgacc

SEQ ID NO: 352855 - RNA, 13 nt, Bordetella pertussis
cuggccugcgccg

SEQ ID NO: 352856 - RNA, 15 nt, Bordetella pertussis
cuggccugcgccgcc

SEQ ID NO: 352857 - RNA, 13 nt, Bordetella pertussis
cuggccuucgacc

SEQ ID NO: 352858 - RNA, 16 nt, Bordetella pertussis
cuggccuucgaccugc

SEQ ID NO: 352859 - RNA, 15 nt, Bordetella pertussis
cuggccuucuucacg

SEQ ID NO: 352860 - RNA, 14 nt, Bordetella pertussis
cuggccuggccgcc

SEQ ID NO: 352861 - RNA, 18 nt, Bordetella pertussis
cuggccugucugguggcg

SEQ ID NO: 352862 - RNA, 22 nt, Bordetella pertussis
cuggcgaacaguugcaccagug

SEQ ID NO: 352863 - RNA, 18 nt, Bordetella pertussis
cuggcgaagaacaccgcc

SEQ ID NO: 352864 - RNA, 22 nt, Bordetella pertussis
cuggcgaagaacaccgccgcgc

SEQ ID NO: 352865 - RNA, 21 nt, Bordetella pertussis
cuggcgaagaccgugaucggc

SEQ ID NO: 352866 - RNA, 23 nt, Bordetella pertussis
cuggcgaagaccgugaucggcgc

SEQ ID NO: 352867 - RNA, 17 nt, Bordetella pertussis
cuggcgagcacccgcag

SEQ ID NO: 352868 - RNA, 22 nt, Bordetella pertussis
cuggcgagcacccgcaggcggc

SEQ ID NO: 352869 - RNA, 17 nt, Bordetella pertussis
cuggcgaggaccugacc

SEQ ID NO: 352870 - RNA, 19 nt, Bordetella pertussis
cuggcgaucaccgacagcg

SEQ ID NO: 352871 - RNA, 20 nt, Bordetella pertussis
cuggcgaucaccgacagcgc

SEQ ID NO: 352872 - RNA, 22 nt, Bordetella pertussis
cuggcgaucaccgacagcgcca

SEQ ID NO: 352873 - RNA, 14 nt, Bordetella pertussis
cuggcgaucacggc

SEQ ID NO: 352874 - RNA, 16 nt, Bordetella pertussis
cuggcgaucacggcca

SEQ ID NO: 352875 - RNA, 17 nt, Bordetella pertussis
cuggcgaucacggccaa

SEQ ID NO: 352876 - RNA, 15 nt, Bordetella pertussis
cuggcgaucaggccg

SEQ ID NO: 352877 - RNA, 14 nt, Bordetella pertussis
cuggcgcaaggacg

SEQ ID NO: 352878 - RNA, 13 nt, Bordetella pertussis
cuggcgcaaggcg

SEQ ID NO: 352879 - RNA, 14 nt, Bordetella pertussis
cuggcgcagcacgc

SEQ ID NO: 352880 - RNA, 21 nt, Bordetella pertussis
cuggcgcagcacgccgcgcca

SEQ ID NO: 352881 - RNA, 24 nt, Bordetella pertussis
cuggcgcagcacgccgcgccaggc

SEQ ID NO: 352882 - RNA, 16 nt, Bordetella pertussis
cuggcgcagcagcgcc

SEQ ID NO: 352883 - RNA, 18 nt, Bordetella pertussis
cuggcgcagcaggcgcgc

SEQ ID NO: 352884 - RNA, 14 nt, Bordetella pertussis
cuggcgcacgauga

SEQ ID NO: 352885 - RNA, 16 nt, Bordetella pertussis
cuggcgcagcaaggcg

SEQ ID NO: 352886 - RNA, 19 nt, Bordetella pertussis
cuggcgcagcaaggcgcgc

SEQ ID NO: 352887 - RNA, 14 nt, Bordetella pertussis
cuggcgcaggccgg

SEQ ID NO: 352888 - RNA, 18 nt, Bordetella pertussis
cuggcgcaggccggcggc

SEQ ID NO: 352889 - RNA, 22 nt, Bordetella pertussis
cuggcgcaggccggcggccagc

SEQ ID NO: 352890 - RNA, 23 nt, Bordetella pertussis
cuggcgcaggccggcggccagcg

SEQ ID NO: 352891 - RNA, 20 nt, Bordetella pertussis
cuggcgcaguaucccggcca

SEQ ID NO: 352892 - RNA, 14 nt, Bordetella pertussis
cuggcgcauggccg

SEQ ID NO: 352893 - RNA, 19 nt, Bordetella pertussis
cuggcgcauggccggcgug

SEQ ID NO: 352894 - RNA, 13 nt, Bordetella pertussis
cuggcgcaggccg

SEQ ID NO: 352895 - RNA, 13 nt, Bordetella pertussis
cuggcgcccacgc

SEQ ID NO: 352896 - RNA, 19 nt, Bordetella pertussis
cuggcgcccgacggcgccg

SEQ ID NO: 352897 - RNA, 12 nt, Bordetella pertussis
cuggcgcccggc

SEQ ID NO: 352898 - RNA, 15 nt, Bordetella pertussis
cuggcgcccggcggc

SEQ ID NO: 352899 - RNA, 20 nt, Bordetella pertussis
cuggcgcccggcggcgcgcu

SEQ ID NO: 352900 - RNA, 16 nt, Bordetella pertussis
cuggcgccguucgucg

SEQ ID NO: 352901 - RNA, 23 nt, Bordetella pertussis
cuggcgccguucgucgcgcagca

SEQ ID NO: 352902 - RNA, 16 nt, Bordetella pertussis
cuggcgcgagaccacg

SEQ ID NO: 352903 - RNA, 15 nt, Bordetella pertussis
cuggcgcgaggcggc

SEQ ID NO: 352904 - RNA, 17 nt, Bordetella pertussis
cuggcgcgaggcggcga

SEQ ID NO: 352905 - RNA, 23 nt, Bordetella pertussis
cuggcgcgaggcggcgacgcagc

SEQ ID NO: 352906 - RNA, 20 nt, Bordetella pertussis
cuggcgcgcaccaucgccga

SEQ ID NO: 352907 - RNA, 18 nt, Bordetella pertussis
cuggcgcgcaccaugggc

SEQ ID NO: 352908 - RNA, 17 nt, Bordetella pertussis
cuggcgcgcaucggcgc

SEQ ID NO: 352909 - RNA, 18 nt, Bordetella pertussis
cuggcgcgcaucggcgcc

SEQ ID NO: 352910 - RNA, 20 nt, Bordetella pertussis
cuggcgcgcaucggcgccga

SEQ ID NO: 352911 - RNA, 16 nt, Bordetella pertussis
cuggcgcgccaggcga

SEQ ID NO: 352912 - RNA, 14 nt, Bordetella pertussis
cuggcgcgcccacu

SEQ ID NO: 352913 - RNA, 20 nt, Bordetella pertussis
cuggcgcgccgccucgcgcu

SEQ ID NO: 352914 - RNA, 14 nt, Bordetella pertussis
cuggcgcgacgccu

SEQ ID NO: 352915 - RNA, 18 nt, Bordetella pertussis
cuggcgcgacgccugcgc

SEQ ID NO: 352916 - RNA, 20 nt, Bordetella pertussis
cuggcgcgagaaccaggcca

SEQ ID NO: 352917 - RNA, 21 nt, Bordetella pertussis
cuggcgcgagaaccaggccac

SEQ ID NO: 352918 - RNA, 17 nt, Bordetella pertussis
cuggcgcgcgcaagccg

SEQ ID NO: 352919 - RNA, 19 nt, Bordetella pertussis
cuggcgcgcggccgcgucg

SEQ ID NO: 352920 - RNA, 21 nt, Bordetella pertussis
cuggcgcgcggccugggcggc

SEQ ID NO: 352921 - RNA, 16 nt, Bordetella pertussis
cuggcgcgucaggccg

SEQ ID NO: 352922 - RNA, 17 nt, Bordetella pertussis
cuggcgcgucaggccgg

SEQ ID NO: 352923 - RNA, 20 nt, Bordetella pertussis
cuggcgcgucaggccgggca

SEQ ID NO: 352924 - RNA, 13 nt, Bordetella pertussis
cuggcgcggcggc

SEQ ID NO: 352925 - RNA, 13 nt, Bordetella pertussis
cuggcgcggcugg

SEQ ID NO: 352926 - RNA, 17 nt, Bordetella pertussis
cuggcgcgguccacgcg

SEQ ID NO: 352927 - RNA, 17 nt, Bordetella pertussis
cuggcgcgucggcgcgc

SEQ ID NO: 352928 - RNA, 20 nt, Bordetella pertussis
cuggcgcgucggcgcgcgcg

SEQ ID NO: 352929 - RNA, 13 nt, Bordetella pertussis
cuggcgcgucugg

SEQ ID NO: 352930 - RNA, 17 nt, Bordetella pertussis
cuggcgcuccucgcgcg

SEQ ID NO: 352931 - RNA, 19 nt, Bordetella pertussis
cuggcgcuccucgcgcgcg

SEQ ID NO: 352932 - RNA, 17 nt, Bordetella pertussis
cuggcgcucgggcgcgg

SEQ ID NO: 352933 - RNA, 18 nt, Bordetella pertussis
cuggcgcucgggcgcggc

SEQ ID NO: 352934 - RNA, 11 nt, Bordetella pertussis
cuggcgcugcc

SEQ ID NO: 352935 - RNA, 17 nt, Bordetella pertussis
cuggcgcugccgaccag

SEQ ID NO: 352936 - RNA, 20 nt, Bordetella pertussis
cuggcgcuguuuccgggccu

SEQ ID NO: 352937 - RNA, 22 nt, Bordetella pertussis
cuggcgcuguuuccgggccugg

SEQ ID NO: 352938 - RNA, 17 nt, Bordetella pertussis
cuggcgcuuggccagcu

SEQ ID NO: 352939 - RNA, 17 nt, Bordetella pertussis
cuggcggaucucggcca

SEQ ID NO: 352940 - RNA, 21 nt, Bordetella pertussis
cuggcggaucucggccagcag

SEQ ID NO: 352941 - RNA, 23 nt, Bordetella pertussis
cuggcggaucucggccagcagcg

SEQ ID NO: 352942 - RNA, 14 nt, Bordetella pertussis
cuggcggacgaugg

SEQ ID NO: 352943 - RNA, 17 nt, Bordetella pertussis
cuggcggcagcucgcgc

SEQ ID NO: 352944 - RNA, 19 nt, Bordetella pertussis
cuggcggcagcucgcgcug

SEQ ID NO: 352945 - RNA, 16 nt, Bordetella pertussis
cuggcggccgcccagc

SEQ ID NO: 352946 - RNA, 17 nt, Bordetella pertussis
cuggcggccgcccagca

SEQ ID NO: 352947 - RNA, 20 nt, Bordetella pertussis
cuggcggcgcagcaccaggc

SEQ ID NO: 352948 - RNA, 22 nt, Bordetella pertussis
cuggcggcgcaggccgcgccgg

SEQ ID NO: 352949 - RNA, 18 nt, Bordetella pertussis
cuggcggcgcgcggcugg

SEQ ID NO: 352950 - RNA, 14 nt, Bordetella pertussis
cuggcggcugguca

SEQ ID NO: 352951 - RNA, 19 nt, Bordetella pertussis
cuggcggcugucgggcggc

SEQ ID NO: 352952 - RNA, 21 nt, Bordetella pertussis
cuggcggcugucgggcggcgc

SEQ ID NO: 352953 - RNA, 15 nt, Bordetella pertussis
cuggcgggccugggc

SEQ ID NO: 352954 - RNA, 20 nt, Bordetella pertussis
cuggcgggugcugcagcgca

SEQ ID NO: 352955 - RNA, 20 nt, Bordetella pertussis
cuggcgguaugcggcgccca

SEQ ID NO: 352956 - RNA, 22 nt, Bordetella pertussis
cuggcgguaugcggcgcccagg

SEQ ID NO: 352957 - RNA, 23 nt, Bordetella pertussis
cuggcgguaugcggcgcccaggc

SEQ ID NO: 352958 - RNA, 23 nt, Bordetella pertussis
cuggcggugcgugcgcccauggc

SEQ ID NO: 352959 - RNA, 16 nt, Bordetella pertussis
cuggcguagggcugca

SEQ ID NO: 352960 - RNA, 22 nt, Bordetella pertussis
cuggcguccagccugcccgggc

SEQ ID NO: 352961 - RNA, 14 nt, Bordetella pertussis
cuggcgucgcgcuu

SEQ ID NO: 352962 - RNA, 14 nt, Bordetella pertussis
cuggcguggcgcgc

SEQ ID NO: 352963 - RNA, 17 nt, Bordetella pertussis
cuggcguggcgcgcgcc

SEQ ID NO: 352964 - RNA, 16 nt, Bordetella pertussis
cuggcguucggcaccg

SEQ ID NO: 352965 - RNA, 18 nt, Bordetella pertussis
cuggcguucggcaccggc

SEQ ID NO: 352966 - RNA, 13 nt, Bordetella pertussis
cuggcguucgucg

SEQ ID NO: 352967 - RNA, 15 nt, Bordetella pertussis
cuggcguucgucgcc

SEQ ID NO: 352968 - RNA, 16 nt, Bordetella pertussis
cuggcguucgucgccu

SEQ ID NO: 352969 - RNA, 18 nt, Bordetella pertussis
cuggcguuugcgcgcgcg

SEQ ID NO: 352970 - RNA, 20 nt, Bordetella pertussis
cuggcguuugcgcgcgcgcu

SEQ ID NO: 352971 - RNA, 23 nt, Bordetella pertussis
cuggcguuugcgcgcgcgcuggg

SEQ ID NO: 352972 - RNA, 17 nt, Bordetella pertussis
cuggcucagucggccug

SEQ ID NO: 352973 - RNA, 21 nt, Bordetella pertussis
cuggcucagucggccuggcgc

SEQ ID NO: 352974 - RNA, 21 nt, Bordetella pertussis
cuggcucccgagggaucagcc

SEQ ID NO: 352975 - RNA, 18 nt, Bordetella pertussis
cuggcucguucgcucggc

SEQ ID NO: 352976 - RNA, 20 nt, Bordetella pertussis
cuggcucguucgcucggcgu

SEQ ID NO: 352977 - RNA, 20 nt, Bordetella pertussis
cuggcucuccgugcaucggc

SEQ ID NO: 352978 - RNA, 21 nt, Bordetella pertussis
cuggcucuccgugcaucggca

SEQ ID NO: 352979 - RNA, 22 nt, Bordetella pertussis
cuggcucugaucgcgcuggacc

SEQ ID NO: 352980 - RNA, 21 nt, Bordetella pertussis
cuggcugacgauguucaggcc

SEQ ID NO: 352981 - RNA, 14 nt, Bordetella pertussis
cuggcugagcaggc

SEQ ID NO: 352982 - RNA, 17 nt, Bordetella pertussis
cuggcugagcaggccga

SEQ ID NO: 352983 - RNA, 18 nt, Bordetella pertussis
cuggcugagcaggccgau

SEQ ID NO: 352984 - RNA, 22 nt, Bordetella pertussis
cuggcugagcgacaugucgccg

SEQ ID NO: 352985 - RNA, 17 nt, Bordetella pertussis
cuggcugaucacagccg

SEQ ID NO: 352986 - RNA, 20 nt, Bordetella pertussis
cuggcugaucacagccgcca

SEQ ID NO: 352987 - RNA, 15 nt, Bordetella pertussis
cuggcugcccuggcg

SEQ ID NO: 352988 - RNA, 13 nt, Bordetella pertussis
cuggcugcgcgcc

SEQ ID NO: 352989 - RNA, 16 nt, Bordetella pertussis
cuggcuggacgcgcgc

SEQ ID NO: 352990 - RNA, 15 nt, Bordetella pertussis
cuggcugggccugcu

SEQ ID NO: 352991 - RNA, 17 nt, Bordetella pertussis
cuggcugggcgcgccgc

SEQ ID NO: 352992 - RNA, 22 nt, Bordetella pertussis
cuggcuggccagccggcccagc

SEQ ID NO: 352993 - RNA, 15 nt, Bordetella pertussis
cuggcugugcccgcc

SEQ ID NO: 352994 - RNA, 15 nt, Bordetella pertussis
cuggcuucccggucc

SEQ ID NO: 352995 - RNA, 16 nt, Bordetella pertussis
cuggcuucccggucca

SEQ ID NO: 352996 - RNA, 18 nt, Bordetella pertussis
cuggcuucggcgcugggc

SEQ ID NO: 352997 - RNA, 15 nt, Bordetella pertussis
cuggcuucgucgccg

SEQ ID NO: 352998 - RNA, 16 nt, Bordetella pertussis
cuggcuuacaggccca

SEQ ID NO: 352999 - RNA, 19 nt, Bordetella pertussis
cuggcuugcgccacgcccg

SEQ ID NO: 353000 - RNA, 22 nt, Bordetella pertussis
cugggacaggcacaccguggca

SEQ ID NO: 353001 - RNA, 19 nt, Bordetella pertussis
cugggccggcgcgcgcagg

SEQ ID NO: 353002 - RNA, 21 nt, Bordetella pertussis
cugggccgucaugcgccgucc

SEQ ID NO: 353003 - RNA, 18 nt, Bordetella pertussis
cugggcgaaacggccagc

SEQ ID NO: 353004 - RNA, 19 nt, Bordetella pertussis
cugggcgaaacggccagcg

SEQ ID NO: 353005 - RNA, 21 nt, Bordetella pertussis
cugggcgaauccaccggcgcg

SEQ ID NO: 353006 - RNA, 22 nt, Bordetella pertussis
cugggcgaauccaccggcgcgc

SEQ ID NO: 353007 - RNA, 22 nt, Bordetella pertussis
cugggcgagguagggcgcggcc

SEQ ID NO: 353008 - RNA, 14 nt, Bordetella pertussis
cugggcgccagcag

SEQ ID NO: 353009 - RNA, 16 nt, Bordetella pertussis
cugggcgccagcagca

SEQ ID NO: 353010 - RNA, 20 nt, Bordetella pertussis
cugggcgccaugcgcccggc

SEQ ID NO: 353011 - RNA, 22 nt, Bordetella pertussis
cugggcgucgaaggcggccggc

SEQ ID NO: 353012 - RNA, 17 nt, Bordetella pertussis
cugggcgucguccugca

SEQ ID NO: 353013 - RNA, 23 nt, Bordetella pertussis
cugggcgucguccugcagcaggg

SEQ ID NO: 353014 - RNA, 20 nt, Bordetella pertussis
cugggcgugaaaggccagcg

SEQ ID NO: 353015 - RNA, 21 nt, Bordetella pertussis
cugggcgugaaaggccagcgg

SEQ ID NO: 353016 - RNA, 22 nt, Bordetella pertussis
cugggcuguauagaugcgcggg

SEQ ID NO: 353017 - RNA, 21 nt, Bordetella pertussis
cugggcuugccggugcucggc

SEQ ID NO: 353018 - RNA, 14 nt, Bordetella pertussis
cuggggacgggcgc

SEQ ID NO: 353019 - RNA, 23 nt, Bordetella pertussis
cugggucagcuuccagaucgacc

SEQ ID NO: 353020 - RNA, 14 nt, Bordetella pertussis
cugggucaggucgc

SEQ ID NO: 353021 - RNA, 23 nt, Bordetella pertussis
cugggucaggucgcugcccagca

SEQ ID NO: 353022 - RNA, 19 nt, Bordetella pertussis
cugggucugcaccggcuug

SEQ ID NO: 353023 - RNA, 19 nt, Bordetella pertussis
cugggugcgccaaucggcg

SEQ ID NO: 353024 - RNA, 15 nt, Bordetella pertussis
cugggugcugccgcc

SEQ ID NO: 353025 - RNA, 20 nt, Bordetella pertussis
cuggguggccagcugcgugg

SEQ ID NO: 353026 - RNA, 13 nt, Bordetella pertussis
cugggugcgguca

SEQ ID NO: 353027 - RNA, 16 nt, Bordetella pertussis
cugguagugcggcgcc

SEQ ID NO: 353028 - RNA, 15 nt, Bordetella pertussis
cugguaguuggccag

SEQ ID NO: 353029 - RNA, 17 nt, Bordetella pertussis
cugguauccggcgcacg

SEQ ID NO: 353030 - RNA, 16 nt, Bordetella pertussis
cuggucaaccuggugu

SEQ ID NO: 353031 - RNA, 19 nt, Bordetella pertussis
cuggucaaccugguguucg

SEQ ID NO: 353032 - RNA, 15 nt, Bordetella pertussis
cuggucaagggcggc

SEQ ID NO: 353033 - RNA, 16 nt, Bordetella pertussis
cuggucagccgugucg

SEQ ID NO: 353034 - RNA, 13 nt, Bordetella pertussis
cuggucagcgccg

SEQ ID NO: 353035 - RNA, 14 nt, Bordetella pertussis
cuggucagcgccga

SEQ ID NO: 353036 - RNA, 16 nt, Bordetella pertussis
cuggucaggcggucga

SEQ ID NO: 353037 - RNA, 15 nt, Bordetella pertussis
cuggucagggcugca

SEQ ID NO: 353038 - RNA, 16 nt, Bordetella pertussis
cuggucagguugcgcc

SEQ ID NO: 353039 - RNA, 23 nt, Bordetella pertussis
cugguccaccaccuucagggcgc

SEQ ID NO: 353040 - RNA, 23 nt, Bordetella pertussis
cugguccaggcggugcguccagg

SEQ ID NO: 353041 - RNA, 16 nt, Bordetella pertussis
cugguccgccgcgacc

SEQ ID NO: 353042 - RNA, 22 nt, Bordetella pertussis
cuggucgaacgcuuccugggcc

SEQ ID NO: 353043 - RNA, 21 nt, Bordetella pertussis
cuggucgaaguagaacgccgg

SEQ ID NO: 353044 - RNA, 16 nt, Bordetella pertussis
cuggucgaccaggccg

SEQ ID NO: 353045 - RNA, 18 nt, Bordetella pertussis
cuggucgaccaggccggu

SEQ ID NO: 353046 - RNA, 14 nt, Bordetella pertussis
cuguaccgccgggu

SEQ ID NO: 353047 - RNA, 14 nt, Bordetella pertussis
cuguacggccggcu

SEQ ID NO: 353048 - RNA, 22 nt, Bordetella pertussis
cuguagaggcgcggcucgccgg

SEQ ID NO: 353049 - RNA, 18 nt, Bordetella pertussis
cuguaggcgccggcgccg

SEQ ID NO: 353050 - RNA, 18 nt, Bordetella pertussis
cuguaucguugucgcgcc

SEQ ID NO: 353051 - RNA, 20 nt, Bordetella pertussis
cuguaucguugucgcgccgc

SEQ ID NO: 353052 - RNA, 19 nt, Bordetella pertussis
cugucgcgccacggcuucg

SEQ ID NO: 353053 - RNA, 12 nt, Bordetella pertussis
cugucgcgcgca

SEQ ID NO: 353054 - RNA, 15 nt, Bordetella pertussis
cugucgcgcuacagc

SEQ ID NO: 353055 - RNA, 19 nt, Bordetella pertussis
cugucgcgcuacagcgugg

SEQ ID NO: 353056 - RNA, 13 nt, Bordetella pertussis
cugucgcgcugcu

SEQ ID NO: 353057 - RNA, 19 nt, Bordetella pertussis
cugucgcucaugaccagcg

SEQ ID NO: 353058 - RNA, 22 nt, Bordetella pertussis
cugucgcucaugaccagcggcg

SEQ ID NO: 353059 - RNA, 14 nt, Bordetella pertussis
cugucgcugaucug

SEQ ID NO: 353060 - RNA, 13 nt, Bordetella pertussis
cugucggcguucc

SEQ ID NO: 353061 - RNA, 15 nt, Bordetella pertussis
cugucggcguuccug

SEQ ID NO: 353062 - RNA, 19 nt, Bordetella pertussis
cugucggcguuccuggcgc

SEQ ID NO: 353063 - RNA, 22 nt, Bordetella pertussis
cugucgggcggcggcguggcgg

SEQ ID NO: 353064 - RNA, 20 nt, Bordetella pertussis
cugugccccacacgcgcgca

SEQ ID NO: 353065 - RNA, 23 nt, Bordetella pertussis
cugugcccgcagagggagcgaca

SEQ ID NO: 353066 - RNA, 16 nt, Bordetella pertussis
cugugccagcuggccc

SEQ ID NO: 353067 - RNA, 19 nt, Bordetella pertussis
cugugcgacgauccggcga

SEQ ID NO: 353068 - RNA, 20 nt, Bordetella pertussis
cugugcgauggcacggcacg

SEQ ID NO: 353069 - RNA, 15 nt, Bordetella pertussis
cuguggccgcggccc

SEQ ID NO: 353070 - RNA, 20 nt, Bordetella pertussis
cuguggccgcggcccagcgc

SEQ ID NO: 353071 - RNA, 19 nt, Bordetella pertussis
cuguguaccccgaucggga

SEQ ID NO: 353072 - RNA, 15 nt, Bordetella pertussis
cuguguccacgaacg

SEQ ID NO: 353073 - RNA, 19 nt, Bordetella pertussis
cugugugcauuuuccucgg

SEQ ID NO: 353074 - RNA, 21 nt, Bordetella pertussis
cugugugcauuuuccucggcg

SEQ ID NO: 353075 - RNA, 15 nt, Bordetella pertussis
cuguguugauccgcc

SEQ ID NO: 353076 - RNA, 19 nt, Bordetella pertussis
cuguuucccuuccuggcca

SEQ ID NO: 353077 - RNA, 19 nt, Bordetella pertussis
cuguuuccgggccuggccu

SEQ ID NO: 353078 - RNA, 23 nt, Bordetella pertussis
cuguuuccgggccuggccugcgc

SEQ ID NO: 353079 - RNA, 13 nt, Bordetella pertussis
cuucagccagcga

SEQ ID NO: 353080 - RNA, 18 nt, Bordetella pertussis
cuucagcccggcgcgcca

SEQ ID NO: 353081 - RNA, 15 nt, Bordetella pertussis
cuucagccugggccu

SEQ ID NO: 353082 - RNA, 13 nt, Bordetella pertussis
cuucaggcgcgcg

SEQ ID NO: 353083 - RNA, 14 nt, Bordetella pertussis
cuucagguagccga

SEQ ID NO: 353084 - RNA, 19 nt, Bordetella pertussis
cuucagguagguggacacg

SEQ ID NO: 353085 - RNA, 17 nt, Bordetella pertussis
cuuccagaucgaccagg

SEQ ID NO: 353086 - RNA, 22 nt, Bordetella pertussis
cuuccagcagcaugccgcggug

SEQ ID NO: 353087 - RNA, 20 nt, Bordetella pertussis
cuuccagcgcauuggugagc

SEQ ID NO: 353088 - RNA, 13 nt, Bordetella pertussis
cuuccagcgcccg

SEQ ID NO: 353089 - RNA, 16 nt, Bordetella pertussis
cuuccagcgcccgcgg

SEQ ID NO: 353090 - RNA, 17 nt, Bordetella pertussis
cuuccaggcgcccgcca

SEQ ID NO: 353091 - RNA, 21 nt, Bordetella pertussis
cuuccaggaguucccagcgcg

SEQ ID NO: 353092 - RNA, 15 nt, Bordetella pertussis
cuuccaguucgcuuu

SEQ ID NO: 353093 - RNA, 14 nt, Bordetella pertussis
cuuccgcacgccga

SEQ ID NO: 353094 - RNA, 22 nt, Bordetella pertussis
cuuccgcacgccgaccuggcgc

SEQ ID NO: 353095 - RNA, 14 nt, Bordetella pertussis
cuuccggcagcggc

SEQ ID NO: 353096 - RNA, 18 nt, Bordetella pertussis
cuuccggccgggccagua

SEQ ID NO: 353097 - RNA, 15 nt, Bordetella pertussis
cuuccgggcccgcgc

SEQ ID NO: 353098 - RNA, 14 nt, Bordetella pertussis
cuuccugggcgccg

SEQ ID NO: 353099 - RNA, 14 nt, Bordetella pertussis
cuuccugggugcgc

SEQ ID NO: 353100 - RNA, 16 nt, Bordetella pertussis
cuuccuggugggcggc

SEQ ID NO: 353101 - RNA, 16 nt, Bordetella pertussis
cuuccuugcgaugcca

SEQ ID NO: 353102 - RNA, 15 nt, Bordetella pertussis
cuuccuuggucagcg

SEQ ID NO: 353103 - RNA, 15 nt, Bordetella pertussis
cuucgacagcgcgca

SEQ ID NO: 353104 - RNA, 16 nt, Bordetella pertussis
cuucgauggcggcggc

SEQ ID NO: 353105 - RNA, 20 nt, Bordetella pertussis
cuucgcccccgauccccugc

SEQ ID NO: 353106 - RNA, 21 nt, Bordetella pertussis
cuucgcccgcauagacgccga

SEQ ID NO: 353107 - RNA, 21 nt, Bordetella pertussis
cuucgcgguaaccggcgauaa

SEQ ID NO: 353108 - RNA, 21 nt, Bordetella pertussis
cuucgcgguaggacggcagca

SEQ ID NO: 353109 - RNA, 20 nt, Bordetella pertussis
cuucggcaaccgcgccucgu

SEQ ID NO: 353110 - RNA, 19 nt, Bordetella pertussis
cuucggcagcuuguagcgc

SEQ ID NO: 353111 - RNA, 15 nt, Bordetella pertussis
cuucggcggccgcgu

SEQ ID NO: 353112 - RNA, 13 nt, Bordetella pertussis
cuucggcggcggg

SEQ ID NO: 353113 - RNA, 23 nt, Bordetella pertussis
cuucguaaacaucgcgcauggcg

SEQ ID NO: 353114 - RNA, 14 nt, Bordetella pertussis
cuucguccggcgcg

SEQ ID NO: 353115 - RNA, 18 nt, Bordetella pertussis
cuucguccugccauugcg

SEQ ID NO: 353116 - RNA, 12 nt, Bordetella pertussis
cuucgucggcgu

SEQ ID NO: 353117 - RNA, 15 nt, Bordetella pertussis
cuucgucggcgucga

SEQ ID NO: 353118 - RNA, 13 nt, Bordetella pertussis
cuucgucgggcag

SEQ ID NO: 353119 - RNA, 17 nt, Bordetella pertussis
cuucgugcagcgcgugg

SEQ ID NO: 353120 - RNA, 13 nt, Bordetella pertussis
cuucgugcggccg

SEQ ID NO: 353121 - RNA, 16 nt, Bordetella pertussis
cuucgugguggcgaaa

SEQ ID NO: 353122 - RNA, 23 nt, Bordetella pertussis
cuucguguucgcggccggacagg

SEQ ID NO: 353123 - RNA, 21 nt, Bordetella pertussis
cuugcucccaguucugcagcg

SEQ ID NO: 353124 - RNA, 16 nt, Bordetella pertussis
cuugcucgcccauggc

SEQ ID NO: 353125 - RNA, 18 nt, Bordetella pertussis
cuugcugaaccugcuggc

SEQ ID NO: 353126 - RNA, 16 nt, Bordetella pertussis
cuugcugcccgacggc

SEQ ID NO: 353127 - RNA, 17 nt, Bordetella pertussis
cuugcugcccgacggcg

SEQ ID NO: 353128 - RNA, 18 nt, Bordetella pertussis
cuugcuguccagucugga

SEQ ID NO: 353129 - RNA, 16 nt, Bordetella pertussis
cuugcuugccagcucg

SEQ ID NO: 353130 - RNA, 17 nt, Bordetella pertussis
cuuggccaccacgccca

SEQ ID NO: 353131 - RNA, 16 nt, Bordetella pertussis
cuuggccagcagcgca

SEQ ID NO: 353132 - RNA, 13 nt, Bordetella pertussis
cuuggcgaucucg

SEQ ID NO: 353133 - RNA, 17 nt, Bordetella pertussis
cuuggcgauggccgcca

SEQ ID NO: 353134 - RNA, 13 nt, Bordetella pertussis
cuuggcgcgccgg

SEQ ID NO: 353135 - RNA, 14 nt, Bordetella pertussis
cuuggcggccagga

SEQ ID NO: 353136 - RNA, 20 nt, Bordetella pertussis
cuuggcggccccgcgucggc

SEQ ID NO: 353137 - RNA, 18 nt, Bordetella pertussis
cuuggcggcuggcgcggc

SEQ ID NO: 353138 - RNA, 17 nt, Bordetella pertussis
cuuggcgucagcgugcg

SEQ ID NO: 353139 - RNA, 20 nt, Bordetella pertussis
cuuggcuugcagcgccucgg

SEQ ID NO: 353140 - RNA, 14 nt, Bordetella pertussis
cuugggaucggcca

SEQ ID NO: 353141 - RNA, 15 nt, Bordetella pertussis
cuugggaucguccca

SEQ ID NO: 353142 - RNA, 22 nt, Bordetella pertussis
cuugggaugcaggucggggcgc

SEQ ID NO: 353143 - RNA, 16 nt, Bordetella pertussis
cuugggacgcuucgag

SEQ ID NO: 353144 - RNA, 17 nt, Bordetella pertussis
cuugggccgcgccugca

SEQ ID NO: 353145 - RNA, 15 nt, Bordetella pertussis
cuugggcgcggcggc

SEQ ID NO: 353146 - RNA, 22 nt, Bordetella pertussis
cuuggggcggcccagcggcaaa

SEQ ID NO: 353147 - RNA, 22 nt, Bordetella pertussis
cuugggggcccacaugccgugc

SEQ ID NO: 353148 - RNA, 16 nt, Bordetella pertussis
cuuggucacggccucg

SEQ ID NO: 353149 - RNA, 13 nt, Bordetella pertussis
cuuggucagcgaa

SEQ ID NO: 353150 - RNA, 23 nt, Bordetella pertussis
cuuguccaucgcgugcagcgacu

SEQ ID NO: 353151 - RNA, 14 nt, Bordetella pertussis
cuuguccgccaccc

SEQ ID NO: 353152 - RNA, 23 nt, Bordetella pertussis
cuugucgaucgccaccagcguca

SEQ ID NO: 353153 - RNA, 21 nt, Bordetella pertussis
cuugucgcgcccgauggugca

SEQ ID NO: 353154 - RNA, 16 nt, Bordetella pertussis
cuuucaaagaucugcu

SEQ ID NO: 353155 - RNA, 19 nt, Bordetella pertussis
cuuucaaagaucugcuggc

SEQ ID NO: 353156 - RNA, 16 nt, Bordetella pertussis
aaccggucggccggca

SEQ ID NO: 353157 - RNA, 22 nt, Bordetella pertussis
aaccggucggccggcagcggcg

SEQ ID NO: 353158 - RNA, 14 nt, Bordetella pertussis
aaccgucgaccggc

SEQ ID NO: 353159 - RNA, 21 nt, Bordetella pertussis
cuuucaucaaacgcggcgccg

SEQ ID NO: 353160 - RNA, 17 nt, Bordetella pertussis
cuuucauuucggcgccg

SEQ ID NO: 353161 - RNA, 17 nt, Bordetella pertussis
cuuucccauccuggccg

SEQ ID NO: 353162 - RNA, 23 nt, Bordetella pertussis
cuuucccgcgccgagcggggccg

SEQ ID NO: 353163 - RNA, 15 nt, Bordetella pertussis
cuuucgcgcgcgccu

SEQ ID NO: 353164 - RNA, 16 nt, Bordetella pertussis
cuuuggccgcgcgccg

SEQ ID NO: 353165 - RNA, 21 nt, Bordetella pertussis
cuuuugcuugggggcguggca

SEQ ID NO: 353166 - RNA, 22 nt, Bordetella pertussis
cuuuuucuuuugcggcgcggcg

SEQ ID NO: 353167 - RNA, 17 nt, Bordetella pertussis
gaaaacagcaccagcau

SEQ ID NO: 353168 - RNA, 14 nt, Bordetella pertussis
gaaaaccggcgccu

SEQ ID NO: 353169 - RNA, 17 nt, Bordetella pertussis
gaaaaccggcgccuggc

SEQ ID NO: 353170 - RNA, 20 nt, Bordetella pertussis
gaaaagccggcggccgguca

SEQ ID NO: 353171 - RNA, 13 nt, Bordetella pertussis
aaccucgacgcgc

SEQ ID NO: 353172 - RNA, 14 nt, Bordetella pertussis
aaccucgacgcgca

SEQ ID NO: 353173 - RNA, 17 nt, Bordetella pertussis
aaccucgccgcgccagc

SEQ ID NO: 353174 - RNA, 15 nt, Bordetella pertussis
aaccugcacgcgggc

SEQ ID NO: 353175 - RNA, 23 nt, Bordetella pertussis
aaccugcuggccgccggcgcggu

SEQ ID NO: 353176 - RNA, 15 nt, Bordetella pertussis
gaaacccccugggug

SEQ ID NO: 353177 - RNA, 20 nt, Bordetella pertussis
gaaaccgccgcggcuugccg

SEQ ID NO: 353178 - RNA, 12 nt, Bordetella pertussis
gaaaccgcgucg

SEQ ID NO: 353179 - RNA, 13 nt, Bordetella pertussis
gaaacgcgcgcgc

SEQ ID NO: 353180 - RNA, 23 nt, Bordetella pertussis
gaaacgcggucaccgagcugagc

SEQ ID NO: 353181 - RNA, 20 nt, Bordetella pertussis
gaaacgcugcgcgaugcgcg

SEQ ID NO: 353182 - RNA, 14 nt, Bordetella pertussis
gaaacgcuggcgua

SEQ ID NO: 353183 - RNA, 15 nt, Bordetella pertussis
gaaauacgcgcgcgc

SEQ ID NO: 353184 - RNA, 19 nt, Bordetella pertussis
gaaaugccgaagcgcgcgu

SEQ ID NO: 353185 - RNA, 21 nt, Bordetella pertussis
gaaaugccgaagcgcgcgugc

SEQ ID NO: 353186 - RNA, 20 nt, Bordetella pertussis
gaaaugcguggcgugccgca

SEQ ID NO: 353187 - RNA, 14 nt, Bordetella pertussis
gaaauggcggcggu

SEQ ID NO: 353188 - RNA, 23 nt, Bordetella pertussis
gaaaugguguacagccgccuggc

SEQ ID NO: 353189 - RNA, 19 nt, Bordetella pertussis
gaaaugucgagcgcgaugc

SEQ ID NO: 353190 - RNA, 24 nt, Bordetella pertussis
gaacaagguacccgcgccggcggc

SEQ ID NO: 353191 - RNA, 23 nt, Bordetella pertussis
gaacaagguccaggcccggcaga

SEQ ID NO: 353192 - RNA, 16 nt, Bordetella pertussis
gaacagccgccccagc

SEQ ID NO: 353193 - RNA, 13 nt, Bordetella pertussis
gaacagccgcugc

SEQ ID NO: 353194 - RNA, 23 nt, Bordetella pertussis
gaacagcgagaagcaaccgauga

SEQ ID NO: 353195 - RNA, 14 nt, Bordetella pertussis
gaacagcgccggca

SEQ ID NO: 353196 - RNA, 17 nt, Bordetella pertussis
gaacagcggaucgccgg

SEQ ID NO: 353197 - RNA, 17 nt, Bordetella pertussis
gaacagcggcacgccgg

SEQ ID NO: 353198 - RNA, 18 nt, Bordetella pertussis
gaacagcggcacgccggc

SEQ ID NO: 353199 - RNA, 19 nt, Bordetella pertussis
gaacagcggcacgccggcg

SEQ ID NO: 353200 - RNA, 20 nt, Bordetella pertussis
gaacagcguccagccgcccg

SEQ ID NO: 353201 - RNA, 15 nt, Bordetella pertussis
gaaccacccggccau

SEQ ID NO: 353202 - RNA, 22 nt, Bordetella pertussis
gaaccacccggccaucgaagcc

SEQ ID NO: 353203 - RNA, 15 nt, Bordetella pertussis
gaaccagcggcuggc

SEQ ID NO: 353204 - RNA, 20 nt, Bordetella pertussis
gaaccagcggcuggcggugc

SEQ ID NO: 353205 - RNA, 21 nt, Bordetella pertussis
gaaccaguagcacacgccgau

SEQ ID NO: 353206 - RNA, 16 nt, Bordetella pertussis
gaaccagugcaggggg

SEQ ID NO: 353207 - RNA, 16 nt, Bordetella pertussis
gaaccccggcugcgcg

SEQ ID NO: 353208 - RNA, 22 nt, Bordetella pertussis
gaacccgccgcgaucagcgcgg

SEQ ID NO: 353209 - RNA, 13 nt, Bordetella pertussis
gaacccggccggc

SEQ ID NO: 353210 - RNA, 14 nt, Bordetella pertussis
gaacccggccggcg

SEQ ID NO: 353211 - RNA, 21 nt, Bordetella pertussis
gaacccggccggcgccggcaa

SEQ ID NO: 353212 - RNA, 16 nt, Bordetella pertussis
gaaccgaccgccacga

SEQ ID NO: 353213 - RNA, 19 nt, Bordetella pertussis
gaaccgaauuccggcucgg

SEQ ID NO: 353214 - RNA, 19 nt, Bordetella pertussis
gaaccgcaacgccagcagg

SEQ ID NO: 353215 - RNA, 22 nt, Bordetella pertussis
gaaccgcaccggaggcgccgcg

SEQ ID NO: 353216 - RNA, 16 nt, Bordetella pertussis
gaaccgcagcgccacc

SEQ ID NO: 353217 - RNA, 18 nt, Bordetella pertussis
gaaccgcagcgccaccgg

SEQ ID NO: 353218 - RNA, 21 nt, Bordetella pertussis
gaacgacaggguccagguggc

SEQ ID NO: 353219 - RNA, 16 nt, Bordetella pertussis
gaacgacucgucgacc

SEQ ID NO: 353220 - RNA, 16 nt, Bordetella pertussis
gaacgagccggccgcg

SEQ ID NO: 353221 - RNA, 19 nt, Bordetella pertussis
gaacgagccggccgcgccc

SEQ ID NO: 353222 - RNA, 20 nt, Bordetella pertussis
gaacgaggauauccaucugg

SEQ ID NO: 353223 - RNA, 16 nt, Bordetella pertussis
gaacgagguccgcaug

SEQ ID NO: 353224 - RNA, 22 nt, Bordetella pertussis
gaacgcgaacccgaucgcgaug

SEQ ID NO: 353225 - RNA, 23 nt, Bordetella pertussis
gaacgcgcauucgucgcugccgc

SEQ ID NO: 353226 - RNA, 18 nt, Bordetella pertussis
gaacgcgacagcgcuggu

SEQ ID NO: 353227 - RNA, 15 nt, Bordetella pertussis
gaacgcgccgcuggc

SEQ ID NO: 353228 - RNA, 14 nt, Bordetella pertussis
gaacgcgcgccggc

SEQ ID NO: 353229 - RNA, 16 nt, Bordetella pertussis
gaacgcgcgccggcca

SEQ ID NO: 353230 - RNA, 22 nt, Bordetella pertussis
gaacgcguucaagucgcccugc

SEQ ID NO: 353231 - RNA, 14 nt, Bordetella pertussis
gaacgcugaugcgc

SEQ ID NO: 353232 - RNA, 19 nt, Bordetella pertussis
gaacgcuuccugggccugc

SEQ ID NO: 353233 - RNA, 20 nt, Bordetella pertussis
gaacgcuuccugggccugcg

SEQ ID NO: 353234 - RNA, 18 nt, Bordetella pertussis
gaacgcuugacggccagg

SEQ ID NO: 353235 - RNA, 19 nt, Bordetella pertussis
gaacgcuugacggccagga

SEQ ID NO: 353236 - RNA, 21 nt, Bordetella pertussis
gaacgcuugacggccaggacg

SEQ ID NO: 353237 - RNA, 16 nt, Bordetella pertussis
gaacggaaacgcccag

SEQ ID NO: 353238 - RNA, 16 nt, Bordetella pertussis
gaacggcacgucgcgc

SEQ ID NO: 353239 - RNA, 18 nt, Bordetella pertussis
gaacggcagcagcgcgcc

SEQ ID NO: 353240 - RNA, 15 nt, Bordetella pertussis
gaacggcagcgcgcg

SEQ ID NO: 353241 - RNA, 15 nt, Bordetella pertussis
gaacgggcguggcgc

SEQ ID NO: 353242 - RNA, 14 nt, Bordetella pertussis
gaacggggacuggc

SEQ ID NO: 353243 - RNA, 19 nt, Bordetella pertussis
gaacggggccgccucggcg

SEQ ID NO: 353244 - RNA, 18 nt, Bordetella pertussis
gaacgggguggccggcgc

SEQ ID NO: 353245 - RNA, 23 nt, Bordetella pertussis
gaacgggguggccggcgcgcggc

SEQ ID NO: 353246 - RNA, 23 nt, Bordetella pertussis
gaacgucaccccgcccugcccgg

SEQ ID NO: 353247 - RNA, 16 nt, Bordetella pertussis
gaacucgaacacgccg

SEQ ID NO: 353248 - RNA, 14 nt, Bordetella pertussis
gaacucgaacgcgu

SEQ ID NO: 353249 - RNA, 18 nt, Bordetella pertussis
gaacugcaggccgccggc

SEQ ID NO: 353250 - RNA, 12 nt, Bordetella pertussis
gaacugccggcg

SEQ ID NO: 353251 - RNA, 14 nt, Bordetella pertussis
gaacugccggcgcg

SEQ ID NO: 353252 - RNA, 15 nt, Bordetella pertussis
gaacugccggcgcgg

SEQ ID NO: 353253 - RNA, 17 nt, Bordetella pertussis
gaacugcuugcgcgugc

SEQ ID NO: 353254 - RNA, 17 nt, Bordetella pertussis
gaacuggacggcgcugg

SEQ ID NO: 353255 - RNA, 16 nt, Bordetella pertussis
gaacugggacaggccc

SEQ ID NO: 353256 - RNA, 15 nt, Bordetella pertussis
gaaguggaaccgcgg

SEQ ID NO: 353257 - RNA, 16 nt, Bordetella pertussis
gaaguggucgcgcagg

SEQ ID NO: 353258 - RNA, 17 nt, Bordetella pertussis
gaaguugcggccgugcg

SEQ ID NO: 353259 - RNA, 13 nt, Bordetella pertussis
gaauaaucgccgg

SEQ ID NO: 353260 - RNA, 15 nt, Bordetella pertussis
gaauauccuggucga

SEQ ID NO: 353261 - RNA, 22 nt, Bordetella pertussis
gaauccggccagcacgccggcg

SEQ ID NO: 353262 - RNA, 18 nt, Bordetella pertussis
gaauccguaagcgcugga

SEQ ID NO: 353263 - RNA, 20 nt, Bordetella pertussis
gaauccucucgccccgacca

SEQ ID NO: 353264 - RNA, 16 nt, Bordetella pertussis
gaaucgcccgggcgcc

SEQ ID NO: 353265 - RNA, 15 nt, Bordetella pertussis
gaaugcggcgacagg

SEQ ID NO: 353266 - RNA, 19 nt, Bordetella pertussis
gaaugcguguuccagcgcc

SEQ ID NO: 353267 - RNA, 13 nt, Bordetella pertussis
gaauucggcgcgu

SEQ ID NO: 353268 - RNA, 13 nt, Bordetella pertussis
gaauuggcgccca

SEQ ID NO: 353269 - RNA, 13 nt, Bordetella pertussis
gaauuggcggcga

SEQ ID NO: 353270 - RNA, 14 nt, Bordetella pertussis
gacaaacccgacga

SEQ ID NO: 353271 - RNA, 22 nt, Bordetella pertussis
gacaacagcuugcccggcgugc

SEQ ID NO: 353272 - RNA, 12 nt, Bordetella pertussis
gacaacgcgcgc

SEQ ID NO: 353273 - RNA, 13 nt, Bordetella pertussis
gacaacggcgugc

SEQ ID NO: 353274 - RNA, 17 nt, Bordetella pertussis
gacaacggcgugcugcg

SEQ ID NO: 353275 - RNA, 12 nt, Bordetella pertussis
gacaacugcgcg

SEQ ID NO: 353276 - RNA, 14 nt, Bordetella pertussis
gacaaggcgcgcgc

SEQ ID NO: 353277 - RNA, 14 nt, Bordetella pertussis
gacaaugccccgca

SEQ ID NO: 353278 - RNA, 14 nt, Bordetella pertussis
gacaccaaccugcu

SEQ ID NO: 353279 - RNA, 19 nt, Bordetella pertussis
gacaccaaccugcuggcca

SEQ ID NO: 353280 - RNA, 13 nt, Bordetella pertussis
gacacccccaggg

SEQ ID NO: 353281 - RNA, 15 nt, Bordetella pertussis
gacacccuugcgcaa

SEQ ID NO: 353282 - RNA, 16 nt, Bordetella pertussis
gacaccgcggccuugc

SEQ ID NO: 353283 - RNA, 22 nt, Bordetella pertussis
gacaccgugcgauggaacucgu

SEQ ID NO: 353284 - RNA, 21 nt, Bordetella pertussis
gacaccguuuuggcaggcugg

SEQ ID NO: 353285 - RNA, 15 nt, Bordetella pertussis
gacacgcccuggccg

SEQ ID NO: 353286 - RNA, 13 nt, Bordetella pertussis
gacacgcccagca

SEQ ID NO: 353287 - RNA, 13 nt, Bordetella pertussis
gacacgccgcgcg

SEQ ID NO: 353288 - RNA, 21 nt, Bordetella pertussis
gacacgccgcgcgaucgccgc

SEQ ID NO: 353289 - RNA, 18 nt, Bordetella pertussis
gacacgcuagggcguggc

SEQ ID NO: 353290 - RNA, 20 nt, Bordetella pertussis
gacacgcuagggcguggcgc

SEQ ID NO: 353291 - RNA, 15 nt, Bordetella pertussis
gacacggcggugccg

SEQ ID NO: 353292 - RNA, 19 nt, Bordetella pertussis
gacacggcggugccgcgca

SEQ ID NO: 353293 - RNA, 19 nt, Bordetella pertussis
gacagauaccgccuuggcc

SEQ ID NO: 353294 - RNA, 19 nt, Bordetella pertussis
gacagauccagcgcggcca

SEQ ID NO: 353295 - RNA, 23 nt, Bordetella pertussis
gacagcaagaaucggggcguagc

SEQ ID NO: 353296 - RNA, 15 nt, Bordetella pertussis
gacagcaagggcguc

SEQ ID NO: 353297 - RNA, 17 nt, Bordetella pertussis
gacagcacauggcgcgc

SEQ ID NO: 353298 - RNA, 21 nt, Bordetella pertussis
gacagcacauggcgcgccggc

SEQ ID NO: 353299 - RNA, 16 nt, Bordetella pertussis
gacagcaaugacgacg

SEQ ID NO: 353300 - RNA, 19 nt, Bordetella pertussis
gacagcaccgacaggccga

SEQ ID NO: 353301 - RNA, 13 nt, Bordetella pertussis
gacagcacgcccg

SEQ ID NO: 353302 - RNA, 23 nt, Bordetella pertussis
gacagcacgcccgccagcagcuc

SEQ ID NO: 353303 - RNA, 19 nt, Bordetella pertussis
gacagcagcaugcggcccg

SEQ ID NO: 353304 - RNA, 20 nt, Bordetella pertussis
gacagcagcaugcggcccgc

SEQ ID NO: 353305 - RNA, 16 nt, Bordetella pertussis
gacagcagcccgcugg

SEQ ID NO: 353306 - RNA, 18 nt, Bordetella pertussis
gacagcagcccgcuggcc

SEQ ID NO: 353307 - RNA, 20 nt, Bordetella pertussis
gacagcagcccgcuggccga

SEQ ID NO: 353308 - RNA, 19 nt, Bordetella pertussis
gacagcgcucuauucggcc

SEQ ID NO: 353309 - RNA, 20 nt, Bordetella pertussis
gacagcgcugguggccagau

SEQ ID NO: 353310 - RNA, 14 nt, Bordetella pertussis
gacagcaggccggu

SEQ ID NO: 353311 - RNA, 15 nt, Bordetella pertussis
gacagcuugcgcugg

SEQ ID NO: 353312 - RNA, 22 nt, Bordetella pertussis
gacagcuugcgcuggcgcgcgg

SEQ ID NO: 353313 - RNA, 20 nt, Bordetella pertussis
gacaggaacuccggcggcgc

SEQ ID NO: 353314 - RNA, 21 nt, Bordetella pertussis
gacaggaacuccggcggcgca

SEQ ID NO: 353315 - RNA, 19 nt, Bordetella pertussis
aacgacgcaggcgccgcac

SEQ ID NO: 353316 - RNA, 16 nt, Bordetella pertussis
gacaggcccgcggccg

SEQ ID NO: 353317 - RNA, 17 nt, Bordetella pertussis
gacaggcccgcggccgc

SEQ ID NO: 353318 - RNA, 22 nt, Bordetella pertussis
gacaggcccucggugcggaaga

SEQ ID NO: 353319 - RNA, 20 nt, Bordetella pertussis
gacaggccgaugcuggucgc

SEQ ID NO: 353320 - RNA, 22 nt, Bordetella pertussis
gacaggccgaugcuggucgcca

SEQ ID NO: 353321 - RNA, 13 nt, Bordetella pertussis
gacaggcgcagcu

SEQ ID NO: 353322 - RNA, 13 nt, Bordetella pertussis
gacaggcgccgca

SEQ ID NO: 353323 - RNA, 19 nt, Bordetella pertussis
gacaggcgccucgcgacgg

SEQ ID NO: 353324 - RNA, 23 nt, Bordetella pertussis
gacauagagauuguccagcggca

SEQ ID NO: 353325 - RNA, 16 nt, Bordetella pertussis
gacaucgccgcugcgc

SEQ ID NO: 353326 - RNA, 22 nt, Bordetella pertussis
gacaugcacgauauuggcgucg

SEQ ID NO: 353327 - RNA, 14 nt, Bordetella pertussis
gacaugcccgccgg

SEQ ID NO: 353328 - RNA, 16 nt, Bordetella pertussis
gacaugcccgccggca

SEQ ID NO: 353329 - RNA, 16 nt, Bordetella pertussis
gaccacccgcgccagg

SEQ ID NO: 353330 - RNA, 22 nt, Bordetella pertussis
gaccaccgucuugcccgccagc

SEQ ID NO: 353331 - RNA, 23 nt, Bordetella pertussis
gaccaccgucuugcccgccagcg

SEQ ID NO: 353332 - RNA, 14 nt, Bordetella pertussis
gaccacgccggcgg

SEQ ID NO: 353333 - RNA, 19 nt, Bordetella pertussis
gaccacgccggcggccaug

SEQ ID NO: 353334 - RNA, 16 nt, Bordetella pertussis
gaccacgccggcgguc

SEQ ID NO: 353335 - RNA, 19 nt, Bordetella pertussis
gaccacgccggcggucacg

SEQ ID NO: 353336 - RNA, 19 nt, Bordetella pertussis
aacgccagcccgacggcca

SEQ ID NO: 353337 - RNA, 21 nt, Bordetella pertussis
aacgcccagguugcggccgcc

SEQ ID NO: 353338 - RNA, 13 nt, Bordetella pertussis
gaccacuggcaga

SEQ ID NO: 353339 - RNA, 22 nt, Bordetella pertussis
gaccacuggcagaccgagcgcg

SEQ ID NO: 353340 - RNA, 14 nt, Bordetella pertussis
gaccagcaccagcg

SEQ ID NO: 353341 - RNA, 19 nt, Bordetella pertussis
gaccagcaccagcgccugc

SEQ ID NO: 353342 - RNA, 21 nt, Bordetella pertussis
gaccagcaccagcgccugccg

SEQ ID NO: 353343 - RNA, 22 nt, Bordetella pertussis
gaccagcacgggaugcuccagc

SEQ ID NO: 353344 - RNA, 13 nt, Bordetella pertussis
gaccagcaggccc

SEQ ID NO: 353345 - RNA, 14 nt, Bordetella pertussis
gaccagcaggccca

SEQ ID NO: 353346 - RNA, 19 nt, Bordetella pertussis
gaccagcaggcccaccagg

SEQ ID NO: 353347 - RNA, 20 nt, Bordetella pertussis
gaccagcagcucggcgaucu

SEQ ID NO: 353348 - RNA, 14 nt, Bordetella pertussis
gaccagcgccggcg

SEQ ID NO: 353349 - RNA, 20 nt, Bordetella pertussis
gaccaggccggugcgcacau

SEQ ID NO: 353350 - RNA, 14 nt, Bordetella pertussis
gaccaggcgggcau

SEQ ID NO: 353351 - RNA, 16 nt, Bordetella pertussis
gaccaggcgggcaucg

SEQ ID NO: 353352 - RNA, 18 nt, Bordetella pertussis
gaccaggcgggcaucgcc

SEQ ID NO: 353353 - RNA, 19 nt, Bordetella pertussis
gaccaggcgggcaucgccc

SEQ ID NO: 353354 - RNA, 13 nt, Bordetella pertussis
gaccaggcugcgc

SEQ ID NO: 353355 - RNA, 16 nt, Bordetella pertussis
gaccaggcugcgcgcc

SEQ ID NO: 353356 - RNA, 17 nt, Bordetella pertussis
gaccaggcugcgcgccg

SEQ ID NO: 353357 - RNA, 13 nt, Bordetella pertussis
gaccagggcacgg

SEQ ID NO: 353358 - RNA, 17 nt, Bordetella pertussis
gaccagggcgccgaccg

SEQ ID NO: 353359 - RNA, 22 nt, Bordetella pertussis
gaccagggcucguagucggugg

SEQ ID NO: 353360 - RNA, 19 nt, Bordetella pertussis
gaccaucuuguccuucagc

SEQ ID NO: 353361 - RNA, 18 nt, Bordetella pertussis
gaccaugaccaugccggc

SEQ ID NO: 353362 - RNA, 14 nt, Bordetella pertussis
gaccaugcgcaccg

SEQ ID NO: 353363 - RNA, 13 nt, Bordetella pertussis
gaccaugcgcugg

SEQ ID NO: 353364 - RNA, 20 nt, Bordetella pertussis
gaccauuucgauuucggcgg

SEQ ID NO: 353365 - RNA, 21 nt, Bordetella pertussis
gaccauuucgauuucggcggc

SEQ ID NO: 353366 - RNA, 17 nt, Bordetella pertussis
gacccacuugagcagcg

SEQ ID NO: 353367 - RNA, 20 nt, Bordetella pertussis
gacccacuugagcagcgccu

SEQ ID NO: 353368 - RNA, 23 nt, Bordetella pertussis
gacccacuugagcagcgccuugc

SEQ ID NO: 353369 - RNA, 20 nt, Bordetella pertussis
gacccagaacccggccggcg

SEQ ID NO: 353370 - RNA, 13 nt, Bordetella pertussis
gacccaggccggc

SEQ ID NO: 353371 - RNA, 15 nt, Bordetella pertussis
gacccaggccggcgc

SEQ ID NO: 353372 - RNA, 16 nt, Bordetella pertussis
gacccgcgccgcaggc

SEQ ID NO: 353373 - RNA, 12 nt, Bordetella pertussis
gacccgcggccc

SEQ ID NO: 353374 - RNA, 17 nt, Bordetella pertussis
gacccgcggcccuugcg

SEQ ID NO: 353375 - RNA, 19 nt, Bordetella pertussis
gacccgcucgaccuugucg

SEQ ID NO: 353376 - RNA, 14 nt, Bordetella pertussis
gacccgcucggcca

SEQ ID NO: 353377 - RNA, 20 nt, Bordetella pertussis
gacccgcucggccacgcgca

SEQ ID NO: 353378 - RNA, 23 nt, Bordetella pertussis
gacccgcucggccacgcgcaacg

SEQ ID NO: 353379 - RNA, 16 nt, Bordetella pertussis
gacccggacaacgcgc

SEQ ID NO: 353380 - RNA, 21 nt, Bordetella pertussis
gacccggacaacgcgcgccac

SEQ ID NO: 353381 - RNA, 19 nt, Bordetella pertussis
aacgcggcguaccggucca

SEQ ID NO: 353382 - RNA, 23 nt, Bordetella pertussis
aacgcggucgcauuggccgccgc

SEQ ID NO: 353383 - RNA, 21 nt, Bordetella pertussis
aacgcgguggcguuggccugc

SEQ ID NO: 353384 - RNA, 12 nt, Bordetella pertussis
aacgcgucgaug

SEQ ID NO: 353385 - RNA, 14 nt, Bordetella pertussis
gacccgggccgcug

SEQ ID NO: 353386 - RNA, 17 nt, Bordetella pertussis
gacccgggccgcuggcc

SEQ ID NO: 353387 - RNA, 19 nt, Bordetella pertussis
gacccgggccgcuggcccg

SEQ ID NO: 353388 - RNA, 19 nt, Bordetella pertussis
gacccguggcccgggugcc

SEQ ID NO: 353389 - RNA, 20 nt, Bordetella pertussis
gacccguggcccgggugccu

SEQ ID NO: 353390 - RNA, 15 nt, Bordetella pertussis
gacccguuugcgcag

SEQ ID NO: 353391 - RNA, 18 nt, Bordetella pertussis
gacccguuugcgcagcuc

SEQ ID NO: 353392 - RNA, 14 nt, Bordetella pertussis
gacccugcccggca

SEQ ID NO: 353393 - RNA, 14 nt, Bordetella pertussis
gacccugcgcaccc

SEQ ID NO: 353394 - RNA, 16 nt, Bordetella pertussis
gacccuggccgaacgc

SEQ ID NO: 353395 - RNA, 14 nt, Bordetella pertussis
gacccuggcgcgcg

SEQ ID NO: 353396 - RNA, 19 nt, Bordetella pertussis
gaccgacagcacauggcgc

SEQ ID NO: 353397 - RNA, 14 nt, Bordetella pertussis
gaccgagcccggca

SEQ ID NO: 353398 - RNA, 16 nt, Bordetella pertussis
gaccgagcccggcacc

SEQ ID NO: 353399 - RNA, 18 nt, Bordetella pertussis
gaccgagccggccagcgc

SEQ ID NO: 353400 - RNA, 14 nt, Bordetella pertussis
gaccgagcgcgccc

SEQ ID NO: 353401 - RNA, 15 nt, Bordetella pertussis
gaccgagcgcgcccg

SEQ ID NO: 353402 - RNA, 16 nt, Bordetella pertussis
gaccgagcgcgcccgc

SEQ ID NO: 353403 - RNA, 13 nt, Bordetella pertussis
gaccgagggcgcg

SEQ ID NO: 353404 - RNA, 20 nt, Bordetella pertussis
gaccgagguguagaacucgg

SEQ ID NO: 353405 - RNA, 18 nt, Bordetella pertussis
gaccgccgccagcagcgc

SEQ ID NO: 353406 - RNA, 22 nt, Bordetella pertussis
gaccgccgccuuggacgcgcug

SEQ ID NO: 353407 - RNA, 16 nt, Bordetella pertussis
gaccgccgcgcccagc

SEQ ID NO: 353408 - RNA, 21 nt, Bordetella pertussis
gaccgcgacccgauagccgcg

SEQ ID NO: 353409 - RNA, 15 nt, Bordetella pertussis
gaccgccgcgccggu

SEQ ID NO: 353410 - RNA, 18 nt, Bordetella pertussis
gaccgccgcgccgguggc

SEQ ID NO: 353411 - RNA, 15 nt, Bordetella pertussis
gaccgcgacgcgccu

SEQ ID NO: 353412 - RNA, 17 nt, Bordetella pertussis
gaccgcgacgcgccugc

SEQ ID NO: 353413 - RNA, 15 nt, Bordetella pertussis
gaccgcgccgccgcg

SEQ ID NO: 353414 - RNA, 14 nt, Bordetella pertussis
gaccgcgcgcgacg

SEQ ID NO: 353415 - RNA, 12 nt, Bordetella pertussis
gaccgcgcggcg

SEQ ID NO: 353416 - RNA, 13 nt, Bordetella pertussis
gaccgcgcggcgc

SEQ ID NO: 353417 - RNA, 15 nt, Bordetella pertussis
gaccgcgcggcgcug

SEQ ID NO: 353418 - RNA, 16 nt, Bordetella pertussis
gaccgcgcggcgcugc

SEQ ID NO: 353419 - RNA, 20 nt, Bordetella pertussis
gaccgcgcgguggccgccgc

SEQ ID NO: 353420 - RNA, 16 nt, Bordetella pertussis
gaccgcggacgccaug

SEQ ID NO: 353421 - RNA, 18 nt, Bordetella pertussis
gaccgcggacgccauggc

SEQ ID NO: 353422 - RNA, 16 nt, Bordetella pertussis
gaccgcggccgcgcug

SEQ ID NO: 353423 - RNA, 24 nt, Bordetella pertussis
gaccgcggccgcgcuggcgcuggc

SEQ ID NO: 353424 - RNA, 22 nt, Bordetella pertussis
gaccgcggcgaucucgucgacc

SEQ ID NO: 353425 - RNA, 16 nt, Bordetella pertussis
gaccgcguccgcgacg

SEQ ID NO: 353426 - RNA, 13 nt, Bordetella pertussis
gaccgcgucgaac

SEQ ID NO: 353427 - RNA, 19 nt, Bordetella pertussis
gaccgcguaguugucggcg

SEQ ID NO: 353428 - RNA, 23 nt, Bordetella pertussis
gaccgcguaguugucggcgcaga

SEQ ID NO: 353429 - RNA, 22 nt, Bordetella pertussis
gaccgcguugaccggcuggcgc

SEQ ID NO: 353430 - RNA, 23 nt, Bordetella pertussis
gaccgcguugaccggcuggcgca

SEQ ID NO: 353431 - RNA, 13 nt, Bordetella pertussis
gaccggcgcggcc

SEQ ID NO: 353432 - RNA, 16 nt, Bordetella pertussis
gaccggcgcggccugc

SEQ ID NO: 353433 - RNA, 19 nt, Bordetella pertussis
gaccggcggcaccauugcc

SEQ ID NO: 353434 - RNA, 13 nt, Bordetella pertussis
gaccggcggcacg

SEQ ID NO: 353435 - RNA, 19 nt, Bordetella pertussis
gaccggcgccugcggcaug

SEQ ID NO: 353436 - RNA, 20 nt, Bordetella pertussis
gaccggcgcgaacaccggca

SEQ ID NO: 353437 - RNA, 23 nt, Bordetella pertussis
gaccggcgcgaacaccggcaggc

SEQ ID NO: 353438 - RNA, 22 nt, Bordetella pertussis
aacggcagcuugucgaucgcca

SEQ ID NO: 353439 - RNA, 19 nt, Bordetella pertussis
aacggccagcgucagcgca

SEQ ID NO: 353440 - RNA, 20 nt, Bordetella pertussis
gaccugcaaccccaccggca

SEQ ID NO: 353441 - RNA, 17 nt, Bordetella pertussis
gaccugcacgauggcgc

SEQ ID NO: 353442 - RNA, 18 nt, Bordetella pertussis
gaccugcacgauggcgcc

SEQ ID NO: 353443 - RNA, 22 nt, Bordetella pertussis
gaccugcacgauggcgccggcu

SEQ ID NO: 353444 - RNA, 21 nt, Bordetella pertussis
gaccugccacugcaucgugcg

SEQ ID NO: 353445 - RNA, 13 nt, Bordetella pertussis
gaccugcgcaccg

SEQ ID NO: 353446 - RNA, 21 nt, Bordetella pertussis
gaccugcgcaccggccggccg

SEQ ID NO: 353447 - RNA, 17 nt, Bordetella pertussis
gaccugcgcgaagcgcu

SEQ ID NO: 353448 - RNA, 13 nt, Bordetella pertussis
gaccugcgcgacc

SEQ ID NO: 353449 - RNA, 17 nt, Bordetella pertussis
gaccugcgcgaccgccg

SEQ ID NO: 353450 - RNA, 12 nt, Bordetella pertussis
gaccugcgcgcc

SEQ ID NO: 353451 - RNA, 14 nt, Bordetella pertussis
gaccugcgggccgc

SEQ ID NO: 353452 - RNA, 15 nt, Bordetella pertussis
gaccugcgggccgca

SEQ ID NO: 353453 - RNA, 20 nt, Bordetella pertussis
gaccugcgggcgcagcgccg

SEQ ID NO: 353454 - RNA, 21 nt, Bordetella pertussis
gaccugcgggcgcagcgccgc

SEQ ID NO: 353455 - RNA, 16 nt, Bordetella pertussis
gaccugcucgagcggc

SEQ ID NO: 353456 - RNA, 17 nt, Bordetella pertussis
gaccugcucgagcggcg

SEQ ID NO: 353457 - RNA, 22 nt, Bordetella pertussis
gaccugcucgagcggcggaaug

SEQ ID NO: 353458 - RNA, 18 nt, Bordetella pertussis
gaccugcucgucgccaug

SEQ ID NO: 353459 - RNA, 23 nt, Bordetella pertussis
gaccugcucgucgccaugcggcu

SEQ ID NO: 353460 - RNA, 19 nt, Bordetella pertussis
gaccuggucgaucagcccc

SEQ ID NO: 353461 - RNA, 14 nt, Bordetella pertussis
gaccuggucggccu

SEQ ID NO: 353462 - RNA, 17 nt, Bordetella pertussis
gaccuggucgggcguga

SEQ ID NO: 353463 - RNA, 22 nt, Bordetella pertussis
gaccuggucgggcgugagcgcc

SEQ ID NO: 353464 - RNA, 16 nt, Bordetella pertussis
gaccuggugaucgcgc

SEQ ID NO: 353465 - RNA, 21 nt, Bordetella pertussis
gaccuggugcaccacgcgcuc

SEQ ID NO: 353466 - RNA, 23 nt, Bordetella pertussis
gaccuuacggauaauugggcggc

SEQ ID NO: 353467 - RNA, 21 nt, Bordetella pertussis
gaccuugagaugccagcggcg

SEQ ID NO: 353468 - RNA, 20 nt, Bordetella pertussis
gaccuugccgauccagcgcc

SEQ ID NO: 353469 - RNA, 20 nt, Bordetella pertussis
gaccuugcgcgacggcgaug

SEQ ID NO: 353470 - RNA, 17 nt, Bordetella pertussis
gaccuugcggccgcgca

SEQ ID NO: 353471 - RNA, 23 nt, Bordetella pertussis
gaccuugcuggaccgcgccuggg

SEQ ID NO: 353472 - RNA, 13 nt, Bordetella pertussis
gaccuuggcggcc

SEQ ID NO: 353473 - RNA, 18 nt, Bordetella pertussis
gaccuuggcggcuggcgc

SEQ ID NO: 353474 - RNA, 20 nt, Bordetella pertussis
gaccuuggcuugcagcgccu

SEQ ID NO: 353475 - RNA, 14 nt, Bordetella pertussis
gaccuugggaugca

SEQ ID NO: 353476 - RNA, 23 nt, Bordetella pertussis
gaccuuggucggguccagcacgc

SEQ ID NO: 353477 - RNA, 17 nt, Bordetella pertussis
gacgaagaacaccauca

SEQ ID NO: 353478 - RNA, 13 nt, Bordetella pertussis
gacgaagccgggu

SEQ ID NO: 353479 - RNA, 19 nt, Bordetella pertussis
gacgaaggcgccggccagg

SEQ ID NO: 353480 - RNA, 16 nt, Bordetella pertussis
gacgaauacgcuggcg

SEQ ID NO: 353481 - RNA, 19 nt, Bordetella pertussis
gacgaccuugcccgucagc

SEQ ID NO: 353482 - RNA, 21 nt, Bordetella pertussis
gacgaccuugcccgucagcgg

SEQ ID NO: 353483 - RNA, 14 nt, Bordetella pertussis
gacgaccuugcugg

SEQ ID NO: 353484 - RNA, 14 nt, Bordetella pertussis
gacgacgcagcgug

SEQ ID NO: 353485 - RNA, 14 nt, Bordetella pertussis
gacgacggccggcg

SEQ ID NO: 353486 - RNA, 15 nt, Bordetella pertussis
gacgacggccggcgc

SEQ ID NO: 353487 - RNA, 14 nt, Bordetella pertussis
gacgacuacgcgcu

SEQ ID NO: 353488 - RNA, 19 nt, Bordetella pertussis
gacgacuacgcgcuggcgc

SEQ ID NO: 353489 - RNA, 23 nt, Bordetella pertussis
gacgacuugaucagggccacggc

SEQ ID NO: 353490 - RNA, 14 nt, Bordetella pertussis
gacgagaucgcgcc

SEQ ID NO: 353491 - RNA, 13 nt, Bordetella pertussis
gacgagcgcagca

SEQ ID NO: 353492 - RNA, 16 nt, Bordetella pertussis
gacgagggccgcggcg

SEQ ID NO: 353493 - RNA, 14 nt, Bordetella pertussis
gacgagggccggcg

SEQ ID NO: 353494 - RNA, 14 nt, Bordetella pertussis
gacgagggcgccau

SEQ ID NO: 353495 - RNA, 13 nt, Bordetella pertussis
gacgaggcgcugu

SEQ ID NO: 353496 - RNA, 21 nt, Bordetella pertussis
gacgaguugcucggagcccag

SEQ ID NO: 353497 - RNA, 18 nt, Bordetella pertussis
gacgauauccaggcgcgu

SEQ ID NO: 353498 - RNA, 16 nt, Bordetella pertussis
gacgaucacgguggcg

SEQ ID NO: 353499 - RNA, 22 nt, Bordetella pertussis
gacgaucaggcccuggggccgc

SEQ ID NO: 353500 - RNA, 20 nt, Bordetella pertussis
gacgaucauccaggccguga

SEQ ID NO: 353501 - RNA, 15 nt, Bordetella pertussis
gacgaucuccacccc

SEQ ID NO: 353502 - RNA, 14 nt, Bordetella pertussis
gacgaucucgcccu

SEQ ID NO: 353503 - RNA, 15 nt, Bordetella pertussis
gacgaucucgcggcu

SEQ ID NO: 353504 - RNA, 23 nt, Bordetella pertussis
gacgaugagcugguccaccaccu

SEQ ID NO: 353505 - RNA, 13 nt, Bordetella pertussis
gacgaugcccagg

SEQ ID NO: 353506 - RNA, 21 nt, Bordetella pertussis
gacgaugcccugcgccagcgc

SEQ ID NO: 353507 - RNA, 16 nt, Bordetella pertussis
gacgaugccgcccacg

SEQ ID NO: 353508 - RNA, 11 nt, Bordetella pertussis
gacgaugcgcg

SEQ ID NO: 353509 - RNA, 17 nt, Bordetella pertussis
gacgaugcgcgaagcgc

SEQ ID NO: 353510 - RNA, 21 nt, Bordetella pertussis
gacgauguagaucuggcgcgu

SEQ ID NO: 353511 - RNA, 14 nt, Bordetella pertussis
gacgauggugccgg

SEQ ID NO: 353512 - RNA, 20 nt, Bordetella pertussis
gacgauggugcgcaggggcu

SEQ ID NO: 353513 - RNA, 23 nt, Bordetella pertussis
gacgcaaaaacgcccggcgcggu

SEQ ID NO: 353514 - RNA, 14 nt, Bordetella pertussis
gacgcaaccggucg

SEQ ID NO: 353515 - RNA, 18 nt, Bordetella pertussis
gacgcaaccggucggccg

SEQ ID NO: 353516 - RNA, 13 nt, Bordetella pertussis
gacgcagaccacg

SEQ ID NO: 353517 - RNA, 16 nt, Bordetella pertussis
gacgcagaccacgccg

SEQ ID NO: 353518 - RNA, 19 nt, Bordetella pertussis
gacgcagaccacgccggcg

SEQ ID NO: 353519 - RNA, 14 nt, Bordetella pertussis
gacgcagccgcccg

SEQ ID NO: 353520 - RNA, 16 nt, Bordetella pertussis
gacgcagccgcccggc

SEQ ID NO: 353521 - RNA, 14 nt, Bordetella pertussis
gacgcagcgcaccg

SEQ ID NO: 353522 - RNA, 13 nt, Bordetella pertussis
gacgcagcgugcg

SEQ ID NO: 353523 - RNA, 12 nt, Bordetella pertussis
gacgcaggccca

SEQ ID NO: 353524 - RNA, 13 nt, Bordetella pertussis
gacgcaggcccag

SEQ ID NO: 353525 - RNA, 16 nt, Bordetella pertussis
gacgcaggcccagcca

SEQ ID NO: 353526 - RNA, 18 nt, Bordetella pertussis
gacgcaggcccaugacga

SEQ ID NO: 353527 - RNA, 12 nt, Bordetella pertussis
gacgcaggcgcc

SEQ ID NO: 353528 - RNA, 13 nt, Bordetella pertussis
gacgcaggcgccg

SEQ ID NO: 353529 - RNA, 20 nt, Bordetella pertussis
gacgcauauccaggcggcgc

SEQ ID NO: 353530 - RNA, 17 nt, Bordetella pertussis
gacgcaugucagcgccu

SEQ ID NO: 353531 - RNA, 15 nt, Bordetella pertussis
gacgccaagaccgcg

SEQ ID NO: 353532 - RNA, 22 nt, Bordetella pertussis
gacgccaagaccgcggccgcgc

SEQ ID NO: 353533 - RNA, 17 nt, Bordetella pertussis
gacgccaccagugcgcc

SEQ ID NO: 353534 - RNA, 22 nt, Bordetella pertussis
gacgccagcaugaucaugccgc

SEQ ID NO: 353535 - RNA, 15 nt, Bordetella pertussis
gacgccagcccgccg

SEQ ID NO: 353536 - RNA, 17 nt, Bordetella pertussis
gacgccagcccgccggc

SEQ ID NO: 353537 - RNA, 17 nt, Bordetella pertussis
gacgccagcgcgccaug

SEQ ID NO: 353538 - RNA, 23 nt, Bordetella pertussis
gacgccagcgcgccauggccggc

SEQ ID NO: 353539 - RNA, 22 nt, Bordetella pertussis
gacgccaucucgcgcgcuaagc

SEQ ID NO: 353540 - RNA, 20 nt, Bordetella pertussis
gacgccaucuugcaggcgcc

SEQ ID NO: 353541 - RNA, 22 nt, Bordetella pertussis
gacgccaucuugcaggcgccag

SEQ ID NO: 353542 - RNA, 14 nt, Bordetella pertussis
gacgccauggcggc

SEQ ID NO: 353543 - RNA, 15 nt, Bordetella pertussis
gacgccauggcggcg

SEQ ID NO: 353544 - RNA, 21 nt, Bordetella pertussis
gacgccauggcggcggccacg

SEQ ID NO: 353545 - RNA, 17 nt, Bordetella pertussis
gacgcccagccugccgg

SEQ ID NO: 353546 - RNA, 18 nt, Bordetella pertussis
gacgcccagccugccggc

SEQ ID NO: 353547 - RNA, 21 nt, Bordetella pertussis
gacgcccagccugccggcggc

SEQ ID NO: 353548 - RNA, 12 nt, Bordetella pertussis
gacgcccaggcc

SEQ ID NO: 353549 - RNA, 15 nt, Bordetella pertussis
gacgcccaggcccac

SEQ ID NO: 353550 - RNA, 17 nt, Bordetella pertussis
gacgcccaggcccaccg

SEQ ID NO: 353551 - RNA, 14 nt, Bordetella pertussis
gacgcccagguccg

SEQ ID NO: 353552 - RNA, 15 nt, Bordetella pertussis
gacgcccgcgcccag

SEQ ID NO: 353553 - RNA, 20 nt, Bordetella pertussis
gacgcccugaacuauggcgc

SEQ ID NO: 353554 - RNA, 17 nt, Bordetella pertussis
gacgcccugccauucgg

SEQ ID NO: 353555 - RNA, 21 nt, Bordetella pertussis
gacgcccuggcgcaggccggc

SEQ ID NO: 353556 - RNA, 21 nt, Bordetella pertussis
gacgccgaacacaucgagggc

SEQ ID NO: 353557 - RNA, 21 nt, Bordetella pertussis
gacgccgaaggucuuggcgug

SEQ ID NO: 353558 - RNA, 13 nt, Bordetella pertussis
gacgccgaccgcg

SEQ ID NO: 353559 - RNA, 18 nt, Bordetella pertussis
gacgccgacgaugccggu

SEQ ID NO: 353560 - RNA, 22 nt, Bordetella pertussis
gacgccgacugggugcgccuga

SEQ ID NO: 353561 - RNA, 17 nt, Bordetella pertussis
gacgccgccacgcuggc

SEQ ID NO: 353562 - RNA, 23 nt, Bordetella pertussis
gacgccgccacgcuggccgcgcu

SEQ ID NO: 353563 - RNA, 13 nt, Bordetella pertussis
gacgccgccgaac

SEQ ID NO: 353564 - RNA, 14 nt, Bordetella pertussis
gacgccgccgaagg

SEQ ID NO: 353565 - RNA, 16 nt, Bordetella pertussis
gacgccgccgaagggc

SEQ ID NO: 353566 - RNA, 19 nt, Bordetella pertussis
gacgccgccgaagggcacc

SEQ ID NO: 353567 - RNA, 20 nt, Bordetella pertussis
gacgccgccgaagggcaccg

SEQ ID NO: 353568 - RNA, 20 nt, Bordetella pertussis
gacgccgccgauggcgccac

SEQ ID NO: 353569 - RNA, 20 nt, Bordetella pertussis
gacgccgcgcgcgacgcgau

SEQ ID NO: 353570 - RNA, 13 nt, Bordetella pertussis
gacgccgcgcggu

SEQ ID NO: 353571 - RNA, 17 nt, Bordetella pertussis
gacgccggcagcgacuu

SEQ ID NO: 353572 - RNA, 15 nt, Bordetella pertussis
gacgccggcgccggc

SEQ ID NO: 353573 - RNA, 16 nt, Bordetella pertussis
gacgccggcgccggcg

SEQ ID NO: 353574 - RNA, 12 nt, Bordetella pertussis
gacgccggcggc

SEQ ID NO: 353575 - RNA, 16 nt, Bordetella pertussis
gacgccggcggcgugc

SEQ ID NO: 353576 - RNA, 23 nt, Bordetella pertussis
gacgccggcggcgugcgccugcu

SEQ ID NO: 353577 - RNA, 14 nt, Bordetella pertussis
gacgccggcgggca

SEQ ID NO: 353578 - RNA, 18 nt, Bordetella pertussis
gacgccggcgggcaggcg

SEQ ID NO: 353579 - RNA, 20 nt, Bordetella pertussis
gacgccggcucaggccagcg

SEQ ID NO: 353580 - RNA, 12 nt, Bordetella pertussis
gacgccgggacg

SEQ ID NO: 353581 - RNA, 20 nt, Bordetella pertussis
gacgccgggcgcggcccggc

SEQ ID NO: 353582 - RNA, 17 nt, Bordetella pertussis
gacgccguacugggcac

SEQ ID NO: 353583 - RNA, 20 nt, Bordetella pertussis
gacgccguacugggcaccac

SEQ ID NO: 353584 - RNA, 14 nt, Bordetella pertussis
gacgccgugguggu

SEQ ID NO: 353585 - RNA, 14 nt, Bordetella pertussis
gacgccucgccggu

SEQ ID NO: 353586 - RNA, 14 nt, Bordetella pertussis
gacgccuggcgcgg

SEQ ID NO: 353587 - RNA, 15 nt, Bordetella pertussis
gacgccuggcgcggc

SEQ ID NO: 353588 - RNA, 23 nt, Bordetella pertussis
gacgccuuccuugaacugcgcgg

SEQ ID NO: 353589 - RNA, 17 nt, Bordetella pertussis
gacgcgaagaucccgcc

SEQ ID NO: 353590 - RNA, 22 nt, Bordetella pertussis
gacgcgacacgcagcaacggug

SEQ ID NO: 353591 - RNA, 17 nt, Bordetella pertussis
gacgcgauacugcgcau

SEQ ID NO: 353592 - RNA, 21 nt, Bordetella pertussis
gacgcgauacugcgcaugggc

SEQ ID NO: 353593 - RNA, 20 nt, Bordetella pertussis
gacgcgaugcccgcgcacca

SEQ ID NO: 353594 - RNA, 22 nt, Bordetella pertussis
gacgcgcaggccauugcuggcg

SEQ ID NO: 353595 - RNA, 23 nt, Bordetella pertussis
gacgcgcaggccauugcuggcgc

SEQ ID NO: 353596 - RNA, 16 nt, Bordetella pertussis
gacgcgccggaugcgc

SEQ ID NO: 353597 - RNA, 17 nt, Bordetella pertussis
gacgcgccggaugcgcg

SEQ ID NO: 353598 - RNA, 23 nt, Bordetella pertussis
gacgcgccggaugcgcguggcgc

SEQ ID NO: 353599 - RNA, 18 nt, Bordetella pertussis
gacgcgccgggcgaaccg

SEQ ID NO: 353600 - RNA, 14 nt, Bordetella pertussis
gacgcgccgcgccu

SEQ ID NO: 353601 - RNA, 14 nt, Bordetella pertussis
gacgcgcgccggcg

SEQ ID NO: 353602 - RNA, 15 nt, Bordetella pertussis
gacgcgcgccggcgc

SEQ ID NO: 353603 - RNA, 16 nt, Bordetella pertussis
gacgcgcgccggcgcu

SEQ ID NO: 353604 - RNA, 16 nt, Bordetella pertussis
gacgcgcgcggcgacc

SEQ ID NO: 353605 - RNA, 20 nt, Bordetella pertussis
gacgcgcgcggugucgccgc

SEQ ID NO: 353606 - RNA, 17 nt, Bordetella pertussis
gacgcgccugcgcgcgg

SEQ ID NO: 353607 - RNA, 15 nt, Bordetella pertussis
gacgcgcucaggcgg

SEQ ID NO: 353608 - RNA, 18 nt, Bordetella pertussis
gacgcgcucaggcgguga

SEQ ID NO: 353609 - RNA, 13 nt, Bordetella pertussis
gacgcgcucgcgc

SEQ ID NO: 353610 - RNA, 18 nt, Bordetella pertussis
gacgcgcucgcgcgcgug

SEQ ID NO: 353611 - RNA, 19 nt, Bordetella pertussis
gacgcgcucgcgcgcgugc

SEQ ID NO: 353612 - RNA, 12 nt, Bordetella pertussis
gacgcgcuggcc

SEQ ID NO: 353613 - RNA, 13 nt, Bordetella pertussis
gacgcgcuggccg

SEQ ID NO: 353614 - RNA, 14 nt, Bordetella pertussis
gacgcgcuggccga

SEQ ID NO: 353615 - RNA, 14 nt, Bordetella pertussis
gacgcgcugguccg

SEQ ID NO: 353616 - RNA, 21 nt, Bordetella pertussis
gacgcgcuugacguccagcga

SEQ ID NO: 353617 - RNA, 16 nt, Bordetella pertussis
gacgcggacuucgccc

SEQ ID NO: 353618 - RNA, 17 nt, Bordetella pertussis
gacgcggccagcggcgc

SEQ ID NO: 353619 - RNA, 21 nt, Bordetella pertussis
gacgcggccguggaggcggcg

SEQ ID NO: 353620 - RNA, 12 nt, Bordetella pertussis
gacgcggcgacg

SEQ ID NO: 353621 - RNA, 18 nt, Bordetella pertussis
gacgcggcguacuggcgc

SEQ ID NO: 353622 - RNA, 20 nt, Bordetella pertussis
gacgcggcguacuggcgcgg

SEQ ID NO: 353623 - RNA, 22 nt, Bordetella pertussis
gacgcggcguacuggcgcggcg

SEQ ID NO: 353624 - RNA, 15 nt, Bordetella pertussis
gacgcggcggccggu

SEQ ID NO: 353625 - RNA, 12 nt, Bordetella pertussis
gacgcgggccac

SEQ ID NO: 353626 - RNA, 17 nt, Bordetella pertussis
gacgcgggccacgcgcc

SEQ ID NO: 353627 - RNA, 16 nt, Bordetella pertussis
gacgcggucgcccaac

SEQ ID NO: 353628 - RNA, 23 nt, Bordetella pertussis
gacgcggucgcccaacccggcga

SEQ ID NO: 353629 - RNA, 17 nt, Bordetella pertussis
gacgcguccucggccag

SEQ ID NO: 353630 - RNA, 18 nt, Bordetella pertussis
gacgcguccucggccagc

SEQ ID NO: 353631 - RNA, 15 nt, Bordetella pertussis
gacgcuacagcguca

SEQ ID NO: 353632 - RNA, 18 nt, Bordetella pertussis
gacgcucauccaggcgcg

SEQ ID NO: 353633 - RNA, 19 nt, Bordetella pertussis
gacgcucauccaggcgcgu

SEQ ID NO: 353634 - RNA, 18 nt, Bordetella pertussis
gacgcugacugcggugcc

SEQ ID NO: 353635 - RNA, 17 nt, Bordetella pertussis
gacgcugaucggccgac

SEQ ID NO: 353636 - RNA, 15 nt, Bordetella pertussis
gacgcugaucucggc

SEQ ID NO: 353637 - RNA, 17 nt, Bordetella pertussis
gacgcugaucucggccu

SEQ ID NO: 353638 - RNA, 19 nt, Bordetella pertussis
gacgcugaucucggccugc

SEQ ID NO: 353639 - RNA, 15 nt, Bordetella pertussis
gacgcugauggccgc

SEQ ID NO: 353640 - RNA, 18 nt, Bordetella pertussis
gacgcugauggccgccag

SEQ ID NO: 353641 - RNA, 20 nt, Bordetella pertussis
gacgcugauggccgccagcg

SEQ ID NO: 353642 - RNA, 21 nt, Bordetella pertussis
gacgcugaugcccagcccggc

SEQ ID NO: 353643 - RNA, 14 nt, Bordetella pertussis
gacgcuggagaugg

SEQ ID NO: 353644 - RNA, 21 nt, Bordetella pertussis
gacgcuggagauggcgccgau

SEQ ID NO: 353645 - RNA, 15 nt, Bordetella pertussis
gacgcuggagcgcgg

SEQ ID NO: 353646 - RNA, 16 nt, Bordetella pertussis
gacgcuggagcgcggc

SEQ ID NO: 353647 - RNA, 20 nt, Bordetella pertussis
gacgcuggcgaugcccacca

SEQ ID NO: 353648 - RNA, 16 nt, Bordetella pertussis
gacgcuguagaggcgc

SEQ ID NO: 353649 - RNA, 18 nt, Bordetella pertussis
gacgcuguagaggcgcgg

SEQ ID NO: 353650 - RNA, 14 nt, Bordetella pertussis
gacgcuugccggcg

SEQ ID NO: 353651 - RNA, 19 nt, Bordetella pertussis
gacgcuuucggggcgcaag

SEQ ID NO: 353652 - RNA, 19 nt, Bordetella pertussis
gacggaugggcgccgugcc

SEQ ID NO: 353653 - RNA, 23 nt, Bordetella pertussis
gacggauucccagcuccacgcac

SEQ ID NO: 353654 - RNA, 17 nt, Bordetella pertussis
gacggcaaucuugccgc

SEQ ID NO: 353655 - RNA, 18 nt, Bordetella pertussis
gacggcaaucuugccgcc

SEQ ID NO: 353656 - RNA, 20 nt, Bordetella pertussis
gacggcaaucuugccgccgg

SEQ ID NO: 353657 - RNA, 13 nt, Bordetella pertussis
gacggcagaugga

SEQ ID NO: 353658 - RNA, 23 nt, Bordetella pertussis
gacggcaucgauuucucgcugcu

SEQ ID NO: 353659 - RNA, 15 nt, Bordetella pertussis
gacggcauggccggc

SEQ ID NO: 353660 - RNA, 16 nt, Bordetella pertussis
gacggcauggcggcca

SEQ ID NO: 353661 - RNA, 17 nt, Bordetella pertussis
gacggcauggcggccag

SEQ ID NO: 353662 - RNA, 20 nt, Bordetella pertussis
gacggccagcaggagcccgc

SEQ ID NO: 353663 - RNA, 13 nt, Bordetella pertussis
gacggccagcgcg

SEQ ID NO: 353664 - RNA, 23 nt, Bordetella pertussis
gacggccagcgcgacgggcaccg

SEQ ID NO: 353665 - RNA, 17 nt, Bordetella pertussis
gacggccagcgcgcgug

SEQ ID NO: 353666 - RNA, 16 nt, Bordetella pertussis
gacggccaggacggca

SEQ ID NO: 353667 - RNA, 14 nt, Bordetella pertussis
gacggccaggaugg

SEQ ID NO: 353668 - RNA, 16 nt, Bordetella pertussis
gacggccaggggcagc

SEQ ID NO: 353669 - RNA, 22 nt, Bordetella pertussis
gacggccccguugucgccgcgg

SEQ ID NO: 353670 - RNA, 18 nt, Bordetella pertussis
gacggccauucagaccgg

SEQ ID NO: 353671 - RNA, 17 nt, Bordetella pertussis
gacggccccagcgccgc

SEQ ID NO: 353672 - RNA, 20 nt, Bordetella pertussis
gacggccgcaagcuggccga

SEQ ID NO: 353673 - RNA, 17 nt, Bordetella pertussis
gacggccgccgacgccg

SEQ ID NO: 353674 - RNA, 17 nt, Bordetella pertussis
gacggccgccacgcccu

SEQ ID NO: 353675 - RNA, 16 nt, Bordetella pertussis
gacggccggcgcgugc

SEQ ID NO: 353676 - RNA, 21 nt, Bordetella pertussis
gacggccucccgccgcccggc

SEQ ID NO: 353677 - RNA, 16 nt, Bordetella pertussis
gacggccuccgcgccg

SEQ ID NO: 353678 - RNA, 24 nt, Bordetella pertussis
gacggccuccgcgccgaccacgcu

SEQ ID NO: 353679 - RNA, 15 nt, Bordetella pertussis
gacggccucggccag

SEQ ID NO: 353680 - RNA, 22 nt, Bordetella pertussis
gacggccucguccucgucggcg

SEQ ID NO: 353681 - RNA, 18 nt, Bordetella pertussis
gacggccugccaccgaca

SEQ ID NO: 353682 - RNA, 21 nt, Bordetella pertussis
gacggccuggaggccgagcgc

SEQ ID NO: 353683 - RNA, 12 nt, Bordetella pertussis
aacgucggcagc

SEQ ID NO: 353684 - RNA, 14 nt, Bordetella pertussis
gacggcgcccugca

SEQ ID NO: 353685 - RNA, 19 nt, Bordetella pertussis
gacggcgcccugcagggca

SEQ ID NO: 353686 - RNA, 15 nt, Bordetella pertussis
gacggcgccgauccg

SEQ ID NO: 353687 - RNA, 15 nt, Bordetella pertussis
gacggcgccuggcgc

SEQ ID NO: 353688 - RNA, 17 nt, Bordetella pertussis
gacggcgccuggcgcau

SEQ ID NO: 353689 - RNA, 20 nt, Bordetella pertussis
gacggcgccuugacgcugcu

SEQ ID NO: 353690 - RNA, 16 nt, Bordetella pertussis
gacggcgcggcgaucg

SEQ ID NO: 353691 - RNA, 20 nt, Bordetella pertussis
gacggcgccguccgcaucgc

SEQ ID NO: 353692 - RNA, 22 nt, Bordetella pertussis
gacggcgccuauugcgacgccg

SEQ ID NO: 353693 - RNA, 15 nt, Bordetella pertussis
gacggcgcucggccu

SEQ ID NO: 353694 - RNA, 19 nt, Bordetella pertussis
gacggcgcuggcgagcaug

SEQ ID NO: 353695 - RNA, 20 nt, Bordetella pertussis
gacggcgcuggcgagcaugg

SEQ ID NO: 353696 - RNA, 12 nt, Bordetella pertussis
gacggcgcuggg

SEQ ID NO: 353697 - RNA, 20 nt, Bordetella pertussis
gacggcgcuggggaagcgcu

SEQ ID NO: 353698 - RNA, 22 nt, Bordetella pertussis
gacggcgcuggggaagcgcucg

SEQ ID NO: 353699 - RNA, 11 nt, Bordetella pertussis
gacggcgcugg

SEQ ID NO: 353700 - RNA, 21 nt, Bordetella pertussis
gacggcggcgcggcgccagcg

SEQ ID NO: 353701 - RNA, 16 nt, Bordetella pertussis
gacggcggcuggacgc

SEQ ID NO: 353702 - RNA, 22 nt, Bordetella pertussis
gacggcgggaccggcgauggcg

SEQ ID NO: 353703 - RNA, 16 nt, Bordetella pertussis
gacggcgggcgccccg

SEQ ID NO: 353704 - RNA, 24 nt, Bordetella pertussis
gacggcgggcgccccgaucggcgc

SEQ ID NO: 353705 - RNA, 16 nt, Bordetella pertussis
gacggcgucgggcagc

SEQ ID NO: 353706 - RNA, 15 nt, Bordetella pertussis
gacggcgugcugcgc

SEQ ID NO: 353707 - RNA, 20 nt, Bordetella pertussis
gacggcgugcugcgcguggc

SEQ ID NO: 353708 - RNA, 22 nt, Bordetella pertussis
gacggcgugcugcgcguggcca

SEQ ID NO: 353709 - RNA, 17 nt, Bordetella pertussis
gacggcuacacccugcu

SEQ ID NO: 353710 - RNA, 19 nt, Bordetella pertussis
gacggcucgcgcucgcccg

SEQ ID NO: 353711 - RNA, 22 nt, Bordetella pertussis
gacggcuggagauacuggccga

SEQ ID NO: 353712 - RNA, 20 nt, Bordetella pertussis
gacggcuucgaccacgcggc

SEQ ID NO: 353713 - RNA, 23 nt, Bordetella pertussis
gacggcuucgaccacgcggcggu

SEQ ID NO: 353714 - RNA, 20 nt, Bordetella pertussis
gacggcuugaccacggccag

SEQ ID NO: 353715 - RNA, 19 nt, Bordetella pertussis
gacgggaaagcggcgaucc

SEQ ID NO: 353716 - RNA, 19 nt, Bordetella pertussis
gacgggaauccgcugcgcc

SEQ ID NO: 353717 - RNA, 17 nt, Bordetella pertussis
gacgggcaccgacacgc

SEQ ID NO: 353718 - RNA, 14 nt, Bordetella pertussis
gacgggcaggccca

SEQ ID NO: 353719 - RNA, 23 nt, Bordetella pertussis
gacgggccagccccggcgcgccg

SEQ ID NO: 353720 - RNA, 22 nt, Bordetella pertussis
gacgggccgaugaagacgccgu

SEQ ID NO: 353721 - RNA, 23 nt, Bordetella pertussis
gacgggcgcacaguugcaggcca

SEQ ID NO: 353722 - RNA, 13 nt, Bordetella pertussis
gacgggcggcggc

SEQ ID NO: 353723 - RNA, 15 nt, Bordetella pertussis
gacgggcggcggcgc

SEQ ID NO: 353724 - RNA, 18 nt, Bordetella pertussis
gacgggcggcggcgcgcg

SEQ ID NO: 353725 - RNA, 18 nt, Bordetella pertussis
gacgggcggcugcuggcc

SEQ ID NO: 353726 - RNA, 15 nt, Bordetella pertussis
gacgggcugggccga

SEQ ID NO: 353727 - RNA, 19 nt, Bordetella pertussis
gacggggaacaggcgcgcc

SEQ ID NO: 353728 - RNA, 23 nt, Bordetella pertussis
gacggggaacaggcgcgccagcc

SEQ ID NO: 353729 - RNA, 16 nt, Bordetella pertussis
gacggggacgccggcg

SEQ ID NO: 353730 - RNA, 13 nt, Bordetella pertussis
gacggggcggcgc

SEQ ID NO: 353731 - RNA, 14 nt, Bordetella pertussis
gacggggcggcgcc

SEQ ID NO: 353732 - RNA, 12 nt, Bordetella pertussis
gacggggugccu

SEQ ID NO: 353733 - RNA, 16 nt, Bordetella pertussis
gacgguaagcaccagg

SEQ ID NO: 353734 - RNA, 15 nt, Bordetella pertussis
gacgguagcgcacgc

SEQ ID NO: 353735 - RNA, 23 nt, Bordetella pertussis
gacgguagcgcacgcaccgcgcc

SEQ ID NO: 353736 - RNA, 19 nt, Bordetella pertussis
gacgguaucucagcgcgcc

SEQ ID NO: 353737 - RNA, 24 nt, Bordetella pertussis
gacgguaucucagcgcgccgcgcc

SEQ ID NO: 353738 - RNA, 15 nt, Bordetella pertussis
gacgguaucuguccc

SEQ ID NO: 353739 - RNA, 23 nt, Bordetella pertussis
gacgguaucuguccccgcgggga

SEQ ID NO: 353740 - RNA, 17 nt, Bordetella pertussis
gacggucaggggcaggc

SEQ ID NO: 353741 - RNA, 20 nt, Bordetella pertussis
gacggucaggggcaggcgca

SEQ ID NO: 353742 - RNA, 21 nt, Bordetella pertussis
gacggucaggggcaggcgcac

SEQ ID NO: 353743 - RNA, 20 nt, Bordetella pertussis
gacggucugggccaugccgu

SEQ ID NO: 353744 - RNA, 16 nt, Bordetella pertussis
gacggugccgagcaga

SEQ ID NO: 353745 - RNA, 23 nt, Bordetella pertussis
gacggugccggccagccugcccg

SEQ ID NO: 353746 - RNA, 14 nt, Bordetella pertussis
gacgguggccgcgg

SEQ ID NO: 353747 - RNA, 16 nt, Bordetella pertussis
gacgguggccgcggcg

SEQ ID NO: 353748 - RNA, 19 nt, Bordetella pertussis
gacgguggccgcggcgucc

SEQ ID NO: 353749 - RNA, 14 nt, Bordetella pertussis
gacgguggugucgg

SEQ ID NO: 353750 - RNA, 17 nt, Bordetella pertussis
gacgguggugucggcgg

SEQ ID NO: 353751 - RNA, 20 nt, Bordetella pertussis
gacgguggugucggcggcca

SEQ ID NO: 353752 - RNA, 20 nt, Bordetella pertussis
gacgguuaacgaaucgcugc

SEQ ID NO: 353753 - RNA, 22 nt, Bordetella pertussis
gacgguuaacgaaucgcugccu

SEQ ID NO: 353754 - RNA, 17 nt, Bordetella pertussis
gacguaagugcccaggc

SEQ ID NO: 353755 - RNA, 21 nt, Bordetella pertussis
gacguaagugcccaggcccgu

SEQ ID NO: 353756 - RNA, 13 nt, Bordetella pertussis
gagccgcgcgcau

SEQ ID NO: 353757 - RNA, 20 nt, Bordetella pertussis
gagccgcgcgcaugcgccuu

SEQ ID NO: 353758 - RNA, 12 nt, Bordetella pertussis
gagccggccacg

SEQ ID NO: 353759 - RNA, 16 nt, Bordetella pertussis
gagccggccagcgcca

SEQ ID NO: 353760 - RNA, 14 nt, Bordetella pertussis
gagccggccgcgcc

SEQ ID NO: 353761 - RNA, 15 nt, Bordetella pertussis
gagccggccgcgccc

SEQ ID NO: 353762 - RNA, 16 nt, Bordetella pertussis
gagccggcgggcggcu

SEQ ID NO: 353763 - RNA, 16 nt, Bordetella pertussis
gagccggcagaucggc

SEQ ID NO: 353764 - RNA, 22 nt, Bordetella pertussis
gagccggcagaucggcgcuggc

SEQ ID NO: 353765 - RNA, 22 nt, Bordetella pertussis
gagccggcuccagucccgcacc

SEQ ID NO: 353766 - RNA, 12 nt, Bordetella pertussis
gagccgggccac

SEQ ID NO: 353767 - RNA, 17 nt, Bordetella pertussis
gagccgggccacgcgca

SEQ ID NO: 353768 - RNA, 14 nt, Bordetella pertussis
gagccgggcgccga

SEQ ID NO: 353769 - RNA, 17 nt, Bordetella pertussis
gagccucacuccauagc

SEQ ID NO: 353770 - RNA, 22 nt, Bordetella pertussis
gagccucacuccauagcgccgc

SEQ ID NO: 353771 - RNA, 22 nt, Bordetella pertussis
gagccuggaagugaugccgccg

SEQ ID NO: 353772 - RNA, 19 nt, Bordetella pertussis
gagccuguccccgcgggga

SEQ ID NO: 353773 - RNA, 20 nt, Bordetella pertussis
gagccugucccugcggggac

SEQ ID NO: 353774 - RNA, 22 nt, Bordetella pertussis
gagccuucggccggcugcgcgc

SEQ ID NO: 353775 - RNA, 19 nt, Bordetella pertussis
gagcgaaagccgucggcca

SEQ ID NO: 353776 - RNA, 14 nt, Bordetella pertussis
gagcgcaccauggc

SEQ ID NO: 353777 - RNA, 21 nt, Bordetella pertussis
gagcgcaccauggcgcccacg

SEQ ID NO: 353778 - RNA, 12 nt, Bordetella pertussis
gagcgcaccccg

SEQ ID NO: 353779 - RNA, 15 nt, Bordetella pertussis
gagcgcaccccggcc

SEQ ID NO: 353780 - RNA, 17 nt, Bordetella pertussis
gagcgcacaggcggcgc

SEQ ID NO: 353781 - RNA, 13 nt, Bordetella pertussis
gagcgcagccgcu

SEQ ID NO: 353782 - RNA, 21 nt, Bordetella pertussis
gagcgccacauaaucgucggc

SEQ ID NO: 353783 - RNA, 19 nt, Bordetella pertussis
gagcgccacgccagcggcg

SEQ ID NO: 353784 - RNA, 21 nt, Bordetella pertussis
gagcgccacgccagcggcgag

SEQ ID NO: 353785 - RNA, 19 nt, Bordetella pertussis
gagcgccgccaggccgucg

SEQ ID NO: 353786 - RNA, 20 nt, Bordetella pertussis
gagcgcggcauagcccaggc

SEQ ID NO: 353787 - RNA, 24 nt, Bordetella pertussis
gagcgcggccucgccggccuggcg

SEQ ID NO: 353788 - RNA, 13 nt, Bordetella pertussis
gagcgcggcgcgc

SEQ ID NO: 353789 - RNA, 15 nt, Bordetella pertussis
gagcgcggcgcgcgc

SEQ ID NO: 353790 - RNA, 14 nt, Bordetella pertussis
gagcgcggcgcugg

SEQ ID NO: 353791 - RNA, 14 nt, Bordetella pertussis
gagcgcggcggcgu

SEQ ID NO: 353792 - RNA, 13 nt, Bordetella pertussis
gagcgcggcgggu

SEQ ID NO: 353793 - RNA, 21 nt, Bordetella pertussis
gagcggccagcaagcgcgcca

SEQ ID NO: 353794 - RNA, 12 nt, Bordetella pertussis
gagcggccagcc

SEQ ID NO: 353795 - RNA, 12 nt, Bordetella pertussis
gagcggcccggg

SEQ ID NO: 353796 - RNA, 12 nt, Bordetella pertussis
gagcggccuggc

SEQ ID NO: 353797 - RNA, 19 nt, Bordetella pertussis
gagcggcgccagucgcgca

SEQ ID NO: 353798 - RNA, 20 nt, Bordetella pertussis
gagcggcgccagucgcgcag

SEQ ID NO: 353799 - RNA, 19 nt, Bordetella pertussis
gagcggcggcuucgcgcag

SEQ ID NO: 353800 - RNA, 17 nt, Bordetella pertussis
gagcggcguggcgccga

SEQ ID NO: 353801 - RNA, 16 nt, Bordetella pertussis
gagcggcucgccgcuc

SEQ ID NO: 353802 - RNA, 22 nt, Bordetella pertussis
aacucgccagguccguguucga

SEQ ID NO: 353803 - RNA, 22 nt, Bordetella pertussis
aacucggccaccuggucgucgg

SEQ ID NO: 353804 - RNA, 15 nt, Bordetella pertussis
aacucgguggcgguc

SEQ ID NO: 353805 - RNA, 14 nt, Bordetella pertussis
aacugcaggccgcc

SEQ ID NO: 353806 - RNA, 15 nt, Bordetella pertussis
aacugccggcgcggg

SEQ ID NO: 353807 - RNA, 18 nt, Bordetella pertussis
aacugccggcgcgggcgc

SEQ ID NO: 353808 - RNA, 13 nt, Bordetella pertussis
gagcgggccagcg

SEQ ID NO: 353809 - RNA, 22 nt, Bordetella pertussis
gagcgggccagcgcggccaggu

SEQ ID NO: 353810 - RNA, 17 nt, Bordetella pertussis
gagcgggcccgacagcg

SEQ ID NO: 353811 - RNA, 14 nt, Bordetella pertussis
gagcgggccggucg

SEQ ID NO: 353812 - RNA, 13 nt, Bordetella pertussis
gagcgggcgccag

SEQ ID NO: 353813 - RNA, 13 nt, Bordetella pertussis
gagcggggcuggu

SEQ ID NO: 353814 - RNA, 22 nt, Bordetella pertussis
gagcgggugaugcugcagcgca

SEQ ID NO: 353815 - RNA, 14 nt, Bordetella pertussis
gagcguaagcccac

SEQ ID NO: 353816 - RNA, 20 nt, Bordetella pertussis
gagcuacccccugaccggcg

SEQ ID NO: 353817 - RNA, 13 nt, Bordetella pertussis
gagcuccagccgg

SEQ ID NO: 353818 - RNA, 18 nt, Bordetella pertussis
gagcucgggugggccggc

SEQ ID NO: 353819 - RNA, 18 nt, Bordetella pertussis
gagcucuaugucgccggc

SEQ ID NO: 353820 - RNA, 20 nt, Bordetella pertussis
gagcucuaugucgccggcca

SEQ ID NO: 353821 - RNA, 13 nt, Bordetella pertussis
gagcugcgcggcu

SEQ ID NO: 353822 - RNA, 17 nt, Bordetella pertussis
gagcugcgcgugcacga

SEQ ID NO: 353823 - RNA, 20 nt, Bordetella pertussis
gagcugcgcgugcacgaccu

SEQ ID NO: 353824 - RNA, 22 nt, Bordetella pertussis
gagcugccaggcuaucguggcu

SEQ ID NO: 353825 - RNA, 15 nt, Bordetella pertussis
gaggaccugcuggcg

SEQ ID NO: 353826 - RNA, 22 nt, Bordetella pertussis
gaggacgccgaccucggcaccg

SEQ ID NO: 353827 - RNA, 22 nt, Bordetella pertussis
gaggagcugcugugcgccgggg

SEQ ID NO: 353828 - RNA, 18 nt, Bordetella pertussis
gaggagguuuuccuggag

SEQ ID NO: 353829 - RNA, 19 nt, Bordetella pertussis
gaggcaucgaaggcgaccg

SEQ ID NO: 353830 - RNA, 12 nt, Bordetella pertussis
gaggccagcacg

SEQ ID NO: 353831 - RNA, 13 nt, Bordetella pertussis
gaggccagcacgc

SEQ ID NO: 353832 - RNA, 17 nt, Bordetella pertussis
gaggccagcacgccggc

SEQ ID NO: 353833 - RNA, 19 nt, Bordetella pertussis
gaggccaggcugaccagcg

SEQ ID NO: 353834 - RNA, 14 nt, Bordetella pertussis
gaggcccagccgcu

SEQ ID NO: 353835 - RNA, 12 nt, Bordetella pertussis
gaggccaggccc

SEQ ID NO: 353836 - RNA, 14 nt, Bordetella pertussis
gaggcccggccugc

SEQ ID NO: 353837 - RNA, 14 nt, Bordetella pertussis
gaggcugcgcgcgc

SEQ ID NO: 353838 - RNA, 12 nt, Bordetella pertussis
gaggcuggcgcc

SEQ ID NO: 353839 - RNA, 15 nt, Bordetella pertussis
gaggcuggcgcccac

SEQ ID NO: 353840 - RNA, 16 nt, Bordetella pertussis
gaggcuggugaccgcg

SEQ ID NO: 353841 - RNA, 16 nt, Bordetella pertussis
gaggcuucgauggcgg

SEQ ID NO: 353842 - RNA, 17 nt, Bordetella pertussis
gaggcuucgauggcggc

SEQ ID NO: 353843 - RNA, 18 nt, Bordetella pertussis
gaggcuucgauggcggcg

SEQ ID NO: 353844 - RNA, 21 nt, Bordetella pertussis
gaggcuuuuuuucgccgggcg

SEQ ID NO: 353845 - RNA, 23 nt, Bordetella pertussis
gaggcuuuuuuucgccgggcggc

SEQ ID NO: 353846 - RNA, 22 nt, Bordetella pertussis
gagggaaaacagcgcgggcgca

SEQ ID NO: 353847 - RNA, 18 nt, Bordetella pertussis
gagggcuccaggcugagc

SEQ ID NO: 353848 - RNA, 14 nt, Bordetella pertussis
gagggucuggccgg

SEQ ID NO: 353849 - RNA, 19 nt, Bordetella pertussis
gaggguuucgacgccuucc

SEQ ID NO: 353850 - RNA, 19 nt, Bordetella pertussis
gagguacucgggggcgggc

SEQ ID NO: 353851 - RNA, 20 nt, Bordetella pertussis
gagguaggugaacgacagcg

SEQ ID NO: 353852 - RNA, 15 nt, Bordetella pertussis
gaguacugcguucgg

SEQ ID NO: 353853 - RNA, 14 nt, Bordetella pertussis
gauaaggcgugccg

SEQ ID NO: 353854 - RNA, 19 nt, Bordetella pertussis
gauacagcuuggcgcgcgg

SEQ ID NO: 353855 - RNA, 20 nt, Bordetella pertussis
gauacccauggccgugcgcc

SEQ ID NO: 353856 - RNA, 19 nt, Bordetella pertussis
gauacgcuggaagagaccg

SEQ ID NO: 353857 - RNA, 15 nt, Bordetella pertussis
gauacgggcgcggcg

SEQ ID NO: 353858 - RNA, 16 nt, Bordetella pertussis
gauacgucgcagcacg

SEQ ID NO: 353859 - RNA, 14 nt, Bordetella pertussis
gauacugcgcaugg

SEQ ID NO: 353860 - RNA, 16 nt, Bordetella pertussis
gauacuguucgccgca

SEQ ID NO: 353861 - RNA, 23 nt, Bordetella pertussis
gauacuguucgccgcaccaggcc

SEQ ID NO: 353862 - RNA, 15 nt, Bordetella pertussis
gauagccgcgcgccu

SEQ ID NO: 353863 - RNA, 12 nt, Bordetella pertussis
gauagcgccgcg

SEQ ID NO: 353864 - RNA, 16 nt, Bordetella pertussis
gauagcgccgcgcauc

SEQ ID NO: 353865 - RNA, 18 nt, Bordetella pertussis
gauagcgccguaccagcg

SEQ ID NO: 353866 - RNA, 14 nt, Bordetella pertussis
gauagcgcuccagc

SEQ ID NO: 353867 - RNA, 17 nt, Bordetella pertussis
gauagcggaugaugggc

SEQ ID NO: 353868 - RNA, 15 nt, Bordetella pertussis
gauagcggcgccgcu

SEQ ID NO: 353869 - RNA, 15 nt, Bordetella pertussis
gauagcgggccugca

SEQ ID NO: 353870 - RNA, 16 nt, Bordetella pertussis
gauauagaccagcagc

SEQ ID NO: 353871 - RNA, 23 nt, Bordetella pertussis
gauaugcgagacgaaggcgccgg

SEQ ID NO: 353872 - RNA, 14 nt, Bordetella pertussis
gauaugcgccaggc

SEQ ID NO: 353873 - RNA, 20 nt, Bordetella pertussis
gauaugcgccaggcccuuga

SEQ ID NO: 353874 - RNA, 17 nt, Bordetella pertussis
gaucacauaggccggca

SEQ ID NO: 353875 - RNA, 13 nt, Bordetella pertussis
gaucaccaccggc

SEQ ID NO: 353876 - RNA, 21 nt, Bordetella pertussis
gaucaccacgcccgcgccgca

SEQ ID NO: 353877 - RNA, 18 nt, Bordetella pertussis
gaucaccguuuggccugc

SEQ ID NO: 353878 - RNA, 21 nt, Bordetella pertussis
gaucaccugcaggcccaccgg

SEQ ID NO: 353879 - RNA, 23 nt, Bordetella pertussis
gaucaccugcaggcccaccggca

SEQ ID NO: 353880 - RNA, 20 nt, Bordetella pertussis
gaucacgaacagcgccaggc

SEQ ID NO: 353881 - RNA, 16 nt, Bordetella pertussis
gaucagcaggcccacc

SEQ ID NO: 353882 - RNA, 19 nt, Bordetella pertussis
gaucagcaggucggcgcgg

SEQ ID NO: 353883 - RNA, 17 nt, Bordetella pertussis
gaucagccagccggcgg

SEQ ID NO: 353884 - RNA, 14 nt, Bordetella pertussis
gaucagccgcugca

SEQ ID NO: 353885 - RNA, 17 nt, Bordetella pertussis
gaucagccgcugcagca

SEQ ID NO: 353886 - RNA, 19 nt, Bordetella pertussis
gaucagccgcuuggccugc

SEQ ID NO: 353887 - RNA, 22 nt, Bordetella pertussis
gaucagccgcuuggccugcgcc

SEQ ID NO: 353888 - RNA, 15 nt, Bordetella pertussis
gaucagccggccaug

SEQ ID NO: 353889 - RNA, 17 nt, Bordetella pertussis
gaucagccggccauggc

SEQ ID NO: 353890 - RNA, 22 nt, Bordetella pertussis
gaucagccggccauggcccuug

SEQ ID NO: 353891 - RNA, 16 nt, Bordetella pertussis
gaucagcgacagcagg

SEQ ID NO: 353892 - RNA, 14 nt, Bordetella pertussis
gaucagcgcccagg

SEQ ID NO: 353893 - RNA, 13 nt, Bordetella pertussis
gaucagcgccuca

SEQ ID NO: 353894 - RNA, 19 nt, Bordetella pertussis
gaucagcgcgucggcgccg

SEQ ID NO: 353895 - RNA, 20 nt, Bordetella pertussis
gaucagcgcgucggcgccga

SEQ ID NO: 353896 - RNA, 15 nt, Bordetella pertussis
gaucagcgcgggcca

SEQ ID NO: 353897 - RNA, 13 nt, Bordetella pertussis
gaucagcggcggc

SEQ ID NO: 353898 - RNA, 16 nt, Bordetella pertussis
gaucagcggcggcacg

SEQ ID NO: 353899 - RNA, 16 nt, Bordetella pertussis
gaucagcgggcuggcc

SEQ ID NO: 353900 - RNA, 18 nt, Bordetella pertussis
gaucagcgggcuggccag

SEQ ID NO: 353901 - RNA, 19 nt, Bordetella pertussis
gaucagcuugaugccggcg

SEQ ID NO: 353902 - RNA, 13 nt, Bordetella pertussis
gaucaggaugggc

SEQ ID NO: 353903 - RNA, 17 nt, Bordetella pertussis
gaucaggaugggcgcgg

SEQ ID NO: 353904 - RNA, 12 nt, Bordetella pertussis
gaucaggcgcuc

SEQ ID NO: 353905 - RNA, 21 nt, Bordetella pertussis
gaucaggcgcuccauggcgcc

SEQ ID NO: 353906 - RNA, 23 nt, Bordetella pertussis
gaucaggcgcuccauggcgccgg

SEQ ID NO: 353907 - RNA, 13 nt, Bordetella pertussis
gaucaggcggcgc

SEQ ID NO: 353908 - RNA, 16 nt, Bordetella pertussis
gaucaggcggcgcggc

SEQ ID NO: 353909 - RNA, 14 nt, Bordetella pertussis
gaucaggcugucgc

SEQ ID NO: 353910 - RNA, 18 nt, Bordetella pertussis
gaucaggcugucgcgcgg

SEQ ID NO: 353911 - RNA, 16 nt, Bordetella pertussis
gaucagggccgccagg

SEQ ID NO: 353912 - RNA, 17 nt, Bordetella pertussis
gaucagggccgccaggg

SEQ ID NO: 353913 - RNA, 23 nt, Bordetella pertussis
gaucagggccgccagggcggcug

SEQ ID NO: 353914 - RNA, 24 nt, Bordetella pertussis
gaucagggccgccagggcggcugc

SEQ ID NO: 353915 - RNA, 13 nt, Bordetella pertussis
gaucagggcgcgg

SEQ ID NO: 353916 - RNA, 22 nt, Bordetella pertussis
gaucaucuucgugcuggccauc

SEQ ID NO: 353917 - RNA, 19 nt, Bordetella pertussis
gaucaugaugcgcugggcc

SEQ ID NO: 353918 - RNA, 20 nt, Bordetella pertussis
gaucaugcaguacaggcgcg

SEQ ID NO: 353919 - RNA, 20 nt, Bordetella pertussis
gauccagcccaccgcgaacc

SEQ ID NO: 353920 - RNA, 12 nt, Bordetella pertussis
gauccagccguu

SEQ ID NO: 353921 - RNA, 17 nt, Bordetella pertussis
gauccagccguuggcgc

SEQ ID NO: 353922 - RNA, 20 nt, Bordetella pertussis
gauccagccguuggcgccca

SEQ ID NO: 353923 - RNA, 21 nt, Bordetella pertussis
gauccagcgagaccuugugcg

SEQ ID NO: 353924 - RNA, 17 nt, Bordetella pertussis
gauccagcgccuggggu

SEQ ID NO: 353925 - RNA, 20 nt, Bordetella pertussis
gauccaggccaccgcggcgg

SEQ ID NO: 353926 - RNA, 17 nt, Bordetella pertussis
gauccagggccgccagc

SEQ ID NO: 353927 - RNA, 17 nt, Bordetella pertussis
gauccgcaccggcgugc

SEQ ID NO: 353928 - RNA, 14 nt, Bordetella pertussis
gauccgccaauggc

SEQ ID NO: 353929 - RNA, 18 nt, Bordetella pertussis
gauccgccaauggcggau

SEQ ID NO: 353930 - RNA, 22 nt, Bordetella pertussis
gauccgccaauggcggaugcgc

SEQ ID NO: 353931 - RNA, 23 nt, Bordetella pertussis
gauccgccaauggcggaugcgcc

SEQ ID NO: 353932 - RNA, 18 nt, Bordetella pertussis
gauccgccauaugcgcga

SEQ ID NO: 353933 - RNA, 14 nt, Bordetella pertussis
gauccggcgcuggc

SEQ ID NO: 353934 - RNA, 22 nt, Bordetella pertussis
gauccgguugacgaucucgccc

SEQ ID NO: 353935 - RNA, 14 nt, Bordetella pertussis
gauccgugcggcgc

SEQ ID NO: 353936 - RNA, 22 nt, Bordetella pertussis
gauccucgacccgaaggcgcgg

SEQ ID NO: 353937 - RNA, 23 nt, Bordetella pertussis
gauccucgacccgaaggcgcggc

SEQ ID NO: 353938 - RNA, 13 nt, Bordetella pertussis
gauccucgccagc

SEQ ID NO: 353939 - RNA, 17 nt, Bordetella pertussis
gauccucgcugccggcg

SEQ ID NO: 353940 - RNA, 20 nt, Bordetella pertussis
gauccucgcugccggcgccc

SEQ ID NO: 353941 - RNA, 14 nt, Bordetella pertussis
gauccugcggcgcg

SEQ ID NO: 353942 - RNA, 21 nt, Bordetella pertussis
gaucgaaggcagcgcggccgg

SEQ ID NO: 353943 - RNA, 16 nt, Bordetella pertussis
gaucgacaacaagccg

SEQ ID NO: 353944 - RNA, 15 nt, Bordetella pertussis
gaucgaccgccagca

SEQ ID NO: 353945 - RNA, 20 nt, Bordetella pertussis
gaucgaguggugcgcggucc

SEQ ID NO: 353946 - RNA, 15 nt, Bordetella pertussis
gaucgaguaggccgg

SEQ ID NO: 353947 - RNA, 23 nt, Bordetella pertussis
gaucgaguaggccggcacguccg

SEQ ID NO: 353948 - RNA, 15 nt, Bordetella pertussis
gaucgaucagccagc

SEQ ID NO: 353949 - RNA, 18 nt, Bordetella pertussis
gaucgaucagccagccgg

SEQ ID NO: 353950 - RNA, 12 nt, Bordetella pertussis
gaucgcccgcgu

SEQ ID NO: 353951 - RNA, 20 nt, Bordetella pertussis
gaucgccgaagucggcgcgc

SEQ ID NO: 353952 - RNA, 18 nt, Bordetella pertussis
gaucgccgacgaugucgc

SEQ ID NO: 353953 - RNA, 13 nt, Bordetella pertussis
gaucgccgcaugg

SEQ ID NO: 353954 - RNA, 17 nt, Bordetella pertussis
gaucgccgcaugggcgc

SEQ ID NO: 353955 - RNA, 16 nt, Bordetella pertussis
gaucgccgaucggcaa

SEQ ID NO: 353956 - RNA, 14 nt, Bordetella pertussis
gaucgccggcaacg

SEQ ID NO: 353957 - RNA, 14 nt, Bordetella pertussis
gaucgccggcgccc

SEQ ID NO: 353958 - RNA, 22 nt, Bordetella pertussis
gaucgccggcgcccccagcagc

SEQ ID NO: 353959 - RNA, 20 nt, Bordetella pertussis
gaucgccgguagcgcugggc

SEQ ID NO: 353960 - RNA, 18 nt, Bordetella pertussis
gaucgccggugaugcgau

SEQ ID NO: 353961 - RNA, 20 nt, Bordetella pertussis
gaucuccggauccagccgcu

SEQ ID NO: 353962 - RNA, 19 nt, Bordetella pertussis
gaucuccggcgccuggccg

SEQ ID NO: 353963 - RNA, 17 nt, Bordetella pertussis
gaucuccgggagccugu

SEQ ID NO: 353964 - RNA, 22 nt, Bordetella pertussis
gaucugacgggucacccgccgc

SEQ ID NO: 353965 - RNA, 23 nt, Bordetella pertussis
gaucugacgggucacccgccgca

SEQ ID NO: 353966 - RNA, 23 nt, Bordetella pertussis
gaucugcauguacucggccaggc

SEQ ID NO: 353967 - RNA, 16 nt, Bordetella pertussis
gaucugguccacggcg

SEQ ID NO: 353968 - RNA, 16 nt, Bordetella pertussis
gaucugguuggccaca

SEQ ID NO: 353969 - RNA, 15 nt, Bordetella pertussis
gaucuucccgccaug

SEQ ID NO: 353970 - RNA, 17 nt, Bordetella pertussis
gaucuucgccugcaugg

SEQ ID NO: 353971 - RNA, 15 nt, Bordetella pertussis
gaucuucucgacggc

SEQ ID NO: 353972 - RNA, 18 nt, Bordetella pertussis
gaucuucucgacggcgcg

SEQ ID NO: 353973 - RNA, 22 nt, Bordetella pertussis
gaucuucuggacuugcggcacg

SEQ ID NO: 353974 - RNA, 17 nt, Bordetella pertussis
gaucuugccgaugcggc

SEQ ID NO: 353975 - RNA, 23 nt, Bordetella pertussis
gaugaacgaccagcacgagaugu

SEQ ID NO: 353976 - RNA, 14 nt, Bordetella pertussis
gaugaagaugccga

SEQ ID NO: 353977 - RNA, 21 nt, Bordetella pertussis
gaugaagcccgagcggcgcca

SEQ ID NO: 353978 - RNA, 19 nt, Bordetella pertussis
gaugaagggcuggccggcc

SEQ ID NO: 353979 - RNA, 18 nt, Bordetella pertussis
aacugcuugcgcgugcgc

SEQ ID NO: 353980 - RNA, 20 nt, Bordetella pertussis
aacuggccggccuggcgcgc

SEQ ID NO: 353981 - RNA, 17 nt, Bordetella pertussis
gaugaauuccagccagg

SEQ ID NO: 353982 - RNA, 17 nt, Bordetella pertussis
gaugacaucgccgcugc

SEQ ID NO: 353983 - RNA, 15 nt, Bordetella pertussis
gaugaccagcagcgc

SEQ ID NO: 353984 - RNA, 22 nt, Bordetella pertussis
gaugaccagccagccgccgcgc

SEQ ID NO: 353985 - RNA, 13 nt, Bordetella pertussis
gaugaccagcgcc

SEQ ID NO: 353986 - RNA, 14 nt, Bordetella pertussis
gaugaccagcgccg

SEQ ID NO: 353987 - RNA, 18 nt, Bordetella pertussis
gaugaccagggcgccgac

SEQ ID NO: 353988 - RNA, 14 nt, Bordetella pertussis
gaugaccggccagg

SEQ ID NO: 353989 - RNA, 15 nt, Bordetella pertussis
gaugaccggccaggc

SEQ ID NO: 353990 - RNA, 17 nt, Bordetella pertussis
gaugaccggccaggcgc

SEQ ID NO: 353991 - RNA, 15 nt, Bordetella pertussis
gaugaccucgcgcug

SEQ ID NO: 353992 - RNA, 16 nt, Bordetella pertussis
gaugaccucgcgcugc

SEQ ID NO: 353993 - RNA, 20 nt, Bordetella pertussis
gaugaccucggcgagcgccu

SEQ ID NO: 353994 - RNA, 23 nt, Bordetella pertussis
gaugaccuugagaugccagcggc

SEQ ID NO: 353995 - RNA, 18 nt, Bordetella pertussis
gaugacgcgccgcgccuu

SEQ ID NO: 353996 - RNA, 15 nt, Bordetella pertussis
gaugacucgggcaug

SEQ ID NO: 353997 - RNA, 23 nt, Bordetella pertussis
gaugagcaauuuucgguauggcg

SEQ ID NO: 353998 - RNA, 14 nt, Bordetella pertussis
gaugagcaggccgg

SEQ ID NO: 353999 - RNA, 12 nt, Bordetella pertussis
gaugagcgcgcc

SEQ ID NO: 354000 - RNA, 16 nt, Bordetella pertussis
gaugagcuacccccug

SEQ ID NO: 354001 - RNA, 22 nt, Bordetella pertussis
gaugagguaggugaacgacagc

SEQ ID NO: 354002 - RNA, 13 nt, Bordetella pertussis
gaugaucgcgcag

SEQ ID NO: 354003 - RNA, 14 nt, Bordetella pertussis
gaugaucggcgcca

SEQ ID NO: 354004 - RNA, 18 nt, Bordetella pertussis
gaugaucggcgccaugau

SEQ ID NO: 354005 - RNA, 20 nt, Bordetella pertussis
gaugaucuacgcgcgcgccg

SEQ ID NO: 354006 - RNA, 23 nt, Bordetella pertussis
gaugaucuacgcgcgcgccggca

SEQ ID NO: 354007 - RNA, 18 nt, Bordetella pertussis
gaugaugagcgcgccgcc

SEQ ID NO: 354008 - RNA, 14 nt, Bordetella pertussis
gaugaugauguuca

SEQ ID NO: 354009 - RNA, 14 nt, Bordetella pertussis
gaugaugcggcgcc

SEQ ID NO: 354010 - RNA, 15 nt, Bordetella pertussis
gaugauggcguccgc

SEQ ID NO: 354011 - RNA, 20 nt, Bordetella pertussis
gaugauggucggugccgccg

SEQ ID NO: 354012 - RNA, 13 nt, Bordetella pertussis
aacugggcgucgu

SEQ ID NO: 354013 - RNA, 14 nt, Bordetella pertussis
aacugucgcgccac

SEQ ID NO: 354014 - RNA, 13 nt, Bordetella pertussis
gaugcaccggcca

SEQ ID NO: 354015 - RNA, 14 nt, Bordetella pertussis
gaugcaccggccag

SEQ ID NO: 354016 - RNA, 15 nt, Bordetella pertussis
gaugcaccggccagu

SEQ ID NO: 354017 - RNA, 17 nt, Bordetella pertussis
gaugcaccggccagucg

SEQ ID NO: 354018 - RNA, 18 nt, Bordetella pertussis
gaugcacguagcgcagca

SEQ ID NO: 354019 - RNA, 12 nt, Bordetella pertussis
gaugcagcacgu

SEQ ID NO: 354020 - RNA, 20 nt, Bordetella pertussis
gaugcagcacgucggcgucg

SEQ ID NO: 354021 - RNA, 16 nt, Bordetella pertussis
gaugcaggucggggcg

SEQ ID NO: 354022 - RNA, 19 nt, Bordetella pertussis
gaugcaggucggggcgcuc

SEQ ID NO: 354023 - RNA, 20 nt, Bordetella pertussis
gaugcaugaaccgcagcgcc

SEQ ID NO: 354024 - RNA, 17 nt, Bordetella pertussis
gaugcauucggcggccg

SEQ ID NO: 354025 - RNA, 17 nt, Bordetella pertussis
gaugccaccucgcuugc

SEQ ID NO: 354026 - RNA, 13 nt, Bordetella pertussis
gaugccagcggcg

SEQ ID NO: 354027 - RNA, 16 nt, Bordetella pertussis
gaugccagcggcgcag

SEQ ID NO: 354028 - RNA, 20 nt, Bordetella pertussis
gaugccagcggcgcagccgg

SEQ ID NO: 354029 - RNA, 22 nt, Bordetella pertussis
gaugccagcggcgcagccggcc

SEQ ID NO: 354030 - RNA, 20 nt, Bordetella pertussis
gaugccagugaaacgcgacg

SEQ ID NO: 354031 - RNA, 15 nt, Bordetella pertussis
gaugcccaccagccg

SEQ ID NO: 354032 - RNA, 16 nt, Bordetella pertussis
gaugcccaccagccgc

SEQ ID NO: 354033 - RNA, 18 nt, Bordetella pertussis
gaugcccaccagccgccc

SEQ ID NO: 354034 - RNA, 17 nt, Bordetella pertussis
gaugcccagcaccgcca

SEQ ID NO: 354035 - RNA, 14 nt, Bordetella pertussis
gaugcccagcgcca

SEQ ID NO: 354036 - RNA, 16 nt, Bordetella pertussis
gaugcccagcgccagg

SEQ ID NO: 354037 - RNA, 17 nt, Bordetella pertussis
gaugcccagcgccaggg

SEQ ID NO: 354038 - RNA, 21 nt, Bordetella pertussis
gaugcccaggcccgccagggc

SEQ ID NO: 354039 - RNA, 17 nt, Bordetella pertussis
gaugcccaggcccuggc

SEQ ID NO: 354040 - RNA, 12 nt, Bordetella pertussis
gaugccccaggu

SEQ ID NO: 354041 - RNA, 13 nt, Bordetella pertussis
gaugccccagucc

SEQ ID NO: 354042 - RNA, 19 nt, Bordetella pertussis
gaugccccaguccaggccg

SEQ ID NO: 354043 - RNA, 21 nt, Bordetella pertussis
gaugccccaguccaggccggc

SEQ ID NO: 354044 - RNA, 17 nt, Bordetella pertussis
gaugcccgaggcggcgc

SEQ ID NO: 354045 - RNA, 13 nt, Bordetella pertussis
gaugcccgcgggc

SEQ ID NO: 354046 - RNA, 14 nt, Bordetella pertussis
gaugcccgcgggca

SEQ ID NO: 354047 - RNA, 17 nt, Bordetella pertussis
gaugcccgcgcaccagg

SEQ ID NO: 354048 - RNA, 18 nt, Bordetella pertussis
gaugcccucgcgcacggu

SEQ ID NO: 354049 - RNA, 19 nt, Bordetella pertussis
gaugcccugcgccagcgcc

SEQ ID NO: 354050 - RNA, 22 nt, Bordetella pertussis
gaugcccuggauggccugggug

SEQ ID NO: 354051 - RNA, 17 nt, Bordetella pertussis
gaugcccuggguggcgg

SEQ ID NO: 354052 - RNA, 20 nt, Bordetella pertussis
gaugccgaacaaaccgucga

SEQ ID NO: 354053 - RNA, 13 nt, Bordetella pertussis
gaugccgaacagc

SEQ ID NO: 354054 - RNA, 17 nt, Bordetella pertussis
gaugccgaacagccagg

SEQ ID NO: 354055 - RNA, 20 nt, Bordetella pertussis
gaugccgaacugucgcgcca

SEQ ID NO: 354056 - RNA, 13 nt, Bordetella pertussis
gaugccgaccagg

SEQ ID NO: 354057 - RNA, 22 nt, Bordetella pertussis
gaugccgaccaggcugcgcgcc

SEQ ID NO: 354058 - RNA, 23 nt, Bordetella pertussis
gaugccgauacgucgcagcacgc

SEQ ID NO: 354059 - RNA, 24 nt, Bordetella pertussis
gaugccgcagauggccagcagcgc

SEQ ID NO: 354060 - RNA, 12 nt, Bordetella pertussis
gaugccgcaguu

SEQ ID NO: 354061 - RNA, 23 nt, Bordetella pertussis
gaugccgccaucauccuggucga

SEQ ID NO: 354062 - RNA, 17 nt, Bordetella pertussis
gaugccgccaugcgcca

SEQ ID NO: 354063 - RNA, 22 nt, Bordetella pertussis
gaugccgccaugcgccagcagg

SEQ ID NO: 354064 - RNA, 15 nt, Bordetella pertussis
gaugccgcccacgcc

SEQ ID NO: 354065 - RNA, 13 nt, Bordetella pertussis
gaugccgcccagc

SEQ ID NO: 354066 - RNA, 17 nt, Bordetella pertussis
gaugccgcccagcaugc

SEQ ID NO: 354067 - RNA, 19 nt, Bordetella pertussis
gaugccgcccagcaugcgc

SEQ ID NO: 354068 - RNA, 16 nt, Bordetella pertussis
gaugccgccgccgacg

SEQ ID NO: 354069 - RNA, 17 nt, Bordetella pertussis
gaugccgccggcgggca

SEQ ID NO: 354070 - RNA, 15 nt, Bordetella pertussis
gaugccggccucggc

SEQ ID NO: 354071 - RNA, 16 nt, Bordetella pertussis
gaugccggcgcugcgc

SEQ ID NO: 354072 - RNA, 19 nt, Bordetella pertussis
gaugccggcggccugcacg

SEQ ID NO: 354073 - RNA, 14 nt, Bordetella pertussis
gaugccggcguggc

SEQ ID NO: 354074 - RNA, 16 nt, Bordetella pertussis
gaugccggucuccagc

SEQ ID NO: 354075 - RNA, 22 nt, Bordetella pertussis
gaugccggucuccagcgcgucg

SEQ ID NO: 354076 - RNA, 17 nt, Bordetella pertussis
gaugccgguucgggcgg

SEQ ID NO: 354077 - RNA, 18 nt, Bordetella pertussis
gaugccgguucgggcggg

SEQ ID NO: 354078 - RNA, 15 nt, Bordetella pertussis
gaugccguaccaggu

SEQ ID NO: 354079 - RNA, 22 nt, Bordetella pertussis
gaugccguaccaggugcgcaug

SEQ ID NO: 354080 - RNA, 19 nt, Bordetella pertussis
gaugccguaggugcgcgcc

SEQ ID NO: 354081 - RNA, 23 nt, Bordetella pertussis
gaugccguaggugcgcgccacau

SEQ ID NO: 354082 - RNA, 20 nt, Bordetella pertussis
gaugccguccacgccgcgcg

SEQ ID NO: 354083 - RNA, 22 nt, Bordetella pertussis
gaugccguccacgccgcgcgcg

SEQ ID NO: 354084 - RNA, 14 nt, Bordetella pertussis
gaugccguccuggc

SEQ ID NO: 354085 - RNA, 15 nt, Bordetella pertussis
gaugccgucgagcgc

SEQ ID NO: 354086 - RNA, 17 nt, Bordetella pertussis
gaugccgucgagcgcgg

SEQ ID NO: 354087 - RNA, 20 nt, Bordetella pertussis
gaugccgucgagcgcggcca

SEQ ID NO: 354088 - RNA, 13 nt, Bordetella pertussis
gaugccgucggcg

SEQ ID NO: 354089 - RNA, 19 nt, Bordetella pertussis
gaugccguucuugcccgag

SEQ ID NO: 354090 - RNA, 16 nt, Bordetella pertussis
gaugccguuggccgcg

SEQ ID NO: 354091 - RNA, 21 nt, Bordetella pertussis
gaugccguuggccgcgaaggc

SEQ ID NO: 354092 - RNA, 17 nt, Bordetella pertussis
gaugccucgaagcggcu

SEQ ID NO: 354093 - RNA, 13 nt, Bordetella pertussis
gaugccugucccg

SEQ ID NO: 354094 - RNA, 14 nt, Bordetella pertussis
gaugcgaucgucgc

SEQ ID NO: 354095 - RNA, 17 nt, Bordetella pertussis
gaugcgcaccaugcgca

SEQ ID NO: 354096 - RNA, 23 nt, Bordetella pertussis
gaugcgcaccaugcgcagcaaca

SEQ ID NO: 354097 - RNA, 14 nt, Bordetella pertussis
gaugcgcaccggcc

SEQ ID NO: 354098 - RNA, 17 nt, Bordetella pertussis
gaugcgcaccggccagg

SEQ ID NO: 354099 - RNA, 18 nt, Bordetella pertussis
gaugcgcaccggccaggg

SEQ ID NO: 354100 - RNA, 11 nt, Bordetella pertussis
gaugcgcagca

SEQ ID NO: 354101 - RNA, 22 nt, Bordetella pertussis
gaugcgcagcagcagcgcaucg

SEQ ID NO: 354102 - RNA, 16 nt, Bordetella pertussis
gaugcgcagcaggcgc

SEQ ID NO: 354103 - RNA, 20 nt, Bordetella pertussis
gaugcgcagcaggcgcgugc

SEQ ID NO: 354104 - RNA, 16 nt, Bordetella pertussis
gaugcgcaggacggcg

SEQ ID NO: 354105 - RNA, 18 nt, Bordetella pertussis
gaugcgcaggacggcgcc

SEQ ID NO: 354106 - RNA, 22 nt, Bordetella pertussis
gaugcgcacgggcgagggcugc

SEQ ID NO: 354107 - RNA, 13 nt, Bordetella pertussis
gaugcgcauggga

SEQ ID NO: 354108 - RNA, 14 nt, Bordetella pertussis
gaugcgccaggccu

SEQ ID NO: 354109 - RNA, 20 nt, Bordetella pertussis
gaugcgccaggcgcucggcg

SEQ ID NO: 354110 - RNA, 14 nt, Bordetella pertussis
gaugcgccagucca

SEQ ID NO: 354111 - RNA, 16 nt, Bordetella pertussis
gaugcgccaguccagc

SEQ ID NO: 354112 - RNA, 22 nt, Bordetella pertussis
gaugcgccaguccagcgcgccg

SEQ ID NO: 354113 - RNA, 20 nt, Bordetella pertussis
gaugcgccgcacgucggucg

SEQ ID NO: 354114 - RNA, 11 nt, Bordetella pertussis
gaugcgccgcg

SEQ ID NO: 354115 - RNA, 22 nt, Bordetella pertussis
gaugcgccgcgcuucgucggcg

SEQ ID NO: 354116 - RNA, 19 nt, Bordetella pertussis
gaugcgccggccuggcgcg

SEQ ID NO: 354117 - RNA, 21 nt, Bordetella pertussis
gaugcgccucggcggaugcga

SEQ ID NO: 354118 - RNA, 21 nt, Bordetella pertussis
gaugcgcgaacgggcagccga

SEQ ID NO: 354119 - RNA, 14 nt, Bordetella pertussis
gaugcgcgacaccg

SEQ ID NO: 354120 - RNA, 11 nt, Bordetella pertussis
gaugcgcgccg

SEQ ID NO: 354121 - RNA, 13 nt, Bordetella pertussis
gaugcgcgccgcu

SEQ ID NO: 354122 - RNA, 12 nt, Bordetella pertussis
gaugcgcgccgu

SEQ ID NO: 354123 - RNA, 12 nt, Bordetella pertussis
gaugcgcgccuu

SEQ ID NO: 354124 - RNA, 14 nt, Bordetella pertussis
gaugcgcgcgaccu

SEQ ID NO: 354125 - RNA, 21 nt, Bordetella pertussis
gaugcgcgcgcggaucgacgc

SEQ ID NO: 354126 - RNA, 13 nt, Bordetella pertussis
gaugcgcgcggcc

SEQ ID NO: 354127 - RNA, 14 nt, Bordetella pertussis
gaugcgcgcggcca

SEQ ID NO: 354128 - RNA, 17 nt, Bordetella pertussis
gaugcgcgcggccagcg

SEQ ID NO: 354129 - RNA, 13 nt, Bordetella pertussis
gaugcgcggcacg

SEQ ID NO: 354130 - RNA, 14 nt, Bordetella pertussis
gaugcgcggggcca

SEQ ID NO: 354131 - RNA, 17 nt, Bordetella pertussis
gaugcgcggggccaggc

SEQ ID NO: 354132 - RNA, 18 nt, Bordetella pertussis
gaugcgcggggccaggcg

SEQ ID NO: 354133 - RNA, 15 nt, Bordetella pertussis
gaugcgcuggccggc

SEQ ID NO: 354134 - RNA, 16 nt, Bordetella pertussis
gaugcgcuggccggcc

SEQ ID NO: 354135 - RNA, 17 nt, Bordetella pertussis
gaugcgcuggccggccg

SEQ ID NO: 354136 - RNA, 12 nt, Bordetella pertussis
gaugcgcugggc

SEQ ID NO: 354137 - RNA, 17 nt, Bordetella pertussis
gaugcgcugggccaggc

SEQ ID NO: 354138 - RNA, 20 nt, Bordetella pertussis
aacuuccccgcgugccuguc

SEQ ID NO: 354139 - RNA, 22 nt, Bordetella pertussis
gaugcguucgaaagccagcgcc

SEQ ID NO: 354140 - RNA, 21 nt, Bordetella pertussis
gaugcguucgcccgugccgca

SEQ ID NO: 354141 - RNA, 14 nt, Bordetella pertussis
gaugcucacgccca

SEQ ID NO: 354142 - RNA, 23 nt, Bordetella pertussis
gaugcucgauaugcagcaccgga

SEQ ID NO: 354143 - RNA, 18 nt, Bordetella pertussis
gaugcucgccggcgccgc

SEQ ID NO: 354144 - RNA, 19 nt, Bordetella pertussis
gaugcucgccggcgccgcc

SEQ ID NO: 354145 - RNA, 16 nt, Bordetella pertussis
gauggacuugaccaug

SEQ ID NO: 354146 - RNA, 17 nt, Bordetella pertussis
gauggaucccuggucga

SEQ ID NO: 354147 - RNA, 18 nt, Bordetella pertussis
gauggauucgcgccggcc

SEQ ID NO: 354148 - RNA, 19 nt, Bordetella pertussis
gauggauuucgaccgcaug

SEQ ID NO: 354149 - RNA, 23 nt, Bordetella pertussis
gauggauuucgaccgcaugcggc

SEQ ID NO: 354150 - RNA, 14 nt, Bordetella pertussis
gauggcacggcacg

SEQ ID NO: 354151 - RNA, 21 nt, Bordetella pertussis
gauggcacggcacgccucgcc

SEQ ID NO: 354152 - RNA, 18 nt, Bordetella pertussis
gauggcauggggcaggcg

SEQ ID NO: 354153 - RNA, 15 nt, Bordetella pertussis
gauggccacgaccac

SEQ ID NO: 354154 - RNA, 17 nt, Bordetella pertussis
gauggccacgaccacca

SEQ ID NO: 354155 - RNA, 18 nt, Bordetella pertussis
gauggccacgaccaccag

SEQ ID NO: 354156 - RNA, 19 nt, Bordetella pertussis
gauggccacgaccaccagc

SEQ ID NO: 354157 - RNA, 12 nt, Bordetella pertussis
gauggccgcgcc

SEQ ID NO: 354158 - RNA, 14 nt, Bordetella pertussis
gauggccgcgcgca

SEQ ID NO: 354159 - RNA, 17 nt, Bordetella pertussis
gauggccgcgcgcagcg

SEQ ID NO: 354160 - RNA, 14 nt, Bordetella pertussis
gauggccggccugc

SEQ ID NO: 354161 - RNA, 16 nt, Bordetella pertussis
gauggccggccugccg

SEQ ID NO: 354162 - RNA, 13 nt, Bordetella pertussis
gauggccggcgcg

SEQ ID NO: 354163 - RNA, 16 nt, Bordetella pertussis
gauggccggcgcgaac

SEQ ID NO: 354164 - RNA, 20 nt, Bordetella pertussis
gauggccgggagcggccagc

SEQ ID NO: 354165 - RNA, 16 nt, Bordetella pertussis
gauggccggggcgucg

SEQ ID NO: 354166 - RNA, 20 nt, Bordetella pertussis
gauggccucgcugccagggu

SEQ ID NO: 354167 - RNA, 21 nt, Bordetella pertussis
gauggccucgcugccagggug

SEQ ID NO: 354168 - RNA, 19 nt, Bordetella pertussis
gauggccucggcauggcgc

SEQ ID NO: 354169 - RNA, 23 nt, Bordetella pertussis
gauggccucggcauggcgcgcgc

SEQ ID NO: 354170 - RNA, 13 nt, Bordetella pertussis
gauggccucggcg

SEQ ID NO: 354171 - RNA, 15 nt, Bordetella pertussis
gauggccucggcggc

SEQ ID NO: 354172 - RNA, 21 nt, Bordetella pertussis
gauggccugcuuggcgcgcag

SEQ ID NO: 354173 - RNA, 13 nt, Bordetella pertussis
gauggcgcggccg

SEQ ID NO: 354174 - RNA, 15 nt, Bordetella pertussis
gauggcgcggccgga

SEQ ID NO: 354175 - RNA, 21 nt, Bordetella pertussis
gauggcgcuugugcgucggcu

SEQ ID NO: 354176 - RNA, 14 nt, Bordetella pertussis
gauggcggccaggg

SEQ ID NO: 354177 - RNA, 15 nt, Bordetella pertussis
gauggcggccagggc

SEQ ID NO: 354178 - RNA, 16 nt, Bordetella pertussis
gauggcggccagggca

SEQ ID NO: 354179 - RNA, 16 nt, Bordetella pertussis
gauggcggccgccagc

SEQ ID NO: 354180 - RNA, 19 nt, Bordetella pertussis
gauggcggccgccagcgcc

SEQ ID NO: 354181 - RNA, 22 nt, Bordetella pertussis
gauggcggccgccagcgccaug

SEQ ID NO: 354182 - RNA, 14 nt, Bordetella pertussis
gauggcggcgcugg

SEQ ID NO: 354183 - RNA, 17 nt, Bordetella pertussis
gauggcggcgcuggcgu

SEQ ID NO: 354184 - RNA, 11 nt, Bordetella pertussis
gauggcggcgg

SEQ ID NO: 354185 - RNA, 15 nt, Bordetella pertussis
gauggcucgggcagc

SEQ ID NO: 354186 - RNA, 13 nt, Bordetella pertussis
gauggcuggccga

SEQ ID NO: 354187 - RNA, 19 nt, Bordetella pertussis
gauggcuuccugcggcacg

SEQ ID NO: 354188 - RNA, 20 nt, Bordetella pertussis
gauggcuuccugcggcacga

SEQ ID NO: 354189 - RNA, 18 nt, Bordetella pertussis
gaugggauacgccgugcu

SEQ ID NO: 354190 - RNA, 14 nt, Bordetella pertussis
gaugggcaggccca

SEQ ID NO: 354191 - RNA, 13 nt, Bordetella pertussis
gaugggccaccca

SEQ ID NO: 354192 - RNA, 15 nt, Bordetella pertussis
gaugggccacccagc

SEQ ID NO: 354193 - RNA, 14 nt, Bordetella pertussis
gauggucagcaugu

SEQ ID NO: 354194 - RNA, 21 nt, Bordetella pertussis
gauggucggugccgccgagca

SEQ ID NO: 354195 - RNA, 20 nt, Bordetella pertussis
gauggucugccacaucacgc

SEQ ID NO: 354196 - RNA, 22 nt, Bordetella pertussis
gauggugccgccgcccgacagc

SEQ ID NO: 354197 - RNA, 17 nt, Bordetella pertussis
gauguaccagcccagcc

SEQ ID NO: 354198 - RNA, 21 nt, Bordetella pertussis
gauguagccgacccgcaccga

SEQ ID NO: 354199 - RNA, 20 nt, Bordetella pertussis
gaugucgccgccgcgcacca

SEQ ID NO: 354200 - RNA, 15 nt, Bordetella pertussis
gaugucgcgcgccug

SEQ ID NO: 354201 - RNA, 15 nt, Bordetella pertussis
gaugucgcgcgcgcu

SEQ ID NO: 354202 - RNA, 16 nt, Bordetella pertussis
gaugucgccgucggca

SEQ ID NO: 354203 - RNA, 14 nt, Bordetella pertussis
gaugucgcgcaccg

SEQ ID NO: 354204 - RNA, 13 nt, Bordetella pertussis
gaugucggccagg

SEQ ID NO: 354205 - RNA, 22 nt, Bordetella pertussis
gaugucggccuucugcgccagc

SEQ ID NO: 354206 - RNA, 17 nt, Bordetella pertussis
gauguggucggcgccga

SEQ ID NO: 354207 - RNA, 16 nt, Bordetella pertussis
gauguucaugaccgcc

SEQ ID NO: 354208 - RNA, 23 nt, Bordetella pertussis
gauguucaugaccgccgcgccgg

SEQ ID NO: 354209 - RNA, 15 nt, Bordetella pertussis
gauguuccugcgcga

SEQ ID NO: 354210 - RNA, 17 nt, Bordetella pertussis
gauguugaacagcugga

SEQ ID NO: 354211 - RNA, 17 nt, Bordetella pertussis
gauguugccgccggcca

SEQ ID NO: 354212 - RNA, 17 nt, Bordetella pertussis
gauuccaccuugccgcu

SEQ ID NO: 354213 - RNA, 17 nt, Bordetella pertussis
gauucgccggucggccg

SEQ ID NO: 354214 - RNA, 13 nt, Bordetella pertussis
gauucgcgccggc

SEQ ID NO: 354215 - RNA, 16 nt, Bordetella pertussis
gauucggacgccucgc

SEQ ID NO: 354216 - RNA, 22 nt, Bordetella pertussis
gauugaugucgcgcaccgccug

SEQ ID NO: 354217 - RNA, 16 nt, Bordetella pertussis
gauugccgccgcgcag

SEQ ID NO: 354218 - RNA, 15 nt, Bordetella pertussis
gauugccgcgcggcg

SEQ ID NO: 354219 - RNA, 15 nt, Bordetella pertussis
gauugccguccuggc

SEQ ID NO: 354220 - RNA, 20 nt, Bordetella pertussis
gauugccguccuggcgaccg

SEQ ID NO: 354221 - RNA, 23 nt, Bordetella pertussis
gauugccguccuggcgaccggcg

SEQ ID NO: 354222 - RNA, 17 nt, Bordetella pertussis
gauugcgccagcgcugu

SEQ ID NO: 354223 - RNA, 18 nt, Bordetella pertussis
gauugcggcccgcggccu

SEQ ID NO: 354224 - RNA, 15 nt, Bordetella pertussis
gauuguccagcggca

SEQ ID NO: 354225 - RNA, 20 nt, Bordetella pertussis
gauugugcaugacggccagg

SEQ ID NO: 354226 - RNA, 19 nt, Bordetella pertussis
gcaaacccggcgaagccgg

SEQ ID NO: 354227 - RNA, 23 nt, Bordetella pertussis
gcaaaccugaugccugucccgca

SEQ ID NO: 354228 - RNA, 19 nt, Bordetella pertussis
gcaaacggcggcaggccgc

SEQ ID NO: 354229 - RNA, 14 nt, Bordetella pertussis
gcaacacgaccagc

SEQ ID NO: 354230 - RNA, 16 nt, Bordetella pertussis
gcaacacgaccagcag

SEQ ID NO: 354231 - RNA, 19 nt, Bordetella pertussis
gcaacacgcgcgacgccgu

SEQ ID NO: 354232 - RNA, 23 nt, Bordetella pertussis
gcaacagacccgggccgcuggcc

SEQ ID NO: 354233 - RNA, 13 nt, Bordetella pertussis
gcaacagcagguc

SEQ ID NO: 354234 - RNA, 23 nt, Bordetella pertussis
gcaacagcaggucggagucggcg

SEQ ID NO: 354235 - RNA, 18 nt, Bordetella pertussis
gcaacaggcagcugcgcg

SEQ ID NO: 354236 - RNA, 16 nt, Bordetella pertussis
gcaauucgaccggcag

SEQ ID NO: 354237 - RNA, 21 nt, Bordetella pertussis
gcaauucguugaucuggccgu

SEQ ID NO: 354238 - RNA, 14 nt, Bordetella pertussis
gcaauugcgcggcc

SEQ ID NO: 354239 - RNA, 21 nt, Bordetella pertussis
gcaauugcgcggccaugccgg

SEQ ID NO: 354240 - RNA, 18 nt, Bordetella pertussis
gcaauuuucgguauggcg

SEQ ID NO: 354241 - RNA, 13 nt, Bordetella pertussis
gcacacauggcgc

SEQ ID NO: 354242 - RNA, 22 nt, Bordetella pertussis
gcacaccgucacgcgcaaggcg

SEQ ID NO: 354243 - RNA, 13 nt, Bordetella pertussis
gcacacgaccggc

SEQ ID NO: 354244 - RNA, 23 nt, Bordetella pertussis
gcacacgccgauugaggccagca

SEQ ID NO: 354245 - RNA, 14 nt, Bordetella pertussis
gcacagccgcagcc

SEQ ID NO: 354246 - RNA, 15 nt, Bordetella pertussis
gcacagccgcagccg

SEQ ID NO: 354247 - RNA, 22 nt, Bordetella pertussis
gcacagcccgaucgacggccgc

SEQ ID NO: 354248 - RNA, 13 nt, Bordetella pertussis
gcacagcgcggcg

SEQ ID NO: 354249 - RNA, 23 nt, Bordetella pertussis
gcacagcgcggcgaaggcgcggc

SEQ ID NO: 354250 - RNA, 17 nt, Bordetella pertussis
gcacagcgcggcgaugc

SEQ ID NO: 354251 - RNA, 18 nt, Bordetella pertussis
gcacaggccaucggcgcc

SEQ ID NO: 354252 - RNA, 23 nt, Bordetella pertussis
gcacaggccaucggcgccaagcg

SEQ ID NO: 354253 - RNA, 12 nt, Bordetella pertussis
gcacaggcgcuc

SEQ ID NO: 354254 - RNA, 13 nt, Bordetella pertussis
gcacaggcgcucg

SEQ ID NO: 354255 - RNA, 23 nt, Bordetella pertussis
gcacaggcgcucgcccucgcgcc

SEQ ID NO: 354256 - RNA, 15 nt, Bordetella pertussis
gcacaggcggcgccg

SEQ ID NO: 354257 - RNA, 20 nt, Bordetella pertussis
gcacaggcggcgccggcacg

SEQ ID NO: 354258 - RNA, 19 nt, Bordetella pertussis
gcacagggcgucgcgaugc

SEQ ID NO: 354259 - RNA, 22 nt, Bordetella pertussis
gcacagguagaucagccgcugc

SEQ ID NO: 354260 - RNA, 21 nt, Bordetella pertussis
gcacaguucgugcaccagccc

SEQ ID NO: 354261 - RNA, 16 nt, Bordetella pertussis
gcacaguugcaggcca

SEQ ID NO: 354262 - RNA, 17 nt, Bordetella pertussis
gcacaguugcaggccau

SEQ ID NO: 354263 - RNA, 16 nt, Bordetella pertussis
gcacaguuugucggcg

SEQ ID NO: 354264 - RNA, 13 nt, Bordetella pertussis
gcacauacagcgg

SEQ ID NO: 354265 - RNA, 20 nt, Bordetella pertussis
gcacauacgccgccgaggcg

SEQ ID NO: 354266 - RNA, 22 nt, Bordetella pertussis
gcacaucagcgugccgccggcg

SEQ ID NO: 354267 - RNA, 16 nt, Bordetella pertussis
gcacaucgacgucggc

SEQ ID NO: 354268 - RNA, 19 nt, Bordetella pertussis
gcacaucgacgucggccuc

SEQ ID NO: 354269 - RNA, 16 nt, Bordetella pertussis
gcacaugaugcccagc

SEQ ID NO: 354270 - RNA, 22 nt, Bordetella pertussis
gcacaugaugcccagcgccagg

SEQ ID NO: 354271 - RNA, 15 nt, Bordetella pertussis
gcacaugcccggcca

SEQ ID NO: 354272 - RNA, 20 nt, Bordetella pertussis
gcacaucgucgacgucgauc

SEQ ID NO: 354273 - RNA, 20 nt, Bordetella pertussis
gcacauggcgcgccggccgg

SEQ ID NO: 354274 - RNA, 19 nt, Bordetella pertussis
gcacauuggaguaguggcc

SEQ ID NO: 354275 - RNA, 19 nt, Bordetella pertussis
gcaccaaucuugccaggcc

SEQ ID NO: 354276 - RNA, 16 nt, Bordetella pertussis
gcaccaccagcaccgc

SEQ ID NO: 354277 - RNA, 20 nt, Bordetella pertussis
gcaccaccagcaccgccacg

SEQ ID NO: 354278 - RNA, 22 nt, Bordetella pertussis
gcaccaccagcaccgccacgcg

SEQ ID NO: 354279 - RNA, 15 nt, Bordetella pertussis
gcaccacgaccggcu

SEQ ID NO: 354280 - RNA, 18 nt, Bordetella pertussis
gcaccacgaugucggcgc

SEQ ID NO: 354281 - RNA, 19 nt, Bordetella pertussis
gcaccacgaugucggcgca

SEQ ID NO: 354282 - RNA, 13 nt, Bordetella pertussis
gcaccacgcgcuc

SEQ ID NO: 354283 - RNA, 15 nt, Bordetella pertussis
gcaccacgcgcucca

SEQ ID NO: 354284 - RNA, 14 nt, Bordetella pertussis
gcaccacggcgcgc

SEQ ID NO: 354285 - RNA, 15 nt, Bordetella pertussis
gcaccacggcgcgcg

SEQ ID NO: 354286 - RNA, 17 nt, Bordetella pertussis
gcaccacggcggccagg

SEQ ID NO: 354287 - RNA, 22 nt, Bordetella pertussis
gcaccacggcggccaggccggc

SEQ ID NO: 354288 - RNA, 20 nt, Bordetella pertussis
gcaccacgggcucgcugacc

SEQ ID NO: 354289 - RNA, 23 nt, Bordetella pertussis
gcaccacgggcucgcugaccggc

SEQ ID NO: 354290 - RNA, 14 nt, Bordetella pertussis
gcaccacguccugg

SEQ ID NO: 354291 - RNA, 20 nt, Bordetella pertussis
gcaccagcacaucgacgucg

SEQ ID NO: 354292 - RNA, 16 nt, Bordetella pertussis
gcaccagcacuucgau

SEQ ID NO: 354293 - RNA, 22 nt, Bordetella pertussis
gcaccagccauucgauggcggc

SEQ ID NO: 354294 - RNA, 12 nt, Bordetella pertussis
gcaccagcccga

SEQ ID NO: 354295 - RNA, 20 nt, Bordetella pertussis
gcaccagcagccccagcguc

SEQ ID NO: 354296 - RNA, 16 nt, Bordetella pertussis
gcaccagcaugcgcgu

SEQ ID NO: 354297 - RNA, 14 nt, Bordetella pertussis
gcaccagccgggcu

SEQ ID NO: 354298 - RNA, 21 nt, Bordetella pertussis
gcaccagcgaguuguccuggc

SEQ ID NO: 354299 - RNA, 14 nt, Bordetella pertussis
gcaccagcgccgac

SEQ ID NO: 354300 - RNA, 14 nt, Bordetella pertussis
gcaccagcgccugc

SEQ ID NO: 354301 - RNA, 20 nt, Bordetella pertussis
gcaccagcgcauugccgccg

SEQ ID NO: 354302 - RNA, 16 nt, Bordetella pertussis
gcaccagcgccacgcc

SEQ ID NO: 354303 - RNA, 12 nt, Bordetella pertussis
gcaccagcgcgc

SEQ ID NO: 354304 - RNA, 16 nt, Bordetella pertussis
gcaccagcgcgccgau

SEQ ID NO: 354305 - RNA, 18 nt, Bordetella pertussis
gcaccagcgcgccgcgcg

SEQ ID NO: 354306 - RNA, 14 nt, Bordetella pertussis
gcaccagcggaaug

SEQ ID NO: 354307 - RNA, 19 nt, Bordetella pertussis
gcaccaggauccccagcac

SEQ ID NO: 354308 - RNA, 16 nt, Bordetella pertussis
gcaccaggauuccugc

SEQ ID NO: 354309 - RNA, 18 nt, Bordetella pertussis
gcaccaggccacccgccg

SEQ ID NO: 354310 - RNA, 13 nt, Bordetella pertussis
gcaccaggcccau

SEQ ID NO: 354311 - RNA, 18 nt, Bordetella pertussis
gcaccaggccgccggcca

SEQ ID NO: 354312 - RNA, 14 nt, Bordetella pertussis
gcaccaggccgcgg

SEQ ID NO: 354313 - RNA, 15 nt, Bordetella pertussis
gcaccaggccgcggc

SEQ ID NO: 354314 - RNA, 16 nt, Bordetella pertussis
gcaccaggccgcggcg

SEQ ID NO: 354315 - RNA, 18 nt, Bordetella pertussis
gcaccaggccugccugau

SEQ ID NO: 354316 - RNA, 12 nt, Bordetella pertussis
gcaccaggccga

SEQ ID NO: 354317 - RNA, 20 nt, Bordetella pertussis
gcaccaggccgaacuucagc

SEQ ID NO: 354318 - RNA, 19 nt, Bordetella pertussis
gcaccaggcgcacggcggc

SEQ ID NO: 354319 - RNA, 15 nt, Bordetella pertussis
gcaccaggcgcggcg

SEQ ID NO: 354320 - RNA, 19 nt, Bordetella pertussis
gcaccaggcgcucgcgcgc

SEQ ID NO: 354321 - RNA, 23 nt, Bordetella pertussis
gcaccaggcgcucgcgcgccagc

SEQ ID NO: 354322 - RNA, 23 nt, Bordetella pertussis
gcaccaggcuuugcgcgccaugc

SEQ ID NO: 354323 - RNA, 17 nt, Bordetella pertussis
gcaccagggcgcgcagc

SEQ ID NO: 354324 - RNA, 16 nt, Bordetella pertussis
gcaccagguuggcgau

SEQ ID NO: 354325 - RNA, 16 nt, Bordetella pertussis
gcaccaugccgauggc

SEQ ID NO: 354326 - RNA, 17 nt, Bordetella pertussis
gcaccaugccgauggcg

SEQ ID NO: 354327 - RNA, 14 nt, Bordetella pertussis
gcaccaugccgggg

SEQ ID NO: 354328 - RNA, 16 nt, Bordetella pertussis
gcaccaugcgcaccag

SEQ ID NO: 354329 - RNA, 20 nt, Bordetella pertussis
gcaccaugcgcaccaggcgc

SEQ ID NO: 354330 - RNA, 18 nt, Bordetella pertussis
gcaccaugcgcagcaaca

SEQ ID NO: 354331 - RNA, 18 nt, Bordetella pertussis
gcaccauggcgcccacgg

SEQ ID NO: 354332 - RNA, 21 nt, Bordetella pertussis
gcaccauggcgcccacggccg

SEQ ID NO: 354333 - RNA, 21 nt, Bordetella pertussis
gcaccaugggcgucgucgccg

SEQ ID NO: 354334 - RNA, 18 nt, Bordetella pertussis
gcaccaugggcucgugca

SEQ ID NO: 354335 - RNA, 17 nt, Bordetella pertussis
gcaccaggucgcggugc

SEQ ID NO: 354336 - RNA, 23 nt, Bordetella pertussis
gcaccaugugcgagagcuccagc

SEQ ID NO: 354337 - RNA, 19 nt, Bordetella pertussis
gcaccauugccggcgcgca

SEQ ID NO: 354338 - RNA, 21 nt, Bordetella pertussis
gcaccauucucgcccugcugg

SEQ ID NO: 354339 - RNA, 21 nt, Bordetella pertussis
gcacccacacuuggccggcga

SEQ ID NO: 354340 - RNA, 19 nt, Bordetella pertussis
gcacccgaugacggggcgg

SEQ ID NO: 354341 - RNA, 15 nt, Bordetella pertussis
gcacccggccgcugu

SEQ ID NO: 354342 - RNA, 17 nt, Bordetella pertussis
gcaccgagcacagcaac

SEQ ID NO: 354343 - RNA, 13 nt, Bordetella pertussis
gcaccgaggccga

SEQ ID NO: 354344 - RNA, 17 nt, Bordetella pertussis
gcaccgaggccgagugg

SEQ ID NO: 354345 - RNA, 21 nt, Bordetella pertussis
gcaccgaggccgaguggccgc

SEQ ID NO: 354346 - RNA, 17 nt, Bordetella pertussis
gcaccgaugcgccggcc

SEQ ID NO: 354347 - RNA, 21 nt, Bordetella pertussis
gcaccgaugcgccggccuggc

SEQ ID NO: 354348 - RNA, 14 nt, Bordetella pertussis
gcaccgccgcgcgg

SEQ ID NO: 354349 - RNA, 16 nt, Bordetella pertussis
gcaccgccgccggccc

SEQ ID NO: 354350 - RNA, 14 nt, Bordetella pertussis
gcaccgccgcgucc

SEQ ID NO: 354351 - RNA, 15 nt, Bordetella pertussis
gcaccgccgcguccu

SEQ ID NO: 354352 - RNA, 14 nt, Bordetella pertussis
gcaccgccgcguug

SEQ ID NO: 354353 - RNA, 14 nt, Bordetella pertussis
gcaccgccugcugc

SEQ ID NO: 354354 - RNA, 15 nt, Bordetella pertussis
gcaccgcgcagcccg

SEQ ID NO: 354355 - RNA, 17 nt, Bordetella pertussis
gcaccgcgcagcccggc

SEQ ID NO: 354356 - RNA, 14 nt, Bordetella pertussis
gcaccgcgccagcg

SEQ ID NO: 354357 - RNA, 15 nt, Bordetella pertussis
gcaccgcgccagcgc

SEQ ID NO: 354358 - RNA, 16 nt, Bordetella pertussis
gcaccgcgccagcgcc

SEQ ID NO: 354359 - RNA, 23 nt, Bordetella pertussis
gcaccgcgccagcgccggcgcgu

SEQ ID NO: 354360 - RNA, 22 nt, Bordetella pertussis
gcaccgcgucggccugccagcc

SEQ ID NO: 354361 - RNA, 17 nt, Bordetella pertussis
gcaccgcguggcgcugc

SEQ ID NO: 354362 - RNA, 17 nt, Bordetella pertussis
gcaccggaggcgccgcg

SEQ ID NO: 354363 - RNA, 16 nt, Bordetella pertussis
gcaccggcacgacggc

SEQ ID NO: 354364 - RNA, 17 nt, Bordetella pertussis
gcaccggcacgacggcc

SEQ ID NO: 354365 - RNA, 14 nt, Bordetella pertussis
gcaccggcacgcgc

SEQ ID NO: 354366 - RNA, 17 nt, Bordetella pertussis
gcaccggcacgcgccag

SEQ ID NO: 354367 - RNA, 20 nt, Bordetella pertussis
gcaccggcacgcgccaggcg

SEQ ID NO: 354368 - RNA, 20 nt, Bordetella pertussis
gcaccggcagauggugcucc

SEQ ID NO: 354369 - RNA, 21 nt, Bordetella pertussis
gcaccggccaagcuccaggaa

SEQ ID NO: 354370 - RNA, 23 nt, Bordetella pertussis
gcaccggccaggggcgcuggucg

SEQ ID NO: 354371 - RNA, 15 nt, Bordetella pertussis
gcaccggcccgaaga

SEQ ID NO: 354372 - RNA, 19 nt, Bordetella pertussis
gcaccggccgacccgcggc

SEQ ID NO: 354373 - RNA, 22 nt, Bordetella pertussis
gcaccggccgacccgcggcccu

SEQ ID NO: 354374 - RNA, 22 nt, Bordetella pertussis
gcaccggccgccgcaugccggg

SEQ ID NO: 354375 - RNA, 23 nt, Bordetella pertussis
gcaccugcgucugcacgcugaac

SEQ ID NO: 354376 - RNA, 17 nt, Bordetella pertussis
gcaccugcugcggcacg

SEQ ID NO: 354377 - RNA, 15 nt, Bordetella pertussis
gcaccugcugcuuga

SEQ ID NO: 354378 - RNA, 22 nt, Bordetella pertussis
gcaccugcugcuugaccuuggc

SEQ ID NO: 354379 - RNA, 23 nt, Bordetella pertussis
gcaccugcuugagcaccacgucc

SEQ ID NO: 354380 - RNA, 17 nt, Bordetella pertussis
gcaccugggcgucgauc

SEQ ID NO: 354381 - RNA, 19 nt, Bordetella pertussis
gcaccugguccugcgugau

SEQ ID NO: 354382 - RNA, 18 nt, Bordetella pertussis
gcaccugguggcgcuggc

SEQ ID NO: 354383 - RNA, 17 nt, Bordetella pertussis
gcaccuguucggcggcg

SEQ ID NO: 354384 - RNA, 20 nt, Bordetella pertussis
gcaccuguucggcggcgccc

SEQ ID NO: 354385 - RNA, 21 nt, Bordetella pertussis
gcaccuguucggcggcgccca

SEQ ID NO: 354386 - RNA, 22 nt, Bordetella pertussis
gcaccuguucggcggcgcccau

SEQ ID NO: 354387 - RNA, 20 nt, Bordetella pertussis
gcacgaacgacacccggucg

SEQ ID NO: 354388 - RNA, 22 nt, Bordetella pertussis
gcacgaagccgaugcgccgcgc

SEQ ID NO: 354389 - RNA, 11 nt, Bordetella pertussis
gcacgaagcgg

SEQ ID NO: 354390 - RNA, 19 nt, Bordetella pertussis
gcacgaagggcagcagcag

SEQ ID NO: 354391 - RNA, 22 nt, Bordetella pertussis
gcacgaauguggucgccguucu

SEQ ID NO: 354392 - RNA, 23 nt, Bordetella pertussis
gcacgacagcaucuuggccgcca

SEQ ID NO: 354393 - RNA, 15 nt, Bordetella pertussis
gcacgaccaccagcg

SEQ ID NO: 354394 - RNA, 20 nt, Bordetella pertussis
gcacgaucaccgccgcggcg

SEQ ID NO: 354395 - RNA, 21 nt, Bordetella pertussis
gcacgaucaccgccgcggcga

SEQ ID NO: 354396 - RNA, 17 nt, Bordetella pertussis
gcacgaucacgaacagc

SEQ ID NO: 354397 - RNA, 19 nt, Bordetella pertussis
gcacgaucacgaacagcgc

SEQ ID NO: 354398 - RNA, 16 nt, Bordetella pertussis
gcacgaucgcgccggc

SEQ ID NO: 354399 - RNA, 18 nt, Bordetella pertussis
gcacgaucgcggcgcugg

SEQ ID NO: 354400 - RNA, 18 nt, Bordetella pertussis
gcacgaucggcgccuggc

SEQ ID NO: 354401 - RNA, 15 nt, Bordetella pertussis
gcacgaucuggcgcg

SEQ ID NO: 354402 - RNA, 18 nt, Bordetella pertussis
gcacgaucuggcgcgcga

SEQ ID NO: 354403 - RNA, 23 nt, Bordetella pertussis
gcacgaucuggcgcgcgaccagg

SEQ ID NO: 354404 - RNA, 13 nt, Bordetella pertussis
gcacgaugcccag

SEQ ID NO: 354405 - RNA, 21 nt, Bordetella pertussis
gcacgaugcccagggccgcgc

SEQ ID NO: 354406 - RNA, 12 nt, Bordetella pertussis
gcacgccauggu

SEQ ID NO: 354407 - RNA, 18 nt, Bordetella pertussis
gcacgccauucauccagc

SEQ ID NO: 354408 - RNA, 21 nt, Bordetella pertussis
gcacgccauucauccagcgcg

SEQ ID NO: 354409 - RNA, 16 nt, Bordetella pertussis
gcacgcccagacuggc

SEQ ID NO: 354410 - RNA, 20 nt, Bordetella pertussis
gcacgcccagacuggcguag

SEQ ID NO: 354411 - RNA, 11 nt, Bordetella pertussis
gcacgcccagc

SEQ ID NO: 354412 - RNA, 15 nt, Bordetella pertussis
gcacgcccagccgca

SEQ ID NO: 354413 - RNA, 23 nt, Bordetella pertussis
gcacgcccagccgcagcaggcgc

SEQ ID NO: 354414 - RNA, 14 nt, Bordetella pertussis
gcacgcccgccagc

SEQ ID NO: 354415 - RNA, 15 nt, Bordetella pertussis
gcacgcccgccagca

SEQ ID NO: 354416 - RNA, 17 nt, Bordetella pertussis
gcacgcccgccagcagc

SEQ ID NO: 354417 - RNA, 22 nt, Bordetella pertussis
gcacgcccgcgacgcuggcgau

SEQ ID NO: 354418 - RNA, 16 nt, Bordetella pertussis
gcacgcccgcgcgcga

SEQ ID NO: 354419 - RNA, 14 nt, Bordetella pertussis
gcacgcccgcggcg

SEQ ID NO: 354420 - RNA, 14 nt, Bordetella pertussis
gcacgccgggcgcg

SEQ ID NO: 354421 - RNA, 17 nt, Bordetella pertussis
gcacgccgggcgcgcug

SEQ ID NO: 354422 - RNA, 18 nt, Bordetella pertussis
gcacgccgggcgcgcugc

SEQ ID NO: 354423 - RNA, 17 nt, Bordetella pertussis
gcacgccgggcgcggcc

SEQ ID NO: 354424 - RNA, 19 nt, Bordetella pertussis
gcacgccgggcgcggccgc

SEQ ID NO: 354425 - RNA, 22 nt, Bordetella pertussis
gcacgcccauggucaggacgac

SEQ ID NO: 354426 - RNA, 15 nt, Bordetella pertussis
gcacgccggcgggca

SEQ ID NO: 354427 - RNA, 16 nt, Bordetella pertussis
gcacgccggcgggcag

SEQ ID NO: 354428 - RNA, 20 nt, Bordetella pertussis
gcacgccuugcucgaccagg

SEQ ID NO: 354429 - RNA, 16 nt, Bordetella pertussis
gcacgcgcaccaggcc

SEQ ID NO: 354430 - RNA, 13 nt, Bordetella pertussis
gcacgcgcagcac

SEQ ID NO: 354431 - RNA, 16 nt, Bordetella pertussis
gcacgcgccaggcguu

SEQ ID NO: 354432 - RNA, 19 nt, Bordetella pertussis
gcacgcucagcaugcgcug

SEQ ID NO: 354433 - RNA, 21 nt, Bordetella pertussis
gcacgcucuacacggccgcca

SEQ ID NO: 354434 - RNA, 18 nt, Bordetella pertussis
gcacgcugaccgaagcgg

SEQ ID NO: 354435 - RNA, 23 nt, Bordetella pertussis
gcacgcugaccgaagcgggcgag

SEQ ID NO: 354436 - RNA, 23 nt, Bordetella pertussis
gcacgcucuugagcgcggccucg

SEQ ID NO: 354437 - RNA, 17 nt, Bordetella pertussis
gcacgcugaucgccggc

SEQ ID NO: 354438 - RNA, 18 nt, Bordetella pertussis
gcacgcugaucgccggcg

SEQ ID NO: 354439 - RNA, 12 nt, Bordetella pertussis
gcacgcugcgca

SEQ ID NO: 354440 - RNA, 15 nt, Bordetella pertussis
gcacgcugcgcaggc

SEQ ID NO: 354441 - RNA, 16 nt, Bordetella pertussis
gcacgcugcgcaggcg

SEQ ID NO: 354442 - RNA, 17 nt, Bordetella pertussis
gcacgcugcgcaggcgc

SEQ ID NO: 354443 - RNA, 18 nt, Bordetella pertussis
gcacgcugcgcaggcgcg

SEQ ID NO: 354444 - RNA, 15 nt, Bordetella pertussis
gcacgcugcgcggcg

SEQ ID NO: 354445 - RNA, 17 nt, Bordetella pertussis
gcacgcugcgcggcggc

SEQ ID NO: 354446 - RNA, 17 nt, Bordetella pertussis
gcacggcaaaacggugc

SEQ ID NO: 354447 - RNA, 15 nt, Bordetella pertussis
gcacggcacgccucg

SEQ ID NO: 354448 - RNA, 20 nt, Bordetella pertussis
gcacggcacgccucgccggc

SEQ ID NO: 354449 - RNA, 15 nt, Bordetella pertussis
gcacggccagcggcg

SEQ ID NO: 354450 - RNA, 16 nt, Bordetella pertussis
gcacggccagcggcga

SEQ ID NO: 354451 - RNA, 13 nt, Bordetella pertussis
gcacggccgcggc

SEQ ID NO: 354452 - RNA, 17 nt, Bordetella pertussis
gcacggccgcggccggc

SEQ ID NO: 354453 - RNA, 17 nt, Bordetella pertussis
gcacggccggccaggcg

SEQ ID NO: 354454 - RNA, 18 nt, Bordetella pertussis
gcacggccggccaggcgc

SEQ ID NO: 354455 - RNA, 17 nt, Bordetella pertussis
gcacggccggccugcag

SEQ ID NO: 354456 - RNA, 15 nt, Bordetella pertussis
gcacggcgcacacca

SEQ ID NO: 354457 - RNA, 18 nt, Bordetella pertussis
gcacggccuugucgcgcc

SEQ ID NO: 354458 - RNA, 23 nt, Bordetella pertussis
gcacggcgaugcugccgucgcca

SEQ ID NO: 354459 - RNA, 13 nt, Bordetella pertussis
gcacggcgcggcu

SEQ ID NO: 354460 - RNA, 14 nt, Bordetella pertussis
gcacggggacuggc

SEQ ID NO: 354461 - RNA, 15 nt, Bordetella pertussis
gcacggggagcgacc

SEQ ID NO: 354462 - RNA, 14 nt, Bordetella pertussis
gcacgguccaggcg

SEQ ID NO: 354463 - RNA, 19 nt, Bordetella pertussis
gcacgguccaggcggccgc

SEQ ID NO: 354464 - RNA, 21 nt, Bordetella pertussis
gcacggucgaagaucuucggc

SEQ ID NO: 354465 - RNA, 12 nt, Bordetella pertussis
gcacggucggcg

SEQ ID NO: 354466 - RNA, 15 nt, Bordetella pertussis
gcacggucggcgcgu

SEQ ID NO: 354467 - RNA, 19 nt, Bordetella pertussis
gcacggucugcaccugcgu

SEQ ID NO: 354468 - RNA, 20 nt, Bordetella pertussis
gcacgguguugaccaccacg

SEQ ID NO: 354469 - RNA, 17 nt, Bordetella pertussis
gcacgguuucgccgugc

SEQ ID NO: 354470 - RNA, 16 nt, Bordetella pertussis
gcacguaaucgaagcc

SEQ ID NO: 354471 - RNA, 21 nt, Bordetella pertussis
gcacguaaucgaagccgggcg

SEQ ID NO: 354472 - RNA, 16 nt, Bordetella pertussis
gcacguaccaggcgcu

SEQ ID NO: 354473 - RNA, 17 nt, Bordetella pertussis
gcacguaccaggcgcug

SEQ ID NO: 354474 - RNA, 22 nt, Bordetella pertussis
gcacguaguacagcagcagcac

SEQ ID NO: 354475 - RNA, 17 nt, Bordetella pertussis
gcacgucauccugggcg

SEQ ID NO: 354476 - RNA, 19 nt, Bordetella pertussis
gcacgucauccugggcgcg

SEQ ID NO: 354477 - RNA, 20 nt, Bordetella pertussis
gcacgucauccugggcgcgc

SEQ ID NO: 354478 - RNA, 21 nt, Bordetella pertussis
gcacgucauccugggcgcgcg

SEQ ID NO: 354479 - RNA, 20 nt, Bordetella pertussis
gcacgucauugcaucgcagc

SEQ ID NO: 354480 - RNA, 21 nt, Bordetella pertussis
gcacgucauugcaucgcagca

SEQ ID NO: 354481 - RNA, 12 nt, Bordetella pertussis
gcacgucggcgu

SEQ ID NO: 354482 - RNA, 20 nt, Bordetella pertussis
gcacgucggcgucgggcuug

SEQ ID NO: 354483 - RNA, 19 nt, Bordetella pertussis
gcacgucgggcaggauggc

SEQ ID NO: 354484 - RNA, 20 nt, Bordetella pertussis
gcacgucgggcaggauggcc

SEQ ID NO: 354485 - RNA, 17 nt, Bordetella pertussis
gcacgucguagcgcugc

SEQ ID NO: 354486 - RNA, 15 nt, Bordetella pertussis
gcacgugacgccggc

SEQ ID NO: 354487 - RNA, 16 nt, Bordetella pertussis
gcacgugacgccggcg

SEQ ID NO: 354488 - RNA, 14 nt, Bordetella pertussis
gcacucgaccgccg

SEQ ID NO: 354489 - RNA, 16 nt, Bordetella pertussis
gcacucgaccgccggg

SEQ ID NO: 354490 - RNA, 17 nt, Bordetella pertussis
gcacucgaccgccggga

SEQ ID NO: 354491 - RNA, 17 nt, Bordetella pertussis
gcacuccggauaccgcc

SEQ ID NO: 354492 - RNA, 19 nt, Bordetella pertussis
gcacucuugccgcugcgcg

SEQ ID NO: 354493 - RNA, 22 nt, Bordetella pertussis
gcacugagaaaggccgccacga

SEQ ID NO: 354494 - RNA, 16 nt, Bordetella pertussis
gcacugcaggccaucg

SEQ ID NO: 354495 - RNA, 12 nt, Bordetella pertussis
gcacuggcgcgg

SEQ ID NO: 354496 - RNA, 18 nt, Bordetella pertussis
gcacuggcgcggcgcuac

SEQ ID NO: 354497 - RNA, 22 nt, Bordetella pertussis
gcacuggguggccagcgccgcc

SEQ ID NO: 354498 - RNA, 23 nt, Bordetella pertussis
gcacuggguggccagcgccgcca

SEQ ID NO: 354499 - RNA, 22 nt, Bordetella pertussis
gcacugggugacgcuggagcgc

SEQ ID NO: 354500 - RNA, 21 nt, Bordetella pertussis
gcacuuguggaccgcgaagaa

SEQ ID NO: 354501 - RNA, 17 nt, Bordetella pertussis
gcacuuucgacacgggg

SEQ ID NO: 354502 - RNA, 13 nt, Bordetella pertussis
gcagaaaccccag

SEQ ID NO: 354503 - RNA, 14 nt, Bordetella pertussis
gcagaaaccccagg

SEQ ID NO: 354504 - RNA, 19 nt, Bordetella pertussis
gcagaaaggaugcccgcgg

SEQ ID NO: 354505 - RNA, 18 nt, Bordetella pertussis
gcagaaauggaugcgcgc

SEQ ID NO: 354506 - RNA, 14 nt, Bordetella pertussis
gcagaacagggugc

SEQ ID NO: 354507 - RNA, 13 nt, Bordetella pertussis
gcagaccacgccg

SEQ ID NO: 354508 - RNA, 16 nt, Bordetella pertussis
gcagaccacgccggcg

SEQ ID NO: 354509 - RNA, 20 nt, Bordetella pertussis
gcagaccacgccggcgguca

SEQ ID NO: 354510 - RNA, 24 nt, Bordetella pertussis
gcagaccacgccggcggucacgcc

SEQ ID NO: 354511 - RNA, 19 nt, Bordetella pertussis
gcagaccagcaccggcacg

SEQ ID NO: 354512 - RNA, 16 nt, Bordetella pertussis
gcagacccgcgcccag

SEQ ID NO: 354513 - RNA, 17 nt, Bordetella pertussis
gcagacccgcgcccagc

SEQ ID NO: 354514 - RNA, 23 nt, Bordetella pertussis
gcagauggugcuccgacggcugg

SEQ ID NO: 354515 - RNA, 16 nt, Bordetella pertussis
gcagauuuccagcgcg

SEQ ID NO: 354516 - RNA, 14 nt, Bordetella pertussis
gcagcaacccgccc

SEQ ID NO: 354517 - RNA, 12 nt, Bordetella pertussis
gcagcaacgccg

SEQ ID NO: 354518 - RNA, 14 nt, Bordetella pertussis
gcagcaacgccggc

SEQ ID NO: 354519 - RNA, 14 nt, Bordetella pertussis
gcagcaacgcggcg

SEQ ID NO: 354520 - RNA, 15 nt, Bordetella pertussis
gcagcaacgcggcgu

SEQ ID NO: 354521 - RNA, 15 nt, Bordetella pertussis
gcagcaacggugagc

SEQ ID NO: 354522 - RNA, 21 nt, Bordetella pertussis
gcagcaacggugagccggcca

SEQ ID NO: 354523 - RNA, 14 nt, Bordetella pertussis
gcagcaagcugcug

SEQ ID NO: 354524 - RNA, 16 nt, Bordetella pertussis
gcagcaagcugcugcu

SEQ ID NO: 354525 - RNA, 21 nt, Bordetella pertussis
gcagcaagucagcccgcgucg

SEQ ID NO: 354526 - RNA, 19 nt, Bordetella pertussis
gcagcaauucgaccggcag

SEQ ID NO: 354527 - RNA, 17 nt, Bordetella pertussis
gcagcaccgccagcgcg

SEQ ID NO: 354528 - RNA, 22 nt, Bordetella pertussis
gcagcaccgccagcgcgucguc

SEQ ID NO: 354529 - RNA, 17 nt, Bordetella pertussis
gcagcaccgcgcgcacg

SEQ ID NO: 354530 - RNA, 13 nt, Bordetella pertussis
gcagcaccggcag

SEQ ID NO: 354531 - RNA, 12 nt, Bordetella pertussis
gcagcaccggcg

SEQ ID NO: 354532 - RNA, 18 nt, Bordetella pertussis
gcagccccagcguccagg

SEQ ID NO: 354533 - RNA, 13 nt, Bordetella pertussis
gcagcccgcuggc

SEQ ID NO: 354534 - RNA, 14 nt, Bordetella pertussis
gcagcccgcuggcc

SEQ ID NO: 354535 - RNA, 15 nt, Bordetella pertussis
gcagcccgcuggccg

SEQ ID NO: 354536 - RNA, 14 nt, Bordetella pertussis
gcagcccggccaga

SEQ ID NO: 354537 - RNA, 15 nt, Bordetella pertussis
gcagcccgcgcgccu

SEQ ID NO: 354538 - RNA, 18 nt, Bordetella pertussis
gcagcccgcgcgccugca

SEQ ID NO: 354539 - RNA, 15 nt, Bordetella pertussis
gcagccgcgcgccuu

SEQ ID NO: 354540 - RNA, 16 nt, Bordetella pertussis
gcagccgcgcggccgg

SEQ ID NO: 354541 - RNA, 15 nt, Bordetella pertussis
gcagccggccauggc

SEQ ID NO: 354542 - RNA, 13 nt, Bordetella pertussis
gcagccggccccg

SEQ ID NO: 354543 - RNA, 14 nt, Bordetella pertussis
gcagccggccccgc

SEQ ID NO: 354544 - RNA, 19 nt, Bordetella pertussis
gcagccgggcugccggcag

SEQ ID NO: 354545 - RNA, 18 nt, Bordetella pertussis
gcagcgaacggcccacgc

SEQ ID NO: 354546 - RNA, 23 nt, Bordetella pertussis
gcagcgaacggcccacgcugucg

SEQ ID NO: 354547 - RNA, 15 nt, Bordetella pertussis
gcagcgaaucgcccu

SEQ ID NO: 354548 - RNA, 18 nt, Bordetella pertussis
gcagcgacaacaggucgu

SEQ ID NO: 354549 - RNA, 15 nt, Bordetella pertussis
gcagcgacaggacgu

SEQ ID NO: 354550 - RNA, 18 nt, Bordetella pertussis
gcagcgcaccgacggcag

SEQ ID NO: 354551 - RNA, 15 nt, Bordetella pertussis
gcagcgcagcgccac

SEQ ID NO: 354552 - RNA, 17 nt, Bordetella pertussis
gcagcgcagcgccacgc

SEQ ID NO: 354553 - RNA, 21 nt, Bordetella pertussis
gcagcgcaucgaucucggccu

SEQ ID NO: 354554 - RNA, 18 nt, Bordetella pertussis
gcagcgcaucgccgcagg

SEQ ID NO: 354555 - RNA, 14 nt, Bordetella pertussis
gcagcgcaggaugg

SEQ ID NO: 354556 - RNA, 21 nt, Bordetella pertussis
gcagcgcaggaugggcagcuc

SEQ ID NO: 354557 - RNA, 11 nt, Bordetella pertussis
gcagcgccgca

SEQ ID NO: 354558 - RNA, 21 nt, Bordetella pertussis
gcagcgccgccaccucggcgu

SEQ ID NO: 354559 - RNA, 14 nt, Bordetella pertussis
gcagcgccgcgcgc

SEQ ID NO: 354560 - RNA, 17 nt, Bordetella pertussis
gcagcgccggcaggcgc

SEQ ID NO: 354561 - RNA, 16 nt, Bordetella pertussis
gcagcgccggcugggc

SEQ ID NO: 354562 - RNA, 18 nt, Bordetella pertussis
gcagcgccggcugggcgu

SEQ ID NO: 354563 - RNA, 22 nt, Bordetella pertussis
gcagcgccgguucgacgcugau

SEQ ID NO: 354564 - RNA, 23 nt, Bordetella pertussis
gcagcgccgguucgacgcugauc

SEQ ID NO: 354565 - RNA, 13 nt, Bordetella pertussis
gcagcgcgaccgg

SEQ ID NO: 354566 - RNA, 14 nt, Bordetella pertussis
gcagcgcgaccggc

SEQ ID NO: 354567 - RNA, 15 nt, Bordetella pertussis
gcagcgcgaccgggc

SEQ ID NO: 354568 - RNA, 22 nt, Bordetella pertussis
gcagcgcgacuucgcgaaagcg

SEQ ID NO: 354569 - RNA, 13 nt, Bordetella pertussis
gcagcgcgccagg

SEQ ID NO: 354570 - RNA, 15 nt, Bordetella pertussis
gcagcgcgccaggcg

SEQ ID NO: 354571 - RNA, 17 nt, Bordetella pertussis
gcagcgcgccaggcgcu

SEQ ID NO: 354572 - RNA, 19 nt, Bordetella pertussis
gcagcgcgccaggcgcugc

SEQ ID NO: 354573 - RNA, 20 nt, Bordetella pertussis
gcagcgcgccaggcgcugcg

SEQ ID NO: 354574 - RNA, 14 nt, Bordetella pertussis
gcagcgcgccgggc

SEQ ID NO: 354575 - RNA, 21 nt, Bordetella pertussis
gcagcgcggcacgcugcugau

SEQ ID NO: 354576 - RNA, 13 nt, Bordetella pertussis
gcagcgcggccgg

SEQ ID NO: 354577 - RNA, 13 nt, Bordetella pertussis
gcagcgcggcgcc

SEQ ID NO: 354578 - RNA, 14 nt, Bordetella pertussis
gcagcgcggcgccg

SEQ ID NO: 354579 - RNA, 13 nt, Bordetella pertussis
gcagcgcggcggc

SEQ ID NO: 354580 - RNA, 21 nt, Bordetella pertussis
gcagcgcggcguugaccuggu

SEQ ID NO: 354581 - RNA, 18 nt, Bordetella pertussis
gcagcgcggugcggguga

SEQ ID NO: 354582 - RNA, 18 nt, Bordetella pertussis
gcagcgcgguggccagcg

SEQ ID NO: 354583 - RNA, 19 nt, Bordetella pertussis
gcagcgcgguggccagcga

SEQ ID NO: 354584 - RNA, 15 nt, Bordetella pertussis
gcagcgcguccugcc

SEQ ID NO: 354585 - RNA, 23 nt, Bordetella pertussis
gcagcgcgucggcgcggucggcg

SEQ ID NO: 354586 - RNA, 12 nt, Bordetella pertussis
gcagcggacggc

SEQ ID NO: 354587 - RNA, 14 nt, Bordetella pertussis
gcagcggacggcgc

SEQ ID NO: 354588 - RNA, 16 nt, Bordetella pertussis
gcagcggacggcgcgg

SEQ ID NO: 354589 - RNA, 19 nt, Bordetella pertussis
gcagcggacgguagcgcac

SEQ ID NO: 354590 - RNA, 22 nt, Bordetella pertussis
gcagcggacgguagcgcacgca

SEQ ID NO: 354591 - RNA, 23 nt, Bordetella pertussis
gcagcggacgguagcgcacgcac

SEQ ID NO: 354592 - RNA, 19 nt, Bordetella pertussis
gcagcggacguuggccgau

SEQ ID NO: 354593 - RNA, 18 nt, Bordetella pertussis
gcagcggagcgacggcag

SEQ ID NO: 354594 - RNA, 14 nt, Bordetella pertussis
gcagcggcagcgca

SEQ ID NO: 354595 - RNA, 12 nt, Bordetella pertussis
gcagcggcagca

SEQ ID NO: 354596 - RNA, 15 nt, Bordetella pertussis
gcagcggcagcaugg

SEQ ID NO: 354597 - RNA, 18 nt, Bordetella pertussis
gcagcggcagcauggcgc

SEQ ID NO: 354598 - RNA, 14 nt, Bordetella pertussis
gcagcggcaggccc

SEQ ID NO: 354599 - RNA, 20 nt, Bordetella pertussis
gcagcggcaggcccugccgc

SEQ ID NO: 354600 - RNA, 15 nt, Bordetella pertussis
gcagcggcaggucgg

SEQ ID NO: 354601 - RNA, 18 nt, Bordetella pertussis
gcagcggcaucacgccgg

SEQ ID NO: 354602 - RNA, 20 nt, Bordetella pertussis
gcagcggcaucacgccggug

SEQ ID NO: 354603 - RNA, 12 nt, Bordetella pertussis
gcagcggccagc

SEQ ID NO: 354604 - RNA, 15 nt, Bordetella pertussis
gcagcggccagcgcg

SEQ ID NO: 354605 - RNA, 20 nt, Bordetella pertussis
gcagcggccagcgcggcggc

SEQ ID NO: 354606 - RNA, 17 nt, Bordetella pertussis
gcagcggccauggacga

SEQ ID NO: 354607 - RNA, 12 nt, Bordetella pertussis
gcagcggcgcca

SEQ ID NO: 354608 - RNA, 16 nt, Bordetella pertussis
gcagcggcgacggcgc

SEQ ID NO: 354609 - RNA, 14 nt, Bordetella pertussis
gcagcggcggcacg

SEQ ID NO: 354610 - RNA, 20 nt, Bordetella pertussis
gcagcggcggcacgguggcg

SEQ ID NO: 354611 - RNA, 22 nt, Bordetella pertussis
gcagcggcggcgcggucagcau

SEQ ID NO: 354612 - RNA, 20 nt, Bordetella pertussis
gcagcggcucgacgccguac

SEQ ID NO: 354613 - RNA, 15 nt, Bordetella pertussis
gcagcggcucgagcg

SEQ ID NO: 354614 - RNA, 15 nt, Bordetella pertussis
gcagcggcuucaugc

SEQ ID NO: 354615 - RNA, 16 nt, Bordetella pertussis
gcagcggcuucaugcc

SEQ ID NO: 354616 - RNA, 20 nt, Bordetella pertussis
gcagcggcuucaugccggcg

SEQ ID NO: 354617 - RNA, 20 nt, Bordetella pertussis
gcagcggcuccccuggucag

SEQ ID NO: 354618 - RNA, 20 nt, Bordetella pertussis
gcagcgggcccgucgcgcca

SEQ ID NO: 354619 - RNA, 18 nt, Bordetella pertussis
gcagcggguugcgcgcca

SEQ ID NO: 354620 - RNA, 16 nt, Bordetella pertussis
gcagcguacgcacgcc

SEQ ID NO: 354621 - RNA, 19 nt, Bordetella pertussis
gcagcgucaauccgccgcc

SEQ ID NO: 354622 - RNA, 23 nt, Bordetella pertussis
gcagcgucaauccgccgccagca

SEQ ID NO: 354623 - RNA, 15 nt, Bordetella pertussis
gcagcgucucgccca

SEQ ID NO: 354624 - RNA, 15 nt, Bordetella pertussis
gcagcgucugcuggu

SEQ ID NO: 354625 - RNA, 20 nt, Bordetella pertussis
gcagcgucuggcacgcuugc

SEQ ID NO: 354626 - RNA, 21 nt, Bordetella pertussis
gcagcgugaccgacaggccug

SEQ ID NO: 354627 - RNA, 17 nt, Bordetella pertussis
gcagcgugaugccgucg

SEQ ID NO: 354628 - RNA, 23 nt, Bordetella pertussis
gcagcgugaugcggucggccaca

SEQ ID NO: 354629 - RNA, 21 nt, Bordetella pertussis
gcagcgugauggggccgggcg

SEQ ID NO: 354630 - RNA, 20 nt, Bordetella pertussis
gcagcgugcgacgcauguca

SEQ ID NO: 354631 - RNA, 14 nt, Bordetella pertussis
gcagcgugcugcgu

SEQ ID NO: 354632 - RNA, 14 nt, Bordetella pertussis
gcagcguggcggcg

SEQ ID NO: 354633 - RNA, 15 nt, Bordetella pertussis
gcagcguggcggcga

SEQ ID NO: 354634 - RNA, 13 nt, Bordetella pertussis
gcagcguggcgua

SEQ ID NO: 354635 - RNA, 16 nt, Bordetella pertussis
gcagcguuacgcgacc

SEQ ID NO: 354636 - RNA, 15 nt, Bordetella pertussis
gcagcguugcggcgu

SEQ ID NO: 354637 - RNA, 22 nt, Bordetella pertussis
gcagcguugcggcgucgacgua

SEQ ID NO: 354638 - RNA, 16 nt, Bordetella pertussis
gcagcucccccacgcc

SEQ ID NO: 354639 - RNA, 17 nt, Bordetella pertussis
gcagcucccccacgccg

SEQ ID NO: 354640 - RNA, 18 nt, Bordetella pertussis
gcagcuccguauccuggu

SEQ ID NO: 354641 - RNA, 22 nt, Bordetella pertussis
gcagcuccucggccugccggcg

SEQ ID NO: 354642 - RNA, 16 nt, Bordetella pertussis
gcagcucgcgcugcgc

SEQ ID NO: 354643 - RNA, 14 nt, Bordetella pertussis
gcagcucgcggucg

SEQ ID NO: 354644 - RNA, 15 nt, Bordetella pertussis
gcagcucggcgacca

SEQ ID NO: 354645 - RNA, 14 nt, Bordetella pertussis
gcagcucggcgaag

SEQ ID NO: 354646 - RNA, 17 nt, Bordetella pertussis
gcagcucggugcagccc

SEQ ID NO: 354647 - RNA, 18 nt, Bordetella pertussis
gcagcucggugcagccca

SEQ ID NO: 354648 - RNA, 19 nt, Bordetella pertussis
gcagcucggugcagcccag

SEQ ID NO: 354649 - RNA, 18 nt, Bordetella pertussis
gcagcucguggcgcgccu

SEQ ID NO: 354650 - RNA, 19 nt, Bordetella pertussis
gcagcucguggcgcgccuc

SEQ ID NO: 354651 - RNA, 20 nt, Bordetella pertussis
gcagcugccugagcaccgcc

SEQ ID NO: 354652 - RNA, 14 nt, Bordetella pertussis
gcagcugcgccagc

SEQ ID NO: 354653 - RNA, 20 nt, Bordetella pertussis
gcagcugcuugcccaggccg

SEQ ID NO: 354654 - RNA, 14 nt, Bordetella pertussis
gcagcuggauggcc

SEQ ID NO: 354655 - RNA, 15 nt, Bordetella pertussis
gcagcuggcgcgggc

SEQ ID NO: 354656 - RNA, 19 nt, Bordetella pertussis
gcagcuggcgcgggcggcc

SEQ ID NO: 354657 - RNA, 19 nt, Bordetella pertussis
gcagcuguagcccuggcgc

SEQ ID NO: 354658 - RNA, 20 nt, Bordetella pertussis
gcagcuguagcccuggcgcu

SEQ ID NO: 354659 - RNA, 22 nt, Bordetella pertussis
gcagcuguagcccuggcgcugc

SEQ ID NO: 354660 - RNA, 21 nt, Bordetella pertussis
gcagcuucuugaacucggcca

SEQ ID NO: 354661 - RNA, 17 nt, Bordetella pertussis
gcagcuugcccgcgcgc

SEQ ID NO: 354662 - RNA, 20 nt, Bordetella pertussis
gcagcuugaccgccuccagg

SEQ ID NO: 354663 - RNA, 20 nt, Bordetella pertussis
gcagcuugagcgaaugcgcg

SEQ ID NO: 354664 - RNA, 15 nt, Bordetella pertussis
gcagcuugcgcgccc

SEQ ID NO: 354665 - RNA, 14 nt, Bordetella pertussis
gcagcuuggcgcgc

SEQ ID NO: 354666 - RNA, 19 nt, Bordetella pertussis
gcaggaaaaagccucgccc

SEQ ID NO: 354667 - RNA, 20 nt, Bordetella pertussis
gcaggaaaaagccucgcccu

SEQ ID NO: 354668 - RNA, 22 nt, Bordetella pertussis
gcaggaacaggcugcgcaggcg

SEQ ID NO: 354669 - RNA, 15 nt, Bordetella pertussis
gcaggaagcgcacca

SEQ ID NO: 354670 - RNA, 23 nt, Bordetella pertussis
gcaggaaguccuucagccgcuga

SEQ ID NO: 354671 - RNA, 17 nt, Bordetella pertussis
gcaggaaguucagggcg

SEQ ID NO: 354672 - RNA, 13 nt, Bordetella pertussis
gcaggacgccggc

SEQ ID NO: 354673 - RNA, 19 nt, Bordetella pertussis
gcaggacggcgccguccgc

SEQ ID NO: 354674 - RNA, 16 nt, Bordetella pertussis
gcaggagcccgcugcc

SEQ ID NO: 354675 - RNA, 20 nt, Bordetella pertussis
gcaggagccuguccccgcgg

SEQ ID NO: 354676 - RNA, 14 nt, Bordetella pertussis
gcaggagucgcucc

SEQ ID NO: 354677 - RNA, 12 nt, Bordetella pertussis
gcaggaucagcu

SEQ ID NO: 354678 - RNA, 12 nt, Bordetella pertussis
gcaggaucgcgg

SEQ ID NO: 354679 - RNA, 15 nt, Bordetella pertussis
gcaggaucgcggcca

SEQ ID NO: 354680 - RNA, 17 nt, Bordetella pertussis
gcaggaucgcggccagc

SEQ ID NO: 354681 - RNA, 22 nt, Bordetella pertussis
gcaggaucuccgcccaggugcg

SEQ ID NO: 354682 - RNA, 23 nt, Bordetella pertussis
gcaggaucugguagugcaggccg

SEQ ID NO: 354683 - RNA, 19 nt, Bordetella pertussis
gcaggaugaggcgccgggu

SEQ ID NO: 354684 - RNA, 14 nt, Bordetella pertussis
gcaggaugcgcggc

SEQ ID NO: 354685 - RNA, 17 nt, Bordetella pertussis
gcaggaugcgcggcacg

SEQ ID NO: 354686 - RNA, 18 nt, Bordetella pertussis
gcaggaugcgcuggccgg

SEQ ID NO: 354687 - RNA, 19 nt, Bordetella pertussis
gcaggaugcgcuggccggc

SEQ ID NO: 354688 - RNA, 15 nt, Bordetella pertussis
gcaggauggcgaaca

SEQ ID NO: 354689 - RNA, 20 nt, Bordetella pertussis
gcaggaugggccguccggcc

SEQ ID NO: 354690 - RNA, 21 nt, Bordetella pertussis
gcaggaugggccguccggccg

SEQ ID NO: 354691 - RNA, 12 nt, Bordetella pertussis
gcaggauggggc

SEQ ID NO: 354692 - RNA, 14 nt, Bordetella pertussis
gcaggauguccacg

SEQ ID NO: 354693 - RNA, 18 nt, Bordetella pertussis
gcaggcaagcugcuggcg

SEQ ID NO: 354694 - RNA, 17 nt, Bordetella pertussis
gcaggcacacgaccggc

SEQ ID NO: 354695 - RNA, 19 nt, Bordetella pertussis
gcaggcacacgaccggcuu

SEQ ID NO: 354696 - RNA, 14 nt, Bordetella pertussis
gcaggcacgcggag

SEQ ID NO: 354697 - RNA, 15 nt, Bordetella pertussis
gcaggcacuggcgcg

SEQ ID NO: 354698 - RNA, 18 nt, Bordetella pertussis
gcaggcacuggcgcggcg

SEQ ID NO: 354699 - RNA, 21 nt, Bordetella pertussis
gcaggcauucgaacaacagcg

SEQ ID NO: 354700 - RNA, 20 nt, Bordetella pertussis
gcaggcauugcgccagccgu

SEQ ID NO: 354701 - RNA, 20 nt, Bordetella pertussis
gcaggccagcccgcgcgcgu

SEQ ID NO: 354702 - RNA, 23 nt, Bordetella pertussis
gcaggccagcccgcgcgcguuca

SEQ ID NO: 354703 - RNA, 13 nt, Bordetella pertussis
gcaggccagcgcc

SEQ ID NO: 354704 - RNA, 14 nt, Bordetella pertussis
gcaggccagcgcca

SEQ ID NO: 354705 - RNA, 16 nt, Bordetella pertussis
gcaggccagcgccgcg

SEQ ID NO: 354706 - RNA, 20 nt, Bordetella pertussis
gcaggccaggaagcggcgca

SEQ ID NO: 354707 - RNA, 17 nt, Bordetella pertussis
gcaggccaggcucagca

SEQ ID NO: 354708 - RNA, 13 nt, Bordetella pertussis
gcaggccaucgcg

SEQ ID NO: 354709 - RNA, 17 nt, Bordetella pertussis
gcaggccaucgcggucg

SEQ ID NO: 354710 - RNA, 19 nt, Bordetella pertussis
gcaggccaucgcggucgau

SEQ ID NO: 354711 - RNA, 21 nt, Bordetella pertussis
gcaggccaugcucguccaucg

SEQ ID NO: 354712 - RNA, 17 nt, Bordetella pertussis
gcaggccauugcuggcg

SEQ ID NO: 354713 - RNA, 21 nt, Bordetella pertussis
gcaggccauugcuggcgcgau

SEQ ID NO: 354714 - RNA, 19 nt, Bordetella pertussis
gcaggcccaccagggccag

SEQ ID NO: 354715 - RNA, 13 nt, Bordetella pertussis
gcaggcccaccgg

SEQ ID NO: 354716 - RNA, 15 nt, Bordetella pertussis
gcaggcccagcacgc

SEQ ID NO: 354717 - RNA, 16 nt, Bordetella pertussis
gcaggcccagcacgcg

SEQ ID NO: 354718 - RNA, 15 nt, Bordetella pertussis
gcaggcccagccagc

SEQ ID NO: 354719 - RNA, 20 nt, Bordetella pertussis
gcaggcccagccagcccugg

SEQ ID NO: 354720 - RNA, 16 nt, Bordetella pertussis
gcaggcccagccagcg

SEQ ID NO: 354721 - RNA, 15 nt, Bordetella pertussis
gcaggcccaugccgc

SEQ ID NO: 354722 - RNA, 13 nt, Bordetella pertussis
gcaggcccgacag

SEQ ID NO: 354723 - RNA, 14 nt, Bordetella pertussis
gcaggcccggcgcg

SEQ ID NO: 354724 - RNA, 13 nt, Bordetella pertussis
gcaggcccgggcg

SEQ ID NO: 354725 - RNA, 18 nt, Bordetella pertussis
gcaggcccuugaucaggc

SEQ ID NO: 354726 - RNA, 20 nt, Bordetella pertussis
gcaggcccuugaucaggcgc

SEQ ID NO: 354727 - RNA, 21 nt, Bordetella pertussis
gcaggcccguguagacggcaa

SEQ ID NO: 354728 - RNA, 21 nt, Bordetella pertussis
gcaggccgaggaccugcuggc

SEQ ID NO: 354729 - RNA, 17 nt, Bordetella pertussis
gcaggccgauguagccc

SEQ ID NO: 354730 - RNA, 16 nt, Bordetella pertussis
gcaggccgcagcgggc

SEQ ID NO: 354731 - RNA, 14 nt, Bordetella pertussis
gcaggccgccacuu

SEQ ID NO: 354732 - RNA, 14 nt, Bordetella pertussis
gcaggccgcccagc

SEQ ID NO: 354733 - RNA, 15 nt, Bordetella pertussis
gcaggccgcccagcg

SEQ ID NO: 354734 - RNA, 18 nt, Bordetella pertussis
gcaggccgccgccgguga

SEQ ID NO: 354735 - RNA, 15 nt, Bordetella pertussis
gcaggccgccggccu

SEQ ID NO: 354736 - RNA, 14 nt, Bordetella pertussis
gcaggccgcgaaca

SEQ ID NO: 354737 - RNA, 14 nt, Bordetella pertussis
gcaggccgcgccac

SEQ ID NO: 354738 - RNA, 14 nt, Bordetella pertussis
gcaggccgcgcgca

SEQ ID NO: 354739 - RNA, 14 nt, Bordetella pertussis
gcaggccgcgcugg

SEQ ID NO: 354740 - RNA, 17 nt, Bordetella pertussis
gcaggccgcggccaggc

SEQ ID NO: 354741 - RNA, 14 nt, Bordetella pertussis
gcaggccggcgcgc

SEQ ID NO: 354742 - RNA, 15 nt, Bordetella pertussis
gcaggccggcgcgca

SEQ ID NO: 354743 - RNA, 16 nt, Bordetella pertussis
gcaggccggcgcgcau

SEQ ID NO: 354744 - RNA, 16 nt, Bordetella pertussis
gcaggccggcgcgcgc

SEQ ID NO: 354745 - RNA, 15 nt, Bordetella pertussis
gcaggccggcggcca

SEQ ID NO: 354746 - RNA, 21 nt, Bordetella pertussis
gcaggccggcggccagcgcgc

SEQ ID NO: 354747 - RNA, 20 nt, Bordetella pertussis
gcaggccggcguucaccagg

SEQ ID NO: 354748 - RNA, 15 nt, Bordetella pertussis
gcaggccggccagca

SEQ ID NO: 354749 - RNA, 18 nt, Bordetella pertussis
gcaggccguuggccgcgc

SEQ ID NO: 354750 - RNA, 20 nt, Bordetella pertussis
gcaggccucgcccgaucggc

SEQ ID NO: 354751 - RNA, 15 nt, Bordetella pertussis
gcaggccugcacgac

SEQ ID NO: 354752 - RNA, 17 nt, Bordetella pertussis
gcaggccugcacgacgg

SEQ ID NO: 354753 - RNA, 18 nt, Bordetella pertussis
gcaggccugcugcagcgu

SEQ ID NO: 354754 - RNA, 20 nt, Bordetella pertussis
gcaggcgaaacgccagcccg

SEQ ID NO: 354755 - RNA, 21 nt, Bordetella pertussis
gcaggcgaaacgccagcccga

SEQ ID NO: 354756 - RNA, 22 nt, Bordetella pertussis
gcaggcgaaacgccagcccgac

SEQ ID NO: 354757 - RNA, 14 nt, Bordetella pertussis
gcaggcgcaccagc

SEQ ID NO: 354758 - RNA, 18 nt, Bordetella pertussis
gcaggcgcaccagcgcgc

SEQ ID NO: 354759 - RNA, 20 nt, Bordetella pertussis
gcaggcgcaccagcgcgccg

SEQ ID NO: 354760 - RNA, 15 nt, Bordetella pertussis
gcaggcgcagcggcg

SEQ ID NO: 354761 - RNA, 17 nt, Bordetella pertussis
gcaggcgcagcggcggc

SEQ ID NO: 354762 - RNA, 14 nt, Bordetella pertussis
gcaggcgcaggccg

SEQ ID NO: 354763 - RNA, 17 nt, Bordetella pertussis
gcaggcgcaggccgcgc

SEQ ID NO: 354764 - RNA, 12 nt, Bordetella pertussis
gcaggcgccagu

SEQ ID NO: 354765 - RNA, 21 nt, Bordetella pertussis
gcaggcgcccaacccaggucg

SEQ ID NO: 354766 - RNA, 13 nt, Bordetella pertussis
gcaggcgccgccg

SEQ ID NO: 354767 - RNA, 19 nt, Bordetella pertussis
gcaggcgccgccgcccggc

SEQ ID NO: 354768 - RNA, 21 nt, Bordetella pertussis
gcaggcgccgccgcccggcaa

SEQ ID NO: 354769 - RNA, 14 nt, Bordetella pertussis
gcaggcgcaucagc

SEQ ID NO: 354770 - RNA, 14 nt, Bordetella pertussis
gcaggcgccugccc

SEQ ID NO: 354771 - RNA, 19 nt, Bordetella pertussis
gcaggcgccuucggcgcgg

SEQ ID NO: 354772 - RNA, 14 nt, Bordetella pertussis
gcaggcgcgagcgc

SEQ ID NO: 354773 - RNA, 15 nt, Bordetella pertussis
gcaggcgccggcugg

SEQ ID NO: 354774 - RNA, 19 nt, Bordetella pertussis
gcaggcgcgccgggccggc

SEQ ID NO: 354775 - RNA, 12 nt, Bordetella pertussis
gcaggcgcgcgg

SEQ ID NO: 354776 - RNA, 14 nt, Bordetella pertussis
gcaggcgcgcggcc

SEQ ID NO: 354777 - RNA, 15 nt, Bordetella pertussis
gcaggcgcgcggccu

SEQ ID NO: 354778 - RNA, 16 nt, Bordetella pertussis
gcaggcgcgcggccuc

SEQ ID NO: 354779 - RNA, 22 nt, Bordetella pertussis
gcaggcgcgcucaggccgccgg

SEQ ID NO: 354780 - RNA, 20 nt, Bordetella pertussis
gcaggcgcguggccacggcg

SEQ ID NO: 354781 - RNA, 17 nt, Bordetella pertussis
gcaggcgcucgaggcgc

SEQ ID NO: 354782 - RNA, 20 nt, Bordetella pertussis
gcaggcgcucgaggcgcugg

SEQ ID NO: 354783 - RNA, 13 nt, Bordetella pertussis
gcaggcgcucggc

SEQ ID NO: 354784 - RNA, 15 nt, Bordetella pertussis
gcaggcgcucggcca

SEQ ID NO: 354785 - RNA, 17 nt, Bordetella pertussis
gcaggcgcucggccagc

SEQ ID NO: 354786 - RNA, 19 nt, Bordetella pertussis
gcaggcgcucggccagcga

SEQ ID NO: 354787 - RNA, 14 nt, Bordetella pertussis
gcaggcgcugcagc

SEQ ID NO: 354788 - RNA, 11 nt, Bordetella pertussis
gcaggcgcugg

SEQ ID NO: 354789 - RNA, 14 nt, Bordetella pertussis
gcaggcgcuggucg

SEQ ID NO: 354790 - RNA, 18 nt, Bordetella pertussis
gcaggcggccgaccagca

SEQ ID NO: 354791 - RNA, 23 nt, Bordetella pertussis
gcaggcggcgcaucagcgcgccc

SEQ ID NO: 354792 - RNA, 21 nt, Bordetella pertussis
gcaggcggcggccuccagcag

SEQ ID NO: 354793 - RNA, 22 nt, Bordetella pertussis
gcaggcggcggccuccagcagg

SEQ ID NO: 354794 - RNA, 20 nt, Bordetella pertussis
gcaggcggcuuucaugggcc

SEQ ID NO: 354795 - RNA, 22 nt, Bordetella pertussis
gcaggcgugcgcgggcgccauc

SEQ ID NO: 354796 - RNA, 13 nt, Bordetella pertussis
gcaggcgucggcc

SEQ ID NO: 354797 - RNA, 16 nt, Bordetella pertussis
gcaggcgucggccagc

SEQ ID NO: 354798 - RNA, 18 nt, Bordetella pertussis
gcaggcucagcgggcugc

SEQ ID NO: 354799 - RNA, 16 nt, Bordetella pertussis
gcaggcucuggcugac

SEQ ID NO: 354800 - RNA, 14 nt, Bordetella pertussis
gcaggcugccgccg

SEQ ID NO: 354801 - RNA, 15 nt, Bordetella pertussis
gcaggcuggccaccg

SEQ ID NO: 354802 - RNA, 14 nt, Bordetella pertussis
gcaggcuggccggc

SEQ ID NO: 354803 - RNA, 21 nt, Bordetella pertussis
gcaggcuggccggcguggccu

SEQ ID NO: 354804 - RNA, 21 nt, Bordetella pertussis
gcaggcuuucgcacagccggg

SEQ ID NO: 354805 - RNA, 20 nt, Bordetella pertussis
gcaggcuuugcuggccauag

SEQ ID NO: 354806 - RNA, 15 nt, Bordetella pertussis
gcagggacuugggca

SEQ ID NO: 354807 - RNA, 14 nt, Bordetella pertussis
gcagggacaggcac

SEQ ID NO: 354808 - RNA, 19 nt, Bordetella pertussis
gcagggcaugggcccgggc

SEQ ID NO: 354809 - RNA, 20 nt, Bordetella pertussis
gcagggcaugggcccgggcg

SEQ ID NO: 354810 - RNA, 21 nt, Bordetella pertussis
gcagggcaugggcccgggcgc

SEQ ID NO: 354811 - RNA, 18 nt, Bordetella pertussis
gcagggccacgcccaggc

SEQ ID NO: 354812 - RNA, 20 nt, Bordetella pertussis
gcagggccacgcccaggccg

SEQ ID NO: 354813 - RNA, 24 nt, Bordetella pertussis
gcagggccacgcccaggccguggc

SEQ ID NO: 354814 - RNA, 15 nt, Bordetella pertussis
gcagggccaggccga

SEQ ID NO: 354815 - RNA, 18 nt, Bordetella pertussis
gcagggcccgcaucggcg

SEQ ID NO: 354816 - RNA, 13 nt, Bordetella pertussis
gcagggccaggcc

SEQ ID NO: 354817 - RNA, 14 nt, Bordetella pertussis
gcagggccaggccg

SEQ ID NO: 354818 - RNA, 22 nt, Bordetella pertussis
gcagggccggccgggcgcggcg

SEQ ID NO: 354819 - RNA, 16 nt, Bordetella pertussis
gcagggccuccugcag

SEQ ID NO: 354820 - RNA, 14 nt, Bordetella pertussis
gcagggccuggcag

SEQ ID NO: 354821 - RNA, 19 nt, Bordetella pertussis
gcagggcgcaacgccggcc

SEQ ID NO: 354822 - RNA, 15 nt, Bordetella pertussis
gcagggcgccgacga

SEQ ID NO: 354823 - RNA, 21 nt, Bordetella pertussis
gcagggcgacgucccaggccg

SEQ ID NO: 354824 - RNA, 12 nt, Bordetella pertussis
gcagggcggcca

SEQ ID NO: 354825 - RNA, 15 nt, Bordetella pertussis
gcagggcggccaggc

SEQ ID NO: 354826 - RNA, 17 nt, Bordetella pertussis
gcagggcggccaggccg

SEQ ID NO: 354827 - RNA, 18 nt, Bordetella pertussis
gcagggcggccaggccgg

SEQ ID NO: 354828 - RNA, 15 nt, Bordetella pertussis
gcagggcggccggca

SEQ ID NO: 354829 - RNA, 18 nt, Bordetella pertussis
gcagggcggccucgacgg

SEQ ID NO: 354830 - RNA, 22 nt, Bordetella pertussis
gcagggcggccucgacggccgc

SEQ ID NO: 354831 - RNA, 14 nt, Bordetella pertussis
gcagggcgucggcc

SEQ ID NO: 354832 - RNA, 21 nt, Bordetella pertussis
gcagggcgucggccgcgccca

SEQ ID NO: 354833 - RNA, 15 nt, Bordetella pertussis
gcaggggauugccgc

SEQ ID NO: 354834 - RNA, 21 nt, Bordetella pertussis
gcaggggccgcacgcgcggca

SEQ ID NO: 354835 - RNA, 17 nt, Bordetella pertussis
gcaggggguggcggccg

SEQ ID NO: 354836 - RNA, 22 nt, Bordetella pertussis
gcagggucagcccgccaucgcg

SEQ ID NO: 354837 - RNA, 19 nt, Bordetella pertussis
gcagggucagcggccggcc

SEQ ID NO: 354838 - RNA, 20 nt, Bordetella pertussis
gcaggguccgucggauugcg

SEQ ID NO: 354839 - RNA, 19 nt, Bordetella pertussis
gcagggucgagaccagcag

SEQ ID NO: 354840 - RNA, 16 nt, Bordetella pertussis
gcagggugccuguccc

SEQ ID NO: 354841 - RNA, 13 nt, Bordetella pertussis
gcaggguggccac

SEQ ID NO: 354842 - RNA, 18 nt, Bordetella pertussis
gcagggugucggccaggg

SEQ ID NO: 354843 - RNA, 19 nt, Bordetella pertussis
gcagggugucggccagggc

SEQ ID NO: 354844 - RNA, 20 nt, Bordetella pertussis
gcaggguuggcgcgccgugg

SEQ ID NO: 354845 - RNA, 21 nt, Bordetella pertussis
gcaggguuuuauacggcgcga

SEQ ID NO: 354846 - RNA, 14 nt, Bordetella pertussis
gcagguaggacggc

SEQ ID NO: 354847 - RNA, 16 nt, Bordetella pertussis
gcagguaggacggcgc

SEQ ID NO: 354848 - RNA, 21 nt, Bordetella pertussis
gcagguagucggucaccgucc

SEQ ID NO: 354849 - RNA, 13 nt, Bordetella pertussis
gcagguauuccgc

SEQ ID NO: 354850 - RNA, 17 nt, Bordetella pertussis
gcaggucaucgcgcugg

SEQ ID NO: 354851 - RNA, 19 nt, Bordetella pertussis
gcaggucaucgcgcuggcg

SEQ ID NO: 354852 - RNA, 20 nt, Bordetella pertussis
gcagguccaccgccacguca

SEQ ID NO: 354853 - RNA, 14 nt, Bordetella pertussis
gcagguccaggccu

SEQ ID NO: 354854 - RNA, 16 nt, Bordetella pertussis
gcagguccaggccugg

SEQ ID NO: 354855 - RNA, 20 nt, Bordetella pertussis
gcagguccauggccagucug

SEQ ID NO: 354856 - RNA, 23 nt, Bordetella pertussis
gcagguccugguagaucagcgcg

SEQ ID NO: 354857 - RNA, 22 nt, Bordetella pertussis
gcaggucgaucuccacgaaggc

SEQ ID NO: 354858 - RNA, 20 nt, Bordetella pertussis
gcaggucgccagcaggcccu

SEQ ID NO: 354859 - RNA, 13 nt, Bordetella pertussis
gcaggucgcgcac

SEQ ID NO: 354860 - RNA, 12 nt, Bordetella pertussis
gcaggucgcgcg

SEQ ID NO: 354861 - RNA, 16 nt, Bordetella pertussis
gcaggucggcgaugcg

SEQ ID NO: 354862 - RNA, 13 nt, Bordetella pertussis
gcaggucggcgcg

SEQ ID NO: 354863 - RNA, 14 nt, Bordetella pertussis
gcaggucggcgcgg

SEQ ID NO: 354864 - RNA, 16 nt, Bordetella pertussis
gcaggucggcgcggcc

SEQ ID NO: 354865 - RNA, 17 nt, Bordetella pertussis
gcaggucggccaggacg

SEQ ID NO: 354866 - RNA, 19 nt, Bordetella pertussis
gcaggucggggcgcucgag

SEQ ID NO: 354867 - RNA, 13 nt, Bordetella pertussis
gcaggucgucgag

SEQ ID NO: 354868 - RNA, 17 nt, Bordetella pertussis
gcaggucguggccgugc

SEQ ID NO: 354869 - RNA, 19 nt, Bordetella pertussis
gcaggucugcacgaggcgc

SEQ ID NO: 354870 - RNA, 15 nt, Bordetella pertussis
gcaggucuucgggcg

SEQ ID NO: 354871 - RNA, 17 nt, Bordetella pertussis
gcaggucuucgggcgug

SEQ ID NO: 354872 - RNA, 17 nt, Bordetella pertussis
gcaggugaugcgcgcgg

SEQ ID NO: 354873 - RNA, 20 nt, Bordetella pertussis
gcaggugaugcgcgcggcca

SEQ ID NO: 354874 - RNA, 14 nt, Bordetella pertussis
gcaggugccugucc

SEQ ID NO: 354875 - RNA, 15 nt, Bordetella pertussis
gcaggugccuguccc

SEQ ID NO: 354876 - RNA, 13 nt, Bordetella pertussis
gcaggugcgccag

SEQ ID NO: 354877 - RNA, 17 nt, Bordetella pertussis
gcaggugccgccggcgc

SEQ ID NO: 354878 - RNA, 19 nt, Bordetella pertussis
gcaggugccgccggcgcgg

SEQ ID NO: 354879 - RNA, 21 nt, Bordetella pertussis
gcaggugcgucacgcacagca

SEQ ID NO: 354880 - RNA, 15 nt, Bordetella pertussis
gcagguggccagccc

SEQ ID NO: 354881 - RNA, 14 nt, Bordetella pertussis
gcagguggcgcugu

SEQ ID NO: 354882 - RNA, 20 nt, Bordetella pertussis
gcagguggcgcuguccggcg

SEQ ID NO: 354883 - RNA, 21 nt, Bordetella pertussis
gcagguggggcagcaggccgg

SEQ ID NO: 354884 - RNA, 18 nt, Bordetella pertussis
gcaggugucgccccccau

SEQ ID NO: 354885 - RNA, 22 nt, Bordetella pertussis
gcaggugugccagccgcuggcg

SEQ ID NO: 354886 - RNA, 19 nt, Bordetella pertussis
gcagguguuguugcacgac

SEQ ID NO: 354887 - RNA, 18 nt, Bordetella pertussis
gcagguucugcgcguccu

SEQ ID NO: 354888 - RNA, 23 nt, Bordetella pertussis
gcaguacccaguacgagaacgcg

SEQ ID NO: 354889 - RNA, 14 nt, Bordetella pertussis
gcaguacgagcggc

SEQ ID NO: 354890 - RNA, 17 nt, Bordetella pertussis
gcaguacguacgcccgg

SEQ ID NO: 354891 - RNA, 14 nt, Bordetella pertussis
gcaguagcgcucga

SEQ ID NO: 354892 - RNA, 14 nt, Bordetella pertussis
gcaguaucccggcc

SEQ ID NO: 354893 - RNA, 17 nt, Bordetella pertussis
gcaguaucccggccagg

SEQ ID NO: 354894 - RNA, 18 nt, Bordetella pertussis
gcaguaucuggugcgcgu

SEQ ID NO: 354895 - RNA, 19 nt, Bordetella pertussis
gcaguaugcaaccggcacg

SEQ ID NO: 354896 - RNA, 12 nt, Bordetella pertussis
gcagucagccgu

SEQ ID NO: 354897 - RNA, 16 nt, Bordetella pertussis
gcagucccaguccggc

SEQ ID NO: 354898 - RNA, 14 nt, Bordetella pertussis
gcaguccuggcugg

SEQ ID NO: 354899 - RNA, 14 nt, Bordetella pertussis
gcagucgcgcagcc

SEQ ID NO: 354900 - RNA, 16 nt, Bordetella pertussis
gccaacucgcuccagc

SEQ ID NO: 354901 - RNA, 17 nt, Bordetella pertussis
gccaagaccgcggccgc

SEQ ID NO: 354902 - RNA, 23 nt, Bordetella pertussis
gccaagaccgcggccgcgcuggc

SEQ ID NO: 354903 - RNA, 20 nt, Bordetella pertussis
gccaagcagaccuaccaggc

SEQ ID NO: 354904 - RNA, 22 nt, Bordetella pertussis
gccaagcagaccuaccaggccg

SEQ ID NO: 354905 - RNA, 18 nt, Bordetella pertussis
gccaagggcgccgcgccg

SEQ ID NO: 354906 - RNA, 21 nt, Bordetella pertussis
gccaagggcgccgcgccgggg

SEQ ID NO: 354907 - RNA, 17 nt, Bordetella pertussis
gccaagggcgcgccagc

SEQ ID NO: 354908 - RNA, 18 nt, Bordetella pertussis
gccaagggcgcgccagca

SEQ ID NO: 354909 - RNA, 14 nt, Bordetella pertussis
gccaagggcgccgc

SEQ ID NO: 354910 - RNA, 23 nt, Bordetella pertussis
gccaauaacagaggaacgccgcg

SEQ ID NO: 354911 - RNA, 18 nt, Bordetella pertussis
gccaaugcgccgcgccaa

SEQ ID NO: 354912 - RNA, 16 nt, Bordetella pertussis
gccaauggccgcggcg

SEQ ID NO: 354913 - RNA, 23 nt, Bordetella pertussis
gccaauggccggugagauccagc

SEQ ID NO: 354914 - RNA, 17 nt, Bordetella pertussis
gccaauggcggaugcgc

SEQ ID NO: 354915 - RNA, 23 nt, Bordetella pertussis
gccaauuguccuggucgaccagg

SEQ ID NO: 354916 - RNA, 21 nt, Bordetella pertussis
gccacaaagccuccguccaug

SEQ ID NO: 354917 - RNA, 23 nt, Bordetella pertussis
gccacaaagccuccguccaugcg

SEQ ID NO: 354918 - RNA, 15 nt, Bordetella pertussis
gccacaaagggcgug

SEQ ID NO: 354919 - RNA, 16 nt, Bordetella pertussis
gccacagauuggccac

SEQ ID NO: 354920 - RNA, 23 nt, Bordetella pertussis
gccacagcaugaccucggccugc

SEQ ID NO: 354921 - RNA, 13 nt, Bordetella pertussis
gccacagcgccau

SEQ ID NO: 354922 - RNA, 17 nt, Bordetella pertussis
gccacagcgccaucgcg

SEQ ID NO: 354923 - RNA, 20 nt, Bordetella pertussis
gccacagcgccaucgcgcgc

SEQ ID NO: 354924 - RNA, 12 nt, Bordetella pertussis
gccacagcgccg

SEQ ID NO: 354925 - RNA, 14 nt, Bordetella pertussis
gccacagcgccgcg

SEQ ID NO: 354926 - RNA, 12 nt, Bordetella pertussis
gccacaggccca

SEQ ID NO: 354927 - RNA, 13 nt, Bordetella pertussis
gccacaggcccau

SEQ ID NO: 354928 - RNA, 15 nt, Bordetella pertussis
gccacaggcccaugc

SEQ ID NO: 354929 - RNA, 15 nt, Bordetella pertussis
gccaccaacgaaggc

SEQ ID NO: 354930 - RNA, 14 nt, Bordetella pertussis
gccaccaccaggcc

SEQ ID NO: 354931 - RNA, 20 nt, Bordetella pertussis
gccaccaccggcacgccggc

SEQ ID NO: 354932 - RNA, 22 nt, Bordetella pertussis
gccaccaccggcacgccggcgg

SEQ ID NO: 354933 - RNA, 20 nt, Bordetella pertussis
gccaccaccgucucgaacgc

SEQ ID NO: 354934 - RNA, 21 nt, Bordetella pertussis
gccaccaccgucucgaacgcc

SEQ ID NO: 354935 - RNA, 17 nt, Bordetella pertussis
gccaccaccucggccuc

SEQ ID NO: 354936 - RNA, 19 nt, Bordetella pertussis
gccaccaccucggccucgc

SEQ ID NO: 354937 - RNA, 23 nt, Bordetella pertussis
gccaccaccucggccucgcuggc

SEQ ID NO: 354938 - RNA, 16 nt, Bordetella pertussis
gccaccacgauggcgc

SEQ ID NO: 354939 - RNA, 12 nt, Bordetella pertussis
gccaccacgccc

SEQ ID NO: 354940 - RNA, 14 nt, Bordetella pertussis
gccaccacgcccau

SEQ ID NO: 354941 - RNA, 13 nt, Bordetella pertussis
gccaccacgcgca

SEQ ID NO: 354942 - RNA, 18 nt, Bordetella pertussis
gccaccacgcgcaccagc

SEQ ID NO: 354943 - RNA, 19 nt, Bordetella pertussis
gccaccacugcaaggcccg

SEQ ID NO: 354944 - RNA, 17 nt, Bordetella pertussis
gccaccagcagcgccag

SEQ ID NO: 354945 - RNA, 16 nt, Bordetella pertussis
gccaccagcgcgccag

SEQ ID NO: 354946 - RNA, 17 nt, Bordetella pertussis
gccaccagcgcgccagc

SEQ ID NO: 354947 - RNA, 23 nt, Bordetella pertussis
gccaccagcggcgccggaucggc

SEQ ID NO: 354948 - RNA, 20 nt, Bordetella pertussis
gccaccagcggcguggcggc

SEQ ID NO: 354949 - RNA, 19 nt, Bordetella pertussis
gccaccagcgcgucgccgc

SEQ ID NO: 354950 - RNA, 21 nt, Bordetella pertussis
gccaccagcgcgucgccgcca

SEQ ID NO: 354951 - RNA, 22 nt, Bordetella pertussis
gccaccaggaacgccagcagca

SEQ ID NO: 354952 - RNA, 23 nt, Bordetella pertussis
gccaccaggaacgccagcagcac

SEQ ID NO: 354953 - RNA, 13 nt, Bordetella pertussis
gccaccaggccga

SEQ ID NO: 354954 - RNA, 13 nt, Bordetella pertussis
gccaccaggccgu

SEQ ID NO: 354955 - RNA, 20 nt, Bordetella pertussis
gccaccaggccgucggccag

SEQ ID NO: 354956 - RNA, 21 nt, Bordetella pertussis
gccaccaggcgcgcgccaucg

SEQ ID NO: 354957 - RNA, 14 nt, Bordetella pertussis
gccaccaggcugau

SEQ ID NO: 354958 - RNA, 22 nt, Bordetella pertussis
gccaccagggcccggacgcggc

SEQ ID NO: 354959 - RNA, 15 nt, Bordetella pertussis
gccaccagggcgccc

SEQ ID NO: 354960 - RNA, 13 nt, Bordetella pertussis
gccacccagggcu

SEQ ID NO: 354961 - RNA, 21 nt, Bordetella pertussis
gccacccagggcuugacgcgc

SEQ ID NO: 354962 - RNA, 13 nt, Bordetella pertussis
gccaccccgccgc

SEQ ID NO: 354963 - RNA, 16 nt, Bordetella pertussis
gccaccccguagcgca

SEQ ID NO: 354964 - RNA, 22 nt, Bordetella pertussis
gccaccccguugcagcccagcg

SEQ ID NO: 354965 - RNA, 18 nt, Bordetella pertussis
gccacccgacagcucgga

SEQ ID NO: 354966 - RNA, 15 nt, Bordetella pertussis
gccacccgccguacc

SEQ ID NO: 354967 - RNA, 17 nt, Bordetella pertussis
gccacccggaucgacag

SEQ ID NO: 354968 - RNA, 19 nt, Bordetella pertussis
gccacccugccgugcagau

SEQ ID NO: 354969 - RNA, 18 nt, Bordetella pertussis
gccacccuggcacgcugg

SEQ ID NO: 354970 - RNA, 12 nt, Bordetella pertussis
gccaccgacggc

SEQ ID NO: 354971 - RNA, 16 nt, Bordetella pertussis
gccaccgacggcgcgg

SEQ ID NO: 354972 - RNA, 23 nt, Bordetella pertussis
gccaccgagauguuccugcgcga

SEQ ID NO: 354973 - RNA, 13 nt, Bordetella pertussis
gccaccgcccagg

SEQ ID NO: 354974 - RNA, 16 nt, Bordetella pertussis
gccaccgcccaggcgc

SEQ ID NO: 354975 - RNA, 17 nt, Bordetella pertussis
gccaccgcccccgccgc

SEQ ID NO: 354976 - RNA, 22 nt, Bordetella pertussis
gccaccgcccccgccgccaugc

SEQ ID NO: 354977 - RNA, 13 nt, Bordetella pertussis
gccaccgcccaga

SEQ ID NO: 354978 - RNA, 17 nt, Bordetella pertussis
gccaccgcggcggacca

SEQ ID NO: 354979 - RNA, 23 nt, Bordetella pertussis
gccaccgcggugccgcgcgcggc

SEQ ID NO: 354980 - RNA, 23 nt, Bordetella pertussis
gccaccgcguugagcgccgacgg

SEQ ID NO: 354981 - RNA, 17 nt, Bordetella pertussis
gccaccgguugcagcgc

SEQ ID NO: 354982 - RNA, 20 nt, Bordetella pertussis
gccaccgguugcagcgcgcc

SEQ ID NO: 354983 - RNA, 22 nt, Bordetella pertussis
gccaccgguugcagcgcgccag

SEQ ID NO: 354984 - RNA, 23 nt, Bordetella pertussis
gccaccgguugcagcgcgccagg

SEQ ID NO: 354985 - RNA, 15 nt, Bordetella pertussis
gccaccucuucagcc

SEQ ID NO: 354986 - RNA, 18 nt, Bordetella pertussis
gccaccucuucagcccgg

SEQ ID NO: 354987 - RNA, 21 nt, Bordetella pertussis
gccaccucuucagcccggcgc

SEQ ID NO: 354988 - RNA, 13 nt, Bordetella pertussis
gccaccuggcgca

SEQ ID NO: 354989 - RNA, 14 nt, Bordetella pertussis
gccaccuggcgcaa

SEQ ID NO: 354990 - RNA, 21 nt, Bordetella pertussis
gccaccuggcgcaaggcgucg

SEQ ID NO: 354991 - RNA, 16 nt, Bordetella pertussis
gccaccuggcgcccgg

SEQ ID NO: 354992 - RNA, 17 nt, Bordetella pertussis
gccaccuggcgcccggc

SEQ ID NO: 354993 - RNA, 20 nt, Bordetella pertussis
gccaccugggccgccugcug

SEQ ID NO: 354994 - RNA, 17 nt, Bordetella pertussis
gccaccuucgccgcgca

SEQ ID NO: 354995 - RNA, 15 nt, Bordetella pertussis
gccaccuggucgucg

SEQ ID NO: 354996 - RNA, 19 nt, Bordetella pertussis
gccaccuggucgucggcca

SEQ ID NO: 354997 - RNA, 21 nt, Bordetella pertussis
gccaccuuggccaauggccgc

SEQ ID NO: 354998 - RNA, 21 nt, Bordetella pertussis
gccacgccggccacgaacggc

SEQ ID NO: 354999 - RNA, 14 nt, Bordetella pertussis
gccacgccggccgc

SEQ ID NO: 355000 - RNA, 18 nt, Bordetella pertussis
gccacgccggccgccugg

SEQ ID NO: 355001 - RNA, 17 nt, Bordetella pertussis
gccacgccggcgcgccg

SEQ ID NO: 355002 - RNA, 15 nt, Bordetella pertussis
gccacgccgucagcg

SEQ ID NO: 355003 - RNA, 22 nt, Bordetella pertussis
gccacgccuggccgcgcucagc

SEQ ID NO: 355004 - RNA, 12 nt, Bordetella pertussis
gccacgcgcaac

SEQ ID NO: 355005 - RNA, 13 nt, Bordetella pertussis
gccacgcgcaacg

SEQ ID NO: 355006 - RNA, 19 nt, Bordetella pertussis
gccacgcgcaacgccgcca

SEQ ID NO: 355007 - RNA, 20 nt, Bordetella pertussis
gccacgcgcacauuggagua

SEQ ID NO: 355008 - RNA, 13 nt, Bordetella pertussis
gccacgcgcacgg

SEQ ID NO: 355009 - RNA, 21 nt, Bordetella pertussis
gccacgcgccgcccgggccgg

SEQ ID NO: 355010 - RNA, 21 nt, Bordetella pertussis
gccacgcgccgugcagacggc

SEQ ID NO: 355011 - RNA, 23 nt, Bordetella pertussis
gccacgcgccgugcagacggcgg

SEQ ID NO: 355012 - RNA, 21 nt, Bordetella pertussis
gccacgcgcgauccgcgccag

SEQ ID NO: 355013 - RNA, 15 nt, Bordetella pertussis
gccacgcgcgcuggc

SEQ ID NO: 355014 - RNA, 17 nt, Bordetella pertussis
gccacgcgcgcuggcgc

SEQ ID NO: 355015 - RNA, 23 nt, Bordetella pertussis
gccacgcgcgcuggcgcccggcc

SEQ ID NO: 355016 - RNA, 22 nt, Bordetella pertussis
gccacgcgcggaucggccacga

SEQ ID NO: 355017 - RNA, 15 nt, Bordetella pertussis
gccacgcgcgggcug

SEQ ID NO: 355018 - RNA, 12 nt, Bordetella pertussis
gccacgcgcugu

SEQ ID NO: 355019 - RNA, 15 nt, Bordetella pertussis
gccacgcgcuugcgc

SEQ ID NO: 355020 - RNA, 21 nt, Bordetella pertussis
gccacgcgcuugcgcgccacg

SEQ ID NO: 355021 - RNA, 12 nt, Bordetella pertussis
gccacgcgccgc

SEQ ID NO: 355022 - RNA, 14 nt, Bordetella pertussis
gccacgcgggccgg

SEQ ID NO: 355023 - RNA, 14 nt, Bordetella pertussis
gccacgcgggcgug

SEQ ID NO: 355024 - RNA, 19 nt, Bordetella pertussis
gccacgcgguccagccccu

SEQ ID NO: 355025 - RNA, 21 nt, Bordetella pertussis
gccacgcgguccagccccugc

SEQ ID NO: 355026 - RNA, 17 nt, Bordetella pertussis
gccacgcucacgcccgu

SEQ ID NO: 355027 - RNA, 17 nt, Bordetella pertussis
gccacgcugcccugcug

SEQ ID NO: 355028 - RNA, 18 nt, Bordetella pertussis
gccacgcuggccgcgcug

SEQ ID NO: 355029 - RNA, 20 nt, Bordetella pertussis
gccacgcuggccgcgcuggc

SEQ ID NO: 355030 - RNA, 16 nt, Bordetella pertussis
gccacgcugcugccgu

SEQ ID NO: 355031 - RNA, 17 nt, Bordetella pertussis
gccacgcuguacuggua

SEQ ID NO: 355032 - RNA, 18 nt, Bordetella pertussis
gccacgcuguuuucggcc

SEQ ID NO: 355033 - RNA, 20 nt, Bordetella pertussis
gccacgcuguuuucggccga

SEQ ID NO: 355034 - RNA, 20 nt, Bordetella pertussis
gccacgucacggaucagccg

SEQ ID NO: 355035 - RNA, 21 nt, Bordetella pertussis
gccacgucacggaucagccgc

SEQ ID NO: 355036 - RNA, 22 nt, Bordetella pertussis
gccacgucacggaucagccgcu

SEQ ID NO: 355037 - RNA, 20 nt, Bordetella pertussis
gccacguccagcacggccgc

SEQ ID NO: 355038 - RNA, 13 nt, Bordetella pertussis
gccacgucgaccu

SEQ ID NO: 355039 - RNA, 19 nt, Bordetella pertussis
gccacgucgaccucgagca

SEQ ID NO: 355040 - RNA, 22 nt, Bordetella pertussis
gccacgucgaccucgagcaccu

SEQ ID NO: 355041 - RNA, 15 nt, Bordetella pertussis
gccacgucgccggcg

SEQ ID NO: 355042 - RNA, 16 nt, Bordetella pertussis
gccacgucgccggcgu

SEQ ID NO: 355043 - RNA, 14 nt, Bordetella pertussis
gccacgucgccggc

SEQ ID NO: 355044 - RNA, 14 nt, Bordetella pertussis
gccacgucggcggc

SEQ ID NO: 355045 - RNA, 15 nt, Bordetella pertussis
gccacgucggcggcc

SEQ ID NO: 355046 - RNA, 16 nt, Bordetella pertussis
gccacgucggcggccg

SEQ ID NO: 355047 - RNA, 17 nt, Bordetella pertussis
gccacgugaagcgccgc

SEQ ID NO: 355048 - RNA, 20 nt, Bordetella pertussis
gccacgugaagcgccgcgcc

SEQ ID NO: 355049 - RNA, 21 nt, Bordetella pertussis
gccacgugaagcgccgcgccu

SEQ ID NO: 355050 - RNA, 15 nt, Bordetella pertussis
gccacgugcugcugg

SEQ ID NO: 355051 - RNA, 21 nt, Bordetella pertussis
gccacgugcugcuggagaucg

SEQ ID NO: 355052 - RNA, 19 nt, Bordetella pertussis
gccacguguggcaggccag

SEQ ID NO: 355053 - RNA, 22 nt, Bordetella pertussis
gccacguugaagcgcagccacg

SEQ ID NO: 355054 - RNA, 21 nt, Bordetella pertussis
gccacguugauccagcgcucg

SEQ ID NO: 355055 - RNA, 22 nt, Bordetella pertussis
gccacguugauccagcgcucgg

SEQ ID NO: 355056 - RNA, 16 nt, Bordetella pertussis
gccacguugucgcgcg

SEQ ID NO: 355057 - RNA, 18 nt, Bordetella pertussis
gccacucgaugggcgcgc

SEQ ID NO: 355058 - RNA, 22 nt, Bordetella pertussis
gccacuuccuggugggcggcaa

SEQ ID NO: 355059 - RNA, 15 nt, Bordetella pertussis
gccacuucgcggccg

SEQ ID NO: 355060 - RNA, 18 nt, Bordetella pertussis
gccacuugcaggccgcga

SEQ ID NO: 355061 - RNA, 17 nt, Bordetella pertussis
gccacuuucgcgcgcgc

SEQ ID NO: 355062 - RNA, 23 nt, Bordetella pertussis
gccagaaaaaauacccguccuug

SEQ ID NO: 355063 - RNA, 16 nt, Bordetella pertussis
gccagcaagcgcgcca

SEQ ID NO: 355064 - RNA, 15 nt, Bordetella pertussis
gccagcaagcgcucg

SEQ ID NO: 355065 - RNA, 21 nt, Bordetella pertussis
gccagcaaggcgucggccagg

SEQ ID NO: 355066 - RNA, 13 nt, Bordetella pertussis
gccagcaccggca

SEQ ID NO: 355067 - RNA, 14 nt, Bordetella pertussis
gccagcaccggcac

SEQ ID NO: 355068 - RNA, 15 nt, Bordetella pertussis
gccagcaccggcacg

SEQ ID NO: 355069 - RNA, 15 nt, Bordetella pertussis
gccagcaccggcccg

SEQ ID NO: 355070 - RNA, 15 nt, Bordetella pertussis
gccagcaccggccgc

SEQ ID NO: 355071 - RNA, 16 nt, Bordetella pertussis
gccagcacgguggcgc

SEQ ID NO: 355072 - RNA, 17 nt, Bordetella pertussis
gccagcacgguggcgcc

SEQ ID NO: 355073 - RNA, 22 nt, Bordetella pertussis
gccagcagaaugccgcccacga

SEQ ID NO: 355074 - RNA, 21 nt, Bordetella pertussis
gccagcagcacgaucgcggcg

SEQ ID NO: 355075 - RNA, 13 nt, Bordetella pertussis
gccagcagcacgu

SEQ ID NO: 355076 - RNA, 22 nt, Bordetella pertussis
gccagcagcucggcgaccaggc

SEQ ID NO: 355077 - RNA, 13 nt, Bordetella pertussis
gccagcagcuggc

SEQ ID NO: 355078 - RNA, 16 nt, Bordetella pertussis
gccagcagcuggcgca

SEQ ID NO: 355079 - RNA, 19 nt, Bordetella pertussis
gccagcagcuggcgcagca

SEQ ID NO: 355080 - RNA, 22 nt, Bordetella pertussis
gccagcagcuggcgcagcacgc

SEQ ID NO: 355081 - RNA, 22 nt, Bordetella pertussis
gccagcaggagcccgcugccga

SEQ ID NO: 355082 - RNA, 15 nt, Bordetella pertussis
gccagcaggcccugg

SEQ ID NO: 355083 - RNA, 13 nt, Bordetella pertussis
gccagcaggcgcu

SEQ ID NO: 355084 - RNA, 15 nt, Bordetella pertussis
gccagcaggcgcugg

SEQ ID NO: 355085 - RNA, 15 nt, Bordetella pertussis
gccagcaggcgcucg

SEQ ID NO: 355086 - RNA, 14 nt, Bordetella pertussis
gccagcaggcucag

SEQ ID NO: 355087 - RNA, 21 nt, Bordetella pertussis
gccagcauacccugcgcgccg

SEQ ID NO: 355088 - RNA, 20 nt, Bordetella pertussis
gccagcauccagccgaucag

SEQ ID NO: 355089 - RNA, 22 nt, Bordetella pertussis
gccagcauccagccgaucagcc

SEQ ID NO: 355090 - RNA, 14 nt, Bordetella pertussis
gccagcaucggcac

SEQ ID NO: 355091 - RNA, 13 nt, Bordetella pertussis
gccagcaugauca

SEQ ID NO: 355092 - RNA, 14 nt, Bordetella pertussis
gccagcaugcgcgc

SEQ ID NO: 355093 - RNA, 15 nt, Bordetella pertussis
gccagcaugcgcgcg

SEQ ID NO: 355094 - RNA, 16 nt, Bordetella pertussis
gccagcauggccgugg

SEQ ID NO: 355095 - RNA, 20 nt, Bordetella pertussis
gccagcauggccguggcgug

SEQ ID NO: 355096 - RNA, 16 nt, Bordetella pertussis
gccagcauggcggcca

SEQ ID NO: 355097 - RNA, 17 nt, Bordetella pertussis
gccagcauggcggccag

SEQ ID NO: 355098 - RNA, 21 nt, Bordetella pertussis
gccagcauggcgucgaaacgc

SEQ ID NO: 355099 - RNA, 16 nt, Bordetella pertussis
gccagcauuaccagca

SEQ ID NO: 355100 - RNA, 13 nt, Bordetella pertussis
gccagcccuggcc

SEQ ID NO: 355101 - RNA, 17 nt, Bordetella pertussis
gccagcccuggcccagc

SEQ ID NO: 355102 - RNA, 18 nt, Bordetella pertussis
gccagcccuggcccagcg

SEQ ID NO: 355103 - RNA, 12 nt, Bordetella pertussis
gccagccgcgcc

SEQ ID NO: 355104 - RNA, 19 nt, Bordetella pertussis
gccagccguugcgccagcg

SEQ ID NO: 355105 - RNA, 22 nt, Bordetella pertussis
gccagccguugcgccagcggcg

SEQ ID NO: 355106 - RNA, 12 nt, Bordetella pertussis
gccagccugcca

SEQ ID NO: 355107 - RNA, 15 nt, Bordetella pertussis
gccagccugccgcgg

SEQ ID NO: 355108 - RNA, 18 nt, Bordetella pertussis
gccagccugccgcggccg

SEQ ID NO: 355109 - RNA, 19 nt, Bordetella pertussis
gccagccugccgcggccgc

SEQ ID NO: 355110 - RNA, 20 nt, Bordetella pertussis
gccagcgaaauacgcgacag

SEQ ID NO: 355111 - RNA, 14 nt, Bordetella pertussis
gccagccuggcgcc

SEQ ID NO: 355112 - RNA, 14 nt, Bordetella pertussis
gccagcgacgacuu

SEQ ID NO: 355113 - RNA, 23 nt, Bordetella pertussis
gccagcgacgacuugaucagggc

SEQ ID NO: 355114 - RNA, 13 nt, Bordetella pertussis
gccagcgccauga

SEQ ID NO: 355115 - RNA, 19 nt, Bordetella pertussis
gccagcgccaugaugucgc

SEQ ID NO: 355116 - RNA, 15 nt, Bordetella pertussis
gccagcgccccggcg

SEQ ID NO: 355117 - RNA, 15 nt, Bordetella pertussis
gccagcgccgcagcg

SEQ ID NO: 355118 - RNA, 16 nt, Bordetella pertussis
gccagcgccgcagcgu

SEQ ID NO: 355119 - RNA, 12 nt, Bordetella pertussis
gccagcgccgcc

SEQ ID NO: 355120 - RNA, 13 nt, Bordetella pertussis
gccagcgccgcca

SEQ ID NO: 355121 - RNA, 14 nt, Bordetella pertussis
gccagcgccgccau

SEQ ID NO: 355122 - RNA, 16 nt, Bordetella pertussis
gccagcgccgccagcc

SEQ ID NO: 355123 - RNA, 21 nt, Bordetella pertussis
gccagcgccgccagccgcugg

SEQ ID NO: 355124 - RNA, 22 nt, Bordetella pertussis
gccagcgccgccagccgcuggc

SEQ ID NO: 355125 - RNA, 13 nt, Bordetella pertussis
gccagcgccgcga

SEQ ID NO: 355126 - RNA, 13 nt, Bordetella pertussis
gccagcgccgcgg

SEQ ID NO: 355127 - RNA, 16 nt, Bordetella pertussis
gccagcgccgcggccg

SEQ ID NO: 355128 - RNA, 13 nt, Bordetella pertussis
gccagcgccggcg

SEQ ID NO: 355129 - RNA, 14 nt, Bordetella pertussis
gccagcgccggcgc

SEQ ID NO: 355130 - RNA, 15 nt, Bordetella pertussis
gccagcgccggcgcg

SEQ ID NO: 355131 - RNA, 19 nt, Bordetella pertussis
gccagcgccggcgcgucca

SEQ ID NO: 355132 - RNA, 18 nt, Bordetella pertussis
gccagcgccuccaucagc

SEQ ID NO: 355133 - RNA, 12 nt, Bordetella pertussis
gccagcgccucg

SEQ ID NO: 355134 - RNA, 15 nt, Bordetella pertussis
gccagcgccucgcgc

SEQ ID NO: 355135 - RNA, 15 nt, Bordetella pertussis
gccagcgccugcgcg

SEQ ID NO: 355136 - RNA, 21 nt, Bordetella pertussis
gccagcgccugcgcggccucg

SEQ ID NO: 355137 - RNA, 12 nt, Bordetella pertussis
gccagcgccugg

SEQ ID NO: 355138 - RNA, 23 nt, Bordetella pertussis
gccagcgccuggaccuggacgag

SEQ ID NO: 355139 - RNA, 14 nt, Bordetella pertussis
gccagcgccugggc

SEQ ID NO: 355140 - RNA, 20 nt, Bordetella pertussis
gccagcgcgaucucgcgcag

SEQ ID NO: 355141 - RNA, 12 nt, Bordetella pertussis
gccagcgcgcca

SEQ ID NO: 355142 - RNA, 14 nt, Bordetella pertussis
gccagcgcgccgcc

SEQ ID NO: 355143 - RNA, 16 nt, Bordetella pertussis
gccagcgcgccgccag

SEQ ID NO: 355144 - RNA, 17 nt, Bordetella pertussis
gccagcgcgccggccag

SEQ ID NO: 355145 - RNA, 13 nt, Bordetella pertussis
gccagcgcgccuu

SEQ ID NO: 355146 - RNA, 15 nt, Bordetella pertussis
gccagcgcgccuucg

SEQ ID NO: 355147 - RNA, 14 nt, Bordetella pertussis
gccagcgcgcgcca

SEQ ID NO: 355148 - RNA, 23 nt, Bordetella pertussis
gccagcgcgcgccaguugcgcac

SEQ ID NO: 355149 - RNA, 13 nt, Bordetella pertussis
gccagcgcgcgau

SEQ ID NO: 355150 - RNA, 21 nt, Bordetella pertussis
gccagcgcgcgauagauggcc

SEQ ID NO: 355151 - RNA, 14 nt, Bordetella pertussis
gccagcgcgcggcc

SEQ ID NO: 355152 - RNA, 17 nt, Bordetella pertussis
gccagcgcgcggcgcag

SEQ ID NO: 355153 - RNA, 15 nt, Bordetella pertussis
gccagcgcgcgggcg

SEQ ID NO: 355154 - RNA, 13 nt, Bordetella pertussis
gccagcgcggcca

SEQ ID NO: 355155 - RNA, 16 nt, Bordetella pertussis
gccagcgcggccagcg

SEQ ID NO: 355156 - RNA, 18 nt, Bordetella pertussis
gccagcgcggccagcgcg

SEQ ID NO: 355157 - RNA, 15 nt, Bordetella pertussis
gccagcgcggccagg

SEQ ID NO: 355158 - RNA, 12 nt, Bordetella pertussis
gccagcgcggcg

SEQ ID NO: 355159 - RNA, 15 nt, Bordetella pertussis
gccagcgcggcggca

SEQ ID NO: 355160 - RNA, 13 nt, Bordetella pertussis
gccagcggcgcgg

SEQ ID NO: 355161 - RNA, 21 nt, Bordetella pertussis
gccagcggcgcggcgcgcugg

SEQ ID NO: 355162 - RNA, 22 nt, Bordetella pertussis
gccagcggcgcggcgcgcugga

SEQ ID NO: 355163 - RNA, 13 nt, Bordetella pertussis
gccagcggcuggc

SEQ ID NO: 355164 - RNA, 17 nt, Bordetella pertussis
gccagcggugcgcggcg

SEQ ID NO: 355165 - RNA, 15 nt, Bordetella pertussis
gccagcgugcccagc

SEQ ID NO: 355166 - RNA, 13 nt, Bordetella pertussis
gccagcgugccgg

SEQ ID NO: 355167 - RNA, 17 nt, Bordetella pertussis
gccagcguggccgaggu

SEQ ID NO: 355168 - RNA, 17 nt, Bordetella pertussis
gccagcguggggacgcg

SEQ ID NO: 355169 - RNA, 20 nt, Bordetella pertussis
gccagcguggggacgcgggc

SEQ ID NO: 355170 - RNA, 21 nt, Bordetella pertussis
gccagcguggggacgcgggcc

SEQ ID NO: 355171 - RNA, 16 nt, Bordetella pertussis
gccagcguucggccac

SEQ ID NO: 355172 - RNA, 20 nt, Bordetella pertussis
gccagcguucggccacccgg

SEQ ID NO: 355173 - RNA, 18 nt, Bordetella pertussis
gccagcuccaccgggcug

SEQ ID NO: 355174 - RNA, 19 nt, Bordetella pertussis
gccagcuccaccgggcuga

SEQ ID NO: 355175 - RNA, 18 nt, Bordetella pertussis
gccagcuccagccgcagg

SEQ ID NO: 355176 - RNA, 14 nt, Bordetella pertussis
gccagcuccaggua

SEQ ID NO: 355177 - RNA, 17 nt, Bordetella pertussis
gccagcuccccgggcgu

SEQ ID NO: 355178 - RNA, 21 nt, Bordetella pertussis
gccagcuccccgggcgugacc

SEQ ID NO: 355179 - RNA, 14 nt, Bordetella pertussis
gccagcucgacgcg

SEQ ID NO: 355180 - RNA, 19 nt, Bordetella pertussis
gccagcucgacgcgcugau

SEQ ID NO: 355181 - RNA, 14 nt, Bordetella pertussis
gccagcucgcgcag

SEQ ID NO: 355182 - RNA, 16 nt, Bordetella pertussis
gccagcucgcgcagca

SEQ ID NO: 355183 - RNA, 19 nt, Bordetella pertussis
gccagcucgcgcagcaggc

SEQ ID NO: 355184 - RNA, 15 nt, Bordetella pertussis
gccagcucggccaag

SEQ ID NO: 355185 - RNA, 14 nt, Bordetella pertussis
gccagcucggccug

SEQ ID NO: 355186 - RNA, 15 nt, Bordetella pertussis
gccagcucggccugc

SEQ ID NO: 355187 - RNA, 19 nt, Bordetella pertussis
gccagcucuucgagcgcgg

SEQ ID NO: 355188 - RNA, 23 nt, Bordetella pertussis
gccagcugaccucgcccaggccg

SEQ ID NO: 355189 - RNA, 22 nt, Bordetella pertussis
gccagcugcaugcgcacggaca

SEQ ID NO: 355190 - RNA, 24 nt, Bordetella pertussis
gccagcugcaugcgcacggacagc

SEQ ID NO: 355191 - RNA, 21 nt, Bordetella pertussis
gccagcugcguggcgacgcgc

SEQ ID NO: 355192 - RNA, 22 nt, Bordetella pertussis
gccagcugcguggcgacgcgcu

SEQ ID NO: 355193 - RNA, 15 nt, Bordetella pertussis
gccagcuggaccgcc

SEQ ID NO: 355194 - RNA, 20 nt, Bordetella pertussis
gccagcuggaccgccuggcc

SEQ ID NO: 355195 - RNA, 13 nt, Bordetella pertussis
gccagcuggcgcg

SEQ ID NO: 355196 - RNA, 20 nt, Bordetella pertussis
gccagcuggcgcguggccgc

SEQ ID NO: 355197 - RNA, 14 nt, Bordetella pertussis
gccagcuggcggcg

SEQ ID NO: 355198 - RNA, 22 nt, Bordetella pertussis
gccagcuggcggcgcagcacca

SEQ ID NO: 355199 - RNA, 18 nt, Bordetella pertussis
gccagcuugacguccagc

SEQ ID NO: 355200 - RNA, 19 nt, Bordetella pertussis
gccagcuugacguccagcc

SEQ ID NO: 355201 - RNA, 22 nt, Bordetella pertussis
gccagcuugacguccagccagg

SEQ ID NO: 355202 - RNA, 16 nt, Bordetella pertussis
gccagcuugagcaggc

SEQ ID NO: 355203 - RNA, 23 nt, Bordetella pertussis
gccagcuugagcaggcgcgagcg

SEQ ID NO: 355204 - RNA, 21 nt, Bordetella pertussis
gccagcuugcaggcgccuucg

SEQ ID NO: 355205 - RNA, 24 nt, Bordetella pertussis
gccagcuugcaggcgccuucggcg

SEQ ID NO: 355206 - RNA, 15 nt, Bordetella pertussis
gccagcuuggccagg

SEQ ID NO: 355207 - RNA, 16 nt, Bordetella pertussis
gccagcuuggccaggc

SEQ ID NO: 355208 - RNA, 17 nt, Bordetella pertussis
gccagcuuguagcggcc

SEQ ID NO: 355209 - RNA, 19 nt, Bordetella pertussis
gccagcuuguagcggccau

SEQ ID NO: 355210 - RNA, 21 nt, Bordetella pertussis
gccagcuugcgcgccuuggcg

SEQ ID NO: 355211 - RNA, 17 nt, Bordetella pertussis
gccaggaacagcgccgg

SEQ ID NO: 355212 - RNA, 18 nt, Bordetella pertussis
gccaggaacagcgccggc

SEQ ID NO: 355213 - RNA, 21 nt, Bordetella pertussis
gccaggauggccacgaccacc

SEQ ID NO: 355214 - RNA, 13 nt, Bordetella pertussis
gccaggauggcgu

SEQ ID NO: 355215 - RNA, 21 nt, Bordetella pertussis
gccaggauggcguugccggcc

SEQ ID NO: 355216 - RNA, 16 nt, Bordetella pertussis
gccaggaucgcggcca

SEQ ID NO: 355217 - RNA, 20 nt, Bordetella pertussis
gccaggaucgcggccagccg

SEQ ID NO: 355218 - RNA, 21 nt, Bordetella pertussis
gccaggauuucauggcaucgg

SEQ ID NO: 355219 - RNA, 22 nt, Bordetella pertussis
gccaggcaaucgaugaucacgc

SEQ ID NO: 355220 - RNA, 20 nt, Bordetella pertussis
gccaggcccuugauggccgg

SEQ ID NO: 355221 - RNA, 13 nt, Bordetella pertussis
gccaggccgaacg

SEQ ID NO: 355222 - RNA, 17 nt, Bordetella pertussis
gccaggccgaacgcggu

SEQ ID NO: 355223 - RNA, 17 nt, Bordetella pertussis
gccaggccgaucagcac

SEQ ID NO: 355224 - RNA, 15 nt, Bordetella pertussis
gccaggccgaugccg

SEQ ID NO: 355225 - RNA, 16 nt, Bordetella pertussis
gccaggccgaugccga

SEQ ID NO: 355226 - RNA, 13 nt, Bordetella pertussis
gccaggccggccc

SEQ ID NO: 355227 - RNA, 13 nt, Bordetella pertussis
gccaggccggccu

SEQ ID NO: 355228 - RNA, 17 nt, Bordetella pertussis
gccaggccggcgcgccg

SEQ ID NO: 355229 - RNA, 15 nt, Bordetella pertussis
gccaggccggcggcg

SEQ ID NO: 355230 - RNA, 13 nt, Bordetella pertussis
gccaggccgucga

SEQ ID NO: 355231 - RNA, 22 nt, Bordetella pertussis
gccaggcugucccagauggcgc

SEQ ID NO: 355232 - RNA, 22 nt, Bordetella pertussis
gccaggcugucgucgucggcac

SEQ ID NO: 355233 - RNA, 16 nt, Bordetella pertussis
gccagggccaggccgc

SEQ ID NO: 355234 - RNA, 22 nt, Bordetella pertussis
gccagggccauguggcgcagcg

SEQ ID NO: 355235 - RNA, 18 nt, Bordetella pertussis
gccagggccucgcgggcc

SEQ ID NO: 355236 - RNA, 19 nt, Bordetella pertussis
gccagggccugcgggccgg

SEQ ID NO: 355237 - RNA, 13 nt, Bordetella pertussis
gccagggcgccgc

SEQ ID NO: 355238 - RNA, 14 nt, Bordetella pertussis
gccagggcgccgcg

SEQ ID NO: 355239 - RNA, 14 nt, Bordetella pertussis
gccaggucgcgcac

SEQ ID NO: 355240 - RNA, 16 nt, Bordetella pertussis
gccaggucgcgcacca

SEQ ID NO: 355241 - RNA, 22 nt, Bordetella pertussis
gccaggucggccaccgccgugg

SEQ ID NO: 355242 - RNA, 14 nt, Bordetella pertussis
gccaggucggccag

SEQ ID NO: 355243 - RNA, 15 nt, Bordetella pertussis
gccaggucggccagc

SEQ ID NO: 355244 - RNA, 17 nt, Bordetella pertussis
gccaggucggccagccg

SEQ ID NO: 355245 - RNA, 18 nt, Bordetella pertussis
gccaggucggcggccagc

SEQ ID NO: 355246 - RNA, 15 nt, Bordetella pertussis
gccagguucgccugg

SEQ ID NO: 355247 - RNA, 20 nt, Bordetella pertussis
gccagguucgccuggcgggg

SEQ ID NO: 355248 - RNA, 22 nt, Bordetella pertussis
gccagguucuggucgaacuggc

SEQ ID NO: 355249 - RNA, 17 nt, Bordetella pertussis
gccagguugggugcgcc

SEQ ID NO: 355250 - RNA, 20 nt, Bordetella pertussis
gccagguugggugcgccgcc

SEQ ID NO: 355251 - RNA, 22 nt, Bordetella pertussis
gccagguugggugcgccgccgg

SEQ ID NO: 355252 - RNA, 14 nt, Bordetella pertussis
gccagucgccgcgg

SEQ ID NO: 355253 - RNA, 14 nt, Bordetella pertussis
gccagucgcgcagc

SEQ ID NO: 355254 - RNA, 15 nt, Bordetella pertussis
gccagucgcgcagca

SEQ ID NO: 355255 - RNA, 16 nt, Bordetella pertussis
gccagucuccaggcuc

SEQ ID NO: 355256 - RNA, 18 nt, Bordetella pertussis
gccagucuccaggcucag

SEQ ID NO: 355257 - RNA, 23 nt, Bordetella pertussis
gccagucuccaggcucaggcggc

SEQ ID NO: 355258 - RNA, 18 nt, Bordetella pertussis
gccagugaaacgcgacgc

SEQ ID NO: 355259 - RNA, 17 nt, Bordetella pertussis
aagacauggcgcgcgcc

SEQ ID NO: 355260 - RNA, 17 nt, Bordetella pertussis
gccaugaucgccggcaa

SEQ ID NO: 355261 - RNA, 19 nt, Bordetella pertussis
gccaugaugucgcgcgccu

SEQ ID NO: 355262 - RNA, 13 nt, Bordetella pertussis
gccaugcaacacg

SEQ ID NO: 355263 - RNA, 17 nt, Bordetella pertussis
gccaugcaacacgacca

SEQ ID NO: 355264 - RNA, 12 nt, Bordetella pertussis
gccaugcgcagg

SEQ ID NO: 355265 - RNA, 23 nt, Bordetella pertussis
gccaugcgcauggccagcgcgca

SEQ ID NO: 355266 - RNA, 15 nt, Bordetella pertussis
gccaugcgccagcag

SEQ ID NO: 355267 - RNA, 16 nt, Bordetella pertussis
gccaugcgcgccagca

SEQ ID NO: 355268 - RNA, 17 nt, Bordetella pertussis
gccaugcggaugaacga

SEQ ID NO: 355269 - RNA, 18 nt, Bordetella pertussis
gccaugcggcuggccgau

SEQ ID NO: 355270 - RNA, 15 nt, Bordetella pertussis
gccaugcgggucagg

SEQ ID NO: 355271 - RNA, 20 nt, Bordetella pertussis
gccaugcgggucaggccgcc

SEQ ID NO: 355272 - RNA, 14 nt, Bordetella pertussis
gccaugcggugcgc

SEQ ID NO: 355273 - RNA, 18 nt, Bordetella pertussis
gccaugcggugcgccgcg

SEQ ID NO: 355274 - RNA, 17 nt, Bordetella pertussis
gccaugcguaucggcag

SEQ ID NO: 355275 - RNA, 16 nt, Bordetella pertussis
gccauggaagcggcag

SEQ ID NO: 355276 - RNA, 20 nt, Bordetella pertussis
gccauggaagcggcagacga

SEQ ID NO: 355277 - RNA, 16 nt, Bordetella pertussis
gccauggacgaguugc

SEQ ID NO: 355278 - RNA, 15 nt, Bordetella pertussis
gccauggaggcgcag

SEQ ID NO: 355279 - RNA, 16 nt, Bordetella pertussis
gccauggaggcgcagc

SEQ ID NO: 355280 - RNA, 17 nt, Bordetella pertussis
gccauggaggcgcagcg

SEQ ID NO: 355281 - RNA, 22 nt, Bordetella pertussis
gccauggaggcgcagcgcggca

SEQ ID NO: 355282 - RNA, 15 nt, Bordetella pertussis
gccaugcuggccgcc

SEQ ID NO: 355283 - RNA, 17 nt, Bordetella pertussis
gccauggcacaggccau

SEQ ID NO: 355284 - RNA, 19 nt, Bordetella pertussis
gccauggcagggcgccgcg

SEQ ID NO: 355285 - RNA, 17 nt, Bordetella pertussis
gccauggccacgacgag

SEQ ID NO: 355286 - RNA, 13 nt, Bordetella pertussis
gccauggccgcca

SEQ ID NO: 355287 - RNA, 17 nt, Bordetella pertussis
gccauggccgcgcggcg

SEQ ID NO: 355288 - RNA, 16 nt, Bordetella pertussis
gccauguccuggcagg

SEQ ID NO: 355289 - RNA, 20 nt, Bordetella pertussis
gccauguccuggcaggccgc

SEQ ID NO: 355290 - RNA, 16 nt, Bordetella pertussis
gccaugucggcuucgg

SEQ ID NO: 355291 - RNA, 15 nt, Bordetella pertussis
gccaugugcgccgcg

SEQ ID NO: 355292 - RNA, 22 nt, Bordetella pertussis
gccaugugcgccgcgccguaca

SEQ ID NO: 355293 - RNA, 19 nt, Bordetella pertussis
gccaugugcguugccagcc

SEQ ID NO: 355294 - RNA, 20 nt, Bordetella pertussis
gccaugugcguugccagccc

SEQ ID NO: 355295 - RNA, 14 nt, Bordetella pertussis
gccauguggcgacg

SEQ ID NO: 355296 - RNA, 19 nt, Bordetella pertussis
gccauguggcgacgcccag

SEQ ID NO: 355297 - RNA, 15 nt, Bordetella pertussis
gccauguggcgcagc

SEQ ID NO: 355298 - RNA, 14 nt, Bordetella pertussis
gccauucagaccgg

SEQ ID NO: 355299 - RNA, 17 nt, Bordetella pertussis
gccauucagaccggguu

SEQ ID NO: 355300 - RNA, 20 nt, Bordetella pertussis
gccauuccagcuccggcggc

SEQ ID NO: 355301 - RNA, 18 nt, Bordetella pertussis
gccauuccggcuggucgg

SEQ ID NO: 355302 - RNA, 17 nt, Bordetella pertussis
gccauucgauggcggcg

SEQ ID NO: 355303 - RNA, 18 nt, Bordetella pertussis
gccauucgauggcggcgc

SEQ ID NO: 355304 - RNA, 14 nt, Bordetella pertussis
gccauucggccagg

SEQ ID NO: 355305 - RNA, 23 nt, Bordetella pertussis
gccauugccgcacgaucgcgccg

SEQ ID NO: 355306 - RNA, 15 nt, Bordetella pertussis
gccauugcgcggccu

SEQ ID NO: 355307 - RNA, 16 nt, Bordetella pertussis
gcccaacccggcgagg

SEQ ID NO: 355308 - RNA, 14 nt, Bordetella pertussis
gcccaacgaggaca

SEQ ID NO: 355309 - RNA, 17 nt, Bordetella pertussis
gcccaaugucaccgacg

SEQ ID NO: 355310 - RNA, 14 nt, Bordetella pertussis
gcccacauagcggc

SEQ ID NO: 355311 - RNA, 22 nt, Bordetella pertussis
gcccacauagcggccggcgcgc

SEQ ID NO: 355312 - RNA, 16 nt, Bordetella pertussis
gcccacauggcggcga

SEQ ID NO: 355313 - RNA, 20 nt, Bordetella pertussis
gcccaccaccagcgcggcca

SEQ ID NO: 355314 - RNA, 21 nt, Bordetella pertussis
gcccaccaccagcgcggccag

SEQ ID NO: 355315 - RNA, 22 nt, Bordetella pertussis
gcccaccaccagcgcggccagc

SEQ ID NO: 355316 - RNA, 16 nt, Bordetella pertussis
gcccaccacgccgccc

SEQ ID NO: 355317 - RNA, 20 nt, Bordetella pertussis
gcccaccacgccgcccagcg

SEQ ID NO: 355318 - RNA, 22 nt, Bordetella pertussis
gcccaccacggcgggaucgggc

SEQ ID NO: 355319 - RNA, 13 nt, Bordetella pertussis
gcccaccagccgc

SEQ ID NO: 355320 - RNA, 18 nt, Bordetella pertussis
gcccaccagccgcccggc

SEQ ID NO: 355321 - RNA, 15 nt, Bordetella pertussis
gcccaccagcgccac

SEQ ID NO: 355322 - RNA, 20 nt, Bordetella pertussis
gcccaccagccgggcggcca

SEQ ID NO: 355323 - RNA, 17 nt, Bordetella pertussis
gcccaccagggccagcu

SEQ ID NO: 355324 - RNA, 21 nt, Bordetella pertussis
gcccaccaugagcacgcccca

SEQ ID NO: 355325 - RNA, 16 nt, Bordetella pertussis
gcccacccccggcacc

SEQ ID NO: 355326 - RNA, 19 nt, Bordetella pertussis
gcccacccggcacgcgccg

SEQ ID NO: 355327 - RNA, 19 nt, Bordetella pertussis
gcccaccgagacgcugucg

SEQ ID NO: 355328 - RNA, 23 nt, Bordetella pertussis
gcccaccgagacgcugucgcgcc

SEQ ID NO: 355329 - RNA, 13 nt, Bordetella pertussis
gcccaccgcaucg

SEQ ID NO: 355330 - RNA, 15 nt, Bordetella pertussis
gcccaccgcaucgcg

SEQ ID NO: 355331 - RNA, 16 nt, Bordetella pertussis
gcccaccgcaucgcgc

SEQ ID NO: 355332 - RNA, 20 nt, Bordetella pertussis
gcccaccgcaucgcgcagcg

SEQ ID NO: 355333 - RNA, 13 nt, Bordetella pertussis
gcccaccgccagg

SEQ ID NO: 355334 - RNA, 22 nt, Bordetella pertussis
gcccaccgccaggaagaucggc

SEQ ID NO: 355335 - RNA, 18 nt, Bordetella pertussis
gcccaccgccgcccgcca

SEQ ID NO: 355336 - RNA, 22 nt, Bordetella pertussis
gcccaccggcaugccguccacg

SEQ ID NO: 355337 - RNA, 17 nt, Bordetella pertussis
gcccaccgggccggccu

SEQ ID NO: 355338 - RNA, 18 nt, Bordetella pertussis
gcccaccgggccggccug

SEQ ID NO: 355339 - RNA, 16 nt, Bordetella pertussis
gcccaccgugaccagc

SEQ ID NO: 355340 - RNA, 18 nt, Bordetella pertussis
gcccaccuuccugcugga

SEQ ID NO: 355341 - RNA, 22 nt, Bordetella pertussis
gcccaccuuccugcuggaccug

SEQ ID NO: 355342 - RNA, 12 nt, Bordetella pertussis
gcccaccuugcg

SEQ ID NO: 355343 - RNA, 21 nt, Bordetella pertussis
gcccaccuugcgcgcgaacuc

SEQ ID NO: 355344 - RNA, 18 nt, Bordetella pertussis
gcccacgaucaccacgcc

SEQ ID NO: 355345 - RNA, 20 nt, Bordetella pertussis
gcccacgaucaccacgcccg

SEQ ID NO: 355346 - RNA, 22 nt, Bordetella pertussis
gcccacgcacaugaugcccagc

SEQ ID NO: 355347 - RNA, 23 nt, Bordetella pertussis
gcccacgcacaugaugcccagcg

SEQ ID NO: 355348 - RNA, 13 nt, Bordetella pertussis
gcccacgccaugg

SEQ ID NO: 355349 - RNA, 16 nt, Bordetella pertussis
gcccacgccgcugucg

SEQ ID NO: 355350 - RNA, 17 nt, Bordetella pertussis
gcccacgccgcugucga

SEQ ID NO: 355351 - RNA, 13 nt, Bordetella pertussis
gcccacgcgccgc

SEQ ID NO: 355352 - RNA, 14 nt, Bordetella pertussis
gcccacgcgccgcc

SEQ ID NO: 355353 - RNA, 18 nt, Bordetella pertussis
gcccacgcgccgccaggc

SEQ ID NO: 355354 - RNA, 14 nt, Bordetella pertussis
gcccacgcgcuccu

SEQ ID NO: 355355 - RNA, 14 nt, Bordetella pertussis
gcccacgcggcgcu

SEQ ID NO: 355356 - RNA, 19 nt, Bordetella pertussis
gcccacgcggcgcugcugg

SEQ ID NO: 355357 - RNA, 14 nt, Bordetella pertussis
gcccacgcugucgg

SEQ ID NO: 355358 - RNA, 19 nt, Bordetella pertussis
gcccacgcugucggggugc

SEQ ID NO: 355359 - RNA, 18 nt, Bordetella pertussis
gcccacggcaucgccgcg

SEQ ID NO: 355360 - RNA, 12 nt, Bordetella pertussis
gcccacggccag

SEQ ID NO: 355361 - RNA, 13 nt, Bordetella pertussis
gcccacggccagc

SEQ ID NO: 355362 - RNA, 18 nt, Bordetella pertussis
gcccacggccuguccggc

SEQ ID NO: 355363 - RNA, 19 nt, Bordetella pertussis
gcccacggccuguccggca

SEQ ID NO: 355364 - RNA, 17 nt, Bordetella pertussis
gcccacucggugcgcgc

SEQ ID NO: 355365 - RNA, 17 nt, Bordetella pertussis
gcccacugccaggcgag

SEQ ID NO: 355366 - RNA, 23 nt, Bordetella pertussis
gcccacuggaucgccgaucggca

SEQ ID NO: 355367 - RNA, 16 nt, Bordetella pertussis
gcccagcaaggguucg

SEQ ID NO: 355368 - RNA, 22 nt, Bordetella pertussis
gcccagcaauucguugaucugg

SEQ ID NO: 355369 - RNA, 13 nt, Bordetella pertussis
gcccagcaccacg

SEQ ID NO: 355370 - RNA, 13 nt, Bordetella pertussis
gcccagcaccagg

SEQ ID NO: 355371 - RNA, 15 nt, Bordetella pertussis
gcccagcaccaggcc

SEQ ID NO: 355372 - RNA, 13 nt, Bordetella pertussis
gcccagcaccgcc

SEQ ID NO: 355373 - RNA, 17 nt, Bordetella pertussis
gcccagcaccgccaccg

SEQ ID NO: 355374 - RNA, 14 nt, Bordetella pertussis
gcccagcaccgccg

SEQ ID NO: 355375 - RNA, 18 nt, Bordetella pertussis
gcccagcaccugcaggcc

SEQ ID NO: 355376 - RNA, 14 nt, Bordetella pertussis
gcccagcacgacga

SEQ ID NO: 355377 - RNA, 15 nt, Bordetella pertussis
gcccagcacgacgaa

SEQ ID NO: 355378 - RNA, 20 nt, Bordetella pertussis
gcccagcacgccgcgcucgu

SEQ ID NO: 355379 - RNA, 17 nt, Bordetella pertussis
gcccagcacgcgcgcca

SEQ ID NO: 355380 - RNA, 21 nt, Bordetella pertussis
gcccagcacgcgcgccagcug

SEQ ID NO: 355381 - RNA, 12 nt, Bordetella pertussis
gcccagcagcgc

SEQ ID NO: 355382 - RNA, 14 nt, Bordetella pertussis
gcccagcagcgcca

SEQ ID NO: 355383 - RNA, 15 nt, Bordetella pertussis
gcccagcaucaggcc

SEQ ID NO: 355384 - RNA, 17 nt, Bordetella pertussis
gcccagcauccgcgcca

SEQ ID NO: 355385 - RNA, 19 nt, Bordetella pertussis
gcccagcauccgcgccagg

SEQ ID NO: 355386 - RNA, 22 nt, Bordetella pertussis
gcccagcauccgcgccaggaug

SEQ ID NO: 355387 - RNA, 16 nt, Bordetella pertussis
gcccagcaugcgcgcg

SEQ ID NO: 355388 - RNA, 13 nt, Bordetella pertussis
gcccagccagccc

SEQ ID NO: 355389 - RNA, 22 nt, Bordetella pertussis
gcccagcauggucggcauggcc

SEQ ID NO: 355390 - RNA, 14 nt, Bordetella pertussis
gcccagccacacca

SEQ ID NO: 355391 - RNA, 16 nt, Bordetella pertussis
gcccagccacaccagg

SEQ ID NO: 355392 - RNA, 13 nt, Bordetella pertussis
gcccagccaggcg

SEQ ID NO: 355393 - RNA, 14 nt, Bordetella pertussis
gcccagccaggcgc

SEQ ID NO: 355394 - RNA, 18 nt, Bordetella pertussis
gcccagccaggcgccagc

SEQ ID NO: 355395 - RNA, 19 nt, Bordetella pertussis
gcccagccaggcgccagcg

SEQ ID NO: 355396 - RNA, 17 nt, Bordetella pertussis
gcccagccccgcggccg

SEQ ID NO: 355397 - RNA, 13 nt, Bordetella pertussis
gcccagcccggcu

SEQ ID NO: 355398 - RNA, 14 nt, Bordetella pertussis
gcccagcccggcuu

SEQ ID NO: 355399 - RNA, 15 nt, Bordetella pertussis
gcccagcccugcccg

SEQ ID NO: 355400 - RNA, 17 nt, Bordetella pertussis
gcccagcccugcccgca

SEQ ID NO: 355401 - RNA, 16 nt, Bordetella pertussis
gcccagccgcagcagg

SEQ ID NO: 355402 - RNA, 18 nt, Bordetella pertussis
gcccagccgcaugccggc

SEQ ID NO: 355403 - RNA, 14 nt, Bordetella pertussis
gcccagccgcagca

SEQ ID NO: 355404 - RNA, 14 nt, Bordetella pertussis
gcccagccgcgcca

SEQ ID NO: 355405 - RNA, 18 nt, Bordetella pertussis
gcccagccgcucggccac

SEQ ID NO: 355406 - RNA, 19 nt, Bordetella pertussis
gcccagccggugcgcggcu

SEQ ID NO: 355407 - RNA, 16 nt, Bordetella pertussis
gcccagccugccggcg

SEQ ID NO: 355408 - RNA, 15 nt, Bordetella pertussis
gcccagcgagccggc

SEQ ID NO: 355409 - RNA, 17 nt, Bordetella pertussis
gcccagcgagccggcca

SEQ ID NO: 355410 - RNA, 18 nt, Bordetella pertussis
gcccagcgagccggccag

SEQ ID NO: 355411 - RNA, 20 nt, Bordetella pertussis
gcccagcgagccggccagcg

SEQ ID NO: 355412 - RNA, 20 nt, Bordetella pertussis
gcccagcgagcggggcuggu

SEQ ID NO: 355413 - RNA, 22 nt, Bordetella pertussis
gcccagcgagcggggcuggucg

SEQ ID NO: 355414 - RNA, 17 nt, Bordetella pertussis
gcccagcgagucgacca

SEQ ID NO: 355415 - RNA, 19 nt, Bordetella pertussis
gcccagcgcauaggacgcc

SEQ ID NO: 355416 - RNA, 22 nt, Bordetella pertussis
gcccagcgcauaggacgccacc

SEQ ID NO: 355417 - RNA, 11 nt, Bordetella pertussis
gcccagcgcca

SEQ ID NO: 355418 - RNA, 13 nt, Bordetella pertussis
gcccagcgccagc

SEQ ID NO: 355419 - RNA, 15 nt, Bordetella pertussis
gcccagcgccagcag

SEQ ID NO: 355420 - RNA, 16 nt, Bordetella pertussis
gcccagcgccagcagc

SEQ ID NO: 355421 - RNA, 13 nt, Bordetella pertussis
gcccagcgccgcc

SEQ ID NO: 355422 - RNA, 15 nt, Bordetella pertussis
gcccagcgccgccga

SEQ ID NO: 355423 - RNA, 23 nt, Bordetella pertussis
gcccagcgccgccgacggcaugg

SEQ ID NO: 355424 - RNA, 14 nt, Bordetella pertussis
gcccagcgccggca

SEQ ID NO: 355425 - RNA, 16 nt, Bordetella pertussis
gcccagcgcgccgggg

SEQ ID NO: 355426 - RNA, 12 nt, Bordetella pertussis
gcccagcgcgcc

SEQ ID NO: 355427 - RNA, 17 nt, Bordetella pertussis
gcccagcgcggcggcca

SEQ ID NO: 355428 - RNA, 18 nt, Bordetella pertussis
gcccagcgcgucggccag

SEQ ID NO: 355429 - RNA, 19 nt, Bordetella pertussis
gcccagcgcgucggccagc

SEQ ID NO: 355430 - RNA, 20 nt, Bordetella pertussis
gcccagcgcgucggccagcg

SEQ ID NO: 355431 - RNA, 20 nt, Bordetella pertussis
gcccagcgcgugggccagca

SEQ ID NO: 355432 - RNA, 19 nt, Bordetella pertussis
gcccagcgcggcggccaug

SEQ ID NO: 355433 - RNA, 15 nt, Bordetella pertussis
gcccagcggcaggcu

SEQ ID NO: 355434 - RNA, 17 nt, Bordetella pertussis
gcccagcggcaggcugg

SEQ ID NO: 355435 - RNA, 14 nt, Bordetella pertussis
gcccagcggcgccg

SEQ ID NO: 355436 - RNA, 13 nt, Bordetella pertussis
gcccagcuccagc

SEQ ID NO: 355437 - RNA, 19 nt, Bordetella pertussis
gcccagcuccagcuggcgc

SEQ ID NO: 355438 - RNA, 23 nt, Bordetella pertussis
gcccagcuccagcuggcgcacca

SEQ ID NO: 355439 - RNA, 17 nt, Bordetella pertussis
gcccagcuccaccccgg

SEQ ID NO: 355440 - RNA, 12 nt, Bordetella pertussis
gcccagcucugg

SEQ ID NO: 355441 - RNA, 20 nt, Bordetella pertussis
gcccagcugcuucaugcgcu

SEQ ID NO: 355442 - RNA, 16 nt, Bordetella pertussis
gcccagcugggccaca

SEQ ID NO: 355443 - RNA, 16 nt, Bordetella pertussis
gcccagcuggcaccgc

SEQ ID NO: 355444 - RNA, 12 nt, Bordetella pertussis
gcccagcugucc

SEQ ID NO: 355445 - RNA, 19 nt, Bordetella pertussis
gcccaggaaaccggcgacc

SEQ ID NO: 355446 - RNA, 19 nt, Bordetella pertussis
gcccagcuugaugccgccg

SEQ ID NO: 355447 - RNA, 19 nt, Bordetella pertussis
gcccaggaugcccuuggcg

SEQ ID NO: 355448 - RNA, 15 nt, Bordetella pertussis
gcccaggauggcgcc

SEQ ID NO: 355449 - RNA, 18 nt, Bordetella pertussis
gcccaggcaaugcgcagg

SEQ ID NO: 355450 - RNA, 16 nt, Bordetella pertussis
gcccaggcccagcauc

SEQ ID NO: 355451 - RNA, 21 nt, Bordetella pertussis
gcccaggcccaguucggcgcg

SEQ ID NO: 355452 - RNA, 16 nt, Bordetella pertussis
gcccaggcccgccagg

SEQ ID NO: 355453 - RNA, 17 nt, Bordetella pertussis
gcccaguugaaucggcg

SEQ ID NO: 355454 - RNA, 18 nt, Bordetella pertussis
gcccaguugaaucggcgc

SEQ ID NO: 355455 - RNA, 22 nt, Bordetella pertussis
gcccaguuucgcgaccaccagg

SEQ ID NO: 355456 - RNA, 19 nt, Bordetella pertussis
gcccaggcccacgccgcgu

SEQ ID NO: 355457 - RNA, 22 nt, Bordetella pertussis
gcccaggcccacgccgcguucg

SEQ ID NO: 355458 - RNA, 15 nt, Bordetella pertussis
gcccauaugccgccg

SEQ ID NO: 355459 - RNA, 13 nt, Bordetella pertussis
gcccaucaggugg

SEQ ID NO: 355460 - RNA, 18 nt, Bordetella pertussis
gcccaucaggugggccga

SEQ ID NO: 355461 - RNA, 12 nt, Bordetella pertussis
gcccaucaggcc

SEQ ID NO: 355462 - RNA, 14 nt, Bordetella pertussis
gcccaucaggccga

SEQ ID NO: 355463 - RNA, 13 nt, Bordetella pertussis
gcccaucgcgcug

SEQ ID NO: 355464 - RNA, 15 nt, Bordetella pertussis
gcccaucgugcgcga

SEQ ID NO: 355465 - RNA, 17 nt, Bordetella pertussis
gcccaucucggccgcgg

SEQ ID NO: 355466 - RNA, 21 nt, Bordetella pertussis
gcccaucuguacggccggcuc

SEQ ID NO: 355467 - RNA, 15 nt, Bordetella pertussis
gcccaugaacaggca

SEQ ID NO: 355468 - RNA, 21 nt, Bordetella pertussis
gcccaugaacaggcacgacgc

SEQ ID NO: 355469 - RNA, 21 nt, Bordetella pertussis
gccccaaugugcugacggugc

SEQ ID NO: 355470 - RNA, 17 nt, Bordetella pertussis
gccccacacgcgcgcaa

SEQ ID NO: 355471 - RNA, 22 nt, Bordetella pertussis
gccccacccggguacguggccc

SEQ ID NO: 355472 - RNA, 22 nt, Bordetella pertussis
gccccaccuggcggugcgccgc

SEQ ID NO: 355473 - RNA, 24 nt, Bordetella pertussis
gccccaccuggcggugcgccgcau

SEQ ID NO: 355474 - RNA, 21 nt, Bordetella pertussis
gccccaccuugcccagcagcu

SEQ ID NO: 355475 - RNA, 13 nt, Bordetella pertussis
gccccaccuggcg

SEQ ID NO: 355476 - RNA, 21 nt, Bordetella pertussis
gccccagcacgaagggcagca

SEQ ID NO: 355477 - RNA, 19 nt, Bordetella pertussis
gccccagcagcacgcccag

SEQ ID NO: 355478 - RNA, 15 nt, Bordetella pertussis
gccccagcagcagcg

SEQ ID NO: 355479 - RNA, 20 nt, Bordetella pertussis
gccccagcaucugccccagc

SEQ ID NO: 355480 - RNA, 17 nt, Bordetella pertussis
gccccagcgccagcgug

SEQ ID NO: 355481 - RNA, 15 nt, Bordetella pertussis
gccccagcgcccagg

SEQ ID NO: 355482 - RNA, 16 nt, Bordetella pertussis
gccccagcgcccaggc

SEQ ID NO: 355483 - RNA, 14 nt, Bordetella pertussis
gccccagcgccgcg

SEQ ID NO: 355484 - RNA, 12 nt, Bordetella pertussis
gccccagcggcu

SEQ ID NO: 355485 - RNA, 19 nt, Bordetella pertussis
gccccagcggcuggcgcac

SEQ ID NO: 355486 - RNA, 18 nt, Bordetella pertussis
gccccagcguccaggcgg

SEQ ID NO: 355487 - RNA, 21 nt, Bordetella pertussis
gccccaggaaaccgaccugau

SEQ ID NO: 355488 - RNA, 23 nt, Bordetella pertussis
gccccaggaacuugaacggcgcg

SEQ ID NO: 355489 - RNA, 22 nt, Bordetella pertussis
gccccaggaugcgcaccggcca

SEQ ID NO: 355490 - RNA, 16 nt, Bordetella pertussis
gccccaggcgucggcg

SEQ ID NO: 355491 - RNA, 21 nt, Bordetella pertussis
gccccaggcgucggcggccca

SEQ ID NO: 355492 - RNA, 16 nt, Bordetella pertussis
gccccaggcgugaacg

SEQ ID NO: 355493 - RNA, 18 nt, Bordetella pertussis
gccccaggcgugaacgcc

SEQ ID NO: 355494 - RNA, 21 nt, Bordetella pertussis
gccccaggcgugaacgccccg

SEQ ID NO: 355495 - RNA, 13 nt, Bordetella pertussis
gcccccagcgcgc

SEQ ID NO: 355496 - RNA, 15 nt, Bordetella pertussis
gccccccaugccgga

SEQ ID NO: 355497 - RNA, 14 nt, Bordetella pertussis
gccccccgaggcca

SEQ ID NO: 355498 - RNA, 14 nt, Bordetella pertussis
gccccccggcgcgg

SEQ ID NO: 355499 - RNA, 16 nt, Bordetella pertussis
gccccccggcgcggcc

SEQ ID NO: 355500 - RNA, 22 nt, Bordetella pertussis
gccccccguaggcggcccaggc

SEQ ID NO: 355501 - RNA, 13 nt, Bordetella pertussis
gcccccgccgcca

SEQ ID NO: 355502 - RNA, 14 nt, Bordetella pertussis
gcccccgcgccgcg

SEQ ID NO: 355503 - RNA, 16 nt, Bordetella pertussis
gcccccgcgccgcgca

SEQ ID NO: 355504 - RNA, 19 nt, Bordetella pertussis
gcccccgcgcugcgcccgc

SEQ ID NO: 355505 - RNA, 17 nt, Bordetella pertussis
gcccccgcggcgccccg

SEQ ID NO: 355506 - RNA, 23 nt, Bordetella pertussis
gcccccgcggcgccccgugccau

SEQ ID NO: 355507 - RNA, 23 nt, Bordetella pertussis
gcccccucaacgguaucgcgucg

SEQ ID NO: 355508 - RNA, 20 nt, Bordetella pertussis
gccccgcgacccagaacccg

SEQ ID NO: 355509 - RNA, 22 nt, Bordetella pertussis
gccccgcgaggggcccuugugc

SEQ ID NO: 355510 - RNA, 14 nt, Bordetella pertussis
gccccgcgcgagcg

SEQ ID NO: 355511 - RNA, 15 nt, Bordetella pertussis
gccccgcgcgagcgc

SEQ ID NO: 355512 - RNA, 23 nt, Bordetella pertussis
gccccgcuacguguccugccggg

SEQ ID NO: 355513 - RNA, 13 nt, Bordetella pertussis
gccccggcgcgca

SEQ ID NO: 355514 - RNA, 14 nt, Bordetella pertussis
gccccggcgcgcag

SEQ ID NO: 355515 - RNA, 15 nt, Bordetella pertussis
gccccggcgcgcagc

SEQ ID NO: 355516 - RNA, 18 nt, Bordetella pertussis
gccccggcgcgccggccg

SEQ ID NO: 355517 - RNA, 19 nt, Bordetella pertussis
gccccggcgcgccggccgc

SEQ ID NO: 355518 - RNA, 19 nt, Bordetella pertussis
gccccggcgcggcgcgcgc

SEQ ID NO: 355519 - RNA, 21 nt, Bordetella pertussis
gccccggcgcggcgcgcgccg

SEQ ID NO: 355520 - RNA, 17 nt, Bordetella pertussis
gccccgguagucgccgg

SEQ ID NO: 355521 - RNA, 18 nt, Bordetella pertussis
gccccgguagucgccggc

SEQ ID NO: 355522 - RNA, 18 nt, Bordetella pertussis
gccccgucaucgggugcg

SEQ ID NO: 355523 - RNA, 21 nt, Bordetella pertussis
gccccguccuuacuugcgcac

SEQ ID NO: 355524 - RNA, 22 nt, Bordetella pertussis
gccccgugcaccaugccgacga

SEQ ID NO: 355525 - RNA, 21 nt, Bordetella pertussis
gccccgugccgcggcgcggcc

SEQ ID NO: 355526 - RNA, 16 nt, Bordetella pertussis
gccccguugucgccgc

SEQ ID NO: 355527 - RNA, 20 nt, Bordetella pertussis
gccccguugucgccgcggcc

SEQ ID NO: 355528 - RNA, 22 nt, Bordetella pertussis
gccccguugucgccgcggccgg

SEQ ID NO: 355529 - RNA, 15 nt, Bordetella pertussis
gccccuagcgccgcg

SEQ ID NO: 355530 - RNA, 16 nt, Bordetella pertussis
gccccuagcgccgcgc

SEQ ID NO: 355531 - RNA, 19 nt, Bordetella pertussis
gccccuagcgccgcgccag

SEQ ID NO: 355532 - RNA, 14 nt, Bordetella pertussis
gccccuccggcgcc

SEQ ID NO: 355533 - RNA, 17 nt, Bordetella pertussis
gccccuccggcgccgcc

SEQ ID NO: 355534 - RNA, 21 nt, Bordetella pertussis
gccccuccgggucgcggcacg

SEQ ID NO: 355535 - RNA, 21 nt, Bordetella pertussis
gccccucgcggaugaccuggu

SEQ ID NO: 355536 - RNA, 14 nt, Bordetella pertussis
gccccucgcggggc

SEQ ID NO: 355537 - RNA, 22 nt, Bordetella pertussis
gccccucgcggggcccuugugc

SEQ ID NO: 355538 - RNA, 14 nt, Bordetella pertussis
gccccugcggggac

SEQ ID NO: 355539 - RNA, 13 nt, Bordetella pertussis
gcccgagggcgcg

SEQ ID NO: 355540 - RNA, 16 nt, Bordetella pertussis
gcccgagggcgcgucg

SEQ ID NO: 355541 - RNA, 20 nt, Bordetella pertussis
gcccgauaugcagccgcacc

SEQ ID NO: 355542 - RNA, 23 nt, Bordetella pertussis
gcccgauaugcagccgcaccagc

SEQ ID NO: 355543 - RNA, 14 nt, Bordetella pertussis
gcccgaucgacggc

SEQ ID NO: 355544 - RNA, 15 nt, Bordetella pertussis
gcccgaucgacggcc

SEQ ID NO: 355545 - RNA, 23 nt, Bordetella pertussis
gcccgaucgccggugaugcgaug

SEQ ID NO: 355546 - RNA, 14 nt, Bordetella pertussis
gcccgaucggccgg

SEQ ID NO: 355547 - RNA, 18 nt, Bordetella pertussis
gcccgaucggccggccgg

SEQ ID NO: 355548 - RNA, 21 nt, Bordetella pertussis
gcccgaucggccggccgggcc

SEQ ID NO: 355549 - RNA, 18 nt, Bordetella pertussis
gcccgaugccgccaugcg

SEQ ID NO: 355550 - RNA, 15 nt, Bordetella pertussis
gcccgaugcgccagg

SEQ ID NO: 355551 - RNA, 16 nt, Bordetella pertussis
gcccgaugcucgccgg

SEQ ID NO: 355552 - RNA, 18 nt, Bordetella pertussis
gcccgaugcucgccggcg

SEQ ID NO: 355553 - RNA, 15 nt, Bordetella pertussis
gcccgauggcgggga

SEQ ID NO: 355554 - RNA, 21 nt, Bordetella pertussis
gcccgcaacgccgcccguccg

SEQ ID NO: 355555 - RNA, 16 nt, Bordetella pertussis
gcccgcaacgggccgg

SEQ ID NO: 355556 - RNA, 23 nt, Bordetella pertussis
gcccgcaacgggccggccgccgg

SEQ ID NO: 355557 - RNA, 13 nt, Bordetella pertussis
gcccgcaggcggc

SEQ ID NO: 355558 - RNA, 15 nt, Bordetella pertussis
gcccgcaggcggcgg

SEQ ID NO: 355559 - RNA, 14 nt, Bordetella pertussis
gcccgcaucgcgcg

SEQ ID NO: 355560 - RNA, 18 nt, Bordetella pertussis
gcccgcaucggcuggcgc

SEQ ID NO: 355561 - RNA, 15 nt, Bordetella pertussis
gcccgcaugcagguc

SEQ ID NO: 355562 - RNA, 17 nt, Bordetella pertussis
gcccgcaugcagguccu

SEQ ID NO: 355563 - RNA, 21 nt, Bordetella pertussis
gcccgcaugcagguccuggua

SEQ ID NO: 355564 - RNA, 17 nt, Bordetella pertussis
gcccgcaugucccagcg

SEQ ID NO: 355565 - RNA, 19 nt, Bordetella pertussis
gcccgcaugucccagcgcu

SEQ ID NO: 355566 - RNA, 21 nt, Bordetella pertussis
gcccgcaugucccagcgcucg

SEQ ID NO: 355567 - RNA, 13 nt, Bordetella pertussis
gcccgccagcgcg

SEQ ID NO: 355568 - RNA, 20 nt, Bordetella pertussis
gcccgccaggaagcgggccu

SEQ ID NO: 355569 - RNA, 14 nt, Bordetella pertussis
gcccgccaggccag

SEQ ID NO: 355570 - RNA, 16 nt, Bordetella pertussis
gcccgccaggccaggu

SEQ ID NO: 355571 - RNA, 14 nt, Bordetella pertussis
gcccgccagggcgu

SEQ ID NO: 355572 - RNA, 16 nt, Bordetella pertussis
gcccgccaucgccagg

SEQ ID NO: 355573 - RNA, 14 nt, Bordetella pertussis
gcccgccaucgcgc

SEQ ID NO: 355574 - RNA, 17 nt, Bordetella pertussis
gcccgccaugcacgggc

SEQ ID NO: 355575 - RNA, 22 nt, Bordetella pertussis
gcccgccauugcacgcgcagga

SEQ ID NO: 355576 - RNA, 13 nt, Bordetella pertussis
gcccgccggcacc

SEQ ID NO: 355577 - RNA, 15 nt, Bordetella pertussis
gcccgccggcacccg

SEQ ID NO: 355578 - RNA, 16 nt, Bordetella pertussis
gcccgccggcacccgg

SEQ ID NO: 355579 - RNA, 17 nt, Bordetella pertussis
gcccgccccgugcacca

SEQ ID NO: 355580 - RNA, 13 nt, Bordetella pertussis
gcccgccggcgcg

SEQ ID NO: 355581 - RNA, 14 nt, Bordetella pertussis
gcccgccggcgcgc

SEQ ID NO: 355582 - RNA, 13 nt, Bordetella pertussis
gcccgccgggccg

SEQ ID NO: 355583 - RNA, 17 nt, Bordetella pertussis
gcccgcgaagcagccgg

SEQ ID NO: 355584 - RNA, 20 nt, Bordetella pertussis
gcccgcgaagcagccggcca

SEQ ID NO: 355585 - RNA, 21 nt, Bordetella pertussis
gcccgcgaagcagccggccaa

SEQ ID NO: 355586 - RNA, 22 nt, Bordetella pertussis
gcccgcgaagcagccggccaag

SEQ ID NO: 355587 - RNA, 15 nt, Bordetella pertussis
gcccgcgagcggcca

SEQ ID NO: 355588 - RNA, 16 nt, Bordetella pertussis
gcccgcgagcggccag

SEQ ID NO: 355589 - RNA, 17 nt, Bordetella pertussis
gcccgcgagcggccagc

SEQ ID NO: 355590 - RNA, 13 nt, Bordetella pertussis
gcccgcgccguac

SEQ ID NO: 355591 - RNA, 13 nt, Bordetella pertussis
gcccgcgcgagcg

SEQ ID NO: 355592 - RNA, 16 nt, Bordetella pertussis
gcccgcgcgagcggcg

SEQ ID NO: 355593 - RNA, 12 nt, Bordetella pertussis
gcccgcgcgccu

SEQ ID NO: 355594 - RNA, 14 nt, Bordetella pertussis
gcccgcgcgccugc

SEQ ID NO: 355595 - RNA, 14 nt, Bordetella pertussis
gcccgcgcgcgagc

SEQ ID NO: 355596 - RNA, 23 nt, Bordetella pertussis
gcccgcgcgcgagcugcgcggcu

SEQ ID NO: 355597 - RNA, 15 nt, Bordetella pertussis
gcccgcgcggccagc

SEQ ID NO: 355598 - RNA, 16 nt, Bordetella pertussis
gcccgcgcggccagcg

SEQ ID NO: 355599 - RNA, 20 nt, Bordetella pertussis
gcccgcgcggccagcgccgg

SEQ ID NO: 355600 - RNA, 23 nt, Bordetella pertussis
gcccgcgcggccagcgccggcgc

SEQ ID NO: 355601 - RNA, 21 nt, Bordetella pertussis
gcccgcgcgguauugcgccac

SEQ ID NO: 355602 - RNA, 14 nt, Bordetella pertussis
gcccgcgcuggcgc

SEQ ID NO: 355603 - RNA, 17 nt, Bordetella pertussis
gcccgcgcuggcgcagc

SEQ ID NO: 355604 - RNA, 18 nt, Bordetella pertussis
gcccgcgcuggcgcagca

SEQ ID NO: 355605 - RNA, 22 nt, Bordetella pertussis
gcccgcgcuguugcuccaggcc

SEQ ID NO: 355606 - RNA, 17 nt, Bordetella pertussis
gcccgcggaaagcuggc

SEQ ID NO: 355607 - RNA, 13 nt, Bordetella pertussis
gcccgcggccacc

SEQ ID NO: 355608 - RNA, 17 nt, Bordetella pertussis
gcccgcggccaccaggc

SEQ ID NO: 355609 - RNA, 12 nt, Bordetella pertussis
gcccgcggccag

SEQ ID NO: 355610 - RNA, 13 nt, Bordetella pertussis
gcccgcggccagc

SEQ ID NO: 355611 - RNA, 14 nt, Bordetella pertussis
gcccgcggccagcc

SEQ ID NO: 355612 - RNA, 22 nt, Bordetella pertussis
gcccgcggccagccacgccggc

SEQ ID NO: 355613 - RNA, 13 nt, Bordetella pertussis
gcccgcggccgcg

SEQ ID NO: 355614 - RNA, 17 nt, Bordetella pertussis
gcccgcggccgcgucau

SEQ ID NO: 355615 - RNA, 19 nt, Bordetella pertussis
gcccgcggccugcagacca

SEQ ID NO: 355616 - RNA, 14 nt, Bordetella pertussis
gcccgcggccugcg

SEQ ID NO: 355617 - RNA, 15 nt, Bordetella pertussis
gcccgcggccugcgc

SEQ ID NO: 355618 - RNA, 17 nt, Bordetella pertussis
gcccgcggccugcgcgu

SEQ ID NO: 355619 - RNA, 23 nt, Bordetella pertussis
gcccgcggccuuggucgcgaccu

SEQ ID NO: 355620 - RNA, 15 nt, Bordetella pertussis
gcccgcggcgccagc

SEQ ID NO: 355621 - RNA, 13 nt, Bordetella pertussis
gcccgcggcgccc

SEQ ID NO: 355622 - RNA, 14 nt, Bordetella pertussis
gcccgcggcgccca

SEQ ID NO: 355623 - RNA, 19 nt, Bordetella pertussis
gcccgcggcgcccagcugg

SEQ ID NO: 355624 - RNA, 22 nt, Bordetella pertussis
gcccgcggcgcccagcuggcgc

SEQ ID NO: 355625 - RNA, 14 nt, Bordetella pertussis
gcccgcggcggccc

SEQ ID NO: 355626 - RNA, 15 nt, Bordetella pertussis
gcccgcggcggcccg

SEQ ID NO: 355627 - RNA, 14 nt, Bordetella pertussis
gcccgcgggcgccc

SEQ ID NO: 355628 - RNA, 16 nt, Bordetella pertussis
gcccgcgggcgcccgg

SEQ ID NO: 355629 - RNA, 17 nt, Bordetella pertussis
gcccgcgggcgcccggc

SEQ ID NO: 355630 - RNA, 15 nt, Bordetella pertussis
gcccgcgguccagca

SEQ ID NO: 355631 - RNA, 21 nt, Bordetella pertussis
gcccgcgguccagcacggcga

SEQ ID NO: 355632 - RNA, 21 nt, Bordetella pertussis
gcccgcggucgagacgauggc

SEQ ID NO: 355633 - RNA, 14 nt, Bordetella pertussis
gcccgcgucgcugu

SEQ ID NO: 355634 - RNA, 20 nt, Bordetella pertussis
gcccgcgucgcugucggcga

SEQ ID NO: 355635 - RNA, 16 nt, Bordetella pertussis
gcccgcgucagacgcg

SEQ ID NO: 355636 - RNA, 18 nt, Bordetella pertussis
gcccgcgucagacgcgcu

SEQ ID NO: 355637 - RNA, 19 nt, Bordetella pertussis
gcccgcgucagacgcgcuu

SEQ ID NO: 355638 - RNA, 21 nt, Bordetella pertussis
gcccgcgugacggccgccacg

SEQ ID NO: 355639 - RNA, 20 nt, Bordetella pertussis
gcccgcgugcgugccgacga

SEQ ID NO: 355640 - RNA, 22 nt, Bordetella pertussis
gcccgcguggaagguccacggc

SEQ ID NO: 355641 - RNA, 20 nt, Bordetella pertussis
gcccgcguucaggcgcggcu

SEQ ID NO: 355642 - RNA, 22 nt, Bordetella pertussis
gcccgcguucaggcgcggcugg

SEQ ID NO: 355643 - RNA, 16 nt, Bordetella pertussis
gcccgcuacgcgggcu

SEQ ID NO: 355644 - RNA, 23 nt, Bordetella pertussis
gcccgcuacgcgggcuugcugcc

SEQ ID NO: 355645 - RNA, 15 nt, Bordetella pertussis
gcccgcuccaccagc

SEQ ID NO: 355646 - RNA, 20 nt, Bordetella pertussis
gcccgcuccaccagcaccgg

SEQ ID NO: 355647 - RNA, 22 nt, Bordetella pertussis
gcccgcuccaccagcaccggca

SEQ ID NO: 355648 - RNA, 14 nt, Bordetella pertussis
gcccgcuccaggcg

SEQ ID NO: 355649 - RNA, 18 nt, Bordetella pertussis
gcccgcuccaggcggcca

SEQ ID NO: 355650 - RNA, 13 nt, Bordetella pertussis
gcccgcucggcca

SEQ ID NO: 355651 - RNA, 22 nt, Bordetella pertussis
gcccgcugaccggccuggucau

SEQ ID NO: 355652 - RNA, 17 nt, Bordetella pertussis
gcccuccggcgccagca

SEQ ID NO: 355653 - RNA, 22 nt, Bordetella pertussis
gcccucgcccccgaaggccgcg

SEQ ID NO: 355654 - RNA, 16 nt, Bordetella pertussis
gcccucgcccgugcgc

SEQ ID NO: 355655 - RNA, 17 nt, Bordetella pertussis
gcccucgauaugggcgc

SEQ ID NO: 355656 - RNA, 14 nt, Bordetella pertussis
gcccucgcgcacgg

SEQ ID NO: 355657 - RNA, 13 nt, Bordetella pertussis
gcccucgcgccac

SEQ ID NO: 355658 - RNA, 14 nt, Bordetella pertussis
gcccucgcugcgcg

SEQ ID NO: 355659 - RNA, 18 nt, Bordetella pertussis
gcccucgcugcgcgucaa

SEQ ID NO: 355660 - RNA, 19 nt, Bordetella pertussis
gcccucgggaaacaggccc

SEQ ID NO: 355661 - RNA, 18 nt, Bordetella pertussis
gcccucgggcgacaggcg

SEQ ID NO: 355662 - RNA, 19 nt, Bordetella pertussis
gcccucgggcgacaggcgc

SEQ ID NO: 355663 - RNA, 21 nt, Bordetella pertussis
gcccucgggcgacaggcgcgc

SEQ ID NO: 355664 - RNA, 23 nt, Bordetella pertussis
gcccucgggcgacaggcgcgccc

SEQ ID NO: 355665 - RNA, 18 nt, Bordetella pertussis
gcccucggucagcgccag

SEQ ID NO: 355666 - RNA, 20 nt, Bordetella pertussis
gcccucggucagcgccaggg

SEQ ID NO: 355667 - RNA, 13 nt, Bordetella pertussis
gcccucggugcgg

SEQ ID NO: 355668 - RNA, 18 nt, Bordetella pertussis
gcccucuucggcggccag

SEQ ID NO: 355669 - RNA, 22 nt, Bordetella pertussis
gcccucuucggcggccagccgg

SEQ ID NO: 355670 - RNA, 17 nt, Bordetella pertussis
gcccucuuucgccgcgc

SEQ ID NO: 355671 - RNA, 22 nt, Bordetella pertussis
gcccugaacuauggcgcgcgca

SEQ ID NO: 355672 - RNA, 14 nt, Bordetella pertussis
gcccugacccgcug

SEQ ID NO: 355673 - RNA, 17 nt, Bordetella pertussis
gcccugacccgcuggcu

SEQ ID NO: 355674 - RNA, 14 nt, Bordetella pertussis
gcccugacgccugc

SEQ ID NO: 355675 - RNA, 23 nt, Bordetella pertussis
gcccugacgaccaaccugaccgc

SEQ ID NO: 355676 - RNA, 21 nt, Bordetella pertussis
gcccugcaccgucacgcgcug

SEQ ID NO: 355677 - RNA, 13 nt, Bordetella pertussis
gcccugcacgcgc

SEQ ID NO: 355678 - RNA, 14 nt, Bordetella pertussis
gcccugcacgcgcg

SEQ ID NO: 355679 - RNA, 14 nt, Bordetella pertussis
gcccugcagcggcc

SEQ ID NO: 355680 - RNA, 15 nt, Bordetella pertussis
gcccugcagcggcca

SEQ ID NO: 355681 - RNA, 16 nt, Bordetella pertussis
gcccugcagcggccag

SEQ ID NO: 355682 - RNA, 22 nt, Bordetella pertussis
gcccugcaggaacucgcacacg

SEQ ID NO: 355683 - RNA, 13 nt, Bordetella pertussis
gcccugcaugacc

SEQ ID NO: 355684 - RNA, 23 nt, Bordetella pertussis
gcccugcaugaccgccgccagca

SEQ ID NO: 355685 - RNA, 19 nt, Bordetella pertussis
gcccugccauucggacacg

SEQ ID NO: 355686 - RNA, 20 nt, Bordetella pertussis
gcccugcccgcaccaugccg

SEQ ID NO: 355687 - RNA, 13 nt, Bordetella pertussis
gcccugcccggcg

SEQ ID NO: 355688 - RNA, 16 nt, Bordetella pertussis
gcccugccgcccuggc

SEQ ID NO: 355689 - RNA, 15 nt, Bordetella pertussis
gcccugcgaacccgc

SEQ ID NO: 355690 - RNA, 20 nt, Bordetella pertussis
gcccugcgaacccgccgcga

SEQ ID NO: 355691 - RNA, 23 nt, Bordetella pertussis
gcccugcgcaucgaucagcgcgc

SEQ ID NO: 355692 - RNA, 13 nt, Bordetella pertussis
gcccugcgccagc

SEQ ID NO: 355693 - RNA, 14 nt, Bordetella pertussis
gcccugcgccagcg

SEQ ID NO: 355694 - RNA, 13 nt, Bordetella pertussis
gcccugcggcgcg

SEQ ID NO: 355695 - RNA, 17 nt, Bordetella pertussis
gcccugcggcgcggcca

SEQ ID NO: 355696 - RNA, 19 nt, Bordetella pertussis
gcccugcggcgcggccagc

SEQ ID NO: 355697 - RNA, 21 nt, Bordetella pertussis
gcccugcggcgcggccagcac

SEQ ID NO: 355698 - RNA, 21 nt, Bordetella pertussis
gcccugcggcuugggcccggc

SEQ ID NO: 355699 - RNA, 19 nt, Bordetella pertussis
gcccugcgcguugagcagc

SEQ ID NO: 355700 - RNA, 20 nt, Bordetella pertussis
gcccugcucccacgaacgcc

SEQ ID NO: 355701 - RNA, 17 nt, Bordetella pertussis
gcccugcucgcgcagcg

SEQ ID NO: 355702 - RNA, 18 nt, Bordetella pertussis
gcccugcugcugcagcca

SEQ ID NO: 355703 - RNA, 15 nt, Bordetella pertussis
gcccugcuggcgcag

SEQ ID NO: 355704 - RNA, 20 nt, Bordetella pertussis
gcccuggacgucugagcgcc

SEQ ID NO: 355705 - RNA, 17 nt, Bordetella pertussis
gcccuggagaucgccgc

SEQ ID NO: 355706 - RNA, 19 nt, Bordetella pertussis
gcccuggagaucgccgccg

SEQ ID NO: 355707 - RNA, 14 nt, Bordetella pertussis
gcccuggauggcgg

SEQ ID NO: 355708 - RNA, 20 nt, Bordetella pertussis
gcccuggauggcggccgcca

SEQ ID NO: 355709 - RNA, 21 nt, Bordetella pertussis
gcccuggauggcggccgccag

SEQ ID NO: 355710 - RNA, 22 nt, Bordetella pertussis
gcccuggauggcggccgccagc

SEQ ID NO: 355711 - RNA, 21 nt, Bordetella pertussis
gcccuggcaugugccaccgcc

SEQ ID NO: 355712 - RNA, 22 nt, Bordetella pertussis
gcccuggcaugugccaccgccc

SEQ ID NO: 355713 - RNA, 21 nt, Bordetella pertussis
gcccuggccacgcugcugccg

SEQ ID NO: 355714 - RNA, 14 nt, Bordetella pertussis
gcccuggcccagcg

SEQ ID NO: 355715 - RNA, 16 nt, Bordetella pertussis
gcccuggcccaggccg

SEQ ID NO: 355716 - RNA, 14 nt, Bordetella pertussis
gcccuggcagcugg

SEQ ID NO: 355717 - RNA, 16 nt, Bordetella pertussis
gcccuggccgcgccgu

SEQ ID NO: 355718 - RNA, 20 nt, Bordetella pertussis
gcccuggccgcgccguucgg

SEQ ID NO: 355719 - RNA, 16 nt, Bordetella pertussis
gcccuggcgcaggccg

SEQ ID NO: 355720 - RNA, 23 nt, Bordetella pertussis
gcccuggcgcaggccggcggcca

SEQ ID NO: 355721 - RNA, 15 nt, Bordetella pertussis
gcccuggcgcagggc

SEQ ID NO: 355722 - RNA, 22 nt, Bordetella pertussis
gcccuggccuucgaccugcccg

SEQ ID NO: 355723 - RNA, 18 nt, Bordetella pertussis
gcccuggcgccgcggccg

SEQ ID NO: 355724 - RNA, 14 nt, Bordetella pertussis
gcccuggcgcggcg

SEQ ID NO: 355725 - RNA, 17 nt, Bordetella pertussis
gcccuggcgcggcggcg

SEQ ID NO: 355726 - RNA, 17 nt, Bordetella pertussis
gcccuggcgcugcagcg

SEQ ID NO: 355727 - RNA, 19 nt, Bordetella pertussis
gcccuggcgcugcagcguc

SEQ ID NO: 355728 - RNA, 12 nt, Bordetella pertussis
gcccuggcggcg

SEQ ID NO: 355729 - RNA, 13 nt, Bordetella pertussis
gcccuggcggcgc

SEQ ID NO: 355730 - RNA, 15 nt, Bordetella pertussis
gcccuggcggcgcag

SEQ ID NO: 355731 - RNA, 23 nt, Bordetella pertussis
gcccuggcggucuuucaccgaca

SEQ ID NO: 355732 - RNA, 17 nt, Bordetella pertussis
gcccuggcguggcgcgc

SEQ ID NO: 355733 - RNA, 18 nt, Bordetella pertussis
gcccuggcguggcgcgcg

SEQ ID NO: 355734 - RNA, 19 nt, Bordetella pertussis
gcccuggcguggcgcgcgc

SEQ ID NO: 355735 - RNA, 21 nt, Bordetella pertussis
gcccuggcguggcgcgcgccg

SEQ ID NO: 355736 - RNA, 13 nt, Bordetella pertussis
gcccuggcguucg

SEQ ID NO: 355737 - RNA, 22 nt, Bordetella pertussis
gcccugggccagcagcuggcgc

SEQ ID NO: 355738 - RNA, 15 nt, Bordetella pertussis
gcccugggccagcca

SEQ ID NO: 355739 - RNA, 16 nt, Bordetella pertussis
gcccugggccagccag

SEQ ID NO: 355740 - RNA, 18 nt, Bordetella pertussis
gcccugggccagccagcg

SEQ ID NO: 355741 - RNA, 14 nt, Bordetella pertussis
gcccuggcuggcca

SEQ ID NO: 355742 - RNA, 15 nt, Bordetella pertussis
gcccuggcuggccag

SEQ ID NO: 355743 - RNA, 22 nt, Bordetella pertussis
gcccuggcuggccagccggccc

SEQ ID NO: 355744 - RNA, 13 nt, Bordetella pertussis
gcccuggcuggcg

SEQ ID NO: 355745 - RNA, 17 nt, Bordetella pertussis
gcccuggcuggcggccc

SEQ ID NO: 355746 - RNA, 19 nt, Bordetella pertussis
gcccuggggccgcggcgcg

SEQ ID NO: 355747 - RNA, 22 nt, Bordetella pertussis
gcccuggggccgcggcgcgcgc

SEQ ID NO: 355748 - RNA, 18 nt, Bordetella pertussis
gcccuggguggcggggcg

SEQ ID NO: 355749 - RNA, 19 nt, Bordetella pertussis
gcccugucggccgaaccgc

SEQ ID NO: 355750 - RNA, 16 nt, Bordetella pertussis
gcccuguucgcgcggc

SEQ ID NO: 355751 - RNA, 13 nt, Bordetella pertussis
gcccuucaggcca

SEQ ID NO: 355752 - RNA, 13 nt, Bordetella pertussis
gcccuucgcggcu

SEQ ID NO: 355753 - RNA, 19 nt, Bordetella pertussis
gcccuucgcggcuggucgc

SEQ ID NO: 355754 - RNA, 21 nt, Bordetella pertussis
gcccuugagcacggcgcggcu

SEQ ID NO: 355755 - RNA, 17 nt, Bordetella pertussis
gcccuugaucagcggcg

SEQ ID NO: 355756 - RNA, 16 nt, Bordetella pertussis
gcccuugauggccucg

SEQ ID NO: 355757 - RNA, 17 nt, Bordetella pertussis
gcccuugauggccucgg

SEQ ID NO: 355758 - RNA, 18 nt, Bordetella pertussis
gcccuugccagggccugg

SEQ ID NO: 355759 - RNA, 23 nt, Bordetella pertussis
gcccuugccagggccuggcacau

SEQ ID NO: 355760 - RNA, 21 nt, Bordetella pertussis
gcccuugccguuguccgccug

SEQ ID NO: 355761 - RNA, 23 nt, Bordetella pertussis
gcccuugccguuguccgccugcg

SEQ ID NO: 355762 - RNA, 14 nt, Bordetella pertussis
gcccuuggcggccu

SEQ ID NO: 355763 - RNA, 13 nt, Bordetella pertussis
gcccuuggcggcg

SEQ ID NO: 355764 - RNA, 19 nt, Bordetella pertussis
gcccuuggcggcgaucgaa

SEQ ID NO: 355765 - RNA, 13 nt, Bordetella pertussis
gcccuugggggcc

SEQ ID NO: 355766 - RNA, 15 nt, Bordetella pertussis
gcccuugugcguugg

SEQ ID NO: 355767 - RNA, 15 nt, Bordetella pertussis
gcccuugugcugcca

SEQ ID NO: 355768 - RNA, 23 nt, Bordetella pertussis
gcccuugugcugccaugccgcgc

SEQ ID NO: 355769 - RNA, 15 nt, Bordetella pertussis
gcccuuguggccgcc

SEQ ID NO: 355770 - RNA, 19 nt, Bordetella pertussis
gcccuuguggccgccgaac

SEQ ID NO: 355771 - RNA, 22 nt, Bordetella pertussis
gcccuuguggccgccgaacggc

SEQ ID NO: 355772 - RNA, 19 nt, Bordetella pertussis
gcccuuugcauugcggcug

SEQ ID NO: 355773 - RNA, 15 nt, Bordetella pertussis
gccgaaaaacggcgg

SEQ ID NO: 355774 - RNA, 12 nt, Bordetella pertussis
gccgaacaccag

SEQ ID NO: 355775 - RNA, 14 nt, Bordetella pertussis
gccgaacaccagcu

SEQ ID NO: 355776 - RNA, 23 nt, Bordetella pertussis
gccgaacaccagcucggcggcga

SEQ ID NO: 355777 - RNA, 19 nt, Bordetella pertussis
gccgaacagcauggcggcg

SEQ ID NO: 355778 - RNA, 20 nt, Bordetella pertussis
gccgaacagcauggcggcgc

SEQ ID NO: 355779 - RNA, 14 nt, Bordetella pertussis
gccgaacagccagg

SEQ ID NO: 355780 - RNA, 15 nt, Bordetella pertussis
gccgaacagccaggg

SEQ ID NO: 355781 - RNA, 21 nt, Bordetella pertussis
gccgaacagccagggcagggc

SEQ ID NO: 355782 - RNA, 12 nt, Bordetella pertussis
gccgaacucgcg

SEQ ID NO: 355783 - RNA, 15 nt, Bordetella pertussis
gccgaacucgcgcuc

SEQ ID NO: 355784 - RNA, 21 nt, Bordetella pertussis
gccgaacucgcgcucggccag

SEQ ID NO: 355785 - RNA, 13 nt, Bordetella pertussis
gccgaacugccgg

SEQ ID NO: 355786 - RNA, 14 nt, Bordetella pertussis
gccgaacugucgcg

SEQ ID NO: 355787 - RNA, 17 nt, Bordetella pertussis
gccgaacugucgcgcca

SEQ ID NO: 355788 - RNA, 18 nt, Bordetella pertussis
gccgaacugucgcgccac

SEQ ID NO: 355789 - RNA, 19 nt, Bordetella pertussis
gccgaacugucgcgccacg

SEQ ID NO: 355790 - RNA, 22 nt, Bordetella pertussis
gccgaacugggacaggcccagc

SEQ ID NO: 355791 - RNA, 22 nt, Bordetella pertussis
gccgaagaucuccucgcgcgcg

SEQ ID NO: 355792 - RNA, 20 nt, Bordetella pertussis
gccgaaggcggcgccgguga

SEQ ID NO: 355793 - RNA, 17 nt, Bordetella pertussis
gccgaagggcaggucgu

SEQ ID NO: 355794 - RNA, 12 nt, Bordetella pertussis
gccgaagucggc

SEQ ID NO: 355795 - RNA, 18 nt, Bordetella pertussis
gccgacagcuugcgcugg

SEQ ID NO: 355796 - RNA, 19 nt, Bordetella pertussis
gccgacagcuugcgcuggc

SEQ ID NO: 355797 - RNA, 22 nt, Bordetella pertussis
gccgacagcuugcgcuggcgcg

SEQ ID NO: 355798 - RNA, 23 nt, Bordetella pertussis
gccgacagcuugcgcuggcgcgc

SEQ ID NO: 355799 - RNA, 16 nt, Bordetella pertussis
gccgacaggcgcgcag

SEQ ID NO: 355800 - RNA, 18 nt, Bordetella pertussis
gccgacaugucgugcugg

SEQ ID NO: 355801 - RNA, 13 nt, Bordetella pertussis
gccgacaugccgu

SEQ ID NO: 355802 - RNA, 14 nt, Bordetella pertussis
gccgaccaggcccg

SEQ ID NO: 355803 - RNA, 15 nt, Bordetella pertussis
gccgaccaggcccgc

SEQ ID NO: 355804 - RNA, 21 nt, Bordetella pertussis
gccgaccaggcccgccacggc

SEQ ID NO: 355805 - RNA, 18 nt, Bordetella pertussis
gccgaccaggcugcgcgc

SEQ ID NO: 355806 - RNA, 22 nt, Bordetella pertussis
gccgaccaggcugcgcgccggc

SEQ ID NO: 355807 - RNA, 23 nt, Bordetella pertussis
gccgaccaggcugcgcgccggcg

SEQ ID NO: 355808 - RNA, 18 nt, Bordetella pertussis
gccgaccauguggcagau

SEQ ID NO: 355809 - RNA, 20 nt, Bordetella pertussis
gccgaccauguggcagaugg

SEQ ID NO: 355810 - RNA, 23 nt, Bordetella pertussis
gccgaccauguggcagauggcgg

SEQ ID NO: 355811 - RNA, 17 nt, Bordetella pertussis
gccgacccgagcccugg

SEQ ID NO: 355812 - RNA, 22 nt, Bordetella pertussis
gccgaccgcuuccgccaccgcg

SEQ ID NO: 355813 - RNA, 18 nt, Bordetella pertussis
gccgaccggccccaccug

SEQ ID NO: 355814 - RNA, 14 nt, Bordetella pertussis
gccgaccggcgcgc

SEQ ID NO: 355815 - RNA, 13 nt, Bordetella pertussis
gccgaccgggccg

SEQ ID NO: 355816 - RNA, 16 nt, Bordetella pertussis
gccgaccgggccgacc

SEQ ID NO: 355817 - RNA, 20 nt, Bordetella pertussis
gccgaccgggccgaccaggc

SEQ ID NO: 355818 - RNA, 17 nt, Bordetella pertussis
gccgacgaaagcggcaa

SEQ ID NO: 355819 - RNA, 16 nt, Bordetella pertussis
gccgacgaggcgcugu

SEQ ID NO: 355820 - RNA, 19 nt, Bordetella pertussis
gccgacgaggcgcuguucg

SEQ ID NO: 355821 - RNA, 13 nt, Bordetella pertussis
gccgacgccgcca

SEQ ID NO: 355822 - RNA, 14 nt, Bordetella pertussis
gccgacgccgccac

SEQ ID NO: 355823 - RNA, 12 nt, Bordetella pertussis
gccgacgcucca

SEQ ID NO: 355824 - RNA, 19 nt, Bordetella pertussis
gccgacggcauggccggca

SEQ ID NO: 355825 - RNA, 20 nt, Bordetella pertussis
gccgacggcauggccggcag

SEQ ID NO: 355826 - RNA, 16 nt, Bordetella pertussis
gccgacggcauggcgg

SEQ ID NO: 355827 - RNA, 22 nt, Bordetella pertussis
gccgacggcaagaucgccggcu

SEQ ID NO: 355828 - RNA, 15 nt, Bordetella pertussis
gccgacggccucggc

SEQ ID NO: 355829 - RNA, 22 nt, Bordetella pertussis
gccgacggcgcccugcagggca

SEQ ID NO: 355830 - RNA, 16 nt, Bordetella pertussis
gccgacggcgcuggcg

SEQ ID NO: 355831 - RNA, 18 nt, Bordetella pertussis
gccgacggcggcgcggcg

SEQ ID NO: 355832 - RNA, 21 nt, Bordetella pertussis
gccgacggcggcgcggcgcca

SEQ ID NO: 355833 - RNA, 18 nt, Bordetella pertussis
gccgagcagaucgccaac

SEQ ID NO: 355834 - RNA, 13 nt, Bordetella pertussis
gccgagcagaugc

SEQ ID NO: 355835 - RNA, 13 nt, Bordetella pertussis
gccgagcgccagu

SEQ ID NO: 355836 - RNA, 13 nt, Bordetella pertussis
gccgagcgcgcca

SEQ ID NO: 355837 - RNA, 14 nt, Bordetella pertussis
gccgagcgcgccag

SEQ ID NO: 355838 - RNA, 16 nt, Bordetella pertussis
gccgagcgcgccagca

SEQ ID NO: 355839 - RNA, 17 nt, Bordetella pertussis
gccgagcgggccagcgc

SEQ ID NO: 355840 - RNA, 19 nt, Bordetella pertussis
gccgagcggggccgcgccg

SEQ ID NO: 355841 - RNA, 18 nt, Bordetella pertussis
gccgagcgcugcgccaac

SEQ ID NO: 355842 - RNA, 16 nt, Bordetella pertussis
gccgaggaccugcugg

SEQ ID NO: 355843 - RNA, 20 nt, Bordetella pertussis
gccgaggaucuggccggcgc

SEQ ID NO: 355844 - RNA, 13 nt, Bordetella pertussis
gccgaggccaggu

SEQ ID NO: 355845 - RNA, 22 nt, Bordetella pertussis
gccgaggccagguugggugcgc

SEQ ID NO: 355846 - RNA, 14 nt, Bordetella pertussis
gccgaggcgccgcc

SEQ ID NO: 355847 - RNA, 15 nt, Bordetella pertussis
gccgaggcgccgccg

SEQ ID NO: 355848 - RNA, 22 nt, Bordetella pertussis
gccgaggcggugggcagggcgg

SEQ ID NO: 355849 - RNA, 13 nt, Bordetella pertussis
gccgaggcugcgc

SEQ ID NO: 355850 - RNA, 18 nt, Bordetella pertussis
gccgaggcugcgcgcgcc

SEQ ID NO: 355851 - RNA, 19 nt, Bordetella pertussis
gccgaggcugcgcgcgcca

SEQ ID NO: 355852 - RNA, 18 nt, Bordetella pertussis
gccgaggcuucgauggcg

SEQ ID NO: 355853 - RNA, 20 nt, Bordetella pertussis
gccgaggcuucgauggcggc

SEQ ID NO: 355854 - RNA, 22 nt, Bordetella pertussis
gccgaggcuucgauggcggcgg

SEQ ID NO: 355855 - RNA, 15 nt, Bordetella pertussis
gccgagggccgcgcg

SEQ ID NO: 355856 - RNA, 15 nt, Bordetella pertussis
gccgagguggaugcg

SEQ ID NO: 355857 - RNA, 20 nt, Bordetella pertussis
gccgagguggaugcguucgc

SEQ ID NO: 355858 - RNA, 17 nt, Bordetella pertussis
gccgaguagcggcgcaa

SEQ ID NO: 355859 - RNA, 18 nt, Bordetella pertussis
gccgaguccugguugccg

SEQ ID NO: 355860 - RNA, 22 nt, Bordetella pertussis
gccgaucaaccugaucguuccc

SEQ ID NO: 355861 - RNA, 13 nt, Bordetella pertussis
gccgagucggcga

SEQ ID NO: 355862 - RNA, 18 nt, Bordetella pertussis
gccgagucggcgauggcg

SEQ ID NO: 355863 - RNA, 19 nt, Bordetella pertussis
gccgagucggcgauggcgc

SEQ ID NO: 355864 - RNA, 23 nt, Bordetella pertussis
gccgagucggcgauggcgcgcgc

SEQ ID NO: 355865 - RNA, 16 nt, Bordetella pertussis
gccgaucaccacgggc

SEQ ID NO: 355866 - RNA, 13 nt, Bordetella pertussis
gccgauccgcgac

SEQ ID NO: 355867 - RNA, 14 nt, Bordetella pertussis
gccgauccgcgacg

SEQ ID NO: 355868 - RNA, 23 nt, Bordetella pertussis
gccgauccgguugacgaucucgc

SEQ ID NO: 355869 - RNA, 17 nt, Bordetella pertussis
gccgaucgagcaggccg

SEQ ID NO: 355870 - RNA, 23 nt, Bordetella pertussis
gccgaucgagcaggccgccgggg

SEQ ID NO: 355871 - RNA, 19 nt, Bordetella pertussis
gccgaucgcgcacagcaug

SEQ ID NO: 355872 - RNA, 23 nt, Bordetella pertussis
gccgaucgcgcacagcauggcca

SEQ ID NO: 355873 - RNA, 16 nt, Bordetella pertussis
gccgaucgcgccgucc

SEQ ID NO: 355874 - RNA, 18 nt, Bordetella pertussis
gccgaucgcggcuccagc

SEQ ID NO: 355875 - RNA, 16 nt, Bordetella pertussis
gccgaugaacgacagg

SEQ ID NO: 355876 - RNA, 19 nt, Bordetella pertussis
gccgaugacaucgccgcug

SEQ ID NO: 355877 - RNA, 16 nt, Bordetella pertussis
gccgaugaccggccag

SEQ ID NO: 355878 - RNA, 22 nt, Bordetella pertussis
gccgaugaccggccaggcgcgg

SEQ ID NO: 355879 - RNA, 23 nt, Bordetella pertussis
gccgaugaccggccaggcgcgga

SEQ ID NO: 355880 - RNA, 23 nt, Bordetella pertussis
gccgaugauggccauggccagcu

SEQ ID NO: 355881 - RNA, 23 nt, Bordetella pertussis
gccgaugauggugaacgccacca

SEQ ID NO: 355882 - RNA, 14 nt, Bordetella pertussis
gccgaugccgccau

SEQ ID NO: 355883 - RNA, 22 nt, Bordetella pertussis
gccgaugccgcgcaccugggcg

SEQ ID NO: 355884 - RNA, 14 nt, Bordetella pertussis
gccgaugcgccagg

SEQ ID NO: 355885 - RNA, 15 nt, Bordetella pertussis
gccgaugcgccaggc

SEQ ID NO: 355886 - RNA, 15 nt, Bordetella pertussis
gccgaugcgccgcgc

SEQ ID NO: 355887 - RNA, 17 nt, Bordetella pertussis
gccgaugcgccgcgcuu

SEQ ID NO: 355888 - RNA, 22 nt, Bordetella pertussis
gccgaugcggcgcaugcugcgc

SEQ ID NO: 355889 - RNA, 22 nt, Bordetella pertussis
gccgaugcggguacuggccgac

SEQ ID NO: 355890 - RNA, 19 nt, Bordetella pertussis
gccgaugcgguaggcccag

SEQ ID NO: 355891 - RNA, 21 nt, Bordetella pertussis
gccgaugcgguaggcccagca

SEQ ID NO: 355892 - RNA, 12 nt, Bordetella pertussis
gccgaugcuggu

SEQ ID NO: 355893 - RNA, 19 nt, Bordetella pertussis
gccgaugcuuagcgcagca

SEQ ID NO: 355894 - RNA, 22 nt, Bordetella pertussis
gccgaugcuuagcgcagcagcg

SEQ ID NO: 355895 - RNA, 16 nt, Bordetella pertussis
gccgauggccucgcug

SEQ ID NO: 355896 - RNA, 20 nt, Bordetella pertussis
gccgauggccucgcugccag

SEQ ID NO: 355897 - RNA, 15 nt, Bordetella pertussis
gccgauggcgccacc

SEQ ID NO: 355898 - RNA, 15 nt, Bordetella pertussis
gccgauggcgccgcu

SEQ ID NO: 355899 - RNA, 17 nt, Bordetella pertussis
gccgauggcgccgcugu

SEQ ID NO: 355900 - RNA, 19 nt, Bordetella pertussis
gccgauggcgccgcugucg

SEQ ID NO: 355901 - RNA, 17 nt, Bordetella pertussis
gccgauggcgcgcggcu

SEQ ID NO: 355902 - RNA, 19 nt, Bordetella pertussis
gccgauggcgcggccgcca

SEQ ID NO: 355903 - RNA, 13 nt, Bordetella pertussis
gccgauggcggug

SEQ ID NO: 355904 - RNA, 14 nt, Bordetella pertussis
gccgauggcgucca

SEQ ID NO: 355905 - RNA, 16 nt, Bordetella pertussis
gccgauggcguccagc

SEQ ID NO: 355906 - RNA, 19 nt, Bordetella pertussis
gccgauggcguccagcagc

SEQ ID NO: 355907 - RNA, 15 nt, Bordetella pertussis
gccgauggucagcgu

SEQ ID NO: 355908 - RNA, 20 nt, Bordetella pertussis
gccgauggucagcgugucgc

SEQ ID NO: 355909 - RNA, 22 nt, Bordetella pertussis
gccgauguccacgaaggcgccg

SEQ ID NO: 355910 - RNA, 23 nt, Bordetella pertussis
gccgauguccacgaaggcgccga

SEQ ID NO: 355911 - RNA, 16 nt, Bordetella pertussis
gccgaugucgaacagc

SEQ ID NO: 355912 - RNA, 19 nt, Bordetella pertussis
gccgaugucgaacagcugc

SEQ ID NO: 355913 - RNA, 22 nt, Bordetella pertussis
gccgaugucgaacagcugcagc

SEQ ID NO: 355914 - RNA, 22 nt, Bordetella pertussis
gccgauguagcccauggccagg

SEQ ID NO: 355915 - RNA, 17 nt, Bordetella pertussis
gccgaugucgccgccug

SEQ ID NO: 355916 - RNA, 23 nt, Bordetella pertussis
gccgaugugcggcgugagcacga

SEQ ID NO: 355917 - RNA, 19 nt, Bordetella pertussis
gccgauguuguuggccgcc

SEQ ID NO: 355918 - RNA, 23 nt, Bordetella pertussis
gccgauguuguuggccgccagcc

SEQ ID NO: 355919 - RNA, 13 nt, Bordetella pertussis
gccgauuccagcg

SEQ ID NO: 355920 - RNA, 18 nt, Bordetella pertussis
gccgauuccagcgccgcc

SEQ ID NO: 355921 - RNA, 19 nt, Bordetella pertussis
gccgcaacccacccccagc

SEQ ID NO: 355922 - RNA, 20 nt, Bordetella pertussis
gccgcaacccacccccagca

SEQ ID NO: 355923 - RNA, 15 nt, Bordetella pertussis
gccgcaacgccgccg

SEQ ID NO: 355924 - RNA, 17 nt, Bordetella pertussis
gccgcaacgccgccggc

SEQ ID NO: 355925 - RNA, 18 nt, Bordetella pertussis
gccgcaacgccgccggca

SEQ ID NO: 355926 - RNA, 20 nt, Bordetella pertussis
gccgcaacgccgccggcagg

SEQ ID NO: 355927 - RNA, 13 nt, Bordetella pertussis
aagcaagccccag

SEQ ID NO: 355928 - RNA, 21 nt, Bordetella pertussis
aagcaccagguugcauccggc

SEQ ID NO: 355929 - RNA, 16 nt, Bordetella pertussis
aagcacugcaggccau

SEQ ID NO: 355930 - RNA, 14 nt, Bordetella pertussis
gccgcaagacggcg

SEQ ID NO: 355931 - RNA, 14 nt, Bordetella pertussis
gccgcaagcaagcc

SEQ ID NO: 355932 - RNA, 16 nt, Bordetella pertussis
gccgcaagcaagcccc

SEQ ID NO: 355933 - RNA, 22 nt, Bordetella pertussis
gccgcaagcguacguaccaggc

SEQ ID NO: 355934 - RNA, 23 nt, Bordetella pertussis
gccgcaagcguacguaccaggcc

SEQ ID NO: 355935 - RNA, 14 nt, Bordetella pertussis
gccgcaacgccggg

SEQ ID NO: 355936 - RNA, 16 nt, Bordetella pertussis
gccgcaacgccgggcc

SEQ ID NO: 355937 - RNA, 13 nt, Bordetella pertussis
gccgcaagcuggc

SEQ ID NO: 355938 - RNA, 14 nt, Bordetella pertussis
gccgcaagcuggcc

SEQ ID NO: 355939 - RNA, 15 nt, Bordetella pertussis
gccgcaagcuggccg

SEQ ID NO: 355940 - RNA, 15 nt, Bordetella pertussis
gccgcaagcuggcgg

SEQ ID NO: 355941 - RNA, 16 nt, Bordetella pertussis
gccgcaagcuggcggc

SEQ ID NO: 355942 - RNA, 21 nt, Bordetella pertussis
gccgcaagcuggcggcgcgcg

SEQ ID NO: 355943 - RNA, 15 nt, Bordetella pertussis
gccgcacgaucgcgc

SEQ ID NO: 355944 - RNA, 16 nt, Bordetella pertussis
gccgcacgcccgccug

SEQ ID NO: 355945 - RNA, 12 nt, Bordetella pertussis
gccgcacgcgcg

SEQ ID NO: 355946 - RNA, 18 nt, Bordetella pertussis
gccgcacgcgcggcagcg

SEQ ID NO: 355947 - RNA, 16 nt, Bordetella pertussis
gccgcacgcggccgcg

SEQ ID NO: 355948 - RNA, 22 nt, Bordetella pertussis
gccgcacgcucuacacggccgc

SEQ ID NO: 355949 - RNA, 24 nt, Bordetella pertussis
gccgcacgcucuacacggccgcca

SEQ ID NO: 355950 - RNA, 18 nt, Bordetella pertussis
gccgcacgccggucgcca

SEQ ID NO: 355951 - RNA, 20 nt, Bordetella pertussis
gccgcacgccggucgccagc

SEQ ID NO: 355952 - RNA, 14 nt, Bordetella pertussis
gccgcacgggcgcc

SEQ ID NO: 355953 - RNA, 16 nt, Bordetella pertussis
gccgcacgguggcgcc

SEQ ID NO: 355954 - RNA, 13 nt, Bordetella pertussis
gccgcacgucggu

SEQ ID NO: 355955 - RNA, 14 nt, Bordetella pertussis
gccgcacuggguga

SEQ ID NO: 355956 - RNA, 17 nt, Bordetella pertussis
gccgcacugggugacgc

SEQ ID NO: 355957 - RNA, 21 nt, Bordetella pertussis
gccgcacugggugacgcugga

SEQ ID NO: 355958 - RNA, 22 nt, Bordetella pertussis
gccgcacugggugacgcuggag

SEQ ID NO: 355959 - RNA, 23 nt, Bordetella pertussis
gccgcacugggugacgcuggagc

SEQ ID NO: 355960 - RNA, 24 nt, Bordetella pertussis
gccgcacugggugacgcuggagcg

SEQ ID NO: 355961 - RNA, 22 nt, Bordetella pertussis
gccgcacuccguaaagaugcgc

SEQ ID NO: 355962 - RNA, 12 nt, Bordetella pertussis
gccgcagcggca

SEQ ID NO: 355963 - RNA, 13 nt, Bordetella pertussis
gccgcagcggcag

SEQ ID NO: 355964 - RNA, 12 nt, Bordetella pertussis
gccgcagcggcc

SEQ ID NO: 355965 - RNA, 13 nt, Bordetella pertussis
gccgcagcggcca

SEQ ID NO: 355966 - RNA, 14 nt, Bordetella pertussis
gccgcagcggccau

SEQ ID NO: 355967 - RNA, 14 nt, Bordetella pertussis
gccgcagcggggac

SEQ ID NO: 355968 - RNA, 19 nt, Bordetella pertussis
gccgcagcuggacuauggc

SEQ ID NO: 355969 - RNA, 15 nt, Bordetella pertussis
gccgcaggccagccc

SEQ ID NO: 355970 - RNA, 22 nt, Bordetella pertussis
gccgcaggccagcccgcgcgcg

SEQ ID NO: 355971 - RNA, 13 nt, Bordetella pertussis
gccgcaggcuaug

SEQ ID NO: 355972 - RNA, 15 nt, Bordetella pertussis
gccgcaggcuuucgc

SEQ ID NO: 355973 - RNA, 14 nt, Bordetella pertussis
gccgcagggcgugc

SEQ ID NO: 355974 - RNA, 15 nt, Bordetella pertussis
gccgcagguccaggc

SEQ ID NO: 355975 - RNA, 17 nt, Bordetella pertussis
gccgcagguccaggccu

SEQ ID NO: 355976 - RNA, 20 nt, Bordetella pertussis
gccgcaugaaaaaagcccca

SEQ ID NO: 355977 - RNA, 13 nt, Bordetella pertussis
gccgccaccagcg

SEQ ID NO: 355978 - RNA, 18 nt, Bordetella pertussis
gccgccaccagcgcgucg

SEQ ID NO: 355979 - RNA, 14 nt, Bordetella pertussis
gccgccaccagcgg

SEQ ID NO: 355980 - RNA, 15 nt, Bordetella pertussis
gccgccaccagcggc

SEQ ID NO: 355981 - RNA, 16 nt, Bordetella pertussis
gccgccaccagcggcg

SEQ ID NO: 355982 - RNA, 16 nt, Bordetella pertussis
gccgccaccagggcgc

SEQ ID NO: 355983 - RNA, 19 nt, Bordetella pertussis
gccgccaccagggcgcccg

SEQ ID NO: 355984 - RNA, 22 nt, Bordetella pertussis
gccgccaccagggcgcccgccg

SEQ ID NO: 355985 - RNA, 19 nt, Bordetella pertussis
gccgccacccaggcggcag

SEQ ID NO: 355986 - RNA, 21 nt, Bordetella pertussis
gccgccacccaggcggcaggc

SEQ ID NO: 355987 - RNA, 23 nt, Bordetella pertussis
gccgccacccaggcggcaggcgc

SEQ ID NO: 355988 - RNA, 14 nt, Bordetella pertussis
gccgccaccucggc

SEQ ID NO: 355989 - RNA, 18 nt, Bordetella pertussis
gccgccaccucggcgucg

SEQ ID NO: 355990 - RNA, 19 nt, Bordetella pertussis
gccgccaccucggcgucgc

SEQ ID NO: 355991 - RNA, 16 nt, Bordetella pertussis
gccgccaccugggccg

SEQ ID NO: 355992 - RNA, 17 nt, Bordetella pertussis
gccgccaccugggccgc

SEQ ID NO: 355993 - RNA, 22 nt, Bordetella pertussis
gccgccaccugggccgccugcu

SEQ ID NO: 355994 - RNA, 14 nt, Bordetella pertussis
gccgccacgaaacc

SEQ ID NO: 355995 - RNA, 22 nt, Bordetella pertussis
gccgccacgaaacccacggcga

SEQ ID NO: 355996 - RNA, 16 nt, Bordetella pertussis
gccgccacgcccuggc

SEQ ID NO: 355997 - RNA, 19 nt, Bordetella pertussis
gccgccacgcccuggcagc

SEQ ID NO: 355998 - RNA, 16 nt, Bordetella pertussis
gccgccacgcgcacgg

SEQ ID NO: 355999 - RNA, 15 nt, Bordetella pertussis
gccgccacgcuggcc

SEQ ID NO: 356000 - RNA, 16 nt, Bordetella pertussis
gccgccacgcuggccg

SEQ ID NO: 356001 - RNA, 22 nt, Bordetella pertussis
gccgccacuugcggcaggugcg

SEQ ID NO: 356002 - RNA, 15 nt, Bordetella pertussis
gccgccgaggcggug

SEQ ID NO: 356003 - RNA, 15 nt, Bordetella pertussis
gccgccgauggcgcc

SEQ ID NO: 356004 - RNA, 18 nt, Bordetella pertussis
gccgccgauggcgcgcgg

SEQ ID NO: 356005 - RNA, 23 nt, Bordetella pertussis
gccgccgauggcgcgcggcuggg

SEQ ID NO: 356006 - RNA, 22 nt, Bordetella pertussis
gccgccgaugugcggcgugagc

SEQ ID NO: 356007 - RNA, 14 nt, Bordetella pertussis
gccgccgcccgcac

SEQ ID NO: 356008 - RNA, 13 nt, Bordetella pertussis
gccgccgcccggc

SEQ ID NO: 356009 - RNA, 13 nt, Bordetella pertussis
gccgccgcccugg

SEQ ID NO: 356010 - RNA, 12 nt, Bordetella pertussis
gccgccgccgcg

SEQ ID NO: 356011 - RNA, 13 nt, Bordetella pertussis
gccgccgccgcgc

SEQ ID NO: 356012 - RNA, 15 nt, Bordetella pertussis
gccgccgccgcgcgc

SEQ ID NO: 356013 - RNA, 14 nt, Bordetella pertussis
gccgccgccgcggc

SEQ ID NO: 356014 - RNA, 13 nt, Bordetella pertussis
gccgccgccggca

SEQ ID NO: 356015 - RNA, 13 nt, Bordetella pertussis
gccgccgccggcg

SEQ ID NO: 356016 - RNA, 12 nt, Bordetella pertussis
gccgccgccggc

SEQ ID NO: 356017 - RNA, 14 nt, Bordetella pertussis
gccgccgccggcgc

SEQ ID NO: 356018 - RNA, 13 nt, Bordetella pertussis
gccgccgccgggc

SEQ ID NO: 356019 - RNA, 16 nt, Bordetella pertussis
gccgccgccgggcugg

SEQ ID NO: 356020 - RNA, 15 nt, Bordetella pertussis
gccgccgccggcgcg

SEQ ID NO: 356021 - RNA, 18 nt, Bordetella pertussis
gccgccgcggccuggccg

SEQ ID NO: 356022 - RNA, 22 nt, Bordetella pertussis
gccgccgcgggcggccacgcgc

SEQ ID NO: 356023 - RNA, 14 nt, Bordetella pertussis
gccgccgcgggcgc

SEQ ID NO: 356024 - RNA, 20 nt, Bordetella pertussis
gccgccgcguggcggcgcag

SEQ ID NO: 356025 - RNA, 23 nt, Bordetella pertussis
gccgccgcguggcggcgcagcgc

SEQ ID NO: 356026 - RNA, 13 nt, Bordetella pertussis
gccgccgcugccg

SEQ ID NO: 356027 - RNA, 16 nt, Bordetella pertussis
gccgccgcugccggcc

SEQ ID NO: 356028 - RNA, 20 nt, Bordetella pertussis
gccgccgcugucggucagca

SEQ ID NO: 356029 - RNA, 14 nt, Bordetella pertussis
gccgccggacgcag

SEQ ID NO: 356030 - RNA, 13 nt, Bordetella pertussis
gccgccggacggc

SEQ ID NO: 356031 - RNA, 16 nt, Bordetella pertussis
gccgccggacggcgcc

SEQ ID NO: 356032 - RNA, 17 nt, Bordetella pertussis
gccgccggacggcgccu

SEQ ID NO: 356033 - RNA, 14 nt, Bordetella pertussis
gccgccggcagggc

SEQ ID NO: 356034 - RNA, 16 nt, Bordetella pertussis
gccgccggcagggcca

SEQ ID NO: 356035 - RNA, 17 nt, Bordetella pertussis
gccgccggcagggccag

SEQ ID NO: 356036 - RNA, 21 nt, Bordetella pertussis
gccgccggcagggccagcgcc

SEQ ID NO: 356037 - RNA, 11 nt, Bordetella pertussis
gccgccggcca

SEQ ID NO: 356038 - RNA, 14 nt, Bordetella pertussis
gccgccggccacca

SEQ ID NO: 356039 - RNA, 16 nt, Bordetella pertussis
gccgccggcacguacc

SEQ ID NO: 356040 - RNA, 22 nt, Bordetella pertussis
gccgccggcacguaccaggcgc

SEQ ID NO: 356041 - RNA, 12 nt, Bordetella pertussis
gccgccggccag

SEQ ID NO: 356042 - RNA, 13 nt, Bordetella pertussis
gccgccggccagc

SEQ ID NO: 356043 - RNA, 14 nt, Bordetella pertussis
gccgccggccagcc

SEQ ID NO: 356044 - RNA, 15 nt, Bordetella pertussis
gccgccggccagccu

SEQ ID NO: 356045 - RNA, 16 nt, Bordetella pertussis
gccgccggccagcgcc

SEQ ID NO: 356046 - RNA, 13 nt, Bordetella pertussis
gccgccggcccag

SEQ ID NO: 356047 - RNA, 16 nt, Bordetella pertussis
gccgccggcccgccac

SEQ ID NO: 356048 - RNA, 13 nt, Bordetella pertussis
gccgccggcccgg

SEQ ID NO: 356049 - RNA, 14 nt, Bordetella pertussis
gccgccggcccgga

SEQ ID NO: 356050 - RNA, 16 nt, Bordetella pertussis
gccgccggccaucagg

SEQ ID NO: 356051 - RNA, 13 nt, Bordetella pertussis
gccgccggccugc

SEQ ID NO: 356052 - RNA, 20 nt, Bordetella pertussis
gccgccggccugcugcagca

SEQ ID NO: 356053 - RNA, 13 nt, Bordetella pertussis
gccgccggcgaca

SEQ ID NO: 356054 - RNA, 13 nt, Bordetella pertussis
gccgccggcgcac

SEQ ID NO: 356055 - RNA, 15 nt, Bordetella pertussis
gccgccggcgcaccc

SEQ ID NO: 356056 - RNA, 15 nt, Bordetella pertussis
gccgccggcgaugau

SEQ ID NO: 356057 - RNA, 12 nt, Bordetella pertussis
gccgccggcgcg

SEQ ID NO: 356058 - RNA, 14 nt, Bordetella pertussis
gccgccggcgcgcg

SEQ ID NO: 356059 - RNA, 15 nt, Bordetella pertussis
gccgccggcgcgcgg

SEQ ID NO: 356060 - RNA, 13 nt, Bordetella pertussis
gccgccggcgcgg

SEQ ID NO: 356061 - RNA, 15 nt, Bordetella pertussis
gccgccggcgcggcu

SEQ ID NO: 356062 - RNA, 14 nt, Bordetella pertussis
gccgccggcgcggu

SEQ ID NO: 356063 - RNA, 17 nt, Bordetella pertussis
gccgccggcgcgguggc

SEQ ID NO: 356064 - RNA, 17 nt, Bordetella pertussis
gccgccggcggccugga

SEQ ID NO: 356065 - RNA, 13 nt, Bordetella pertussis
gccgccggcggcg

SEQ ID NO: 356066 - RNA, 15 nt, Bordetella pertussis
gccgccggcggcgca

SEQ ID NO: 356067 - RNA, 16 nt, Bordetella pertussis
gccgccggcggcgcac

SEQ ID NO: 356068 - RNA, 15 nt, Bordetella pertussis
gccgccggcggcgcc

SEQ ID NO: 356069 - RNA, 23 nt, Bordetella pertussis
gccgccggcggcgucggcgcccg

SEQ ID NO: 356070 - RNA, 13 nt, Bordetella pertussis
gccgccggcgggc

SEQ ID NO: 356071 - RNA, 14 nt, Bordetella pertussis
gccgccgggccugc

SEQ ID NO: 356072 - RNA, 18 nt, Bordetella pertussis
gccgccgggccugcccgc

SEQ ID NO: 356073 - RNA, 15 nt, Bordetella pertussis
gccgccgggcgcgcg

SEQ ID NO: 356074 - RNA, 21 nt, Bordetella pertussis
gccgccgggcgcgcgccggcg

SEQ ID NO: 356075 - RNA, 13 nt, Bordetella pertussis
gccgccgggucgc

SEQ ID NO: 356076 - RNA, 18 nt, Bordetella pertussis
gccgccgggucgcugugc

SEQ ID NO: 356077 - RNA, 20 nt, Bordetella pertussis
gccgccgggucgcugugcgc

SEQ ID NO: 356078 - RNA, 16 nt, Bordetella pertussis
gccgccggucaccgcc

SEQ ID NO: 356079 - RNA, 23 nt, Bordetella pertussis
gccgccggucacugccgaaacgc

SEQ ID NO: 356080 - RNA, 21 nt, Bordetella pertussis
gccgccggugauaugcgccag

SEQ ID NO: 356081 - RNA, 23 nt, Bordetella pertussis
gccgccggugauaugcgccaggc

SEQ ID NO: 356082 - RNA, 14 nt, Bordetella pertussis
gccgccggucgaga

SEQ ID NO: 356083 - RNA, 17 nt, Bordetella pertussis
gccgccggugcaccagg

SEQ ID NO: 356084 - RNA, 19 nt, Bordetella pertussis
gccgccggugcaccaggcc

SEQ ID NO: 356085 - RNA, 20 nt, Bordetella pertussis
gccgccggugcaccaggcca

SEQ ID NO: 356086 - RNA, 14 nt, Bordetella pertussis
gccgccguagccgc

SEQ ID NO: 356087 - RNA, 19 nt, Bordetella pertussis
gccgccguagccgcugcgc

SEQ ID NO: 356088 - RNA, 20 nt, Bordetella pertussis
gccgccguaggacagcccca

SEQ ID NO: 356089 - RNA, 23 nt, Bordetella pertussis
gccgccguaggacagccccagca

SEQ ID NO: 356090 - RNA, 15 nt, Bordetella pertussis
gccgccguaaucggc

SEQ ID NO: 356091 - RNA, 19 nt, Bordetella pertussis
gccgccguaaucggcgucg

SEQ ID NO: 356092 - RNA, 14 nt, Bordetella pertussis
gccgccgucgaugu

SEQ ID NO: 356093 - RNA, 17 nt, Bordetella pertussis
gccgccgugacgcugau

SEQ ID NO: 356094 - RNA, 22 nt, Bordetella pertussis
gccgccgugacuucggccgcca

SEQ ID NO: 356095 - RNA, 16 nt, Bordetella pertussis
gccgccgugaugccgc

SEQ ID NO: 356096 - RNA, 17 nt, Bordetella pertussis
gccgccgugaugccgcc

SEQ ID NO: 356097 - RNA, 20 nt, Bordetella pertussis
gccgccgugaugccgcccgc

SEQ ID NO: 356098 - RNA, 19 nt, Bordetella pertussis
gccgccgugcgagcacggc

SEQ ID NO: 356099 - RNA, 20 nt, Bordetella pertussis
gccgccuauguaggcgccgc

SEQ ID NO: 356100 - RNA, 21 nt, Bordetella pertussis
gccgccuauguaggcgccgcg

SEQ ID NO: 356101 - RNA, 15 nt, Bordetella pertussis
gccgccucaccgcgc

SEQ ID NO: 356102 - RNA, 20 nt, Bordetella pertussis
gccgccucaccgcgccgggc

SEQ ID NO: 356103 - RNA, 15 nt, Bordetella pertussis
gccgccucagcccgc

SEQ ID NO: 356104 - RNA, 16 nt, Bordetella pertussis
gccgccucaggccggc

SEQ ID NO: 356105 - RNA, 20 nt, Bordetella pertussis
gccgccucaggccggcgccu

SEQ ID NO: 356106 - RNA, 13 nt, Bordetella pertussis
gccgccuccaggc

SEQ ID NO: 356107 - RNA, 22 nt, Bordetella pertussis
gccgccucgaccggcgaagagc

SEQ ID NO: 356108 - RNA, 19 nt, Bordetella pertussis
gccgccucgauugaccagc

SEQ ID NO: 356109 - RNA, 20 nt, Bordetella pertussis
gccgccucgauugaccagca

SEQ ID NO: 356110 - RNA, 22 nt, Bordetella pertussis
gccgccucgauugaccagcacc

SEQ ID NO: 356111 - RNA, 19 nt, Bordetella pertussis
gccgccucgcgcuccagca

SEQ ID NO: 356112 - RNA, 14 nt, Bordetella pertussis
gccgccucggcggc

SEQ ID NO: 356113 - RNA, 16 nt, Bordetella pertussis
gccgccucggcggcca

SEQ ID NO: 356114 - RNA, 17 nt, Bordetella pertussis
gccgccucggcggccag

SEQ ID NO: 356115 - RNA, 18 nt, Bordetella pertussis
gccgccucgggcacggcc

SEQ ID NO: 356116 - RNA, 20 nt, Bordetella pertussis
gccgccucgggcacggccag

SEQ ID NO: 356117 - RNA, 18 nt, Bordetella pertussis
gccgccugagcacaugcc

SEQ ID NO: 356118 - RNA, 13 nt, Bordetella pertussis
gccgccugcgccg

SEQ ID NO: 356119 - RNA, 17 nt, Bordetella pertussis
gccgccugcgccgaggc

SEQ ID NO: 356120 - RNA, 18 nt, Bordetella pertussis
gccgccugcgccgucugc

SEQ ID NO: 356121 - RNA, 13 nt, Bordetella pertussis
gccgccugcuggg

SEQ ID NO: 356122 - RNA, 19 nt, Bordetella pertussis
gccgccugcugggccgcgc

SEQ ID NO: 356123 - RNA, 21 nt, Bordetella pertussis
gccgccuggcccaugaacagg

SEQ ID NO: 356124 - RNA, 17 nt, Bordetella pertussis
gccgccuggcgcggcgc

SEQ ID NO: 356125 - RNA, 19 nt, Bordetella pertussis
gccgccuggcuuucgccgc

SEQ ID NO: 356126 - RNA, 20 nt, Bordetella pertussis
gccgccuggcuuucgccgcg

SEQ ID NO: 356127 - RNA, 21 nt, Bordetella pertussis
gccgccugguaguaaucgcgc

SEQ ID NO: 356128 - RNA, 15 nt, Bordetella pertussis
gccgccuucccaggc

SEQ ID NO: 356129 - RNA, 16 nt, Bordetella pertussis
gccgccuucccaggcg

SEQ ID NO: 356130 - RNA, 18 nt, Bordetella pertussis
gccgccuucccaggcgag

SEQ ID NO: 356131 - RNA, 17 nt, Bordetella pertussis
gccgccuucgggcgguu

SEQ ID NO: 356132 - RNA, 17 nt, Bordetella pertussis
gccgccuuuucgcagcg

SEQ ID NO: 356133 - RNA, 20 nt, Bordetella pertussis
gccgccuuuucgcagcggau

SEQ ID NO: 356134 - RNA, 20 nt, Bordetella pertussis
gccgcgaacagauccacgcc

SEQ ID NO: 356135 - RNA, 15 nt, Bordetella pertussis
gccgcgaacgcgccg

SEQ ID NO: 356136 - RNA, 20 nt, Bordetella pertussis
gccgcgaacgcgccggccca

SEQ ID NO: 356137 - RNA, 21 nt, Bordetella pertussis
gccgcgaacgcgccggcccag

SEQ ID NO: 356138 - RNA, 16 nt, Bordetella pertussis
gccgcgaccaccagca

SEQ ID NO: 356139 - RNA, 15 nt, Bordetella pertussis
gccgcgaccacgguc

SEQ ID NO: 356140 - RNA, 22 nt, Bordetella pertussis
gccgcgaccacggucuggcgcg

SEQ ID NO: 356141 - RNA, 24 nt, Bordetella pertussis
gccgcgaccacggucuggcgcgac

SEQ ID NO: 356142 - RNA, 15 nt, Bordetella pertussis
gccgcgaccgggccg

SEQ ID NO: 356143 - RNA, 16 nt, Bordetella pertussis
gccgcgagcaugcgca

SEQ ID NO: 356144 - RNA, 17 nt, Bordetella pertussis
gccgcgagcaugcgcag

SEQ ID NO: 356145 - RNA, 19 nt, Bordetella pertussis
gccgcgagcaugcgcagcg

SEQ ID NO: 356146 - RNA, 16 nt, Bordetella pertussis
gccgcgagcgccgaac

SEQ ID NO: 356147 - RNA, 12 nt, Bordetella pertussis
gccgcgaggcgc

SEQ ID NO: 356148 - RNA, 16 nt, Bordetella pertussis
gccgcgaggcgcaggc

SEQ ID NO: 356149 - RNA, 20 nt, Bordetella pertussis
gccgcgauauugaaggccga

SEQ ID NO: 356150 - RNA, 21 nt, Bordetella pertussis
gccgcgauauugaaggccgag

SEQ ID NO: 356151 - RNA, 13 nt, Bordetella pertussis
gccgcgaucagcg

SEQ ID NO: 356152 - RNA, 18 nt, Bordetella pertussis
gccgcgaucagcgcggcc

SEQ ID NO: 356153 - RNA, 23 nt, Bordetella pertussis
gccgcgaucagcgcggccgcuug

SEQ ID NO: 356154 - RNA, 18 nt, Bordetella pertussis
gccgcgauauccuugcgc

SEQ ID NO: 356155 - RNA, 22 nt, Bordetella pertussis
gccgcgauauccuugcgcucgc

SEQ ID NO: 356156 - RNA, 13 nt, Bordetella pertussis
gccgcgauggcgc

SEQ ID NO: 356157 - RNA, 18 nt, Bordetella pertussis
gccgcgauggcgccggcc

SEQ ID NO: 356158 - RNA, 19 nt, Bordetella pertussis
gccgcgauggcgccggcca

SEQ ID NO: 356159 - RNA, 20 nt, Bordetella pertussis
gccgcgauggcgccggccag

SEQ ID NO: 356160 - RNA, 23 nt, Bordetella pertussis
gccgcgauggcgccggccagcgc

SEQ ID NO: 356161 - RNA, 14 nt, Bordetella pertussis
gccgcgaugucgcg

SEQ ID NO: 356162 - RNA, 16 nt, Bordetella pertussis
gccgcgaugucgcgcg

SEQ ID NO: 356163 - RNA, 19 nt, Bordetella pertussis
gccgcgaugucgcgcgcgc

SEQ ID NO: 356164 - RNA, 18 nt, Bordetella pertussis
gccgcgauugcagguggc

SEQ ID NO: 356165 - RNA, 23 nt, Bordetella pertussis
gccgcgauugcagguggccagcc

SEQ ID NO: 356166 - RNA, 19 nt, Bordetella pertussis
gccgcgauuucguccgggg

SEQ ID NO: 356167 - RNA, 13 nt, Bordetella pertussis
gccgcgcaaggcg

SEQ ID NO: 356168 - RNA, 16 nt, Bordetella pertussis
gccgcgcaaggcggcc

SEQ ID NO: 356169 - RNA, 18 nt, Bordetella pertussis
gccgcgcaaggcggcccg

SEQ ID NO: 356170 - RNA, 18 nt, Bordetella pertussis
gccgcgcacacauggcgc

SEQ ID NO: 356171 - RNA, 22 nt, Bordetella pertussis
gccgcgcacacauggcgcaucu

SEQ ID NO: 356172 - RNA, 16 nt, Bordetella pertussis
gccgcgcacagcccga

SEQ ID NO: 356173 - RNA, 17 nt, Bordetella pertussis
gccgcgcacagcccgau

SEQ ID NO: 356174 - RNA, 19 nt, Bordetella pertussis
gccgcgcacccaggcccau

SEQ ID NO: 356175 - RNA, 21 nt, Bordetella pertussis
gccgcgcaccugcugcggcac

SEQ ID NO: 356176 - RNA, 22 nt, Bordetella pertussis
gccgcgcaccugcugcggcacg

SEQ ID NO: 356177 - RNA, 15 nt, Bordetella pertussis
gccgcgcaccugggc

SEQ ID NO: 356178 - RNA, 17 nt, Bordetella pertussis
gccgcgcaccugggcgu

SEQ ID NO: 356179 - RNA, 17 nt, Bordetella pertussis
gccgcgcacgauggggc

SEQ ID NO: 356180 - RNA, 15 nt, Bordetella pertussis
gccgcgcacgggcgc

SEQ ID NO: 356181 - RNA, 16 nt, Bordetella pertussis
gccgcgcacgggcgcc

SEQ ID NO: 356182 - RNA, 19 nt, Bordetella pertussis
gccgcgcagcacgcccgcg

SEQ ID NO: 356183 - RNA, 15 nt, Bordetella pertussis
gccgcgcagcagcaa

SEQ ID NO: 356184 - RNA, 18 nt, Bordetella pertussis
gccgcgcagccgacaggc

SEQ ID NO: 356185 - RNA, 11 nt, Bordetella pertussis
gccgcgcagcg

SEQ ID NO: 356186 - RNA, 13 nt, Bordetella pertussis
gccgcgcagcguc

SEQ ID NO: 356187 - RNA, 23 nt, Bordetella pertussis
gccgcgcagcgucugcgcaucga

SEQ ID NO: 356188 - RNA, 16 nt, Bordetella pertussis
gccgcgcaggaugacg

SEQ ID NO: 356189 - RNA, 22 nt, Bordetella pertussis
gccgcgcaggauuucaucgccc

SEQ ID NO: 356190 - RNA, 13 nt, Bordetella pertussis
gccgcgcaggccc

SEQ ID NO: 356191 - RNA, 14 nt, Bordetella pertussis
gccgcgcaggcccu

SEQ ID NO: 356192 - RNA, 14 nt, Bordetella pertussis
gccgcgcaggucgg

SEQ ID NO: 356193 - RNA, 19 nt, Bordetella pertussis
gccgcgcaggucggcgaug

SEQ ID NO: 356194 - RNA, 23 nt, Bordetella pertussis
gccgcgcaggucggcgaugcgcg

SEQ ID NO: 356195 - RNA, 18 nt, Bordetella pertussis
gccgcgcauuugccgcgg

SEQ ID NO: 356196 - RNA, 17 nt, Bordetella pertussis
gccgcgccaacccggcc

SEQ ID NO: 356197 - RNA, 18 nt, Bordetella pertussis
gccgcgccaagggcgugc

SEQ ID NO: 356198 - RNA, 13 nt, Bordetella pertussis
gccgcgccacagg

SEQ ID NO: 356199 - RNA, 13 nt, Bordetella pertussis
gccgcgccagcgc

SEQ ID NO: 356200 - RNA, 14 nt, Bordetella pertussis
gccgcgccagcugc

SEQ ID NO: 356201 - RNA, 13 nt, Bordetella pertussis
gccgcgccaggca

SEQ ID NO: 356202 - RNA, 14 nt, Bordetella pertussis
gccgcgccagggcg

SEQ ID NO: 356203 - RNA, 13 nt, Bordetella pertussis
gccgcgccaggua

SEQ ID NO: 356204 - RNA, 22 nt, Bordetella pertussis
gccgcgccagguaggccggcgc

SEQ ID NO: 356205 - RNA, 14 nt, Bordetella pertussis
gccgcgcccacagg

SEQ ID NO: 356206 - RNA, 21 nt, Bordetella pertussis
gccgcgccaucacggugucga

SEQ ID NO: 356207 - RNA, 15 nt, Bordetella pertussis
gccgcgcccagcagc

SEQ ID NO: 356208 - RNA, 19 nt, Bordetella pertussis
gccgcgcccagcagcgcca

SEQ ID NO: 356209 - RNA, 22 nt, Bordetella pertussis
gccgcgcccagcagcgccaccg

SEQ ID NO: 356210 - RNA, 13 nt, Bordetella pertussis
gccgcgcccagcc

SEQ ID NO: 356211 - RNA, 15 nt, Bordetella pertussis
gccgcgcccagccgc

SEQ ID NO: 356212 - RNA, 21 nt, Bordetella pertussis
gccgcgcccagccgcgccauc

SEQ ID NO: 356213 - RNA, 18 nt, Bordetella pertussis
gccgcgcccagcgcggcc

SEQ ID NO: 356214 - RNA, 12 nt, Bordetella pertussis
gccgcgcccagc

SEQ ID NO: 356215 - RNA, 19 nt, Bordetella pertussis
gccgcgcccaugcgcuggc

SEQ ID NO: 356216 - RNA, 16 nt, Bordetella pertussis
gccgcgccccuagcgc

SEQ ID NO: 356217 - RNA, 20 nt, Bordetella pertussis
gccgcgccccuagcgccgcg

SEQ ID NO: 356218 - RNA, 22 nt, Bordetella pertussis
gccgcgccccuagcgccgcgcc

SEQ ID NO: 356219 - RNA, 23 nt, Bordetella pertussis
gccgcgccccuagcgccgcgcca

SEQ ID NO: 356220 - RNA, 15 nt, Bordetella pertussis
gccgcgcccgcuugc

SEQ ID NO: 356221 - RNA, 16 nt, Bordetella pertussis
gccgcgcccgcuugcg

SEQ ID NO: 356222 - RNA, 23 nt, Bordetella pertussis
gccgcgcccgcuugcggccggcg

SEQ ID NO: 356223 - RNA, 21 nt, Bordetella pertussis
gccgcgcccggaucaguccgg

SEQ ID NO: 356224 - RNA, 23 nt, Bordetella pertussis
gccgcgcccggaucaguccgggc

SEQ ID NO: 356225 - RNA, 14 nt, Bordetella pertussis
gccgcgcccggccg

SEQ ID NO: 356226 - RNA, 16 nt, Bordetella pertussis
gccgcgcccggccggc

SEQ ID NO: 356227 - RNA, 15 nt, Bordetella pertussis
gccgcgcccgccuuc

SEQ ID NO: 356228 - RNA, 17 nt, Bordetella pertussis
gccgcgcccggcggcca

SEQ ID NO: 356229 - RNA, 18 nt, Bordetella pertussis
gccgcgcccggcggccag

SEQ ID NO: 356230 - RNA, 16 nt, Bordetella pertussis
gccgcgcccguccacg

SEQ ID NO: 356231 - RNA, 19 nt, Bordetella pertussis
gccgcgcccguccacggcc

SEQ ID NO: 356232 - RNA, 14 nt, Bordetella pertussis
gccgcgcccuggcg

SEQ ID NO: 356233 - RNA, 15 nt, Bordetella pertussis
gccgcgcccuggcgc

SEQ ID NO: 356234 - RNA, 19 nt, Bordetella pertussis
gccgcgcccuggcgcggcg

SEQ ID NO: 356235 - RNA, 16 nt, Bordetella pertussis
gccgcgccgaacgcgc

SEQ ID NO: 356236 - RNA, 18 nt, Bordetella pertussis
gccgcgccgaacgcgcag

SEQ ID NO: 356237 - RNA, 20 nt, Bordetella pertussis
gccgcgccgaacgcgcagcg

SEQ ID NO: 356238 - RNA, 14 nt, Bordetella pertussis
gccgcgccgaaggc

SEQ ID NO: 356239 - RNA, 15 nt, Bordetella pertussis
gccgcgccgaccggc

SEQ ID NO: 356240 - RNA, 16 nt, Bordetella pertussis
gccgcgccgaccggcc

SEQ ID NO: 356241 - RNA, 19 nt, Bordetella pertussis
gccgcgccgaccggcccca

SEQ ID NO: 356242 - RNA, 19 nt, Bordetella pertussis
gccgcgccgcccccgccca

SEQ ID NO: 356243 - RNA, 18 nt, Bordetella pertussis
gccgcgccgcccgcggcc

SEQ ID NO: 356244 - RNA, 18 nt, Bordetella pertussis
gccgcgccgccgccuggc

SEQ ID NO: 356245 - RNA, 12 nt, Bordetella pertussis
gccgcgccgcug

SEQ ID NO: 356246 - RNA, 13 nt, Bordetella pertussis
gccgcgccgcugg

SEQ ID NO: 356247 - RNA, 16 nt, Bordetella pertussis
gccgcgccgcuggcgu

SEQ ID NO: 356248 - RNA, 18 nt, Bordetella pertussis
gccgcgccgcuggcgucc

SEQ ID NO: 356249 - RNA, 15 nt, Bordetella pertussis
gccgcgccggaucgu

SEQ ID NO: 356250 - RNA, 13 nt, Bordetella pertussis
gccgcgccggcgc

SEQ ID NO: 356251 - RNA, 16 nt, Bordetella pertussis
gccgcgccggcgcgcg

SEQ ID NO: 356252 - RNA, 18 nt, Bordetella pertussis
gccgcgccggcgcgcgau

SEQ ID NO: 356253 - RNA, 13 nt, Bordetella pertussis
gccgcgccggugg

SEQ ID NO: 356254 - RNA, 21 nt, Bordetella pertussis
gccgcgccgguggccagcagc

SEQ ID NO: 356255 - RNA, 22 nt, Bordetella pertussis
gccgcgccguacagggccgcga

SEQ ID NO: 356256 - RNA, 16 nt, Bordetella pertussis
gccgcgccgggcgcgc

SEQ ID NO: 356257 - RNA, 20 nt, Bordetella pertussis
gccgcgccgggcgcgccggc

SEQ ID NO: 356258 - RNA, 22 nt, Bordetella pertussis
gccgcgccggggcggcgcagca

SEQ ID NO: 356259 - RNA, 21 nt, Bordetella pertussis
gccgcgccguucucaggccga

SEQ ID NO: 356260 - RNA, 22 nt, Bordetella pertussis
gccgcgccguucucaggccgag

SEQ ID NO: 356261 - RNA, 20 nt, Bordetella pertussis
gccgcgccuauaucgacggc

SEQ ID NO: 356262 - RNA, 22 nt, Bordetella pertussis
gccgcgccuauaucgacggcgc

SEQ ID NO: 356263 - RNA, 13 nt, Bordetella pertussis
gccgcgccugcag

SEQ ID NO: 356264 - RNA, 18 nt, Bordetella pertussis
gccgcgccugcagcagcg

SEQ ID NO: 356265 - RNA, 14 nt, Bordetella pertussis
gccgcgccugcagg

SEQ ID NO: 356266 - RNA, 16 nt, Bordetella pertussis
gccgcgccuugcccgu

SEQ ID NO: 356267 - RNA, 14 nt, Bordetella pertussis
gccgcgcgacagcc

SEQ ID NO: 356268 - RNA, 17 nt, Bordetella pertussis
gccgcgcgacagccgcg

SEQ ID NO: 356269 - RNA, 21 nt, Bordetella pertussis
gccgcgcgacagccgcgccag

SEQ ID NO: 356270 - RNA, 23 nt, Bordetella pertussis
gccgcgcgacagccgcgccagcg

SEQ ID NO: 356271 - RNA, 15 nt, Bordetella pertussis
gccgcgcgauccggc

SEQ ID NO: 356272 - RNA, 17 nt, Bordetella pertussis
gccgcgcgauccggcgu

SEQ ID NO: 356273 - RNA, 21 nt, Bordetella pertussis
gccgcgcgauccggcguggua

SEQ ID NO: 356274 - RNA, 13 nt, Bordetella pertussis
gccgcgcgauccu

SEQ ID NO: 356275 - RNA, 13 nt, Bordetella pertussis
gccgcgcgaucgc

SEQ ID NO: 356276 - RNA, 20 nt, Bordetella pertussis
gccgcgcgaucgccgcaugg

SEQ ID NO: 356277 - RNA, 18 nt, Bordetella pertussis
gccgcgcgaugcgcggcc

SEQ ID NO: 356278 - RNA, 12 nt, Bordetella pertussis
gccgcgcgcacg

SEQ ID NO: 356279 - RNA, 14 nt, Bordetella pertussis
gccgcgcgcagggc

SEQ ID NO: 356280 - RNA, 15 nt, Bordetella pertussis
gccgcgcgcauccag

SEQ ID NO: 356281 - RNA, 21 nt, Bordetella pertussis
gccgcgcgcaugcgccuuacu

SEQ ID NO: 356282 - RNA, 21 nt, Bordetella pertussis
gccgcgcgccauccggcgcau

SEQ ID NO: 356283 - RNA, 24 nt, Bordetella pertussis
gccgcgcgccauccggcgcaugau

SEQ ID NO: 356284 - RNA, 11 nt, Bordetella pertussis
gccgcgcgccg

SEQ ID NO: 356285 - RNA, 15 nt, Bordetella pertussis
gccgcgcgccgcgcc

SEQ ID NO: 356286 - RNA, 19 nt, Bordetella pertussis
gccgcgcgccgcgccuucg

SEQ ID NO: 356287 - RNA, 16 nt, Bordetella pertussis
gccgcgcgccgcggcc

SEQ ID NO: 356288 - RNA, 13 nt, Bordetella pertussis
gccgcgcgccggc

SEQ ID NO: 356289 - RNA, 14 nt, Bordetella pertussis
gccgcgcgccggcg

SEQ ID NO: 356290 - RNA, 15 nt, Bordetella pertussis
gccgcgcgccggcgc

SEQ ID NO: 356291 - RNA, 21 nt, Bordetella pertussis
gccgcgcgccucgaugauggc

SEQ ID NO: 356292 - RNA, 23 nt, Bordetella pertussis
gccgcgcgccucgaugauggcgu

SEQ ID NO: 356293 - RNA, 13 nt, Bordetella pertussis
gccgcgcgccugc

SEQ ID NO: 356294 - RNA, 23 nt, Bordetella pertussis
gccgcgcgccuuccugggcgccg

SEQ ID NO: 356295 - RNA, 14 nt, Bordetella pertussis
gccgcgcgcgacuu

SEQ ID NO: 356296 - RNA, 16 nt, Bordetella pertussis
gccgcgcgcgcagacg

SEQ ID NO: 356297 - RNA, 19 nt, Bordetella pertussis
gccgcgcgcgcagacgcgc

SEQ ID NO: 356298 - RNA, 13 nt, Bordetella pertussis
gccgcgcgcggca

SEQ ID NO: 356299 - RNA, 23 nt, Bordetella pertussis
gccgcgcgcggcaaugcgcgcgc

SEQ ID NO: 356300 - RNA, 16 nt, Bordetella pertussis
gccgcgcgcggccccg

SEQ ID NO: 356301 - RNA, 17 nt, Bordetella pertussis
gccgcgcgcggccggca

SEQ ID NO: 356302 - RNA, 20 nt, Bordetella pertussis
gccgcgcgcggccggcgcgc

SEQ ID NO: 356303 - RNA, 13 nt, Bordetella pertussis
gccgcgcgcggcg

SEQ ID NO: 356304 - RNA, 18 nt, Bordetella pertussis
gccgcgcgcgggcgcccg

SEQ ID NO: 356305 - RNA, 23 nt, Bordetella pertussis
gccgcgcgcguauggcggcgccg

SEQ ID NO: 356306 - RNA, 20 nt, Bordetella pertussis
gccgcgcgcgucgccgcugg

SEQ ID NO: 356307 - RNA, 21 nt, Bordetella pertussis
gccgcgcgcgucgccgcuggc

SEQ ID NO: 356308 - RNA, 19 nt, Bordetella pertussis
gccgcgcgcgugccgcagg

SEQ ID NO: 356309 - RNA, 14 nt, Bordetella pertussis
gccgcgcgcugguc

SEQ ID NO: 356310 - RNA, 21 nt, Bordetella pertussis
gccgcgcgcuucaggcgccgc

SEQ ID NO: 356311 - RNA, 13 nt, Bordetella pertussis
gccgcgcggccgg

SEQ ID NO: 356312 - RNA, 15 nt, Bordetella pertussis
gccgcgcggccguca

SEQ ID NO: 356313 - RNA, 18 nt, Bordetella pertussis
gccgcgcggccgucaggc

SEQ ID NO: 356314 - RNA, 21 nt, Bordetella pertussis
gccgcgcggccgucaggcguu

SEQ ID NO: 356315 - RNA, 19 nt, Bordetella pertussis
gccgcgcggcguauggcgc

SEQ ID NO: 356316 - RNA, 14 nt, Bordetella pertussis
gccgcgcggcgcgu

SEQ ID NO: 356317 - RNA, 19 nt, Bordetella pertussis
gccgcgcgggcggcccgca

SEQ ID NO: 356318 - RNA, 13 nt, Bordetella pertussis
gccgcgcguacgc

SEQ ID NO: 356319 - RNA, 17 nt, Bordetella pertussis
gccgcgcguacgcggcg

SEQ ID NO: 356320 - RNA, 18 nt, Bordetella pertussis
gccgcgcguacgcggcgc

SEQ ID NO: 356321 - RNA, 22 nt, Bordetella pertussis
gccgcgcguaugcaccgggccg

SEQ ID NO: 356322 - RNA, 16 nt, Bordetella pertussis
gccgcgcucagcacca

SEQ ID NO: 356323 - RNA, 20 nt, Bordetella pertussis
gccgcgcucagcaccaggcc

SEQ ID NO: 356324 - RNA, 13 nt, Bordetella pertussis
gccgcgcucaggc

SEQ ID NO: 356325 - RNA, 14 nt, Bordetella pertussis
gccgcgcucaggcc

SEQ ID NO: 356326 - RNA, 16 nt, Bordetella pertussis
gccgcgcucaggccgc

SEQ ID NO: 356327 - RNA, 18 nt, Bordetella pertussis
gccgcgcucaggccgcug

SEQ ID NO: 356328 - RNA, 20 nt, Bordetella pertussis
gccgcgcucaggccgcuggg

SEQ ID NO: 356329 - RNA, 21 nt, Bordetella pertussis
gccgcgcucaggccgcugggc

SEQ ID NO: 356330 - RNA, 13 nt, Bordetella pertussis
gccgcgcuccagg

SEQ ID NO: 356331 - RNA, 18 nt, Bordetella pertussis
gccgcgcuccagggcguc

SEQ ID NO: 356332 - RNA, 23 nt, Bordetella pertussis
gccgcgcuccagggcgucggcga

SEQ ID NO: 356333 - RNA, 13 nt, Bordetella pertussis
gccgcgcucgcgc

SEQ ID NO: 356334 - RNA, 16 nt, Bordetella pertussis
gccgcgcucggcgcug

SEQ ID NO: 356335 - RNA, 17 nt, Bordetella pertussis
gccgcgcucggcgcugc

SEQ ID NO: 356336 - RNA, 19 nt, Bordetella pertussis
gccgcgcucggcgcugccg

SEQ ID NO: 356337 - RNA, 14 nt, Bordetella pertussis
gccgcgcugauccu

SEQ ID NO: 356338 - RNA, 20 nt, Bordetella pertussis
gccgcgcugauccuggcucu

SEQ ID NO: 356339 - RNA, 11 nt, Bordetella pertussis
gccgcgcugcc

SEQ ID NO: 356340 - RNA, 16 nt, Bordetella pertussis
gccgcgcugccagcca

SEQ ID NO: 356341 - RNA, 12 nt, Bordetella pertussis
gccgcgcugccu

SEQ ID NO: 356342 - RNA, 22 nt, Bordetella pertussis
gccgcgcugccugaaaccgcag

SEQ ID NO: 356343 - RNA, 20 nt, Bordetella pertussis
gccgcgcuggaagacguggc

SEQ ID NO: 356344 - RNA, 13 nt, Bordetella pertussis
gccgcgcuggcgc

SEQ ID NO: 356345 - RNA, 14 nt, Bordetella pertussis
gccgcgcuggcgcu

SEQ ID NO: 356346 - RNA, 21 nt, Bordetella pertussis
gccgcgcuggcgcuggccgcc

SEQ ID NO: 356347 - RNA, 14 nt, Bordetella pertussis
gccgcgcuggcggc

SEQ ID NO: 356348 - RNA, 18 nt, Bordetella pertussis
gccgcgcuggcggcgcag

SEQ ID NO: 356349 - RNA, 12 nt, Bordetella pertussis
gccgcgcugggc

SEQ ID NO: 356350 - RNA, 21 nt, Bordetella pertussis
gccgcgcugggcgcugcugcu

SEQ ID NO: 356351 - RNA, 13 nt, Bordetella pertussis
gccgcgcuggugc

SEQ ID NO: 356352 - RNA, 19 nt, Bordetella pertussis
gccgcgcuggugcuggccg

SEQ ID NO: 356353 - RNA, 18 nt, Bordetella pertussis
gccgcgcuucgucggcgu

SEQ ID NO: 356354 - RNA, 19 nt, Bordetella pertussis
gccgcggaagucgggcacc

SEQ ID NO: 356355 - RNA, 17 nt, Bordetella pertussis
gccgcggacccaggccu

SEQ ID NO: 356356 - RNA, 14 nt, Bordetella pertussis
gccgcggacgaagc

SEQ ID NO: 356357 - RNA, 12 nt, Bordetella pertussis
gccgcggccagc

SEQ ID NO: 356358 - RNA, 13 nt, Bordetella pertussis
gccgcggccagcg

SEQ ID NO: 356359 - RNA, 16 nt, Bordetella pertussis
gccgcggccagcgccg

SEQ ID NO: 356360 - RNA, 17 nt, Bordetella pertussis
gccgcggccagcgccgc

SEQ ID NO: 356361 - RNA, 17 nt, Bordetella pertussis
gccgcggccaggcccau

SEQ ID NO: 356362 - RNA, 22 nt, Bordetella pertussis
gccgcggccaggcccaugccgc

SEQ ID NO: 356363 - RNA, 13 nt, Bordetella pertussis
gccgcggcccagc

SEQ ID NO: 356364 - RNA, 15 nt, Bordetella pertussis
gccgcggcccagcgc

SEQ ID NO: 356365 - RNA, 19 nt, Bordetella pertussis
gccgcggcccagcgcggcg

SEQ ID NO: 356366 - RNA, 22 nt, Bordetella pertussis
gccgcggcccagcgcggcggcc

SEQ ID NO: 356367 - RNA, 15 nt, Bordetella pertussis
gccgcggccagcgcc

SEQ ID NO: 356368 - RNA, 16 nt, Bordetella pertussis
gccgcggccggcacgc

SEQ ID NO: 356369 - RNA, 19 nt, Bordetella pertussis
gccgcggccggcacgccca

SEQ ID NO: 356370 - RNA, 15 nt, Bordetella pertussis
gccgcggccggcgca

SEQ ID NO: 356371 - RNA, 16 nt, Bordetella pertussis
gccgcggccggcggcg

SEQ ID NO: 356372 - RNA, 17 nt, Bordetella pertussis
gccgcggccggcggcgc

SEQ ID NO: 356373 - RNA, 13 nt, Bordetella pertussis
gccgcggccgggu

SEQ ID NO: 356374 - RNA, 13 nt, Bordetella pertussis
gccgcggccucgg

SEQ ID NO: 356375 - RNA, 16 nt, Bordetella pertussis
gccgcggccuggccgg

SEQ ID NO: 356376 - RNA, 14 nt, Bordetella pertussis
gccgcggcgaagcc

SEQ ID NO: 356377 - RNA, 18 nt, Bordetella pertussis
gccgcggcgaagccuucu

SEQ ID NO: 356378 - RNA, 19 nt, Bordetella pertussis
gccgcggcgagcucggcau

SEQ ID NO: 356379 - RNA, 18 nt, Bordetella pertussis
gccgcggcgaugccggcc

SEQ ID NO: 356380 - RNA, 19 nt, Bordetella pertussis
gccgcggcgaugccggcca

SEQ ID NO: 356381 - RNA, 20 nt, Bordetella pertussis
gccgcggcgaugccggccag

SEQ ID NO: 356382 - RNA, 22 nt, Bordetella pertussis
gccgcggcgaugccggccagca

SEQ ID NO: 356383 - RNA, 12 nt, Bordetella pertussis
gccgcggcgccg

SEQ ID NO: 356384 - RNA, 13 nt, Bordetella pertussis
gccgcggcgccgc

SEQ ID NO: 356385 - RNA, 14 nt, Bordetella pertussis
gccgcggcgcggcc

SEQ ID NO: 356386 - RNA, 16 nt, Bordetella pertussis
gccgcggcgcggcccg

SEQ ID NO: 356387 - RNA, 18 nt, Bordetella pertussis
gccgcggcgcggcccgcc

SEQ ID NO: 356388 - RNA, 19 nt, Bordetella pertussis
gccgcggcgcggcccgcca

SEQ ID NO: 356389 - RNA, 12 nt, Bordetella pertussis
gccgcggcgcgg

SEQ ID NO: 356390 - RNA, 13 nt, Bordetella pertussis
gccgcggcggcga

SEQ ID NO: 356391 - RNA, 21 nt, Bordetella pertussis
gccgcggcggcgagggcgucg

SEQ ID NO: 356392 - RNA, 22 nt, Bordetella pertussis
gccgcggcgguuucggccggga

SEQ ID NO: 356393 - RNA, 13 nt, Bordetella pertussis
gccgcggcgugcu

SEQ ID NO: 356394 - RNA, 17 nt, Bordetella pertussis
gccgcggcuugccgcgg

SEQ ID NO: 356395 - RNA, 20 nt, Bordetella pertussis
gccgcgggauucugcugcau

SEQ ID NO: 356396 - RNA, 18 nt, Bordetella pertussis
gccgcgggcaaagcccag

SEQ ID NO: 356397 - RNA, 19 nt, Bordetella pertussis
gccgcgggcaaagcccagc

SEQ ID NO: 356398 - RNA, 20 nt, Bordetella pertussis
gccgcgggcaaagcccagca

SEQ ID NO: 356399 - RNA, 17 nt, Bordetella pertussis
gccgcgggccgcugguc

SEQ ID NO: 356400 - RNA, 12 nt, Bordetella pertussis
gccgcgggcgcc

SEQ ID NO: 356401 - RNA, 15 nt, Bordetella pertussis
gccgcgggcgccgcg

SEQ ID NO: 356402 - RNA, 20 nt, Bordetella pertussis
gccgcgggcggccacgcgcc

SEQ ID NO: 356403 - RNA, 14 nt, Bordetella pertussis
gccgcgggcggcgc

SEQ ID NO: 356404 - RNA, 20 nt, Bordetella pertussis
gccgcgggcggcgccggccg

SEQ ID NO: 356405 - RNA, 15 nt, Bordetella pertussis
gccgcgggcggcgcg

SEQ ID NO: 356406 - RNA, 16 nt, Bordetella pertussis
gccgcgggcggcgcgc

SEQ ID NO: 356407 - RNA, 18 nt, Bordetella pertussis
gccgcgggcggcgcgccc

SEQ ID NO: 356408 - RNA, 22 nt, Bordetella pertussis
gccgcgggcggcgcgcccagcg

SEQ ID NO: 356409 - RNA, 14 nt, Bordetella pertussis
gccgcgggcgugcu

SEQ ID NO: 356410 - RNA, 14 nt, Bordetella pertussis
gccgcggggcuggc

SEQ ID NO: 356411 - RNA, 15 nt, Bordetella pertussis
gccgcggggcuggcc

SEQ ID NO: 356412 - RNA, 17 nt, Bordetella pertussis
gccgcggggcuggccag

SEQ ID NO: 356413 - RNA, 22 nt, Bordetella pertussis
gccgcggggcuggccagcuggc

SEQ ID NO: 356414 - RNA, 18 nt, Bordetella pertussis
gccgcggguggccgcucc

SEQ ID NO: 356415 - RNA, 20 nt, Bordetella pertussis
gccgcggguggccgcuccag

SEQ ID NO: 356416 - RNA, 14 nt, Bordetella pertussis
gccgcgggugucgc

SEQ ID NO: 356417 - RNA, 17 nt, Bordetella pertussis
gccgcgggugucgcucc

SEQ ID NO: 356418 - RNA, 14 nt, Bordetella pertussis
gccgcggucagcca

SEQ ID NO: 356419 - RNA, 17 nt, Bordetella pertussis
gccgcggucgcagacga

SEQ ID NO: 356420 - RNA, 14 nt, Bordetella pertussis
gccgcgguccgggc

SEQ ID NO: 356421 - RNA, 15 nt, Bordetella pertussis
gccgcgguggcgggc

SEQ ID NO: 356422 - RNA, 19 nt, Bordetella pertussis
gccgcguacaacgccgcgu

SEQ ID NO: 356423 - RNA, 21 nt, Bordetella pertussis
gccgcguacaacgccgcgucc

SEQ ID NO: 356424 - RNA, 14 nt, Bordetella pertussis
gccgcguccagcgc

SEQ ID NO: 356425 - RNA, 17 nt, Bordetella pertussis
gccgcguccagcgcgcg

SEQ ID NO: 356426 - RNA, 20 nt, Bordetella pertussis
gccgcguccagcgcgcggcc

SEQ ID NO: 356427 - RNA, 14 nt, Bordetella pertussis
gccgcguccgcccg

SEQ ID NO: 356428 - RNA, 15 nt, Bordetella pertussis
gccgcguccgcccgc

SEQ ID NO: 356429 - RNA, 14 nt, Bordetella pertussis
gccgcgucauggcg

SEQ ID NO: 356430 - RNA, 17 nt, Bordetella pertussis
gccgcguccucggccug

SEQ ID NO: 356431 - RNA, 18 nt, Bordetella pertussis
gccgcguccucggccugg

SEQ ID NO: 356432 - RNA, 18 nt, Bordetella pertussis
gccgcgucgagcgcgacg

SEQ ID NO: 356433 - RNA, 17 nt, Bordetella pertussis
gccgcgucgaucagcgc

SEQ ID NO: 356434 - RNA, 19 nt, Bordetella pertussis
gccgcgucgaucagcgcgg

SEQ ID NO: 356435 - RNA, 14 nt, Bordetella pertussis
gccgcgucgauccg

SEQ ID NO: 356436 - RNA, 20 nt, Bordetella pertussis
gccgcgucgauccggcagca

SEQ ID NO: 356437 - RNA, 21 nt, Bordetella pertussis
gccgcgucgauccggcagcag

SEQ ID NO: 356438 - RNA, 14 nt, Bordetella pertussis
gccgcguaugcggc

SEQ ID NO: 356439 - RNA, 13 nt, Bordetella pertussis
gccgcgucgcugg

SEQ ID NO: 356440 - RNA, 14 nt, Bordetella pertussis
gccgcgucgcuggc

SEQ ID NO: 356441 - RNA, 15 nt, Bordetella pertussis
gccgcgucgcuggcc

SEQ ID NO: 356442 - RNA, 15 nt, Bordetella pertussis
gccgcgucggcgccg

SEQ ID NO: 356443 - RNA, 19 nt, Bordetella pertussis
gccgcgucggcgccgauca

SEQ ID NO: 356444 - RNA, 19 nt, Bordetella pertussis
gccgcgucgguggccagcc

SEQ ID NO: 356445 - RNA, 21 nt, Bordetella pertussis
gccgcgucgguggccagccag

SEQ ID NO: 356446 - RNA, 20 nt, Bordetella pertussis
gccgcgucuucggcgcggcg

SEQ ID NO: 356447 - RNA, 23 nt, Bordetella pertussis
gccgcgucuucggcgcggcgggc

SEQ ID NO: 356448 - RNA, 14 nt, Bordetella pertussis
gccgcgucggccuc

SEQ ID NO: 356449 - RNA, 16 nt, Bordetella pertussis
gccgcgucggccucau

SEQ ID NO: 356450 - RNA, 12 nt, Bordetella pertussis
gccgcgugcgcc

SEQ ID NO: 356451 - RNA, 17 nt, Bordetella pertussis
gccgcgugcgccgggcu

SEQ ID NO: 356452 - RNA, 21 nt, Bordetella pertussis
gccgcgugcccgcguccacca

SEQ ID NO: 356453 - RNA, 20 nt, Bordetella pertussis
gccgcguggauuuugcggaa

SEQ ID NO: 356454 - RNA, 19 nt, Bordetella pertussis
gccgcguggcggcgcagcg

SEQ ID NO: 356455 - RNA, 23 nt, Bordetella pertussis
gccgcgugguggcgcagaugggc

SEQ ID NO: 356456 - RNA, 16 nt, Bordetella pertussis
gccgcguucacgccgg

SEQ ID NO: 356457 - RNA, 17 nt, Bordetella pertussis
gccgcguucacgccggc

SEQ ID NO: 356458 - RNA, 20 nt, Bordetella pertussis
gccgcguucacgccggcgcg

SEQ ID NO: 356459 - RNA, 15 nt, Bordetella pertussis
gccgcguugcagcca

SEQ ID NO: 356460 - RNA, 20 nt, Bordetella pertussis
gccgcguugcagccacaggc

SEQ ID NO: 356461 - RNA, 21 nt, Bordetella pertussis
gccgcguugcagccacaggcc

SEQ ID NO: 356462 - RNA, 23 nt, Bordetella pertussis
gccgcguugcagccacaggccca

SEQ ID NO: 356463 - RNA, 17 nt, Bordetella pertussis
gccgcguugcgcgacuu

SEQ ID NO: 356464 - RNA, 22 nt, Bordetella pertussis
gccgcguuucccucggugcugc

SEQ ID NO: 356465 - RNA, 14 nt, Bordetella pertussis
gccgcuacggcggu

SEQ ID NO: 356466 - RNA, 19 nt, Bordetella pertussis
gccgcuaggccuugccgcc

SEQ ID NO: 356467 - RNA, 19 nt, Bordetella pertussis
gccgcucagcgcggcgcgg

SEQ ID NO: 356468 - RNA, 22 nt, Bordetella pertussis
gccgcucagcgcggcgcggcca

SEQ ID NO: 356469 - RNA, 22 nt, Bordetella pertussis
gccgcucagguagaccacgcgc

SEQ ID NO: 356470 - RNA, 17 nt, Bordetella pertussis
gccgcuccagagcgcgc

SEQ ID NO: 356471 - RNA, 18 nt, Bordetella pertussis
gccgcuccagagcgcgca

SEQ ID NO: 356472 - RNA, 20 nt, Bordetella pertussis
gccgcuccagagcgcgcaca

SEQ ID NO: 356473 - RNA, 13 nt, Bordetella pertussis
gccgcuccagcca

SEQ ID NO: 356474 - RNA, 16 nt, Bordetella pertussis
gccgcuccagccacca

SEQ ID NO: 356475 - RNA, 14 nt, Bordetella pertussis
gccgcuccgccaug

SEQ ID NO: 356476 - RNA, 16 nt, Bordetella pertussis
gccgcuccgccaugga

SEQ ID NO: 356477 - RNA, 23 nt, Bordetella pertussis
gccgcuccgccauggaggcgcag

SEQ ID NO: 356478 - RNA, 14 nt, Bordetella pertussis
gccgcuccggcaug

SEQ ID NO: 356479 - RNA, 23 nt, Bordetella pertussis
gccgcuccggcaugaaacggcaa

SEQ ID NO: 356480 - RNA, 16 nt, Bordetella pertussis
gccgcucgcgcgacca

SEQ ID NO: 356481 - RNA, 17 nt, Bordetella pertussis
gccgcucgcgcgaccac

SEQ ID NO: 356482 - RNA, 23 nt, Bordetella pertussis
gccgcucgcgcgaccacuggcag

SEQ ID NO: 356483 - RNA, 17 nt, Bordetella pertussis
gccgcucggccacgcgc

SEQ ID NO: 356484 - RNA, 20 nt, Bordetella pertussis
gccgcucguaguguuccugg

SEQ ID NO: 356485 - RNA, 16 nt, Bordetella pertussis
gccgcugaccagcacg

SEQ ID NO: 356486 - RNA, 13 nt, Bordetella pertussis
gccgcugaccggc

SEQ ID NO: 356487 - RNA, 14 nt, Bordetella pertussis
gccgcugaccggcg

SEQ ID NO: 356488 - RNA, 16 nt, Bordetella pertussis
gccgcugaccggcggc

SEQ ID NO: 356489 - RNA, 20 nt, Bordetella pertussis
gccgcugaccggcggcacgg

SEQ ID NO: 356490 - RNA, 22 nt, Bordetella pertussis
gccgcugaccggcggcacggcc

SEQ ID NO: 356491 - RNA, 19 nt, Bordetella pertussis
gccgcugaucuuccugggc

SEQ ID NO: 356492 - RNA, 23 nt, Bordetella pertussis
gccgcugcagaucaucggcgcca

SEQ ID NO: 356493 - RNA, 17 nt, Bordetella pertussis
gccgcugcagcacgcac

SEQ ID NO: 356494 - RNA, 22 nt, Bordetella pertussis
gccgcugcagcacgcaccaggc

SEQ ID NO: 356495 - RNA, 16 nt, Bordetella pertussis
gccgcugauggcgguc

SEQ ID NO: 356496 - RNA, 17 nt, Bordetella pertussis
gccgcugauggcgguca

SEQ ID NO: 356497 - RNA, 17 nt, Bordetella pertussis
gccggcgucacgcggcc

SEQ ID NO: 356498 - RNA, 21 nt, Bordetella pertussis
gccggcgucacgcggccgggc

SEQ ID NO: 356499 - RNA, 19 nt, Bordetella pertussis
gccggcguagucguugccg

SEQ ID NO: 356500 - RNA, 23 nt, Bordetella pertussis
gccggcguagucguugccggcca

SEQ ID NO: 356501 - RNA, 23 nt, Bordetella pertussis
gccggcguccacggcaucggcca

SEQ ID NO: 356502 - RNA, 21 nt, Bordetella pertussis
gccggcguucuggucagccgu

SEQ ID NO: 356503 - RNA, 22 nt, Bordetella pertussis
gccggcguugaaggcgaugggc

SEQ ID NO: 356504 - RNA, 21 nt, Bordetella pertussis
gccggcuacagcucgccggcg

SEQ ID NO: 356505 - RNA, 14 nt, Bordetella pertussis
gccggcucagcccc

SEQ ID NO: 356506 - RNA, 15 nt, Bordetella pertussis
gccggcucagccccc

SEQ ID NO: 356507 - RNA, 18 nt, Bordetella pertussis
gccggcucaggccagcga

SEQ ID NO: 356508 - RNA, 20 nt, Bordetella pertussis
gccggcucaggccagcgacc

SEQ ID NO: 356509 - RNA, 18 nt, Bordetella pertussis
gccggcucauucggcgcg

SEQ ID NO: 356510 - RNA, 12 nt, Bordetella pertussis
gccggcugggcg

SEQ ID NO: 356511 - RNA, 16 nt, Bordetella pertussis
gccggcugggcggccu

SEQ ID NO: 356512 - RNA, 19 nt, Bordetella pertussis
gccggcugggcggccuugg

SEQ ID NO: 356513 - RNA, 15 nt, Bordetella pertussis
gccggcugggcguuc

SEQ ID NO: 356514 - RNA, 14 nt, Bordetella pertussis
gccggcuuccagca

SEQ ID NO: 356515 - RNA, 15 nt, Bordetella pertussis
gccggcuuccagcag

SEQ ID NO: 356516 - RNA, 16 nt, Bordetella pertussis
gccggcuuccagcagc

SEQ ID NO: 356517 - RNA, 17 nt, Bordetella pertussis
gccggcuggcaugcggc

SEQ ID NO: 356518 - RNA, 21 nt, Bordetella pertussis
gccggcuugcauggugccgga

SEQ ID NO: 356519 - RNA, 14 nt, Bordetella pertussis
gccggcuugcgcaa

SEQ ID NO: 356520 - RNA, 16 nt, Bordetella pertussis
gccggcuugcgcaagc

SEQ ID NO: 356521 - RNA, 17 nt, Bordetella pertussis
gccggcuugcgcaagcc

SEQ ID NO: 356522 - RNA, 21 nt, Bordetella pertussis
gccggcuugcgcaagccggcc

SEQ ID NO: 356523 - RNA, 16 nt, Bordetella pertussis
gccggcuugcgccagc

SEQ ID NO: 356524 - RNA, 17 nt, Bordetella pertussis
gccggcuugcgccagcc

SEQ ID NO: 356525 - RNA, 16 nt, Bordetella pertussis
gccggcuuucagcgcc

SEQ ID NO: 356526 - RNA, 17 nt, Bordetella pertussis
gccggcuuucagcgccg

SEQ ID NO: 356527 - RNA, 20 nt, Bordetella pertussis
gccggcuuucagcgccgagc

SEQ ID NO: 356528 - RNA, 18 nt, Bordetella pertussis
gccggcuuuggacaggcg

SEQ ID NO: 356529 - RNA, 21 nt, Bordetella pertussis
gccgggaaaaagagccugucc

SEQ ID NO: 356530 - RNA, 21 nt, Bordetella pertussis
gccgggacaaucgaagauggu

SEQ ID NO: 356531 - RNA, 20 nt, Bordetella pertussis
gccgggaccuuggcggcugg

SEQ ID NO: 356532 - RNA, 22 nt, Bordetella pertussis
gccgggaccuuggcggcuggcg

SEQ ID NO: 356533 - RNA, 22 nt, Bordetella pertussis
gccgggcacaccgucacgcgca

SEQ ID NO: 356534 - RNA, 15 nt, Bordetella pertussis
gccgggcaccgagcc

SEQ ID NO: 356535 - RNA, 20 nt, Bordetella pertussis
gccgggcaccgagccgcagg

SEQ ID NO: 356536 - RNA, 16 nt, Bordetella pertussis
gccgggcagcaucacg

SEQ ID NO: 356537 - RNA, 23 nt, Bordetella pertussis
gccgggcagcaucacggugccgc

SEQ ID NO: 356538 - RNA, 18 nt, Bordetella pertussis
gccgggcagcccgcgcac

SEQ ID NO: 356539 - RNA, 19 nt, Bordetella pertussis
gccgggcagcccgcgcacg

SEQ ID NO: 356540 - RNA, 22 nt, Bordetella pertussis
gccgggcagcccgcgcacgccc

SEQ ID NO: 356541 - RNA, 16 nt, Bordetella pertussis
gccgggcagcgggccg

SEQ ID NO: 356542 - RNA, 19 nt, Bordetella pertussis
gccgggcagcgggccgcag

SEQ ID NO: 356543 - RNA, 21 nt, Bordetella pertussis
gccgggcagcgggccgcagca

SEQ ID NO: 356544 - RNA, 16 nt, Bordetella pertussis
gccgggcaguccuggc

SEQ ID NO: 356545 - RNA, 21 nt, Bordetella pertussis
gccgggcauugccggagcagc

SEQ ID NO: 356546 - RNA, 14 nt, Bordetella pertussis
gccgggccacgcgc

SEQ ID NO: 356547 - RNA, 15 nt, Bordetella pertussis
gccgggccacgcgca

SEQ ID NO: 356548 - RNA, 14 nt, Bordetella pertussis
gccgggccagcgcg

SEQ ID NO: 356549 - RNA, 16 nt, Bordetella pertussis
gccgggccagcgcgau

SEQ ID NO: 356550 - RNA, 18 nt, Bordetella pertussis
gccgggccagaccuggug

SEQ ID NO: 356551 - RNA, 16 nt, Bordetella pertussis
gccgggcccggccacg

SEQ ID NO: 356552 - RNA, 19 nt, Bordetella pertussis
gccgggcccggccacggcc

SEQ ID NO: 356553 - RNA, 23 nt, Bordetella pertussis
gccgggcccggccacggccgggc

SEQ ID NO: 356554 - RNA, 17 nt, Bordetella pertussis
gccgggcccggcgcgcc

SEQ ID NO: 356555 - RNA, 18 nt, Bordetella pertussis
gccgggcccggcgcgccu

SEQ ID NO: 356556 - RNA, 14 nt, Bordetella pertussis
gccgggccgcgccc

SEQ ID NO: 356557 - RNA, 15 nt, Bordetella pertussis
gccgggccgcgccca

SEQ ID NO: 356558 - RNA, 16 nt, Bordetella pertussis
gccgggccgcgccgcc

SEQ ID NO: 356559 - RNA, 15 nt, Bordetella pertussis
gccgggccgggcacg

SEQ ID NO: 356560 - RNA, 16 nt, Bordetella pertussis
gccgggccgggcacga

SEQ ID NO: 356561 - RNA, 15 nt, Bordetella pertussis
gccgggccgugcgcc

SEQ ID NO: 356562 - RNA, 16 nt, Bordetella pertussis
gccgggccgugcgccg

SEQ ID NO: 356563 - RNA, 12 nt, Bordetella pertussis
gccgggccgugg

SEQ ID NO: 356564 - RNA, 16 nt, Bordetella pertussis
gccgggccugcccgca

SEQ ID NO: 356565 - RNA, 14 nt, Bordetella pertussis
gccgggccuggugc

SEQ ID NO: 356566 - RNA, 15 nt, Bordetella pertussis
gccgggccuggugcc

SEQ ID NO: 356567 - RNA, 23 nt, Bordetella pertussis
gccgggcgaucgcgucggccaag

SEQ ID NO: 356568 - RNA, 14 nt, Bordetella pertussis
gccgggcgccaggc

SEQ ID NO: 356569 - RNA, 14 nt, Bordetella pertussis
gccgggcgcccagc

SEQ ID NO: 356570 - RNA, 13 nt, Bordetella pertussis
gccgggcgccgcg

SEQ ID NO: 356571 - RNA, 16 nt, Bordetella pertussis
gccgggcgccgcgccc

SEQ ID NO: 356572 - RNA, 23 nt, Bordetella pertussis
gccgggcgccgcgccccaucacc

SEQ ID NO: 356573 - RNA, 19 nt, Bordetella pertussis
gccgggcgcgccggcgggc

SEQ ID NO: 356574 - RNA, 13 nt, Bordetella pertussis
gccgggcgcgcgc

SEQ ID NO: 356575 - RNA, 15 nt, Bordetella pertussis
gccgggcgcgcgccg

SEQ ID NO: 356576 - RNA, 20 nt, Bordetella pertussis
gccgggcgcgcgccggcggc

SEQ ID NO: 356577 - RNA, 22 nt, Bordetella pertussis
gccgggcgcgcgccggcggccu

SEQ ID NO: 356578 - RNA, 13 nt, Bordetella pertussis
gccgggcgcgccg

SEQ ID NO: 356579 - RNA, 15 nt, Bordetella pertussis
gccgggcgcgccggc

SEQ ID NO: 356580 - RNA, 20 nt, Bordetella pertussis
gccgggcgcgcugcccagcc

SEQ ID NO: 356581 - RNA, 16 nt, Bordetella pertussis
gccgggcgcggccagg

SEQ ID NO: 356582 - RNA, 16 nt, Bordetella pertussis
gccgggcgcggcccgg

SEQ ID NO: 356583 - RNA, 17 nt, Bordetella pertussis
gccgggcgcggcccggc

SEQ ID NO: 356584 - RNA, 20 nt, Bordetella pertussis
gccgggcgcggcccggcguc

SEQ ID NO: 356585 - RNA, 14 nt, Bordetella pertussis
gccgggcgcggccg

SEQ ID NO: 356586 - RNA, 17 nt, Bordetella pertussis
gccgggcgcggccgccg

SEQ ID NO: 356587 - RNA, 14 nt, Bordetella pertussis
gccgggcgcggcgc

SEQ ID NO: 356588 - RNA, 17 nt, Bordetella pertussis
gccgggcgcggcgcccg

SEQ ID NO: 356589 - RNA, 19 nt, Bordetella pertussis
gccgggcgcggcgcccgcc

SEQ ID NO: 356590 - RNA, 13 nt, Bordetella pertussis
gccgggcggcgcg

SEQ ID NO: 356591 - RNA, 18 nt, Bordetella pertussis
gccgggcucaggcugcgc

SEQ ID NO: 356592 - RNA, 16 nt, Bordetella pertussis
gccgggcuccucgccc

SEQ ID NO: 356593 - RNA, 20 nt, Bordetella pertussis
gccgggcucgaugaccagca

SEQ ID NO: 356594 - RNA, 23 nt, Bordetella pertussis
gccgggcucgaugaccagcagcg

SEQ ID NO: 356595 - RNA, 16 nt, Bordetella pertussis
gccgggcugccggcag

SEQ ID NO: 356596 - RNA, 20 nt, Bordetella pertussis
gccgggcuggauccggcgcu

SEQ ID NO: 356597 - RNA, 22 nt, Bordetella pertussis
gccgggcuggauccggcgcugg

SEQ ID NO: 356598 - RNA, 14 nt, Bordetella pertussis
gccgggcucggcca

SEQ ID NO: 356599 - RNA, 17 nt, Bordetella pertussis
gccgggcucggccacca

SEQ ID NO: 356600 - RNA, 21 nt, Bordetella pertussis
gccgggcuggugcgccgugcc

SEQ ID NO: 356601 - RNA, 18 nt, Bordetella pertussis
gccgggcuguccgccacc

SEQ ID NO: 356602 - RNA, 15 nt, Bordetella pertussis
gccgggcuugcgcac

SEQ ID NO: 356603 - RNA, 16 nt, Bordetella pertussis
gccgggcuugcgcacc

SEQ ID NO: 356604 - RNA, 17 nt, Bordetella pertussis
gccgggcuugcgcaccc

SEQ ID NO: 356605 - RNA, 17 nt, Bordetella pertussis
gccggggcccgcgggcg

SEQ ID NO: 356606 - RNA, 16 nt, Bordetella pertussis
gccggggccgcccugg

SEQ ID NO: 356607 - RNA, 18 nt, Bordetella pertussis
gccggggcgagcgcagcc

SEQ ID NO: 356608 - RNA, 22 nt, Bordetella pertussis
gccggggcgcaccggcacgcgc

SEQ ID NO: 356609 - RNA, 13 nt, Bordetella pertussis
gccggggcgccgg

SEQ ID NO: 356610 - RNA, 15 nt, Bordetella pertussis
gccggggcggcgcag

SEQ ID NO: 356611 - RNA, 17 nt, Bordetella pertussis
gccggggcggcgcagca

SEQ ID NO: 356612 - RNA, 15 nt, Bordetella pertussis
gccggggcggcucgg

SEQ ID NO: 356613 - RNA, 19 nt, Bordetella pertussis
gccggggcggcucggcccu

SEQ ID NO: 356614 - RNA, 14 nt, Bordetella pertussis
gccggggggcgcac

SEQ ID NO: 356615 - RNA, 22 nt, Bordetella pertussis
gccggggggcgcacgccgcgcc

SEQ ID NO: 356616 - RNA, 16 nt, Bordetella pertussis
gccggggguuccugcc

SEQ ID NO: 356617 - RNA, 22 nt, Bordetella pertussis
gccgggguccugaggccaggcc

SEQ ID NO: 356618 - RNA, 19 nt, Bordetella pertussis
gccggggucuugccgcgca

SEQ ID NO: 356619 - RNA, 14 nt, Bordetella pertussis
gccgggucaucgag

SEQ ID NO: 356620 - RNA, 20 nt, Bordetella pertussis
gccgggucaucgagguggcg

SEQ ID NO: 356621 - RNA, 16 nt, Bordetella pertussis
gccgggucccuggccc

SEQ ID NO: 356622 - RNA, 17 nt, Bordetella pertussis
gccgggucccuggcccu

SEQ ID NO: 356623 - RNA, 19 nt, Bordetella pertussis
gccgggucccuggcccugg

SEQ ID NO: 356624 - RNA, 16 nt, Bordetella pertussis
gccggguccggccgcg

SEQ ID NO: 356625 - RNA, 13 nt, Bordetella pertussis
gccgggucgcgca

SEQ ID NO: 356626 - RNA, 15 nt, Bordetella pertussis
gccgggucgcgcagc

SEQ ID NO: 356627 - RNA, 15 nt, Bordetella pertussis
gccgggucgccggug

SEQ ID NO: 356628 - RNA, 19 nt, Bordetella pertussis
gccgggucgcugugcgcgg

SEQ ID NO: 356629 - RNA, 13 nt, Bordetella pertussis
gccgggucggccu

SEQ ID NO: 356630 - RNA, 16 nt, Bordetella pertussis
gccgguacagccaggc

SEQ ID NO: 356631 - RNA, 21 nt, Bordetella pertussis
gccgguacagccaggccagca

SEQ ID NO: 356632 - RNA, 22 nt, Bordetella pertussis
gccgguacagccaggccagcag

SEQ ID NO: 356633 - RNA, 16 nt, Bordetella pertussis
gccggucaggaugcgc

SEQ ID NO: 356634 - RNA, 20 nt, Bordetella pertussis
gccggucaggaugcgcgcca

SEQ ID NO: 356635 - RNA, 13 nt, Bordetella pertussis
gccggucaggcgu

SEQ ID NO: 356636 - RNA, 14 nt, Bordetella pertussis
gccggucagggagg

SEQ ID NO: 356637 - RNA, 16 nt, Bordetella pertussis
gccgguccagcgcccg

SEQ ID NO: 356638 - RNA, 19 nt, Bordetella pertussis
gccggucgccgcgggcaaa

SEQ ID NO: 356639 - RNA, 21 nt, Bordetella pertussis
gccggucggccgcuccgccau

SEQ ID NO: 356640 - RNA, 22 nt, Bordetella pertussis
gccggucggccgcuccgccaug

SEQ ID NO: 356641 - RNA, 16 nt, Bordetella pertussis
gccggucuccagcgcg

SEQ ID NO: 356642 - RNA, 22 nt, Bordetella pertussis
gccggucuccagcgcgucggcc

SEQ ID NO: 356643 - RNA, 21 nt, Bordetella pertussis
gccggucugcauguaguucac

SEQ ID NO: 356644 - RNA, 23 nt, Bordetella pertussis
gccggucugggcgcggaacagcc

SEQ ID NO: 356645 - RNA, 15 nt, Bordetella pertussis
gccggucuggucggc

SEQ ID NO: 356646 - RNA, 17 nt, Bordetella pertussis
gccggucuggucggcga

SEQ ID NO: 356647 - RNA, 12 nt, Bordetella pertussis
gccggugcgcac

SEQ ID NO: 356648 - RNA, 20 nt, Bordetella pertussis
gccggugcgcagcaccagca

SEQ ID NO: 356649 - RNA, 12 nt, Bordetella pertussis
gccggugcgcgg

SEQ ID NO: 356650 - RNA, 15 nt, Bordetella pertussis
gccggugcgcggcgc

SEQ ID NO: 356651 - RNA, 18 nt, Bordetella pertussis
gccggugcgcggcgcccc

SEQ ID NO: 356652 - RNA, 15 nt, Bordetella pertussis
gccggugcgcggcuu

SEQ ID NO: 356653 - RNA, 22 nt, Bordetella pertussis
gccgguucgaugaccugggccu

SEQ ID NO: 356654 - RNA, 22 nt, Bordetella pertussis
gccgguucggucgacgacggca

SEQ ID NO: 356655 - RNA, 15 nt, Bordetella pertussis
gccgguugcgcgccg

SEQ ID NO: 356656 - RNA, 17 nt, Bordetella pertussis
gccgguuucggccugca

SEQ ID NO: 356657 - RNA, 22 nt, Bordetella pertussis
gccgguuucggccugcaggccc

SEQ ID NO: 356658 - RNA, 21 nt, Bordetella pertussis
gccgguuuuuuugcgccgcua

SEQ ID NO: 356659 - RNA, 15 nt, Bordetella pertussis
gccguaaccggccag

SEQ ID NO: 356660 - RNA, 14 nt, Bordetella pertussis
gccguaauccaggc

SEQ ID NO: 356661 - RNA, 17 nt, Bordetella pertussis
gccguaccaguacaccg

SEQ ID NO: 356662 - RNA, 21 nt, Bordetella pertussis
gccguaccaguacaccggcgu

SEQ ID NO: 356663 - RNA, 16 nt, Bordetella pertussis
gccguacauggccagg

SEQ ID NO: 356664 - RNA, 19 nt, Bordetella pertussis
gccguagccgcugcgcgcg

SEQ ID NO: 356665 - RNA, 14 nt, Bordetella pertussis
gccguagcgcgcca

SEQ ID NO: 356666 - RNA, 15 nt, Bordetella pertussis
gccguagcgcgccag

SEQ ID NO: 356667 - RNA, 16 nt, Bordetella pertussis
gccguagcgcgccagc

SEQ ID NO: 356668 - RNA, 20 nt, Bordetella pertussis
gccguagcgcguggccagca

SEQ ID NO: 356669 - RNA, 22 nt, Bordetella pertussis
gccguagcgcguggccagcacg

SEQ ID NO: 356670 - RNA, 21 nt, Bordetella pertussis
gccguagcguuggcggccggc

SEQ ID NO: 356671 - RNA, 22 nt, Bordetella pertussis
gccguagcguuggcggccggcc

SEQ ID NO: 356672 - RNA, 23 nt, Bordetella pertussis
gccguagcguuggcggccggcca

SEQ ID NO: 356673 - RNA, 14 nt, Bordetella pertussis
gccguaggacagcc

SEQ ID NO: 356674 - RNA, 17 nt, Bordetella pertussis
gccguaggugcgcgcca

SEQ ID NO: 356675 - RNA, 13 nt, Bordetella pertussis
gccguaggcgccg

SEQ ID NO: 356676 - RNA, 19 nt, Bordetella pertussis
gccguaggguucgccgcug

SEQ ID NO: 356677 - RNA, 19 nt, Bordetella pertussis
gccgucaccgccgccgcgc

SEQ ID NO: 356678 - RNA, 15 nt, Bordetella pertussis
gccgucaccggcuac

SEQ ID NO: 356679 - RNA, 19 nt, Bordetella pertussis
gccgucgacgucggugacg

SEQ ID NO: 356680 - RNA, 19 nt, Bordetella pertussis
gccgucgagccgggcgccg

SEQ ID NO: 356681 - RNA, 15 nt, Bordetella pertussis
gccgucgagcgcggc

SEQ ID NO: 356682 - RNA, 19 nt, Bordetella pertussis
gccgucgagcgcggccagg

SEQ ID NO: 356683 - RNA, 20 nt, Bordetella pertussis
gccgucgagcgcggccaggc

SEQ ID NO: 356684 - RNA, 22 nt, Bordetella pertussis
gccgucgagcgcggccaggcgc

SEQ ID NO: 356685 - RNA, 24 nt, Bordetella pertussis
gccgucgagcgcggccaggcgcgu

SEQ ID NO: 356686 - RNA, 20 nt, Bordetella pertussis
gccgucgagcugcucgagca

SEQ ID NO: 356687 - RNA, 22 nt, Bordetella pertussis
gccgucgagcugcucgagcaug

SEQ ID NO: 356688 - RNA, 16 nt, Bordetella pertussis
gccgucgccuucggcg

SEQ ID NO: 356689 - RNA, 22 nt, Bordetella pertussis
gccgucgccuucggcggcgaug

SEQ ID NO: 356690 - RNA, 13 nt, Bordetella pertussis
gccgucgcgcacc

SEQ ID NO: 356691 - RNA, 15 nt, Bordetella pertussis
gccgucgcgcaccac

SEQ ID NO: 356692 - RNA, 20 nt, Bordetella pertussis
gccgucgcgcaccaccuggc

SEQ ID NO: 356693 - RNA, 14 nt, Bordetella pertussis
gccgucgcgcucgg

SEQ ID NO: 356694 - RNA, 13 nt, Bordetella pertussis
gccgucgcgcugc

SEQ ID NO: 356695 - RNA, 19 nt, Bordetella pertussis
gccgucgcgcugcaggcgu

SEQ ID NO: 356696 - RNA, 15 nt, Bordetella pertussis
gccgucgcuggggcg

SEQ ID NO: 356697 - RNA, 14 nt, Bordetella pertussis
gccgucggcauggg

SEQ ID NO: 356698 - RNA, 21 nt, Bordetella pertussis
gccgucggccacguccggguu

SEQ ID NO: 356699 - RNA, 15 nt, Bordetella pertussis
gccgucggccagcuu

SEQ ID NO: 356700 - RNA, 13 nt, Bordetella pertussis
gccgucggccagg

SEQ ID NO: 356701 - RNA, 16 nt, Bordetella pertussis
gccgucggccgcgccc

SEQ ID NO: 356702 - RNA, 17 nt, Bordetella pertussis
gccgucggccgcgccca

SEQ ID NO: 356703 - RNA, 13 nt, Bordetella pertussis
gccgucggccugg

SEQ ID NO: 356704 - RNA, 15 nt, Bordetella pertussis
gccgucggccuggaa

SEQ ID NO: 356705 - RNA, 14 nt, Bordetella pertussis
gccgucggcgcugg

SEQ ID NO: 356706 - RNA, 15 nt, Bordetella pertussis
gccgucggcgcuggc

SEQ ID NO: 356707 - RNA, 17 nt, Bordetella pertussis
gccgucggcgcuggcgc

SEQ ID NO: 356708 - RNA, 16 nt, Bordetella pertussis
gccgucgugcagcgug

SEQ ID NO: 356709 - RNA, 13 nt, Bordetella pertussis
gccgucgugcgcc

SEQ ID NO: 356710 - RNA, 19 nt, Bordetella pertussis
gccgucgugcgccuggcgg

SEQ ID NO: 356711 - RNA, 21 nt, Bordetella pertussis
gccgucgugcgccuggcggcu

SEQ ID NO: 356712 - RNA, 20 nt, Bordetella pertussis
gccgucguugacggggacgc

SEQ ID NO: 356713 - RNA, 14 nt, Bordetella pertussis
gccgucuacaggcc

SEQ ID NO: 356714 - RNA, 23 nt, Bordetella pertussis
gccgucuacaggcccagcgccag

SEQ ID NO: 356715 - RNA, 15 nt, Bordetella pertussis
gccgugagcgccgcc

SEQ ID NO: 356716 - RNA, 18 nt, Bordetella pertussis
gccgugaugccgcccgca

SEQ ID NO: 356717 - RNA, 20 nt, Bordetella pertussis
gccgugaugccgcccgcaug

SEQ ID NO: 356718 - RNA, 19 nt, Bordetella pertussis
gccgugaucuugaugccgc

SEQ ID NO: 356719 - RNA, 20 nt, Bordetella pertussis
gccgugaucuugaugccgcc

SEQ ID NO: 356720 - RNA, 22 nt, Bordetella pertussis
gccgugaucuugaugccgccca

SEQ ID NO: 356721 - RNA, 18 nt, Bordetella pertussis
gccgugcagacggcggcu

SEQ ID NO: 356722 - RNA, 14 nt, Bordetella pertussis
gccgugcagauggc

SEQ ID NO: 356723 - RNA, 13 nt, Bordetella pertussis
gccgugcaggccc

SEQ ID NO: 356724 - RNA, 14 nt, Bordetella pertussis
gccgugcaggcccg

SEQ ID NO: 356725 - RNA, 15 nt, Bordetella pertussis
gccgugcaggcccgg

SEQ ID NO: 356726 - RNA, 16 nt, Bordetella pertussis
gccgugcaggcccggg

SEQ ID NO: 356727 - RNA, 20 nt, Bordetella pertussis
gccgugcaggcccgggcgcc

SEQ ID NO: 356728 - RNA, 14 nt, Bordetella pertussis
gccgugcagggcca

SEQ ID NO: 356729 - RNA, 19 nt, Bordetella pertussis
gccgugcccggcgggccgc

SEQ ID NO: 356730 - RNA, 13 nt, Bordetella pertussis
gccgugccgcccg

SEQ ID NO: 356731 - RNA, 19 nt, Bordetella pertussis
gccgugccgcccgguucgc

SEQ ID NO: 356732 - RNA, 15 nt, Bordetella pertussis
gccgugccgcgcgca

SEQ ID NO: 356733 - RNA, 18 nt, Bordetella pertussis
gccgugccgcgcgcaccg

SEQ ID NO: 356734 - RNA, 20 nt, Bordetella pertussis
gccgugccgcgcgcaccggc

SEQ ID NO: 356735 - RNA, 18 nt, Bordetella pertussis
gccgugcccgagggcgcg

SEQ ID NO: 356736 - RNA, 22 nt, Bordetella pertussis
gccguggcccagccgcaugccg

SEQ ID NO: 356737 - RNA, 16 nt, Bordetella pertussis
gccguggccggcaucg

SEQ ID NO: 356738 - RNA, 17 nt, Bordetella pertussis
gccguggccgggcccgg

SEQ ID NO: 356739 - RNA, 13 nt, Bordetella pertussis
gccguggcgcacc

SEQ ID NO: 356740 - RNA, 14 nt, Bordetella pertussis
gccguggcgcacca

SEQ ID NO: 356741 - RNA, 17 nt, Bordetella pertussis
gccguggcgcaccaggu

SEQ ID NO: 356742 - RNA, 15 nt, Bordetella pertussis
gccguggcggccaca

SEQ ID NO: 356743 - RNA, 19 nt, Bordetella pertussis
gccguggcggccugcgccg

SEQ ID NO: 356744 - RNA, 20 nt, Bordetella pertussis
gccguggcggccugcgccgg

SEQ ID NO: 356745 - RNA, 21 nt, Bordetella pertussis
gccguggcggccugcgccggc

SEQ ID NO: 356746 - RNA, 22 nt, Bordetella pertussis
gccguggcggccugcgccggca

SEQ ID NO: 356747 - RNA, 21 nt, Bordetella pertussis
gccguggcggguccacguggc

SEQ ID NO: 356748 - RNA, 16 nt, Bordetella pertussis
gccguggcgugcaggc

SEQ ID NO: 356749 - RNA, 20 nt, Bordetella pertussis
gccguguucgagcaggcgcg

SEQ ID NO: 356750 - RNA, 22 nt, Bordetella pertussis
gccguguucgagcaggcgcgcg

SEQ ID NO: 356751 - RNA, 15 nt, Bordetella pertussis
gccguguuguccugg

SEQ ID NO: 356752 - RNA, 21 nt, Bordetella pertussis
gccguucaugccgaccacggc

SEQ ID NO: 356753 - RNA, 15 nt, Bordetella pertussis
gccguuccagcugcu

SEQ ID NO: 356754 - RNA, 16 nt, Bordetella pertussis
gccguuccaguccagc

SEQ ID NO: 356755 - RNA, 13 nt, Bordetella pertussis
gccguucggccag

SEQ ID NO: 356756 - RNA, 15 nt, Bordetella pertussis
gccguucggccagcg

SEQ ID NO: 356757 - RNA, 17 nt, Bordetella pertussis
gccguucggccagcgcg

SEQ ID NO: 356758 - RNA, 22 nt, Bordetella pertussis
gccguucggccagcgcgcggcg

SEQ ID NO: 356759 - RNA, 14 nt, Bordetella pertussis
gccguucggugcgc

SEQ ID NO: 356760 - RNA, 16 nt, Bordetella pertussis
gccguucggugcgcag

SEQ ID NO: 356761 - RNA, 20 nt, Bordetella pertussis
gccguucggugcgcagcggc

SEQ ID NO: 356762 - RNA, 13 nt, Bordetella pertussis
gccguucgucgcg

SEQ ID NO: 356763 - RNA, 16 nt, Bordetella pertussis
gccguucgucgcgcag

SEQ ID NO: 356764 - RNA, 17 nt, Bordetella pertussis
gccguucgucgcgcagc

SEQ ID NO: 356765 - RNA, 18 nt, Bordetella pertussis
gccguucgucgcgcagca

SEQ ID NO: 356766 - RNA, 16 nt, Bordetella pertussis
gccguuguccgccugc

SEQ ID NO: 356767 - RNA, 20 nt, Bordetella pertussis
gccguuguccuggcgcgcca

SEQ ID NO: 356768 - RNA, 21 nt, Bordetella pertussis
gccguuguccuggcgcgccag

SEQ ID NO: 356769 - RNA, 19 nt, Bordetella pertussis
gccguuuccucuggagacg

SEQ ID NO: 356770 - RNA, 18 nt, Bordetella pertussis
gccguuucucaacccgcc

SEQ ID NO: 356771 - RNA, 21 nt, Bordetella pertussis
gccguuucucaacccgccggc

SEQ ID NO: 356772 - RNA, 22 nt, Bordetella pertussis
gccguuucucaacccgccggcc

SEQ ID NO: 356773 - RNA, 23 nt, Bordetella pertussis
gccguuucucaacccgccggcca

SEQ ID NO: 356774 - RNA, 17 nt, Bordetella pertussis
gccguuuucagcgcagg

SEQ ID NO: 356775 - RNA, 20 nt, Bordetella pertussis
gccguuuucgaucagggcga

SEQ ID NO: 356776 - RNA, 17 nt, Bordetella pertussis
gccuacggcggcggcca

SEQ ID NO: 356777 - RNA, 20 nt, Bordetella pertussis
gccuacggcggcggccaucg

SEQ ID NO: 356778 - RNA, 16 nt, Bordetella pertussis
gccuacuggcgcgcgc

SEQ ID NO: 356779 - RNA, 18 nt, Bordetella pertussis
gccuacuggcgcgcgcaa

SEQ ID NO: 356780 - RNA, 16 nt, Bordetella pertussis
gccuagcccggcgcca

SEQ ID NO: 356781 - RNA, 16 nt, Bordetella pertussis
gccuaugaagacgcgc

SEQ ID NO: 356782 - RNA, 14 nt, Bordetella pertussis
gccuaugugcaggc

SEQ ID NO: 356783 - RNA, 16 nt, Bordetella pertussis
gccucaacuggccggc

SEQ ID NO: 356784 - RNA, 18 nt, Bordetella pertussis
gccucaacuggccggccu

SEQ ID NO: 356785 - RNA, 20 nt, Bordetella pertussis
gccucaacuggccggccugg

SEQ ID NO: 356786 - RNA, 23 nt, Bordetella pertussis
gccucacaugucacacgaagaac

SEQ ID NO: 356787 - RNA, 15 nt, Bordetella pertussis
gccucaccgcgccgg

SEQ ID NO: 356788 - RNA, 19 nt, Bordetella pertussis
gccucacuccauagcgccg

SEQ ID NO: 356789 - RNA, 13 nt, Bordetella pertussis
gccucagcccgcg

SEQ ID NO: 356790 - RNA, 14 nt, Bordetella pertussis
gccucagcccgcgu

SEQ ID NO: 356791 - RNA, 18 nt, Bordetella pertussis
gccucagcggccgcugcc

SEQ ID NO: 356792 - RNA, 19 nt, Bordetella pertussis
gccucagcggccgcugccg

SEQ ID NO: 356793 - RNA, 22 nt, Bordetella pertussis
gccucagcguuuccagggcgcg

SEQ ID NO: 356794 - RNA, 23 nt, Bordetella pertussis
gccucaucguucugcgucaaggc

SEQ ID NO: 356795 - RNA, 14 nt, Bordetella pertussis
gccucaugacgggg

SEQ ID NO: 356796 - RNA, 19 nt, Bordetella pertussis
gccucaugacggggccuuc

SEQ ID NO: 356797 - RNA, 12 nt, Bordetella pertussis
gccuccagcagg

SEQ ID NO: 356798 - RNA, 15 nt, Bordetella pertussis
gccuccagcgcggcg

SEQ ID NO: 356799 - RNA, 22 nt, Bordetella pertussis
gccuccagcuccagcgcgccga

SEQ ID NO: 356800 - RNA, 21 nt, Bordetella pertussis
gccuccaggaugagcgccugc

SEQ ID NO: 356801 - RNA, 16 nt, Bordetella pertussis
gccuccaggcgcaagc

SEQ ID NO: 356802 - RNA, 15 nt, Bordetella pertussis
gccuccaggcggcgg

SEQ ID NO: 356803 - RNA, 24 nt, Bordetella pertussis
gccuccaggcggcggugccagcgc

SEQ ID NO: 356804 - RNA, 18 nt, Bordetella pertussis
gccucccauugcgcggcc

SEQ ID NO: 356805 - RNA, 19 nt, Bordetella pertussis
gccucccauugcgcggcca

SEQ ID NO: 356806 - RNA, 20 nt, Bordetella pertussis
gccucccgccgcccggccgg

SEQ ID NO: 356807 - RNA, 19 nt, Bordetella pertussis
gccuccgcgcacagcgcgg

SEQ ID NO: 356808 - RNA, 14 nt, Bordetella pertussis
gccuccgcgccgac

SEQ ID NO: 356809 - RNA, 16 nt, Bordetella pertussis
gccuccgcgccgacca

SEQ ID NO: 356810 - RNA, 19 nt, Bordetella pertussis
gccuccugcagcaggucgg

SEQ ID NO: 356811 - RNA, 18 nt, Bordetella pertussis
gccucgaagcccggcagg

SEQ ID NO: 356812 - RNA, 18 nt, Bordetella pertussis
gccucgaagcggcucagg

SEQ ID NO: 356813 - RNA, 20 nt, Bordetella pertussis
gccucgaagcggcucaggcg

SEQ ID NO: 356814 - RNA, 23 nt, Bordetella pertussis
gccucgaagcggcucaggcgcgg

SEQ ID NO: 356815 - RNA, 17 nt, Bordetella pertussis
gccucgaugaaggugcg

SEQ ID NO: 356816 - RNA, 20 nt, Bordetella pertussis
gccucgaugcccucgcgcac

SEQ ID NO: 356817 - RNA, 14 nt, Bordetella pertussis
gccucgcaucggcc

SEQ ID NO: 356818 - RNA, 17 nt, Bordetella pertussis
gccucgcccgaucggcc

SEQ ID NO: 356819 - RNA, 15 nt, Bordetella pertussis
gccucgcccuggcgc

SEQ ID NO: 356820 - RNA, 15 nt, Bordetella pertussis
gccucgccggccugg

SEQ ID NO: 356821 - RNA, 16 nt, Bordetella pertussis
gccucgccggccuggc

SEQ ID NO: 356822 - RNA, 21 nt, Bordetella pertussis
gccucgccggccuggcgcgcg

SEQ ID NO: 356823 - RNA, 12 nt, Bordetella pertussis
gccucgccggcc

SEQ ID NO: 356824 - RNA, 14 nt, Bordetella pertussis
gccucgggcgcaac

SEQ ID NO: 356825 - RNA, 15 nt, Bordetella pertussis
gccucgggcgcaacg

SEQ ID NO: 356826 - RNA, 22 nt, Bordetella pertussis
gccucgggcgcaacgucgaaca

SEQ ID NO: 356827 - RNA, 16 nt, Bordetella pertussis
gccucggucagggugg

SEQ ID NO: 356828 - RNA, 13 nt, Bordetella pertussis
gccucgguccagc

SEQ ID NO: 356829 - RNA, 19 nt, Bordetella pertussis
gccucgguggucagguagc

SEQ ID NO: 356830 - RNA, 13 nt, Bordetella pertussis
gccucguaucgcc

SEQ ID NO: 356831 - RNA, 17 nt, Bordetella pertussis
gccucguaucgccugac

SEQ ID NO: 356832 - RNA, 19 nt, Bordetella pertussis
gccucguccucgucggcga

SEQ ID NO: 356833 - RNA, 18 nt, Bordetella pertussis
gccucguccugcaggcgg

SEQ ID NO: 356834 - RNA, 21 nt, Bordetella pertussis
gccucguccugcaggcggcgc

SEQ ID NO: 356835 - RNA, 20 nt, Bordetella pertussis
gccucgucgaccacgccggc

SEQ ID NO: 356836 - RNA, 21 nt, Bordetella pertussis
gccucgucgaccacgccggcg

SEQ ID NO: 356837 - RNA, 16 nt, Bordetella pertussis
gccucgucgcgcaacg

SEQ ID NO: 356838 - RNA, 17 nt, Bordetella pertussis
gccucgucgcgcaacgc

SEQ ID NO: 356839 - RNA, 21 nt, Bordetella pertussis
gccucgucgcgcaacgccggg

SEQ ID NO: 356840 - RNA, 18 nt, Bordetella pertussis
gccucgugcugcugcagg

SEQ ID NO: 356841 - RNA, 20 nt, Bordetella pertussis
gccucgugcugcugcaggcg

SEQ ID NO: 356842 - RNA, 23 nt, Bordetella pertussis
gccucgugcugcugcaggcgcgg

SEQ ID NO: 356843 - RNA, 20 nt, Bordetella pertussis
gccucgugcgaggccacggc

SEQ ID NO: 356844 - RNA, 17 nt, Bordetella pertussis
gccucguucaugucgcg

SEQ ID NO: 356845 - RNA, 16 nt, Bordetella pertussis
gccucguuggucagca

SEQ ID NO: 356846 - RNA, 23 nt, Bordetella pertussis
gccucuucgaugaugagcgcgcc

SEQ ID NO: 356847 - RNA, 17 nt, Bordetella pertussis
gccucuucgucgccggc

SEQ ID NO: 356848 - RNA, 20 nt, Bordetella pertussis
gccugagcacaugcccggcc

SEQ ID NO: 356849 - RNA, 15 nt, Bordetella pertussis
gccugagcaccgccg

SEQ ID NO: 356850 - RNA, 16 nt, Bordetella pertussis
gccugagcaccgccgc

SEQ ID NO: 356851 - RNA, 21 nt, Bordetella pertussis
gccugagccgauacaggcgcu

SEQ ID NO: 356852 - RNA, 23 nt, Bordetella pertussis
gccugagccgauacaggcgcucg

SEQ ID NO: 356853 - RNA, 21 nt, Bordetella pertussis
gccugagcugccaggcuaucg

SEQ ID NO: 356854 - RNA, 18 nt, Bordetella pertussis
gccugcaaguccagcgug

SEQ ID NO: 356855 - RNA, 14 nt, Bordetella pertussis
gccugcaaugcggc

SEQ ID NO: 356856 - RNA, 16 nt, Bordetella pertussis
gccugcaaugcggcca

SEQ ID NO: 356857 - RNA, 17 nt, Bordetella pertussis
gccugcaaugcggccag

SEQ ID NO: 356858 - RNA, 22 nt, Bordetella pertussis
gccugcaaugcggccaggcccg

SEQ ID NO: 356859 - RNA, 13 nt, Bordetella pertussis
gccugcaccgccg

SEQ ID NO: 356860 - RNA, 22 nt, Bordetella pertussis
gccugcacgaccugcgcaugcg

SEQ ID NO: 356861 - RNA, 23 nt, Bordetella pertussis
gccugcacgacgggauugccguc

SEQ ID NO: 356862 - RNA, 20 nt, Bordetella pertussis
gccugcacgcucuugagcgc

SEQ ID NO: 356863 - RNA, 16 nt, Bordetella pertussis
gccugcagaccagcac

SEQ ID NO: 356864 - RNA, 19 nt, Bordetella pertussis
gccugcagcacggccacgg

SEQ ID NO: 356865 - RNA, 23 nt, Bordetella pertussis
gccugcagcacggccacggccgg

SEQ ID NO: 356866 - RNA, 12 nt, Bordetella pertussis
gccugcagcagc

SEQ ID NO: 356867 - RNA, 14 nt, Bordetella pertussis
gccugcagcagcgc

SEQ ID NO: 356868 - RNA, 20 nt, Bordetella pertussis
gccugcagcaugaccgacag

SEQ ID NO: 356869 - RNA, 13 nt, Bordetella pertussis
gccugcagcgccg

SEQ ID NO: 356870 - RNA, 16 nt, Bordetella pertussis
gccugcagcgccgccu

SEQ ID NO: 356871 - RNA, 13 nt, Bordetella pertussis
gccugcagcgcgc

SEQ ID NO: 356872 - RNA, 14 nt, Bordetella pertussis
gccugcagcgcgcg

SEQ ID NO: 356873 - RNA, 21 nt, Bordetella pertussis
gccugcaggaagccugcgcgc

SEQ ID NO: 356874 - RNA, 22 nt, Bordetella pertussis
gccugcaggaagccugcgcgcg

SEQ ID NO: 356875 - RNA, 15 nt, Bordetella pertussis
gccugcaggaugggc

SEQ ID NO: 356876 - RNA, 14 nt, Bordetella pertussis
gccugcaggcccag

SEQ ID NO: 356877 - RNA, 16 nt, Bordetella pertussis
gccugcaggcccagca

SEQ ID NO: 356878 - RNA, 12 nt, Bordetella pertussis
gccugcaggccg

SEQ ID NO: 356879 - RNA, 13 nt, Bordetella pertussis
gccugcaggccgu

SEQ ID NO: 356880 - RNA, 22 nt, Bordetella pertussis
gccugcaggcucuugaccagcu

SEQ ID NO: 356881 - RNA, 15 nt, Bordetella pertussis
gccugcaggugccgc

SEQ ID NO: 356882 - RNA, 18 nt, Bordetella pertussis
gccugcaggugccgccgg

SEQ ID NO: 356883 - RNA, 14 nt, Bordetella pertussis
gccugcaguucggc

SEQ ID NO: 356884 - RNA, 17 nt, Bordetella pertussis
gccugcaguucggccgc

SEQ ID NO: 356885 - RNA, 18 nt, Bordetella pertussis
gccugcaucacgguaggc

SEQ ID NO: 356886 - RNA, 21 nt, Bordetella pertussis
gccugcaucacgguaggcgcg

SEQ ID NO: 356887 - RNA, 20 nt, Bordetella pertussis
gccugcaugccauagucgcg

SEQ ID NO: 356888 - RNA, 19 nt, Bordetella pertussis
gccugcauguccagcggcg

SEQ ID NO: 356889 - RNA, 19 nt, Bordetella pertussis
gccugcaugucguacaggc

SEQ ID NO: 356890 - RNA, 18 nt, Bordetella pertussis
gccugccacaucgaaggc

SEQ ID NO: 356891 - RNA, 14 nt, Bordetella pertussis
gccugccaccagcg

SEQ ID NO: 356892 - RNA, 16 nt, Bordetella pertussis
gccugccaccagcgcg

SEQ ID NO: 356893 - RNA, 19 nt, Bordetella pertussis
gccugccaccagcgcgcca

SEQ ID NO: 356894 - RNA, 19 nt, Bordetella pertussis
gccugccaccgacaagccg

SEQ ID NO: 356895 - RNA, 19 nt, Bordetella pertussis
gccugugccagcuggccca

SEQ ID NO: 356896 - RNA, 23 nt, Bordetella pertussis
gccuguucgcggugucgcaccgc

SEQ ID NO: 356897 - RNA, 15 nt, Bordetella pertussis
gccuguucggacgca

SEQ ID NO: 356898 - RNA, 14 nt, Bordetella pertussis
gccuguucggccgg

SEQ ID NO: 356899 - RNA, 23 nt, Bordetella pertussis
gccuguucccgccgggccaaggu

SEQ ID NO: 356900 - RNA, 22 nt, Bordetella pertussis
gccuucaccccgccaccgcccc

SEQ ID NO: 356901 - RNA, 18 nt, Bordetella pertussis
gccuucagguucaugacc

SEQ ID NO: 356902 - RNA, 16 nt, Bordetella pertussis
gccuuccaccagccgu

SEQ ID NO: 356903 - RNA, 17 nt, Bordetella pertussis
gccuucggcgcgcacgc

SEQ ID NO: 356904 - RNA, 17 nt, Bordetella pertussis
gccuucggcgcgcgccg

SEQ ID NO: 356905 - RNA, 19 nt, Bordetella pertussis
gccuucggcgcgcgccggc

SEQ ID NO: 356906 - RNA, 15 nt, Bordetella pertussis
gccuucggcgcggcg

SEQ ID NO: 356907 - RNA, 19 nt, Bordetella pertussis
gccuucggcggcgcgcugg

SEQ ID NO: 356908 - RNA, 14 nt, Bordetella pertussis
gccuucggcggcgg

SEQ ID NO: 356909 - RNA, 14 nt, Bordetella pertussis
gccuucccaggcga

SEQ ID NO: 356910 - RNA, 14 nt, Bordetella pertussis
gccuucggguugca

SEQ ID NO: 356911 - RNA, 21 nt, Bordetella pertussis
gccuucguaaacaucgcgcau

SEQ ID NO: 356912 - RNA, 17 nt, Bordetella pertussis
gccuucguccugccauu

SEQ ID NO: 356913 - RNA, 16 nt, Bordetella pertussis
gccuucgucgagguca

SEQ ID NO: 356914 - RNA, 22 nt, Bordetella pertussis
gccuucgucgaggucagcggcu

SEQ ID NO: 356915 - RNA, 21 nt, Bordetella pertussis
gccuucgucgcgcacccgcag

SEQ ID NO: 356916 - RNA, 21 nt, Bordetella pertussis
gccuucguugaccgcuuccga

SEQ ID NO: 356917 - RNA, 16 nt, Bordetella pertussis
gccuucugcgccagcg

SEQ ID NO: 356918 - RNA, 11 nt, Bordetella pertussis
gccuucuugaa

SEQ ID NO: 356919 - RNA, 23 nt, Bordetella pertussis
gccuucuucacguagccggccag

SEQ ID NO: 356920 - RNA, 14 nt, Bordetella pertussis
gccuugacgguggc

SEQ ID NO: 356921 - RNA, 17 nt, Bordetella pertussis
gccuugacgguggccgc

SEQ ID NO: 356922 - RNA, 16 nt, Bordetella pertussis
gccuugagcaucugcg

SEQ ID NO: 356923 - RNA, 15 nt, Bordetella pertussis
gccuugcccaggcug

SEQ ID NO: 356924 - RNA, 16 nt, Bordetella pertussis
gccuugcccaggcugg

SEQ ID NO: 356925 - RNA, 13 nt, Bordetella pertussis
gccuugcccgggc

SEQ ID NO: 356926 - RNA, 17 nt, Bordetella pertussis
gccuugccgccgcgcag

SEQ ID NO: 356927 - RNA, 18 nt, Bordetella pertussis
gccuugccgccgcgcagg

SEQ ID NO: 356928 - RNA, 19 nt, Bordetella pertussis
gccuugcccuuggcggccu

SEQ ID NO: 356929 - RNA, 20 nt, Bordetella pertussis
gccuugccgguggacggcca

SEQ ID NO: 356930 - RNA, 19 nt, Bordetella pertussis
gccuugccuugcgcggcca

SEQ ID NO: 356931 - RNA, 21 nt, Bordetella pertussis
gccuugcgcgacagcaggccg

SEQ ID NO: 356932 - RNA, 14 nt, Bordetella pertussis
gccuugcgcggcca

SEQ ID NO: 356933 - RNA, 17 nt, Bordetella pertussis
gccuugcgcggccagca

SEQ ID NO: 356934 - RNA, 23 nt, Bordetella pertussis
gccuugcgcuuuuuucuccagcg

SEQ ID NO: 356935 - RNA, 17 nt, Bordetella pertussis
gccuugcgggccggcug

SEQ ID NO: 356936 - RNA, 16 nt, Bordetella pertussis
gccuugcuccggcgug

SEQ ID NO: 356937 - RNA, 17 nt, Bordetella pertussis
gccuugcucgaccaggu

SEQ ID NO: 356938 - RNA, 23 nt, Bordetella pertussis
gccuugcucgcccauggcaucga

SEQ ID NO: 356939 - RNA, 23 nt, Bordetella pertussis
gccuugcugaaccugcuggccgc

SEQ ID NO: 356940 - RNA, 17 nt, Bordetella pertussis
gccuugcugcccgacgg

SEQ ID NO: 356941 - RNA, 19 nt, Bordetella pertussis
gccuuggcaucgaccacgc

SEQ ID NO: 356942 - RNA, 13 nt, Bordetella pertussis
gccuuggccagca

SEQ ID NO: 356943 - RNA, 14 nt, Bordetella pertussis
gccuuggccagcag

SEQ ID NO: 356944 - RNA, 21 nt, Bordetella pertussis
gccuuggccagcagcgcaucg

SEQ ID NO: 356945 - RNA, 17 nt, Bordetella pertussis
gccuuggccgcagccgg

SEQ ID NO: 356946 - RNA, 15 nt, Bordetella pertussis
gccuuggccugggcg

SEQ ID NO: 356947 - RNA, 22 nt, Bordetella pertussis
gccuuggcgaauggccacggcu

SEQ ID NO: 356948 - RNA, 14 nt, Bordetella pertussis
gccuuggcgcgcag

SEQ ID NO: 356949 - RNA, 17 nt, Bordetella pertussis
gccuuggcgcgcagacg

SEQ ID NO: 356950 - RNA, 21 nt, Bordetella pertussis
gccuugggcgcggcggccugg

SEQ ID NO: 356951 - RNA, 15 nt, Bordetella pertussis
gccuuggggcggccc

SEQ ID NO: 356952 - RNA, 19 nt, Bordetella pertussis
gccuuggggcggcccagcg

SEQ ID NO: 356953 - RNA, 19 nt, Bordetella pertussis
gccuuggggcggcccggcg

SEQ ID NO: 356954 - RNA, 23 nt, Bordetella pertussis
gccuuggucgcgaccucggcggc

SEQ ID NO: 356955 - RNA, 14 nt, Bordetella pertussis
gccuugugcgccag

SEQ ID NO: 356956 - RNA, 18 nt, Bordetella pertussis
gccuugugcgccagcgcg

SEQ ID NO: 356957 - RNA, 16 nt, Bordetella pertussis
gccuuguucgcgcgcg

SEQ ID NO: 356958 - RNA, 15 nt, Bordetella pertussis
gcgaaaacccgcggc

SEQ ID NO: 356959 - RNA, 13 nt, Bordetella pertussis
gcgaaacgccagc

SEQ ID NO: 356960 - RNA, 15 nt, Bordetella pertussis
gcgaaacggccagcg

SEQ ID NO: 356961 - RNA, 21 nt, Bordetella pertussis
gcgaaacggcgggcgcgcagg

SEQ ID NO: 356962 - RNA, 17 nt, Bordetella pertussis
gcgaaagccggccuccg

SEQ ID NO: 356963 - RNA, 21 nt, Bordetella pertussis
gcgaaagcgcugcgccgcggc

SEQ ID NO: 356964 - RNA, 14 nt, Bordetella pertussis
gcgaaagcggccag

SEQ ID NO: 356965 - RNA, 12 nt, Bordetella pertussis
gcgaaagcggcg

SEQ ID NO: 356966 - RNA, 15 nt, Bordetella pertussis
gcgaaagcggcgugu

SEQ ID NO: 356967 - RNA, 16 nt, Bordetella pertussis
gcgaaauccagcgcgc

SEQ ID NO: 356968 - RNA, 17 nt, Bordetella pertussis
gcgaaauccagcgcgcc

SEQ ID NO: 356969 - RNA, 23 nt, Bordetella pertussis
gcgaaaucuucugcgccacggcg

SEQ ID NO: 356970 - RNA, 13 nt, Bordetella pertussis
gcgaaauggcggc

SEQ ID NO: 356971 - RNA, 18 nt, Bordetella pertussis
gcgaaauggcggccucgg

SEQ ID NO: 356972 - RNA, 18 nt, Bordetella pertussis
gcgaacaacgggaucggc

SEQ ID NO: 356973 - RNA, 19 nt, Bordetella pertussis
gcgaacaacgggaucggcg

SEQ ID NO: 356974 - RNA, 12 nt, Bordetella pertussis
gcgaacaccagg

SEQ ID NO: 356975 - RNA, 14 nt, Bordetella pertussis
gcgaacaccggcag

SEQ ID NO: 356976 - RNA, 21 nt, Bordetella pertussis
gcgaacaccggcaggccgcgc

SEQ ID NO: 356977 - RNA, 22 nt, Bordetella pertussis
gcgaacaccggcaggccgcgcu

SEQ ID NO: 356978 - RNA, 14 nt, Bordetella pertussis
gcgaacagggcgcg

SEQ ID NO: 356979 - RNA, 15 nt, Bordetella pertussis
gcgaacagggcgcga

SEQ ID NO: 356980 - RNA, 21 nt, Bordetella pertussis
gcgaacagggcgcgacgccag

SEQ ID NO: 356981 - RNA, 22 nt, Bordetella pertussis
gcgaacaguugcaccagugcgc

SEQ ID NO: 356982 - RNA, 14 nt, Bordetella pertussis
gcgaaccaggccug

SEQ ID NO: 356983 - RNA, 15 nt, Bordetella pertussis
gcgaacccgaucgcg

SEQ ID NO: 356984 - RNA, 15 nt, Bordetella pertussis
gcgaaccgguggcca

SEQ ID NO: 356985 - RNA, 13 nt, Bordetella pertussis
gcgaacgcccggc

SEQ ID NO: 356986 - RNA, 14 nt, Bordetella pertussis
gcgaacgcccggcc

SEQ ID NO: 356987 - RNA, 19 nt, Bordetella pertussis
gcgaacgcccggcccaggc

SEQ ID NO: 356988 - RNA, 17 nt, Bordetella pertussis
gcgaacgcgcgccggcc

SEQ ID NO: 356989 - RNA, 23 nt, Bordetella pertussis
gcgaacgcgcgccggccagcggc

SEQ ID NO: 356990 - RNA, 15 nt, Bordetella pertussis
gcgaacgcgccggcc

SEQ ID NO: 356991 - RNA, 21 nt, Bordetella pertussis
gcgaacggauggucgugcggc

SEQ ID NO: 356992 - RNA, 21 nt, Bordetella pertussis
gcgaacggcagcuugucgauc

SEQ ID NO: 356993 - RNA, 14 nt, Bordetella pertussis
gcgaacggcccacg

SEQ ID NO: 356994 - RNA, 13 nt, Bordetella pertussis
gcgaacggccgcc

SEQ ID NO: 356995 - RNA, 16 nt, Bordetella pertussis
gcgaacggccgcccgg

SEQ ID NO: 356996 - RNA, 18 nt, Bordetella pertussis
gcgaacggccgcccggca

SEQ ID NO: 356997 - RNA, 13 nt, Bordetella pertussis
gcgaacggcgggc

SEQ ID NO: 356998 - RNA, 14 nt, Bordetella pertussis
gcgaacgggcagcc

SEQ ID NO: 356999 - RNA, 18 nt, Bordetella pertussis
gcgaacgggguggccggc

SEQ ID NO: 357000 - RNA, 14 nt, Bordetella pertussis
gcgaacgugcgcgc

SEQ ID NO: 357001 - RNA, 15 nt, Bordetella pertussis
gcgaacgugcgcgcc

SEQ ID NO: 357002 - RNA, 16 nt, Bordetella pertussis
gcgaacgugcgcgcca

SEQ ID NO: 357003 - RNA, 22 nt, Bordetella pertussis
gcgaacuccauuucgugcguga

SEQ ID NO: 357004 - RNA, 13 nt, Bordetella pertussis
gcgaacugggcgu

SEQ ID NO: 357005 - RNA, 17 nt, Bordetella pertussis
gcgaacugggcgucguc

SEQ ID NO: 357006 - RNA, 23 nt, Bordetella pertussis
gcgaacugggcgucguccugcag

SEQ ID NO: 357007 - RNA, 21 nt, Bordetella pertussis
gcgaagaccgugaucggcgca

SEQ ID NO: 357008 - RNA, 23 nt, Bordetella pertussis
gcgaagaccgugaucggcgcaac

SEQ ID NO: 357009 - RNA, 14 nt, Bordetella pertussis
gcgaagacgauggc

SEQ ID NO: 357010 - RNA, 15 nt, Bordetella pertussis
gcgaagacgauggcg

SEQ ID NO: 357011 - RNA, 14 nt, Bordetella pertussis
gcgaagcagccggc

SEQ ID NO: 357012 - RNA, 17 nt, Bordetella pertussis
gcgaagccaucgacaag

SEQ ID NO: 357013 - RNA, 14 nt, Bordetella pertussis
gcgaagccggcacg

SEQ ID NO: 357014 - RNA, 18 nt, Bordetella pertussis
gcgaagccuugcgcggcc

SEQ ID NO: 357015 - RNA, 12 nt, Bordetella pertussis
gcgaagcgcccu

SEQ ID NO: 357016 - RNA, 13 nt, Bordetella pertussis
gcgaagcgcgccu

SEQ ID NO: 357017 - RNA, 22 nt, Bordetella pertussis
gcgaagcggaaacgcgcgcgcc

SEQ ID NO: 357018 - RNA, 15 nt, Bordetella pertussis
gcgaaggccagcgcc

SEQ ID NO: 357019 - RNA, 14 nt, Bordetella pertussis
gcgaaggccgcccc

SEQ ID NO: 357020 - RNA, 13 nt, Bordetella pertussis
gcgaaggcgucgg

SEQ ID NO: 357021 - RNA, 18 nt, Bordetella pertussis
gcgaaggcgucggccaug

SEQ ID NO: 357022 - RNA, 23 nt, Bordetella pertussis
gcgaaggcgucggccauggcgcu

SEQ ID NO: 357023 - RNA, 18 nt, Bordetella pertussis
gcgaaggugcggaucacg

SEQ ID NO: 357024 - RNA, 21 nt, Bordetella pertussis
gcgaagugcccgcuggccaug

SEQ ID NO: 357025 - RNA, 20 nt, Bordetella pertussis
gcgaauaugcccucuucggc

SEQ ID NO: 357026 - RNA, 19 nt, Bordetella pertussis
gcgaaucaguucgcgcagg

SEQ ID NO: 357027 - RNA, 15 nt, Bordetella pertussis
gcgaauccaccggcg

SEQ ID NO: 357028 - RNA, 21 nt, Bordetella pertussis
gcgaaugcgacagcgacagcc

SEQ ID NO: 357029 - RNA, 14 nt, Bordetella pertussis
gcgaaugcguguuc

SEQ ID NO: 357030 - RNA, 17 nt, Bordetella pertussis
gcgacaaccgcggcgac

SEQ ID NO: 357031 - RNA, 21 nt, Bordetella pertussis
gcgacagcaaugacgacgccg

SEQ ID NO: 357032 - RNA, 13 nt, Bordetella pertussis
gcgacagcagcau

SEQ ID NO: 357033 - RNA, 16 nt, Bordetella pertussis
gcgacagcaggccggu

SEQ ID NO: 357034 - RNA, 17 nt, Bordetella pertussis
gcgacagcaggccgguc

SEQ ID NO: 357035 - RNA, 16 nt, Bordetella pertussis
gcgacagcagggccag

SEQ ID NO: 357036 - RNA, 18 nt, Bordetella pertussis
gcgacagcagggccaggc

SEQ ID NO: 357037 - RNA, 13 nt, Bordetella pertussis
gcgacagccaggc

SEQ ID NO: 357038 - RNA, 16 nt, Bordetella pertussis
gcgacagccaggccag

SEQ ID NO: 357039 - RNA, 17 nt, Bordetella pertussis
gcgacagccaggccagc

SEQ ID NO: 357040 - RNA, 18 nt, Bordetella pertussis
gcgacagccaggccagcg

SEQ ID NO: 357041 - RNA, 20 nt, Bordetella pertussis
gcgacagccaggccagcgcc

SEQ ID NO: 357042 - RNA, 15 nt, Bordetella pertussis
gcgacagccgcgcca

SEQ ID NO: 357043 - RNA, 18 nt, Bordetella pertussis
gcgacagccgcgccagcg

SEQ ID NO: 357044 - RNA, 21 nt, Bordetella pertussis
gcgacagcgacagccaggcca

SEQ ID NO: 357045 - RNA, 23 nt, Bordetella pertussis
gcgacaucgugcuguucggcgac

SEQ ID NO: 357046 - RNA, 16 nt, Bordetella pertussis
gcgacaugacgauggu

SEQ ID NO: 357047 - RNA, 15 nt, Bordetella pertussis
gcgacaugagcugcg

SEQ ID NO: 357048 - RNA, 16 nt, Bordetella pertussis
gcgacaugagcugcgc

SEQ ID NO: 357049 - RNA, 13 nt, Bordetella pertussis
gcgaccaggccca

SEQ ID NO: 357050 - RNA, 14 nt, Bordetella pertussis
gcgaccaggcccac

SEQ ID NO: 357051 - RNA, 18 nt, Bordetella pertussis
gcgaccaggcccauggcg

SEQ ID NO: 357052 - RNA, 19 nt, Bordetella pertussis
gcgaccaggcccauggcgu

SEQ ID NO: 357053 - RNA, 23 nt, Bordetella pertussis
gcgaccaggcccauggcguagcc

SEQ ID NO: 357054 - RNA, 21 nt, Bordetella pertussis
gcgaccagcuucugcgccugc

SEQ ID NO: 357055 - RNA, 12 nt, Bordetella pertussis
gcgacccguggc

SEQ ID NO: 357056 - RNA, 23 nt, Bordetella pertussis
gcgacccuuucauuucggcgccg

SEQ ID NO: 357057 - RNA, 14 nt, Bordetella pertussis
gcgaccgcgcggcg

SEQ ID NO: 357058 - RNA, 15 nt, Bordetella pertussis
gcgaccgcgcggcgc

SEQ ID NO: 357059 - RNA, 18 nt, Bordetella pertussis
gcgaccgcgcggcgcugc

SEQ ID NO: 357060 - RNA, 13 nt, Bordetella pertussis
gcgaccggcaccu

SEQ ID NO: 357061 - RNA, 15 nt, Bordetella pertussis
gcgaccggcgccggc

SEQ ID NO: 357062 - RNA, 12 nt, Bordetella pertussis
gcgaccggcggc

SEQ ID NO: 357063 - RNA, 14 nt, Bordetella pertussis
gcgaccggcggcac

SEQ ID NO: 357064 - RNA, 23 nt, Bordetella pertussis
gcgacgacuacgcgcuggcgcag

SEQ ID NO: 357065 - RNA, 15 nt, Bordetella pertussis
gcgacgagggcgcca

SEQ ID NO: 357066 - RNA, 21 nt, Bordetella pertussis
gcgacgcccagccugccggcg

SEQ ID NO: 357067 - RNA, 13 nt, Bordetella pertussis
gcgacgcgacacg

SEQ ID NO: 357068 - RNA, 21 nt, Bordetella pertussis
gcgacgcgcccucaguccagc

SEQ ID NO: 357069 - RNA, 13 nt, Bordetella pertussis
gcgacgcgccugc

SEQ ID NO: 357070 - RNA, 15 nt, Bordetella pertussis
gcgacgcgccugcgc

SEQ ID NO: 357071 - RNA, 19 nt, Bordetella pertussis
gcgacgcgccugcgcgcgg

SEQ ID NO: 357072 - RNA, 16 nt, Bordetella pertussis
gcgacgcgcgccggcg

SEQ ID NO: 357073 - RNA, 15 nt, Bordetella pertussis
gcgacgccguggugg

SEQ ID NO: 357074 - RNA, 16 nt, Bordetella pertussis
gcgacgccugcgccau

SEQ ID NO: 357075 - RNA, 14 nt, Bordetella pertussis
gcgacgcgcugccg

SEQ ID NO: 357076 - RNA, 15 nt, Bordetella pertussis
gcgacgcggcguacu

SEQ ID NO: 357077 - RNA, 15 nt, Bordetella pertussis
gcgacgcguagccga

SEQ ID NO: 357078 - RNA, 15 nt, Bordetella pertussis
gcgacgggcaccgac

SEQ ID NO: 357079 - RNA, 20 nt, Bordetella pertussis
gcgacggucaggggcaggcg

SEQ ID NO: 357080 - RNA, 21 nt, Bordetella pertussis
gcgacggucaggggcaggcgc

SEQ ID NO: 357081 - RNA, 17 nt, Bordetella pertussis
gcgacgguccugcgcgc

SEQ ID NO: 357082 - RNA, 19 nt, Bordetella pertussis
gcgacgguccugcgcgccg

SEQ ID NO: 357083 - RNA, 20 nt, Bordetella pertussis
gcgacgucccaggccgaagc

SEQ ID NO: 357084 - RNA, 21 nt, Bordetella pertussis
gcgacgucccaggccgaagcc

SEQ ID NO: 357085 - RNA, 16 nt, Bordetella pertussis
gcgacuccggccgggc

SEQ ID NO: 357086 - RNA, 20 nt, Bordetella pertussis
gcgacucgacgaacacgcgc

SEQ ID NO: 357087 - RNA, 22 nt, Bordetella pertussis
gcgacucgacgaacacgcgcgc

SEQ ID NO: 357088 - RNA, 14 nt, Bordetella pertussis
gcgacugcagcagg

SEQ ID NO: 357089 - RNA, 15 nt, Bordetella pertussis
gcgagaaaaucggcg

SEQ ID NO: 357090 - RNA, 19 nt, Bordetella pertussis
gcgagaaaaucggcgaucg

SEQ ID NO: 357091 - RNA, 17 nt, Bordetella pertussis
gcgagaacgcggccgcg

SEQ ID NO: 357092 - RNA, 18 nt, Bordetella pertussis
gcgagaacgcggccgcga

SEQ ID NO: 357093 - RNA, 15 nt, Bordetella pertussis
gcgagaauggcgcga

SEQ ID NO: 357094 - RNA, 21 nt, Bordetella pertussis
gcgagaccacgauggccggcg

SEQ ID NO: 357095 - RNA, 20 nt, Bordetella pertussis
gcgagcaaaggacacgcgcg

SEQ ID NO: 357096 - RNA, 14 nt, Bordetella pertussis
gcgagcacccgcag

SEQ ID NO: 357097 - RNA, 22 nt, Bordetella pertussis
gcgagcacccgcaggcggcugg

SEQ ID NO: 357098 - RNA, 19 nt, Bordetella pertussis
gcgagcacggccugcucgu

SEQ ID NO: 357099 - RNA, 16 nt, Bordetella pertussis
gcgagcacggcguggc

SEQ ID NO: 357100 - RNA, 13 nt, Bordetella pertussis
gcgagcgcagccg

SEQ ID NO: 357101 - RNA, 18 nt, Bordetella pertussis
gcgagcgccgccaggccg

SEQ ID NO: 357102 - RNA, 19 nt, Bordetella pertussis
gcgagcgccgccaggccgu

SEQ ID NO: 357103 - RNA, 22 nt, Bordetella pertussis
gcgagcgccgggcgccgcgccc

SEQ ID NO: 357104 - RNA, 15 nt, Bordetella pertussis
gcgagcgccucgcgc

SEQ ID NO: 357105 - RNA, 18 nt, Bordetella pertussis
gcgagcgcggcgcgcgcc

SEQ ID NO: 357106 - RNA, 20 nt, Bordetella pertussis
gcgagcgcggcgcgcgccag

SEQ ID NO: 357107 - RNA, 22 nt, Bordetella pertussis
gcgagcggcggccgcguccagc

SEQ ID NO: 357108 - RNA, 11 nt, Bordetella pertussis
gcgagcggcgu

SEQ ID NO: 357109 - RNA, 16 nt, Bordetella pertussis
gcgagcugcgcgaccu

SEQ ID NO: 357110 - RNA, 15 nt, Bordetella pertussis
gcgagcugcgcggcu

SEQ ID NO: 357111 - RNA, 13 nt, Bordetella pertussis
gcgagcuggugau

SEQ ID NO: 357112 - RNA, 21 nt, Bordetella pertussis
gcgagcuggugauggugucga

SEQ ID NO: 357113 - RNA, 19 nt, Bordetella pertussis
gcgaggccgcccgccccgg

SEQ ID NO: 357114 - RNA, 20 nt, Bordetella pertussis
gcgaggcgaacaggcacagg

SEQ ID NO: 357115 - RNA, 24 nt, Bordetella pertussis
gcgaggcgaugccccgguagucgc

SEQ ID NO: 357116 - RNA, 13 nt, Bordetella pertussis
gcgaggcgcaggc

SEQ ID NO: 357117 - RNA, 15 nt, Bordetella pertussis
gcgaggcgcgggcga

SEQ ID NO: 357118 - RNA, 16 nt, Bordetella pertussis
gcgaggcgcuggccgg

SEQ ID NO: 357119 - RNA, 13 nt, Bordetella pertussis
gcgaggcuggcgc

SEQ ID NO: 357120 - RNA, 17 nt, Bordetella pertussis
gcgaggcuggcgcccac

SEQ ID NO: 357121 - RNA, 19 nt, Bordetella pertussis
gcgaggcuggcgcccacgc

SEQ ID NO: 357122 - RNA, 22 nt, Bordetella pertussis
gcgaggcuuuuuuucgccgggc

SEQ ID NO: 357123 - RNA, 23 nt, Bordetella pertussis
gcgaggcuuuuuuucgccgggcg

SEQ ID NO: 357124 - RNA, 18 nt, Bordetella pertussis
gcgagggcaucagcgcga

SEQ ID NO: 357125 - RNA, 15 nt, Bordetella pertussis
gcgagugcgccccgc

SEQ ID NO: 357126 - RNA, 18 nt, Bordetella pertussis
gcgaguuguccuggccgg

SEQ ID NO: 357127 - RNA, 14 nt, Bordetella pertussis
gcgauagcgccgcg

SEQ ID NO: 357128 - RNA, 16 nt, Bordetella pertussis
gcgauagcgccgcgca

SEQ ID NO: 357129 - RNA, 18 nt, Bordetella pertussis
gcgauagcgccgcgcauc

SEQ ID NO: 357130 - RNA, 16 nt, Bordetella pertussis
gcgauaggcgaagcgc

SEQ ID NO: 357131 - RNA, 16 nt, Bordetella pertussis
gcgauaggugcgcagc

SEQ ID NO: 357132 - RNA, 18 nt, Bordetella pertussis
gcgauaggugcgcagccg

SEQ ID NO: 357133 - RNA, 20 nt, Bordetella pertussis
gcgcaauggacacagcggcg

SEQ ID NO: 357134 - RNA, 23 nt, Bordetella pertussis
gcgcaauggacacagcggcgcga

SEQ ID NO: 357135 - RNA, 22 nt, Bordetella pertussis
gcgauauccagguaggcggcgc

SEQ ID NO: 357136 - RNA, 13 nt, Bordetella pertussis
gcgcacacauggc

SEQ ID NO: 357137 - RNA, 15 nt, Bordetella pertussis
gcgcacaccaucagc

SEQ ID NO: 357138 - RNA, 17 nt, Bordetella pertussis
gcgcacacuggccagca

SEQ ID NO: 357139 - RNA, 13 nt, Bordetella pertussis
gcgcacagcgcgc

SEQ ID NO: 357140 - RNA, 18 nt, Bordetella pertussis
gcgcacagcgcggcgaug

SEQ ID NO: 357141 - RNA, 14 nt, Bordetella pertussis
gcgcacagcccgau

SEQ ID NO: 357142 - RNA, 13 nt, Bordetella pertussis
gcgcacaggcggc

SEQ ID NO: 357143 - RNA, 14 nt, Bordetella pertussis
gcgcacaggcggcg

SEQ ID NO: 357144 - RNA, 16 nt, Bordetella pertussis
gcgcacaggcggcgcc

SEQ ID NO: 357145 - RNA, 14 nt, Bordetella pertussis
gcgcacagggcguc

SEQ ID NO: 357146 - RNA, 14 nt, Bordetella pertussis
gcgcacaggucgcc

SEQ ID NO: 357147 - RNA, 23 nt, Bordetella pertussis
gcgcacaguugcaggccaugcuc

SEQ ID NO: 357148 - RNA, 15 nt, Bordetella pertussis
gcgcacauccagccg

SEQ ID NO: 357149 - RNA, 17 nt, Bordetella pertussis
gcgcaccauggcgccca

SEQ ID NO: 357150 - RNA, 19 nt, Bordetella pertussis
gcgcaccauggcgcccacg

SEQ ID NO: 357151 - RNA, 22 nt, Bordetella pertussis
gcgcaccaugggcgucgucgcc

SEQ ID NO: 357152 - RNA, 19 nt, Bordetella pertussis
gcgcaccagguuggcgaug

SEQ ID NO: 357153 - RNA, 20 nt, Bordetella pertussis
gcgcaccaguuucucggcca

SEQ ID NO: 357154 - RNA, 14 nt, Bordetella pertussis
gcgcaccccggccg

SEQ ID NO: 357155 - RNA, 17 nt, Bordetella pertussis
gcgcaccccggugucgc

SEQ ID NO: 357156 - RNA, 20 nt, Bordetella pertussis
gcgcacccgccuggacggcg

SEQ ID NO: 357157 - RNA, 14 nt, Bordetella pertussis
gcgcacccgcggcg

SEQ ID NO: 357158 - RNA, 22 nt, Bordetella pertussis
gcgcaccggccaggggcgcugg

SEQ ID NO: 357159 - RNA, 14 nt, Bordetella pertussis
gcgcaccggccggc

SEQ ID NO: 357160 - RNA, 16 nt, Bordetella pertussis
gcgcaccggccggccg

SEQ ID NO: 357161 - RNA, 14 nt, Bordetella pertussis
gcgcaccggcuugg

SEQ ID NO: 357162 - RNA, 15 nt, Bordetella pertussis
gcgcaccgaggugcc

SEQ ID NO: 357163 - RNA, 17 nt, Bordetella pertussis
gcgcacgcguucgggcg

SEQ ID NO: 357164 - RNA, 20 nt, Bordetella pertussis
gcgcacgcguucgggcggca

SEQ ID NO: 357165 - RNA, 13 nt, Bordetella pertussis
gcgcaccuggucc

SEQ ID NO: 357166 - RNA, 22 nt, Bordetella pertussis
gcgcaccugguccauggcgggg

SEQ ID NO: 357167 - RNA, 13 nt, Bordetella pertussis
gcgcacgcuggca

SEQ ID NO: 357168 - RNA, 19 nt, Bordetella pertussis
gcgcacggacagcccgcgc

SEQ ID NO: 357169 - RNA, 22 nt, Bordetella pertussis
gcgcacggacagcccgcgcugg

SEQ ID NO: 357170 - RNA, 13 nt, Bordetella pertussis
gcgcacgcuggcg

SEQ ID NO: 357171 - RNA, 14 nt, Bordetella pertussis
gcgcacgcuggcgc

SEQ ID NO: 357172 - RNA, 16 nt, Bordetella pertussis
gcgcacgcuggcgccc

SEQ ID NO: 357173 - RNA, 14 nt, Bordetella pertussis
gcgcacgcugggcg

SEQ ID NO: 357174 - RNA, 14 nt, Bordetella pertussis
gcgcacggccagca

SEQ ID NO: 357175 - RNA, 14 nt, Bordetella pertussis
gcgcacggcgcccu

SEQ ID NO: 357176 - RNA, 12 nt, Bordetella pertussis
gcgcacggcggc

SEQ ID NO: 357177 - RNA, 21 nt, Bordetella pertussis
gcgcacggcggcgaucacgcc

SEQ ID NO: 357178 - RNA, 20 nt, Bordetella pertussis
gcgcacgggcgaggcggggc

SEQ ID NO: 357179 - RNA, 16 nt, Bordetella pertussis
gcgcacgggcgagggc

SEQ ID NO: 357180 - RNA, 20 nt, Bordetella pertussis
gcgcacgggcgagggcugcc

SEQ ID NO: 357181 - RNA, 16 nt, Bordetella pertussis
gcgcacgggcgccugu

SEQ ID NO: 357182 - RNA, 20 nt, Bordetella pertussis
gcgcacgguccaggcggccg

SEQ ID NO: 357183 - RNA, 14 nt, Bordetella pertussis
gcgcacguccagag

SEQ ID NO: 357184 - RNA, 12 nt, Bordetella pertussis
gcgcagacgacg

SEQ ID NO: 357185 - RNA, 14 nt, Bordetella pertussis
gcgcagacgcgcuc

SEQ ID NO: 357186 - RNA, 20 nt, Bordetella pertussis
gcgcagacgcgcucaggcgg

SEQ ID NO: 357187 - RNA, 23 nt, Bordetella pertussis
gcgcagacgcgcucaggcgguga

SEQ ID NO: 357188 - RNA, 13 nt, Bordetella pertussis
gcgcagauggcgg

SEQ ID NO: 357189 - RNA, 14 nt, Bordetella pertussis
gcgcagauggcggc

SEQ ID NO: 357190 - RNA, 15 nt, Bordetella pertussis
gcgcagauggcggcg

SEQ ID NO: 357191 - RNA, 15 nt, Bordetella pertussis
gcgcagaugggcggc

SEQ ID NO: 357192 - RNA, 19 nt, Bordetella pertussis
gcgcagaugggcggcgacg

SEQ ID NO: 357193 - RNA, 17 nt, Bordetella pertussis
gcgcagcaacccgcccg

SEQ ID NO: 357194 - RNA, 18 nt, Bordetella pertussis
gcgcagcaacccgcccgg

SEQ ID NO: 357195 - RNA, 15 nt, Bordetella pertussis
gcgcagcaaggcgcg

SEQ ID NO: 357196 - RNA, 17 nt, Bordetella pertussis
gcgcagcaaggcgcgcc

SEQ ID NO: 357197 - RNA, 21 nt, Bordetella pertussis
gcgcagcaaggcgcgccaccg

SEQ ID NO: 357198 - RNA, 15 nt, Bordetella pertussis
gcgcagcaccggcag

SEQ ID NO: 357199 - RNA, 19 nt, Bordetella pertussis
gcgcagcaccggcagaugg

SEQ ID NO: 357200 - RNA, 16 nt, Bordetella pertussis
gcgcagcaccggcgug

SEQ ID NO: 357201 - RNA, 21 nt, Bordetella pertussis
gcgcagcaccggcgugagcgc

SEQ ID NO: 357202 - RNA, 21 nt, Bordetella pertussis
gcgcagauugcgcucggucau

SEQ ID NO: 357203 - RNA, 15 nt, Bordetella pertussis
gcgcagcacgauggg

SEQ ID NO: 357204 - RNA, 12 nt, Bordetella pertussis
gcgcagcacgcc

SEQ ID NO: 357205 - RNA, 14 nt, Bordetella pertussis
gcgcagcacgcccg

SEQ ID NO: 357206 - RNA, 17 nt, Bordetella pertussis
gcgcagcacgcccgcgc

SEQ ID NO: 357207 - RNA, 15 nt, Bordetella pertussis
gcgcagcacgccgcg

SEQ ID NO: 357208 - RNA, 19 nt, Bordetella pertussis
gcgcagcaccucggggcgc

SEQ ID NO: 357209 - RNA, 12 nt, Bordetella pertussis
gcgcagcagcgc

SEQ ID NO: 357210 - RNA, 18 nt, Bordetella pertussis
gcgcagcagcuugccgac

SEQ ID NO: 357211 - RNA, 20 nt, Bordetella pertussis
gcgcagcaggccaggaagcg

SEQ ID NO: 357212 - RNA, 17 nt, Bordetella pertussis
gcgcagcaggcccaugc

SEQ ID NO: 357213 - RNA, 20 nt, Bordetella pertussis
gcgcagcaggcccaugccgc

SEQ ID NO: 357214 - RNA, 18 nt, Bordetella pertussis
gcgcagcaggccguugcc

SEQ ID NO: 357215 - RNA, 12 nt, Bordetella pertussis
gcgcagcaggcg

SEQ ID NO: 357216 - RNA, 14 nt, Bordetella pertussis
gcgcagcaggcgcg

SEQ ID NO: 357217 - RNA, 20 nt, Bordetella pertussis
gcgcagcaggcgcgcggccu

SEQ ID NO: 357218 - RNA, 22 nt, Bordetella pertussis
gcgcagcaggcgcgcggccucg

SEQ ID NO: 357219 - RNA, 14 nt, Bordetella pertussis
gcgcagcagggugg

SEQ ID NO: 357220 - RNA, 17 nt, Bordetella pertussis
gcgcagcaggguggcca

SEQ ID NO: 357221 - RNA, 18 nt, Bordetella pertussis
gcgcagcaggguggccac

SEQ ID NO: 357222 - RNA, 19 nt, Bordetella pertussis
gcgcagcaggguggccacg

SEQ ID NO: 357223 - RNA, 15 nt, Bordetella pertussis
gcgcagcagggcggc

SEQ ID NO: 357224 - RNA, 13 nt, Bordetella pertussis
gcgcagcaggugg

SEQ ID NO: 357225 - RNA, 16 nt, Bordetella pertussis
gcgcagcaucuugcgc

SEQ ID NO: 357226 - RNA, 21 nt, Bordetella pertussis
gcgcagcaucuugcgccgcug

SEQ ID NO: 357227 - RNA, 17 nt, Bordetella pertussis
gcgcagccacagcgcgu

SEQ ID NO: 357228 - RNA, 23 nt, Bordetella pertussis
gcgcagcccacucagggcggggu

SEQ ID NO: 357229 - RNA, 19 nt, Bordetella pertussis
gcgcagcccagcgcgaugu

SEQ ID NO: 357230 - RNA, 18 nt, Bordetella pertussis
gcgcagccgacaggcgcg

SEQ ID NO: 357231 - RNA, 22 nt, Bordetella pertussis
gcgcagccgacaggcgcgcagg

SEQ ID NO: 357232 - RNA, 13 nt, Bordetella pertussis
gcgcagccgcgcc

SEQ ID NO: 357233 - RNA, 15 nt, Bordetella pertussis
gcgcagccgcgccaa

SEQ ID NO: 357234 - RNA, 16 nt, Bordetella pertussis
gcgcagccgcgcgccu

SEQ ID NO: 357235 - RNA, 16 nt, Bordetella pertussis
gcgcagccgcuccagc

SEQ ID NO: 357236 - RNA, 21 nt, Bordetella pertussis
gcgcagccgcuccagccacca

SEQ ID NO: 357237 - RNA, 20 nt, Bordetella pertussis
gcgcagccgggcugccggca

SEQ ID NO: 357238 - RNA, 20 nt, Bordetella pertussis
gcgcagcgaacggcccacgc

SEQ ID NO: 357239 - RNA, 12 nt, Bordetella pertussis
gcgcagcgacuc

SEQ ID NO: 357240 - RNA, 14 nt, Bordetella pertussis
gcgcagcgccacgc

SEQ ID NO: 357241 - RNA, 14 nt, Bordetella pertussis
gcgcagcgcccagg

SEQ ID NO: 357242 - RNA, 15 nt, Bordetella pertussis
gcgcagcgcccaggc

SEQ ID NO: 357243 - RNA, 14 nt, Bordetella pertussis
gcgcagcgccgcca

SEQ ID NO: 357244 - RNA, 23 nt, Bordetella pertussis
gcgcagcgccgcuuccaccgucu

SEQ ID NO: 357245 - RNA, 22 nt, Bordetella pertussis
gcgcagcgccgccaccucggcg

SEQ ID NO: 357246 - RNA, 16 nt, Bordetella pertussis
gcgcagcgccuggccg

SEQ ID NO: 357247 - RNA, 18 nt, Bordetella pertussis
gcgcagcgccuggccgag

SEQ ID NO: 357248 - RNA, 17 nt, Bordetella pertussis
gcgcagcgcgccggaca

SEQ ID NO: 357249 - RNA, 21 nt, Bordetella pertussis
gcgcagcgcggcacgcugcug

SEQ ID NO: 357250 - RNA, 17 nt, Bordetella pertussis
gcgcagcgcggcguuga

SEQ ID NO: 357251 - RNA, 19 nt, Bordetella pertussis
gcgcagcgcggcguugacc

SEQ ID NO: 357252 - RNA, 21 nt, Bordetella pertussis
gcgcagcgcgucggcgcgguc

SEQ ID NO: 357253 - RNA, 12 nt, Bordetella pertussis
gcgcagcggcag

SEQ ID NO: 357254 - RNA, 15 nt, Bordetella pertussis
gcgcagcggcaggcg

SEQ ID NO: 357255 - RNA, 20 nt, Bordetella pertussis
gcgcagcggcaggcggcuga

SEQ ID NO: 357256 - RNA, 22 nt, Bordetella pertussis
gcgcagcgugcggaccagcggu

SEQ ID NO: 357257 - RNA, 17 nt, Bordetella pertussis
gcgcagcguggcggcga

SEQ ID NO: 357258 - RNA, 19 nt, Bordetella pertussis
gcgcagcgugaccggacug

SEQ ID NO: 357259 - RNA, 19 nt, Bordetella pertussis
gcgcagcguuucaccgcug

SEQ ID NO: 357260 - RNA, 21 nt, Bordetella pertussis
gcgcagcucccccacgccgcc

SEQ ID NO: 357261 - RNA, 11 nt, Bordetella pertussis
gcgcagcucgu

SEQ ID NO: 357262 - RNA, 16 nt, Bordetella pertussis
gcgcagcucguggcgc

SEQ ID NO: 357263 - RNA, 13 nt, Bordetella pertussis
gcgcagcugccug

SEQ ID NO: 357264 - RNA, 23 nt, Bordetella pertussis
gcgcagcugccugagcaccgccg

SEQ ID NO: 357265 - RNA, 17 nt, Bordetella pertussis
gcgcaggaacucagcgc

SEQ ID NO: 357266 - RNA, 17 nt, Bordetella pertussis
gcgcaggacaaggcgcg

SEQ ID NO: 357267 - RNA, 21 nt, Bordetella pertussis
gcgcaggacaaggcgcgcgcc

SEQ ID NO: 357268 - RNA, 13 nt, Bordetella pertussis
gcgcaggacggcg

SEQ ID NO: 357269 - RNA, 16 nt, Bordetella pertussis
gcgcaggacggcgccg

SEQ ID NO: 357270 - RNA, 13 nt, Bordetella pertussis
gcgcaggaugacg

SEQ ID NO: 357271 - RNA, 16 nt, Bordetella pertussis
gcgcaggaugcgcugg

SEQ ID NO: 357272 - RNA, 21 nt, Bordetella pertussis
gcgcaggaugcgcuggccggc

SEQ ID NO: 357273 - RNA, 20 nt, Bordetella pertussis
gcgcaggccauugcuggcgc

SEQ ID NO: 357274 - RNA, 14 nt, Bordetella pertussis
gcgcaggccgacgc

SEQ ID NO: 357275 - RNA, 13 nt, Bordetella pertussis
gcgcaggccgcca

SEQ ID NO: 357276 - RNA, 11 nt, Bordetella pertussis
gcgcaggccgg

SEQ ID NO: 357277 - RNA, 13 nt, Bordetella pertussis
gcgcaggccggcg

SEQ ID NO: 357278 - RNA, 15 nt, Bordetella pertussis
gcgcaggccggcggc

SEQ ID NO: 357279 - RNA, 16 nt, Bordetella pertussis
gcgcaggccggcggcc

SEQ ID NO: 357280 - RNA, 18 nt, Bordetella pertussis
gcgcaggccggcggccag

SEQ ID NO: 357281 - RNA, 21 nt, Bordetella pertussis
gcgcaggauuucaucgcccau

SEQ ID NO: 357282 - RNA, 15 nt, Bordetella pertussis
gcgcaggcgccgcag

SEQ ID NO: 357283 - RNA, 17 nt, Bordetella pertussis
gcgcaggcgcgccaggg

SEQ ID NO: 357284 - RNA, 14 nt, Bordetella pertussis
gcgcaggcgcgcgg

SEQ ID NO: 357285 - RNA, 18 nt, Bordetella pertussis
gcgcaggcgcguggccac

SEQ ID NO: 357286 - RNA, 19 nt, Bordetella pertussis
gcgcaggcgcguggccacg

SEQ ID NO: 357287 - RNA, 16 nt, Bordetella pertussis
gcgcaggcgggccucg

SEQ ID NO: 357288 - RNA, 19 nt, Bordetella pertussis
gcgcaggcguucgcaccag

SEQ ID NO: 357289 - RNA, 20 nt, Bordetella pertussis
gcgcaggcguuucgccagga

SEQ ID NO: 357290 - RNA, 21 nt, Bordetella pertussis
gcgcaggcugauccagguggu

SEQ ID NO: 357291 - RNA, 19 nt, Bordetella pertussis
gcgcaggcgugcgcgggcg

SEQ ID NO: 357292 - RNA, 17 nt, Bordetella pertussis
gcgcagggcggccggca

SEQ ID NO: 357293 - RNA, 15 nt, Bordetella pertussis
gcgcagggcgggcgg

SEQ ID NO: 357294 - RNA, 13 nt, Bordetella pertussis
gcgcaggggcucu

SEQ ID NO: 357295 - RNA, 15 nt, Bordetella pertussis
gcgcagggugcgggg

SEQ ID NO: 357296 - RNA, 16 nt, Bordetella pertussis
gcgcagguauuccgcc

SEQ ID NO: 357297 - RNA, 14 nt, Bordetella pertussis
gcgcaggucggcca

SEQ ID NO: 357298 - RNA, 17 nt, Bordetella pertussis
gcgcaggucggccagga

SEQ ID NO: 357299 - RNA, 17 nt, Bordetella pertussis
gcgcagguccaccgcca

SEQ ID NO: 357300 - RNA, 19 nt, Bordetella pertussis
gcgcagguccaccgccacg

SEQ ID NO: 357301 - RNA, 15 nt, Bordetella pertussis
gcgcagugggccagu

SEQ ID NO: 357302 - RNA, 18 nt, Bordetella pertussis
gcgcaguuguucgcgcaa

SEQ ID NO: 357303 - RNA, 20 nt, Bordetella pertussis
gcgcaguuguucgcgcaacu

SEQ ID NO: 357304 - RNA, 15 nt, Bordetella pertussis
gcgcauacagggcgg

SEQ ID NO: 357305 - RNA, 20 nt, Bordetella pertussis
gcgcaucgcgaugcgcagca

SEQ ID NO: 357306 - RNA, 15 nt, Bordetella pertussis
gcgcaucgcgcaccc

SEQ ID NO: 357307 - RNA, 17 nt, Bordetella pertussis
gcgcaucgcgcgcgccg

SEQ ID NO: 357308 - RNA, 22 nt, Bordetella pertussis
gcgcaucgggauccgugcggcg

SEQ ID NO: 357309 - RNA, 13 nt, Bordetella pertussis
gcgcaucggcgcc

SEQ ID NO: 357310 - RNA, 14 nt, Bordetella pertussis
gcgcaucggcgccg

SEQ ID NO: 357311 - RNA, 14 nt, Bordetella pertussis
gcgcaucgucaggc

SEQ ID NO: 357312 - RNA, 19 nt, Bordetella pertussis
gcgcaucgucaggcaggcg

SEQ ID NO: 357313 - RNA, 21 nt, Bordetella pertussis
gcgcaucgucaggcaggcgcg

SEQ ID NO: 357314 - RNA, 20 nt, Bordetella pertussis
gcgcauggugagggccacgc

SEQ ID NO: 357315 - RNA, 23 nt, Bordetella pertussis
gcgcaugacgaggugccuguccc

SEQ ID NO: 357316 - RNA, 16 nt, Bordetella pertussis
gcgcauucgccggaca

SEQ ID NO: 357317 - RNA, 19 nt, Bordetella pertussis
gcgcauucgcgccugagcu

SEQ ID NO: 357318 - RNA, 14 nt, Bordetella pertussis
gcgcauugccgcca

SEQ ID NO: 357319 - RNA, 21 nt, Bordetella pertussis
gcgcauugccgccaacgcggc

SEQ ID NO: 357320 - RNA, 18 nt, Bordetella pertussis
gcgcauuggcccugcugg

SEQ ID NO: 357321 - RNA, 19 nt, Bordetella pertussis
gcgcauuggugagcacgcg

SEQ ID NO: 357322 - RNA, 20 nt, Bordetella pertussis
gcgcauuggugagcacgcgc

SEQ ID NO: 357323 - RNA, 21 nt, Bordetella pertussis
gcgcauuucgaacaaggcggu

SEQ ID NO: 357324 - RNA, 15 nt, Bordetella pertussis
gcgcauuucgaccug

SEQ ID NO: 357325 - RNA, 22 nt, Bordetella pertussis
gcgcauuucgaccugcgcaccg

SEQ ID NO: 357326 - RNA, 14 nt, Bordetella pertussis
gcgcauuugccgcg

SEQ ID NO: 357327 - RNA, 16 nt, Bordetella pertussis
gcgcauuugccgcggc

SEQ ID NO: 357328 - RNA, 20 nt, Bordetella pertussis
gcgcauuugccgcggcgaag

SEQ ID NO: 357329 - RNA, 17 nt, Bordetella pertussis
gcgccacagcaugaccu

SEQ ID NO: 357330 - RNA, 24 nt, Bordetella pertussis
gcgccacagcaugaccucggccug

SEQ ID NO: 357331 - RNA, 13 nt, Bordetella pertussis
gcgccacagcgcc

SEQ ID NO: 357332 - RNA, 16 nt, Bordetella pertussis
gcgccacagcgccauc

SEQ ID NO: 357333 - RNA, 13 nt, Bordetella pertussis
gcgccacaggcgc

SEQ ID NO: 357334 - RNA, 17 nt, Bordetella pertussis
gcgccacaggugcgcgg

SEQ ID NO: 357335 - RNA, 22 nt, Bordetella pertussis
gcgccacaggugcgcggcgcgc

SEQ ID NO: 357336 - RNA, 13 nt, Bordetella pertussis
gcgccaccaccgu

SEQ ID NO: 357337 - RNA, 19 nt, Bordetella pertussis
gcgccaccaccucggugcc

SEQ ID NO: 357338 - RNA, 12 nt, Bordetella pertussis
gcgccaccagca

SEQ ID NO: 357339 - RNA, 23 nt, Bordetella pertussis
gcgccaccaccggcacgccggcg

SEQ ID NO: 357340 - RNA, 13 nt, Bordetella pertussis
gcgccaccagcag

SEQ ID NO: 357341 - RNA, 19 nt, Bordetella pertussis
gcgccaccagcagcgccag

SEQ ID NO: 357342 - RNA, 12 nt, Bordetella pertussis
gcgccaccagcu

SEQ ID NO: 357343 - RNA, 21 nt, Bordetella pertussis
gcgccaccagcuugcgcgccg

SEQ ID NO: 357344 - RNA, 14 nt, Bordetella pertussis
gcgccaccccgccg

SEQ ID NO: 357345 - RNA, 17 nt, Bordetella pertussis
gcgccaccccgccgcug

SEQ ID NO: 357346 - RNA, 13 nt, Bordetella pertussis
gcgccaccgccag

SEQ ID NO: 357347 - RNA, 15 nt, Bordetella pertussis
gcgccaccggcugga

SEQ ID NO: 357348 - RNA, 22 nt, Bordetella pertussis
gcgccaccggucgccguccagg

SEQ ID NO: 357349 - RNA, 19 nt, Bordetella pertussis
gcgccacggucugcacgcc

SEQ ID NO: 357350 - RNA, 22 nt, Bordetella pertussis
gcgccacggucugcacgccggg

SEQ ID NO: 357351 - RNA, 23 nt, Bordetella pertussis
gcgccacggucugcacgccgggc

SEQ ID NO: 357352 - RNA, 21 nt, Bordetella pertussis
gcgccacguccagcacggccg

SEQ ID NO: 357353 - RNA, 16 nt, Bordetella pertussis
gcgccacugccaggcg

SEQ ID NO: 357354 - RNA, 18 nt, Bordetella pertussis
gcgccacugccaggcgcc

SEQ ID NO: 357355 - RNA, 17 nt, Bordetella pertussis
gcgccacuauguggcgu

SEQ ID NO: 357356 - RNA, 17 nt, Bordetella pertussis
gcgccacuucgccucgg

SEQ ID NO: 357357 - RNA, 19 nt, Bordetella pertussis
gcgccaguccagcgcgccg

SEQ ID NO: 357358 - RNA, 22 nt, Bordetella pertussis
gcgccaguccccaugcggggac

SEQ ID NO: 357359 - RNA, 13 nt, Bordetella pertussis
gcgccagucgcgc

SEQ ID NO: 357360 - RNA, 16 nt, Bordetella pertussis
gcgccagucgcgcagc

SEQ ID NO: 357361 - RNA, 15 nt, Bordetella pertussis
gcgccaguugcgcac

SEQ ID NO: 357362 - RNA, 17 nt, Bordetella pertussis
gcgccaguugcgcaccg

SEQ ID NO: 357363 - RNA, 18 nt, Bordetella pertussis
gcgccaguugcgcaccgc

SEQ ID NO: 357364 - RNA, 16 nt, Bordetella pertussis
gcgccaguugcggggc

SEQ ID NO: 357365 - RNA, 19 nt, Bordetella pertussis
gcgccaguugcggggcgcc

SEQ ID NO: 357366 - RNA, 21 nt, Bordetella pertussis
gcgccauacccggucgaucag

SEQ ID NO: 357367 - RNA, 19 nt, Bordetella pertussis
gcgccaucaagagcaccgu

SEQ ID NO: 357368 - RNA, 20 nt, Bordetella pertussis
gcgccauccugaacgccgcg

SEQ ID NO: 357369 - RNA, 23 nt, Bordetella pertussis
gcgccauccugaacgccgcgcug

SEQ ID NO: 357370 - RNA, 11 nt, Bordetella pertussis
gcgccaucgcg

SEQ ID NO: 357371 - RNA, 14 nt, Bordetella pertussis
gcgccaucgcgucg

SEQ ID NO: 357372 - RNA, 13 nt, Bordetella pertussis
gcgccaugaacuc

SEQ ID NO: 357373 - RNA, 21 nt, Bordetella pertussis
gcgccaugaacucgcgcucgg

SEQ ID NO: 357374 - RNA, 22 nt, Bordetella pertussis
gcgccauucuucgccgaugcgc

SEQ ID NO: 357375 - RNA, 15 nt, Bordetella pertussis
gcgccauugccacgg

SEQ ID NO: 357376 - RNA, 17 nt, Bordetella pertussis
gcgccauugccacggcg

SEQ ID NO: 357377 - RNA, 15 nt, Bordetella pertussis
gcgcccaacccaggu

SEQ ID NO: 357378 - RNA, 17 nt, Bordetella pertussis
gcgcccaauccgaucag

SEQ ID NO: 357379 - RNA, 19 nt, Bordetella pertussis
gcgcccaauccgaucagca

SEQ ID NO: 357380 - RNA, 22 nt, Bordetella pertussis
gcgcccaccgagacgcugucgc

SEQ ID NO: 357381 - RNA, 23 nt, Bordetella pertussis
gcgcccaccgagacgcugucgcg

SEQ ID NO: 357382 - RNA, 22 nt, Bordetella pertussis
gcgcccagcuguccaagcgcgu

SEQ ID NO: 357383 - RNA, 21 nt, Bordetella pertussis
gcgcccagcuugaugccgccg

SEQ ID NO: 357384 - RNA, 13 nt, Bordetella pertussis
gcgcccaggccag

SEQ ID NO: 357385 - RNA, 15 nt, Bordetella pertussis
gcgcccaggccagcc

SEQ ID NO: 357386 - RNA, 20 nt, Bordetella pertussis
gcgcccaggccagccaggug

SEQ ID NO: 357387 - RNA, 17 nt, Bordetella pertussis
gcgcccaggccgaucag

SEQ ID NO: 357388 - RNA, 17 nt, Bordetella pertussis
gcgcccaggggccggcg

SEQ ID NO: 357389 - RNA, 18 nt, Bordetella pertussis
gcgcccagggugguggcc

SEQ ID NO: 357390 - RNA, 19 nt, Bordetella pertussis
gcgcccagggugguggccu

SEQ ID NO: 357391 - RNA, 16 nt, Bordetella pertussis
gcgcccagguacauca

SEQ ID NO: 357392 - RNA, 22 nt, Bordetella pertussis
gcgcccagguacaucaucccca

SEQ ID NO: 357393 - RNA, 19 nt, Bordetella pertussis
gcgcccaggcccagcgcgc

SEQ ID NO: 357394 - RNA, 16 nt, Bordetella pertussis
gcgcccagguccugcg

SEQ ID NO: 357395 - RNA, 13 nt, Bordetella pertussis
gcgcccagguuuc

SEQ ID NO: 357396 - RNA, 21 nt, Bordetella pertussis
gcgcccaguuccacgcggccg

SEQ ID NO: 357397 - RNA, 18 nt, Bordetella pertussis
gcgccccgaucggcgccg

SEQ ID NO: 357398 - RNA, 23 nt, Bordetella pertussis
gcgccccgaucggcgccgcgcgc

SEQ ID NO: 357399 - RNA, 21 nt, Bordetella pertussis
gcgccccgccacgucgccggc

SEQ ID NO: 357400 - RNA, 14 nt, Bordetella pertussis
gcgccccgccaugc

SEQ ID NO: 357401 - RNA, 16 nt, Bordetella pertussis
gcgccccgcuggccgu

SEQ ID NO: 357402 - RNA, 20 nt, Bordetella pertussis
gcgccccuagcgccgcgcca

SEQ ID NO: 357403 - RNA, 23 nt, Bordetella pertussis
gcgccccuagcgccgcgccaggu

SEQ ID NO: 357404 - RNA, 21 nt, Bordetella pertussis
gcgccccuugcggggcgcguu

SEQ ID NO: 357405 - RNA, 12 nt, Bordetella pertussis
gcgcccgaagcc

SEQ ID NO: 357406 - RNA, 23 nt, Bordetella pertussis
gcgcccgaaggugggcgaaccgc

SEQ ID NO: 357407 - RNA, 16 nt, Bordetella pertussis
gcgcccgagcgccaca

SEQ ID NO: 357408 - RNA, 16 nt, Bordetella pertussis
gcgcccgaggcgcgca

SEQ ID NO: 357409 - RNA, 17 nt, Bordetella pertussis
gcgcccgaggcgcgcag

SEQ ID NO: 357410 - RNA, 21 nt, Bordetella pertussis
gcgcccgaggcgcgcagcacg

SEQ ID NO: 357411 - RNA, 22 nt, Bordetella pertussis
gcgcccgacggcgcgcccgccg

SEQ ID NO: 357412 - RNA, 18 nt, Bordetella pertussis
gcgcccgagagcugcguc

SEQ ID NO: 357413 - RNA, 18 nt, Bordetella pertussis
gcgcccgcacgaugccga

SEQ ID NO: 357414 - RNA, 20 nt, Bordetella pertussis
gcgcccgcaggcggcggccu

SEQ ID NO: 357415 - RNA, 18 nt, Bordetella pertussis
gcgcccgcaucggcuggc

SEQ ID NO: 357416 - RNA, 21 nt, Bordetella pertussis
gcgcccgcaucggcuggcgca

SEQ ID NO: 357417 - RNA, 13 nt, Bordetella pertussis
gcgcccgccacca

SEQ ID NO: 357418 - RNA, 14 nt, Bordetella pertussis
gcgcccgccgacga

SEQ ID NO: 357419 - RNA, 18 nt, Bordetella pertussis
gcgcccggccugcgggcg

SEQ ID NO: 357420 - RNA, 15 nt, Bordetella pertussis
gcgcccggccggccu

SEQ ID NO: 357421 - RNA, 18 nt, Bordetella pertussis
gcgcccuugaugccgucg

SEQ ID NO: 357422 - RNA, 21 nt, Bordetella pertussis
gcgcccuugaugccgucggcg

SEQ ID NO: 357423 - RNA, 19 nt, Bordetella pertussis
gcgcccuuugcauugcggc

SEQ ID NO: 357424 - RNA, 23 nt, Bordetella pertussis
gcgcccuuugcauugcggcuggg

SEQ ID NO: 357425 - RNA, 21 nt, Bordetella pertussis
gcgccgaaacauaagucugcg

SEQ ID NO: 357426 - RNA, 21 nt, Bordetella pertussis
gcgccgaaauauggaccagcc

SEQ ID NO: 357427 - RNA, 22 nt, Bordetella pertussis
gcgccgaaauauggaccagccc

SEQ ID NO: 357428 - RNA, 18 nt, Bordetella pertussis
gcgccgaacaccagcucg

SEQ ID NO: 357429 - RNA, 19 nt, Bordetella pertussis
gcgccgaacgacuuggcgc

SEQ ID NO: 357430 - RNA, 12 nt, Bordetella pertussis
gcgccgaccagg

SEQ ID NO: 357431 - RNA, 15 nt, Bordetella pertussis
gcgccgaccgcacga

SEQ ID NO: 357432 - RNA, 23 nt, Bordetella pertussis
gcgccgaccgggccgaccaggcc

SEQ ID NO: 357433 - RNA, 24 nt, Bordetella pertussis
gcgccgaccgggccgaccaggccg

SEQ ID NO: 357434 - RNA, 14 nt, Bordetella pertussis
gcgccgacgaccga

SEQ ID NO: 357435 - RNA, 18 nt, Bordetella pertussis
gcgccgacgaccgaaccg

SEQ ID NO: 357436 - RNA, 23 nt, Bordetella pertussis
gcgccgacgauaucgcgaaagcg

SEQ ID NO: 357437 - RNA, 15 nt, Bordetella pertussis
gcgccgacgaugccg

SEQ ID NO: 357438 - RNA, 23 nt, Bordetella pertussis
gcgccgacgaugccgcccacgcc

SEQ ID NO: 357439 - RNA, 20 nt, Bordetella pertussis
gcgccgaguuuccgcacccg

SEQ ID NO: 357440 - RNA, 15 nt, Bordetella pertussis
gcgccgaucagcagg

SEQ ID NO: 357441 - RNA, 16 nt, Bordetella pertussis
gcgccgauccagccca

SEQ ID NO: 357442 - RNA, 19 nt, Bordetella pertussis
gcgccgauccagggccgca

SEQ ID NO: 357443 - RNA, 14 nt, Bordetella pertussis
gcgccgaucgcggc

SEQ ID NO: 357444 - RNA, 15 nt, Bordetella pertussis
gcgccgaucgcggcu

SEQ ID NO: 357445 - RNA, 18 nt, Bordetella pertussis
gcgccgaucgcggcucca

SEQ ID NO: 357446 - RNA, 21 nt, Bordetella pertussis
gcgccgaucgcggcuccagcu

SEQ ID NO: 357447 - RNA, 13 nt, Bordetella pertussis
gcgccgcaccagc

SEQ ID NO: 357448 - RNA, 16 nt, Bordetella pertussis
gcgccgcaccagcgcc

SEQ ID NO: 357449 - RNA, 23 nt, Bordetella pertussis
gcgccgcaccagcgccgacggca

SEQ ID NO: 357450 - RNA, 13 nt, Bordetella pertussis
gcgccgcacccga

SEQ ID NO: 357451 - RNA, 15 nt, Bordetella pertussis
gcgccgcacgucggu

SEQ ID NO: 357452 - RNA, 19 nt, Bordetella pertussis
gcgccgcagauggcguagg

SEQ ID NO: 357453 - RNA, 23 nt, Bordetella pertussis
gcgccgcagcaccucggcguggc

SEQ ID NO: 357454 - RNA, 15 nt, Bordetella pertussis
gcgccgcagcgucgc

SEQ ID NO: 357455 - RNA, 17 nt, Bordetella pertussis
gcgccgcagcguggcgu

SEQ ID NO: 357456 - RNA, 16 nt, Bordetella pertussis
gcgccgccaggcgcga

SEQ ID NO: 357457 - RNA, 20 nt, Bordetella pertussis
gcgccgccauggcggcgccc

SEQ ID NO: 357458 - RNA, 18 nt, Bordetella pertussis
gcgccgcccaccaccagc

SEQ ID NO: 357459 - RNA, 13 nt, Bordetella pertussis
gcgccgcccacgc

SEQ ID NO: 357460 - RNA, 17 nt, Bordetella pertussis
gcgccgcccacgccgcu

SEQ ID NO: 357461 - RNA, 18 nt, Bordetella pertussis
gcgccgcccccgcccagc

SEQ ID NO: 357462 - RNA, 15 nt, Bordetella pertussis
gcgccgccccgucau

SEQ ID NO: 357463 - RNA, 22 nt, Bordetella pertussis
gcgccgccccgucaucgggugc

SEQ ID NO: 357464 - RNA, 16 nt, Bordetella pertussis
gcgccgccccuucagc

SEQ ID NO: 357465 - RNA, 18 nt, Bordetella pertussis
gcgccgcccgggccggcu

SEQ ID NO: 357466 - RNA, 16 nt, Bordetella pertussis
gcgccgcccgcggcca

SEQ ID NO: 357467 - RNA, 17 nt, Bordetella pertussis
gcgccgcccgcggccag

SEQ ID NO: 357468 - RNA, 14 nt, Bordetella pertussis
gcgccgccgcccgg

SEQ ID NO: 357469 - RNA, 20 nt, Bordetella pertussis
gcgccgccgccggcccgcca

SEQ ID NO: 357470 - RNA, 13 nt, Bordetella pertussis
gcgccgccgcgcg

SEQ ID NO: 357471 - RNA, 14 nt, Bordetella pertussis
gcgccgccgcgcgc

SEQ ID NO: 357472 - RNA, 16 nt, Bordetella pertussis
gcgccgccgcgcgcug

SEQ ID NO: 357473 - RNA, 18 nt, Bordetella pertussis
gcgccgccgcguggcggc

SEQ ID NO: 357474 - RNA, 14 nt, Bordetella pertussis
gcgccgccggccag

SEQ ID NO: 357475 - RNA, 14 nt, Bordetella pertussis
gcgccgccggcggc

SEQ ID NO: 357476 - RNA, 16 nt, Bordetella pertussis
gcgccgccggcggccu

SEQ ID NO: 357477 - RNA, 16 nt, Bordetella pertussis
gcgccgccgggccugc

SEQ ID NO: 357478 - RNA, 12 nt, Bordetella pertussis
gcgccgccgggu

SEQ ID NO: 357479 - RNA, 19 nt, Bordetella pertussis
gcgccgccggugcaccagg

SEQ ID NO: 357480 - RNA, 20 nt, Bordetella pertussis
gcgccgccguaggacagccc

SEQ ID NO: 357481 - RNA, 19 nt, Bordetella pertussis
gcgccgccgugcgcgggcg

SEQ ID NO: 357482 - RNA, 16 nt, Bordetella pertussis
gcgccgccuaggugug

SEQ ID NO: 357483 - RNA, 16 nt, Bordetella pertussis
gcgccgccucagcccg

SEQ ID NO: 357484 - RNA, 14 nt, Bordetella pertussis
gcgccgccucgcgc

SEQ ID NO: 357485 - RNA, 21 nt, Bordetella pertussis
gcgccgccucgggcacggcca

SEQ ID NO: 357486 - RNA, 22 nt, Bordetella pertussis
gcgccgccucgggcacggccag

SEQ ID NO: 357487 - RNA, 16 nt, Bordetella pertussis
gcgccgccuggcccac

SEQ ID NO: 357488 - RNA, 17 nt, Bordetella pertussis
gcgccgccuggcccaca

SEQ ID NO: 357489 - RNA, 13 nt, Bordetella pertussis
gcgccgcgaaacg

SEQ ID NO: 357490 - RNA, 13 nt, Bordetella pertussis
gcgccgccuggcc

SEQ ID NO: 357491 - RNA, 16 nt, Bordetella pertussis
gcgccgcgagcgccga

SEQ ID NO: 357492 - RNA, 19 nt, Bordetella pertussis
gcgccgcgagcgccgaacc

SEQ ID NO: 357493 - RNA, 21 nt, Bordetella pertussis
gcgccgcgauggcgccggcca

SEQ ID NO: 357494 - RNA, 22 nt, Bordetella pertussis
gcgccgcgauggcgccggccag

SEQ ID NO: 357495 - RNA, 13 nt, Bordetella pertussis
gcgccgcgcacgc

SEQ ID NO: 357496 - RNA, 12 nt, Bordetella pertussis
gcgccgcgccag

SEQ ID NO: 357497 - RNA, 14 nt, Bordetella pertussis
gcgccgcgcaucga

SEQ ID NO: 357498 - RNA, 19 nt, Bordetella pertussis
gcgccgcgccccaucacca

SEQ ID NO: 357499 - RNA, 15 nt, Bordetella pertussis
gcgccgcgccgcccc

SEQ ID NO: 357500 - RNA, 18 nt, Bordetella pertussis
gcgccgcgccgcccccgc

SEQ ID NO: 357501 - RNA, 14 nt, Bordetella pertussis
gcgccgcgccgccg

SEQ ID NO: 357502 - RNA, 13 nt, Bordetella pertussis
gcgccgcgccgcg

SEQ ID NO: 357503 - RNA, 13 nt, Bordetella pertussis
gcgccgcgccggg

SEQ ID NO: 357504 - RNA, 14 nt, Bordetella pertussis
gcgccgcgccgguc

SEQ ID NO: 357505 - RNA, 16 nt, Bordetella pertussis
gcgccgcgccggucag

SEQ ID NO: 357506 - RNA, 14 nt, Bordetella pertussis
gcgccgcgccucgg

SEQ ID NO: 357507 - RNA, 15 nt, Bordetella pertussis
gcgccgcgccuugcc

SEQ ID NO: 357508 - RNA, 15 nt, Bordetella pertussis
gcgccgcgcgcacgg

SEQ ID NO: 357509 - RNA, 14 nt, Bordetella pertussis
gcgccgcgcgccau

SEQ ID NO: 357510 - RNA, 15 nt, Bordetella pertussis
gcgccgcgcgccgcg

SEQ ID NO: 357511 - RNA, 19 nt, Bordetella pertussis
gcgccgcgcgcggccccgg

SEQ ID NO: 357512 - RNA, 20 nt, Bordetella pertussis
gcgccgcgcgcgugccgcag

SEQ ID NO: 357513 - RNA, 14 nt, Bordetella pertussis
gcgccgcgcgcugg

SEQ ID NO: 357514 - RNA, 19 nt, Bordetella pertussis
gcgccgcgcuccagggcgu

SEQ ID NO: 357515 - RNA, 13 nt, Bordetella pertussis
gcgccgcgcgcgg

SEQ ID NO: 357516 - RNA, 19 nt, Bordetella pertussis
gcgccgcgcuucgucggcg

SEQ ID NO: 357517 - RNA, 15 nt, Bordetella pertussis
gcgccgcggccacgc

SEQ ID NO: 357518 - RNA, 15 nt, Bordetella pertussis
gcgccgcggccggcg

SEQ ID NO: 357519 - RNA, 21 nt, Bordetella pertussis
gcgccgcggccggcggcgccg

SEQ ID NO: 357520 - RNA, 14 nt, Bordetella pertussis
gcgccgcggccggg

SEQ ID NO: 357521 - RNA, 15 nt, Bordetella pertussis
gcgccgcggcgcuuc

SEQ ID NO: 357522 - RNA, 13 nt, Bordetella pertussis
gcgccgcggcgcu

SEQ ID NO: 357523 - RNA, 15 nt, Bordetella pertussis
gcgccgcggcggcga

SEQ ID NO: 357524 - RNA, 19 nt, Bordetella pertussis
gcgccgcggcgggcuuggc

SEQ ID NO: 357525 - RNA, 13 nt, Bordetella pertussis
gcgccggacuggg

SEQ ID NO: 357526 - RNA, 15 nt, Bordetella pertussis
gcgccggaucgcaca

SEQ ID NO: 357527 - RNA, 14 nt, Bordetella pertussis
gcgccggaugcgcg

SEQ ID NO: 357528 - RNA, 15 nt, Bordetella pertussis
gcgccggaugcgcgu

SEQ ID NO: 357529 - RNA, 18 nt, Bordetella pertussis
gcgccggcacgcugaccg

SEQ ID NO: 357530 - RNA, 19 nt, Bordetella pertussis
gcgccggcacgcugaucgc

SEQ ID NO: 357531 - RNA, 13 nt, Bordetella pertussis
gcgccggcgcucg

SEQ ID NO: 357532 - RNA, 12 nt, Bordetella pertussis
gcgccggcggca

SEQ ID NO: 357533 - RNA, 13 nt, Bordetella pertussis
gcgccggcggcaa

SEQ ID NO: 357534 - RNA, 18 nt, Bordetella pertussis
gcgccggcggcaccgcgc

SEQ ID NO: 357535 - RNA, 19 nt, Bordetella pertussis
gcgccggcggcaccgcgca

SEQ ID NO: 357536 - RNA, 14 nt, Bordetella pertussis
gcgccggcggccuc

SEQ ID NO: 357537 - RNA, 15 nt, Bordetella pertussis
gcgccggcggccucc

SEQ ID NO: 357538 - RNA, 15 nt, Bordetella pertussis
gcgccggcggccugc

SEQ ID NO: 357539 - RNA, 21 nt, Bordetella pertussis
gcgccggcggccugcaggccg

SEQ ID NO: 357540 - RNA, 20 nt, Bordetella pertussis
gcgccggcgucacgcggccg

SEQ ID NO: 357541 - RNA, 15 nt, Bordetella pertussis
gcgccggcguccacg

SEQ ID NO: 357542 - RNA, 20 nt, Bordetella pertussis
gcgccggcguccacggcauc

SEQ ID NO: 357543 - RNA, 13 nt, Bordetella pertussis
gcgccggcguagu

SEQ ID NO: 357544 - RNA, 16 nt, Bordetella pertussis
gcgccgggcgggucgg

SEQ ID NO: 357545 - RNA, 22 nt, Bordetella pertussis
gcgccgggcgggucggcgaaca

SEQ ID NO: 357546 - RNA, 21 nt, Bordetella pertussis
gcgccgggcguuuuugcgucc

SEQ ID NO: 357547 - RNA, 22 nt, Bordetella pertussis
gcgccgggcguuuuugcguccg

SEQ ID NO: 357548 - RNA, 23 nt, Bordetella pertussis
gcgccgggcuggugcgccgugcc

SEQ ID NO: 357549 - RNA, 15 nt, Bordetella pertussis
gcgccggggcggcgc

SEQ ID NO: 357550 - RNA, 16 nt, Bordetella pertussis
gcgccggggcggcgca

SEQ ID NO: 357551 - RNA, 17 nt, Bordetella pertussis
gcgccggggcggcgcag

SEQ ID NO: 357552 - RNA, 19 nt, Bordetella pertussis
gcgccggggcggcgcagca

SEQ ID NO: 357553 - RNA, 21 nt, Bordetella pertussis
gcgccggggucagcgccggca

SEQ ID NO: 357554 - RNA, 23 nt, Bordetella pertussis
gcgccggggucagcgccggcacg

SEQ ID NO: 357555 - RNA, 17 nt, Bordetella pertussis
gcgccggguccggccgc

SEQ ID NO: 357556 - RNA, 18 nt, Bordetella pertussis
gcgccggguccggccgcg

SEQ ID NO: 357557 - RNA, 19 nt, Bordetella pertussis
gcgccggguccggccgcgc

SEQ ID NO: 357558 - RNA, 21 nt, Bordetella pertussis
gcgccggguccggccgcgcaa

SEQ ID NO: 357559 - RNA, 19 nt, Bordetella pertussis
gcgccggugaccgccagca

SEQ ID NO: 357560 - RNA, 19 nt, Bordetella pertussis
gcgccggugcgcggcgccc

SEQ ID NO: 357561 - RNA, 22 nt, Bordetella pertussis
gcgccggugcgcggcgcccccg

SEQ ID NO: 357562 - RNA, 15 nt, Bordetella pertussis
gcgccgguguccacg

SEQ ID NO: 357563 - RNA, 18 nt, Bordetella pertussis
gcgccggugucggcccac

SEQ ID NO: 357564 - RNA, 18 nt, Bordetella pertussis
gcgccgguucgacgcuga

SEQ ID NO: 357565 - RNA, 15 nt, Bordetella pertussis
gcgccguaccugcag

SEQ ID NO: 357566 - RNA, 18 nt, Bordetella pertussis
gcgccguaccugcagcag

SEQ ID NO: 357567 - RNA, 21 nt, Bordetella pertussis
gcgccguaccugcagcaggcg

SEQ ID NO: 357568 - RNA, 12 nt, Bordetella pertussis
gcgccguccagc

SEQ ID NO: 357569 - RNA, 13 nt, Bordetella pertussis
gcgccguccagcg

SEQ ID NO: 357570 - RNA, 16 nt, Bordetella pertussis
gcgccguccagcgcgg

SEQ ID NO: 357571 - RNA, 18 nt, Bordetella pertussis
gcgccguccagcgcggca

SEQ ID NO: 357572 - RNA, 18 nt, Bordetella pertussis
gcgccgucgggggccggc

SEQ ID NO: 357573 - RNA, 19 nt, Bordetella pertussis
gcgccgucgggggccggcu

SEQ ID NO: 357574 - RNA, 14 nt, Bordetella pertussis
gcgccgucugcgcc

SEQ ID NO: 357575 - RNA, 15 nt, Bordetella pertussis
gcgccgucugcgccg

SEQ ID NO: 357576 - RNA, 22 nt, Bordetella pertussis
gcgccgucugcgccgccgcgug

SEQ ID NO: 357577 - RNA, 20 nt, Bordetella pertussis
gcgccgucugugcgccccgc

SEQ ID NO: 357578 - RNA, 20 nt, Bordetella pertussis
gcgccgugaaugcgccuggc

SEQ ID NO: 357579 - RNA, 16 nt, Bordetella pertussis
gcgcgaaguaccagcg

SEQ ID NO: 357580 - RNA, 21 nt, Bordetella pertussis
gcgcgaaguaccagcgcacgu

SEQ ID NO: 357581 - RNA, 15 nt, Bordetella pertussis
gcgcgaaguggccac

SEQ ID NO: 357582 - RNA, 21 nt, Bordetella pertussis
gcgcgaaugcguguuccagcg

SEQ ID NO: 357583 - RNA, 16 nt, Bordetella pertussis
gcgcgacaaccgcggc

SEQ ID NO: 357584 - RNA, 13 nt, Bordetella pertussis
gcgcgaccugcgc

SEQ ID NO: 357585 - RNA, 14 nt, Bordetella pertussis
gcgcgaccugcgcg

SEQ ID NO: 357586 - RNA, 22 nt, Bordetella pertussis
gcgcgaccugcgcgaccgccgc

SEQ ID NO: 357587 - RNA, 16 nt, Bordetella pertussis
gcgcgacgacagcggc

SEQ ID NO: 357588 - RNA, 22 nt, Bordetella pertussis
gcgcgacgacagcggcgagcgc

SEQ ID NO: 357589 - RNA, 14 nt, Bordetella pertussis
gcgcgacgccagcg

SEQ ID NO: 357590 - RNA, 15 nt, Bordetella pertussis
gcgcgacgccagcgc

SEQ ID NO: 357591 - RNA, 17 nt, Bordetella pertussis
gcgcgacgccugcgcca

SEQ ID NO: 357592 - RNA, 24 nt, Bordetella pertussis
gcgcgacgcgcuugacguccagcg

SEQ ID NO: 357593 - RNA, 12 nt, Bordetella pertussis
gcgcgacgcgua

SEQ ID NO: 357594 - RNA, 14 nt, Bordetella pertussis
gcgcgacggcgccg

SEQ ID NO: 357595 - RNA, 20 nt, Bordetella pertussis
gcgcgacgugucggccacca

SEQ ID NO: 357596 - RNA, 15 nt, Bordetella pertussis
gcgcgacuccaccgg

SEQ ID NO: 357597 - RNA, 17 nt, Bordetella pertussis
gcgcgacuccaccggcg

SEQ ID NO: 357598 - RNA, 18 nt, Bordetella pertussis
gcgcgacuggcccaggcg

SEQ ID NO: 357599 - RNA, 23 nt, Bordetella pertussis
gcgcgacuggcccaggcgggcca

SEQ ID NO: 357600 - RNA, 23 nt, Bordetella pertussis
gcgcgacuuccucgacccgcgcc

SEQ ID NO: 357601 - RNA, 19 nt, Bordetella pertussis
gcgcgacuucgccgaucga

SEQ ID NO: 357602 - RNA, 17 nt, Bordetella pertussis
gcgcgagaaccaggcca

SEQ ID NO: 357603 - RNA, 20 nt, Bordetella pertussis
gcgcgagaaccaggccacga

SEQ ID NO: 357604 - RNA, 14 nt, Bordetella pertussis
gcgcgagaccagcg

SEQ ID NO: 357605 - RNA, 20 nt, Bordetella pertussis
gcgcgagaccagcggaucgc

SEQ ID NO: 357606 - RNA, 23 nt, Bordetella pertussis
gcgcgagaccagcggaucgccgg

SEQ ID NO: 357607 - RNA, 20 nt, Bordetella pertussis
gcgcgagcagggcaucacca

SEQ ID NO: 357608 - RNA, 22 nt, Bordetella pertussis
gcgcgagcgcaagcaccgccug

SEQ ID NO: 357609 - RNA, 12 nt, Bordetella pertussis
gcgcgagcgcac

SEQ ID NO: 357610 - RNA, 17 nt, Bordetella pertussis
gcgcgagcgcacaggcg

SEQ ID NO: 357611 - RNA, 16 nt, Bordetella pertussis
gcgcgagcgccgggcg

SEQ ID NO: 357612 - RNA, 13 nt, Bordetella pertussis
gcgcgagcggcgg

SEQ ID NO: 357613 - RNA, 16 nt, Bordetella pertussis
gcgcgagcggcggccg

SEQ ID NO: 357614 - RNA, 19 nt, Bordetella pertussis
gcgcgagcggcggccgcgu

SEQ ID NO: 357615 - RNA, 18 nt, Bordetella pertussis
gcgcgaucaggcggugcc

SEQ ID NO: 357616 - RNA, 16 nt, Bordetella pertussis
gcgcgauccgcgccag

SEQ ID NO: 357617 - RNA, 17 nt, Bordetella pertussis
gcgcgauccggcguggu

SEQ ID NO: 357618 - RNA, 19 nt, Bordetella pertussis
gcgcgauccuggggcagga

SEQ ID NO: 357619 - RNA, 19 nt, Bordetella pertussis
gcgcgauccuucgcggccg

SEQ ID NO: 357620 - RNA, 14 nt, Bordetella pertussis
gcgcgaucgccagc

SEQ ID NO: 357621 - RNA, 15 nt, Bordetella pertussis
gcgcgaucgccagca

SEQ ID NO: 357622 - RNA, 19 nt, Bordetella pertussis
gcgcgaucgccagcaggcg

SEQ ID NO: 357623 - RNA, 13 nt, Bordetella pertussis
gcgcgaucgccgc

SEQ ID NO: 357624 - RNA, 17 nt, Bordetella pertussis
gcgcgaucgccgcaugg

SEQ ID NO: 357625 - RNA, 19 nt, Bordetella pertussis
gcgcgcaaaccgacgcggc

SEQ ID NO: 357626 - RNA, 15 nt, Bordetella pertussis
gcgcgcaacacgcgc

SEQ ID NO: 357627 - RNA, 21 nt, Bordetella pertussis
gcgcgcaaccaggggcggcgc

SEQ ID NO: 357628 - RNA, 23 nt, Bordetella pertussis
gcgcgcaaccaggggcggcgcgg

SEQ ID NO: 357629 - RNA, 15 nt, Bordetella pertussis
gcgcgcaaugcgcgg

SEQ ID NO: 357630 - RNA, 17 nt, Bordetella pertussis
gcgcgcaaugcgcggcg

SEQ ID NO: 357631 - RNA, 14 nt, Bordetella pertussis
gcgcgcacaagcgc

SEQ ID NO: 357632 - RNA, 15 nt, Bordetella pertussis
gcgcgcacacuggcc

SEQ ID NO: 357633 - RNA, 13 nt, Bordetella pertussis
gcgcgcaccagcc

SEQ ID NO: 357634 - RNA, 19 nt, Bordetella pertussis
gcgcgcaccaucgccgagc

SEQ ID NO: 357635 - RNA, 16 nt, Bordetella pertussis
gcgcgcaccaugggcg

SEQ ID NO: 357636 - RNA, 22 nt, Bordetella pertussis
gcgcgcaccauucucgcccugc

SEQ ID NO: 357637 - RNA, 12 nt, Bordetella pertussis
gcgcgcaccggc

SEQ ID NO: 357638 - RNA, 13 nt, Bordetella pertussis
gcgcgcaccggcu

SEQ ID NO: 357639 - RNA, 14 nt, Bordetella pertussis
gcgcgcaccggcuu

SEQ ID NO: 357640 - RNA, 15 nt, Bordetella pertussis
gcgcgcaugcccgac

SEQ ID NO: 357641 - RNA, 17 nt, Bordetella pertussis
gcgcgcaugcccgaccg

SEQ ID NO: 357642 - RNA, 21 nt, Bordetella pertussis
gcgcgccaccaccucggugcc

SEQ ID NO: 357643 - RNA, 13 nt, Bordetella pertussis
gcgcgccaccgcc

SEQ ID NO: 357644 - RNA, 17 nt, Bordetella pertussis
gcgcgccacggcgucgc

SEQ ID NO: 357645 - RNA, 21 nt, Bordetella pertussis
gcgcgccacggcgucgccggc

SEQ ID NO: 357646 - RNA, 23 nt, Bordetella pertussis
gcgcgccacggcgucgccggcca

SEQ ID NO: 357647 - RNA, 23 nt, Bordetella pertussis
gcgcgccacgucgaccucgagca

SEQ ID NO: 357648 - RNA, 13 nt, Bordetella pertussis
gcgcgccagcacg

SEQ ID NO: 357649 - RNA, 18 nt, Bordetella pertussis
gcgcgccagcagcgccgg

SEQ ID NO: 357650 - RNA, 11 nt, Bordetella pertussis
gcgcgccagcc

SEQ ID NO: 357651 - RNA, 13 nt, Bordetella pertussis
gcgcgccagccgc

SEQ ID NO: 357652 - RNA, 14 nt, Bordetella pertussis
gcgcgccagccgcg

SEQ ID NO: 357653 - RNA, 14 nt, Bordetella pertussis
gcgcgccagccgcu

SEQ ID NO: 357654 - RNA, 19 nt, Bordetella pertussis
gcgcgccagccgcugcagc

SEQ ID NO: 357655 - RNA, 13 nt, Bordetella pertussis
gcgcgccagcagc

SEQ ID NO: 357656 - RNA, 17 nt, Bordetella pertussis
gcgcgccagcgccacgc

SEQ ID NO: 357657 - RNA, 19 nt, Bordetella pertussis
gcgcgccagcgccacgcga

SEQ ID NO: 357658 - RNA, 14 nt, Bordetella pertussis
gcgcgccagcgccu

SEQ ID NO: 357659 - RNA, 15 nt, Bordetella pertussis
gcgcgccagcgcgcg

SEQ ID NO: 357660 - RNA, 16 nt, Bordetella pertussis
gcgcgccagcgcgcga

SEQ ID NO: 357661 - RNA, 14 nt, Bordetella pertussis
gcgcgccagcgcgg

SEQ ID NO: 357662 - RNA, 15 nt, Bordetella pertussis
gcgcgccagcgcggc

SEQ ID NO: 357663 - RNA, 16 nt, Bordetella pertussis
gcgcgccagcgcggcg

SEQ ID NO: 357664 - RNA, 19 nt, Bordetella pertussis
gcgcgccagcgcggcgggc

SEQ ID NO: 357665 - RNA, 13 nt, Bordetella pertussis
gcgcgccagcgcc

SEQ ID NO: 357666 - RNA, 14 nt, Bordetella pertussis
gcgcgccagcgcca

SEQ ID NO: 357667 - RNA, 15 nt, Bordetella pertussis
gcgcgccagcggcug

SEQ ID NO: 357668 - RNA, 20 nt, Bordetella pertussis
gcgcgccagcucgcgcagca

SEQ ID NO: 357669 - RNA, 12 nt, Bordetella pertussis
gcgcgccagcuc

SEQ ID NO: 357670 - RNA, 21 nt, Bordetella pertussis
gcgcgccagcucuucgagcgc

SEQ ID NO: 357671 - RNA, 13 nt, Bordetella pertussis
gcgcgccagcugg

SEQ ID NO: 357672 - RNA, 19 nt, Bordetella pertussis
gcgcgccaggaagcgcgcc

SEQ ID NO: 357673 - RNA, 20 nt, Bordetella pertussis
gcgcgccaggaagcgcgccg

SEQ ID NO: 357674 - RNA, 23 nt, Bordetella pertussis
gcgcgccaggaagcgcgccgcgc

SEQ ID NO: 357675 - RNA, 11 nt, Bordetella pertussis
gcgcgccaggc

SEQ ID NO: 357676 - RNA, 15 nt, Bordetella pertussis
gcgcgccaggcccag

SEQ ID NO: 357677 - RNA, 13 nt, Bordetella pertussis
gcgcgccaggccu

SEQ ID NO: 357678 - RNA, 20 nt, Bordetella pertussis
gcgcgccaggccuucgacgu

SEQ ID NO: 357679 - RNA, 12 nt, Bordetella pertussis
gcgcgccaggcg

SEQ ID NO: 357680 - RNA, 13 nt, Bordetella pertussis
gcgcgccaggcgc

SEQ ID NO: 357681 - RNA, 14 nt, Bordetella pertussis
gcgcgccaggcgca

SEQ ID NO: 357682 - RNA, 14 nt, Bordetella pertussis
gcgcgccaggcgcg

SEQ ID NO: 357683 - RNA, 16 nt, Bordetella pertussis
gcgcgccaggcgcgca

SEQ ID NO: 357684 - RNA, 19 nt, Bordetella pertussis
gcgcgccaggcgcgcaucg

SEQ ID NO: 357685 - RNA, 20 nt, Bordetella pertussis
gcgcgccaggcgcgcaucgc

SEQ ID NO: 357686 - RNA, 14 nt, Bordetella pertussis
gcgcgccaggcgcu

SEQ ID NO: 357687 - RNA, 15 nt, Bordetella pertussis
gcgcgccaggucgcg

SEQ ID NO: 357688 - RNA, 18 nt, Bordetella pertussis
gcgcgccaggucgcgcac

SEQ ID NO: 357689 - RNA, 20 nt, Bordetella pertussis
gcgcgccaggucgcgcacca

SEQ ID NO: 357690 - RNA, 13 nt, Bordetella pertussis
gcgcgccaggugc

SEQ ID NO: 357691 - RNA, 20 nt, Bordetella pertussis
gcgcgccaguucaaggcgcg

SEQ ID NO: 357692 - RNA, 16 nt, Bordetella pertussis
gcgcgccaguugcgca

SEQ ID NO: 357693 - RNA, 17 nt, Bordetella pertussis
gcgcgccauccggcgca

SEQ ID NO: 357694 - RNA, 22 nt, Bordetella pertussis
gcgcgccaugaaagcgaacagg

SEQ ID NO: 357695 - RNA, 14 nt, Bordetella pertussis
gcgcgccaugcaac

SEQ ID NO: 357696 - RNA, 16 nt, Bordetella pertussis
gcgcgccaggcgcugc

SEQ ID NO: 357697 - RNA, 17 nt, Bordetella pertussis
gcgcgccaggcgcugcg

SEQ ID NO: 357698 - RNA, 18 nt, Bordetella pertussis
gcgcgccauggccggccg

SEQ ID NO: 357699 - RNA, 23 nt, Bordetella pertussis
gcgcgccauggugaacggccccg

SEQ ID NO: 357700 - RNA, 13 nt, Bordetella pertussis
gcgcgcccaccag

SEQ ID NO: 357701 - RNA, 18 nt, Bordetella pertussis
gcgcgcccaccagggugc

SEQ ID NO: 357702 - RNA, 19 nt, Bordetella pertussis
gcgcgcccaccagggugcc

SEQ ID NO: 357703 - RNA, 15 nt, Bordetella pertussis
gcgcgcccagcgcgc

SEQ ID NO: 357704 - RNA, 16 nt, Bordetella pertussis
gcgcgcccagcgcgcc

SEQ ID NO: 357705 - RNA, 17 nt, Bordetella pertussis
gcgcgcccagcgcgccg

SEQ ID NO: 357706 - RNA, 16 nt, Bordetella pertussis
gcgcgcccagcggcag

SEQ ID NO: 357707 - RNA, 17 nt, Bordetella pertussis
gcgcgcccagcggcagg

SEQ ID NO: 357708 - RNA, 11 nt, Bordetella pertussis
gcgcgcccagg

SEQ ID NO: 357709 - RNA, 18 nt, Bordetella pertussis
gcgcgcccaggccagcca

SEQ ID NO: 357710 - RNA, 23 nt, Bordetella pertussis
gcgcgcccaggccagccaggugc

SEQ ID NO: 357711 - RNA, 14 nt, Bordetella pertussis
gcgcgcccccagcg

SEQ ID NO: 357712 - RNA, 22 nt, Bordetella pertussis
gcgcgccccgcuucgggccgga

SEQ ID NO: 357713 - RNA, 15 nt, Bordetella pertussis
gcgcgcccgaggcgc

SEQ ID NO: 357714 - RNA, 19 nt, Bordetella pertussis
gcgcgcccgaggcgcgcag

SEQ ID NO: 357715 - RNA, 17 nt, Bordetella pertussis
gcgcgcccgaugccccg

SEQ ID NO: 357716 - RNA, 14 nt, Bordetella pertussis
gcgcgcccgcacga

SEQ ID NO: 357717 - RNA, 22 nt, Bordetella pertussis
gcgcgcccgcaggcggcggccu

SEQ ID NO: 357718 - RNA, 14 nt, Bordetella pertussis
gcgcgcccgccgcg

SEQ ID NO: 357719 - RNA, 15 nt, Bordetella pertussis
gcgcgcccggcgaaa

SEQ ID NO: 357720 - RNA, 23 nt, Bordetella pertussis
gcgcgcccucguugacgccgacg

SEQ ID NO: 357721 - RNA, 14 nt, Bordetella pertussis
gcgcgcccugcacg

SEQ ID NO: 357722 - RNA, 19 nt, Bordetella pertussis
gcgcgccgacaggaaggcg

SEQ ID NO: 357723 - RNA, 21 nt, Bordetella pertussis
gcgcgccgacaggaaggcgag

SEQ ID NO: 357724 - RNA, 14 nt, Bordetella pertussis
gcgcgccgaccacc

SEQ ID NO: 357725 - RNA, 14 nt, Bordetella pertussis
gcgcgccgaugcgc

SEQ ID NO: 357726 - RNA, 18 nt, Bordetella pertussis
gcgcgccgaugcgccagg

SEQ ID NO: 357727 - RNA, 19 nt, Bordetella pertussis
gcgcgccgaugcgccaggc

SEQ ID NO: 357728 - RNA, 10 nt, Bordetella pertussis
gcgcgccgcc

SEQ ID NO: 357729 - RNA, 13 nt, Bordetella pertussis
gcgcgccgccagc

SEQ ID NO: 357730 - RNA, 15 nt, Bordetella pertussis
gcgcgccgccagcgc

SEQ ID NO: 357731 - RNA, 18 nt, Bordetella pertussis
gcgcgccgcccaccacca

SEQ ID NO: 357732 - RNA, 20 nt, Bordetella pertussis
gcgcgccgccgcgcugugcg

SEQ ID NO: 357733 - RNA, 15 nt, Bordetella pertussis
gcgcgccgccggcca

SEQ ID NO: 357734 - RNA, 14 nt, Bordetella pertussis
gcgcgccgccgggc

SEQ ID NO: 357735 - RNA, 24 nt, Bordetella pertussis
gcgcgccgccgggccugcccgcau

SEQ ID NO: 357736 - RNA, 13 nt, Bordetella pertussis
gcgcgccgccggu

SEQ ID NO: 357737 - RNA, 15 nt, Bordetella pertussis
gcgcgccgccggugc

SEQ ID NO: 357738 - RNA, 22 nt, Bordetella pertussis
gcgcgccgccggugcaccaggc

SEQ ID NO: 357739 - RNA, 21 nt, Bordetella pertussis
gcgcgccgccguaggacagcc

SEQ ID NO: 357740 - RNA, 18 nt, Bordetella pertussis
gcgcgccgccucagcccg

SEQ ID NO: 357741 - RNA, 21 nt, Bordetella pertussis
gcgcgccgcgauggcgccggc

SEQ ID NO: 357742 - RNA, 12 nt, Bordetella pertussis
gcgcgccgcgcc

SEQ ID NO: 357743 - RNA, 16 nt, Bordetella pertussis
gcgcgccgcgccgggc

SEQ ID NO: 357744 - RNA, 14 nt, Bordetella pertussis
gcgcgccgcgcgca

SEQ ID NO: 357745 - RNA, 16 nt, Bordetella pertussis
gcgcgccgcgcgcacg

SEQ ID NO: 357746 - RNA, 13 nt, Bordetella pertussis
gcgcgccgcgggc

SEQ ID NO: 357747 - RNA, 14 nt, Bordetella pertussis
gcgcgccgcgggcu

SEQ ID NO: 357748 - RNA, 18 nt, Bordetella pertussis
gcgcgccgcgggcugcga

SEQ ID NO: 357749 - RNA, 22 nt, Bordetella pertussis
gcgcgccgcgggcugcgacagg

SEQ ID NO: 357750 - RNA, 23 nt, Bordetella pertussis
gcgcgccgcgggcugcgacaggc

SEQ ID NO: 357751 - RNA, 15 nt, Bordetella pertussis
gcgcgccgccgcccg

SEQ ID NO: 357752 - RNA, 12 nt, Bordetella pertussis
gcgcgccgcugc

SEQ ID NO: 357753 - RNA, 13 nt, Bordetella pertussis
gcgcgccgcugca

SEQ ID NO: 357754 - RNA, 16 nt, Bordetella pertussis
gcgcgccgcugcagcg

SEQ ID NO: 357755 - RNA, 11 nt, Bordetella pertussis
gcgcgccggca

SEQ ID NO: 357756 - RNA, 19 nt, Bordetella pertussis
gcgcgccggcagggcggcc

SEQ ID NO: 357757 - RNA, 20 nt, Bordetella pertussis
gcgcgccggcagggcggcca

SEQ ID NO: 357758 - RNA, 23 nt, Bordetella pertussis
gcgcgccggcagggcggccaggc

SEQ ID NO: 357759 - RNA, 21 nt, Bordetella pertussis
gcgcgccggcauuucgcuggg

SEQ ID NO: 357760 - RNA, 22 nt, Bordetella pertussis
gcgcgccggcauuucgcugggc

SEQ ID NO: 357761 - RNA, 11 nt, Bordetella pertussis
gcgcgccggcc

SEQ ID NO: 357762 - RNA, 13 nt, Bordetella pertussis
gcgcgccggccag

SEQ ID NO: 357763 - RNA, 21 nt, Bordetella pertussis
gcgcgccgcuuucucccgccg

SEQ ID NO: 357764 - RNA, 13 nt, Bordetella pertussis
gcgcgccggaaca

SEQ ID NO: 357765 - RNA, 18 nt, Bordetella pertussis
gcgcgccggaacauggcg

SEQ ID NO: 357766 - RNA, 16 nt, Bordetella pertussis
gcgcgccggacgcaaa

SEQ ID NO: 357767 - RNA, 16 nt, Bordetella pertussis
gcgcgccggccagcgg

SEQ ID NO: 357768 - RNA, 17 nt, Bordetella pertussis
gcgcgccggccagcggc

SEQ ID NO: 357769 - RNA, 13 nt, Bordetella pertussis
gcgcgccggccca

SEQ ID NO: 357770 - RNA, 22 nt, Bordetella pertussis
gcgcgccggcccaaggccccgc

SEQ ID NO: 357771 - RNA, 13 nt, Bordetella pertussis
gcgcgccggccgc

SEQ ID NO: 357772 - RNA, 17 nt, Bordetella pertussis
gcgcgccggccgccagc

SEQ ID NO: 357773 - RNA, 18 nt, Bordetella pertussis
gcgcgccggccgccagca

SEQ ID NO: 357774 - RNA, 15 nt, Bordetella pertussis
gcgcgccggccgcgg

SEQ ID NO: 357775 - RNA, 24 nt, Bordetella pertussis
gcgcgccggccgcggggcuggcca

SEQ ID NO: 357776 - RNA, 14 nt, Bordetella pertussis
gcgcgccggccggu

SEQ ID NO: 357777 - RNA, 21 nt, Bordetella pertussis
gcgcgccggccugcgccgggc

SEQ ID NO: 357778 - RNA, 12 nt, Bordetella pertussis
gcgcgccggcgc

SEQ ID NO: 357779 - RNA, 14 nt, Bordetella pertussis
gcgcgccggcgccg

SEQ ID NO: 357780 - RNA, 20 nt, Bordetella pertussis
gcgcgccggcgccuuggccu

SEQ ID NO: 357781 - RNA, 17 nt, Bordetella pertussis
gcgcgccggcggccugc

SEQ ID NO: 357782 - RNA, 23 nt, Bordetella pertussis
gcgcgccggcuaccgcgccaucu

SEQ ID NO: 357783 - RNA, 22 nt, Bordetella pertussis
gcgcgccggcucgaacaggcug

SEQ ID NO: 357784 - RNA, 21 nt, Bordetella pertussis
gcgcgccgggccagaccuggu

SEQ ID NO: 357785 - RNA, 22 nt, Bordetella pertussis
gcgcgccgggcccggccacggc

SEQ ID NO: 357786 - RNA, 20 nt, Bordetella pertussis
gcgcgccgggccggcgggca

SEQ ID NO: 357787 - RNA, 23 nt, Bordetella pertussis
gcgcgccgggccuagcccggcgc

SEQ ID NO: 357788 - RNA, 14 nt, Bordetella pertussis
gcgcgccgucggcg

SEQ ID NO: 357789 - RNA, 15 nt, Bordetella pertussis
gcgcgccguccgggc

SEQ ID NO: 357790 - RNA, 18 nt, Bordetella pertussis
gcgcgccguccgggccgg

SEQ ID NO: 357791 - RNA, 22 nt, Bordetella pertussis
gcgcgccuacagcagcggcucg

SEQ ID NO: 357792 - RNA, 22 nt, Bordetella pertussis
gcgcgccuccagcuccagcgcg

SEQ ID NO: 357793 - RNA, 23 nt, Bordetella pertussis
gcgcgccuccagcuccagcgcgc

SEQ ID NO: 357794 - RNA, 19 nt, Bordetella pertussis
gcgcgccugcagcacggcc

SEQ ID NO: 357795 - RNA, 21 nt, Bordetella pertussis
gcgcgccugcagcacggccac

SEQ ID NO: 357796 - RNA, 15 nt, Bordetella pertussis
gcgcgccugcagcag

SEQ ID NO: 357797 - RNA, 13 nt, Bordetella pertussis
gcgcgccugcaug

SEQ ID NO: 357798 - RNA, 20 nt, Bordetella pertussis
gcgcgccugcauguccagcg

SEQ ID NO: 357799 - RNA, 22 nt, Bordetella pertussis
gcgcgccugcauguccagcggc

SEQ ID NO: 357800 - RNA, 24 nt, Bordetella pertussis
gcgcgccugcauguccagcggcgu

SEQ ID NO: 357801 - RNA, 16 nt, Bordetella pertussis
gcgcgccugcccaggc

SEQ ID NO: 357802 - RNA, 17 nt, Bordetella pertussis
gcgcgccugcccaggcc

SEQ ID NO: 357803 - RNA, 21 nt, Bordetella pertussis
gcgcgccugcccaggccagcg

SEQ ID NO: 357804 - RNA, 22 nt, Bordetella pertussis
gcgcgccugccccgccugcgcc

SEQ ID NO: 357805 - RNA, 13 nt, Bordetella pertussis
gcgcgccugcgcg

SEQ ID NO: 357806 - RNA, 14 nt, Bordetella pertussis
gcgcgccugcgcgc

SEQ ID NO: 357807 - RNA, 15 nt, Bordetella pertussis
gcgcgccugcgcgcc

SEQ ID NO: 357808 - RNA, 12 nt, Bordetella pertussis
gcgcgccugcgc

SEQ ID NO: 357809 - RNA, 23 nt, Bordetella pertussis
gcgcgccugcucgaccugcucgg

SEQ ID NO: 357810 - RNA, 13 nt, Bordetella pertussis
gcgcgccuggcac

SEQ ID NO: 357811 - RNA, 23 nt, Bordetella pertussis
gcgcgccuggcacgacguggccu

SEQ ID NO: 357812 - RNA, 16 nt, Bordetella pertussis
gcgcgccuuacgcggc

SEQ ID NO: 357813 - RNA, 16 nt, Bordetella pertussis
gcgcgccuuccugggc

SEQ ID NO: 357814 - RNA, 13 nt, Bordetella pertussis
gcgcgccuucggc

SEQ ID NO: 357815 - RNA, 18 nt, Bordetella pertussis
gcgcgccuucggcaggcg

SEQ ID NO: 357816 - RNA, 19 nt, Bordetella pertussis
gcgcgccuucggcaggcgc

SEQ ID NO: 357817 - RNA, 21 nt, Bordetella pertussis
gcgcgccuugaaccccggcug

SEQ ID NO: 357818 - RNA, 15 nt, Bordetella pertussis
gcgcgccuugcgcgg

SEQ ID NO: 357819 - RNA, 13 nt, Bordetella pertussis
gcgcgcgaccagg

SEQ ID NO: 357820 - RNA, 14 nt, Bordetella pertussis
gcgcgcgaccaggc

SEQ ID NO: 357821 - RNA, 12 nt, Bordetella pertussis
gcgcgcgaccuc

SEQ ID NO: 357822 - RNA, 18 nt, Bordetella pertussis
gcgcgcgacuccaccggc

SEQ ID NO: 357823 - RNA, 19 nt, Bordetella pertussis
gcgcgcgacuccaccggcg

SEQ ID NO: 357824 - RNA, 20 nt, Bordetella pertussis
gcgcgcgacuccaccggcgu

SEQ ID NO: 357825 - RNA, 16 nt, Bordetella pertussis
gcgcgcgagcagucga

SEQ ID NO: 357826 - RNA, 14 nt, Bordetella pertussis
gcgcgcgaucgcca

SEQ ID NO: 357827 - RNA, 17 nt, Bordetella pertussis
gcgcgcgaucgccagca

SEQ ID NO: 357828 - RNA, 15 nt, Bordetella pertussis
gcgcgcgaugcgcag

SEQ ID NO: 357829 - RNA, 13 nt, Bordetella pertussis
gcgcgcgcagcca

SEQ ID NO: 357830 - RNA, 13 nt, Bordetella pertussis
gcgcgcgcaucgg

SEQ ID NO: 357831 - RNA, 15 nt, Bordetella pertussis
gcgcgcgcaucggcc

SEQ ID NO: 357832 - RNA, 13 nt, Bordetella pertussis
gcgcgcgccaggc

SEQ ID NO: 357833 - RNA, 14 nt, Bordetella pertussis
gcgcgcgccagguu

SEQ ID NO: 357834 - RNA, 14 nt, Bordetella pertussis
gcgcgcgccaguug

SEQ ID NO: 357835 - RNA, 19 nt, Bordetella pertussis
gcgcgcgccaugucgacga

SEQ ID NO: 357836 - RNA, 14 nt, Bordetella pertussis
gcgcgcgcccaccg

SEQ ID NO: 357837 - RNA, 14 nt, Bordetella pertussis
gcgcgcgcccaggc

SEQ ID NO: 357838 - RNA, 13 nt, Bordetella pertussis
gcgcgcgccccgc

SEQ ID NO: 357839 - RNA, 16 nt, Bordetella pertussis
gcgcgcgccgaugcgc

SEQ ID NO: 357840 - RNA, 15 nt, Bordetella pertussis
gcgcgcgccgcacgc

SEQ ID NO: 357841 - RNA, 12 nt, Bordetella pertussis
gcgcgcgccagc

SEQ ID NO: 357842 - RNA, 19 nt, Bordetella pertussis
gcgcgcgccagcggcugcu

SEQ ID NO: 357843 - RNA, 13 nt, Bordetella pertussis
gcgcgcgccgccg

SEQ ID NO: 357844 - RNA, 17 nt, Bordetella pertussis
gcgcgcgccgccggcca

SEQ ID NO: 357845 - RNA, 13 nt, Bordetella pertussis
gcgcgcgccggcg

SEQ ID NO: 357846 - RNA, 14 nt, Bordetella pertussis
gcgcgcgcgaggcg

SEQ ID NO: 357847 - RNA, 13 nt, Bordetella pertussis
gcgcgcgcgcaca

SEQ ID NO: 357848 - RNA, 16 nt, Bordetella pertussis
gcgcgcgcgcacaggc

SEQ ID NO: 357849 - RNA, 13 nt, Bordetella pertussis
gcgcgcgcgccga

SEQ ID NO: 357850 - RNA, 14 nt, Bordetella pertussis
gcgcgcgcgcgccg

SEQ ID NO: 357851 - RNA, 16 nt, Bordetella pertussis
gcgcgcgcgcgcgggc

SEQ ID NO: 357852 - RNA, 13 nt, Bordetella pertussis
gcgcgcgcgcugg

SEQ ID NO: 357853 - RNA, 13 nt, Bordetella pertussis
gcgcgcgcggcca

SEQ ID NO: 357854 - RNA, 14 nt, Bordetella pertussis
gcgcgcgcggccag

SEQ ID NO: 357855 - RNA, 15 nt, Bordetella pertussis
gcgcgcgcggccagu

SEQ ID NO: 357856 - RNA, 12 nt, Bordetella pertussis
gcgcgcgcggcg

SEQ ID NO: 357857 - RNA, 13 nt, Bordetella pertussis
gcgcgcgcggcgc

SEQ ID NO: 357858 - RNA, 13 nt, Bordetella pertussis
gcgcgcgcgggcg

SEQ ID NO: 357859 - RNA, 17 nt, Bordetella pertussis
gcgcgcgcugcacggcc

SEQ ID NO: 357860 - RNA, 14 nt, Bordetella pertussis
gcgcgcgcuggggc

SEQ ID NO: 357861 - RNA, 21 nt, Bordetella pertussis
gcgcgcggaucgaaaccggcg

SEQ ID NO: 357862 - RNA, 17 nt, Bordetella pertussis
gcgcgcggcagggcguc

SEQ ID NO: 357863 - RNA, 14 nt, Bordetella pertussis
gcgcgcggccagcg

SEQ ID NO: 357864 - RNA, 14 nt, Bordetella pertussis
gcgcgcggccccgg

SEQ ID NO: 357865 - RNA, 13 nt, Bordetella pertussis
gcgcgcggccgag

SEQ ID NO: 357866 - RNA, 12 nt, Bordetella pertussis
gcgcgcggccgc

SEQ ID NO: 357867 - RNA, 13 nt, Bordetella pertussis
gcgcgcggccggc

SEQ ID NO: 357868 - RNA, 14 nt, Bordetella pertussis
gcgcgcggccggcc

SEQ ID NO: 357869 - RNA, 21 nt, Bordetella pertussis
gcgcgcggccggcgcgccggc

SEQ ID NO: 357870 - RNA, 14 nt, Bordetella pertussis
gcgcgcggccucgg

SEQ ID NO: 357871 - RNA, 13 nt, Bordetella pertussis
gcgcgcggccugg

SEQ ID NO: 357872 - RNA, 12 nt, Bordetella pertussis
gcgcgcggcgca

SEQ ID NO: 357873 - RNA, 13 nt, Bordetella pertussis
gcgcgcggcgccg

SEQ ID NO: 357874 - RNA, 15 nt, Bordetella pertussis
gcgcgcggcgcggcu

SEQ ID NO: 357875 - RNA, 13 nt, Bordetella pertussis
gcgcgcggcgccu

SEQ ID NO: 357876 - RNA, 22 nt, Bordetella pertussis
gcgcgcggcguugcggcgccau

SEQ ID NO: 357877 - RNA, 15 nt, Bordetella pertussis
gcgcgcggcuggcug

SEQ ID NO: 357878 - RNA, 19 nt, Bordetella pertussis
gcgcgcggcuggggcugcu

SEQ ID NO: 357879 - RNA, 19 nt, Bordetella pertussis
gcgcgcgggaagcugucgg

SEQ ID NO: 357880 - RNA, 20 nt, Bordetella pertussis
gcgcgcgggcgauggccacg

SEQ ID NO: 357881 - RNA, 15 nt, Bordetella pertussis
gcgcgcgggcgcccg

SEQ ID NO: 357882 - RNA, 16 nt, Bordetella pertussis
gcgcgcgggcgcgccg

SEQ ID NO: 357883 - RNA, 18 nt, Bordetella pertussis
gcgcgcggggcaggccga

SEQ ID NO: 357884 - RNA, 20 nt, Bordetella pertussis
gcgcgcggggcaggccgaug

SEQ ID NO: 357885 - RNA, 20 nt, Bordetella pertussis
gcgcgcgggguaggccucga

SEQ ID NO: 357886 - RNA, 20 nt, Bordetella pertussis
gcgcgcgguauccaggucga

SEQ ID NO: 357887 - RNA, 19 nt, Bordetella pertussis
gcgcgcggugccgccuggc

SEQ ID NO: 357888 - RNA, 14 nt, Bordetella pertussis
gcgcgcggugucgc

SEQ ID NO: 357889 - RNA, 21 nt, Bordetella pertussis
gcgcgcggugucgccgccgcg

SEQ ID NO: 357890 - RNA, 21 nt, Bordetella pertussis
gcgcgcgguucaucgccucgu

SEQ ID NO: 357891 - RNA, 21 nt, Bordetella pertussis
gcgcgcgguugagcgccaggg

SEQ ID NO: 357892 - RNA, 18 nt, Bordetella pertussis
gcgcgcgugcagcgccgc

SEQ ID NO: 357893 - RNA, 19 nt, Bordetella pertussis
gcgcgcgugcagcgccgcg

SEQ ID NO: 357894 - RNA, 13 nt, Bordetella pertussis
gcgcgcgugccgc

SEQ ID NO: 357895 - RNA, 17 nt, Bordetella pertussis
gcgcgcgugccgcaggc

SEQ ID NO: 357896 - RNA, 16 nt, Bordetella pertussis
gcgcgcguugaccgcc

SEQ ID NO: 357897 - RNA, 20 nt, Bordetella pertussis
gcgcgcguugaucaucggcc

SEQ ID NO: 357898 - RNA, 22 nt, Bordetella pertussis
gcgcgcguugaucaucggcccg

SEQ ID NO: 357899 - RNA, 14 nt, Bordetella pertussis
gcgcgcguccugcg

SEQ ID NO: 357900 - RNA, 17 nt, Bordetella pertussis
gcgcgcguccugcgcca

SEQ ID NO: 357901 - RNA, 21 nt, Bordetella pertussis
gcgcgcgucgccgcuggccag

SEQ ID NO: 357902 - RNA, 19 nt, Bordetella pertussis
gcgcgcuaagcacaagcgc

SEQ ID NO: 357903 - RNA, 15 nt, Bordetella pertussis
gcgcgcucaggccgc

SEQ ID NO: 357904 - RNA, 16 nt, Bordetella pertussis
gcgcgcucaggccgcc

SEQ ID NO: 357905 - RNA, 20 nt, Bordetella pertussis
gcgcgcucaggccgccggcg

SEQ ID NO: 357906 - RNA, 14 nt, Bordetella pertussis
gcgcgcucaggggg

SEQ ID NO: 357907 - RNA, 18 nt, Bordetella pertussis
gcgcgcucagggggcgcc

SEQ ID NO: 357908 - RNA, 23 nt, Bordetella pertussis
gcgcgcucagggggcgccccaac

SEQ ID NO: 357909 - RNA, 15 nt, Bordetella pertussis
gcgcgcucagcgcca

SEQ ID NO: 357910 - RNA, 17 nt, Bordetella pertussis
gcgcgcucauggcgcau

SEQ ID NO: 357911 - RNA, 19 nt, Bordetella pertussis
gcgcgcucauggcgcauga

SEQ ID NO: 357912 - RNA, 21 nt, Bordetella pertussis
gcgcgcucauggcgcaugacg

SEQ ID NO: 357913 - RNA, 12 nt, Bordetella pertussis
gcgcgcuccagc

SEQ ID NO: 357914 - RNA, 22 nt, Bordetella pertussis
gcgcgcuccagcauguacagcg

SEQ ID NO: 357915 - RNA, 16 nt, Bordetella pertussis
gcgcgcucgcugccgg

SEQ ID NO: 357916 - RNA, 20 nt, Bordetella pertussis
gcgcgcucgcugccggcguc

SEQ ID NO: 357917 - RNA, 15 nt, Bordetella pertussis
gcgcgcucggcgccg

SEQ ID NO: 357918 - RNA, 18 nt, Bordetella pertussis
gcgcgcucggcgccgggc

SEQ ID NO: 357919 - RNA, 15 nt, Bordetella pertussis
gcgcgcugcacggcc

SEQ ID NO: 357920 - RNA, 16 nt, Bordetella pertussis
gcgcgcugcccagcca

SEQ ID NO: 357921 - RNA, 14 nt, Bordetella pertussis
gcgcgcuggcgcuc

SEQ ID NO: 357922 - RNA, 15 nt, Bordetella pertussis
gcgcgcuggcugugc

SEQ ID NO: 357923 - RNA, 18 nt, Bordetella pertussis
gcgcgcuggggcugucgc

SEQ ID NO: 357924 - RNA, 16 nt, Bordetella pertussis
gcgcgcuucaggcgcc

SEQ ID NO: 357925 - RNA, 20 nt, Bordetella pertussis
gcgcgcuucgagccgguaca

SEQ ID NO: 357926 - RNA, 17 nt, Bordetella pertussis
gcgcgcuucuuggcgac

SEQ ID NO: 357927 - RNA, 21 nt, Bordetella pertussis
gcgcgcuugaacuccgcggcg

SEQ ID NO: 357928 - RNA, 22 nt, Bordetella pertussis
gcgcgcuuucaggugggcgaug

SEQ ID NO: 357929 - RNA, 19 nt, Bordetella pertussis
gcgcgcuuggucagcauca

SEQ ID NO: 357930 - RNA, 23 nt, Bordetella pertussis
gcgcggaaauccguaguccagca

SEQ ID NO: 357931 - RNA, 14 nt, Bordetella pertussis
gcgcggacugccag

SEQ ID NO: 357932 - RNA, 16 nt, Bordetella pertussis
gcgcggacugccagau

SEQ ID NO: 357933 - RNA, 14 nt, Bordetella pertussis
gcgcggacuucgcu

SEQ ID NO: 357934 - RNA, 21 nt, Bordetella pertussis
gcgcggauauucgucggccgc

SEQ ID NO: 357935 - RNA, 21 nt, Bordetella pertussis
gcgcggaucaugggcucgcgc

SEQ ID NO: 357936 - RNA, 13 nt, Bordetella pertussis
gcgcggauccagc

SEQ ID NO: 357937 - RNA, 17 nt, Bordetella pertussis
gcgcggauccagccaug

SEQ ID NO: 357938 - RNA, 23 nt, Bordetella pertussis
gcgcggaucgaaguugaacgagc

SEQ ID NO: 357939 - RNA, 15 nt, Bordetella pertussis
gcgcggaucgacgcg

SEQ ID NO: 357940 - RNA, 16 nt, Bordetella pertussis
gcgcggaucgacgcga

SEQ ID NO: 357941 - RNA, 17 nt, Bordetella pertussis
gcgcggaugaccugcgc

SEQ ID NO: 357942 - RNA, 19 nt, Bordetella pertussis
gcgcggaugaccugcgcca

SEQ ID NO: 357943 - RNA, 23 nt, Bordetella pertussis
gcgcggaugaccugcgccaggug

SEQ ID NO: 357944 - RNA, 20 nt, Bordetella pertussis
gcgcggaucgugcgccacuu

SEQ ID NO: 357945 - RNA, 20 nt, Bordetella pertussis
gcgcggaugccguccacgcc

SEQ ID NO: 357946 - RNA, 23 nt, Bordetella pertussis
gcgcggauugaugucgcgcaccg

SEQ ID NO: 357947 - RNA, 18 nt, Bordetella pertussis
gcgcggcaaaaugccgcg

SEQ ID NO: 357948 - RNA, 16 nt, Bordetella pertussis
gcgcggcaaugcgcgc

SEQ ID NO: 357949 - RNA, 15 nt, Bordetella pertussis
gcgcggcacguccga

SEQ ID NO: 357950 - RNA, 23 nt, Bordetella pertussis
gcgcggcagugggcggugaccau

SEQ ID NO: 357951 - RNA, 13 nt, Bordetella pertussis
gcgcggcauacgc

SEQ ID NO: 357952 - RNA, 19 nt, Bordetella pertussis
gcgcggcauacgccgaugg

SEQ ID NO: 357953 - RNA, 14 nt, Bordetella pertussis
gcgcggcaucggcc

SEQ ID NO: 357954 - RNA, 14 nt, Bordetella pertussis
gcgcggcaugggca

SEQ ID NO: 357955 - RNA, 15 nt, Bordetella pertussis
gcgcggcaugggcac

SEQ ID NO: 357956 - RNA, 20 nt, Bordetella pertussis
gcgcggccacggccugcccg

SEQ ID NO: 357957 - RNA, 11 nt, Bordetella pertussis
gcgcggccagc

SEQ ID NO: 357958 - RNA, 12 nt, Bordetella pertussis
gcgcggccagca

SEQ ID NO: 357959 - RNA, 19 nt, Bordetella pertussis
gcgcggccagcaccggccg

SEQ ID NO: 357960 - RNA, 20 nt, Bordetella pertussis
gcgcggccagcaccggccgc

SEQ ID NO: 357961 - RNA, 13 nt, Bordetella pertussis
gcgcggccagcgc

SEQ ID NO: 357962 - RNA, 19 nt, Bordetella pertussis
gcgcggccagcgccggcgc

SEQ ID NO: 357963 - RNA, 15 nt, Bordetella pertussis
gcgcggccagcgcgg

SEQ ID NO: 357964 - RNA, 15 nt, Bordetella pertussis
gcgcggccagcgcgu

SEQ ID NO: 357965 - RNA, 13 nt, Bordetella pertussis
gcgcggccaggcg

SEQ ID NO: 357966 - RNA, 15 nt, Bordetella pertussis
gcgcggccaggcgcg

SEQ ID NO: 357967 - RNA, 17 nt, Bordetella pertussis
gcgcggccaggcgcuca

SEQ ID NO: 357968 - RNA, 12 nt, Bordetella pertussis
gcgcggccaggg

SEQ ID NO: 357969 - RNA, 22 nt, Bordetella pertussis
gcgcggccccaugcgcggcacg

SEQ ID NO: 357970 - RNA, 13 nt, Bordetella pertussis
gcgcggcccgcca

SEQ ID NO: 357971 - RNA, 21 nt, Bordetella pertussis
gcgcggcccgccacgcaggcg

SEQ ID NO: 357972 - RNA, 13 nt, Bordetella pertussis
gcgcggccgacgu

SEQ ID NO: 357973 - RNA, 23 nt, Bordetella pertussis
gcgcggccgacguggaccgcgcg

SEQ ID NO: 357974 - RNA, 23 nt, Bordetella pertussis
gcgcggccgaggucggcggucca

SEQ ID NO: 357975 - RNA, 13 nt, Bordetella pertussis
gcgcggcccggcg

SEQ ID NO: 357976 - RNA, 16 nt, Bordetella pertussis
gcgcggccgccgcccg

SEQ ID NO: 357977 - RNA, 17 nt, Bordetella pertussis
gcgcggccggcaccagg

SEQ ID NO: 357978 - RNA, 20 nt, Bordetella pertussis
gcgcggccggcaccaucugc

SEQ ID NO: 357979 - RNA, 12 nt, Bordetella pertussis
gcgcggccggcg

SEQ ID NO: 357980 - RNA, 13 nt, Bordetella pertussis
gcgcggccggcgc

SEQ ID NO: 357981 - RNA, 18 nt, Bordetella pertussis
gcgcggccggcgcgccgg

SEQ ID NO: 357982 - RNA, 22 nt, Bordetella pertussis
gcgcggccgggcucaggcugcg

SEQ ID NO: 357983 - RNA, 15 nt, Bordetella pertussis
gcgcggccgggucgg

SEQ ID NO: 357984 - RNA, 12 nt, Bordetella pertussis
gcgcggccggug

SEQ ID NO: 357985 - RNA, 18 nt, Bordetella pertussis
gcgcggccgucaccgccg

SEQ ID NO: 357986 - RNA, 17 nt, Bordetella pertussis
gcgcggccgucaggcgu

SEQ ID NO: 357987 - RNA, 21 nt, Bordetella pertussis
gcgcggccuauuuggcggccu

SEQ ID NO: 357988 - RNA, 21 nt, Bordetella pertussis
gcgcggccucgccggccuggc

SEQ ID NO: 357989 - RNA, 22 nt, Bordetella pertussis
gcgcggccucgccggccuggcg

SEQ ID NO: 357990 - RNA, 21 nt, Bordetella pertussis
gcgcggccucguaggccauca

SEQ ID NO: 357991 - RNA, 11 nt, Bordetella pertussis
gcgcggccugc

SEQ ID NO: 357992 - RNA, 13 nt, Bordetella pertussis
gcgcggccuggcg

SEQ ID NO: 357993 - RNA, 14 nt, Bordetella pertussis
gcgcggccuggcgg

SEQ ID NO: 357994 - RNA, 13 nt, Bordetella pertussis
gcgcggccugggc

SEQ ID NO: 357995 - RNA, 15 nt, Bordetella pertussis
gcgcggccugggcgg

SEQ ID NO: 357996 - RNA, 15 nt, Bordetella pertussis
gcgcggcgaaggcgc

SEQ ID NO: 357997 - RNA, 14 nt, Bordetella pertussis
gcgcggcgagccgc

SEQ ID NO: 357998 - RNA, 20 nt, Bordetella pertussis
gcgcggcgagcgccgccagg

SEQ ID NO: 357999 - RNA, 21 nt, Bordetella pertussis
gcgcggcgagcgccgccaggc

SEQ ID NO: 358000 - RNA, 16 nt, Bordetella pertussis
gcgcggcgaggcgucc

SEQ ID NO: 358001 - RNA, 17 nt, Bordetella pertussis
gcgcggcgaggcgucca

SEQ ID NO: 358002 - RNA, 13 nt, Bordetella pertussis
gcgcggcgaucgg

SEQ ID NO: 358003 - RNA, 14 nt, Bordetella pertussis
gcgcggcgcacagg

SEQ ID NO: 358004 - RNA, 13 nt, Bordetella pertussis
gcgcggcgcagcg

SEQ ID NO: 358005 - RNA, 18 nt, Bordetella pertussis
gcgcggcgcagcgcacga

SEQ ID NO: 358006 - RNA, 13 nt, Bordetella pertussis
gcgcggcgcaggc

SEQ ID NO: 358007 - RNA, 14 nt, Bordetella pertussis
gcgcggcgcaggcc

SEQ ID NO: 358008 - RNA, 18 nt, Bordetella pertussis
gcgcggcgcaggccugcg

SEQ ID NO: 358009 - RNA, 12 nt, Bordetella pertussis
gcgcggcgccau

SEQ ID NO: 358010 - RNA, 15 nt, Bordetella pertussis
gcgcggcgccaugcc

SEQ ID NO: 358011 - RNA, 17 nt, Bordetella pertussis
gcgcggcgccaugccgc

SEQ ID NO: 358012 - RNA, 13 nt, Bordetella pertussis
gcgcggcgccggc

SEQ ID NO: 358013 - RNA, 14 nt, Bordetella pertussis
gcgcggcgccggcc

SEQ ID NO: 358014 - RNA, 12 nt, Bordetella pertussis
gcgcggcgccgu

SEQ ID NO: 358015 - RNA, 18 nt, Bordetella pertussis
gcgcggcgccguccagcg

SEQ ID NO: 358016 - RNA, 15 nt, Bordetella pertussis
gcgcggcgccugcgc

SEQ ID NO: 358017 - RNA, 17 nt, Bordetella pertussis
gcgcggcgccugcgcgc

SEQ ID NO: 358018 - RNA, 16 nt, Bordetella pertussis
gcgcggcgccuggggc

SEQ ID NO: 358019 - RNA, 12 nt, Bordetella pertussis
gcgcggcgcgcg

SEQ ID NO: 358020 - RNA, 13 nt, Bordetella pertussis
gcgcggcgcgcga

SEQ ID NO: 358021 - RNA, 13 nt, Bordetella pertussis
gcgcggcgcgcgc

SEQ ID NO: 358022 - RNA, 15 nt, Bordetella pertussis
gcgcggcgcgcgcca

SEQ ID NO: 358023 - RNA, 14 nt, Bordetella pertussis
gcgcggcgcgcugg

SEQ ID NO: 358024 - RNA, 14 nt, Bordetella pertussis
gcgcggcgcgucgc

SEQ ID NO: 358025 - RNA, 15 nt, Bordetella pertussis
gcgcggcgcgucgcg

SEQ ID NO: 358026 - RNA, 20 nt, Bordetella pertussis
gcgcggcgcgugccagcagg

SEQ ID NO: 358027 - RNA, 15 nt, Bordetella pertussis
gcgcggcgcugcacg

SEQ ID NO: 358028 - RNA, 23 nt, Bordetella pertussis
gcgcggcgcugcacgcggccgcg

SEQ ID NO: 358029 - RNA, 14 nt, Bordetella pertussis
gcgcggcgcuggcg

SEQ ID NO: 358030 - RNA, 16 nt, Bordetella pertussis
gcgcggcgcuggcgcc

SEQ ID NO: 358031 - RNA, 14 nt, Bordetella pertussis
gcgcggcgcggcca

SEQ ID NO: 358032 - RNA, 18 nt, Bordetella pertussis
gcgcggcgcggcuggcga

SEQ ID NO: 358033 - RNA, 14 nt, Bordetella pertussis
gcgcggcggccagg

SEQ ID NO: 358034 - RNA, 15 nt, Bordetella pertussis
gcgcggcggccaggc

SEQ ID NO: 358035 - RNA, 14 nt, Bordetella pertussis
gcgcggcggccaug

SEQ ID NO: 358036 - RNA, 22 nt, Bordetella pertussis
gcgcggcggccaugcccaggcc

SEQ ID NO: 358037 - RNA, 16 nt, Bordetella pertussis
gcgcggcggccugggc

SEQ ID NO: 358038 - RNA, 12 nt, Bordetella pertussis
gcgcggcggcgg

SEQ ID NO: 358039 - RNA, 17 nt, Bordetella pertussis
gcgcggcggcggccaug

SEQ ID NO: 358040 - RNA, 12 nt, Bordetella pertussis
gcgcggcggcgu

SEQ ID NO: 358041 - RNA, 14 nt, Bordetella pertussis
gcgcggcggcguca

SEQ ID NO: 358042 - RNA, 16 nt, Bordetella pertussis
gcgcggcgggccccgc

SEQ ID NO: 358043 - RNA, 16 nt, Bordetella pertussis
gcgcggcgggcgcugg

SEQ ID NO: 358044 - RNA, 21 nt, Bordetella pertussis
gcgcggcgggcggcgcggcca

SEQ ID NO: 358045 - RNA, 24 nt, Bordetella pertussis
gcgcggcgggcucgagcuggcugg

SEQ ID NO: 358046 - RNA, 17 nt, Bordetella pertussis
gcgcggcgggacggcca

SEQ ID NO: 358047 - RNA, 15 nt, Bordetella pertussis
gcgcggcucgccgcg

SEQ ID NO: 358048 - RNA, 20 nt, Bordetella pertussis
gcgcggcucgccgcgcacgg

SEQ ID NO: 358049 - RNA, 17 nt, Bordetella pertussis
gcgcggcucgccggccg

SEQ ID NO: 358050 - RNA, 16 nt, Bordetella pertussis
gcgcggcugcccucgg

SEQ ID NO: 358051 - RNA, 22 nt, Bordetella pertussis
gcgcggcugcccucggucagcg

SEQ ID NO: 358052 - RNA, 19 nt, Bordetella pertussis
gcgcggcugcgggccggcg

SEQ ID NO: 358053 - RNA, 20 nt, Bordetella pertussis
gcgcggcugcgggccggcgc

SEQ ID NO: 358054 - RNA, 15 nt, Bordetella pertussis
gcgcggcuggcgaug

SEQ ID NO: 358055 - RNA, 22 nt, Bordetella pertussis
gcgcggcuggcuguucgccaug

SEQ ID NO: 358056 - RNA, 18 nt, Bordetella pertussis
gcgcggcuugguugucgc

SEQ ID NO: 358057 - RNA, 14 nt, Bordetella pertussis
gcgcggcuggauga

SEQ ID NO: 358058 - RNA, 19 nt, Bordetella pertussis
gcgcgggaagcgcucgcgc

SEQ ID NO: 358059 - RNA, 13 nt, Bordetella pertussis
gcgcgggagcccg

SEQ ID NO: 358060 - RNA, 19 nt, Bordetella pertussis
gcgcgggcacucggccaug

SEQ ID NO: 358061 - RNA, 15 nt, Bordetella pertussis
gcgcgggccagcaga

SEQ ID NO: 358062 - RNA, 13 nt, Bordetella pertussis
gcgcgggccagcu

SEQ ID NO: 358063 - RNA, 15 nt, Bordetella pertussis
gcgcgggcccuggcg

SEQ ID NO: 358064 - RNA, 15 nt, Bordetella pertussis
gcgcgggccgccgca

SEQ ID NO: 358065 - RNA, 13 nt, Bordetella pertussis
gcgcgggcgaugu

SEQ ID NO: 358066 - RNA, 16 nt, Bordetella pertussis
gcgcgggcgcggcagg

SEQ ID NO: 358067 - RNA, 13 nt, Bordetella pertussis
gcgcgggcgcgca

SEQ ID NO: 358068 - RNA, 17 nt, Bordetella pertussis
gcgcgggcggcuaggcg

SEQ ID NO: 358069 - RNA, 18 nt, Bordetella pertussis
gcgcgggcggucggcgcg

SEQ ID NO: 358070 - RNA, 21 nt, Bordetella pertussis
gcgcgggcggucggcgcggcg

SEQ ID NO: 358071 - RNA, 13 nt, Bordetella pertussis
gcgcgggcggccu

SEQ ID NO: 358072 - RNA, 16 nt, Bordetella pertussis
gcgcggggcaggccga

SEQ ID NO: 358073 - RNA, 14 nt, Bordetella pertussis
gcgcggggccaggc

SEQ ID NO: 358074 - RNA, 16 nt, Bordetella pertussis
gcgcggggccaggcgc

SEQ ID NO: 358075 - RNA, 17 nt, Bordetella pertussis
gcgcggggccaggcgca

SEQ ID NO: 358076 - RNA, 14 nt, Bordetella pertussis
gcgcgggcugucgc

SEQ ID NO: 358077 - RNA, 14 nt, Bordetella pertussis
gcgcggggccgguc

SEQ ID NO: 358078 - RNA, 17 nt, Bordetella pertussis
gcgcgggguaggccucg

SEQ ID NO: 358079 - RNA, 18 nt, Bordetella pertussis
gcgcggguaaugccggug

SEQ ID NO: 358080 - RNA, 23 nt, Bordetella pertussis
gcgcggguaggcaaagcgcagca

SEQ ID NO: 358081 - RNA, 13 nt, Bordetella pertussis
gcgcggguccagg

SEQ ID NO: 358082 - RNA, 16 nt, Bordetella pertussis
gcgcggguccaggccc

SEQ ID NO: 358083 - RNA, 21 nt, Bordetella pertussis
gcgcggguccggcgugccaug

SEQ ID NO: 358084 - RNA, 22 nt, Bordetella pertussis
gcgcggguccuugccgggcucg

SEQ ID NO: 358085 - RNA, 16 nt, Bordetella pertussis
gcgcgguagcgccccu

SEQ ID NO: 358086 - RNA, 21 nt, Bordetella pertussis
gcgcgguauucgcgcuggcgc

SEQ ID NO: 358087 - RNA, 21 nt, Bordetella pertussis
gcgcgguauugcgccaccccg

SEQ ID NO: 358088 - RNA, 23 nt, Bordetella pertussis
gcgcgguauugcgccaccccgcc

SEQ ID NO: 358089 - RNA, 15 nt, Bordetella pertussis
gcgcggucagcauga

SEQ ID NO: 358090 - RNA, 13 nt, Bordetella pertussis
gcgcgguccagca

SEQ ID NO: 358091 - RNA, 15 nt, Bordetella pertussis
gcgcgguccagcaag

SEQ ID NO: 358092 - RNA, 18 nt, Bordetella pertussis
gcgcgguccagcaaggcg

SEQ ID NO: 358093 - RNA, 13 nt, Bordetella pertussis
gcgcggucgacga

SEQ ID NO: 358094 - RNA, 21 nt, Bordetella pertussis
gcgcgguccaccucgucgucc

SEQ ID NO: 358095 - RNA, 15 nt, Bordetella pertussis
gcgcggucggcgggc

SEQ ID NO: 358096 - RNA, 15 nt, Bordetella pertussis
gcgcggugcgcacca

SEQ ID NO: 358097 - RNA, 19 nt, Bordetella pertussis
gcgcggugcgcaccaggcc

SEQ ID NO: 358098 - RNA, 21 nt, Bordetella pertussis
gcgcggugcgcaccaggccca

SEQ ID NO: 358099 - RNA, 16 nt, Bordetella pertussis
gcgcggugccgccugg

SEQ ID NO: 358100 - RNA, 20 nt, Bordetella pertussis
gcgcgguggccaugcugggc

SEQ ID NO: 358101 - RNA, 15 nt, Bordetella pertussis
gcgcgguggccgccg

SEQ ID NO: 358102 - RNA, 19 nt, Bordetella pertussis
gcgcgguggccgcuucggc

SEQ ID NO: 358103 - RNA, 17 nt, Bordetella pertussis
gcgcgguggggcgcaaa

SEQ ID NO: 358104 - RNA, 15 nt, Bordetella pertussis
gcgcgguucaucgcc

SEQ ID NO: 358105 - RNA, 18 nt, Bordetella pertussis
gcgcgguugagcgccagg

SEQ ID NO: 358106 - RNA, 20 nt, Bordetella pertussis
gcgcgguugagcgccagggc

SEQ ID NO: 358107 - RNA, 17 nt, Bordetella pertussis
gcgcgguugggcgcaca

SEQ ID NO: 358108 - RNA, 22 nt, Bordetella pertussis
gcgcgguugguuugcggcgcga

SEQ ID NO: 358109 - RNA, 22 nt, Bordetella pertussis
gcgcguaauaguggucgccggc

SEQ ID NO: 358110 - RNA, 13 nt, Bordetella pertussis
gcgcguacgcggc

SEQ ID NO: 358111 - RNA, 14 nt, Bordetella pertussis
gcgcguacgcggcg

SEQ ID NO: 358112 - RNA, 15 nt, Bordetella pertussis
gcgcguacguggcgc

SEQ ID NO: 358113 - RNA, 19 nt, Bordetella pertussis
gcgcguacguggcgcggcu

SEQ ID NO: 358114 - RNA, 18 nt, Bordetella pertussis
gcgcguaguccgagcccg

SEQ ID NO: 358115 - RNA, 13 nt, Bordetella pertussis
gcgcguaggcgcg

SEQ ID NO: 358116 - RNA, 13 nt, Bordetella pertussis
gcgcguauccagc

SEQ ID NO: 358117 - RNA, 18 nt, Bordetella pertussis
gcgcguaucggcgcgagc

SEQ ID NO: 358118 - RNA, 16 nt, Bordetella pertussis
gcgcguaugacgcgcu

SEQ ID NO: 358119 - RNA, 18 nt, Bordetella pertussis
gcgcguauggcggcgccg

SEQ ID NO: 358120 - RNA, 19 nt, Bordetella pertussis
gcgcguauggcggcgccga

SEQ ID NO: 358121 - RNA, 21 nt, Bordetella pertussis
gcgcguauuccggguccagcc

SEQ ID NO: 358122 - RNA, 22 nt, Bordetella pertussis
gcgcguaucgaauucgcagauu

SEQ ID NO: 358123 - RNA, 14 nt, Bordetella pertussis
gcgcgucaggcgag

SEQ ID NO: 358124 - RNA, 21 nt, Bordetella pertussis
gcgcgucaguugggcgcgccc

SEQ ID NO: 358125 - RNA, 12 nt, Bordetella pertussis
gcgcguccaggc

SEQ ID NO: 358126 - RNA, 16 nt, Bordetella pertussis
gcgcguccaggccaua

SEQ ID NO: 358127 - RNA, 21 nt, Bordetella pertussis
gcgcguccaggcgguccuggu

SEQ ID NO: 358128 - RNA, 13 nt, Bordetella pertussis
gcgcguccacgcc

SEQ ID NO: 358129 - RNA, 18 nt, Bordetella pertussis
gcgcguccacgccguggc

SEQ ID NO: 358130 - RNA, 20 nt, Bordetella pertussis
gcgcgucccgguaggccugg

SEQ ID NO: 358131 - RNA, 14 nt, Bordetella pertussis
gcgcguccugccag

SEQ ID NO: 358132 - RNA, 15 nt, Bordetella pertussis
gcgcguccugcgcca

SEQ ID NO: 358133 - RNA, 17 nt, Bordetella pertussis
gcgcguccugcgccagu

SEQ ID NO: 358134 - RNA, 13 nt, Bordetella pertussis
gcgcguccuggcg

SEQ ID NO: 358135 - RNA, 13 nt, Bordetella pertussis
gcgcguccugggc

SEQ ID NO: 358136 - RNA, 15 nt, Bordetella pertussis
gcgcguccugggccg

SEQ ID NO: 358137 - RNA, 18 nt, Bordetella pertussis
gcgcgucgcacugggugg

SEQ ID NO: 358138 - RNA, 21 nt, Bordetella pertussis
gcgcgucgcacuggguggcca

SEQ ID NO: 358139 - RNA, 13 nt, Bordetella pertussis
gcgcgucgccgcg

SEQ ID NO: 358140 - RNA, 14 nt, Bordetella pertussis
gcgcgucgccgcgc

SEQ ID NO: 358141 - RNA, 15 nt, Bordetella pertussis
gcgcgucgccgcgcc

SEQ ID NO: 358142 - RNA, 18 nt, Bordetella pertussis
gcgcgucgccgcuggcca

SEQ ID NO: 358143 - RNA, 13 nt, Bordetella pertussis
gcgcgucgccggc

SEQ ID NO: 358144 - RNA, 23 nt, Bordetella pertussis
gcgcgucgcgcgaucaggcggug

SEQ ID NO: 358145 - RNA, 14 nt, Bordetella pertussis
gcgcgucgcgcgcc

SEQ ID NO: 358146 - RNA, 15 nt, Bordetella pertussis
gcgcgucgcgcgcca

SEQ ID NO: 358147 - RNA, 18 nt, Bordetella pertussis
gcgcgucgcgcgccaggc

SEQ ID NO: 358148 - RNA, 18 nt, Bordetella pertussis
gcgcgucgcgcggcggca

SEQ ID NO: 358149 - RNA, 20 nt, Bordetella pertussis
gcgcgucgcgcggcggcacc

SEQ ID NO: 358150 - RNA, 16 nt, Bordetella pertussis
gcgcgucgcguagcgc

SEQ ID NO: 358151 - RNA, 14 nt, Bordetella pertussis
gcgcgucggccagg

SEQ ID NO: 358152 - RNA, 13 nt, Bordetella pertussis
gcgcgucggcgcc

SEQ ID NO: 358153 - RNA, 14 nt, Bordetella pertussis
gcgcgucggcgccg

SEQ ID NO: 358154 - RNA, 22 nt, Bordetella pertussis
gcgcgucggcgccgauggugcg

SEQ ID NO: 358155 - RNA, 14 nt, Bordetella pertussis
gcgcgucggcgcgg

SEQ ID NO: 358156 - RNA, 15 nt, Bordetella pertussis
gcgcgucggcgcggu

SEQ ID NO: 358157 - RNA, 18 nt, Bordetella pertussis
gcgcgucguccagcgugg

SEQ ID NO: 358158 - RNA, 20 nt, Bordetella pertussis
gcgcgucguccagcguggcg

SEQ ID NO: 358159 - RNA, 13 nt, Bordetella pertussis
gcgcgucuccagc

SEQ ID NO: 358160 - RNA, 14 nt, Bordetella pertussis
gcgcgucuccagcg

SEQ ID NO: 358161 - RNA, 19 nt, Bordetella pertussis
gcgcgucuccagcgccggc

SEQ ID NO: 358162 - RNA, 18 nt, Bordetella pertussis
gcgcgucuggaggacgag

SEQ ID NO: 358163 - RNA, 19 nt, Bordetella pertussis
gcgcgucuuuacgccgaga

SEQ ID NO: 358164 - RNA, 19 nt, Bordetella pertussis
gcgcgucgugcccgccacc

SEQ ID NO: 358165 - RNA, 23 nt, Bordetella pertussis
gcgcgugagaaaagugaucaccg

SEQ ID NO: 358166 - RNA, 15 nt, Bordetella pertussis
gcgcgugaggucgcg

SEQ ID NO: 358167 - RNA, 15 nt, Bordetella pertussis
gcgcgugcagccagc

SEQ ID NO: 358168 - RNA, 18 nt, Bordetella pertussis
gcgcgugcagcgccgcgc

SEQ ID NO: 358169 - RNA, 14 nt, Bordetella pertussis
gcgcgugccgcagg

SEQ ID NO: 358170 - RNA, 17 nt, Bordetella pertussis
gcgcgugccgcaggcca

SEQ ID NO: 358171 - RNA, 18 nt, Bordetella pertussis
gcgcgugccgcaggccag

SEQ ID NO: 358172 - RNA, 22 nt, Bordetella pertussis
gcgcgugccgcaggccagcccg

SEQ ID NO: 358173 - RNA, 13 nt, Bordetella pertussis
gcgcgugcgcagg

SEQ ID NO: 358174 - RNA, 15 nt, Bordetella pertussis
gcgcgugcgcaggcg

SEQ ID NO: 358175 - RNA, 16 nt, Bordetella pertussis
gcgcgugcgcaggcgc

SEQ ID NO: 358176 - RNA, 17 nt, Bordetella pertussis
gcgcgugcgcaggcgcg

SEQ ID NO: 358177 - RNA, 16 nt, Bordetella pertussis
gcgcgugcaggccgcg

SEQ ID NO: 358178 - RNA, 20 nt, Bordetella pertussis
gcgcgugcagggucagggug

SEQ ID NO: 358179 - RNA, 13 nt, Bordetella pertussis
gcgcgugccagca

SEQ ID NO: 358180 - RNA, 13 nt, Bordetella pertussis
gcgcgugcgcgcg

SEQ ID NO: 358181 - RNA, 18 nt, Bordetella pertussis
gcgcgugcgcgcgccaug

SEQ ID NO: 358182 - RNA, 17 nt, Bordetella pertussis
gcgcgugcucaucggca

SEQ ID NO: 358183 - RNA, 17 nt, Bordetella pertussis
gcgcgugcucgcgcaac

SEQ ID NO: 358184 - RNA, 16 nt, Bordetella pertussis
gcgcgugcuggcgcag

SEQ ID NO: 358185 - RNA, 21 nt, Bordetella pertussis
gcgcgugcuggcgcagcagcg

SEQ ID NO: 358186 - RNA, 19 nt, Bordetella pertussis
gcgcgugcugggccaugcg

SEQ ID NO: 358187 - RNA, 19 nt, Bordetella pertussis
gcgcguggccacggcgucg

SEQ ID NO: 358188 - RNA, 14 nt, Bordetella pertussis
gcgcguggccagca

SEQ ID NO: 358189 - RNA, 21 nt, Bordetella pertussis
gcgcguggccagcacggcgca

SEQ ID NO: 358190 - RNA, 22 nt, Bordetella pertussis
gcgcguggccaucaacguggcg

SEQ ID NO: 358191 - RNA, 23 nt, Bordetella pertussis
gcgcguggcccgcgccgcgucau

SEQ ID NO: 358192 - RNA, 18 nt, Bordetella pertussis
gcgcguggccgccacgcc

SEQ ID NO: 358193 - RNA, 15 nt, Bordetella pertussis
gcgcguggccggcga

SEQ ID NO: 358194 - RNA, 20 nt, Bordetella pertussis
gcgcguggccggcgacggca

SEQ ID NO: 358195 - RNA, 13 nt, Bordetella pertussis
gcgcguggcgcga

SEQ ID NO: 358196 - RNA, 12 nt, Bordetella pertussis
gcgcgugggcac

SEQ ID NO: 358197 - RNA, 18 nt, Bordetella pertussis
gcgcgugggcacccggcc

SEQ ID NO: 358198 - RNA, 19 nt, Bordetella pertussis
gcgcgugggcacccggccg

SEQ ID NO: 358199 - RNA, 20 nt, Bordetella pertussis
gcgcgugggcacccggccgc

SEQ ID NO: 358200 - RNA, 21 nt, Bordetella pertussis
gcgcgugggcacccggccgcu

SEQ ID NO: 358201 - RNA, 19 nt, Bordetella pertussis
gcgcgugggccagcaacug

SEQ ID NO: 358202 - RNA, 21 nt, Bordetella pertussis
gcgcgugggccagcaacuggu

SEQ ID NO: 358203 - RNA, 19 nt, Bordetella pertussis
gcgcgugucccagccggcg

SEQ ID NO: 358204 - RNA, 22 nt, Bordetella pertussis
gcgcgugucccagccggcggca

SEQ ID NO: 358205 - RNA, 17 nt, Bordetella pertussis
gcgcgugugguuggcgc

SEQ ID NO: 358206 - RNA, 19 nt, Bordetella pertussis
gcgcguucagcagcaggcc

SEQ ID NO: 358207 - RNA, 21 nt, Bordetella pertussis
gcgcguucaggucgccguucu

SEQ ID NO: 358208 - RNA, 15 nt, Bordetella pertussis
gcgcguucgccgcag

SEQ ID NO: 358209 - RNA, 19 nt, Bordetella pertussis
gcgcguucgccgcagccgu

SEQ ID NO: 358210 - RNA, 15 nt, Bordetella pertussis
gcgcguucgggucgu

SEQ ID NO: 358211 - RNA, 19 nt, Bordetella pertussis
gcgcguucgggucguuggu

SEQ ID NO: 358212 - RNA, 21 nt, Bordetella pertussis
gcgcguucucagccgcccgcc

SEQ ID NO: 358213 - RNA, 22 nt, Bordetella pertussis
gcgcguucucagccgcccgccg

SEQ ID NO: 358214 - RNA, 22 nt, Bordetella pertussis
gcgcguugagcagcaugugcuc

SEQ ID NO: 358215 - RNA, 22 nt, Bordetella pertussis
gcgcguugaucaucggcccgau

SEQ ID NO: 358216 - RNA, 18 nt, Bordetella pertussis
gcgcguugcgcaucgcgc

SEQ ID NO: 358217 - RNA, 20 nt, Bordetella pertussis
gcgcguugcgcaucgcgcac

SEQ ID NO: 358218 - RNA, 21 nt, Bordetella pertussis
gcgcguugcgcaucgcgcacc

SEQ ID NO: 358219 - RNA, 16 nt, Bordetella pertussis
gcgcguuuucgcuggc

SEQ ID NO: 358220 - RNA, 17 nt, Bordetella pertussis
gcgcguuuucgcuggcg

SEQ ID NO: 358221 - RNA, 18 nt, Bordetella pertussis
gcgcguuuucgcuggcgg

SEQ ID NO: 358222 - RNA, 13 nt, Bordetella pertussis
gcgcuacagggug

SEQ ID NO: 358223 - RNA, 13 nt, Bordetella pertussis
gcgcuacgccgcc

SEQ ID NO: 358224 - RNA, 22 nt, Bordetella pertussis
gcgcuacgccgccgauggcgcg

SEQ ID NO: 358225 - RNA, 24 nt, Bordetella pertussis
gcgcuacgacgagaucgcgccuac

SEQ ID NO: 358226 - RNA, 20 nt, Bordetella pertussis
gcgcucaccgagggccggac

SEQ ID NO: 358227 - RNA, 17 nt, Bordetella pertussis
gcgcucagcaccaggcc

SEQ ID NO: 358228 - RNA, 20 nt, Bordetella pertussis
gcgcucagcaccaggccgcc

SEQ ID NO: 358229 - RNA, 14 nt, Bordetella pertussis
gcgcucagcgccau

SEQ ID NO: 358230 - RNA, 17 nt, Bordetella pertussis
gcgcucagcgccaucau

SEQ ID NO: 358231 - RNA, 17 nt, Bordetella pertussis
gcgcucagccgugccgc

SEQ ID NO: 358232 - RNA, 13 nt, Bordetella pertussis
gcgcucagcgcgc

SEQ ID NO: 358233 - RNA, 22 nt, Bordetella pertussis
gcgcucaggaaccagcggcugg

SEQ ID NO: 358234 - RNA, 23 nt, Bordetella pertussis
gcgcucaggaaccagcggcuggc

SEQ ID NO: 358235 - RNA, 14 nt, Bordetella pertussis
gcgcucaggccgcc

SEQ ID NO: 358236 - RNA, 18 nt, Bordetella pertussis
gcgcucaggccgccggcg

SEQ ID NO: 358237 - RNA, 14 nt, Bordetella pertussis
gcgcucaggcggug

SEQ ID NO: 358238 - RNA, 15 nt, Bordetella pertussis
gcgcucagggggcgc

SEQ ID NO: 358239 - RNA, 17 nt, Bordetella pertussis
gcgcucagggggcgccc

SEQ ID NO: 358240 - RNA, 22 nt, Bordetella pertussis
gcgcucaguagcucgaccauca

SEQ ID NO: 358241 - RNA, 15 nt, Bordetella pertussis
gcgcucaucaucgcg

SEQ ID NO: 358242 - RNA, 22 nt, Bordetella pertussis
gcgcucaucaucgcgcuggcgc

SEQ ID NO: 358243 - RNA, 18 nt, Bordetella pertussis
gcgcucauguucgggcgc

SEQ ID NO: 358244 - RNA, 19 nt, Bordetella pertussis
gcgcucauguucgggcgcg

SEQ ID NO: 358245 - RNA, 20 nt, Bordetella pertussis
gcgcuccagcgucauggccu

SEQ ID NO: 358246 - RNA, 14 nt, Bordetella pertussis
gcgcuccauggcgc

SEQ ID NO: 358247 - RNA, 15 nt, Bordetella pertussis
gcgcuccauggcgcc

SEQ ID NO: 358248 - RNA, 16 nt, Bordetella pertussis
gcgcuccauggcgccg

SEQ ID NO: 358249 - RNA, 13 nt, Bordetella pertussis
gcgcucccgccaa

SEQ ID NO: 358250 - RNA, 21 nt, Bordetella pertussis
gcgcuccaugaucucgggcga

SEQ ID NO: 358251 - RNA, 13 nt, Bordetella pertussis
gcgcuccugcucg

SEQ ID NO: 358252 - RNA, 22 nt, Bordetella pertussis
gcgcuccugcucggcgaugcgc

SEQ ID NO: 358253 - RNA, 19 nt, Bordetella pertussis
gcgcucgaaggcgccgacg

SEQ ID NO: 358254 - RNA, 20 nt, Bordetella pertussis
gcgcucgaaggcgccgacgg

SEQ ID NO: 358255 - RNA, 21 nt, Bordetella pertussis
gcgcucgaaggcgccgacggc

SEQ ID NO: 358256 - RNA, 19 nt, Bordetella pertussis
gcgcucgaauggcugcgcg

SEQ ID NO: 358257 - RNA, 21 nt, Bordetella pertussis
gcgcucgaauggcugcgcgcc

SEQ ID NO: 358258 - RNA, 14 nt, Bordetella pertussis
gcgcucgaaaaagc

SEQ ID NO: 358259 - RNA, 20 nt, Bordetella pertussis
gcgcucgagcaucuggcgca

SEQ ID NO: 358260 - RNA, 18 nt, Bordetella pertussis
gcgcucgagcgcggcgcg

SEQ ID NO: 358261 - RNA, 14 nt, Bordetella pertussis
gcgcucgcccagca

SEQ ID NO: 358262 - RNA, 13 nt, Bordetella pertussis
gcgcucgccccgg

SEQ ID NO: 358263 - RNA, 18 nt, Bordetella pertussis
gcgcucgccccggcgcgc

SEQ ID NO: 358264 - RNA, 19 nt, Bordetella pertussis
gcgcucgccccggcgcgca

SEQ ID NO: 358265 - RNA, 21 nt, Bordetella pertussis
gcgcucgccccggcgcgcagc

SEQ ID NO: 358266 - RNA, 16 nt, Bordetella pertussis
gcgcucgcccggccac

SEQ ID NO: 358267 - RNA, 23 nt, Bordetella pertussis
gcgcucgcccggccacguguggc

SEQ ID NO: 358268 - RNA, 16 nt, Bordetella pertussis
gcgcucgcccucgcgc

SEQ ID NO: 358269 - RNA, 19 nt, Bordetella pertussis
gcgcucgccggcgcgcagg

SEQ ID NO: 358270 - RNA, 20 nt, Bordetella pertussis
gcgcucgccggcgcgcaggc

SEQ ID NO: 358271 - RNA, 15 nt, Bordetella pertussis
gcggcacgcgcgccg

SEQ ID NO: 358272 - RNA, 13 nt, Bordetella pertussis
gcggcacgcugcu

SEQ ID NO: 358273 - RNA, 14 nt, Bordetella pertussis
gcggcacggcuggg

SEQ ID NO: 358274 - RNA, 14 nt, Bordetella pertussis
gcggcacggccggc

SEQ ID NO: 358275 - RNA, 13 nt, Bordetella pertussis
gcggcacgguuuc

SEQ ID NO: 358276 - RNA, 19 nt, Bordetella pertussis
gcggcacgugccggauggc

SEQ ID NO: 358277 - RNA, 20 nt, Bordetella pertussis
gcggcacgugccggauggcg

SEQ ID NO: 358278 - RNA, 16 nt, Bordetella pertussis
gcggcacugaugcugg

SEQ ID NO: 358279 - RNA, 15 nt, Bordetella pertussis
gcggcagcauggcgc

SEQ ID NO: 358280 - RNA, 16 nt, Bordetella pertussis
gcggcagcauggcgcg

SEQ ID NO: 358281 - RNA, 20 nt, Bordetella pertussis
gcggcagccagguggcgaug

SEQ ID NO: 358282 - RNA, 22 nt, Bordetella pertussis
gcggcagcucggcgaagccgca

SEQ ID NO: 358283 - RNA, 21 nt, Bordetella pertussis
gcggcagcuugaccgccucca

SEQ ID NO: 358284 - RNA, 15 nt, Bordetella pertussis
gcggcaggcccagcu

SEQ ID NO: 358285 - RNA, 16 nt, Bordetella pertussis
gcggcaggcccugccg

SEQ ID NO: 358286 - RNA, 18 nt, Bordetella pertussis
gcggcaggcccugccgcc

SEQ ID NO: 358287 - RNA, 16 nt, Bordetella pertussis
gcggcaggccgcgcca

SEQ ID NO: 358288 - RNA, 17 nt, Bordetella pertussis
gcggcaggccgcgccac

SEQ ID NO: 358289 - RNA, 14 nt, Bordetella pertussis
gcggcaggccgcag

SEQ ID NO: 358290 - RNA, 16 nt, Bordetella pertussis
gcggcaggcggcugac

SEQ ID NO: 358291 - RNA, 16 nt, Bordetella pertussis
gcggcaggcuggccgg

SEQ ID NO: 358292 - RNA, 19 nt, Bordetella pertussis
gcggcauacgccgauggcg

SEQ ID NO: 358293 - RNA, 23 nt, Bordetella pertussis
gcggcauagcccaggccgccggc

SEQ ID NO: 358294 - RNA, 18 nt, Bordetella pertussis
gcggcaucgacaugcccg

SEQ ID NO: 358295 - RNA, 21 nt, Bordetella pertussis
gcggcaucgagaaaccagccg

SEQ ID NO: 358296 - RNA, 23 nt, Bordetella pertussis
gcggcaucgagaaaccagccgcc

SEQ ID NO: 358297 - RNA, 13 nt, Bordetella pertussis
gcggcaugcuggu

SEQ ID NO: 358298 - RNA, 13 nt, Bordetella pertussis
aagcgcaugucga

SEQ ID NO: 358299 - RNA, 22 nt, Bordetella pertussis
aagcgcccaggccgaucagcgg

SEQ ID NO: 358300 - RNA, 20 nt, Bordetella pertussis
aagcgcccuggcguggcgcg

SEQ ID NO: 358301 - RNA, 21 nt, Bordetella pertussis
aagcgcgacaugacgaugguc

SEQ ID NO: 358302 - RNA, 18 nt, Bordetella pertussis
aagcgcgccagcagcgcc

SEQ ID NO: 358303 - RNA, 19 nt, Bordetella pertussis
aagcgcgccagcagcgccg

SEQ ID NO: 358304 - RNA, 15 nt, Bordetella pertussis
gcggccaccaccagg

SEQ ID NO: 358305 - RNA, 17 nt, Bordetella pertussis
gcggccaccaccaggcc

SEQ ID NO: 358306 - RNA, 12 nt, Bordetella pertussis
gcggccaccagg

SEQ ID NO: 358307 - RNA, 17 nt, Bordetella pertussis
gcggccacccugccgug

SEQ ID NO: 358308 - RNA, 19 nt, Bordetella pertussis
gcggccacccugccgugca

SEQ ID NO: 358309 - RNA, 17 nt, Bordetella pertussis
gcggccacgaccggcuc

SEQ ID NO: 358310 - RNA, 14 nt, Bordetella pertussis
gcggccacggccug

SEQ ID NO: 358311 - RNA, 22 nt, Bordetella pertussis
gcggccacggccugcccgggcg

SEQ ID NO: 358312 - RNA, 23 nt, Bordetella pertussis
gcggccacggccugcccgggcgg

SEQ ID NO: 358313 - RNA, 21 nt, Bordetella pertussis
gcggccacgcgccgcccgggc

SEQ ID NO: 358314 - RNA, 15 nt, Bordetella pertussis
gcggccagcaagcgc

SEQ ID NO: 358315 - RNA, 18 nt, Bordetella pertussis
gcggccagcaagcgcgcc

SEQ ID NO: 358316 - RNA, 13 nt, Bordetella pertussis
gcggccagcacga

SEQ ID NO: 358317 - RNA, 15 nt, Bordetella pertussis
gcggccagcagcgcg

SEQ ID NO: 358318 - RNA, 18 nt, Bordetella pertussis
gcggccagccacgccggc

SEQ ID NO: 358319 - RNA, 15 nt, Bordetella pertussis
gcggccagccugccg

SEQ ID NO: 358320 - RNA, 22 nt, Bordetella pertussis
gcggccagccugccgcggccgc

SEQ ID NO: 358321 - RNA, 13 nt, Bordetella pertussis
gcggccagcgccg

SEQ ID NO: 358322 - RNA, 15 nt, Bordetella pertussis
gcggccagcgccggc

SEQ ID NO: 358323 - RNA, 16 nt, Bordetella pertussis
gcggccagcgccggcg

SEQ ID NO: 358324 - RNA, 22 nt, Bordetella pertussis
gcggccagcgccggcgcgcgcu

SEQ ID NO: 358325 - RNA, 13 nt, Bordetella pertussis
gcggccagcgcgg

SEQ ID NO: 358326 - RNA, 15 nt, Bordetella pertussis
gcggccagcgcggcg

SEQ ID NO: 358327 - RNA, 15 nt, Bordetella pertussis
gcggccagcggcgcu

SEQ ID NO: 358328 - RNA, 23 nt, Bordetella pertussis
gcggccagcgcggcggcagcgcg

SEQ ID NO: 358329 - RNA, 14 nt, Bordetella pertussis
gcggccagcgcggu

SEQ ID NO: 358330 - RNA, 21 nt, Bordetella pertussis
gcggccagcuugaccgccagc

SEQ ID NO: 358331 - RNA, 22 nt, Bordetella pertussis
gcggccagcuugaccgccagca

SEQ ID NO: 358332 - RNA, 17 nt, Bordetella pertussis
gcggccaggaucgcggc

SEQ ID NO: 358333 - RNA, 22 nt, Bordetella pertussis
gcggccaggaucgcggccagcc

SEQ ID NO: 358334 - RNA, 23 nt, Bordetella pertussis
gcggccaggaucgcggccagccg

SEQ ID NO: 358335 - RNA, 18 nt, Bordetella pertussis
gcggccaggcccaugccg

SEQ ID NO: 358336 - RNA, 20 nt, Bordetella pertussis
gcggccaggcccaugccgcc

SEQ ID NO: 358337 - RNA, 12 nt, Bordetella pertussis
gcggccaggccg

SEQ ID NO: 358338 - RNA, 17 nt, Bordetella pertussis
gcggccaggccgaacgc

SEQ ID NO: 358339 - RNA, 14 nt, Bordetella pertussis
gcggccaggccggc

SEQ ID NO: 358340 - RNA, 20 nt, Bordetella pertussis
gcggccagcucggcggccgc

SEQ ID NO: 358341 - RNA, 21 nt, Bordetella pertussis
gcggccaggccggggccgugg

SEQ ID NO: 358342 - RNA, 16 nt, Bordetella pertussis
gcggccaggccggugg

SEQ ID NO: 358343 - RNA, 14 nt, Bordetella pertussis
gcggccaggcgcgc

SEQ ID NO: 358344 - RNA, 16 nt, Bordetella pertussis
gcggccaggcgcgugc

SEQ ID NO: 358345 - RNA, 18 nt, Bordetella pertussis
gcggccaggcgcucagcg

SEQ ID NO: 358346 - RNA, 11 nt, Bordetella pertussis
gcggccagggc

SEQ ID NO: 358347 - RNA, 15 nt, Bordetella pertussis
gcggccagggcaagc

SEQ ID NO: 358348 - RNA, 18 nt, Bordetella pertussis
gcggccagggccugcggg

SEQ ID NO: 358349 - RNA, 22 nt, Bordetella pertussis
gcggccagggccugcgggccgg

SEQ ID NO: 358350 - RNA, 14 nt, Bordetella pertussis
gcggccagggugcc

SEQ ID NO: 358351 - RNA, 16 nt, Bordetella pertussis
gcggccagggugcccc

SEQ ID NO: 358352 - RNA, 21 nt, Bordetella pertussis
gcggccaggucggcgucgucg

SEQ ID NO: 358353 - RNA, 12 nt, Bordetella pertussis
gcggccagggcu

SEQ ID NO: 358354 - RNA, 17 nt, Bordetella pertussis
gcggccaguucguccgc

SEQ ID NO: 358355 - RNA, 12 nt, Bordetella pertussis
gcggccaucgcc

SEQ ID NO: 358356 - RNA, 20 nt, Bordetella pertussis
gcggccaucgccauggccac

SEQ ID NO: 358357 - RNA, 13 nt, Bordetella pertussis
gcggccaucgccg

SEQ ID NO: 358358 - RNA, 17 nt, Bordetella pertussis
gcggccaucgccgccac

SEQ ID NO: 358359 - RNA, 22 nt, Bordetella pertussis
gcggccaucuuggugcgcgcca

SEQ ID NO: 358360 - RNA, 22 nt, Bordetella pertussis
gcggccaugacggccauccggc

SEQ ID NO: 358361 - RNA, 16 nt, Bordetella pertussis
gcggccaugcccaggc

SEQ ID NO: 358362 - RNA, 15 nt, Bordetella pertussis
gcggccaugccgacg

SEQ ID NO: 358363 - RNA, 13 nt, Bordetella pertussis
gcggccaugccgg

SEQ ID NO: 358364 - RNA, 21 nt, Bordetella pertussis
gcggccaugcggugcgccgcg

SEQ ID NO: 358365 - RNA, 15 nt, Bordetella pertussis
gcggccauguccagc

SEQ ID NO: 358366 - RNA, 16 nt, Bordetella pertussis
gcggccauguccagca

SEQ ID NO: 358367 - RNA, 13 nt, Bordetella pertussis
gcggcccacggcc

SEQ ID NO: 358368 - RNA, 14 nt, Bordetella pertussis
gcggcccacggcca

SEQ ID NO: 358369 - RNA, 17 nt, Bordetella pertussis
gcggcccacggccagca

SEQ ID NO: 358370 - RNA, 19 nt, Bordetella pertussis
gcggcccacggccagcacu

SEQ ID NO: 358371 - RNA, 14 nt, Bordetella pertussis
gcggcccagccgcu

SEQ ID NO: 358372 - RNA, 18 nt, Bordetella pertussis
gcggcccagccgcucggc

SEQ ID NO: 358373 - RNA, 20 nt, Bordetella pertussis
gcggcccagccgcucggcca

SEQ ID NO: 358374 - RNA, 15 nt, Bordetella pertussis
gcggcccacagcgcc

SEQ ID NO: 358375 - RNA, 14 nt, Bordetella pertussis
gcggcccagcgcgg

SEQ ID NO: 358376 - RNA, 18 nt, Bordetella pertussis
gcggcccagcgcggcggc

SEQ ID NO: 358377 - RNA, 15 nt, Bordetella pertussis
gcggcccaucgugcg

SEQ ID NO: 358378 - RNA, 19 nt, Bordetella pertussis
gcggcccauucgcgcaccg

SEQ ID NO: 358379 - RNA, 20 nt, Bordetella pertussis
gcggcccauucgcgcaccga

SEQ ID NO: 358380 - RNA, 13 nt, Bordetella pertussis
gcggccccaggua

SEQ ID NO: 358381 - RNA, 18 nt, Bordetella pertussis
gcggccccagguagacca

SEQ ID NO: 358382 - RNA, 19 nt, Bordetella pertussis
gcggccccagguagaccac

SEQ ID NO: 358383 - RNA, 17 nt, Bordetella pertussis
gcggccccagucgcugc

SEQ ID NO: 358384 - RNA, 20 nt, Bordetella pertussis
gcggccccaugcgcggcacg

SEQ ID NO: 358385 - RNA, 19 nt, Bordetella pertussis
gcggcccaggcguccaggc

SEQ ID NO: 358386 - RNA, 14 nt, Bordetella pertussis
gcggccccggcacc

SEQ ID NO: 358387 - RNA, 16 nt, Bordetella pertussis
aagcgcguggccggcg

SEQ ID NO: 358388 - RNA, 23 nt, Bordetella pertussis
aagcgcguggccggcgacggcau

SEQ ID NO: 358389 - RNA, 17 nt, Bordetella pertussis
aagcggcguggggccgg

SEQ ID NO: 358390 - RNA, 19 nt, Bordetella pertussis
aagcggcguggggccggcc

SEQ ID NO: 358391 - RNA, 23 nt, Bordetella pertussis
aagcggcgugugcccagcaccag

SEQ ID NO: 358392 - RNA, 17 nt, Bordetella pertussis
aagcggcucaggcgcgg

SEQ ID NO: 358393 - RNA, 22 nt, Bordetella pertussis
gcggccccggcucccgcgccau

SEQ ID NO: 358394 - RNA, 18 nt, Bordetella pertussis
aagcgggccugccgcgcg

SEQ ID NO: 358395 - RNA, 20 nt, Bordetella pertussis
gcggccccucaaggggugga

SEQ ID NO: 358396 - RNA, 13 nt, Bordetella pertussis
gcggcccgcaugu

SEQ ID NO: 358397 - RNA, 13 nt, Bordetella pertussis
gcggcccgccacg

SEQ ID NO: 358398 - RNA, 14 nt, Bordetella pertussis
gcggcccgccaggg

SEQ ID NO: 358399 - RNA, 14 nt, Bordetella pertussis
gcggcccgcuccag

SEQ ID NO: 358400 - RNA, 16 nt, Bordetella pertussis
gcggcccgcuccaggc

SEQ ID NO: 358401 - RNA, 17 nt, Bordetella pertussis
gcggcccgcuccaggcg

SEQ ID NO: 358402 - RNA, 19 nt, Bordetella pertussis
gcggcccgcuccaggcggc

SEQ ID NO: 358403 - RNA, 13 nt, Bordetella pertussis
gcggcccggccaa

SEQ ID NO: 358404 - RNA, 13 nt, Bordetella pertussis
gcggcccggccgc

SEQ ID NO: 358405 - RNA, 15 nt, Bordetella pertussis
gcggcccggcggcaa

SEQ ID NO: 358406 - RNA, 21 nt, Bordetella pertussis
gcggcccgggcgagauggcgu

SEQ ID NO: 358407 - RNA, 22 nt, Bordetella pertussis
gcggcccgggcgagauggcgug

SEQ ID NO: 358408 - RNA, 14 nt, Bordetella pertussis
gcggcccugggcca

SEQ ID NO: 358409 - RNA, 15 nt, Bordetella pertussis
gcggcccugggccag

SEQ ID NO: 358410 - RNA, 23 nt, Bordetella pertussis
gcggcccugggccagccagcgcc

SEQ ID NO: 358411 - RNA, 16 nt, Bordetella pertussis
gcggcccuggucgucg

SEQ ID NO: 358412 - RNA, 17 nt, Bordetella pertussis
gcggcccuggucgucgc

SEQ ID NO: 358413 - RNA, 20 nt, Bordetella pertussis
gcggcccuggucgucgcggc

SEQ ID NO: 358414 - RNA, 22 nt, Bordetella pertussis
gcggccgacagcuugcgcuggc

SEQ ID NO: 358415 - RNA, 14 nt, Bordetella pertussis
gcggccgaccagca

SEQ ID NO: 358416 - RNA, 16 nt, Bordetella pertussis
gcggccgaccagcacg

SEQ ID NO: 358417 - RNA, 17 nt, Bordetella pertussis
gcggccgaccagcacga

SEQ ID NO: 358418 - RNA, 23 nt, Bordetella pertussis
gcggccgaccagcacgauccagc

SEQ ID NO: 358419 - RNA, 21 nt, Bordetella pertussis
gcggccgcgcaccugcugcgg

SEQ ID NO: 358420 - RNA, 21 nt, Bordetella pertussis
gcggccgcgcaggauuucauc

SEQ ID NO: 358421 - RNA, 13 nt, Bordetella pertussis
gcggccgcgcccg

SEQ ID NO: 358422 - RNA, 21 nt, Bordetella pertussis
gcggccgcgcgcuucaggcgc

SEQ ID NO: 358423 - RNA, 14 nt, Bordetella pertussis
gcggccgcgcuggc

SEQ ID NO: 358424 - RNA, 18 nt, Bordetella pertussis
gcggccgcgcuggcgcug

SEQ ID NO: 358425 - RNA, 13 nt, Bordetella pertussis
gcggccgcgucga

SEQ ID NO: 358426 - RNA, 22 nt, Bordetella pertussis
gcggccgcgucgaucagcgcgg

SEQ ID NO: 358427 - RNA, 12 nt, Bordetella pertussis
gcggccgcguca

SEQ ID NO: 358428 - RNA, 13 nt, Bordetella pertussis
gcggccgcgucca

SEQ ID NO: 358429 - RNA, 14 nt, Bordetella pertussis
gcggccgcguccag

SEQ ID NO: 358430 - RNA, 19 nt, Bordetella pertussis
gcggccgcguccagcgcgc

SEQ ID NO: 358431 - RNA, 16 nt, Bordetella pertussis
gcggccgcgggccgcu

SEQ ID NO: 358432 - RNA, 19 nt, Bordetella pertussis
gcggccgcgggccgcuggu

SEQ ID NO: 358433 - RNA, 17 nt, Bordetella pertussis
gcggccggccgcgccca

SEQ ID NO: 358434 - RNA, 14 nt, Bordetella pertussis
gcggccggccgggu

SEQ ID NO: 358435 - RNA, 23 nt, Bordetella pertussis
gcggccggccggguugucgccca

SEQ ID NO: 358436 - RNA, 14 nt, Bordetella pertussis
gcggccggccugcg

SEQ ID NO: 358437 - RNA, 13 nt, Bordetella pertussis
gcggccggcgcag

SEQ ID NO: 358438 - RNA, 12 nt, Bordetella pertussis
gcggccggcgcg

SEQ ID NO: 358439 - RNA, 20 nt, Bordetella pertussis
gcggccggcgcgccggccug

SEQ ID NO: 358440 - RNA, 14 nt, Bordetella pertussis
gcggccggcgcgcg

SEQ ID NO: 358441 - RNA, 21 nt, Bordetella pertussis
gcggccggcgcgcgcgaccac

SEQ ID NO: 358442 - RNA, 13 nt, Bordetella pertussis
gcggccggcgcug

SEQ ID NO: 358443 - RNA, 15 nt, Bordetella pertussis
gcggccggcgcugau

SEQ ID NO: 358444 - RNA, 22 nt, Bordetella pertussis
gcggccggcgcgucgccggcga

SEQ ID NO: 358445 - RNA, 17 nt, Bordetella pertussis
gcggccggcuugcgcaa

SEQ ID NO: 358446 - RNA, 17 nt, Bordetella pertussis
gcggccgucggcgcugg

SEQ ID NO: 358447 - RNA, 17 nt, Bordetella pertussis
gcggccgucgugcagcg

SEQ ID NO: 358448 - RNA, 23 nt, Bordetella pertussis
gcggccggcucguaggcgagguc

SEQ ID NO: 358449 - RNA, 16 nt, Bordetella pertussis
gcggccguggcggccu

SEQ ID NO: 358450 - RNA, 19 nt, Bordetella pertussis
gcggccguguucgagcagg

SEQ ID NO: 358451 - RNA, 19 nt, Bordetella pertussis
gcggccguuggcgauggcg

SEQ ID NO: 358452 - RNA, 22 nt, Bordetella pertussis
gcggccuaugugcaggccaccg

SEQ ID NO: 358453 - RNA, 22 nt, Bordetella pertussis
gcggccuauuuggcggccuggc

SEQ ID NO: 358454 - RNA, 18 nt, Bordetella pertussis
gcggccuccgcgcacagc

SEQ ID NO: 358455 - RNA, 14 nt, Bordetella pertussis
gcggccuccggcag

SEQ ID NO: 358456 - RNA, 19 nt, Bordetella pertussis
gcggccugcuuggcagccu

SEQ ID NO: 358457 - RNA, 22 nt, Bordetella pertussis
gcggccuggaccugagccaggc

SEQ ID NO: 358458 - RNA, 12 nt, Bordetella pertussis
gcggccuggccc

SEQ ID NO: 358459 - RNA, 13 nt, Bordetella pertussis
gcggccuggccgc

SEQ ID NO: 358460 - RNA, 15 nt, Bordetella pertussis
gcggccuggccgggg

SEQ ID NO: 358461 - RNA, 14 nt, Bordetella pertussis
gcggccugggcggc

SEQ ID NO: 358462 - RNA, 22 nt, Bordetella pertussis
gcggccugggaggcgcugaugc

SEQ ID NO: 358463 - RNA, 14 nt, Bordetella pertussis
gcggccuucacccc

SEQ ID NO: 358464 - RNA, 22 nt, Bordetella pertussis
gcggccuucaugaucuggccga

SEQ ID NO: 358465 - RNA, 16 nt, Bordetella pertussis
gcggccuugccggugg

SEQ ID NO: 358466 - RNA, 23 nt, Bordetella pertussis
gcggccuugccgguggacggcca

SEQ ID NO: 358467 - RNA, 21 nt, Bordetella pertussis
gcggccuugagcaucugcggc

SEQ ID NO: 358468 - RNA, 16 nt, Bordetella pertussis
gcggccuuggucgcga

SEQ ID NO: 358469 - RNA, 17 nt, Bordetella pertussis
gcggccuuggucgcgac

SEQ ID NO: 358470 - RNA, 20 nt, Bordetella pertussis
gcggccuuggucgcgaccuc

SEQ ID NO: 358471 - RNA, 17 nt, Bordetella pertussis
gcggccuugugcgccag

SEQ ID NO: 358472 - RNA, 19 nt, Bordetella pertussis
gcggccuugugcgccagcg

SEQ ID NO: 358473 - RNA, 21 nt, Bordetella pertussis
gcggccuugugcgccagcgcg

SEQ ID NO: 358474 - RNA, 22 nt, Bordetella pertussis
gcggccuugugcgccagcgcga

SEQ ID NO: 358475 - RNA, 22 nt, Bordetella pertussis
gcggccuugcgggccggcuggg

SEQ ID NO: 358476 - RNA, 21 nt, Bordetella pertussis
gcggccuuuuuuugcggcacg

SEQ ID NO: 358477 - RNA, 23 nt, Bordetella pertussis
gcggccuuuuuuugcggcacggc

SEQ ID NO: 358478 - RNA, 15 nt, Bordetella pertussis
gcggcgaaaugucga

SEQ ID NO: 358479 - RNA, 16 nt, Bordetella pertussis
gcggcgaaaugucgag

SEQ ID NO: 358480 - RNA, 18 nt, Bordetella pertussis
gcggcgaaaugucgagcg

SEQ ID NO: 358481 - RNA, 19 nt, Bordetella pertussis
gcggcgacgaacccgggcg

SEQ ID NO: 358482 - RNA, 13 nt, Bordetella pertussis
gcggcgacgaugc

SEQ ID NO: 358483 - RNA, 22 nt, Bordetella pertussis
gcggcgacgcagcacggcuugc

SEQ ID NO: 358484 - RNA, 19 nt, Bordetella pertussis
gcggcgacggcgccuggcg

SEQ ID NO: 358485 - RNA, 19 nt, Bordetella pertussis
gcggcgacggcgucggccu

SEQ ID NO: 358486 - RNA, 20 nt, Bordetella pertussis
gcggcgacggcgucggccug

SEQ ID NO: 358487 - RNA, 18 nt, Bordetella pertussis
gcggcgccagcgccccgg

SEQ ID NO: 358488 - RNA, 14 nt, Bordetella pertussis
gcggcgccagcgcu

SEQ ID NO: 358489 - RNA, 14 nt, Bordetella pertussis
gcggcgccagcgga

SEQ ID NO: 358490 - RNA, 19 nt, Bordetella pertussis
gcggcgccagcggauggug

SEQ ID NO: 358491 - RNA, 12 nt, Bordetella pertussis
gcggcgccagcu

SEQ ID NO: 358492 - RNA, 16 nt, Bordetella pertussis
gcggcgccagcugggc

SEQ ID NO: 358493 - RNA, 19 nt, Bordetella pertussis
gcggcgccacugccaggcg

SEQ ID NO: 358494 - RNA, 12 nt, Bordetella pertussis
gcggcgccagcg

SEQ ID NO: 358495 - RNA, 16 nt, Bordetella pertussis
gcggcgccaugccgcg

SEQ ID NO: 358496 - RNA, 20 nt, Bordetella pertussis
gcggcgccaugccgcgcccg

SEQ ID NO: 358497 - RNA, 13 nt, Bordetella pertussis
gcggcgcccauca

SEQ ID NO: 358498 - RNA, 15 nt, Bordetella pertussis
gcggcgcccaucagg

SEQ ID NO: 358499 - RNA, 13 nt, Bordetella pertussis
gcggcgcccagcu

SEQ ID NO: 358500 - RNA, 19 nt, Bordetella pertussis
gcggcgcccagcuggcgcc

SEQ ID NO: 358501 - RNA, 14 nt, Bordetella pertussis
gcggcgcccgcgca

SEQ ID NO: 358502 - RNA, 20 nt, Bordetella pertussis
gcggcgcccgcgcaugcaag

SEQ ID NO: 358503 - RNA, 20 nt, Bordetella pertussis
gcggcgcccggugcgcgcag

SEQ ID NO: 358504 - RNA, 22 nt, Bordetella pertussis
gcggcgcccccgcggcgccccg

SEQ ID NO: 358505 - RNA, 12 nt, Bordetella pertussis
gcggcgcccgca

SEQ ID NO: 358506 - RNA, 22 nt, Bordetella pertussis
gcggcgccguccagcgcggcau

SEQ ID NO: 358507 - RNA, 13 nt, Bordetella pertussis
gcggcgccgucga

SEQ ID NO: 358508 - RNA, 14 nt, Bordetella pertussis
gcggcgccucgguc

SEQ ID NO: 358509 - RNA, 19 nt, Bordetella pertussis
gcggcgccucgguccagcg

SEQ ID NO: 358510 - RNA, 21 nt, Bordetella pertussis
gcggcgccucgguccagcgga

SEQ ID NO: 358511 - RNA, 13 nt, Bordetella pertussis
gcggcgccugggc

SEQ ID NO: 358512 - RNA, 22 nt, Bordetella pertussis
gcggcgccuggucgcgcgccug

SEQ ID NO: 358513 - RNA, 16 nt, Bordetella pertussis
gcggcgcgaacggcag

SEQ ID NO: 358514 - RNA, 15 nt, Bordetella pertussis
gcggcgcgaccugcg

SEQ ID NO: 358515 - RNA, 21 nt, Bordetella pertussis
gcggcgcgaccugcgcgaccg

SEQ ID NO: 358516 - RNA, 21 nt, Bordetella pertussis
aagcggucgauguccagcgcc

SEQ ID NO: 358517 - RNA, 21 nt, Bordetella pertussis
aagcguacguaccaggccguc

SEQ ID NO: 358518 - RNA, 22 nt, Bordetella pertussis
aagcguacguaccaggccgucg

SEQ ID NO: 358519 - RNA, 14 nt, Bordetella pertussis
aagcgucgauggcg

SEQ ID NO: 358520 - RNA, 13 nt, Bordetella pertussis
aagcgucggccug

SEQ ID NO: 358521 - RNA, 15 nt, Bordetella pertussis
gcggcgcguauccgc

SEQ ID NO: 358522 - RNA, 18 nt, Bordetella pertussis
gcggcgcgucgcgcgcca

SEQ ID NO: 358523 - RNA, 19 nt, Bordetella pertussis
gcggcgcgucgcgcgccag

SEQ ID NO: 358524 - RNA, 16 nt, Bordetella pertussis
gcggcgcgugccagca

SEQ ID NO: 358525 - RNA, 18 nt, Bordetella pertussis
gcggcgcgugccagcagg

SEQ ID NO: 358526 - RNA, 18 nt, Bordetella pertussis
gcggcgcuacgccgccga

SEQ ID NO: 358527 - RNA, 19 nt, Bordetella pertussis
gcggcgcucaucaucgcgc

SEQ ID NO: 358528 - RNA, 17 nt, Bordetella pertussis
gcggcgcucgaaggcgc

SEQ ID NO: 358529 - RNA, 18 nt, Bordetella pertussis
gcggcgcugcacgcggcc

SEQ ID NO: 358530 - RNA, 20 nt, Bordetella pertussis
gcggcgcugcacgcggccgc

SEQ ID NO: 358531 - RNA, 14 nt, Bordetella pertussis
gcggcgcugcuggc

SEQ ID NO: 358532 - RNA, 17 nt, Bordetella pertussis
gcggcgcugcuggccgg

SEQ ID NO: 358533 - RNA, 18 nt, Bordetella pertussis
gcggcgcugcuggccggc

SEQ ID NO: 358534 - RNA, 14 nt, Bordetella pertussis
gcggcgcuggccug

SEQ ID NO: 358535 - RNA, 20 nt, Bordetella pertussis
gcggcggauaacaucauggg

SEQ ID NO: 358536 - RNA, 14 nt, Bordetella pertussis
gcggcggcaccagc

SEQ ID NO: 358537 - RNA, 15 nt, Bordetella pertussis
gcggcggcaccagca

SEQ ID NO: 358538 - RNA, 21 nt, Bordetella pertussis
gcggcggauucaggcgauccu

SEQ ID NO: 358539 - RNA, 15 nt, Bordetella pertussis
gcggcggcagcgcgu

SEQ ID NO: 358540 - RNA, 19 nt, Bordetella pertussis
gcggcggcaugcuggucau

SEQ ID NO: 358541 - RNA, 20 nt, Bordetella pertussis
gcggcggcaugcuggucauc

SEQ ID NO: 358542 - RNA, 22 nt, Bordetella pertussis
gcggcggccuugugcgccagcg

SEQ ID NO: 358543 - RNA, 13 nt, Bordetella pertussis
gcggcggccuggg

SEQ ID NO: 358544 - RNA, 14 nt, Bordetella pertussis
gcggcggccugggc

SEQ ID NO: 358545 - RNA, 13 nt, Bordetella pertussis
gcggcggcgcgcg

SEQ ID NO: 358546 - RNA, 15 nt, Bordetella pertussis
gcggcggcgcggcgc

SEQ ID NO: 358547 - RNA, 17 nt, Bordetella pertussis
gcggcggcgcggcgcca

SEQ ID NO: 358548 - RNA, 13 nt, Bordetella pertussis
gcggcggcgcugg

SEQ ID NO: 358549 - RNA, 16 nt, Bordetella pertussis
gcggcggcgcuggccu

SEQ ID NO: 358550 - RNA, 12 nt, Bordetella pertussis
gcggcggcgggc

SEQ ID NO: 358551 - RNA, 16 nt, Bordetella pertussis
gcggcgggcgcuggcg

SEQ ID NO: 358552 - RNA, 18 nt, Bordetella pertussis
gcggcgggcgugaugccg

SEQ ID NO: 358553 - RNA, 21 nt, Bordetella pertussis
gcggcgggcucggcgccggcg

SEQ ID NO: 358554 - RNA, 14 nt, Bordetella pertussis
gcggcgggugccgc

SEQ ID NO: 358555 - RNA, 16 nt, Bordetella pertussis
gcggcgggugccgcga

SEQ ID NO: 358556 - RNA, 17 nt, Bordetella pertussis
gcggcgguagcgcucgu

SEQ ID NO: 358557 - RNA, 20 nt, Bordetella pertussis
gcggcgguagcgcucgucca

SEQ ID NO: 358558 - RNA, 15 nt, Bordetella pertussis
gcggcguacuggcgc

SEQ ID NO: 358559 - RNA, 19 nt, Bordetella pertussis
gcggcguacuggcgcggcg

SEQ ID NO: 358560 - RNA, 21 nt, Bordetella pertussis
gcggcguacuggcgcggcggc

SEQ ID NO: 358561 - RNA, 22 nt, Bordetella pertussis
gcggcguacuggcgcggcggcc

SEQ ID NO: 358562 - RNA, 23 nt, Bordetella pertussis
gcggcguacuggcgcggcggcca

SEQ ID NO: 358563 - RNA, 15 nt, Bordetella pertussis
gcggcguagagcgcc

SEQ ID NO: 358564 - RNA, 17 nt, Bordetella pertussis
gcggcguaguucagcca

SEQ ID NO: 358565 - RNA, 16 nt, Bordetella pertussis
gcggcguauaggccac

SEQ ID NO: 358566 - RNA, 16 nt, Bordetella pertussis
gcggcgucaggccguc

SEQ ID NO: 358567 - RNA, 19 nt, Bordetella pertussis
gcggcguccgaauacgcca

SEQ ID NO: 358568 - RNA, 14 nt, Bordetella pertussis
gcggcgugaccgcg

SEQ ID NO: 358569 - RNA, 20 nt, Bordetella pertussis
gcggcgugaugcccaggccc

SEQ ID NO: 358570 - RNA, 21 nt, Bordetella pertussis
gcggcgugaugcccaggcccu

SEQ ID NO: 358571 - RNA, 19 nt, Bordetella pertussis
gcggcgugcccugcggcgc

SEQ ID NO: 358572 - RNA, 22 nt, Bordetella pertussis
gcggcgugcccugcggcgcggc

SEQ ID NO: 358573 - RNA, 24 nt, Bordetella pertussis
gcggcgugcccugcggcgcggcca

SEQ ID NO: 358574 - RNA, 16 nt, Bordetella pertussis
gcggcgugcgccugcu

SEQ ID NO: 358575 - RNA, 20 nt, Bordetella pertussis
gcggcgugcgccugcugguc

SEQ ID NO: 358576 - RNA, 16 nt, Bordetella pertussis
gcggcgugcgcgugca

SEQ ID NO: 358577 - RNA, 15 nt, Bordetella pertussis
gcggcgugcggccca

SEQ ID NO: 358578 - RNA, 17 nt, Bordetella pertussis
gcggcgugcggcccagc

SEQ ID NO: 358579 - RNA, 18 nt, Bordetella pertussis
gcggcgugcggcccagcc

SEQ ID NO: 358580 - RNA, 16 nt, Bordetella pertussis
gcggcguggccgugcu

SEQ ID NO: 358581 - RNA, 20 nt, Bordetella pertussis
gcggcguggccgugcugguc

SEQ ID NO: 358582 - RNA, 13 nt, Bordetella pertussis
gcggcguggcgcc

SEQ ID NO: 358583 - RNA, 15 nt, Bordetella pertussis
gcggcguggcgccga

SEQ ID NO: 358584 - RNA, 16 nt, Bordetella pertussis
gcggcguggcgccgac

SEQ ID NO: 358585 - RNA, 17 nt, Bordetella pertussis
gcggcguggcgccgacc

SEQ ID NO: 358586 - RNA, 15 nt, Bordetella pertussis
gcggcguggcggcca

SEQ ID NO: 358587 - RNA, 16 nt, Bordetella pertussis
gcggcguggcggccag

SEQ ID NO: 358588 - RNA, 18 nt, Bordetella pertussis
gcggcguggcggccaggc

SEQ ID NO: 358589 - RNA, 15 nt, Bordetella pertussis
gcggcguggcggggc

SEQ ID NO: 358590 - RNA, 17 nt, Bordetella pertussis
gcggcguggacuucgug

SEQ ID NO: 358591 - RNA, 16 nt, Bordetella pertussis
gcggcgugugcccagc

SEQ ID NO: 358592 - RNA, 19 nt, Bordetella pertussis
gcggcgugugcccagcacc

SEQ ID NO: 358593 - RNA, 20 nt, Bordetella pertussis
gcggcgugugcccagcacca

SEQ ID NO: 358594 - RNA, 22 nt, Bordetella pertussis
gcggcguguagagcugcggcgc

SEQ ID NO: 358595 - RNA, 16 nt, Bordetella pertussis
gcggcguuccugggca

SEQ ID NO: 358596 - RNA, 20 nt, Bordetella pertussis
gcggcguuccugggcacgcc

SEQ ID NO: 358597 - RNA, 17 nt, Bordetella pertussis
gcggcguugaccugguc

SEQ ID NO: 358598 - RNA, 18 nt, Bordetella pertussis
gcggcguucugcagcgcg

SEQ ID NO: 358599 - RNA, 15 nt, Bordetella pertussis
gcggcguugcggcgc

SEQ ID NO: 358600 - RNA, 16 nt, Bordetella pertussis
gcggcguugcggcgcc

SEQ ID NO: 358601 - RNA, 17 nt, Bordetella pertussis
gcggcguugcggcgcca

SEQ ID NO: 358602 - RNA, 17 nt, Bordetella pertussis
gcggcucaggcgcggau

SEQ ID NO: 358603 - RNA, 14 nt, Bordetella pertussis
gcggcuccagcuca

SEQ ID NO: 358604 - RNA, 22 nt, Bordetella pertussis
gcggcuccagcucagcagcgcc

SEQ ID NO: 358605 - RNA, 14 nt, Bordetella pertussis
gcggcucgacgccg

SEQ ID NO: 358606 - RNA, 14 nt, Bordetella pertussis
gcggcucgccgcgc

SEQ ID NO: 358607 - RNA, 15 nt, Bordetella pertussis
gcggcucgccgcgca

SEQ ID NO: 358608 - RNA, 16 nt, Bordetella pertussis
gcggcucgccgcgcac

SEQ ID NO: 358609 - RNA, 13 nt, Bordetella pertussis
gcggcucgccggc

SEQ ID NO: 358610 - RNA, 14 nt, Bordetella pertussis
gcggcucgccggcc

SEQ ID NO: 358611 - RNA, 18 nt, Bordetella pertussis
gcggcucgccggccgcgc

SEQ ID NO: 358612 - RNA, 22 nt, Bordetella pertussis
gcggcucgccuccccaggccag

SEQ ID NO: 358613 - RNA, 17 nt, Bordetella pertussis
gcggcugaucaccgccg

SEQ ID NO: 358614 - RNA, 23 nt, Bordetella pertussis
gcggcugcccaccuugcgcgcga

SEQ ID NO: 358615 - RNA, 20 nt, Bordetella pertussis
gcggcugcccucggucagcg

SEQ ID NO: 358616 - RNA, 15 nt, Bordetella pertussis
gcggcugccgauacg

SEQ ID NO: 358617 - RNA, 22 nt, Bordetella pertussis
gcggcugcgaaaggccgagcca

SEQ ID NO: 358618 - RNA, 14 nt, Bordetella pertussis
gcggcugcgggccg

SEQ ID NO: 358619 - RNA, 20 nt, Bordetella pertussis
gcggcugcgggcgcaagcca

SEQ ID NO: 358620 - RNA, 13 nt, Bordetella pertussis
gcggcuggccgau

SEQ ID NO: 358621 - RNA, 16 nt, Bordetella pertussis
gcggcuggcgaucacc

SEQ ID NO: 358622 - RNA, 12 nt, Bordetella pertussis
gcggcuggcgca

SEQ ID NO: 358623 - RNA, 14 nt, Bordetella pertussis
gcggcuggcgcacg

SEQ ID NO: 358624 - RNA, 16 nt, Bordetella pertussis
gcggcuggcgccguuc

SEQ ID NO: 358625 - RNA, 21 nt, Bordetella pertussis
gcggcuggggcugcugggccg

SEQ ID NO: 358626 - RNA, 18 nt, Bordetella pertussis
gcggcugggucggcguga

SEQ ID NO: 358627 - RNA, 18 nt, Bordetella pertussis
gcggcugggugcggucag

SEQ ID NO: 358628 - RNA, 16 nt, Bordetella pertussis
gcggcuggucgccguc

SEQ ID NO: 358629 - RNA, 17 nt, Bordetella pertussis
gcggcuggucgccguca

SEQ ID NO: 358630 - RNA, 20 nt, Bordetella pertussis
gcggcuggugccgacggcgc

SEQ ID NO: 358631 - RNA, 22 nt, Bordetella pertussis
gcggcuggugccgacggcgcgg

SEQ ID NO: 358632 - RNA, 18 nt, Bordetella pertussis
gcggcugguggugccgcg

SEQ ID NO: 358633 - RNA, 20 nt, Bordetella pertussis
gcggcugguggugccgcgca

SEQ ID NO: 358634 - RNA, 21 nt, Bordetella pertussis
gcggcuguagucgccgcugcc

SEQ ID NO: 358635 - RNA, 22 nt, Bordetella pertussis
gcggcuguagucgccgcugccg

SEQ ID NO: 358636 - RNA, 15 nt, Bordetella pertussis
gcggcuguccaccug

SEQ ID NO: 358637 - RNA, 19 nt, Bordetella pertussis
gcggcuguccaccugcacc

SEQ ID NO: 358638 - RNA, 14 nt, Bordetella pertussis
gcggcuguccuggc

SEQ ID NO: 358639 - RNA, 19 nt, Bordetella pertussis
gcggcugugggccucgcug

SEQ ID NO: 358640 - RNA, 21 nt, Bordetella pertussis
gcggcugugggccucgcugga

SEQ ID NO: 358641 - RNA, 16 nt, Bordetella pertussis
gcggcuucaggcgcgc

SEQ ID NO: 358642 - RNA, 14 nt, Bordetella pertussis
gcggcuucaugccg

SEQ ID NO: 358643 - RNA, 15 nt, Bordetella pertussis
gcggcuucaugccgg

SEQ ID NO: 358644 - RNA, 19 nt, Bordetella pertussis
gcggcuucaugccggcguu

SEQ ID NO: 358645 - RNA, 21 nt, Bordetella pertussis
gcggcuuccuggucacccggc

SEQ ID NO: 358646 - RNA, 14 nt, Bordetella pertussis
gcggcuucgcgcag

SEQ ID NO: 358647 - RNA, 15 nt, Bordetella pertussis
gcggcuucgcgcagc

SEQ ID NO: 358648 - RNA, 16 nt, Bordetella pertussis
gcggcuucgcgcagca

SEQ ID NO: 358649 - RNA, 16 nt, Bordetella pertussis
gcggcuucggccguca

SEQ ID NO: 358650 - RNA, 18 nt, Bordetella pertussis
gcggcuuuuucucggccu

SEQ ID NO: 358651 - RNA, 23 nt, Bordetella pertussis
gcgggaagcugucggcgcuggcc

SEQ ID NO: 358652 - RNA, 19 nt, Bordetella pertussis
gcgggaucugcaugccgac

SEQ ID NO: 358653 - RNA, 17 nt, Bordetella pertussis
gcgggauggucgcggcc

SEQ ID NO: 358654 - RNA, 18 nt, Bordetella pertussis
gcgggauggucgcggccg

SEQ ID NO: 358655 - RNA, 22 nt, Bordetella pertussis
gcgggauggucgcggccgaggc

SEQ ID NO: 358656 - RNA, 16 nt, Bordetella pertussis
gcgggcaaacggcggc

SEQ ID NO: 358657 - RNA, 17 nt, Bordetella pertussis
gcgggcaaacggcggca

SEQ ID NO: 358658 - RNA, 16 nt, Bordetella pertussis
gcgggcaaagcccagc

SEQ ID NO: 358659 - RNA, 19 nt, Bordetella pertussis
gcgggcaaagcccagcaag

SEQ ID NO: 358660 - RNA, 20 nt, Bordetella pertussis
gcgggcaacuucaccgucga

SEQ ID NO: 358661 - RNA, 23 nt, Bordetella pertussis
gcgggcaauuuuguugauggcga

SEQ ID NO: 358662 - RNA, 16 nt, Bordetella pertussis
gcgggcacaacccgcc

SEQ ID NO: 358663 - RNA, 14 nt, Bordetella pertussis
gcgggcaccaugcg

SEQ ID NO: 358664 - RNA, 21 nt, Bordetella pertussis
gcgggcaugacgaccgcgacc

SEQ ID NO: 358665 - RNA, 12 nt, Bordetella pertussis
gcgggccacgcc

SEQ ID NO: 358666 - RNA, 17 nt, Bordetella pertussis
gcgggccacgccggccg

SEQ ID NO: 358667 - RNA, 18 nt, Bordetella pertussis
gcgggccacgccggccgg

SEQ ID NO: 358668 - RNA, 20 nt, Bordetella pertussis
gcgggccacgccggccgggg

SEQ ID NO: 358669 - RNA, 15 nt, Bordetella pertussis
gcgggccacgcgccg

SEQ ID NO: 358670 - RNA, 21 nt, Bordetella pertussis
gcgggccagcagaaugccgcc

SEQ ID NO: 358671 - RNA, 13 nt, Bordetella pertussis
gcgggccagcgcg

SEQ ID NO: 358672 - RNA, 15 nt, Bordetella pertussis
gcgggccagcgcggc

SEQ ID NO: 358673 - RNA, 17 nt, Bordetella pertussis
gcgggcccgucgcgcca

SEQ ID NO: 358674 - RNA, 19 nt, Bordetella pertussis
gcgggcccuggcguucgcg

SEQ ID NO: 358675 - RNA, 22 nt, Bordetella pertussis
gcgggccgaggcuucgauggcg

SEQ ID NO: 358676 - RNA, 16 nt, Bordetella pertussis
gcgggccgcacagcuc

SEQ ID NO: 358677 - RNA, 18 nt, Bordetella pertussis
gcgggccgcagcauggcg

SEQ ID NO: 358678 - RNA, 19 nt, Bordetella pertussis
gcgggccgcagcauggcgc

SEQ ID NO: 358679 - RNA, 21 nt, Bordetella pertussis
gcgggccgcgccgcggcacgg

SEQ ID NO: 358680 - RNA, 14 nt, Bordetella pertussis
gcgggccgcgcugg

SEQ ID NO: 358681 - RNA, 18 nt, Bordetella pertussis
gcgggccgcugguggcca

SEQ ID NO: 358682 - RNA, 14 nt, Bordetella pertussis
gcgggccggcgaug

SEQ ID NO: 358683 - RNA, 23 nt, Bordetella pertussis
gcgggccggcucauucggcgcgc

SEQ ID NO: 358684 - RNA, 13 nt, Bordetella pertussis
gcgggccgggcag

SEQ ID NO: 358685 - RNA, 15 nt, Bordetella pertussis
gcgggccgggcaggc

SEQ ID NO: 358686 - RNA, 19 nt, Bordetella pertussis
gcgggccgggcaggccgcg

SEQ ID NO: 358687 - RNA, 13 nt, Bordetella pertussis
gcgggccggcgcg

SEQ ID NO: 358688 - RNA, 20 nt, Bordetella pertussis
gcgggccuacuucggcagcu

SEQ ID NO: 358689 - RNA, 23 nt, Bordetella pertussis
gcgggccuacuugccggcgcuca

SEQ ID NO: 358690 - RNA, 20 nt, Bordetella pertussis
gcgggccucgaagcccggca

SEQ ID NO: 358691 - RNA, 21 nt, Bordetella pertussis
gcgggccucgaagcccggcag

SEQ ID NO: 358692 - RNA, 12 nt, Bordetella pertussis
gcgggccugcag

SEQ ID NO: 358693 - RNA, 13 nt, Bordetella pertussis
gcgggccugccgc

SEQ ID NO: 358694 - RNA, 13 nt, Bordetella pertussis
gcgggccuggcgg

SEQ ID NO: 358695 - RNA, 15 nt, Bordetella pertussis
gcgggccuggcggau

SEQ ID NO: 358696 - RNA, 22 nt, Bordetella pertussis
gcgggccuuggccagcagcgca

SEQ ID NO: 358697 - RNA, 16 nt, Bordetella pertussis
gcgggcgccgcgcacg

SEQ ID NO: 358698 - RNA, 17 nt, Bordetella pertussis
gcgggcgccgcgcacgc

SEQ ID NO: 358699 - RNA, 16 nt, Bordetella pertussis
gcgggcgccgcgcccg

SEQ ID NO: 358700 - RNA, 19 nt, Bordetella pertussis
gcgggcgccgcgcccggcc

SEQ ID NO: 358701 - RNA, 20 nt, Bordetella pertussis
gcgggcgccggcgcccggca

SEQ ID NO: 358702 - RNA, 23 nt, Bordetella pertussis
gcgggcgccggcgucacgcggcc

SEQ ID NO: 358703 - RNA, 16 nt, Bordetella pertussis
gcgggcgccugcggca

SEQ ID NO: 358704 - RNA, 18 nt, Bordetella pertussis
gcgggcgccugcggcagg

SEQ ID NO: 358705 - RNA, 17 nt, Bordetella pertussis
gcgggcgcgcccggcgc

SEQ ID NO: 358706 - RNA, 21 nt, Bordetella pertussis
gcgggcgcgcccggcgcgccu

SEQ ID NO: 358707 - RNA, 12 nt, Bordetella pertussis
gcgggcgcgccg

SEQ ID NO: 358708 - RNA, 14 nt, Bordetella pertussis
gcgggcgcgccguc

SEQ ID NO: 358709 - RNA, 14 nt, Bordetella pertussis
gcgggcgcgcgccc

SEQ ID NO: 358710 - RNA, 16 nt, Bordetella pertussis
gcgggcgcgcgccccg

SEQ ID NO: 358711 - RNA, 16 nt, Bordetella pertussis
gcgggcgcgcagcgcg

SEQ ID NO: 358712 - RNA, 15 nt, Bordetella pertussis
gcgggcgcgcaggcc

SEQ ID NO: 358713 - RNA, 15 nt, Bordetella pertussis
gcgggcgcggcaggc

SEQ ID NO: 358714 - RNA, 13 nt, Bordetella pertussis
gcgggcgcgggcu

SEQ ID NO: 358715 - RNA, 18 nt, Bordetella pertussis
gcgggcgcgggcugucgc

SEQ ID NO: 358716 - RNA, 20 nt, Bordetella pertussis
gcgggcgcgguauucgcugc

SEQ ID NO: 358717 - RNA, 17 nt, Bordetella pertussis
gcgggcgcugacgccga

SEQ ID NO: 358718 - RNA, 13 nt, Bordetella pertussis
gcgggcgcugccu

SEQ ID NO: 358719 - RNA, 20 nt, Bordetella pertussis
gcgggcgcugcgcgaacgcg

SEQ ID NO: 358720 - RNA, 16 nt, Bordetella pertussis
gcgggcgcuggcgcgc

SEQ ID NO: 358721 - RNA, 20 nt, Bordetella pertussis
gcgggcgcuggcgcgcggcu

SEQ ID NO: 358722 - RNA, 20 nt, Bordetella pertussis
gcgguaagcguccgcgcgcc

SEQ ID NO: 358723 - RNA, 17 nt, Bordetella pertussis
gcgguaaugacgcagcc

SEQ ID NO: 358724 - RNA, 18 nt, Bordetella pertussis
gcgguacaggccggcggc

SEQ ID NO: 358725 - RNA, 19 nt, Bordetella pertussis
gcgguacaggccggcggcg

SEQ ID NO: 358726 - RNA, 20 nt, Bordetella pertussis
gcgguacaggccggcggcga

SEQ ID NO: 358727 - RNA, 23 nt, Bordetella pertussis
gcgguacaggcugccgucggcca

SEQ ID NO: 358728 - RNA, 14 nt, Bordetella pertussis
gcgguaccaggccg

SEQ ID NO: 358729 - RNA, 15 nt, Bordetella pertussis
gcgguaccaggccga

SEQ ID NO: 358730 - RNA, 23 nt, Bordetella pertussis
gcgguagcgcucguccaugccgg

SEQ ID NO: 358731 - RNA, 22 nt, Bordetella pertussis
gcgguaggcgcccgacggcgcg

SEQ ID NO: 358732 - RNA, 14 nt, Bordetella pertussis
gcgguagguagcgc

SEQ ID NO: 358733 - RNA, 19 nt, Bordetella pertussis
gcgguagguagcgcgcagc

SEQ ID NO: 358734 - RNA, 20 nt, Bordetella pertussis
gcgguagguagcgcgcagcu

SEQ ID NO: 358735 - RNA, 16 nt, Bordetella pertussis
gcgguaguccaucgcg

SEQ ID NO: 358736 - RNA, 23 nt, Bordetella pertussis
gcgguaguccaucgcguccaggc

SEQ ID NO: 358737 - RNA, 23 nt, Bordetella pertussis
gcggucacaucuguccugauuca

SEQ ID NO: 358738 - RNA, 22 nt, Bordetella pertussis
gcggucaccgagcugagcacca

SEQ ID NO: 358739 - RNA, 14 nt, Bordetella pertussis
gcggucagccagag

SEQ ID NO: 358740 - RNA, 15 nt, Bordetella pertussis
gcggucagcgcggcg

SEQ ID NO: 358741 - RNA, 20 nt, Bordetella pertussis
gcggucagcgcggcgccggc

SEQ ID NO: 358742 - RNA, 17 nt, Bordetella pertussis
gcggucagcugugguag

SEQ ID NO: 358743 - RNA, 12 nt, Bordetella pertussis
gcgguccagccc

SEQ ID NO: 358744 - RNA, 16 nt, Bordetella pertussis
gcgguccagccccugc

SEQ ID NO: 358745 - RNA, 18 nt, Bordetella pertussis
gcggucagucgggacggc

SEQ ID NO: 358746 - RNA, 12 nt, Bordetella pertussis
gcgguccagcug

SEQ ID NO: 358747 - RNA, 14 nt, Bordetella pertussis
gcgguccaugguga

SEQ ID NO: 358748 - RNA, 21 nt, Bordetella pertussis
gcgguccccagauccgcaagu

SEQ ID NO: 358749 - RNA, 15 nt, Bordetella pertussis
gcggucccgagcgcu

SEQ ID NO: 358750 - RNA, 20 nt, Bordetella pertussis
gcgguccgaugucgaggauc

SEQ ID NO: 358751 - RNA, 16 nt, Bordetella pertussis
gcgguccgcagcgcuc

SEQ ID NO: 358752 - RNA, 14 nt, Bordetella pertussis
gcggucgaugcgca

SEQ ID NO: 358753 - RNA, 17 nt, Bordetella pertussis
gcggucgaugcgcacgc

SEQ ID NO: 358754 - RNA, 22 nt, Bordetella pertussis
gcggucgauguccagcgccagc

SEQ ID NO: 358755 - RNA, 23 nt, Bordetella pertussis
gcggucgauguccagcgccagca

SEQ ID NO: 358756 - RNA, 20 nt, Bordetella pertussis
gcggucgaugaccagccagc

SEQ ID NO: 358757 - RNA, 19 nt, Bordetella pertussis
gcggucgaugaccucgcgc

SEQ ID NO: 358758 - RNA, 21 nt, Bordetella pertussis
gcggucgcauuggccgccgcc

SEQ ID NO: 358759 - RNA, 16 nt, Bordetella pertussis
gcggucgccaucggcc

SEQ ID NO: 358760 - RNA, 19 nt, Bordetella pertussis
gcggucgccaucggccggc

SEQ ID NO: 358761 - RNA, 20 nt, Bordetella pertussis
gcggucgccaucggccggcc

SEQ ID NO: 358762 - RNA, 21 nt, Bordetella pertussis
gcggucgccaucggccggccc

SEQ ID NO: 358763 - RNA, 18 nt, Bordetella pertussis
gcggucgcccaacccggc

SEQ ID NO: 358764 - RNA, 15 nt, Bordetella pertussis
gcggucgcgcuggcc

SEQ ID NO: 358765 - RNA, 18 nt, Bordetella pertussis
gcggucggccgcgccgcc

SEQ ID NO: 358766 - RNA, 23 nt, Bordetella pertussis
gcggucggccgcgccgccgcccu

SEQ ID NO: 358767 - RNA, 15 nt, Bordetella pertussis
gcggucggcgcggcg

SEQ ID NO: 358768 - RNA, 13 nt, Bordetella pertussis
gcggucggcgggc

SEQ ID NO: 358769 - RNA, 15 nt, Bordetella pertussis
gcggucguagcggau

SEQ ID NO: 358770 - RNA, 23 nt, Bordetella pertussis
gcggucuccgguucggcgcggcg

SEQ ID NO: 358771 - RNA, 21 nt, Bordetella pertussis
gcggucugggcgucccaggcc

SEQ ID NO: 358772 - RNA, 16 nt, Bordetella pertussis
gcggucuggucuggca

SEQ ID NO: 358773 - RNA, 22 nt, Bordetella pertussis
gcggucuguuuuuuugggggcc

SEQ ID NO: 358774 - RNA, 20 nt, Bordetella pertussis
gcggucuucacauagcccgg

SEQ ID NO: 358775 - RNA, 20 nt, Bordetella pertussis
gcggucuucgaugcuggcgc

SEQ ID NO: 358776 - RNA, 21 nt, Bordetella pertussis
gcggucuucgaugcuggcgcg

SEQ ID NO: 358777 - RNA, 18 nt, Bordetella pertussis
gcggucuuucaccgacag

SEQ ID NO: 358778 - RNA, 20 nt, Bordetella pertussis
gcggucuuucaccgacagga

SEQ ID NO: 358779 - RNA, 13 nt, Bordetella pertussis
gcggugaaggcgc

SEQ ID NO: 358780 - RNA, 19 nt, Bordetella pertussis
gcggugaccaccaggccgc

SEQ ID NO: 358781 - RNA, 20 nt, Bordetella pertussis
gcggugaccaccaggccgcc

SEQ ID NO: 358782 - RNA, 16 nt, Bordetella pertussis
gcggugaccaugcgca

SEQ ID NO: 358783 - RNA, 19 nt, Bordetella pertussis
gcggugaccaugcgcaccg

SEQ ID NO: 358784 - RNA, 23 nt, Bordetella pertussis
gcggugaccaugcgcaccgacug

SEQ ID NO: 358785 - RNA, 16 nt, Bordetella pertussis
gcggugaggcggccgg

SEQ ID NO: 358786 - RNA, 19 nt, Bordetella pertussis
gcggugaucugcucgccgc

SEQ ID NO: 358787 - RNA, 19 nt, Bordetella pertussis
gcggugcaagcggccggcc

SEQ ID NO: 358788 - RNA, 16 nt, Bordetella pertussis
gcggugcaucucggca

SEQ ID NO: 358789 - RNA, 14 nt, Bordetella pertussis
gcggugccccggcc

SEQ ID NO: 358790 - RNA, 15 nt, Bordetella pertussis
gcggugccccggccu

SEQ ID NO: 358791 - RNA, 18 nt, Bordetella pertussis
gcggugccccggccucgc

SEQ ID NO: 358792 - RNA, 16 nt, Bordetella pertussis
gcggugccgcgcaccc

SEQ ID NO: 358793 - RNA, 22 nt, Bordetella pertussis
gcggugccgcgcacccaggccc

SEQ ID NO: 358794 - RNA, 15 nt, Bordetella pertussis
gcggugccgcgcgcg

SEQ ID NO: 358795 - RNA, 16 nt, Bordetella pertussis
gcggugccgcgcgcgg

SEQ ID NO: 358796 - RNA, 18 nt, Bordetella pertussis
gcggugccgcgcgcggcc

SEQ ID NO: 358797 - RNA, 13 nt, Bordetella pertussis
gcggugccugucc

SEQ ID NO: 358798 - RNA, 14 nt, Bordetella pertussis
gcggugccuguccc

SEQ ID NO: 358799 - RNA, 14 nt, Bordetella pertussis
gcggugcgacugca

SEQ ID NO: 358800 - RNA, 23 nt, Bordetella pertussis
gcggugcgccgcaugcggcggcu

SEQ ID NO: 358801 - RNA, 16 nt, Bordetella pertussis
gcggugcgcgcggccg

SEQ ID NO: 358802 - RNA, 11 nt, Bordetella pertussis
gcggugcgcgg

SEQ ID NO: 358803 - RNA, 13 nt, Bordetella pertussis
gcggugcgcggcg

SEQ ID NO: 358804 - RNA, 16 nt, Bordetella pertussis
gcggugcgcggcgcag

SEQ ID NO: 358805 - RNA, 17 nt, Bordetella pertussis
gcggugcgcggcgcagc

SEQ ID NO: 358806 - RNA, 21 nt, Bordetella pertussis
gcggugcggaggcggccgcgg

SEQ ID NO: 358807 - RNA, 14 nt, Bordetella pertussis
gcggugcggccucg

SEQ ID NO: 358808 - RNA, 15 nt, Bordetella pertussis
gcggugcggccucgg

SEQ ID NO: 358809 - RNA, 16 nt, Bordetella pertussis
gcggugcggccucggc

SEQ ID NO: 358810 - RNA, 17 nt, Bordetella pertussis
gcggugcggccucggcg

SEQ ID NO: 358811 - RNA, 16 nt, Bordetella pertussis
gcggugcgugcgccca

SEQ ID NO: 358812 - RNA, 21 nt, Bordetella pertussis
gcggugcgugcgcccauggcg

SEQ ID NO: 358813 - RNA, 14 nt, Bordetella pertussis
gcggugcugaacgc

SEQ ID NO: 358814 - RNA, 13 nt, Bordetella pertussis
gcgguggccagcg

SEQ ID NO: 358815 - RNA, 15 nt, Bordetella pertussis
gcgguggccagcgug

SEQ ID NO: 358816 - RNA, 19 nt, Bordetella pertussis
gcgguggccgccgcgcgcc

SEQ ID NO: 358817 - RNA, 14 nt, Bordetella pertussis
gcgguggccgcgca

SEQ ID NO: 358818 - RNA, 18 nt, Bordetella pertussis
gcgguggccgcgcaugcc

SEQ ID NO: 358819 - RNA, 13 nt, Bordetella pertussis
gcgguggcggccg

SEQ ID NO: 358820 - RNA, 15 nt, Bordetella pertussis
gcggugggcagcgcg

SEQ ID NO: 358821 - RNA, 21 nt, Bordetella pertussis
gcgguguagaccaccagcagg

SEQ ID NO: 358822 - RNA, 14 nt, Bordetella pertussis
gcggugucgcaccg

SEQ ID NO: 358823 - RNA, 16 nt, Bordetella pertussis
gcggugucgcaccgca

SEQ ID NO: 358824 - RNA, 14 nt, Bordetella pertussis
gcggugucgccgcc

SEQ ID NO: 358825 - RNA, 17 nt, Bordetella pertussis
gcgguguucgagccgga

SEQ ID NO: 358826 - RNA, 23 nt, Bordetella pertussis
gcgguguugcucgugcuggccgg

SEQ ID NO: 358827 - RNA, 15 nt, Bordetella pertussis
gcgguguuggcgucc

SEQ ID NO: 358828 - RNA, 20 nt, Bordetella pertussis
gcgguucaggccccggccgg

SEQ ID NO: 358829 - RNA, 19 nt, Bordetella pertussis
gcgguucaggguggccgcg

SEQ ID NO: 358830 - RNA, 18 nt, Bordetella pertussis
gcgguucgucagggccgc

SEQ ID NO: 358831 - RNA, 20 nt, Bordetella pertussis
gcgguucguccucgucggcc

SEQ ID NO: 358832 - RNA, 20 nt, Bordetella pertussis
gcgguucugggcccgaucgc

SEQ ID NO: 358833 - RNA, 20 nt, Bordetella pertussis
gcgguugaucagggccgcca

SEQ ID NO: 358834 - RNA, 22 nt, Bordetella pertussis
gcgguugcccgccccgugcacc

SEQ ID NO: 358835 - RNA, 18 nt, Bordetella pertussis
gcgguugcgaggcggccu

SEQ ID NO: 358836 - RNA, 15 nt, Bordetella pertussis
gcgguugcgcugcug

SEQ ID NO: 358837 - RNA, 22 nt, Bordetella pertussis
gcgguuggccuugacggcgcgg

SEQ ID NO: 358838 - RNA, 14 nt, Bordetella pertussis
gcgguugggcgcac

SEQ ID NO: 358839 - RNA, 19 nt, Bordetella pertussis
gcgguuggugucgcgcagc

SEQ ID NO: 358840 - RNA, 16 nt, Bordetella pertussis
gcgguugguuugcggc

SEQ ID NO: 358841 - RNA, 22 nt, Bordetella pertussis
gcgguuucguagaugggcaggc

SEQ ID NO: 358842 - RNA, 21 nt, Bordetella pertussis
gcguaauaguggucgccggcg

SEQ ID NO: 358843 - RNA, 15 nt, Bordetella pertussis
gcguacaacgccgcg

SEQ ID NO: 358844 - RNA, 15 nt, Bordetella pertussis
gcguacaggugcugg

SEQ ID NO: 358845 - RNA, 13 nt, Bordetella pertussis
gcguaccaggcag

SEQ ID NO: 358846 - RNA, 15 nt, Bordetella pertussis
gcguaccaggcagcc

SEQ ID NO: 358847 - RNA, 17 nt, Bordetella pertussis
gcguaccaggcagccgg

SEQ ID NO: 358848 - RNA, 22 nt, Bordetella pertussis
gcguacgcuuaucgcggcgcgg

SEQ ID NO: 358849 - RNA, 20 nt, Bordetella pertussis
gcguacggcgcggugccugu

SEQ ID NO: 358850 - RNA, 16 nt, Bordetella pertussis
gcguacuggcgcggcg

SEQ ID NO: 358851 - RNA, 18 nt, Bordetella pertussis
gcguacuggcgcggcggc

SEQ ID NO: 358852 - RNA, 22 nt, Bordetella pertussis
gcguacuggcgcggcggccagg

SEQ ID NO: 358853 - RNA, 20 nt, Bordetella pertussis
gcguagagcagugugccugu

SEQ ID NO: 358854 - RNA, 15 nt, Bordetella pertussis
gcguagagcgccgcg

SEQ ID NO: 358855 - RNA, 21 nt, Bordetella pertussis
gcguagcccuuguggccgccg

SEQ ID NO: 358856 - RNA, 17 nt, Bordetella pertussis
gcguaguagcccaggcc

SEQ ID NO: 358857 - RNA, 21 nt, Bordetella pertussis
gcguaguccgagcccgggcgu

SEQ ID NO: 358858 - RNA, 18 nt, Bordetella pertussis
gcguagucguugccggcc

SEQ ID NO: 358859 - RNA, 23 nt, Bordetella pertussis
gcguagugguaugaccggcgcgg

SEQ ID NO: 358860 - RNA, 13 nt, Bordetella pertussis
gcguauaggccac

SEQ ID NO: 358861 - RNA, 21 nt, Bordetella pertussis
gcguaucaacuuccagcgccc

SEQ ID NO: 358862 - RNA, 21 nt, Bordetella pertussis
gcguauccagcaucaccagcu

SEQ ID NO: 358863 - RNA, 23 nt, Bordetella pertussis
gcgucaacuacacggugggcgac

SEQ ID NO: 358864 - RNA, 22 nt, Bordetella pertussis
gcgucaaggggcuguaccuggc

SEQ ID NO: 358865 - RNA, 16 nt, Bordetella pertussis
gcgucaaugccagucg

SEQ ID NO: 358866 - RNA, 16 nt, Bordetella pertussis
gcgucacaaagacggc

SEQ ID NO: 358867 - RNA, 22 nt, Bordetella pertussis
gcgucaccagcaggcggccgac

SEQ ID NO: 358868 - RNA, 18 nt, Bordetella pertussis
gcgucagcgugcgccccg

SEQ ID NO: 358869 - RNA, 19 nt, Bordetella pertussis
gcgucagcgugcgccccgc

SEQ ID NO: 358870 - RNA, 17 nt, Bordetella pertussis
gcgucagcugggcaugc

SEQ ID NO: 358871 - RNA, 18 nt, Bordetella pertussis
gcgucagcugggcaugca

SEQ ID NO: 358872 - RNA, 12 nt, Bordetella pertussis
gcgucaggccgg

SEQ ID NO: 358873 - RNA, 17 nt, Bordetella pertussis
gcgucaggccgggcagc

SEQ ID NO: 358874 - RNA, 18 nt, Bordetella pertussis
gcgucaggccgggcagcg

SEQ ID NO: 358875 - RNA, 12 nt, Bordetella pertussis
gcgucaggccgu

SEQ ID NO: 358876 - RNA, 15 nt, Bordetella pertussis
gcgucaggggcaugc

SEQ ID NO: 358877 - RNA, 14 nt, Bordetella pertussis
gcguccagcgcgcg

SEQ ID NO: 358878 - RNA, 17 nt, Bordetella pertussis
gcguccagcgcgcggcc

SEQ ID NO: 358879 - RNA, 21 nt, Bordetella pertussis
gcguccaggcgcgccagccgc

SEQ ID NO: 358880 - RNA, 13 nt, Bordetella pertussis
gcguccaggcggc

SEQ ID NO: 358881 - RNA, 15 nt, Bordetella pertussis
gcguccaggcggcca

SEQ ID NO: 358882 - RNA, 18 nt, Bordetella pertussis
gcguccaggcugccggcg

SEQ ID NO: 358883 - RNA, 19 nt, Bordetella pertussis
gcguccaggcugccggcgu

SEQ ID NO: 358884 - RNA, 20 nt, Bordetella pertussis
gcguccaggcugccggcguu

SEQ ID NO: 358885 - RNA, 23 nt, Bordetella pertussis
gcguccaggcccuggcggcgcag

SEQ ID NO: 358886 - RNA, 24 nt, Bordetella pertussis
gcguccaggcccuggcggcgcagu

SEQ ID NO: 358887 - RNA, 20 nt, Bordetella pertussis
gcguccagguugggcaccac

SEQ ID NO: 358888 - RNA, 21 nt, Bordetella pertussis
gcguccaucuggaccgcgcgc

SEQ ID NO: 358889 - RNA, 22 nt, Bordetella pertussis
gcguccaucuggaccgcgcgcg

SEQ ID NO: 358890 - RNA, 23 nt, Bordetella pertussis
gcguccaucuggaccgcgcgcga

SEQ ID NO: 358891 - RNA, 20 nt, Bordetella pertussis
gcguccauuagggcccagcu

SEQ ID NO: 358892 - RNA, 12 nt, Bordetella pertussis
gcgucccaggcc

SEQ ID NO: 358893 - RNA, 17 nt, Bordetella pertussis
gcgucccaggccacguu

SEQ ID NO: 358894 - RNA, 14 nt, Bordetella pertussis
gcgucccggaugcg

SEQ ID NO: 358895 - RNA, 17 nt, Bordetella pertussis
gcgucccgugccggccg

SEQ ID NO: 358896 - RNA, 23 nt, Bordetella pertussis
gcguccggugcgauagcgccgcg

SEQ ID NO: 358897 - RNA, 19 nt, Bordetella pertussis
gcguccgucggguugccgc

SEQ ID NO: 358898 - RNA, 15 nt, Bordetella pertussis
gcguccucggccagc

SEQ ID NO: 358899 - RNA, 19 nt, Bordetella pertussis
gcguccucggccagccggg

SEQ ID NO: 358900 - RNA, 15 nt, Bordetella pertussis
gcguccugcgccagu

SEQ ID NO: 358901 - RNA, 17 nt, Bordetella pertussis
gcguccugcgccaguug

SEQ ID NO: 358902 - RNA, 16 nt, Bordetella pertussis
gcgucgaccgccaugc

SEQ ID NO: 358903 - RNA, 17 nt, Bordetella pertussis
gcgucgaccgccaugcg

SEQ ID NO: 358904 - RNA, 18 nt, Bordetella pertussis
gcgucgaccgcgggcgcg

SEQ ID NO: 358905 - RNA, 20 nt, Bordetella pertussis
gcgucgaccgcgggcgcgcg

SEQ ID NO: 358906 - RNA, 21 nt, Bordetella pertussis
gcgucgaccgcgggcgcgcgc

SEQ ID NO: 358907 - RNA, 19 nt, Bordetella pertussis
gcgucgacgcccgcgccca

SEQ ID NO: 358908 - RNA, 13 nt, Bordetella pertussis
gcgucgacggugc

SEQ ID NO: 358909 - RNA, 14 nt, Bordetella pertussis
gcgucgacggugcg

SEQ ID NO: 358910 - RNA, 19 nt, Bordetella pertussis
gcgucgacggugcgcgcca

SEQ ID NO: 358911 - RNA, 22 nt, Bordetella pertussis
gcgucgacguaccaagccugcu

SEQ ID NO: 358912 - RNA, 19 nt, Bordetella pertussis
gcgucgauggagucgguca

SEQ ID NO: 358913 - RNA, 20 nt, Bordetella pertussis
gcgucgauggcguacagcag

SEQ ID NO: 358914 - RNA, 19 nt, Bordetella pertussis
gcgucgcacuggguggcca

SEQ ID NO: 358915 - RNA, 18 nt, Bordetella pertussis
gcgucgauuucgucgagc

SEQ ID NO: 358916 - RNA, 17 nt, Bordetella pertussis
gcgucgcgcgccaggcg

SEQ ID NO: 358917 - RNA, 23 nt, Bordetella pertussis
gcgucgcgcggcggcaccagcag

SEQ ID NO: 358918 - RNA, 14 nt, Bordetella pertussis
gcgucgcgcuucuu

SEQ ID NO: 358919 - RNA, 17 nt, Bordetella pertussis
gcgucgcggcgucgacc

SEQ ID NO: 358920 - RNA, 18 nt, Bordetella pertussis
gcgucgcgguacaggcug

SEQ ID NO: 358921 - RNA, 14 nt, Bordetella pertussis
gcgucgcguagcgc

SEQ ID NO: 358922 - RNA, 15 nt, Bordetella pertussis
gcgucgcucauggag

SEQ ID NO: 358923 - RNA, 18 nt, Bordetella pertussis
gcgucgcucugcgcggca

SEQ ID NO: 358924 - RNA, 19 nt, Bordetella pertussis
gcgucgcucugcgcggcau

SEQ ID NO: 358925 - RNA, 12 nt, Bordetella pertussis
gcgucggcgcgc

SEQ ID NO: 358926 - RNA, 13 nt, Bordetella pertussis
gcgucggcgcgcg

SEQ ID NO: 358927 - RNA, 13 nt, Bordetella pertussis
gcgucggcgcggu

SEQ ID NO: 358928 - RNA, 14 nt, Bordetella pertussis
gcgucggcggccca

SEQ ID NO: 358929 - RNA, 19 nt, Bordetella pertussis
gcgucggcggcccacagcg

SEQ ID NO: 358930 - RNA, 20 nt, Bordetella pertussis
gcgucggcguaaggccgccg

SEQ ID NO: 358931 - RNA, 18 nt, Bordetella pertussis
gcgucggcuuccaucagg

SEQ ID NO: 358932 - RNA, 13 nt, Bordetella pertussis
gcgucgggcacgu

SEQ ID NO: 358933 - RNA, 14 nt, Bordetella pertussis
gcgucgggcagcag

SEQ ID NO: 358934 - RNA, 15 nt, Bordetella pertussis
gcgucgggcagcagg

SEQ ID NO: 358935 - RNA, 17 nt, Bordetella pertussis
gcgucgggcagcaggcg

SEQ ID NO: 358936 - RNA, 13 nt, Bordetella pertussis
gcgucgggcaguu

SEQ ID NO: 358937 - RNA, 17 nt, Bordetella pertussis
gcgucgguggccagcca

SEQ ID NO: 358938 - RNA, 21 nt, Bordetella pertussis
gcgucgguggccagccaggcg

SEQ ID NO: 358939 - RNA, 18 nt, Bordetella pertussis
gcgucggugccguccagc

SEQ ID NO: 358940 - RNA, 21 nt, Bordetella pertussis
gcgucggugccguccagcgcg

SEQ ID NO: 358941 - RNA, 16 nt, Bordetella pertussis
gcgucguagcccucgc

SEQ ID NO: 358942 - RNA, 15 nt, Bordetella pertussis
gcgucguccaucgac

SEQ ID NO: 358943 - RNA, 22 nt, Bordetella pertussis
gcgucugcugguacagccccag

SEQ ID NO: 358944 - RNA, 22 nt, Bordetella pertussis
gcgucuggaaacuguuggcgug

SEQ ID NO: 358945 - RNA, 14 nt, Bordetella pertussis
gcgucuggaggacg

SEQ ID NO: 358946 - RNA, 22 nt, Bordetella pertussis
gcgucuguaucguugucgcgcc

SEQ ID NO: 358947 - RNA, 14 nt, Bordetella pertussis
gcgucuucgccgac

SEQ ID NO: 358948 - RNA, 22 nt, Bordetella pertussis
gcgucuugccggaggucggcgc

SEQ ID NO: 358949 - RNA, 14 nt, Bordetella pertussis
gcgucuuggcgggc

SEQ ID NO: 358950 - RNA, 17 nt, Bordetella pertussis
gcgucuuggcgggcacc

SEQ ID NO: 358951 - RNA, 17 nt, Bordetella pertussis
gcgugaaaggccagcgg

SEQ ID NO: 358952 - RNA, 13 nt, Bordetella pertussis
gcgugaccgcgac

SEQ ID NO: 358953 - RNA, 17 nt, Bordetella pertussis
gcgugaccgcgacgcgc

SEQ ID NO: 358954 - RNA, 19 nt, Bordetella pertussis
gcgugacgauauccaggcg

SEQ ID NO: 358955 - RNA, 22 nt, Bordetella pertussis
gcgugacgauauccaggcgcgu

SEQ ID NO: 358956 - RNA, 20 nt, Bordetella pertussis
gcgugacgcugacccuggcc

SEQ ID NO: 358957 - RNA, 23 nt, Bordetella pertussis
gcgugacgcugacccuggccgaa

SEQ ID NO: 358958 - RNA, 20 nt, Bordetella pertussis
gcgugacgcuggagauggcg

SEQ ID NO: 358959 - RNA, 14 nt, Bordetella pertussis
gcgugacggccgcc

SEQ ID NO: 358960 - RNA, 18 nt, Bordetella pertussis
gcgugacggccgccacgc

SEQ ID NO: 358961 - RNA, 13 nt, Bordetella pertussis
gcgugacggcggc

SEQ ID NO: 358962 - RNA, 15 nt, Bordetella pertussis
gcgugacggcggcgc

SEQ ID NO: 358963 - RNA, 20 nt, Bordetella pertussis
gcgugacggcggcgcgcgga

SEQ ID NO: 358964 - RNA, 16 nt, Bordetella pertussis
gcgugagcgccaccgu

SEQ ID NO: 358965 - RNA, 23 nt, Bordetella pertussis
gcgugagcgccaccgugauggcg

SEQ ID NO: 358966 - RNA, 15 nt, Bordetella pertussis
gcgugaugcccaggc

SEQ ID NO: 358967 - RNA, 23 nt, Bordetella pertussis
gcgugaugcccaggcccuggcug

SEQ ID NO: 358968 - RNA, 13 nt, Bordetella pertussis
gcgugaugccgac

SEQ ID NO: 358969 - RNA, 15 nt, Bordetella pertussis
gcgugaugccgacca

SEQ ID NO: 358970 - RNA, 19 nt, Bordetella pertussis
gcgugaugccgaccaggcc

SEQ ID NO: 358971 - RNA, 21 nt, Bordetella pertussis
gcgugaugccgaccaggcccg

SEQ ID NO: 358972 - RNA, 15 nt, Bordetella pertussis
gcgugaugccgucga

SEQ ID NO: 358973 - RNA, 18 nt, Bordetella pertussis
gcgugaugcggucggcca

SEQ ID NO: 358974 - RNA, 20 nt, Bordetella pertussis
gcgugaugcggucggccaca

SEQ ID NO: 358975 - RNA, 15 nt, Bordetella pertussis
gcgugauggcguagc

SEQ ID NO: 358976 - RNA, 18 nt, Bordetella pertussis
gcgugauggggccgggcg

SEQ ID NO: 358977 - RNA, 13 nt, Bordetella pertussis
gcgugcaccagcc

SEQ ID NO: 358978 - RNA, 14 nt, Bordetella pertussis
gcgugcaccagcca

SEQ ID NO: 358979 - RNA, 23 nt, Bordetella pertussis
gcgugcaccagccauucgauggc

SEQ ID NO: 358980 - RNA, 15 nt, Bordetella pertussis
gcgugcagaucugca

SEQ ID NO: 358981 - RNA, 17 nt, Bordetella pertussis
gcgugcagaucugcacg

SEQ ID NO: 358982 - RNA, 22 nt, Bordetella pertussis
gcgugcagaucugcacgcugua

SEQ ID NO: 358983 - RNA, 22 nt, Bordetella pertussis
gcgugcagcaagcccaccgggc

SEQ ID NO: 358984 - RNA, 16 nt, Bordetella pertussis
gcgugcagccagcggc

SEQ ID NO: 358985 - RNA, 19 nt, Bordetella pertussis
gcgugcagccagcggccga

SEQ ID NO: 358986 - RNA, 14 nt, Bordetella pertussis
gcgugcagcgacuu

SEQ ID NO: 358987 - RNA, 16 nt, Bordetella pertussis
gcgugcgggacggcca

SEQ ID NO: 358988 - RNA, 22 nt, Bordetella pertussis
gcgugcguauucgguggcgcgc

SEQ ID NO: 358989 - RNA, 14 nt, Bordetella pertussis
gcgugcgugccgac

SEQ ID NO: 358990 - RNA, 18 nt, Bordetella pertussis
gcgugcucaucggcaggc

SEQ ID NO: 358991 - RNA, 15 nt, Bordetella pertussis
gcgugcugaacgcgc

SEQ ID NO: 358992 - RNA, 22 nt, Bordetella pertussis
gcgugcuggcacugucggcguu

SEQ ID NO: 358993 - RNA, 12 nt, Bordetella pertussis
gcgugcuggcgc

SEQ ID NO: 358994 - RNA, 13 nt, Bordetella pertussis
gcgugcugcggcu

SEQ ID NO: 358995 - RNA, 22 nt, Bordetella pertussis
gcgugcuugccgccggacggcg

SEQ ID NO: 358996 - RNA, 18 nt, Bordetella pertussis
gcguggcaggugcggccg

SEQ ID NO: 358997 - RNA, 23 nt, Bordetella pertussis
gcguggcaggugcggccgcagcg

SEQ ID NO: 358998 - RNA, 15 nt, Bordetella pertussis
gcguggccaccaggc

SEQ ID NO: 358999 - RNA, 16 nt, Bordetella pertussis
gcguggccaccaggcg

SEQ ID NO: 359000 - RNA, 22 nt, Bordetella pertussis
gcguggccacggcgucgaugcg

SEQ ID NO: 359001 - RNA, 19 nt, Bordetella pertussis
gcguggccaucaacguggc

SEQ ID NO: 359002 - RNA, 17 nt, Bordetella pertussis
gcguggcccgcgccgcg

SEQ ID NO: 359003 - RNA, 18 nt, Bordetella pertussis
gcguggccgaggugccca

SEQ ID NO: 359004 - RNA, 17 nt, Bordetella pertussis
gcguggccgcagucagg

SEQ ID NO: 359005 - RNA, 18 nt, Bordetella pertussis
gcguggccgccaccagcg

SEQ ID NO: 359006 - RNA, 15 nt, Bordetella pertussis
gcguggccgccacgc

SEQ ID NO: 359007 - RNA, 20 nt, Bordetella pertussis
gcgugggccaguccgcagcg

SEQ ID NO: 359008 - RNA, 14 nt, Bordetella pertussis
gcgugggccagcaa

SEQ ID NO: 359009 - RNA, 20 nt, Bordetella pertussis
gcgugggccagcaacuggug

SEQ ID NO: 359010 - RNA, 22 nt, Bordetella pertussis
gcgugguacgacgagcgcacca

SEQ ID NO: 359011 - RNA, 15 nt, Bordetella pertussis
gcgugguaucgcgcc

SEQ ID NO: 359012 - RNA, 21 nt, Bordetella pertussis
gcgugguaucgcgccagcgcc

SEQ ID NO: 359013 - RNA, 16 nt, Bordetella pertussis
gcguguuccagcgccu

SEQ ID NO: 359014 - RNA, 18 nt, Bordetella pertussis
gcguucaagucgcccugc

SEQ ID NO: 359015 - RNA, 22 nt, Bordetella pertussis
gcguucaccaggaagcgcgccu

SEQ ID NO: 359016 - RNA, 16 nt, Bordetella pertussis
gcguucaggcgcggcu

SEQ ID NO: 359017 - RNA, 17 nt, Bordetella pertussis
gcguucagggcgccgcg

SEQ ID NO: 359018 - RNA, 21 nt, Bordetella pertussis
gcguucaggucgccguucugg

SEQ ID NO: 359019 - RNA, 15 nt, Bordetella pertussis
gcguucauggcgcau

SEQ ID NO: 359020 - RNA, 21 nt, Bordetella pertussis
gcucagcaccaggccgccggc

SEQ ID NO: 359021 - RNA, 17 nt, Bordetella pertussis
gcucagcagcaccggga

SEQ ID NO: 359022 - RNA, 16 nt, Bordetella pertussis
gcucagcagcgccagg

SEQ ID NO: 359023 - RNA, 17 nt, Bordetella pertussis
gcucagcagcgccaggg

SEQ ID NO: 359024 - RNA, 18 nt, Bordetella pertussis
gcucagcagcgccagggc

SEQ ID NO: 359025 - RNA, 23 nt, Bordetella pertussis
gcucagcagcgccagggccaggc

SEQ ID NO: 359026 - RNA, 22 nt, Bordetella pertussis
gcucagcagggucgagaccagc

SEQ ID NO: 359027 - RNA, 23 nt, Bordetella pertussis
gcucagcagggucgagaccagca

SEQ ID NO: 359028 - RNA, 16 nt, Bordetella pertussis
gcucagcccgccuggc

SEQ ID NO: 359029 - RNA, 22 nt, Bordetella pertussis
gcucagcccgccuggcgccgcg

SEQ ID NO: 359030 - RNA, 17 nt, Bordetella pertussis
gcucagcccggcgaggu

SEQ ID NO: 359031 - RNA, 21 nt, Bordetella pertussis
gcucagccucgagguggcgca

SEQ ID NO: 359032 - RNA, 20 nt, Bordetella pertussis
gcucagccuugucgcgggca

SEQ ID NO: 359033 - RNA, 23 nt, Bordetella pertussis
gcucagccuugucgcgggcagug

SEQ ID NO: 359034 - RNA, 20 nt, Bordetella pertussis
gcucagcgacgcgcgccggc

SEQ ID NO: 359035 - RNA, 12 nt, Bordetella pertussis
gcucagcgcgcc

SEQ ID NO: 359036 - RNA, 18 nt, Bordetella pertussis
gcucagcgcggcgcggcc

SEQ ID NO: 359037 - RNA, 20 nt, Bordetella pertussis
gcucagcgcggcgcggccag

SEQ ID NO: 359038 - RNA, 22 nt, Bordetella pertussis
gcucaggaaccagcggcuggcg

SEQ ID NO: 359039 - RNA, 14 nt, Bordetella pertussis
gcucaggauacgug

SEQ ID NO: 359040 - RNA, 15 nt, Bordetella pertussis
gcucaggcggccagg

SEQ ID NO: 359041 - RNA, 16 nt, Bordetella pertussis
gcucaggcggccaggg

SEQ ID NO: 359042 - RNA, 19 nt, Bordetella pertussis
gcucaggcggccagggccu

SEQ ID NO: 359043 - RNA, 17 nt, Bordetella pertussis
gcucagguagaccacgc

SEQ ID NO: 359044 - RNA, 18 nt, Bordetella pertussis
gcucagguagaccacgcg

SEQ ID NO: 359045 - RNA, 22 nt, Bordetella pertussis
gcucagguagaccacgcgcugc

SEQ ID NO: 359046 - RNA, 16 nt, Bordetella pertussis
gcucaggucgaacagg

SEQ ID NO: 359047 - RNA, 15 nt, Bordetella pertussis
gcucagucggccugg

SEQ ID NO: 359048 - RNA, 18 nt, Bordetella pertussis
gcucagucggccuggcgc

SEQ ID NO: 359049 - RNA, 19 nt, Bordetella pertussis
gcucagucggccuggcgcu

SEQ ID NO: 359050 - RNA, 21 nt, Bordetella pertussis
gcucagucgggcagcgcccgc

SEQ ID NO: 359051 - RNA, 21 nt, Bordetella pertussis
gcucaucaccagcagguggcg

SEQ ID NO: 359052 - RNA, 16 nt, Bordetella pertussis
gcucaucaucgcgcug

SEQ ID NO: 359053 - RNA, 20 nt, Bordetella pertussis
gcucaucaucgcgcuggcgc

SEQ ID NO: 359054 - RNA, 14 nt, Bordetella pertussis
gcucauccaggcgc

SEQ ID NO: 359055 - RNA, 15 nt, Bordetella pertussis
gcucauccaggcgcg

SEQ ID NO: 359056 - RNA, 16 nt, Bordetella pertussis
gcucaucggcaggccg

SEQ ID NO: 359057 - RNA, 21 nt, Bordetella pertussis
gcucaucggcaggccggcgcg

SEQ ID NO: 359058 - RNA, 17 nt, Bordetella pertussis
gcucaugccggcaagca

SEQ ID NO: 359059 - RNA, 21 nt, Bordetella pertussis
gcucauggaggggcgcaggca

SEQ ID NO: 359060 - RNA, 20 nt, Bordetella pertussis
gcucauggcacagcgcggcg

SEQ ID NO: 359061 - RNA, 21 nt, Bordetella pertussis
gcuccaaugaaaaaccccgcc

SEQ ID NO: 359062 - RNA, 21 nt, Bordetella pertussis
gcuccaccagcaccggcagcg

SEQ ID NO: 359063 - RNA, 23 nt, Bordetella pertussis
gcuccaccagcaccggcagcgua

SEQ ID NO: 359064 - RNA, 17 nt, Bordetella pertussis
gcuccacgugcggcagg

SEQ ID NO: 359065 - RNA, 16 nt, Bordetella pertussis
gcuccagaacgcgccg

SEQ ID NO: 359066 - RNA, 15 nt, Bordetella pertussis
gcuccagcaugucgu

SEQ ID NO: 359067 - RNA, 14 nt, Bordetella pertussis
gcuccagccaggcg

SEQ ID NO: 359068 - RNA, 15 nt, Bordetella pertussis
gcuccagccaggcgc

SEQ ID NO: 359069 - RNA, 13 nt, Bordetella pertussis
gcuccagcgcgcc

SEQ ID NO: 359070 - RNA, 20 nt, Bordetella pertussis
gcuccagcgcgccgaagcgc

SEQ ID NO: 359071 - RNA, 18 nt, Bordetella pertussis
gcuccagcgucauggccu

SEQ ID NO: 359072 - RNA, 17 nt, Bordetella pertussis
gcuccagcucagcagcg

SEQ ID NO: 359073 - RNA, 20 nt, Bordetella pertussis
gcuccagcucagcagcgcca

SEQ ID NO: 359074 - RNA, 17 nt, Bordetella pertussis
gcuccagcuggcgcacc

SEQ ID NO: 359075 - RNA, 22 nt, Bordetella pertussis
gcuccagcuggcgcaccaggcu

SEQ ID NO: 359076 - RNA, 23 nt, Bordetella pertussis
gcuccagcuggcgcaccaggcug

SEQ ID NO: 359077 - RNA, 18 nt, Bordetella pertussis
gcuccaggaaaaccuccu

SEQ ID NO: 359078 - RNA, 19 nt, Bordetella pertussis
gcuccaggccgcccagccg

SEQ ID NO: 359079 - RNA, 14 nt, Bordetella pertussis
gcuccaggcggcca

SEQ ID NO: 359080 - RNA, 15 nt, Bordetella pertussis
gcuccagggcgucgg

SEQ ID NO: 359081 - RNA, 17 nt, Bordetella pertussis
gcuccagggcgucggcg

SEQ ID NO: 359082 - RNA, 18 nt, Bordetella pertussis
gcuccagggcgucggcga

SEQ ID NO: 359083 - RNA, 20 nt, Bordetella pertussis
gcuccagggcgucggcgacg

SEQ ID NO: 359084 - RNA, 20 nt, Bordetella pertussis
gcuccaguacgaaggggcgg

SEQ ID NO: 359085 - RNA, 16 nt, Bordetella pertussis
gcuccaguggugcucc

SEQ ID NO: 359086 - RNA, 17 nt, Bordetella pertussis
gcuccaugggcguggug

SEQ ID NO: 359087 - RNA, 22 nt, Bordetella pertussis
gcuccauguaaaaacccggccu

SEQ ID NO: 359088 - RNA, 17 nt, Bordetella pertussis
gcuccauggcgccggcg

SEQ ID NO: 359089 - RNA, 16 nt, Bordetella pertussis
gcucccccacgccgcc

SEQ ID NO: 359090 - RNA, 21 nt, Bordetella pertussis
gcucccccacgccgccguagc

SEQ ID NO: 359091 - RNA, 20 nt, Bordetella pertussis
gcuccccgggcgugaccagc

SEQ ID NO: 359092 - RNA, 17 nt, Bordetella pertussis
gcucccgagggaucagc

SEQ ID NO: 359093 - RNA, 16 nt, Bordetella pertussis
gcucccgcuggcggca

SEQ ID NO: 359094 - RNA, 19 nt, Bordetella pertussis
gcuccgcuaucauccgcgc

SEQ ID NO: 359095 - RNA, 22 nt, Bordetella pertussis
gcuccggcggcagcgcgaacgg

SEQ ID NO: 359096 - RNA, 15 nt, Bordetella pertussis
gcuccggcugcgcgc

SEQ ID NO: 359097 - RNA, 17 nt, Bordetella pertussis
gcuccggcugcgcgcgc

SEQ ID NO: 359098 - RNA, 15 nt, Bordetella pertussis
gcuccgggucgagcg

SEQ ID NO: 359099 - RNA, 20 nt, Bordetella pertussis
gcuccgggucgagcgccgaa

SEQ ID NO: 359100 - RNA, 13 nt, Bordetella pertussis
gcuccugcucggc

SEQ ID NO: 359101 - RNA, 17 nt, Bordetella pertussis
gcuccugcucggcgaug

SEQ ID NO: 359102 - RNA, 19 nt, Bordetella pertussis
gcuccugugggggcgcggc

SEQ ID NO: 359103 - RNA, 19 nt, Bordetella pertussis
gcuccuucgugguggcgaa

SEQ ID NO: 359104 - RNA, 20 nt, Bordetella pertussis
gcuccuugaccaguucgcgc

SEQ ID NO: 359105 - RNA, 15 nt, Bordetella pertussis
gcucgaaaugcgcgu

SEQ ID NO: 359106 - RNA, 15 nt, Bordetella pertussis
gcucgaacaggcugg

SEQ ID NO: 359107 - RNA, 21 nt, Bordetella pertussis
gcucgaagcgcaugucgaagc

SEQ ID NO: 359108 - RNA, 19 nt, Bordetella pertussis
gcucgaaggcgccgacggc

SEQ ID NO: 359109 - RNA, 16 nt, Bordetella pertussis
gcucgaauggcugcgc

SEQ ID NO: 359110 - RNA, 21 nt, Bordetella pertussis
gcucgaauggcugcgcgccgu

SEQ ID NO: 359111 - RNA, 20 nt, Bordetella pertussis
gcucgaccaucauggccagg

SEQ ID NO: 359112 - RNA, 21 nt, Bordetella pertussis
gcucgaccaucauggccaggg

SEQ ID NO: 359113 - RNA, 22 nt, Bordetella pertussis
gcucgaccaucauggccagggc

SEQ ID NO: 359114 - RNA, 23 nt, Bordetella pertussis
gcucgaccaucauggccagggcc

SEQ ID NO: 359115 - RNA, 13 nt, Bordetella pertussis
gcucgaccgccgc

SEQ ID NO: 359116 - RNA, 20 nt, Bordetella pertussis
gcucgaccgccgccacgcgc

SEQ ID NO: 359117 - RNA, 14 nt, Bordetella pertussis
gcucgagcaucugg

SEQ ID NO: 359118 - RNA, 20 nt, Bordetella pertussis
gcucgagcaucuggcgcaug

SEQ ID NO: 359119 - RNA, 22 nt, Bordetella pertussis
gcucgagcaucuggcgcauggc

SEQ ID NO: 359120 - RNA, 16 nt, Bordetella pertussis
gcucgagcaugcgggc

SEQ ID NO: 359121 - RNA, 17 nt, Bordetella pertussis
gcucgagcgcggcgcgc

SEQ ID NO: 359122 - RNA, 18 nt, Bordetella pertussis
gcucgagcggcagcagcg

SEQ ID NO: 359123 - RNA, 19 nt, Bordetella pertussis
gcucgagcuccugcucgau

SEQ ID NO: 359124 - RNA, 15 nt, Bordetella pertussis
gcucgaggccaggcu

SEQ ID NO: 359125 - RNA, 16 nt, Bordetella pertussis
gcucgaggccaggcug

SEQ ID NO: 359126 - RNA, 15 nt, Bordetella pertussis
gcucgagcuggcugg

SEQ ID NO: 359127 - RNA, 18 nt, Bordetella pertussis
gcucgagcuggcuggcca

SEQ ID NO: 359128 - RNA, 16 nt, Bordetella pertussis
gcucgaggaaccagcc

SEQ ID NO: 359129 - RNA, 13 nt, Bordetella pertussis
gcucgaggccagg

SEQ ID NO: 359130 - RNA, 14 nt, Bordetella pertussis
gcucgaggcgcugg

SEQ ID NO: 359131 - RNA, 20 nt, Bordetella pertussis
gcucgaggugcacgugggca

SEQ ID NO: 359132 - RNA, 15 nt, Bordetella pertussis
gcucgaugcgccagu

SEQ ID NO: 359133 - RNA, 21 nt, Bordetella pertussis
gcucgauggcuucgcgcacau

SEQ ID NO: 359134 - RNA, 23 nt, Bordetella pertussis
gcucgauggcuucgcgcacaucc

SEQ ID NO: 359135 - RNA, 13 nt, Bordetella pertussis
gcucgcaggccug

SEQ ID NO: 359136 - RNA, 14 nt, Bordetella pertussis
gcucgcaggccugc

SEQ ID NO: 359137 - RNA, 21 nt, Bordetella pertussis
gcucgcaggccugcugcagcg

SEQ ID NO: 359138 - RNA, 22 nt, Bordetella pertussis
gcucgcaggccugcugcagcgu

SEQ ID NO: 359139 - RNA, 21 nt, Bordetella pertussis
gcucgcagucuugcuugaggu

SEQ ID NO: 359140 - RNA, 21 nt, Bordetella pertussis
gcucgcccacauagcggccgg

SEQ ID NO: 359141 - RNA, 22 nt, Bordetella pertussis
gcucgcccacauagcggccggc

SEQ ID NO: 359142 - RNA, 18 nt, Bordetella pertussis
gcucgcccagcaccucga

SEQ ID NO: 359143 - RNA, 20 nt, Bordetella pertussis
gcucgcccagccgccugagc

SEQ ID NO: 359144 - RNA, 20 nt, Bordetella pertussis
gcucgcccccgcgccgcgca

SEQ ID NO: 359145 - RNA, 14 nt, Bordetella pertussis
gcucgccccggcgc

SEQ ID NO: 359146 - RNA, 16 nt, Bordetella pertussis
gcucgccccggcgcgc

SEQ ID NO: 359147 - RNA, 18 nt, Bordetella pertussis
gcucgccccggcgcgcag

SEQ ID NO: 359148 - RNA, 20 nt, Bordetella pertussis
gcucgccccggcgcgcagcg

SEQ ID NO: 359149 - RNA, 13 nt, Bordetella pertussis
gcucgcccggcca

SEQ ID NO: 359150 - RNA, 14 nt, Bordetella pertussis
gcucgcccggccac

SEQ ID NO: 359151 - RNA, 15 nt, Bordetella pertussis
gcucgcccggccacg

SEQ ID NO: 359152 - RNA, 18 nt, Bordetella pertussis
gcucgccuccccaggcca

SEQ ID NO: 359153 - RNA, 20 nt, Bordetella pertussis
gcucgccuucgcgauccagc

SEQ ID NO: 359154 - RNA, 20 nt, Bordetella pertussis
gcucgcgcacagcgcgcaac

SEQ ID NO: 359155 - RNA, 15 nt, Bordetella pertussis
gcucgcggcacugau

SEQ ID NO: 359156 - RNA, 11 nt, Bordetella pertussis
gcucgcggccc

SEQ ID NO: 359157 - RNA, 18 nt, Bordetella pertussis
gcucgcgggugcgcagca

SEQ ID NO: 359158 - RNA, 15 nt, Bordetella pertussis
gcucggaccuggcca

SEQ ID NO: 359159 - RNA, 15 nt, Bordetella pertussis
gcucggacgccgcgc

SEQ ID NO: 359160 - RNA, 22 nt, Bordetella pertussis
gcucggcauggcgaucgaacgc

SEQ ID NO: 359161 - RNA, 17 nt, Bordetella pertussis
gcucggccacgcgcaac

SEQ ID NO: 359162 - RNA, 22 nt, Bordetella pertussis
gcucggcccuagagcaugcggc

SEQ ID NO: 359163 - RNA, 18 nt, Bordetella pertussis
gcucggccuugccguugg

SEQ ID NO: 359164 - RNA, 15 nt, Bordetella pertussis
gcucggcgaagccgc

SEQ ID NO: 359165 - RNA, 19 nt, Bordetella pertussis
gcucggcgaacugggcguc

SEQ ID NO: 359166 - RNA, 17 nt, Bordetella pertussis
gcucggcggccgccugc

SEQ ID NO: 359167 - RNA, 18 nt, Bordetella pertussis
gcucggcggucagcgcgg

SEQ ID NO: 359168 - RNA, 18 nt, Bordetella pertussis
gcucggcguugcuggcaa

SEQ ID NO: 359169 - RNA, 16 nt, Bordetella pertussis
gcucgggacgcaggcc

SEQ ID NO: 359170 - RNA, 20 nt, Bordetella pertussis
gcucguguagggccuggcgu

SEQ ID NO: 359171 - RNA, 16 nt, Bordetella pertussis
gcucguucugcgcgcc

SEQ ID NO: 359172 - RNA, 17 nt, Bordetella pertussis
gcucguucugcgcgccc

SEQ ID NO: 359173 - RNA, 21 nt, Bordetella pertussis
gcucguugcgcaagccgcccg

SEQ ID NO: 359174 - RNA, 15 nt, Bordetella pertussis
gcucuccaugcugaa

SEQ ID NO: 359175 - RNA, 20 nt, Bordetella pertussis
gcucucgaagaagcagccgc

SEQ ID NO: 359176 - RNA, 22 nt, Bordetella pertussis
gcucuuuuucccggcgcggaca

SEQ ID NO: 359177 - RNA, 19 nt, Bordetella pertussis
gcucuuuuucgagccgcag

SEQ ID NO: 359178 - RNA, 23 nt, Bordetella pertussis
gcugaaaaccaacggggccgcca

SEQ ID NO: 359179 - RNA, 19 nt, Bordetella pertussis
gcugaaccugcuggccgcc

SEQ ID NO: 359180 - RNA, 20 nt, Bordetella pertussis
gcugaaccugcuggccgccg

SEQ ID NO: 359181 - RNA, 23 nt, Bordetella pertussis
gcugaaccugcuggccgccggcg

SEQ ID NO: 359182 - RNA, 17 nt, Bordetella pertussis
gcugaacgccucgggcu

SEQ ID NO: 359183 - RNA, 20 nt, Bordetella pertussis
gcugaaggggcuccccugcu

SEQ ID NO: 359184 - RNA, 12 nt, Bordetella pertussis
gcugaaggucgc

SEQ ID NO: 359185 - RNA, 23 nt, Bordetella pertussis
gcugaauccggggugccuguccu

SEQ ID NO: 359186 - RNA, 20 nt, Bordetella pertussis
gcugaauugcgggccggcga

SEQ ID NO: 359187 - RNA, 12 nt, Bordetella pertussis
gcugaccaccgg

SEQ ID NO: 359188 - RNA, 17 nt, Bordetella pertussis
gcugaccagcagcaccg

SEQ ID NO: 359189 - RNA, 14 nt, Bordetella pertussis
gcugaccagcgcgu

SEQ ID NO: 359190 - RNA, 17 nt, Bordetella pertussis
gcugaccagcgcgucgc

SEQ ID NO: 359191 - RNA, 16 nt, Bordetella pertussis
gcugagaucguccagc

SEQ ID NO: 359192 - RNA, 16 nt, Bordetella pertussis
gcugagcaccagcagc

SEQ ID NO: 359193 - RNA, 23 nt, Bordetella pertussis
gcugagcucguguagggccuggc

SEQ ID NO: 359194 - RNA, 23 nt, Bordetella pertussis
gcugaucacccacagcagcgcgc

SEQ ID NO: 359195 - RNA, 14 nt, Bordetella pertussis
gcugaucaccgccg

SEQ ID NO: 359196 - RNA, 13 nt, Bordetella pertussis
gcugauccaggug

SEQ ID NO: 359197 - RNA, 17 nt, Bordetella pertussis
gcugauccucgccagcg

SEQ ID NO: 359198 - RNA, 19 nt, Bordetella pertussis
gcugauccucgccagcggc

SEQ ID NO: 359199 - RNA, 24 nt, Bordetella pertussis
gcugaucgacaugcuggcccagcu

SEQ ID NO: 359200 - RNA, 18 nt, Bordetella pertussis
gcugaucgaucgcccgcu

SEQ ID NO: 359201 - RNA, 20 nt, Bordetella pertussis
gcugaucgccggcgccccca

SEQ ID NO: 359202 - RNA, 14 nt, Bordetella pertussis
gcugaucggccgac

SEQ ID NO: 359203 - RNA, 20 nt, Bordetella pertussis
gcugaucggccgacugcugu

SEQ ID NO: 359204 - RNA, 22 nt, Bordetella pertussis
gcugaucugcuugaggccgcgc

SEQ ID NO: 359205 - RNA, 20 nt, Bordetella pertussis
gcugaucuugaugcggccgu

SEQ ID NO: 359206 - RNA, 19 nt, Bordetella pertussis
gcugaugcccagcccggcu

SEQ ID NO: 359207 - RNA, 16 nt, Bordetella pertussis
gcugaugcccuucggc

SEQ ID NO: 359208 - RNA, 19 nt, Bordetella pertussis
gcugcaaggcagccugucg

SEQ ID NO: 359209 - RNA, 17 nt, Bordetella pertussis
gcugcaauugcgcggcc

SEQ ID NO: 359210 - RNA, 18 nt, Bordetella pertussis
gcugcaauugcgcggcca

SEQ ID NO: 359211 - RNA, 19 nt, Bordetella pertussis
gcugcaccagcgcgccgcg

SEQ ID NO: 359212 - RNA, 20 nt, Bordetella pertussis
gcugcaccagcgcgccgcgc

SEQ ID NO: 359213 - RNA, 22 nt, Bordetella pertussis
gcugcacccacacuuggccggc

SEQ ID NO: 359214 - RNA, 17 nt, Bordetella pertussis
gcugcagaucaucggcg

SEQ ID NO: 359215 - RNA, 23 nt, Bordetella pertussis
gcugcagaucaucggcgccauca

SEQ ID NO: 359216 - RNA, 13 nt, Bordetella pertussis
gcugcagcacgca

SEQ ID NO: 359217 - RNA, 18 nt, Bordetella pertussis
gcugcagcacgcaccagg

SEQ ID NO: 359218 - RNA, 21 nt, Bordetella pertussis
gcugcagcacgcaccaggcgc

SEQ ID NO: 359219 - RNA, 22 nt, Bordetella pertussis
gcugcagcacgcaccaggcgca

SEQ ID NO: 359220 - RNA, 21 nt, Bordetella pertussis
gcugcagccaguugggccagg

SEQ ID NO: 359221 - RNA, 19 nt, Bordetella pertussis
gcugcagccauucggccac

SEQ ID NO: 359222 - RNA, 13 nt, Bordetella pertussis
gcugcagcccggc

SEQ ID NO: 359223 - RNA, 15 nt, Bordetella pertussis
gcugcagcccggcca

SEQ ID NO: 359224 - RNA, 24 nt, Bordetella pertussis
gcugcagcccggccagagccugga

SEQ ID NO: 359225 - RNA, 13 nt, Bordetella pertussis
gcugcagcgacuc

SEQ ID NO: 359226 - RNA, 12 nt, Bordetella pertussis
gcugcagcgcag

SEQ ID NO: 359227 - RNA, 14 nt, Bordetella pertussis
gcugcagcgcaucg

SEQ ID NO: 359228 - RNA, 15 nt, Bordetella pertussis
gcugcagcgcaucgc

SEQ ID NO: 359229 - RNA, 17 nt, Bordetella pertussis
gcugcagcgcaucgccg

SEQ ID NO: 359230 - RNA, 14 nt, Bordetella pertussis
gcugcaugcgcacg

SEQ ID NO: 359231 - RNA, 15 nt, Bordetella pertussis
gcugcaugcgcacgg

SEQ ID NO: 359232 - RNA, 21 nt, Bordetella pertussis
gcugcaugcgcacggacagcc

SEQ ID NO: 359233 - RNA, 20 nt, Bordetella pertussis
gcugcaugcgcgaacgcgcg

SEQ ID NO: 359234 - RNA, 18 nt, Bordetella pertussis
gcugcaugcucuggcaca

SEQ ID NO: 359235 - RNA, 17 nt, Bordetella pertussis
gcugcaugccccaacgg

SEQ ID NO: 359236 - RNA, 16 nt, Bordetella pertussis
gcugccauuccagcuc

SEQ ID NO: 359237 - RNA, 20 nt, Bordetella pertussis
gcugccauuccagcuccggc

SEQ ID NO: 359238 - RNA, 18 nt, Bordetella pertussis
gcugcccaccuuccugcu

SEQ ID NO: 359239 - RNA, 22 nt, Bordetella pertussis
gcugcccaccuugcgcgcgaac

SEQ ID NO: 359240 - RNA, 13 nt, Bordetella pertussis
gcugcccagccac

SEQ ID NO: 359241 - RNA, 14 nt, Bordetella pertussis
gcugcccagccaca

SEQ ID NO: 359242 - RNA, 16 nt, Bordetella pertussis
gcugcccgucgcuggc

SEQ ID NO: 359243 - RNA, 16 nt, Bordetella pertussis
gcugcccuacgacacg

SEQ ID NO: 359244 - RNA, 16 nt, Bordetella pertussis
gcugcccucgcccgug

SEQ ID NO: 359245 - RNA, 19 nt, Bordetella pertussis
gcugcccucggucagcgcc

SEQ ID NO: 359246 - RNA, 20 nt, Bordetella pertussis
gcugcccucggucagcgcca

SEQ ID NO: 359247 - RNA, 14 nt, Bordetella pertussis
gcugcccugcauga

SEQ ID NO: 359248 - RNA, 16 nt, Bordetella pertussis
gcugcccuggcccagg

SEQ ID NO: 359249 - RNA, 17 nt, Bordetella pertussis
gcugcccuggcccaggc

SEQ ID NO: 359250 - RNA, 19 nt, Bordetella pertussis
gcugcccuggcccaggccg

SEQ ID NO: 359251 - RNA, 14 nt, Bordetella pertussis
gcugcccuggcgcu

SEQ ID NO: 359252 - RNA, 17 nt, Bordetella pertussis
gcugccgaaucggcccc

SEQ ID NO: 359253 - RNA, 15 nt, Bordetella pertussis
gcugccgaccagcac

SEQ ID NO: 359254 - RNA, 14 nt, Bordetella pertussis
gcugccgagacggc

SEQ ID NO: 359255 - RNA, 12 nt, Bordetella pertussis
gcugccgccggc

SEQ ID NO: 359256 - RNA, 17 nt, Bordetella pertussis
gcugccggaccugggca

SEQ ID NO: 359257 - RNA, 14 nt, Bordetella pertussis
gcugccggauuggc

SEQ ID NO: 359258 - RNA, 10 nt, Bordetella pertussis
gcugccggca

SEQ ID NO: 359259 - RNA, 21 nt, Bordetella pertussis
gcugccggcauugcccaccac

SEQ ID NO: 359260 - RNA, 13 nt, Bordetella pertussis
gcugccggccgac

SEQ ID NO: 359261 - RNA, 21 nt, Bordetella pertussis
gcugccggccgaccggcgcgc

SEQ ID NO: 359262 - RNA, 13 nt, Bordetella pertussis
gcugccggcauug

SEQ ID NO: 359263 - RNA, 13 nt, Bordetella pertussis
gcugccggcgccc

SEQ ID NO: 359264 - RNA, 23 nt, Bordetella pertussis
gcugccggcguccugcggcggca

SEQ ID NO: 359265 - RNA, 21 nt, Bordetella pertussis
gcugccggcguuggccggguc

SEQ ID NO: 359266 - RNA, 20 nt, Bordetella pertussis
gcugccgggcucggccacca

SEQ ID NO: 359267 - RNA, 13 nt, Bordetella pertussis
gcugcgccagccc

SEQ ID NO: 359268 - RNA, 13 nt, Bordetella pertussis
gcugcgccgcauu

SEQ ID NO: 359269 - RNA, 15 nt, Bordetella pertussis
gcugcgccgaggccu

SEQ ID NO: 359270 - RNA, 15 nt, Bordetella pertussis
gcugcgccggcggca

SEQ ID NO: 359271 - RNA, 18 nt, Bordetella pertussis
gcugcgccuggccgcgcu

SEQ ID NO: 359272 - RNA, 15 nt, Bordetella pertussis
gcugcgccuggcgga

SEQ ID NO: 359273 - RNA, 22 nt, Bordetella pertussis
gcugcgccuggcggacgauggc

SEQ ID NO: 359274 - RNA, 17 nt, Bordetella pertussis
gcugcgccuuggcgcgc

SEQ ID NO: 359275 - RNA, 18 nt, Bordetella pertussis
gcugcgcgaaacggccgg

SEQ ID NO: 359276 - RNA, 16 nt, Bordetella pertussis
gcugcgcgaacgcggc

SEQ ID NO: 359277 - RNA, 16 nt, Bordetella pertussis
gcugcgcgaugcgcgc

SEQ ID NO: 359278 - RNA, 13 nt, Bordetella pertussis
gcugcgcgaccuc

SEQ ID NO: 359279 - RNA, 17 nt, Bordetella pertussis
gcugcgcgccguggugc

SEQ ID NO: 359280 - RNA, 17 nt, Bordetella pertussis
gcugcgcgccuggcacg

SEQ ID NO: 359281 - RNA, 15 nt, Bordetella pertussis
gcugcgcgcgcagcc

SEQ ID NO: 359282 - RNA, 16 nt, Bordetella pertussis
gcugcgcgcgcagcca

SEQ ID NO: 359283 - RNA, 18 nt, Bordetella pertussis
gcugcgcgcgcagccagg

SEQ ID NO: 359284 - RNA, 19 nt, Bordetella pertussis
gcugcgcgcgcagccaggu

SEQ ID NO: 359285 - RNA, 14 nt, Bordetella pertussis
gcugcgcgcggccu

SEQ ID NO: 359286 - RNA, 12 nt, Bordetella pertussis
gcugcgcggccg

SEQ ID NO: 359287 - RNA, 12 nt, Bordetella pertussis
gcugcgcgguca

SEQ ID NO: 359288 - RNA, 22 nt, Bordetella pertussis
gcugcgcggguccggcgugcca

SEQ ID NO: 359289 - RNA, 20 nt, Bordetella pertussis
gcugcguaucaacuuccagc

SEQ ID NO: 359290 - RNA, 21 nt, Bordetella pertussis
gcugcguccaccaccaggccg

SEQ ID NO: 359291 - RNA, 22 nt, Bordetella pertussis
gcugcguccaccaccaggccgg

SEQ ID NO: 359292 - RNA, 15 nt, Bordetella pertussis
gcugcgugcgaucgg

SEQ ID NO: 359293 - RNA, 15 nt, Bordetella pertussis
gcugcgugcgggaca

SEQ ID NO: 359294 - RNA, 16 nt, Bordetella pertussis
gcugcgugcgggacag

SEQ ID NO: 359295 - RNA, 14 nt, Bordetella pertussis
gcugcuaugccgug

SEQ ID NO: 359296 - RNA, 18 nt, Bordetella pertussis
gcugcucaacggccacca

SEQ ID NO: 359297 - RNA, 13 nt, Bordetella pertussis
gcugcucgaaacg

SEQ ID NO: 359298 - RNA, 18 nt, Bordetella pertussis
gcugcucgaaacgcugga

SEQ ID NO: 359299 - RNA, 12 nt, Bordetella pertussis
gcugcucgacag

SEQ ID NO: 359300 - RNA, 18 nt, Bordetella pertussis
gcugcucguucugcgcgc

SEQ ID NO: 359301 - RNA, 16 nt, Bordetella pertussis
gcugcucuuggcgccg

SEQ ID NO: 359302 - RNA, 22 nt, Bordetella pertussis
gcuggcggacacgcccuggccg

SEQ ID NO: 359303 - RNA, 14 nt, Bordetella pertussis
gcuggcggccgugc

SEQ ID NO: 359304 - RNA, 15 nt, Bordetella pertussis
gcuggcggcgcagca

SEQ ID NO: 359305 - RNA, 18 nt, Bordetella pertussis
gcuggcggcgcagcacca

SEQ ID NO: 359306 - RNA, 16 nt, Bordetella pertussis
gcuggcggcgcaggcc

SEQ ID NO: 359307 - RNA, 17 nt, Bordetella pertussis
gcuggcggcgcgcggcu

SEQ ID NO: 359308 - RNA, 20 nt, Bordetella pertussis
gcuggcggugcgugcgccca

SEQ ID NO: 359309 - RNA, 18 nt, Bordetella pertussis
gcuggcgguggccgcgca

SEQ ID NO: 359310 - RNA, 14 nt, Bordetella pertussis
gcuggcguccaggu

SEQ ID NO: 359311 - RNA, 20 nt, Bordetella pertussis
gcuggcguucagcgggcgcg

SEQ ID NO: 359312 - RNA, 17 nt, Bordetella pertussis
gcuggcguuugcgcgcg

SEQ ID NO: 359313 - RNA, 23 nt, Bordetella pertussis
gcuggcguuugcgcgcgcgcugg

SEQ ID NO: 359314 - RNA, 16 nt, Bordetella pertussis
gcuggcugagcaggcc

SEQ ID NO: 359315 - RNA, 17 nt, Bordetella pertussis
gcuggcugagcaggccg

SEQ ID NO: 359316 - RNA, 14 nt, Bordetella pertussis
gcuggcugcccugg

SEQ ID NO: 359317 - RNA, 16 nt, Bordetella pertussis
gcuggcugcccuggcg

SEQ ID NO: 359318 - RNA, 16 nt, Bordetella pertussis
gcuggcuggacgcgcg

SEQ ID NO: 359319 - RNA, 17 nt, Bordetella pertussis
gcuggcuggacgcgcgc

SEQ ID NO: 359320 - RNA, 16 nt, Bordetella pertussis
gcugggagagccggcc

SEQ ID NO: 359321 - RNA, 21 nt, Bordetella pertussis
gcugggacaggcacaccgguc

SEQ ID NO: 359322 - RNA, 16 nt, Bordetella pertussis
gcugggcacauccagc

SEQ ID NO: 359323 - RNA, 18 nt, Bordetella pertussis
gcugggcacauccagcgc

SEQ ID NO: 359324 - RNA, 19 nt, Bordetella pertussis
gcugggcacauccagcgcc

SEQ ID NO: 359325 - RNA, 20 nt, Bordetella pertussis
gcugggcaggcuggcgcggu

SEQ ID NO: 359326 - RNA, 20 nt, Bordetella pertussis
gcugggcaugauggugcugc

SEQ ID NO: 359327 - RNA, 22 nt, Bordetella pertussis
gcugggcaugauggugcugccg

SEQ ID NO: 359328 - RNA, 14 nt, Bordetella pertussis
gcugggcaugggcg

SEQ ID NO: 359329 - RNA, 19 nt, Bordetella pertussis
gcugggccagaccgcgcgc

SEQ ID NO: 359330 - RNA, 19 nt, Bordetella pertussis
gcugggccaggccggccuu

SEQ ID NO: 359331 - RNA, 14 nt, Bordetella pertussis
gcugggccaugcgu

SEQ ID NO: 359332 - RNA, 13 nt, Bordetella pertussis
gcugggccgcgcu

SEQ ID NO: 359333 - RNA, 17 nt, Bordetella pertussis
gcugggccggcgcgcgc

SEQ ID NO: 359334 - RNA, 15 nt, Bordetella pertussis
gcugggcgccagcag

SEQ ID NO: 359335 - RNA, 19 nt, Bordetella pertussis
gcugggcgccaugcgcccg

SEQ ID NO: 359336 - RNA, 14 nt, Bordetella pertussis
gcugggcgcgcaca

SEQ ID NO: 359337 - RNA, 21 nt, Bordetella pertussis
gcugggcgcgcacaagcgcga

SEQ ID NO: 359338 - RNA, 13 nt, Bordetella pertussis
gcugggcgcgccg

SEQ ID NO: 359339 - RNA, 15 nt, Bordetella pertussis
gcugggcgcgccgcu

SEQ ID NO: 359340 - RNA, 19 nt, Bordetella pertussis
gcugggcggccaggcggau

SEQ ID NO: 359341 - RNA, 21 nt, Bordetella pertussis
gcugggcggccuuggccgcag

SEQ ID NO: 359342 - RNA, 12 nt, Bordetella pertussis
gcugggcgcgca

SEQ ID NO: 359343 - RNA, 12 nt, Bordetella pertussis
gcugggcggcgg

SEQ ID NO: 359344 - RNA, 18 nt, Bordetella pertussis
gcugggcgggcugguggu

SEQ ID NO: 359345 - RNA, 19 nt, Bordetella pertussis
gcugggcgguugcgcugcu

SEQ ID NO: 359346 - RNA, 21 nt, Bordetella pertussis
gcugggcguggcgcgcgugcu

SEQ ID NO: 359347 - RNA, 19 nt, Bordetella pertussis
gcuggggccgagcgugccg

SEQ ID NO: 359348 - RNA, 23 nt, Bordetella pertussis
gcuggggguggugaagaaccgcc

SEQ ID NO: 359349 - RNA, 19 nt, Bordetella pertussis
gcuggggcaggacgccggc

SEQ ID NO: 359350 - RNA, 20 nt, Bordetella pertussis
gcuggggcaggacgccggcg

SEQ ID NO: 359351 - RNA, 14 nt, Bordetella pertussis
gcugggucaucagc

SEQ ID NO: 359352 - RNA, 19 nt, Bordetella pertussis
gcuggguguagucgcggcc

SEQ ID NO: 359353 - RNA, 17 nt, Bordetella pertussis
gcugguacagccccagc

SEQ ID NO: 359354 - RNA, 18 nt, Bordetella pertussis
gcugguacagccccagcg

SEQ ID NO: 359355 - RNA, 22 nt, Bordetella pertussis
gcugguagaaguucucgcgcuu

SEQ ID NO: 359356 - RNA, 16 nt, Bordetella pertussis
gcugguaggggaugcg

SEQ ID NO: 359357 - RNA, 19 nt, Bordetella pertussis
gcugguaguaggccacugc

SEQ ID NO: 359358 - RNA, 16 nt, Bordetella pertussis
gcuggucaacucgccc

SEQ ID NO: 359359 - RNA, 21 nt, Bordetella pertussis
gcuggucagccuggggcaggc

SEQ ID NO: 359360 - RNA, 19 nt, Bordetella pertussis
gcuggucaucuacagcgcc

SEQ ID NO: 359361 - RNA, 23 nt, Bordetella pertussis
gcuggucaucuacagcgccuggc

SEQ ID NO: 359362 - RNA, 22 nt, Bordetella pertussis
gcuggucgagagccugggcgcg

SEQ ID NO: 359363 - RNA, 23 nt, Bordetella pertussis
gcuggucgagagccugggcgcgc

SEQ ID NO: 359364 - RNA, 17 nt, Bordetella pertussis
gcuggucgccaucugcu

SEQ ID NO: 359365 - RNA, 14 nt, Bordetella pertussis
gcuggucgcgcacc

SEQ ID NO: 359366 - RNA, 15 nt, Bordetella pertussis
gcuggucgcgcaccu

SEQ ID NO: 359367 - RNA, 22 nt, Bordetella pertussis
gcuggucgcgcaccuguucggc

SEQ ID NO: 359368 - RNA, 18 nt, Bordetella pertussis
gcuggucgcgcagcacga

SEQ ID NO: 359369 - RNA, 16 nt, Bordetella pertussis
gcuggucgcgccgguc

SEQ ID NO: 359370 - RNA, 15 nt, Bordetella pertussis
gcuggucgcgggcca

SEQ ID NO: 359371 - RNA, 17 nt, Bordetella pertussis
gcuggucguaucgccgc

SEQ ID NO: 359372 - RNA, 17 nt, Bordetella pertussis
gcuggugaagucggccc

SEQ ID NO: 359373 - RNA, 13 nt, Bordetella pertussis
gcuggugccgcug

SEQ ID NO: 359374 - RNA, 14 nt, Bordetella pertussis
gcuggugccgcugg

SEQ ID NO: 359375 - RNA, 16 nt, Bordetella pertussis
gcuggugccgcuggcg

SEQ ID NO: 359376 - RNA, 17 nt, Bordetella pertussis
gcuggugcuggugccgc

SEQ ID NO: 359377 - RNA, 17 nt, Bordetella pertussis
gcugguggccaccagcc

SEQ ID NO: 359378 - RNA, 18 nt, Bordetella pertussis
gcugguggccaccagccc

SEQ ID NO: 359379 - RNA, 19 nt, Bordetella pertussis
gcugguggccaccagcccc

SEQ ID NO: 359380 - RNA, 15 nt, Bordetella pertussis
gcugguggcgucgag

SEQ ID NO: 359381 - RNA, 19 nt, Bordetella pertussis
gcugguggugccgcgcacg

SEQ ID NO: 359382 - RNA, 18 nt, Bordetella pertussis
gcugguuuucggacgcag

SEQ ID NO: 359383 - RNA, 15 nt, Bordetella pertussis
gcuguaccuggcgau

SEQ ID NO: 359384 - RNA, 23 nt, Bordetella pertussis
gcuguacgacagcaagggcgucu

SEQ ID NO: 359385 - RNA, 18 nt, Bordetella pertussis
gcuguacugguaccaggc

SEQ ID NO: 359386 - RNA, 20 nt, Bordetella pertussis
gcuguacugguaccaggcgg

SEQ ID NO: 359387 - RNA, 22 nt, Bordetella pertussis
gcuguagaaguaguucggcgcg

SEQ ID NO: 359388 - RNA, 17 nt, Bordetella pertussis
gcuguagaggcgcggcu

SEQ ID NO: 359389 - RNA, 18 nt, Bordetella pertussis
gcuguagcccuggcgcug

SEQ ID NO: 359390 - RNA, 20 nt, Bordetella pertussis
gcuguagcccuggcgcugca

SEQ ID NO: 359391 - RNA, 14 nt, Bordetella pertussis
gcuguagcgcagcc

SEQ ID NO: 359392 - RNA, 15 nt, Bordetella pertussis
gcuguagcgcagccc

SEQ ID NO: 359393 - RNA, 16 nt, Bordetella pertussis
gcuguaggcgccggcg

SEQ ID NO: 359394 - RNA, 19 nt, Bordetella pertussis
gcuguaggcgccggcgccg

SEQ ID NO: 359395 - RNA, 16 nt, Bordetella pertussis
gcuguaucuggccugu

SEQ ID NO: 359396 - RNA, 20 nt, Bordetella pertussis
gcuguauagaugcgcggggc

SEQ ID NO: 359397 - RNA, 23 nt, Bordetella pertussis
gcuguauauauagggggcauggc

SEQ ID NO: 359398 - RNA, 15 nt, Bordetella pertussis
gcuguccaccugcac

SEQ ID NO: 359399 - RNA, 14 nt, Bordetella pertussis
gcuguccccgcaug

SEQ ID NO: 359400 - RNA, 18 nt, Bordetella pertussis
gcuguccccgcauggaga

SEQ ID NO: 359401 - RNA, 19 nt, Bordetella pertussis
gcuguccuucguggcgccg

SEQ ID NO: 359402 - RNA, 22 nt, Bordetella pertussis
gcugucgcagucggggccgcag

SEQ ID NO: 359403 - RNA, 16 nt, Bordetella pertussis
gcugucgcgcgcaucg

SEQ ID NO: 359404 - RNA, 23 nt, Bordetella pertussis
gcugucgcgcuacagcguggugg

SEQ ID NO: 359405 - RNA, 22 nt, Bordetella pertussis
gcugucgcucaugaccagcggc

SEQ ID NO: 359406 - RNA, 23 nt, Bordetella pertussis
gcugucgcucaugaccagcggcg

SEQ ID NO: 359407 - RNA, 22 nt, Bordetella pertussis
gcugucgcugggauggguacgc

SEQ ID NO: 359408 - RNA, 15 nt, Bordetella pertussis
gcugucggcgcuggc

SEQ ID NO: 359409 - RNA, 17 nt, Bordetella pertussis
gcugucgggcggcgccu

SEQ ID NO: 359410 - RNA, 16 nt, Bordetella pertussis
gcugucgucgucggca

SEQ ID NO: 359411 - RNA, 16 nt, Bordetella pertussis
gcugugccugccaagc

SEQ ID NO: 359412 - RNA, 24 nt, Bordetella pertussis
gcugugccugccaagcgccgcggc

SEQ ID NO: 359413 - RNA, 21 nt, Bordetella pertussis
gcugugcgacgauccggcgac

SEQ ID NO: 359414 - RNA, 19 nt, Bordetella pertussis
gcugugcgccggggcgccg

SEQ ID NO: 359415 - RNA, 13 nt, Bordetella pertussis
gcugugcgcggcg

SEQ ID NO: 359416 - RNA, 18 nt, Bordetella pertussis
gcugugcgcguuccggcc

SEQ ID NO: 359417 - RNA, 21 nt, Bordetella pertussis
gcuguggacgccgccggccca

SEQ ID NO: 359418 - RNA, 14 nt, Bordetella pertussis
gcuguggcgcgcca

SEQ ID NO: 359419 - RNA, 17 nt, Bordetella pertussis
gcuguucaggcgcucga

SEQ ID NO: 359420 - RNA, 15 nt, Bordetella pertussis
gcuguucgcgcagca

SEQ ID NO: 359421 - RNA, 16 nt, Bordetella pertussis
gcuguucggcgaccgc

SEQ ID NO: 359422 - RNA, 20 nt, Bordetella pertussis
gcuguucggcgaccgccggc

SEQ ID NO: 359423 - RNA, 21 nt, Bordetella pertussis
gcuguucuucggcaaccgcgc

SEQ ID NO: 359424 - RNA, 17 nt, Bordetella pertussis
gcuguugcccaccagcc

SEQ ID NO: 359425 - RNA, 21 nt, Bordetella pertussis
gcuguugcccaccagccgggc

SEQ ID NO: 359426 - RNA, 20 nt, Bordetella pertussis
gcuguugaggaugugcagcg

SEQ ID NO: 359427 - RNA, 20 nt, Bordetella pertussis
gcuguuggccggcgcgcccu

SEQ ID NO: 359428 - RNA, 13 nt, Bordetella pertussis
gcuuaccaggcgu

SEQ ID NO: 359429 - RNA, 15 nt, Bordetella pertussis
gcuuagcgcagcagc

SEQ ID NO: 359430 - RNA, 18 nt, Bordetella pertussis
gcuuaucgcggcgcggcg

SEQ ID NO: 359431 - RNA, 21 nt, Bordetella pertussis
gcuucaggcgccgcagauggc

SEQ ID NO: 359432 - RNA, 17 nt, Bordetella pertussis
gcuucagugcucgggcu

SEQ ID NO: 359433 - RNA, 15 nt, Bordetella pertussis
gcuucaguuccaggc

SEQ ID NO: 359434 - RNA, 14 nt, Bordetella pertussis
gcuucaugccggcg

SEQ ID NO: 359435 - RNA, 15 nt, Bordetella pertussis
gcuucaugccggcgu

SEQ ID NO: 359436 - RNA, 14 nt, Bordetella pertussis
gcuuccaauccgga

SEQ ID NO: 359437 - RNA, 18 nt, Bordetella pertussis
gcuuccagaucgaccagg

SEQ ID NO: 359438 - RNA, 16 nt, Bordetella pertussis
gcuucccgguccaggc

SEQ ID NO: 359439 - RNA, 15 nt, Bordetella pertussis
gcuuccucgaccagg

SEQ ID NO: 359440 - RNA, 17 nt, Bordetella pertussis
gcuuccuugcgguugaa

SEQ ID NO: 359441 - RNA, 18 nt, Bordetella pertussis
gcuucgaacgacuugggc

SEQ ID NO: 359442 - RNA, 22 nt, Bordetella pertussis
gcuucgagccgguacagccagg

SEQ ID NO: 359443 - RNA, 19 nt, Bordetella pertussis
gcuucgagauccgccggcg

SEQ ID NO: 359444 - RNA, 20 nt, Bordetella pertussis
gcuucgagauccgccggcga

SEQ ID NO: 359445 - RNA, 15 nt, Bordetella pertussis
gcuucgaugcuggcg

SEQ ID NO: 359446 - RNA, 14 nt, Bordetella pertussis
gcuucgcccagcgc

SEQ ID NO: 359447 - RNA, 18 nt, Bordetella pertussis
gcuucgcccagcgcuugc

SEQ ID NO: 359448 - RNA, 13 nt, Bordetella pertussis
gcuucgcccgcca

SEQ ID NO: 359449 - RNA, 16 nt, Bordetella pertussis
gcuucgcgcacaucca

SEQ ID NO: 359450 - RNA, 21 nt, Bordetella pertussis
gcuucgcgcacauccagccga

SEQ ID NO: 359451 - RNA, 13 nt, Bordetella pertussis
gcuucggcgcugg

SEQ ID NO: 359452 - RNA, 13 nt, Bordetella pertussis
gcuucggcggcca

SEQ ID NO: 359453 - RNA, 16 nt, Bordetella pertussis
gcuucggcggccgcgu

SEQ ID NO: 359454 - RNA, 15 nt, Bordetella pertussis
gcuucggucagcugc

SEQ ID NO: 359455 - RNA, 16 nt, Bordetella pertussis
gcuucggucagcugcu

SEQ ID NO: 359456 - RNA, 17 nt, Bordetella pertussis
gcuucgguggcgcgcaa

SEQ ID NO: 359457 - RNA, 22 nt, Bordetella pertussis
gcuucgguggcgcgcaacacgc

SEQ ID NO: 359458 - RNA, 16 nt, Bordetella pertussis
gcuucgucgaccagca

SEQ ID NO: 359459 - RNA, 16 nt, Bordetella pertussis
gcuucgucgccggcgu

SEQ ID NO: 359460 - RNA, 22 nt, Bordetella pertussis
gcuucgucgccggcguugguga

SEQ ID NO: 359461 - RNA, 17 nt, Bordetella pertussis
gcuucgucggcgucgaa

SEQ ID NO: 359462 - RNA, 13 nt, Bordetella pertussis
gcuucgucgggca

SEQ ID NO: 359463 - RNA, 16 nt, Bordetella pertussis
gcuucgucgggcagcg

SEQ ID NO: 359464 - RNA, 23 nt, Bordetella pertussis
gcuucuaggagacggucaccgcg

SEQ ID NO: 359465 - RNA, 22 nt, Bordetella pertussis
gcuucucgcaagugcuggcccg

SEQ ID NO: 359466 - RNA, 18 nt, Bordetella pertussis
gcuucugccagacggcca

SEQ ID NO: 359467 - RNA, 14 nt, Bordetella pertussis
gcuucugcgccugc

SEQ ID NO: 359468 - RNA, 20 nt, Bordetella pertussis
gcuucuggaucaccgccggc

SEQ ID NO: 359469 - RNA, 17 nt, Bordetella pertussis
gcuucuucgucgcgcca

SEQ ID NO: 359470 - RNA, 18 nt, Bordetella pertussis
gcuucuugaacucggcca

SEQ ID NO: 359471 - RNA, 20 nt, Bordetella pertussis
gcuucuugaacucggccagc

SEQ ID NO: 359472 - RNA, 21 nt, Bordetella pertussis
gcuucuugaacucggccagca

SEQ ID NO: 359473 - RNA, 17 nt, Bordetella pertussis
gcuugaagacgcccagg

SEQ ID NO: 359474 - RNA, 18 nt, Bordetella pertussis
gcuugaccacggccagca

SEQ ID NO: 359475 - RNA, 20 nt, Bordetella pertussis
gcuugaccacggccagcagc

SEQ ID NO: 359476 - RNA, 15 nt, Bordetella pertussis
gcuugaccgccagca

SEQ ID NO: 359477 - RNA, 16 nt, Bordetella pertussis
gcuugaccgccagcau

SEQ ID NO: 359478 - RNA, 17 nt, Bordetella pertussis
gcuugaccgccagcauc

SEQ ID NO: 359479 - RNA, 21 nt, Bordetella pertussis
gcuugaccgccucgaucgcca

SEQ ID NO: 359480 - RNA, 14 nt, Bordetella pertussis
gcuugacggccaag

SEQ ID NO: 359481 - RNA, 21 nt, Bordetella pertussis
gcuugacguagcggaucgcgg

SEQ ID NO: 359482 - RNA, 22 nt, Bordetella pertussis
gcuugacguagcggaucgcggc

SEQ ID NO: 359483 - RNA, 17 nt, Bordetella pertussis
gcuugacguccagccag

SEQ ID NO: 359484 - RNA, 17 nt, Bordetella pertussis
gcuugacguccagcgac

SEQ ID NO: 359485 - RNA, 21 nt, Bordetella pertussis
gcuugagauacuugcgcagcg

SEQ ID NO: 359486 - RNA, 13 nt, Bordetella pertussis
gcuugagcagcca

SEQ ID NO: 359487 - RNA, 18 nt, Bordetella pertussis
gcuugagcgaaugcgcgu

SEQ ID NO: 359488 - RNA, 23 nt, Bordetella pertussis
gcuugauaugggcgagcaggccc

SEQ ID NO: 359489 - RNA, 15 nt, Bordetella pertussis
gcuugaugccggcgu

SEQ ID NO: 359490 - RNA, 23 nt, Bordetella pertussis
gcuugauggccagcgcgcgggcg

SEQ ID NO: 359491 - RNA, 14 nt, Bordetella pertussis
gcuugcacgccggc

SEQ ID NO: 359492 - RNA, 17 nt, Bordetella pertussis
gcuugcacgccggccac

SEQ ID NO: 359493 - RNA, 17 nt, Bordetella pertussis
gcuugcagcggacggcg

SEQ ID NO: 359494 - RNA, 17 nt, Bordetella pertussis
gcuugcagcaacgcggc

SEQ ID NO: 359495 - RNA, 14 nt, Bordetella pertussis
gcuugcccacgcgc

SEQ ID NO: 359496 - RNA, 21 nt, Bordetella pertussis
gcuugcccagcagaucguuca

SEQ ID NO: 359497 - RNA, 21 nt, Bordetella pertussis
gcuugcccaggccggcgcgcu

SEQ ID NO: 359498 - RNA, 14 nt, Bordetella pertussis
gcuugccauaggcc

SEQ ID NO: 359499 - RNA, 20 nt, Bordetella pertussis
gcuugccauaggccagcgcc

SEQ ID NO: 359500 - RNA, 15 nt, Bordetella pertussis
gcuugccgcagcggc

SEQ ID NO: 359501 - RNA, 15 nt, Bordetella pertussis
gcuugccggcgauca

SEQ ID NO: 359502 - RNA, 17 nt, Bordetella pertussis
gcuugccggcgaucacg

SEQ ID NO: 359503 - RNA, 15 nt, Bordetella pertussis
gcuugccgcgcggcg

SEQ ID NO: 359504 - RNA, 16 nt, Bordetella pertussis
gcuugcgauaggugcg

SEQ ID NO: 359505 - RNA, 19 nt, Bordetella pertussis
gcuugcgauaggugcgcag

SEQ ID NO: 359506 - RNA, 22 nt, Bordetella pertussis
gcuugcgauaggugcgcagccg

SEQ ID NO: 359507 - RNA, 19 nt, Bordetella pertussis
gcuugcgcaagccggccgc

SEQ ID NO: 359508 - RNA, 21 nt, Bordetella pertussis
gcuugcgccagccacgcgcgc

SEQ ID NO: 359509 - RNA, 14 nt, Bordetella pertussis
gcuugcgcgccgca

SEQ ID NO: 359510 - RNA, 15 nt, Bordetella pertussis
gcuugcgcgccugcu

SEQ ID NO: 359511 - RNA, 16 nt, Bordetella pertussis
gcuugcgcguaggcgc

SEQ ID NO: 359512 - RNA, 16 nt, Bordetella pertussis
gcuugcggccaggcgg

SEQ ID NO: 359513 - RNA, 16 nt, Bordetella pertussis
gcuugcggccggcgcu

SEQ ID NO: 359514 - RNA, 15 nt, Bordetella pertussis
gcuugcggcgcuggc

SEQ ID NO: 359515 - RNA, 12 nt, Bordetella pertussis
gcuugcgcuggc

SEQ ID NO: 359516 - RNA, 15 nt, Bordetella pertussis
gcuugcgcuggcgcg

SEQ ID NO: 359517 - RNA, 20 nt, Bordetella pertussis
gcuugcguuggcauggcgcg

SEQ ID NO: 359518 - RNA, 20 nt, Bordetella pertussis
gcuugcuucaggcuggccug

SEQ ID NO: 359519 - RNA, 23 nt, Bordetella pertussis
gcuugcuucaggcuggccugcag

SEQ ID NO: 359520 - RNA, 15 nt, Bordetella pertussis
gcuugcuugccagcu

SEQ ID NO: 359521 - RNA, 21 nt, Bordetella pertussis
gcuuggaccccguggucgcca

SEQ ID NO: 359522 - RNA, 13 nt, Bordetella pertussis
gcuuggcaggcgu

SEQ ID NO: 359523 - RNA, 14 nt, Bordetella pertussis
gcuuggccaccacg

SEQ ID NO: 359524 - RNA, 16 nt, Bordetella pertussis
gcuuggccaccacgcc

SEQ ID NO: 359525 - RNA, 17 nt, Bordetella pertussis
gcuuggccagcuggcgc

SEQ ID NO: 359526 - RNA, 22 nt, Bordetella pertussis
gcuuggcccugcagcggccagu

SEQ ID NO: 359527 - RNA, 12 nt, Bordetella pertussis
gcuuggccgcgu

SEQ ID NO: 359528 - RNA, 20 nt, Bordetella pertussis
gcuuggcgaacaccagggug

SEQ ID NO: 359529 - RNA, 17 nt, Bordetella pertussis
gcuuggcgcgcagcagc

SEQ ID NO: 359530 - RNA, 20 nt, Bordetella pertussis
gcuuggcgcgcagcagcgca

SEQ ID NO: 359531 - RNA, 13 nt, Bordetella pertussis
gcuuggcgcgccg

SEQ ID NO: 359532 - RNA, 15 nt, Bordetella pertussis
gcuuggcggccagga

SEQ ID NO: 359533 - RNA, 15 nt, Bordetella pertussis
gcuuggcgugcgcga

SEQ ID NO: 359534 - RNA, 20 nt, Bordetella pertussis
gcuuggggcgcgccgcggcg

SEQ ID NO: 359535 - RNA, 17 nt, Bordetella pertussis
gcuuggucagcaucagc

SEQ ID NO: 359536 - RNA, 19 nt, Bordetella pertussis
gcuuggucagcaucagcag

SEQ ID NO: 359537 - RNA, 18 nt, Bordetella pertussis
gcuuguagcccucggucg

SEQ ID NO: 359538 - RNA, 18 nt, Bordetella pertussis
gcuugucgaccaccggcu

SEQ ID NO: 359539 - RNA, 12 nt, Bordetella pertussis
gcuugucggccg

SEQ ID NO: 359540 - RNA, 18 nt, Bordetella pertussis
gcuugucggccgcgcgca

SEQ ID NO: 359541 - RNA, 17 nt, Bordetella pertussis
gcuuucgaagccgcccc

SEQ ID NO: 359542 - RNA, 16 nt, Bordetella pertussis
gcuuucgaccagcgac

SEQ ID NO: 359543 - RNA, 16 nt, Bordetella pertussis
gcuuucgcacagccgg

SEQ ID NO: 359544 - RNA, 22 nt, Bordetella pertussis
gcuuucgcacagccggggcgag

SEQ ID NO: 359545 - RNA, 23 nt, Bordetella pertussis
gcuuucggggcgcaagaucugga

SEQ ID NO: 359546 - RNA, 15 nt, Bordetella pertussis
gcuuugacgccggcu

SEQ ID NO: 359547 - RNA, 14 nt, Bordetella pertussis
gcuuugcgcgccau

SEQ ID NO: 359548 - RNA, 16 nt, Bordetella pertussis
gcuuugcgggcgcgcu

SEQ ID NO: 359549 - RNA, 17 nt, Bordetella pertussis
gcuuuggcuuggcgaau

SEQ ID NO: 359550 - RNA, 21 nt, Bordetella pertussis
gcuuuggucuauuuccgacga

SEQ ID NO: 359551 - RNA, 22 nt, Bordetella pertussis
gcuuuggucuauuuccgacgag

SEQ ID NO: 359552 - RNA, 17 nt, Bordetella pertussis
gcuuuuuccuguucggc

SEQ ID NO: 359553 - RNA, 19 nt, Bordetella pertussis
gcuuuuuucuccagcgcca

SEQ ID NO: 359554 - RNA, 16 nt, Bordetella pertussis
gcuuuuuugcguucgc

SEQ ID NO: 359555 - RNA, 17 nt, Bordetella pertussis
gcuuuuuuucgccgggc

SEQ ID NO: 359556 - RNA, 14 nt, Bordetella pertussis
ggaaaacagcgcgg

SEQ ID NO: 359557 - RNA, 20 nt, Bordetella pertussis
ggaaaaucgauacgccgggc

SEQ ID NO: 359558 - RNA, 20 nt, Bordetella pertussis
ggaaacacguccagcgccgc

SEQ ID NO: 359559 - RNA, 16 nt, Bordetella pertussis
ggaaacaggcccacgg

SEQ ID NO: 359560 - RNA, 19 nt, Bordetella pertussis
ggaaacccuucgcgcagca

SEQ ID NO: 359561 - RNA, 21 nt, Bordetella pertussis
ggaaacgcccagcccugcccg

SEQ ID NO: 359562 - RNA, 16 nt, Bordetella pertussis
ggaaacucgcgcagcg

SEQ ID NO: 359563 - RNA, 14 nt, Bordetella pertussis
ggaaagaggccagg

SEQ ID NO: 359564 - RNA, 12 nt, Bordetella pertussis
ggaaagcccggc

SEQ ID NO: 359565 - RNA, 13 nt, Bordetella pertussis
ggaaagcgccgcc

SEQ ID NO: 359566 - RNA, 20 nt, Bordetella pertussis
ggaaagcuguccacgccgaa

SEQ ID NO: 359567 - RNA, 19 nt, Bordetella pertussis
ggaaauccguaguccagca

SEQ ID NO: 359568 - RNA, 15 nt, Bordetella pertussis
ggaaaucgugccguc

SEQ ID NO: 359569 - RNA, 13 nt, Bordetella pertussis
ggaaaugccgcgc

SEQ ID NO: 359570 - RNA, 13 nt, Bordetella pertussis
ggaaaugccggcg

SEQ ID NO: 359571 - RNA, 15 nt, Bordetella pertussis
ggaaaugccggcggc

SEQ ID NO: 359572 - RNA, 14 nt, Bordetella pertussis
ggaucgagcgcggu

SEQ ID NO: 359573 - RNA, 15 nt, Bordetella pertussis
ggaucgcgccaggcg

SEQ ID NO: 359574 - RNA, 16 nt, Bordetella pertussis
ggaucgcgccaggcgu

SEQ ID NO: 359575 - RNA, 15 nt, Bordetella pertussis
ggaucgcggccagcc

SEQ ID NO: 359576 - RNA, 17 nt, Bordetella pertussis
ggaucgcggccagccgg

SEQ ID NO: 359577 - RNA, 16 nt, Bordetella pertussis
ggaucgcggccagcgg

SEQ ID NO: 359578 - RNA, 15 nt, Bordetella pertussis
ggaucggccaggccg

SEQ ID NO: 359579 - RNA, 19 nt, Bordetella pertussis
ggaucggccggcagcgcga

SEQ ID NO: 359580 - RNA, 24 nt, Bordetella pertussis
ggaucggcguauugcuccacaggc

SEQ ID NO: 359581 - RNA, 19 nt, Bordetella pertussis
ggaucggcgucagcgccca

SEQ ID NO: 359582 - RNA, 22 nt, Bordetella pertussis
ggaucgggcagcuuggcgcgcc

SEQ ID NO: 359583 - RNA, 23 nt, Bordetella pertussis
ggaucggggggugcgaggcgaac

SEQ ID NO: 359584 - RNA, 14 nt, Bordetella pertussis
ggaucgucccaggu

SEQ ID NO: 359585 - RNA, 17 nt, Bordetella pertussis
ggaucugcaugccgacc

SEQ ID NO: 359586 - RNA, 21 nt, Bordetella pertussis
ggaucugguagugcaggccgc

SEQ ID NO: 359587 - RNA, 19 nt, Bordetella pertussis
ggaugaccugcgccaggug

SEQ ID NO: 359588 - RNA, 21 nt, Bordetella pertussis
ggaugaccugcgccaggugcu

SEQ ID NO: 359589 - RNA, 15 nt, Bordetella pertussis
ggaugacgggcgagc

SEQ ID NO: 359590 - RNA, 17 nt, Bordetella pertussis
ggaugacucgggcaugc

SEQ ID NO: 359591 - RNA, 23 nt, Bordetella pertussis
ggaugacucgggcaugcgccugc

SEQ ID NO: 359592 - RNA, 15 nt, Bordetella pertussis
ggaugaucgcgcagc

SEQ ID NO: 359593 - RNA, 14 nt, Bordetella pertussis
ggaugaugcggcgc

SEQ ID NO: 359594 - RNA, 15 nt, Bordetella pertussis
ggaugaugggcaucg

SEQ ID NO: 359595 - RNA, 21 nt, Bordetella pertussis
ggaugcaggucggggcgcucg

SEQ ID NO: 359596 - RNA, 17 nt, Bordetella pertussis
ggaugccccgcccgcgu

SEQ ID NO: 359597 - RNA, 18 nt, Bordetella pertussis
ggaugcccuuggcggcga

SEQ ID NO: 359598 - RNA, 21 nt, Bordetella pertussis
ggaugcccuuggcggcgaucg

SEQ ID NO: 359599 - RNA, 20 nt, Bordetella pertussis
ggaugccguaggugcgcgcc

SEQ ID NO: 359600 - RNA, 13 nt, Bordetella pertussis
ggaugcgcaccgg

SEQ ID NO: 359601 - RNA, 16 nt, Bordetella pertussis
ggaugcgcaccggcca

SEQ ID NO: 359602 - RNA, 13 nt, Bordetella pertussis
ggaugcgcgcccc

SEQ ID NO: 359603 - RNA, 23 nt, Bordetella pertussis
ggaugcgcgccccgucggccguc

SEQ ID NO: 359604 - RNA, 18 nt, Bordetella pertussis
ggauggacuggccgcgac

SEQ ID NO: 359605 - RNA, 19 nt, Bordetella pertussis
ggauggacuggccgcgaca

SEQ ID NO: 359606 - RNA, 17 nt, Bordetella pertussis
ggauggaugccgucggc

SEQ ID NO: 359607 - RNA, 18 nt, Bordetella pertussis
ggauggccugcucgccca

SEQ ID NO: 359608 - RNA, 14 nt, Bordetella pertussis
ggauggcgccagcc

SEQ ID NO: 359609 - RNA, 12 nt, Bordetella pertussis
ggauggcgcgga

SEQ ID NO: 359610 - RNA, 15 nt, Bordetella pertussis
ggauggcggccgcca

SEQ ID NO: 359611 - RNA, 19 nt, Bordetella pertussis
ggaugggcgcggcgcgcgc

SEQ ID NO: 359612 - RNA, 20 nt, Bordetella pertussis
ggaugggcgcggcgcgcgcc

SEQ ID NO: 359613 - RNA, 12 nt, Bordetella pertussis
ggauggguacgc

SEQ ID NO: 359614 - RNA, 19 nt, Bordetella pertussis
ggaugguagaugcgcgcga

SEQ ID NO: 359615 - RNA, 14 nt, Bordetella pertussis
ggauggucacgccc

SEQ ID NO: 359616 - RNA, 13 nt, Bordetella pertussis
ggauggucgugcg

SEQ ID NO: 359617 - RNA, 18 nt, Bordetella pertussis
ggauggugccgccgcccg

SEQ ID NO: 359618 - RNA, 21 nt, Bordetella pertussis
ggauguacgucagcaugcacg

SEQ ID NO: 359619 - RNA, 14 nt, Bordetella pertussis
ggaugugcaggccg

SEQ ID NO: 359620 - RNA, 17 nt, Bordetella pertussis
ggaugugcgcgggcgcg

SEQ ID NO: 359621 - RNA, 22 nt, Bordetella pertussis
ggauuccugcgaggacaggggc

SEQ ID NO: 359622 - RNA, 15 nt, Bordetella pertussis
ggauucgcccagggu

SEQ ID NO: 359623 - RNA, 20 nt, Bordetella pertussis
ggauucgcggugcaagcggc

SEQ ID NO: 359624 - RNA, 16 nt, Bordetella pertussis
ggauucugcugcaugc

SEQ ID NO: 359625 - RNA, 18 nt, Bordetella pertussis
ggauugaugucgcgcacc

SEQ ID NO: 359626 - RNA, 18 nt, Bordetella pertussis
ggauugcuugacgccgcc

SEQ ID NO: 359627 - RNA, 20 nt, Bordetella pertussis
ggauugcuugacgccgccga

SEQ ID NO: 359628 - RNA, 18 nt, Bordetella pertussis
ggcaaaagccggggugcc

SEQ ID NO: 359629 - RNA, 20 nt, Bordetella pertussis
ggcaaacggauugccgccgc

SEQ ID NO: 359630 - RNA, 14 nt, Bordetella pertussis
ggcaaacggcggca

SEQ ID NO: 359631 - RNA, 22 nt, Bordetella pertussis
ggcaaacggcggcaggccgcgc

SEQ ID NO: 359632 - RNA, 19 nt, Bordetella pertussis
ggcaaacuuccccgcgugc

SEQ ID NO: 359633 - RNA, 13 nt, Bordetella pertussis
ggcaaagcgcggc

SEQ ID NO: 359634 - RNA, 15 nt, Bordetella pertussis
ggcaaagccugacgg

SEQ ID NO: 359635 - RNA, 19 nt, Bordetella pertussis
ggcaacccgcccacgcggc

SEQ ID NO: 359636 - RNA, 20 nt, Bordetella pertussis
ggcaaccgucgccagcgcgu

SEQ ID NO: 359637 - RNA, 17 nt, Bordetella pertussis
ggcaaccucgccgcgcc

SEQ ID NO: 359638 - RNA, 21 nt, Bordetella pertussis
ggcaaccugcacgcgggcgcu

SEQ ID NO: 359639 - RNA, 19 nt, Bordetella pertussis
ggcaacuucaccgucgacu

SEQ ID NO: 359640 - RNA, 20 nt, Bordetella pertussis
ggcaagaaucgacucggccg

SEQ ID NO: 359641 - RNA, 16 nt, Bordetella pertussis
ggcaagacggcgcucg

SEQ ID NO: 359642 - RNA, 17 nt, Bordetella pertussis
ggcaagacggcgcucgg

SEQ ID NO: 359643 - RNA, 17 nt, Bordetella pertussis
ggcaagagccuggcucu

SEQ ID NO: 359644 - RNA, 19 nt, Bordetella pertussis
ggcaagcagauggccaucg

SEQ ID NO: 359645 - RNA, 21 nt, Bordetella pertussis
ggcaagcagcgagagcgccac

SEQ ID NO: 359646 - RNA, 13 nt, Bordetella pertussis
ggcaagccuugcg

SEQ ID NO: 359647 - RNA, 22 nt, Bordetella pertussis
ggcaagcgcaauggacacagcg

SEQ ID NO: 359648 - RNA, 15 nt, Bordetella pertussis
ggcaagcgcucgccg

SEQ ID NO: 359649 - RNA, 13 nt, Bordetella pertussis
ggcaaucggcgug

SEQ ID NO: 359650 - RNA, 13 nt, Bordetella pertussis
ggcaaucggggug

SEQ ID NO: 359651 - RNA, 19 nt, Bordetella pertussis
ggcaaucuugccgccgggc

SEQ ID NO: 359652 - RNA, 18 nt, Bordetella pertussis
ggcaaugcgcaggcccga

SEQ ID NO: 359653 - RNA, 15 nt, Bordetella pertussis
ggcaaugguccagca

SEQ ID NO: 359654 - RNA, 20 nt, Bordetella pertussis
ggcacaggccaucggcgcca

SEQ ID NO: 359655 - RNA, 22 nt, Bordetella pertussis
ggcacauacagcggagccgcgc

SEQ ID NO: 359656 - RNA, 18 nt, Bordetella pertussis
ggcacauccagcgccagc

SEQ ID NO: 359657 - RNA, 22 nt, Bordetella pertussis
ggcacauugccguacgccaucg

SEQ ID NO: 359658 - RNA, 18 nt, Bordetella pertussis
ggcaccaccaccgcccgc

SEQ ID NO: 359659 - RNA, 13 nt, Bordetella pertussis
ggcaccaucgccg

SEQ ID NO: 359660 - RNA, 14 nt, Bordetella pertussis
ggcaccaucgccgc

SEQ ID NO: 359661 - RNA, 16 nt, Bordetella pertussis
ggcaccaucguugccu

SEQ ID NO: 359662 - RNA, 19 nt, Bordetella pertussis
ggcaccaucucccgcaggc

SEQ ID NO: 359663 - RNA, 19 nt, Bordetella pertussis
ggcaccaugcgcaccaggc

SEQ ID NO: 359664 - RNA, 13 nt, Bordetella pertussis
ggcacccaggcgg

SEQ ID NO: 359665 - RNA, 18 nt, Bordetella pertussis
ggcacccccgaccgagcc

SEQ ID NO: 359666 - RNA, 17 nt, Bordetella pertussis
ggcaccccggcgccgcg

SEQ ID NO: 359667 - RNA, 13 nt, Bordetella pertussis
ggcaccccgucgu

SEQ ID NO: 359668 - RNA, 22 nt, Bordetella pertussis
ggcacccgcaagauuucauggc

SEQ ID NO: 359669 - RNA, 13 nt, Bordetella pertussis
ggcacccgcacgg

SEQ ID NO: 359670 - RNA, 14 nt, Bordetella pertussis
ggcacccgcauggu

SEQ ID NO: 359671 - RNA, 18 nt, Bordetella pertussis
ggcacccgcaugguggcg

SEQ ID NO: 359672 - RNA, 17 nt, Bordetella pertussis
ggcaccgagccgcaggu

SEQ ID NO: 359673 - RNA, 16 nt, Bordetella pertussis
ggcaccgugaugucgc

SEQ ID NO: 359674 - RNA, 15 nt, Bordetella pertussis
ggcaccucggcgccg

SEQ ID NO: 359675 - RNA, 17 nt, Bordetella pertussis
ggcaccucggcgccgcg

SEQ ID NO: 359676 - RNA, 14 nt, Bordetella pertussis
ggcaccucggggug

SEQ ID NO: 359677 - RNA, 16 nt, Bordetella pertussis
ggcaccucggggugca

SEQ ID NO: 359678 - RNA, 20 nt, Bordetella pertussis
ggcaccuucuuccaggcgcc

SEQ ID NO: 359679 - RNA, 17 nt, Bordetella pertussis
ggcacgccucgccggcc

SEQ ID NO: 359680 - RNA, 17 nt, Bordetella pertussis
ggcacgccugccgcgcc

SEQ ID NO: 359681 - RNA, 16 nt, Bordetella pertussis
ggcacgcgccaggcgu

SEQ ID NO: 359682 - RNA, 15 nt, Bordetella pertussis
ggcacgcgcgccggc

SEQ ID NO: 359683 - RNA, 13 nt, Bordetella pertussis
ggcacgcgcgcgg

SEQ ID NO: 359684 - RNA, 17 nt, Bordetella pertussis
ggcacgcgcgcggcgcg

SEQ ID NO: 359685 - RNA, 12 nt, Bordetella pertussis
ggcacgcgcggu

SEQ ID NO: 359686 - RNA, 22 nt, Bordetella pertussis
ggcacgcgcugaauccggggug

SEQ ID NO: 359687 - RNA, 22 nt, Bordetella pertussis
ggcacgcggaggagguggcugg

SEQ ID NO: 359688 - RNA, 17 nt, Bordetella pertussis
ggcacgcugaucgccgg

SEQ ID NO: 359689 - RNA, 21 nt, Bordetella pertussis
ggcacgcugaucgccggcgcc

SEQ ID NO: 359690 - RNA, 14 nt, Bordetella pertussis
ggcacgcugcgcag

SEQ ID NO: 359691 - RNA, 22 nt, Bordetella pertussis
ggcacgcugcugauccucgcca

SEQ ID NO: 359692 - RNA, 23 nt, Bordetella pertussis
ggcacgcugcugauccucgccag

SEQ ID NO: 359693 - RNA, 13 nt, Bordetella pertussis
ggcacggccagca

SEQ ID NO: 359694 - RNA, 19 nt, Bordetella pertussis
ggcacggccagcaccaugg

SEQ ID NO: 359695 - RNA, 14 nt, Bordetella pertussis
ggcacggccagcau

SEQ ID NO: 359696 - RNA, 17 nt, Bordetella pertussis
ggcacggccagcggcga

SEQ ID NO: 359697 - RNA, 13 nt, Bordetella pertussis
ggcacguugucga

SEQ ID NO: 359698 - RNA, 19 nt, Bordetella pertussis
ggcacuccggauaccgccg

SEQ ID NO: 359699 - RNA, 15 nt, Bordetella pertussis
ggcacucuugccgcu

SEQ ID NO: 359700 - RNA, 17 nt, Bordetella pertussis
ggcacucuugccgcugc

SEQ ID NO: 359701 - RNA, 15 nt, Bordetella pertussis
ggcacuggcgcggcg

SEQ ID NO: 359702 - RNA, 22 nt, Bordetella pertussis
ggcacugucggcguuccuggcg

SEQ ID NO: 359703 - RNA, 20 nt, Bordetella pertussis
ggcagacgaucauccaggcc

SEQ ID NO: 359704 - RNA, 22 nt, Bordetella pertussis
ggcagacgaucauccaggccgu

SEQ ID NO: 359705 - RNA, 23 nt, Bordetella pertussis
ggcagagggcgacggcggcgugg

SEQ ID NO: 359706 - RNA, 20 nt, Bordetella pertussis
ggcagaugaucuacgcgcgc

SEQ ID NO: 359707 - RNA, 23 nt, Bordetella pertussis
ggcagaugaucuacgcgcgcgcc

SEQ ID NO: 359708 - RNA, 24 nt, Bordetella pertussis
ggcagaugaucuacgcgcgcgccg

SEQ ID NO: 359709 - RNA, 16 nt, Bordetella pertussis
ggcagaucggcgcugg

SEQ ID NO: 359710 - RNA, 21 nt, Bordetella pertussis
ggcagaucggcgcuggccugg

SEQ ID NO: 359711 - RNA, 24 nt, Bordetella pertussis
ggcagauugaugcccaugcgcugc

SEQ ID NO: 359712 - RNA, 22 nt, Bordetella pertussis
ggcagcgcgcaggacaaggcgc

SEQ ID NO: 359713 - RNA, 15 nt, Bordetella pertussis
ggcagcgcggcggcg

SEQ ID NO: 359714 - RNA, 16 nt, Bordetella pertussis
ggcagcgcggcggcga

SEQ ID NO: 359715 - RNA, 20 nt, Bordetella pertussis
ggcagcgcggcggcgaccgg

SEQ ID NO: 359716 - RNA, 16 nt, Bordetella pertussis
ggcagcgcggccggca

SEQ ID NO: 359717 - RNA, 22 nt, Bordetella pertussis
ggcagcggacgguagcgcacgc

SEQ ID NO: 359718 - RNA, 13 nt, Bordetella pertussis
ggcagcggcauca

SEQ ID NO: 359719 - RNA, 19 nt, Bordetella pertussis
ggcagcggcaucacgccgg

SEQ ID NO: 359720 - RNA, 14 nt, Bordetella pertussis
ggcagcggccagau

SEQ ID NO: 359721 - RNA, 16 nt, Bordetella pertussis
ggcagcggcgccaugc

SEQ ID NO: 359722 - RNA, 19 nt, Bordetella pertussis
ggcagcggcgccaugcgca

SEQ ID NO: 359723 - RNA, 22 nt, Bordetella pertussis
ggcagcucgcgcugcgcgccgc

SEQ ID NO: 359724 - RNA, 15 nt, Bordetella pertussis
ggcagcucgcggucg

SEQ ID NO: 359725 - RNA, 21 nt, Bordetella pertussis
ggcagcucggugcagcccagc

SEQ ID NO: 359726 - RNA, 13 nt, Bordetella pertussis
ggcagcuggcgcg

SEQ ID NO: 359727 - RNA, 18 nt, Bordetella pertussis
ggcagcuggcgcgggcgg

SEQ ID NO: 359728 - RNA, 16 nt, Bordetella pertussis
ggcagcuugucgaucg

SEQ ID NO: 359729 - RNA, 17 nt, Bordetella pertussis
ggcagcuugucgaucgc

SEQ ID NO: 359730 - RNA, 22 nt, Bordetella pertussis
ggcagcuugucgaucgccacca

SEQ ID NO: 359731 - RNA, 17 nt, Bordetella pertussis
ggcagcuuggcgcgccg

SEQ ID NO: 359732 - RNA, 14 nt, Bordetella pertussis
ggcaggaagccggc

SEQ ID NO: 359733 - RNA, 15 nt, Bordetella pertussis
ggcaggacgccggcg

SEQ ID NO: 359734 - RNA, 18 nt, Bordetella pertussis
ggcaggaggcggcgcgug

SEQ ID NO: 359735 - RNA, 17 nt, Bordetella pertussis
ggcaggcacacgaccgg

SEQ ID NO: 359736 - RNA, 12 nt, Bordetella pertussis
ggcaggccagca

SEQ ID NO: 359737 - RNA, 12 nt, Bordetella pertussis
ggcaggcccagc

SEQ ID NO: 359738 - RNA, 16 nt, Bordetella pertussis
ggcaggccccggcccg

SEQ ID NO: 359739 - RNA, 11 nt, Bordetella pertussis
ggcaggccgau

SEQ ID NO: 359740 - RNA, 15 nt, Bordetella pertussis
ggcaggccgcgccac

SEQ ID NO: 359741 - RNA, 13 nt, Bordetella pertussis
ggcaggccgcggu

SEQ ID NO: 359742 - RNA, 17 nt, Bordetella pertussis
ggcaggccgcuucgaug

SEQ ID NO: 359743 - RNA, 14 nt, Bordetella pertussis
ggcaggccggcgcg

SEQ ID NO: 359744 - RNA, 14 nt, Bordetella pertussis
ggcaggccuucgcg

SEQ ID NO: 359745 - RNA, 12 nt, Bordetella pertussis
ggcaggcgcagc

SEQ ID NO: 359746 - RNA, 14 nt, Bordetella pertussis
ggcaggcgcagcgg

SEQ ID NO: 359747 - RNA, 19 nt, Bordetella pertussis
ggcaggcgcagcggcggcg

SEQ ID NO: 359748 - RNA, 12 nt, Bordetella pertussis
ggcaggcgccgc

SEQ ID NO: 359749 - RNA, 13 nt, Bordetella pertussis
ggcaggcgccgcc

SEQ ID NO: 359750 - RNA, 15 nt, Bordetella pertussis
ggcaggcgccgccgc

SEQ ID NO: 359751 - RNA, 16 nt, Bordetella pertussis
ggcaggcgccggcugg

SEQ ID NO: 359752 - RNA, 15 nt, Bordetella pertussis
ggcaggcgcgccagc

SEQ ID NO: 359753 - RNA, 13 nt, Bordetella pertussis
ggcaggcgcgccg

SEQ ID NO: 359754 - RNA, 16 nt, Bordetella pertussis
ggcaggcggcagaagg

SEQ ID NO: 359755 - RNA, 13 nt, Bordetella pertussis
ggcaggcgggcca

SEQ ID NO: 359756 - RNA, 16 nt, Bordetella pertussis
ggcaggcgggcccgca

SEQ ID NO: 359757 - RNA, 22 nt, Bordetella pertussis
ggcaggcgggcccgcaucgcgc

SEQ ID NO: 359758 - RNA, 16 nt, Bordetella pertussis
ggcaggucggccagcg

SEQ ID NO: 359759 - RNA, 18 nt, Bordetella pertussis
ggcaggucggccagcgug

SEQ ID NO: 359760 - RNA, 22 nt, Bordetella pertussis
ggcaggucgucgagccgggcca

SEQ ID NO: 359761 - RNA, 14 nt, Bordetella pertussis
ggcaggucggugca

SEQ ID NO: 359762 - RNA, 16 nt, Bordetella pertussis
ggcaggugccccacgc

SEQ ID NO: 359763 - RNA, 15 nt, Bordetella pertussis
ggcaggugcuuggcg

SEQ ID NO: 359764 - RNA, 21 nt, Bordetella pertussis
ggcaggugcuuggcggucugg

SEQ ID NO: 359765 - RNA, 16 nt, Bordetella pertussis
ggcaguucgcccggcu

SEQ ID NO: 359766 - RNA, 18 nt, Bordetella pertussis
ggcaguugcuggcggccg

SEQ ID NO: 359767 - RNA, 18 nt, Bordetella pertussis
ggcaguuggcggcgcagc

SEQ ID NO: 359768 - RNA, 19 nt, Bordetella pertussis
ggcauacauccucgaugcc

SEQ ID NO: 359769 - RNA, 23 nt, Bordetella pertussis
ggcauacaggcuguggccgcggc

SEQ ID NO: 359770 - RNA, 18 nt, Bordetella pertussis
ggcauagcccaggccgcc

SEQ ID NO: 359771 - RNA, 17 nt, Bordetella pertussis
ggcaucuugccuuggcg

SEQ ID NO: 359772 - RNA, 20 nt, Bordetella pertussis
ggcaucuugccuuggcgaau

SEQ ID NO: 359773 - RNA, 13 nt, Bordetella pertussis
ggcaucugccagu

SEQ ID NO: 359774 - RNA, 22 nt, Bordetella pertussis
ggcaugaccgcggacgccaugg

SEQ ID NO: 359775 - RNA, 14 nt, Bordetella pertussis
ggcaugacgaccgc

SEQ ID NO: 359776 - RNA, 12 nt, Bordetella pertussis
ggcauggccaau

SEQ ID NO: 359777 - RNA, 17 nt, Bordetella pertussis
ggcauggccaucgcggu

SEQ ID NO: 359778 - RNA, 20 nt, Bordetella pertussis
ggcauggcccggcucgccga

SEQ ID NO: 359779 - RNA, 19 nt, Bordetella pertussis
ggcauggcgccgcgccgcc

SEQ ID NO: 359780 - RNA, 16 nt, Bordetella pertussis
ggcauggcgccgcgcg

SEQ ID NO: 359781 - RNA, 17 nt, Bordetella pertussis
ggcauggcgcgcgcggu

SEQ ID NO: 359782 - RNA, 14 nt, Bordetella pertussis
ggcaugggcggccc

SEQ ID NO: 359783 - RNA, 23 nt, Bordetella pertussis
ggcauggguaaagcgccggcccg

SEQ ID NO: 359784 - RNA, 20 nt, Bordetella pertussis
ggcauucgaacaacagcgcc

SEQ ID NO: 359785 - RNA, 14 nt, Bordetella pertussis
ggcauugacgccca

SEQ ID NO: 359786 - RNA, 12 nt, Bordetella pertussis
ggcauugagggc

SEQ ID NO: 359787 - RNA, 14 nt, Bordetella pertussis
ggcauugcccaggu

SEQ ID NO: 359788 - RNA, 15 nt, Bordetella pertussis
ggcauugcgccagcc

SEQ ID NO: 359789 - RNA, 13 nt, Bordetella pertussis
ggcauuggcggcg

SEQ ID NO: 359790 - RNA, 21 nt, Bordetella pertussis
ggcauugggcagcggacggua

SEQ ID NO: 359791 - RNA, 20 nt, Bordetella pertussis
ggccaacagcucgcgccagg

SEQ ID NO: 359792 - RNA, 18 nt, Bordetella pertussis
ggccaaccacgagcugca

SEQ ID NO: 359793 - RNA, 16 nt, Bordetella pertussis
ggccaaccccgagggc

SEQ ID NO: 359794 - RNA, 18 nt, Bordetella pertussis
ggccaaccccgagggcgc

SEQ ID NO: 359795 - RNA, 14 nt, Bordetella pertussis
ggccaacgccacgc

SEQ ID NO: 359796 - RNA, 21 nt, Bordetella pertussis
ggccaacgggauccggcagca

SEQ ID NO: 359797 - RNA, 14 nt, Bordetella pertussis
ggccaagcagcgcc

SEQ ID NO: 359798 - RNA, 17 nt, Bordetella pertussis
ggccaagcagcgccugc

SEQ ID NO: 359799 - RNA, 18 nt, Bordetella pertussis
ggccaagcagcgccugcc

SEQ ID NO: 359800 - RNA, 16 nt, Bordetella pertussis
ggccaaggcauuggcg

SEQ ID NO: 359801 - RNA, 13 nt, Bordetella pertussis
ggccaagggcgcc

SEQ ID NO: 359802 - RNA, 19 nt, Bordetella pertussis
ggccaagggcgccgcgccg

SEQ ID NO: 359803 - RNA, 22 nt, Bordetella pertussis
ggccaaggugccuguccccgcg

SEQ ID NO: 359804 - RNA, 14 nt, Bordetella pertussis
ggccaaucggccug

SEQ ID NO: 359805 - RNA, 14 nt, Bordetella pertussis
ggccaaugaccgac

SEQ ID NO: 359806 - RNA, 18 nt, Bordetella pertussis
ggccaaugaccgacgccg

SEQ ID NO: 359807 - RNA, 15 nt, Bordetella pertussis
ggccaauggccgcgg

SEQ ID NO: 359808 - RNA, 19 nt, Bordetella pertussis
ggccaauggccgcggcgug

SEQ ID NO: 359809 - RNA, 18 nt, Bordetella pertussis
ggccacagggcgaaggcc

SEQ ID NO: 359810 - RNA, 21 nt, Bordetella pertussis
ggccacagggcgaaggccagc

SEQ ID NO: 359811 - RNA, 22 nt, Bordetella pertussis
ggccacagggcgaaggccagcg

SEQ ID NO: 359812 - RNA, 23 nt, Bordetella pertussis
ggccacaucaucgaccaccagcg

SEQ ID NO: 359813 - RNA, 18 nt, Bordetella pertussis
ggccaccccguugcagcc

SEQ ID NO: 359814 - RNA, 21 nt, Bordetella pertussis
ggccacccgaagguggcccga

SEQ ID NO: 359815 - RNA, 13 nt, Bordetella pertussis
ggccacccgccgc

SEQ ID NO: 359816 - RNA, 16 nt, Bordetella pertussis
ggccacccgccgccgg

SEQ ID NO: 359817 - RNA, 22 nt, Bordetella pertussis
ggccacccgccguaccgggcgg

SEQ ID NO: 359818 - RNA, 15 nt, Bordetella pertussis
ggccacccggcccau

SEQ ID NO: 359819 - RNA, 16 nt, Bordetella pertussis
ggccaccgucgccacc

SEQ ID NO: 359820 - RNA, 18 nt, Bordetella pertussis
ggccaccuggucgucggc

SEQ ID NO: 359821 - RNA, 13 nt, Bordetella pertussis
ggccaccuuggug

SEQ ID NO: 359822 - RNA, 22 nt, Bordetella pertussis
ggccacgaagcgcagcaccgcg

SEQ ID NO: 359823 - RNA, 13 nt, Bordetella pertussis
ggccacgccggcc

SEQ ID NO: 359824 - RNA, 11 nt, Bordetella pertussis
ggccacgcgca

SEQ ID NO: 359825 - RNA, 15 nt, Bordetella pertussis
ggccacgcgcaacgc

SEQ ID NO: 359826 - RNA, 17 nt, Bordetella pertussis
ggccacgcgcaacgccg

SEQ ID NO: 359827 - RNA, 14 nt, Bordetella pertussis
ggccacgcgccgcc

SEQ ID NO: 359828 - RNA, 15 nt, Bordetella pertussis
ggccacgcgcgggcu

SEQ ID NO: 359829 - RNA, 17 nt, Bordetella pertussis
ggccacgcgcgggcugg

SEQ ID NO: 359830 - RNA, 20 nt, Bordetella pertussis
ggccacgcgcugcagcagca

SEQ ID NO: 359831 - RNA, 19 nt, Bordetella pertussis
ggccacgcgcuugcgcgcc

SEQ ID NO: 359832 - RNA, 21 nt, Bordetella pertussis
ggccacgcgcuugcgcgccac

SEQ ID NO: 359833 - RNA, 13 nt, Bordetella pertussis
ggccacgcgggcg

SEQ ID NO: 359834 - RNA, 16 nt, Bordetella pertussis
ggccacgcucacgccc

SEQ ID NO: 359835 - RNA, 19 nt, Bordetella pertussis
ggccacggcaaugucgcag

SEQ ID NO: 359836 - RNA, 14 nt, Bordetella pertussis
ggccacggccgcga

SEQ ID NO: 359837 - RNA, 12 nt, Bordetella pertussis
ggccacggccgg

SEQ ID NO: 359838 - RNA, 14 nt, Bordetella pertussis
ggccacggccggca

SEQ ID NO: 359839 - RNA, 12 nt, Bordetella pertussis
ggccacggccug

SEQ ID NO: 359840 - RNA, 13 nt, Bordetella pertussis
ggccacggccugc

SEQ ID NO: 359841 - RNA, 14 nt, Bordetella pertussis
ggccacggccugcc

SEQ ID NO: 359842 - RNA, 16 nt, Bordetella pertussis
ggccacggccugcccg

SEQ ID NO: 359843 - RNA, 12 nt, Bordetella pertussis
ggccacggcugg

SEQ ID NO: 359844 - RNA, 13 nt, Bordetella pertussis
ggccacggcugga

SEQ ID NO: 359845 - RNA, 14 nt, Bordetella pertussis
ggccacggcuggaa

SEQ ID NO: 359846 - RNA, 16 nt, Bordetella pertussis
ggccacuuucgcgcgc

SEQ ID NO: 359847 - RNA, 17 nt, Bordetella pertussis
ggccagacauugucaag

SEQ ID NO: 359848 - RNA, 19 nt, Bordetella pertussis
ggccagacauugucaagca

SEQ ID NO: 359849 - RNA, 23 nt, Bordetella pertussis
ggccagacauugucaagcagcgc

SEQ ID NO: 359850 - RNA, 18 nt, Bordetella pertussis
ggccagaccgcgcgcacc

SEQ ID NO: 359851 - RNA, 19 nt, Bordetella pertussis
ggccagaccuugcgcgacg

SEQ ID NO: 359852 - RNA, 20 nt, Bordetella pertussis
ggccagaccuugcgcgacgg

SEQ ID NO: 359853 - RNA, 13 nt, Bordetella pertussis
ggccagcaagcgc

SEQ ID NO: 359854 - RNA, 15 nt, Bordetella pertussis
ggccagcaagcgcgc

SEQ ID NO: 359855 - RNA, 18 nt, Bordetella pertussis
ggccagcaagcgcgccau

SEQ ID NO: 359856 - RNA, 20 nt, Bordetella pertussis
ggccagcaagcgcgccauga

SEQ ID NO: 359857 - RNA, 21 nt, Bordetella pertussis
ggccagcaagcgcucggccac

SEQ ID NO: 359858 - RNA, 19 nt, Bordetella pertussis
ggccagaucgaacacgagc

SEQ ID NO: 359859 - RNA, 22 nt, Bordetella pertussis
ggccagcagcgacggccccagc

SEQ ID NO: 359860 - RNA, 19 nt, Bordetella pertussis
ggccagcagcgcaucgcgc

SEQ ID NO: 359861 - RNA, 13 nt, Bordetella pertussis
ggccagcagcgcc

SEQ ID NO: 359862 - RNA, 17 nt, Bordetella pertussis
ggccagcagcgccgcca

SEQ ID NO: 359863 - RNA, 19 nt, Bordetella pertussis
ggccagcagcgccgccagc

SEQ ID NO: 359864 - RNA, 16 nt, Bordetella pertussis
ggccagcagcgccugg

SEQ ID NO: 359865 - RNA, 23 nt, Bordetella pertussis
ggccagcagcgcgugcagccagc

SEQ ID NO: 359866 - RNA, 14 nt, Bordetella pertussis
ggccagcagcucgg

SEQ ID NO: 359867 - RNA, 23 nt, Bordetella pertussis
ggccagcagcucggccaccgccg

SEQ ID NO: 359868 - RNA, 19 nt, Bordetella pertussis
ggccagcaggagcccgcug

SEQ ID NO: 359869 - RNA, 22 nt, Bordetella pertussis
ggccagcaggagcccgcugccg

SEQ ID NO: 359870 - RNA, 21 nt, Bordetella pertussis
ggccagcaggcucagcgggcu

SEQ ID NO: 359871 - RNA, 20 nt, Bordetella pertussis
ggccagccccaccuugccca

SEQ ID NO: 359872 - RNA, 22 nt, Bordetella pertussis
ggccagccccaccuugcccagc

SEQ ID NO: 359873 - RNA, 16 nt, Bordetella pertussis
ggccagccccggcgcg

SEQ ID NO: 359874 - RNA, 19 nt, Bordetella pertussis
ggccagccccggcgcgccg

SEQ ID NO: 359875 - RNA, 21 nt, Bordetella pertussis
ggccagccccggcgcgccggc

SEQ ID NO: 359876 - RNA, 14 nt, Bordetella pertussis
ggccagcccgcgcg

SEQ ID NO: 359877 - RNA, 17 nt, Bordetella pertussis
ggccagcccgcgcgcgu

SEQ ID NO: 359878 - RNA, 17 nt, Bordetella pertussis
ggccagccgcucgcgcg

SEQ ID NO: 359879 - RNA, 20 nt, Bordetella pertussis
ggccagccgcucgcgcgacc

SEQ ID NO: 359880 - RNA, 18 nt, Bordetella pertussis
ggccagcgccgccagccg

SEQ ID NO: 359881 - RNA, 13 nt, Bordetella pertussis
ggccagcgccgcg

SEQ ID NO: 359882 - RNA, 14 nt, Bordetella pertussis
ggccagcgccgcga

SEQ ID NO: 359883 - RNA, 16 nt, Bordetella pertussis
ggccagcgccgcgccg

SEQ ID NO: 359884 - RNA, 15 nt, Bordetella pertussis
ggccagcgccgcggc

SEQ ID NO: 359885 - RNA, 14 nt, Bordetella pertussis
ggccagcgccggcg

SEQ ID NO: 359886 - RNA, 11 nt, Bordetella pertussis
ggccagcgcga

SEQ ID NO: 359887 - RNA, 13 nt, Bordetella pertussis
ggccagcgcgacg

SEQ ID NO: 359888 - RNA, 14 nt, Bordetella pertussis
ggccagcgcgacgg

SEQ ID NO: 359889 - RNA, 20 nt, Bordetella pertussis
ggccagcgcgaucucgcgca

SEQ ID NO: 359890 - RNA, 16 nt, Bordetella pertussis
ggccagcgcgcaggug

SEQ ID NO: 359891 - RNA, 13 nt, Bordetella pertussis
ggccagcgcgccg

SEQ ID NO: 359892 - RNA, 18 nt, Bordetella pertussis
ggccagcgcgccgccagc

SEQ ID NO: 359893 - RNA, 19 nt, Bordetella pertussis
ggccagcgcgccggccagg

SEQ ID NO: 359894 - RNA, 16 nt, Bordetella pertussis
ggccagcgcgcgccag

SEQ ID NO: 359895 - RNA, 17 nt, Bordetella pertussis
ggccagcgcgcgccagu

SEQ ID NO: 359896 - RNA, 19 nt, Bordetella pertussis
ggccagcgcgcggccggcc

SEQ ID NO: 359897 - RNA, 23 nt, Bordetella pertussis
ggccagcgcgcggccggccgcgc

SEQ ID NO: 359898 - RNA, 16 nt, Bordetella pertussis
ggccagcgcgcgggcg

SEQ ID NO: 359899 - RNA, 20 nt, Bordetella pertussis
ggccagcgcgcggggcaggc

SEQ ID NO: 359900 - RNA, 14 nt, Bordetella pertussis
ggccagcgcgcgug

SEQ ID NO: 359901 - RNA, 17 nt, Bordetella pertussis
ggccagcgcgcgugcgu

SEQ ID NO: 359902 - RNA, 13 nt, Bordetella pertussis
ggccagcgcggca

SEQ ID NO: 359903 - RNA, 16 nt, Bordetella pertussis
ggccagcgcggccagg

SEQ ID NO: 359904 - RNA, 17 nt, Bordetella pertussis
ggccagcggggccguga

SEQ ID NO: 359905 - RNA, 19 nt, Bordetella pertussis
ggccagcggggccgugacg

SEQ ID NO: 359906 - RNA, 19 nt, Bordetella pertussis
ggccagcgguacgccgaac

SEQ ID NO: 359907 - RNA, 13 nt, Bordetella pertussis
ggccagcgugccc

SEQ ID NO: 359908 - RNA, 17 nt, Bordetella pertussis
ggccagcguggggacgc

SEQ ID NO: 359909 - RNA, 23 nt, Bordetella pertussis
ggccagcguggggacgcgggcca

SEQ ID NO: 359910 - RNA, 15 nt, Bordetella pertussis
ggccagcuccaccgg

SEQ ID NO: 359911 - RNA, 18 nt, Bordetella pertussis
ggccagcuccccgggcgu

SEQ ID NO: 359912 - RNA, 15 nt, Bordetella pertussis
ggccaggaagcggcg

SEQ ID NO: 359913 - RNA, 16 nt, Bordetella pertussis
ggccaggaagcggcgc

SEQ ID NO: 359914 - RNA, 19 nt, Bordetella pertussis
ggccaggaagcggcgcacc

SEQ ID NO: 359915 - RNA, 22 nt, Bordetella pertussis
ggccaggaagcggcgcaccagc

SEQ ID NO: 359916 - RNA, 23 nt, Bordetella pertussis
ggccaggaagcggcgcaccagcg

SEQ ID NO: 359917 - RNA, 23 nt, Bordetella pertussis
ggccaggaccgaggugccagccu

SEQ ID NO: 359918 - RNA, 22 nt, Bordetella pertussis
ggccaggaucgcggccagccgg

SEQ ID NO: 359919 - RNA, 13 nt, Bordetella pertussis
ggccaggcaaucg

SEQ ID NO: 359920 - RNA, 20 nt, Bordetella pertussis
ggccaggaugagggcgauca

SEQ ID NO: 359921 - RNA, 16 nt, Bordetella pertussis
ggccaggccauggcgc

SEQ ID NO: 359922 - RNA, 12 nt, Bordetella pertussis
ggccaggcccau

SEQ ID NO: 359923 - RNA, 19 nt, Bordetella pertussis
ggccaggcccucgcggccg

SEQ ID NO: 359924 - RNA, 13 nt, Bordetella pertussis
ggccaggccgaac

SEQ ID NO: 359925 - RNA, 12 nt, Bordetella pertussis
ggccaggccgau

SEQ ID NO: 359926 - RNA, 16 nt, Bordetella pertussis
ggccaggccgccgccg

SEQ ID NO: 359927 - RNA, 12 nt, Bordetella pertussis
ggccaggccggc

SEQ ID NO: 359928 - RNA, 13 nt, Bordetella pertussis
ggccaggccggcc

SEQ ID NO: 359929 - RNA, 14 nt, Bordetella pertussis
ggccaggccggccc

SEQ ID NO: 359930 - RNA, 14 nt, Bordetella pertussis
ggccaggccggccu

SEQ ID NO: 359931 - RNA, 15 nt, Bordetella pertussis
ggccaggccggccug

SEQ ID NO: 359932 - RNA, 18 nt, Bordetella pertussis
ggccaggccggccugcag

SEQ ID NO: 359933 - RNA, 19 nt, Bordetella pertussis
ggccaggccggccuuggcc

SEQ ID NO: 359934 - RNA, 15 nt, Bordetella pertussis
ggccaggccggcgcg

SEQ ID NO: 359935 - RNA, 16 nt, Bordetella pertussis
ggccaggccggggccg

SEQ ID NO: 359936 - RNA, 13 nt, Bordetella pertussis
ggccaggcgccag

SEQ ID NO: 359937 - RNA, 14 nt, Bordetella pertussis
ggccaggcgccaga

SEQ ID NO: 359938 - RNA, 20 nt, Bordetella pertussis
ggccaggcgccagaugcgcc

SEQ ID NO: 359939 - RNA, 13 nt, Bordetella pertussis
ggccaggcgccgc

SEQ ID NO: 359940 - RNA, 14 nt, Bordetella pertussis
ggccaggcgccggc

SEQ ID NO: 359941 - RNA, 15 nt, Bordetella pertussis
ggccaggcgcgccgc

SEQ ID NO: 359942 - RNA, 18 nt, Bordetella pertussis
ggccaggcgcgugcgcag

SEQ ID NO: 359943 - RNA, 19 nt, Bordetella pertussis
ggccaggcgcgugcgcagg

SEQ ID NO: 359944 - RNA, 20 nt, Bordetella pertussis
ggccaggcgcgugcgcaggc

SEQ ID NO: 359945 - RNA, 21 nt, Bordetella pertussis
ggccaggcgcuccagcaccug

SEQ ID NO: 359946 - RNA, 15 nt, Bordetella pertussis
ggccaggcucagcag

SEQ ID NO: 359947 - RNA, 16 nt, Bordetella pertussis
ggccaggcucagcagg

SEQ ID NO: 359948 - RNA, 17 nt, Bordetella pertussis
ggccaggcugaccagcg

SEQ ID NO: 359949 - RNA, 18 nt, Bordetella pertussis
ggcccaugaaggcggcca

SEQ ID NO: 359950 - RNA, 21 nt, Bordetella pertussis
ggcccaugaaggcggccagca

SEQ ID NO: 359951 - RNA, 17 nt, Bordetella pertussis
ggcccaugaccggcgug

SEQ ID NO: 359952 - RNA, 19 nt, Bordetella pertussis
ggcccaugacgaccuugcg

SEQ ID NO: 359953 - RNA, 22 nt, Bordetella pertussis
ggcccaugacgaccuugcggcc

SEQ ID NO: 359954 - RNA, 21 nt, Bordetella pertussis
ggcccaucuguacggccggcu

SEQ ID NO: 359955 - RNA, 18 nt, Bordetella pertussis
ggcccaugccgcccgcca

SEQ ID NO: 359956 - RNA, 17 nt, Bordetella pertussis
ggcccaugccgcggacc

SEQ ID NO: 359957 - RNA, 12 nt, Bordetella pertussis
ggccccagcauc

SEQ ID NO: 359958 - RNA, 13 nt, Bordetella pertussis
ggccccagcgccg

SEQ ID NO: 359959 - RNA, 15 nt, Bordetella pertussis
ggccccagcgccgcg

SEQ ID NO: 359960 - RNA, 17 nt, Bordetella pertussis
ggccccaugcgcggcac

SEQ ID NO: 359961 - RNA, 15 nt, Bordetella pertussis
ggccccccggcgcgg

SEQ ID NO: 359962 - RNA, 17 nt, Bordetella pertussis
ggccccccggcgcggcc

SEQ ID NO: 359963 - RNA, 15 nt, Bordetella pertussis
ggccccgcaaggggc

SEQ ID NO: 359964 - RNA, 22 nt, Bordetella pertussis
ggccccgcaaggggccggcgcc

SEQ ID NO: 359965 - RNA, 18 nt, Bordetella pertussis
ggccccgcagggcccgca

SEQ ID NO: 359966 - RNA, 16 nt, Bordetella pertussis
ggccccgccgggccgc

SEQ ID NO: 359967 - RNA, 15 nt, Bordetella pertussis
ggccccgcgucggcg

SEQ ID NO: 359968 - RNA, 13 nt, Bordetella pertussis
ggcccgauacaug

SEQ ID NO: 359969 - RNA, 16 nt, Bordetella pertussis
ggcccgaucgccggug

SEQ ID NO: 359970 - RNA, 20 nt, Bordetella pertussis
ggcccgauggcggggaugga

SEQ ID NO: 359971 - RNA, 12 nt, Bordetella pertussis
ggcccgcaccgg

SEQ ID NO: 359972 - RNA, 20 nt, Bordetella pertussis
ggcccgcaccgggcggcccg

SEQ ID NO: 359973 - RNA, 23 nt, Bordetella pertussis
ggcccgcaccgggcggcccggcg

SEQ ID NO: 359974 - RNA, 20 nt, Bordetella pertussis
ggcccgcagguggggcagca

SEQ ID NO: 359975 - RNA, 18 nt, Bordetella pertussis
ggcccgcaucgcgcgccg

SEQ ID NO: 359976 - RNA, 19 nt, Bordetella pertussis
ggcccgccaccacggcgcg

SEQ ID NO: 359977 - RNA, 17 nt, Bordetella pertussis
ggcccgccacgcgggcc

SEQ ID NO: 359978 - RNA, 22 nt, Bordetella pertussis
ggcccgccacgcgggccggccg

SEQ ID NO: 359979 - RNA, 23 nt, Bordetella pertussis
ggcccgccauugcacgcgcagga

SEQ ID NO: 359980 - RNA, 22 nt, Bordetella pertussis
ggcccgcccgcccugggcagca

SEQ ID NO: 359981 - RNA, 22 nt, Bordetella pertussis
ggcccgccgacugggcuugccg

SEQ ID NO: 359982 - RNA, 13 nt, Bordetella pertussis
ggcccgcgccagc

SEQ ID NO: 359983 - RNA, 14 nt, Bordetella pertussis
ggcccgcgccagcg

SEQ ID NO: 359984 - RNA, 16 nt, Bordetella pertussis
ggcccgcgccagcgcc

SEQ ID NO: 359985 - RNA, 20 nt, Bordetella pertussis
ggcccgcgccgacggcggcg

SEQ ID NO: 359986 - RNA, 20 nt, Bordetella pertussis
ggcccgcgcgagcggcgugc

SEQ ID NO: 359987 - RNA, 13 nt, Bordetella pertussis
ggcccgcgcggcc

SEQ ID NO: 359988 - RNA, 14 nt, Bordetella pertussis
ggcccgcgcggcca

SEQ ID NO: 359989 - RNA, 15 nt, Bordetella pertussis
ggcccgcggccgcgu

SEQ ID NO: 359990 - RNA, 14 nt, Bordetella pertussis
ggcccgcggccuug

SEQ ID NO: 359991 - RNA, 13 nt, Bordetella pertussis
ggcccgcggcgcc

SEQ ID NO: 359992 - RNA, 14 nt, Bordetella pertussis
ggcccgcggcgcca

SEQ ID NO: 359993 - RNA, 15 nt, Bordetella pertussis
ggcccgcggcgccag

SEQ ID NO: 359994 - RNA, 14 nt, Bordetella pertussis
ggcccgcgggcgcc

SEQ ID NO: 359995 - RNA, 15 nt, Bordetella pertussis
ggcccgcgggcgccc

SEQ ID NO: 359996 - RNA, 21 nt, Bordetella pertussis
ggcccgcgggcgcccggccgg

SEQ ID NO: 359997 - RNA, 16 nt, Bordetella pertussis
ggcccgcgucuuggcg

SEQ ID NO: 359998 - RNA, 13 nt, Bordetella pertussis
ggcccgcgugacg

SEQ ID NO: 359999 - RNA, 20 nt, Bordetella pertussis
ggcccgcgugacggccgcca

SEQ ID NO: 360000 - RNA, 15 nt, Bordetella pertussis
ggcccgcuccaggcg

SEQ ID NO: 360001 - RNA, 16 nt, Bordetella pertussis
ggcccgcuccaggcgg

SEQ ID NO: 360002 - RNA, 19 nt, Bordetella pertussis
ggcccgcuccaggcggcca

SEQ ID NO: 360003 - RNA, 21 nt, Bordetella pertussis
ggcccgcuccaggcggccagu

SEQ ID NO: 360004 - RNA, 14 nt, Bordetella pertussis
ggcccgcucggcca

SEQ ID NO: 360005 - RNA, 15 nt, Bordetella pertussis
ggcccgcucggccag

SEQ ID NO: 360006 - RNA, 16 nt, Bordetella pertussis
ggcccgcucggccagc

SEQ ID NO: 360007 - RNA, 17 nt, Bordetella pertussis
ggcccgcucggccagca

SEQ ID NO: 360008 - RNA, 19 nt, Bordetella pertussis
ggcccggaauaccgccagc

SEQ ID NO: 360009 - RNA, 19 nt, Bordetella pertussis
ggcccggacgcggccggca

SEQ ID NO: 360010 - RNA, 19 nt, Bordetella pertussis
ggcccggccgccgccggca

SEQ ID NO: 360011 - RNA, 23 nt, Bordetella pertussis
ggcccggccugcgugucaggcgg

SEQ ID NO: 360012 - RNA, 17 nt, Bordetella pertussis
ggcccggcgggccggcu

SEQ ID NO: 360013 - RNA, 21 nt, Bordetella pertussis
ggcccggcguagcugcgccgc

SEQ ID NO: 360014 - RNA, 17 nt, Bordetella pertussis
ggcccggcucgccgagc

SEQ ID NO: 360015 - RNA, 24 nt, Bordetella pertussis
ggcccggcucgccgagccgggcca

SEQ ID NO: 360016 - RNA, 13 nt, Bordetella pertussis
ggcccgggcaggc

SEQ ID NO: 360017 - RNA, 14 nt, Bordetella pertussis
ggcccgggcaggcu

SEQ ID NO: 360018 - RNA, 16 nt, Bordetella pertussis
ggcccgggcaggcuca

SEQ ID NO: 360019 - RNA, 19 nt, Bordetella pertussis
ggcccgggcgagauggcgu

SEQ ID NO: 360020 - RNA, 12 nt, Bordetella pertussis
ggcccgggcgcc

SEQ ID NO: 360021 - RNA, 14 nt, Bordetella pertussis
ggcccgggcgcgcu

SEQ ID NO: 360022 - RNA, 20 nt, Bordetella pertussis
ggcccgguaggccacgcgcg

SEQ ID NO: 360023 - RNA, 24 nt, Bordetella pertussis
ggcccgguauuccucgacgauggc

SEQ ID NO: 360024 - RNA, 19 nt, Bordetella pertussis
ggcccggugcagccgccgc

SEQ ID NO: 360025 - RNA, 23 nt, Bordetella pertussis
ggcccgguuggggucgcgcuggg

SEQ ID NO: 360026 - RNA, 15 nt, Bordetella pertussis
ggcccgucgcgccag

SEQ ID NO: 360027 - RNA, 20 nt, Bordetella pertussis
ggcccgucgcgccaggccgg

SEQ ID NO: 360028 - RNA, 21 nt, Bordetella pertussis
ggcccgucgcgccaggccggc

SEQ ID NO: 360029 - RNA, 19 nt, Bordetella pertussis
ggcccgugcgcaacgcgcg

SEQ ID NO: 360030 - RNA, 16 nt, Bordetella pertussis
ggcccguguagacggc

SEQ ID NO: 360031 - RNA, 18 nt, Bordetella pertussis
ggcccuagagcaugcggc

SEQ ID NO: 360032 - RNA, 20 nt, Bordetella pertussis
ggcccuagagcaugcggcgu

SEQ ID NO: 360033 - RNA, 14 nt, Bordetella pertussis
ggcccuccggcgcc

SEQ ID NO: 360034 - RNA, 14 nt, Bordetella pertussis
ggcccucgcggccg

SEQ ID NO: 360035 - RNA, 21 nt, Bordetella pertussis
ggcccucgcggccgucggcgc

SEQ ID NO: 360036 - RNA, 23 nt, Bordetella pertussis
ggcccucggugcggaagacgaug

SEQ ID NO: 360037 - RNA, 22 nt, Bordetella pertussis
ggcccugccgcccuggcgcagg

SEQ ID NO: 360038 - RNA, 18 nt, Bordetella pertussis
ggcccugcgcguugagca

SEQ ID NO: 360039 - RNA, 16 nt, Bordetella pertussis
ggcccuggcggcgcag

SEQ ID NO: 360040 - RNA, 17 nt, Bordetella pertussis
ggcccuggcgggccgga

SEQ ID NO: 360041 - RNA, 14 nt, Bordetella pertussis
ggcccuggcguucg

SEQ ID NO: 360042 - RNA, 14 nt, Bordetella pertussis
ggcccugggccagc

SEQ ID NO: 360043 - RNA, 16 nt, Bordetella pertussis
ggcccugggccagcag

SEQ ID NO: 360044 - RNA, 17 nt, Bordetella pertussis
ggcccugggccagccag

SEQ ID NO: 360045 - RNA, 19 nt, Bordetella pertussis
ggcccugggccagccagcg

SEQ ID NO: 360046 - RNA, 22 nt, Bordetella pertussis
ggcccugggcgagguagggcgc

SEQ ID NO: 360047 - RNA, 16 nt, Bordetella pertussis
ggcccuggggccgcgg

SEQ ID NO: 360048 - RNA, 23 nt, Bordetella pertussis
ggcccuguaugccguaggcgccg

SEQ ID NO: 360049 - RNA, 20 nt, Bordetella pertussis
ggcccuguucgcgcggcccg

SEQ ID NO: 360050 - RNA, 20 nt, Bordetella pertussis
ggcccuugauggccgggccg

SEQ ID NO: 360051 - RNA, 22 nt, Bordetella pertussis
ggcccuugcgcgaaggccgccc

SEQ ID NO: 360052 - RNA, 15 nt, Bordetella pertussis
ggccgaaaccgccgc

SEQ ID NO: 360053 - RNA, 16 nt, Bordetella pertussis
ggccgaaaccgccgcg

SEQ ID NO: 360054 - RNA, 23 nt, Bordetella pertussis
ggccgaaaccgccgcggcuugcc

SEQ ID NO: 360055 - RNA, 16 nt, Bordetella pertussis
ggccgaaccgcgcagc

SEQ ID NO: 360056 - RNA, 17 nt, Bordetella pertussis
ggccgaacugggacagg

SEQ ID NO: 360057 - RNA, 18 nt, Bordetella pertussis
ggccgaacugggacaggc

SEQ ID NO: 360058 - RNA, 21 nt, Bordetella pertussis
ggccgaacuucagcccgggca

SEQ ID NO: 360059 - RNA, 20 nt, Bordetella pertussis
ggccgaagaucuccucgcgc

SEQ ID NO: 360060 - RNA, 23 nt, Bordetella pertussis
ggccgaagccaccgucucgccca

SEQ ID NO: 360061 - RNA, 19 nt, Bordetella pertussis
ggccgaaucguucacgccc

SEQ ID NO: 360062 - RNA, 22 nt, Bordetella pertussis
ggccgaaucguucacgcccgag

SEQ ID NO: 360063 - RNA, 17 nt, Bordetella pertussis
ggccgaauugccgccgc

SEQ ID NO: 360064 - RNA, 15 nt, Bordetella pertussis
ggccgacagcgucga

SEQ ID NO: 360065 - RNA, 22 nt, Bordetella pertussis
ggccgacagcuugcgcuggcgc

SEQ ID NO: 360066 - RNA, 23 nt, Bordetella pertussis
ggccgaccacuggaagcugcggc

SEQ ID NO: 360067 - RNA, 14 nt, Bordetella pertussis
ggccgaccagcacg

SEQ ID NO: 360068 - RNA, 12 nt, Bordetella pertussis
ggccgaccagcg

SEQ ID NO: 360069 - RNA, 15 nt, Bordetella pertussis
ggccgaccaggccgg

SEQ ID NO: 360070 - RNA, 17 nt, Bordetella pertussis
ggccgaccaggccggcg

SEQ ID NO: 360071 - RNA, 22 nt, Bordetella pertussis
ggccgacccgcggcccuugcgc

SEQ ID NO: 360072 - RNA, 14 nt, Bordetella pertussis
ggccgaccggcgcg

SEQ ID NO: 360073 - RNA, 22 nt, Bordetella pertussis
ggccgacgcgcugguccgccgc

SEQ ID NO: 360074 - RNA, 14 nt, Bordetella pertussis
ggccgacgcgcugu

SEQ ID NO: 360075 - RNA, 14 nt, Bordetella pertussis
ggccgacgcgcccg

SEQ ID NO: 360076 - RNA, 18 nt, Bordetella pertussis
ggccgacggcaagaucgc

SEQ ID NO: 360077 - RNA, 14 nt, Bordetella pertussis
ggccgacggccucg

SEQ ID NO: 360078 - RNA, 22 nt, Bordetella pertussis
ggccgacggguggguggacagg

SEQ ID NO: 360079 - RNA, 21 nt, Bordetella pertussis
ggccgacucgaaacgggcggc

SEQ ID NO: 360080 - RNA, 17 nt, Bordetella pertussis
ggccgagaacgccgucg

SEQ ID NO: 360081 - RNA, 22 nt, Bordetella pertussis
ggccgagaacgccgucggggug

SEQ ID NO: 360082 - RNA, 19 nt, Bordetella pertussis
ggccgagaugccguucuug

SEQ ID NO: 360083 - RNA, 16 nt, Bordetella pertussis
ggccgagcccgcgucg

SEQ ID NO: 360084 - RNA, 20 nt, Bordetella pertussis
ggccgagccgccccggcgcg

SEQ ID NO: 360085 - RNA, 15 nt, Bordetella pertussis
ggccgagcgcgccag

SEQ ID NO: 360086 - RNA, 17 nt, Bordetella pertussis
ggccgagcgcgccagca

SEQ ID NO: 360087 - RNA, 20 nt, Bordetella pertussis
ggccgagcgcgccagcacgg

SEQ ID NO: 360088 - RNA, 13 nt, Bordetella pertussis
ggccgagcgcgga

SEQ ID NO: 360089 - RNA, 14 nt, Bordetella pertussis
ggccgagcgcggca

SEQ ID NO: 360090 - RNA, 16 nt, Bordetella pertussis
ggccgagcgggccagc

SEQ ID NO: 360091 - RNA, 15 nt, Bordetella pertussis
ggccgaggccagcgu

SEQ ID NO: 360092 - RNA, 16 nt, Bordetella pertussis
ggccgaggccagcgug

SEQ ID NO: 360093 - RNA, 13 nt, Bordetella pertussis
ggccgaggccagg

SEQ ID NO: 360094 - RNA, 18 nt, Bordetella pertussis
ggccgagcuccucgagcg

SEQ ID NO: 360095 - RNA, 19 nt, Bordetella pertussis
ggccgaggcugcgcgcgcc

SEQ ID NO: 360096 - RNA, 15 nt, Bordetella pertussis
ggccgaggcgccgcc

SEQ ID NO: 360097 - RNA, 19 nt, Bordetella pertussis
ggccgaggcgccgccgugc

SEQ ID NO: 360098 - RNA, 14 nt, Bordetella pertussis
ggccgaggucggcg

SEQ ID NO: 360099 - RNA, 16 nt, Bordetella pertussis
ggccgaguagcggcgc

SEQ ID NO: 360100 - RNA, 18 nt, Bordetella pertussis
ggccgauacgcgugcgcg

SEQ ID NO: 360101 - RNA, 14 nt, Bordetella pertussis
ggccgauagccgcg

SEQ ID NO: 360102 - RNA, 20 nt, Bordetella pertussis
ggccgauagccgcggcgccg

SEQ ID NO: 360103 - RNA, 21 nt, Bordetella pertussis
ggccgauagccgcggcgccgc

SEQ ID NO: 360104 - RNA, 19 nt, Bordetella pertussis
ggccgauaucguuggugcg

SEQ ID NO: 360105 - RNA, 23 nt, Bordetella pertussis
ggccgauaucguuggugcgcacc

SEQ ID NO: 360106 - RNA, 17 nt, Bordetella pertussis
ggccgaguggccgcugu

SEQ ID NO: 360107 - RNA, 22 nt, Bordetella pertussis
ggccgaucagcaccacggcggc

SEQ ID NO: 360108 - RNA, 12 nt, Bordetella pertussis
ggccgaucagcg

SEQ ID NO: 360109 - RNA, 17 nt, Bordetella pertussis
ggccgaucagcgacagc

SEQ ID NO: 360110 - RNA, 18 nt, Bordetella pertussis
ggccgaucagcggauuga

SEQ ID NO: 360111 - RNA, 22 nt, Bordetella pertussis
ggccgaucccuugugcgcgcca

SEQ ID NO: 360112 - RNA, 23 nt, Bordetella pertussis
ggccgaugaagacgccgucgacc

SEQ ID NO: 360113 - RNA, 19 nt, Bordetella pertussis
ggccgaugaauugcgccac

SEQ ID NO: 360114 - RNA, 16 nt, Bordetella pertussis
ggccgaugacaucgcc

SEQ ID NO: 360115 - RNA, 17 nt, Bordetella pertussis
ggccgaugacaucgccg

SEQ ID NO: 360116 - RNA, 20 nt, Bordetella pertussis
ggccgaugacaucgccgcug

SEQ ID NO: 360117 - RNA, 17 nt, Bordetella pertussis
ggccgauggcaucgccc

SEQ ID NO: 360118 - RNA, 19 nt, Bordetella pertussis
ggccgauggcaucgccccg

SEQ ID NO: 360119 - RNA, 22 nt, Bordetella pertussis
ggccgauggccucgcugccagg

SEQ ID NO: 360120 - RNA, 17 nt, Bordetella pertussis
ggccgauggucagcaug

SEQ ID NO: 360121 - RNA, 16 nt, Bordetella pertussis
ggccgauguagcccau

SEQ ID NO: 360122 - RNA, 23 nt, Bordetella pertussis
ggccgauguagcccauggccagg

SEQ ID NO: 360123 - RNA, 16 nt, Bordetella pertussis
ggccgaugucgccgcc

SEQ ID NO: 360124 - RNA, 19 nt, Bordetella pertussis
ggccgaugucgccgccugc

SEQ ID NO: 360125 - RNA, 17 nt, Bordetella pertussis
ggccgauggcguccagc

SEQ ID NO: 360126 - RNA, 15 nt, Bordetella pertussis
ggccgauucgaccug

SEQ ID NO: 360127 - RNA, 17 nt, Bordetella pertussis
ggccgauucgccguggc

SEQ ID NO: 360128 - RNA, 16 nt, Bordetella pertussis
ggccgauuucgcgcgc

SEQ ID NO: 360129 - RNA, 18 nt, Bordetella pertussis
ggccgauuucgcgcgcca

SEQ ID NO: 360130 - RNA, 20 nt, Bordetella pertussis
ggccgauuucgcgcgccagc

SEQ ID NO: 360131 - RNA, 21 nt, Bordetella pertussis
ggccgauuucgcgcgccagcg

SEQ ID NO: 360132 - RNA, 22 nt, Bordetella pertussis
ggccgauuucggccgccggcga

SEQ ID NO: 360133 - RNA, 20 nt, Bordetella pertussis
ggccgauuccagcgccgccu

SEQ ID NO: 360134 - RNA, 19 nt, Bordetella pertussis
ggccgcaacccacccccag

SEQ ID NO: 360135 - RNA, 18 nt, Bordetella pertussis
ggccgcacgcgcggcagc

SEQ ID NO: 360136 - RNA, 15 nt, Bordetella pertussis
ggccgcacgcggccg

SEQ ID NO: 360137 - RNA, 19 nt, Bordetella pertussis
ggccgcacugggugacgcu

SEQ ID NO: 360138 - RNA, 23 nt, Bordetella pertussis
ggccgcagcauggcgccagcugg

SEQ ID NO: 360139 - RNA, 15 nt, Bordetella pertussis
ggccgcagcggacgu

SEQ ID NO: 360140 - RNA, 13 nt, Bordetella pertussis
ggccgcagccggc

SEQ ID NO: 360141 - RNA, 15 nt, Bordetella pertussis
ggccgcagcgggccc

SEQ ID NO: 360142 - RNA, 12 nt, Bordetella pertussis
ggccgccgcaug

SEQ ID NO: 360143 - RNA, 20 nt, Bordetella pertussis
ggccgccgcaugccgggcug

SEQ ID NO: 360144 - RNA, 13 nt, Bordetella pertussis
ggccgccgccagc

SEQ ID NO: 360145 - RNA, 14 nt, Bordetella pertussis
ggccgccgccagcg

SEQ ID NO: 360146 - RNA, 15 nt, Bordetella pertussis
ggccgccgccagcgc

SEQ ID NO: 360147 - RNA, 17 nt, Bordetella pertussis
ggccgccgccagcgcgc

SEQ ID NO: 360148 - RNA, 19 nt, Bordetella pertussis
ggccgccgccagcgcgccg

SEQ ID NO: 360149 - RNA, 14 nt, Bordetella pertussis
ggccgccgccgguc

SEQ ID NO: 360150 - RNA, 12 nt, Bordetella pertussis
ggccgccgcgcc

SEQ ID NO: 360151 - RNA, 18 nt, Bordetella pertussis
ggccgccgcgcccagcag

SEQ ID NO: 360152 - RNA, 21 nt, Bordetella pertussis
ggccgccgcgcccagcagcgc

SEQ ID NO: 360153 - RNA, 14 nt, Bordetella pertussis
ggccgccgggccgc

SEQ ID NO: 360154 - RNA, 16 nt, Bordetella pertussis
ggccgccgggccgcga

SEQ ID NO: 360155 - RNA, 20 nt, Bordetella pertussis
ggccgccguaaucggcgucg

SEQ ID NO: 360156 - RNA, 21 nt, Bordetella pertussis
ggccgccgugacuucggccgc

SEQ ID NO: 360157 - RNA, 20 nt, Bordetella pertussis
ggccgccuauguaggcgccg

SEQ ID NO: 360158 - RNA, 18 nt, Bordetella pertussis
ggccgccucaccgcgccg

SEQ ID NO: 360159 - RNA, 14 nt, Bordetella pertussis
ggccgccugcgccg

SEQ ID NO: 360160 - RNA, 13 nt, Bordetella pertussis
ggccgccugcugc

SEQ ID NO: 360161 - RNA, 16 nt, Bordetella pertussis
ggccgccugcugcgcc

SEQ ID NO: 360162 - RNA, 17 nt, Bordetella pertussis
ggccgccuggaccugac

SEQ ID NO: 360163 - RNA, 14 nt, Bordetella pertussis
ggccgccuggccca

SEQ ID NO: 360164 - RNA, 22 nt, Bordetella pertussis
ggccgcgaaggcuucgucgacc

SEQ ID NO: 360165 - RNA, 13 nt, Bordetella pertussis
ggccgcgacauag

SEQ ID NO: 360166 - RNA, 22 nt, Bordetella pertussis
ggccgcgacgcuacagcgucau

SEQ ID NO: 360167 - RNA, 14 nt, Bordetella pertussis
ggccgcgcccagcg

SEQ ID NO: 360168 - RNA, 16 nt, Bordetella pertussis
ggccgcgcccagcgcg

SEQ ID NO: 360169 - RNA, 15 nt, Bordetella pertussis
ggccgcgcccagcgu

SEQ ID NO: 360170 - RNA, 16 nt, Bordetella pertussis
ggccgcgcccagcgug

SEQ ID NO: 360171 - RNA, 12 nt, Bordetella pertussis
ggccgcgcccau

SEQ ID NO: 360172 - RNA, 16 nt, Bordetella pertussis
ggccgcgcccaugcgc

SEQ ID NO: 360173 - RNA, 22 nt, Bordetella pertussis
ggccgcgcccaugcgcuggcgc

SEQ ID NO: 360174 - RNA, 20 nt, Bordetella pertussis
ggccgcgccccuagcgccgc

SEQ ID NO: 360175 - RNA, 21 nt, Bordetella pertussis
ggccgcgccccuagcgccgcg

SEQ ID NO: 360176 - RNA, 13 nt, Bordetella pertussis
ggccgcgcccgca

SEQ ID NO: 360177 - RNA, 14 nt, Bordetella pertussis
ggccgcgcccgccg

SEQ ID NO: 360178 - RNA, 20 nt, Bordetella pertussis
ggccgcgcccgccgcgccau

SEQ ID NO: 360179 - RNA, 15 nt, Bordetella pertussis
ggccgcgccgcgccg

SEQ ID NO: 360180 - RNA, 14 nt, Bordetella pertussis
ggccgcgccgcugg

SEQ ID NO: 360181 - RNA, 18 nt, Bordetella pertussis
ggccgcgccgcuggcggc

SEQ ID NO: 360182 - RNA, 14 nt, Bordetella pertussis
ggccgcgccgccgc

SEQ ID NO: 360183 - RNA, 20 nt, Bordetella pertussis
ggccgcggaagucgggcacc

SEQ ID NO: 360184 - RNA, 23 nt, Bordetella pertussis
ggccgcggaagucgggcaccagc

SEQ ID NO: 360185 - RNA, 13 nt, Bordetella pertussis
ggccgcggccagg

SEQ ID NO: 360186 - RNA, 16 nt, Bordetella pertussis
ggccgcggccaggccc

SEQ ID NO: 360187 - RNA, 17 nt, Bordetella pertussis
ggccgcggcccagcgcg

SEQ ID NO: 360188 - RNA, 14 nt, Bordetella pertussis
ggccgcggccggca

SEQ ID NO: 360189 - RNA, 19 nt, Bordetella pertussis
ggccgcggccuucaccccg

SEQ ID NO: 360190 - RNA, 12 nt, Bordetella pertussis
ggccgcggcgcc

SEQ ID NO: 360191 - RNA, 13 nt, Bordetella pertussis
ggccgcggcgccc

SEQ ID NO: 360192 - RNA, 14 nt, Bordetella pertussis
ggccgcggcguccg

SEQ ID NO: 360193 - RNA, 14 nt, Bordetella pertussis
ggccgcggcgugcu

SEQ ID NO: 360194 - RNA, 14 nt, Bordetella pertussis
ggccgcggcguugc

SEQ ID NO: 360195 - RNA, 16 nt, Bordetella pertussis
ggccgcuucggccugc

SEQ ID NO: 360196 - RNA, 18 nt, Bordetella pertussis
ggccgcuucggcggccau

SEQ ID NO: 360197 - RNA, 21 nt, Bordetella pertussis
ggccgcuucggcggccauggc

SEQ ID NO: 360198 - RNA, 17 nt, Bordetella pertussis
ggccgcuucgaugcugg

SEQ ID NO: 360199 - RNA, 21 nt, Bordetella pertussis
ggccgcuucgaugcuggcggc

SEQ ID NO: 360200 - RNA, 18 nt, Bordetella pertussis
ggccgcuuucgaccagcg

SEQ ID NO: 360201 - RNA, 15 nt, Bordetella pertussis
ggccggaaacgcggu

SEQ ID NO: 360202 - RNA, 16 nt, Bordetella pertussis
ggccggaaaugccgcg

SEQ ID NO: 360203 - RNA, 13 nt, Bordetella pertussis
ggccggaacagcg

SEQ ID NO: 360204 - RNA, 16 nt, Bordetella pertussis
ggccggaacagcgucc

SEQ ID NO: 360205 - RNA, 17 nt, Bordetella pertussis
ggccggaacagcgucca

SEQ ID NO: 360206 - RNA, 19 nt, Bordetella pertussis
ggccggaacagcguccagc

SEQ ID NO: 360207 - RNA, 23 nt, Bordetella pertussis
ggccggacagggccgcgagcaug

SEQ ID NO: 360208 - RNA, 14 nt, Bordetella pertussis
ggccggaccgcugu

SEQ ID NO: 360209 - RNA, 14 nt, Bordetella pertussis
ggccggacuggcgc

SEQ ID NO: 360210 - RNA, 24 nt, Bordetella pertussis
ggccggauccagcugcgaaagcgc

SEQ ID NO: 360211 - RNA, 20 nt, Bordetella pertussis
ggccggaucguagugcgugg

SEQ ID NO: 360212 - RNA, 20 nt, Bordetella pertussis
ggccggcaaggggccagccu

SEQ ID NO: 360213 - RNA, 21 nt, Bordetella pertussis
ggccggcaaggggccagccug

SEQ ID NO: 360214 - RNA, 17 nt, Bordetella pertussis
ggccggcaaggugaucg

SEQ ID NO: 360215 - RNA, 17 nt, Bordetella pertussis
ggccggcaccacgaccg

SEQ ID NO: 360216 - RNA, 20 nt, Bordetella pertussis
ggccggcaccacgaccggcu

SEQ ID NO: 360217 - RNA, 16 nt, Bordetella pertussis
ggccggcacgcccagc

SEQ ID NO: 360218 - RNA, 14 nt, Bordetella pertussis
ggccggcacgccga

SEQ ID NO: 360219 - RNA, 15 nt, Bordetella pertussis
ggccggcacgccgau

SEQ ID NO: 360220 - RNA, 14 nt, Bordetella pertussis
ggccggcacggccg

SEQ ID NO: 360221 - RNA, 17 nt, Bordetella pertussis
ggccggcacggccggcc

SEQ ID NO: 360222 - RNA, 18 nt, Bordetella pertussis
ggccggcagcgccuugcc

SEQ ID NO: 360223 - RNA, 20 nt, Bordetella pertussis
ggccggcagcgcgaccggcg

SEQ ID NO: 360224 - RNA, 22 nt, Bordetella pertussis
ggccggcagcgcgaccggcgcg

SEQ ID NO: 360225 - RNA, 15 nt, Bordetella pertussis
ggccggcagcggcgc

SEQ ID NO: 360226 - RNA, 17 nt, Bordetella pertussis
ggccggcagcggcgcca

SEQ ID NO: 360227 - RNA, 16 nt, Bordetella pertussis
ggccggcaggccggcc

SEQ ID NO: 360228 - RNA, 18 nt, Bordetella pertussis
ggccggcaggccggccag

SEQ ID NO: 360229 - RNA, 22 nt, Bordetella pertussis
ggccggcaucgcgcugacagcg

SEQ ID NO: 360230 - RNA, 14 nt, Bordetella pertussis
ggccggccgggcag

SEQ ID NO: 360231 - RNA, 14 nt, Bordetella pertussis
ggccggccgggccg

SEQ ID NO: 360232 - RNA, 17 nt, Bordetella pertussis
ggccggccgcguggccg

SEQ ID NO: 360233 - RNA, 14 nt, Bordetella pertussis
ggccggccugccgg

SEQ ID NO: 360234 - RNA, 12 nt, Bordetella pertussis
ggccggccugcg

SEQ ID NO: 360235 - RNA, 18 nt, Bordetella pertussis
ggccggccugcgggcuga

SEQ ID NO: 360236 - RNA, 20 nt, Bordetella pertussis
ggccggccugcgucgccacc

SEQ ID NO: 360237 - RNA, 19 nt, Bordetella pertussis
ggccggccuggcgcgcauc

SEQ ID NO: 360238 - RNA, 20 nt, Bordetella pertussis
ggccggccuggggacgggcg

SEQ ID NO: 360239 - RNA, 15 nt, Bordetella pertussis
ggccggcgcacgccg

SEQ ID NO: 360240 - RNA, 13 nt, Bordetella pertussis
ggccggggcgucg

SEQ ID NO: 360241 - RNA, 16 nt, Bordetella pertussis
ggccggggcgucgucg

SEQ ID NO: 360242 - RNA, 19 nt, Bordetella pertussis
ggccggggguuccugccca

SEQ ID NO: 360243 - RNA, 19 nt, Bordetella pertussis
ggccgggguccugaggcca

SEQ ID NO: 360244 - RNA, 17 nt, Bordetella pertussis
ggccgggucccuggccc

SEQ ID NO: 360245 - RNA, 14 nt, Bordetella pertussis
ggccgggucgcgca

SEQ ID NO: 360246 - RNA, 16 nt, Bordetella pertussis
ggccgggucgcgcagc

SEQ ID NO: 360247 - RNA, 16 nt, Bordetella pertussis
ggccgggucggccugc

SEQ ID NO: 360248 - RNA, 20 nt, Bordetella pertussis
ggccgggucguucgaacugg

SEQ ID NO: 360249 - RNA, 18 nt, Bordetella pertussis
ggccgggugguccaugcg

SEQ ID NO: 360250 - RNA, 17 nt, Bordetella pertussis
ggccggguugucgccca

SEQ ID NO: 360251 - RNA, 15 nt, Bordetella pertussis
ggccgguggaccagg

SEQ ID NO: 360252 - RNA, 16 nt, Bordetella pertussis
ggccgguggaccaggg

SEQ ID NO: 360253 - RNA, 13 nt, Bordetella pertussis
ggccgguucgaug

SEQ ID NO: 360254 - RNA, 19 nt, Bordetella pertussis
ggccgguucgaugaccugg

SEQ ID NO: 360255 - RNA, 15 nt, Bordetella pertussis
ggccguaaccggcca

SEQ ID NO: 360256 - RNA, 16 nt, Bordetella pertussis
ggccguaaccggccag

SEQ ID NO: 360257 - RNA, 17 nt, Bordetella pertussis
ggccguaaccggccagu

SEQ ID NO: 360258 - RNA, 15 nt, Bordetella pertussis
ggccguacauggcca

SEQ ID NO: 360259 - RNA, 21 nt, Bordetella pertussis
ggccguccaaaacagacaggc

SEQ ID NO: 360260 - RNA, 17 nt, Bordetella pertussis
ggccguccacgaaggca

SEQ ID NO: 360261 - RNA, 17 nt, Bordetella pertussis
ggccguccggccgugcc

SEQ ID NO: 360262 - RNA, 20 nt, Bordetella pertussis
ggccgucgagccgggcgccg

SEQ ID NO: 360263 - RNA, 14 nt, Bordetella pertussis
ggccgucgccgauc

SEQ ID NO: 360264 - RNA, 16 nt, Bordetella pertussis
ggccgucgccgaucgg

SEQ ID NO: 360265 - RNA, 17 nt, Bordetella pertussis
ggccgucgccgcccugc

SEQ ID NO: 360266 - RNA, 20 nt, Bordetella pertussis
ggccgucgccgcccugcugc

SEQ ID NO: 360267 - RNA, 20 nt, Bordetella pertussis
ggccgucgccuucggcggcg

SEQ ID NO: 360268 - RNA, 15 nt, Bordetella pertussis
ggccgucggccaggg

SEQ ID NO: 360269 - RNA, 17 nt, Bordetella pertussis
ggccgucggccaggggc

SEQ ID NO: 360270 - RNA, 21 nt, Bordetella pertussis
ggccgucggugguggugacgu

SEQ ID NO: 360271 - RNA, 17 nt, Bordetella pertussis
ggccgucgugcgccugg

SEQ ID NO: 360272 - RNA, 16 nt, Bordetella pertussis
ggccgucuacaggccc

SEQ ID NO: 360273 - RNA, 23 nt, Bordetella pertussis
ggccgucuacaggcccagcgcca

SEQ ID NO: 360274 - RNA, 14 nt, Bordetella pertussis
ggccgugccgcccg

SEQ ID NO: 360275 - RNA, 20 nt, Bordetella pertussis
ggccgugccucaacuggccg

SEQ ID NO: 360276 - RNA, 23 nt, Bordetella pertussis
ggccgugccucaacuggccggcc

SEQ ID NO: 360277 - RNA, 21 nt, Bordetella pertussis
ggccgugcgaggcgaacaggc

SEQ ID NO: 360278 - RNA, 14 nt, Bordetella pertussis
ggccgugcgccagc

SEQ ID NO: 360279 - RNA, 16 nt, Bordetella pertussis
ggccgugcgccagcgc

SEQ ID NO: 360280 - RNA, 17 nt, Bordetella pertussis
ggccgugcgccagcgcc

SEQ ID NO: 360281 - RNA, 17 nt, Bordetella pertussis
ggccguggcccagccgc

SEQ ID NO: 360282 - RNA, 20 nt, Bordetella pertussis
ggccguggcccagccgcaug

SEQ ID NO: 360283 - RNA, 20 nt, Bordetella pertussis
ggccguggccgggcccggcg

SEQ ID NO: 360284 - RNA, 17 nt, Bordetella pertussis
ggccguggcgcaccagg

SEQ ID NO: 360285 - RNA, 14 nt, Bordetella pertussis
ggccguggcggccu

SEQ ID NO: 360286 - RNA, 16 nt, Bordetella pertussis
ggccguggcggccugc

SEQ ID NO: 360287 - RNA, 21 nt, Bordetella pertussis
ggccguggcgugcaggccggc

SEQ ID NO: 360288 - RNA, 18 nt, Bordetella pertussis
ggccguuccaguccagcg

SEQ ID NO: 360289 - RNA, 23 nt, Bordetella pertussis
ggccguuccaguccagcgucggc

SEQ ID NO: 360290 - RNA, 14 nt, Bordetella pertussis
ggccguucggugcg

SEQ ID NO: 360291 - RNA, 20 nt, Bordetella pertussis
ggccguucggugcgcagcgg

SEQ ID NO: 360292 - RNA, 15 nt, Bordetella pertussis
ggccguugcgccugc

SEQ ID NO: 360293 - RNA, 16 nt, Bordetella pertussis
ggccguugcgccugcc

SEQ ID NO: 360294 - RNA, 18 nt, Bordetella pertussis
ggccguugcuccagccag

SEQ ID NO: 360295 - RNA, 15 nt, Bordetella pertussis
ggccguuggccagcg

SEQ ID NO: 360296 - RNA, 18 nt, Bordetella pertussis
ggccguuggccagcgccg

SEQ ID NO: 360297 - RNA, 19 nt, Bordetella pertussis
ggccguuggccagcgccgc

SEQ ID NO: 360298 - RNA, 23 nt, Bordetella pertussis
ggccguuggcgauggcgcggccg

SEQ ID NO: 360299 - RNA, 21 nt, Bordetella pertussis
ggccguuggcgcgccuugcgc

SEQ ID NO: 360300 - RNA, 17 nt, Bordetella pertussis
ggccguuucaggccugc

SEQ ID NO: 360301 - RNA, 19 nt, Bordetella pertussis
ggccguuugccccucggcg

SEQ ID NO: 360302 - RNA, 15 nt, Bordetella pertussis
ggccucaucgagcgc

SEQ ID NO: 360303 - RNA, 17 nt, Bordetella pertussis
ggccucaucgagcgccu

SEQ ID NO: 360304 - RNA, 17 nt, Bordetella pertussis
ggccucaugacggggcc

SEQ ID NO: 360305 - RNA, 12 nt, Bordetella pertussis
ggccuccagcag

SEQ ID NO: 360306 - RNA, 15 nt, Bordetella pertussis
ggccucccggaccag

SEQ ID NO: 360307 - RNA, 18 nt, Bordetella pertussis
ggccucccggaccagcag

SEQ ID NO: 360308 - RNA, 19 nt, Bordetella pertussis
ggccuccgcgcacagcgcg

SEQ ID NO: 360309 - RNA, 15 nt, Bordetella pertussis
ggccuccgcgccgac

SEQ ID NO: 360310 - RNA, 16 nt, Bordetella pertussis
ggccuccgcgccgacc

SEQ ID NO: 360311 - RNA, 16 nt, Bordetella pertussis
ggccugacgcgcaagc

SEQ ID NO: 360312 - RNA, 19 nt, Bordetella pertussis
ggccugacgcucauccagg

SEQ ID NO: 360313 - RNA, 17 nt, Bordetella pertussis
ggccugcaaugcggcca

SEQ ID NO: 360314 - RNA, 19 nt, Bordetella pertussis
ggccugcaaugcggccagg

SEQ ID NO: 360315 - RNA, 16 nt, Bordetella pertussis
ggccugcaccggcgcg

SEQ ID NO: 360316 - RNA, 21 nt, Bordetella pertussis
ggccugcacggugggcagcag

SEQ ID NO: 360317 - RNA, 23 nt, Bordetella pertussis
ggccugcacgcucuugagcgcgg

SEQ ID NO: 360318 - RNA, 13 nt, Bordetella pertussis
ggccugcagcaug

SEQ ID NO: 360319 - RNA, 22 nt, Bordetella pertussis
ggccugcagcaugaccgacagg

SEQ ID NO: 360320 - RNA, 16 nt, Bordetella pertussis
ggccugcaggaagccu

SEQ ID NO: 360321 - RNA, 21 nt, Bordetella pertussis
ggccugcaggaagccugcgcg

SEQ ID NO: 360322 - RNA, 18 nt, Bordetella pertussis
ggccugcaggaugggccg

SEQ ID NO: 360323 - RNA, 16 nt, Bordetella pertussis
ggccugcaggcccagc

SEQ ID NO: 360324 - RNA, 17 nt, Bordetella pertussis
ggccugcaggcccagca

SEQ ID NO: 360325 - RNA, 19 nt, Bordetella pertussis
ggccugcaggcccagcacg

SEQ ID NO: 360326 - RNA, 23 nt, Bordetella pertussis
ggccugcaggccguuccagucca

SEQ ID NO: 360327 - RNA, 18 nt, Bordetella pertussis
ggccugcaggugccgccg

SEQ ID NO: 360328 - RNA, 23 nt, Bordetella pertussis
ggccugcaggugccgccggcgcg

SEQ ID NO: 360329 - RNA, 17 nt, Bordetella pertussis
ggccugcaguucggccg

SEQ ID NO: 360330 - RNA, 18 nt, Bordetella pertussis
ggccugcaguucggccgc

SEQ ID NO: 360331 - RNA, 21 nt, Bordetella pertussis
ggccugccaaagacaaugccc

SEQ ID NO: 360332 - RNA, 17 nt, Bordetella pertussis
ggccugccaccagcgcg

SEQ ID NO: 360333 - RNA, 18 nt, Bordetella pertussis
ggccugccaccagcgcgc

SEQ ID NO: 360334 - RNA, 21 nt, Bordetella pertussis
ggccugccaccagcgcgccag

SEQ ID NO: 360335 - RNA, 23 nt, Bordetella pertussis
ggccugccaccagcgcgccagca

SEQ ID NO: 360336 - RNA, 14 nt, Bordetella pertussis
ggccugccagccug

SEQ ID NO: 360337 - RNA, 15 nt, Bordetella pertussis
ggccugccagccugc

SEQ ID NO: 360338 - RNA, 17 nt, Bordetella pertussis
ggccugccauccggccg

SEQ ID NO: 360339 - RNA, 20 nt, Bordetella pertussis
ggccugccauccggccgcac

SEQ ID NO: 360340 - RNA, 22 nt, Bordetella pertussis
ggccugccauccggccgcacgc

SEQ ID NO: 360341 - RNA, 19 nt, Bordetella pertussis
ggccugcccauggccugca

SEQ ID NO: 360342 - RNA, 14 nt, Bordetella pertussis
ggccugcccgggcg

SEQ ID NO: 360343 - RNA, 15 nt, Bordetella pertussis
ggccugcccgggcgg

SEQ ID NO: 360344 - RNA, 12 nt, Bordetella pertussis
ggccugcccguc

SEQ ID NO: 360345 - RNA, 12 nt, Bordetella pertussis
ggccugccggcg

SEQ ID NO: 360346 - RNA, 14 nt, Bordetella pertussis
ggccugccggcgcg

SEQ ID NO: 360347 - RNA, 13 nt, Bordetella pertussis
ggccugcgccacc

SEQ ID NO: 360348 - RNA, 17 nt, Bordetella pertussis
ggccugcgccaccagcu

SEQ ID NO: 360349 - RNA, 19 nt, Bordetella pertussis
ggccugcgccaccagcuug

SEQ ID NO: 360350 - RNA, 18 nt, Bordetella pertussis
ggccugcgccaccgcaug

SEQ ID NO: 360351 - RNA, 14 nt, Bordetella pertussis
ggccugcgccgccg

SEQ ID NO: 360352 - RNA, 20 nt, Bordetella pertussis
ggccugcgccgccgcgcgcu

SEQ ID NO: 360353 - RNA, 12 nt, Bordetella pertussis
ggccugcgccgg

SEQ ID NO: 360354 - RNA, 16 nt, Bordetella pertussis
ggccugcgccggcaug

SEQ ID NO: 360355 - RNA, 15 nt, Bordetella pertussis
ggccugcgccgggcg

SEQ ID NO: 360356 - RNA, 16 nt, Bordetella pertussis
ggccugcgccgggcgc

SEQ ID NO: 360357 - RNA, 17 nt, Bordetella pertussis
ggccugcgccgggcgcg

SEQ ID NO: 360358 - RNA, 20 nt, Bordetella pertussis
ggccugcgccgggcgcggcc

SEQ ID NO: 360359 - RNA, 12 nt, Bordetella pertussis
ggccugcgcgau

SEQ ID NO: 360360 - RNA, 13 nt, Bordetella pertussis
ggccugcgcgccg

SEQ ID NO: 360361 - RNA, 17 nt, Bordetella pertussis
ggccugcgcgccgacca

SEQ ID NO: 360362 - RNA, 14 nt, Bordetella pertussis
ggccugcggcgcca

SEQ ID NO: 360363 - RNA, 15 nt, Bordetella pertussis
ggccugcggcgccag

SEQ ID NO: 360364 - RNA, 17 nt, Bordetella pertussis
ggccugcgggccgggca

SEQ ID NO: 360365 - RNA, 13 nt, Bordetella pertussis
ggccugcgggcgc

SEQ ID NO: 360366 - RNA, 18 nt, Bordetella pertussis
ggccugcgugucaggcgg

SEQ ID NO: 360367 - RNA, 21 nt, Bordetella pertussis
ggccugcgugucaggcggagu

SEQ ID NO: 360368 - RNA, 14 nt, Bordetella pertussis
ggccugcuccggcg

SEQ ID NO: 360369 - RNA, 16 nt, Bordetella pertussis
ggccugcuccggcgug

SEQ ID NO: 360370 - RNA, 14 nt, Bordetella pertussis
ggccugcucgccca

SEQ ID NO: 360371 - RNA, 15 nt, Bordetella pertussis
ggccugcucgcccac

SEQ ID NO: 360372 - RNA, 21 nt, Bordetella pertussis
ggccugcucgcccacauagcg

SEQ ID NO: 360373 - RNA, 18 nt, Bordetella pertussis
ggccugcucgccggccag

SEQ ID NO: 360374 - RNA, 22 nt, Bordetella pertussis
ggccugcucgccggccagcgcg

SEQ ID NO: 360375 - RNA, 23 nt, Bordetella pertussis
ggccugcucgccggccagcgcgg

SEQ ID NO: 360376 - RNA, 14 nt, Bordetella pertussis
ggccugcucgggcg

SEQ ID NO: 360377 - RNA, 16 nt, Bordetella pertussis
ggccugcucgggcgcc

SEQ ID NO: 360378 - RNA, 17 nt, Bordetella pertussis
ggccugcucgggcgccu

SEQ ID NO: 360379 - RNA, 21 nt, Bordetella pertussis
ggccugcgggcugaugcaggc

SEQ ID NO: 360380 - RNA, 13 nt, Bordetella pertussis
ggccugcgggugc

SEQ ID NO: 360381 - RNA, 18 nt, Bordetella pertussis
ggccugcuuggcgcgcag

SEQ ID NO: 360382 - RNA, 19 nt, Bordetella pertussis
ggccuggaagcuggccagc

SEQ ID NO: 360383 - RNA, 24 nt, Bordetella pertussis
ggccuggaccugagccaggcgccc

SEQ ID NO: 360384 - RNA, 20 nt, Bordetella pertussis
ggccuggaugugcaggccga

SEQ ID NO: 360385 - RNA, 17 nt, Bordetella pertussis
ggccuggcccagcucca

SEQ ID NO: 360386 - RNA, 20 nt, Bordetella pertussis
ggccuggcggaucucggcca

SEQ ID NO: 360387 - RNA, 16 nt, Bordetella pertussis
ggccuggcguaugccc

SEQ ID NO: 360388 - RNA, 19 nt, Bordetella pertussis
ggccuggcguucggcaccg

SEQ ID NO: 360389 - RNA, 19 nt, Bordetella pertussis
ggccuggcgguaugcggcg

SEQ ID NO: 360390 - RNA, 22 nt, Bordetella pertussis
ggccuggcgguaugcggcgccc

SEQ ID NO: 360391 - RNA, 20 nt, Bordetella pertussis
ggccuggcuuggcggccagg

SEQ ID NO: 360392 - RNA, 15 nt, Bordetella pertussis
ggccugggccgacau

SEQ ID NO: 360393 - RNA, 17 nt, Bordetella pertussis
ggccugggccgacaugc

SEQ ID NO: 360394 - RNA, 13 nt, Bordetella pertussis
ggcgaggacaggc

SEQ ID NO: 360395 - RNA, 18 nt, Bordetella pertussis
ggcgaggaggugcgccgc

SEQ ID NO: 360396 - RNA, 16 nt, Bordetella pertussis
ggcgaggaugccgcgc

SEQ ID NO: 360397 - RNA, 12 nt, Bordetella pertussis
ggcgaggccgcc

SEQ ID NO: 360398 - RNA, 13 nt, Bordetella pertussis
ggcgaggccgccc

SEQ ID NO: 360399 - RNA, 14 nt, Bordetella pertussis
ggcgaggccgcccg

SEQ ID NO: 360400 - RNA, 15 nt, Bordetella pertussis
ggcgaggccgcccgc

SEQ ID NO: 360401 - RNA, 13 nt, Bordetella pertussis
ggcgaggcgcugg

SEQ ID NO: 360402 - RNA, 14 nt, Bordetella pertussis
ggcgaggcgcuggc

SEQ ID NO: 360403 - RNA, 15 nt, Bordetella pertussis
ggcgaggcgcuggcc

SEQ ID NO: 360404 - RNA, 18 nt, Bordetella pertussis
ggcgaggcggggcuggcg

SEQ ID NO: 360405 - RNA, 18 nt, Bordetella pertussis
ggcgaggcguccagcccc

SEQ ID NO: 360406 - RNA, 13 nt, Bordetella pertussis
ggcgagggcgucg

SEQ ID NO: 360407 - RNA, 13 nt, Bordetella pertussis
ggcgagggcugcc

SEQ ID NO: 360408 - RNA, 15 nt, Bordetella pertussis
ggcgaggggggcgug

SEQ ID NO: 360409 - RNA, 15 nt, Bordetella pertussis
ggcgagguagggcgc

SEQ ID NO: 360410 - RNA, 16 nt, Bordetella pertussis
ggcgaggucagcauga

SEQ ID NO: 360411 - RNA, 17 nt, Bordetella pertussis
ggcgaggucagcccggc

SEQ ID NO: 360412 - RNA, 18 nt, Bordetella pertussis
ggcgagguugcaggccag

SEQ ID NO: 360413 - RNA, 15 nt, Bordetella pertussis
ggcgauacgcgccgc

SEQ ID NO: 360414 - RNA, 19 nt, Bordetella pertussis
ggcgauacgcgccgccugg

SEQ ID NO: 360415 - RNA, 18 nt, Bordetella pertussis
ggcgauagcgcuccagcg

SEQ ID NO: 360416 - RNA, 15 nt, Bordetella pertussis
ggcgauauggccagg

SEQ ID NO: 360417 - RNA, 17 nt, Bordetella pertussis
ggcgauauggccagggu

SEQ ID NO: 360418 - RNA, 22 nt, Bordetella pertussis
ggcgaucaacgugcgccaggca

SEQ ID NO: 360419 - RNA, 18 nt, Bordetella pertussis
ggcgaucaccgacagcgc

SEQ ID NO: 360420 - RNA, 23 nt, Bordetella pertussis
ggcgaucaccgacagcgccagcg

SEQ ID NO: 360421 - RNA, 22 nt, Bordetella pertussis
ggcgaucacgccgaaggcguga

SEQ ID NO: 360422 - RNA, 16 nt, Bordetella pertussis
ggcgaucaggccgccc

SEQ ID NO: 360423 - RNA, 13 nt, Bordetella pertussis
ggcgauccaggcc

SEQ ID NO: 360424 - RNA, 19 nt, Bordetella pertussis
ggcgauccaggccaccgcg

SEQ ID NO: 360425 - RNA, 21 nt, Bordetella pertussis
ggcgauccaggccaccgcggc

SEQ ID NO: 360426 - RNA, 18 nt, Bordetella pertussis
ggcgauccagggccgcca

SEQ ID NO: 360427 - RNA, 20 nt, Bordetella pertussis
ggcgauccagggccgccagc

SEQ ID NO: 360428 - RNA, 19 nt, Bordetella pertussis
ggcgaucaugcaguacagg

SEQ ID NO: 360429 - RNA, 19 nt, Bordetella pertussis
ggcgauccgccgcggccag

SEQ ID NO: 360430 - RNA, 17 nt, Bordetella pertussis
ggcgauccugcccaccg

SEQ ID NO: 360431 - RNA, 21 nt, Bordetella pertussis
ggcgauccugcccaccgccgc

SEQ ID NO: 360432 - RNA, 16 nt, Bordetella pertussis
ggcgaucgaacgcggc

SEQ ID NO: 360433 - RNA, 15 nt, Bordetella pertussis
ggcgaucgcgucggc

SEQ ID NO: 360434 - RNA, 17 nt, Bordetella pertussis
ggcgaucggcccgggcg

SEQ ID NO: 360435 - RNA, 18 nt, Bordetella pertussis
ggcgaucggcccgggcgu

SEQ ID NO: 360436 - RNA, 19 nt, Bordetella pertussis
ggcgaucugcggcguggcg

SEQ ID NO: 360437 - RNA, 16 nt, Bordetella pertussis
ggcgaucugggccucg

SEQ ID NO: 360438 - RNA, 17 nt, Bordetella pertussis
ggcgaucuucagcacca

SEQ ID NO: 360439 - RNA, 22 nt, Bordetella pertussis
ggcgaugaagucgcggcccgcc

SEQ ID NO: 360440 - RNA, 14 nt, Bordetella pertussis
ggcgaugaccggca

SEQ ID NO: 360441 - RNA, 16 nt, Bordetella pertussis
ggcgaugaccggcaag

SEQ ID NO: 360442 - RNA, 20 nt, Bordetella pertussis
ggcgaugaccucggcgagcg

SEQ ID NO: 360443 - RNA, 22 nt, Bordetella pertussis
ggcgaugauggggucgccgggc

SEQ ID NO: 360444 - RNA, 23 nt, Bordetella pertussis
ggcgaugauggggucgccgggca

SEQ ID NO: 360445 - RNA, 21 nt, Bordetella pertussis
ggcgaugcccaccagccgccc

SEQ ID NO: 360446 - RNA, 19 nt, Bordetella pertussis
ggcgaugccccaguccagg

SEQ ID NO: 360447 - RNA, 15 nt, Bordetella pertussis
ggcgaugccgcagau

SEQ ID NO: 360448 - RNA, 15 nt, Bordetella pertussis
ggcgaugccggccag

SEQ ID NO: 360449 - RNA, 13 nt, Bordetella pertussis
ggcgaugccggcg

SEQ ID NO: 360450 - RNA, 13 nt, Bordetella pertussis
ggcgaugccgggc

SEQ ID NO: 360451 - RNA, 15 nt, Bordetella pertussis
ggcgaugcgccauac

SEQ ID NO: 360452 - RNA, 14 nt, Bordetella pertussis
ggcgaugcgcgagc

SEQ ID NO: 360453 - RNA, 22 nt, Bordetella pertussis
ggcgaugcggcggccgaagcgc

SEQ ID NO: 360454 - RNA, 20 nt, Bordetella pertussis
ggcgaugcgggccacgccgg

SEQ ID NO: 360455 - RNA, 17 nt, Bordetella pertussis
ggcgaugcucacgccca

SEQ ID NO: 360456 - RNA, 20 nt, Bordetella pertussis
ggcgaugcugccgucgccaa

SEQ ID NO: 360457 - RNA, 15 nt, Bordetella pertussis
ggcgauggcaucggg

SEQ ID NO: 360458 - RNA, 15 nt, Bordetella pertussis
ggcgauggcccggua

SEQ ID NO: 360459 - RNA, 14 nt, Bordetella pertussis
ggcgauggccgaca

SEQ ID NO: 360460 - RNA, 18 nt, Bordetella pertussis
ggcgauggccgacauguc

SEQ ID NO: 360461 - RNA, 14 nt, Bordetella pertussis
ggcgauggccgcca

SEQ ID NO: 360462 - RNA, 16 nt, Bordetella pertussis
ggcgauggccgccagc

SEQ ID NO: 360463 - RNA, 17 nt, Bordetella pertussis
ggcgauggccgccagcg

SEQ ID NO: 360464 - RNA, 13 nt, Bordetella pertussis
ggcgauggccuga

SEQ ID NO: 360465 - RNA, 16 nt, Bordetella pertussis
ggcgauggcgcgcgcc

SEQ ID NO: 360466 - RNA, 16 nt, Bordetella pertussis
ggcgauggcgcggccg

SEQ ID NO: 360467 - RNA, 17 nt, Bordetella pertussis
ggcgauggucggccgga

SEQ ID NO: 360468 - RNA, 16 nt, Bordetella pertussis
ggcgauguaggccagg

SEQ ID NO: 360469 - RNA, 17 nt, Bordetella pertussis
ggcgauguagggcagcu

SEQ ID NO: 360470 - RNA, 19 nt, Bordetella pertussis
ggcgauggcuuggcgcuua

SEQ ID NO: 360471 - RNA, 18 nt, Bordetella pertussis
ggcgauguggcgcgccau

SEQ ID NO: 360472 - RNA, 15 nt, Bordetella pertussis
ggcgauugcgccagc

SEQ ID NO: 360473 - RNA, 16 nt, Bordetella pertussis
ggcgauugcgccagcg

SEQ ID NO: 360474 - RNA, 21 nt, Bordetella pertussis
ggcgauugcggcccgcggccu

SEQ ID NO: 360475 - RNA, 22 nt, Bordetella pertussis
ggcgauugcggcccgcggccuu

SEQ ID NO: 360476 - RNA, 17 nt, Bordetella pertussis
ggcgcaaaccacgucgg

SEQ ID NO: 360477 - RNA, 21 nt, Bordetella pertussis
ggcgcaccaugcggugcgccc

SEQ ID NO: 360478 - RNA, 14 nt, Bordetella pertussis
ggcgcacccgcggc

SEQ ID NO: 360479 - RNA, 15 nt, Bordetella pertussis
ggcgcacccgcggcg

SEQ ID NO: 360480 - RNA, 16 nt, Bordetella pertussis
ggcgcacccgcggcgc

SEQ ID NO: 360481 - RNA, 21 nt, Bordetella pertussis
ggcgcacccggugaucaugcc

SEQ ID NO: 360482 - RNA, 18 nt, Bordetella pertussis
ggcgcacccugcaggccg

SEQ ID NO: 360483 - RNA, 19 nt, Bordetella pertussis
ggcgcacccugcaggccgg

SEQ ID NO: 360484 - RNA, 21 nt, Bordetella pertussis
ggcgcacccugcaggccgggc

SEQ ID NO: 360485 - RNA, 23 nt, Bordetella pertussis
ggcgcacccugcaggccgggcag

SEQ ID NO: 360486 - RNA, 18 nt, Bordetella pertussis
ggcgcaccaggcuggggc

SEQ ID NO: 360487 - RNA, 21 nt, Bordetella pertussis
ggcgcaccaggcuggggccga

SEQ ID NO: 360488 - RNA, 14 nt, Bordetella pertussis
ggcgcaccgcgcug

SEQ ID NO: 360489 - RNA, 23 nt, Bordetella pertussis
ggcgcaccgucacgcgcuccagc

SEQ ID NO: 360490 - RNA, 13 nt, Bordetella pertussis
ggcgcacgccccg

SEQ ID NO: 360491 - RNA, 16 nt, Bordetella pertussis
ggcgcacgccccgacg

SEQ ID NO: 360492 - RNA, 13 nt, Bordetella pertussis
ggcgcacgccgcc

SEQ ID NO: 360493 - RNA, 14 nt, Bordetella pertussis
ggcgcacgccgcgc

SEQ ID NO: 360494 - RNA, 16 nt, Bordetella pertussis
ggcgcacgccgcgccg

SEQ ID NO: 360495 - RNA, 19 nt, Bordetella pertussis
ggcgcacgccgcgccggcg

SEQ ID NO: 360496 - RNA, 12 nt, Bordetella pertussis
ggcgcacgccgg

SEQ ID NO: 360497 - RNA, 13 nt, Bordetella pertussis
ggcgcacgccgga

SEQ ID NO: 360498 - RNA, 21 nt, Bordetella pertussis
ggcgcacgccgggcgcggccg

SEQ ID NO: 360499 - RNA, 17 nt, Bordetella pertussis
ggcgcagauggcggcga

SEQ ID NO: 360500 - RNA, 18 nt, Bordetella pertussis
ggcgcagaugggcggcga

SEQ ID NO: 360501 - RNA, 14 nt, Bordetella pertussis
ggcgcagcaccagg

SEQ ID NO: 360502 - RNA, 14 nt, Bordetella pertussis
ggcgcagcacgccg

SEQ ID NO: 360503 - RNA, 20 nt, Bordetella pertussis
ggcgcagcacgccgcgccag

SEQ ID NO: 360504 - RNA, 23 nt, Bordetella pertussis
ggcgcagcacgccgcgccaggca

SEQ ID NO: 360505 - RNA, 13 nt, Bordetella pertussis
ggcgcagcagcgc

SEQ ID NO: 360506 - RNA, 16 nt, Bordetella pertussis
ggcgcagcagcgccgg

SEQ ID NO: 360507 - RNA, 14 nt, Bordetella pertussis
ggcgcagcaggcgc

SEQ ID NO: 360508 - RNA, 18 nt, Bordetella pertussis
ggcgcagcaggcgcgcgg

SEQ ID NO: 360509 - RNA, 18 nt, Bordetella pertussis
ggcgcagcaucuugcgcc

SEQ ID NO: 360510 - RNA, 13 nt, Bordetella pertussis
ggcgcagcccagc

SEQ ID NO: 360511 - RNA, 16 nt, Bordetella pertussis
ggcgcagccgccauag

SEQ ID NO: 360512 - RNA, 22 nt, Bordetella pertussis
ggcgcagccgccauaggcgcgc

SEQ ID NO: 360513 - RNA, 13 nt, Bordetella pertussis
ggcgcagccgcgc

SEQ ID NO: 360514 - RNA, 16 nt, Bordetella pertussis
ggcgcagccgcgcgcc

SEQ ID NO: 360515 - RNA, 13 nt, Bordetella pertussis
ggcgcagcgccgc

SEQ ID NO: 360516 - RNA, 14 nt, Bordetella pertussis
ggcgcagcgcggca

SEQ ID NO: 360517 - RNA, 19 nt, Bordetella pertussis
ggcgcauauggagccaggc

SEQ ID NO: 360518 - RNA, 21 nt, Bordetella pertussis
ggcgcauauggagccaggcgg

SEQ ID NO: 360519 - RNA, 16 nt, Bordetella pertussis
ggcgcaucagcgcgcc

SEQ ID NO: 360520 - RNA, 19 nt, Bordetella pertussis
ggcgcaucgacagcgcgcc

SEQ ID NO: 360521 - RNA, 20 nt, Bordetella pertussis
ggcgcaucgacagcgcgccc

SEQ ID NO: 360522 - RNA, 21 nt, Bordetella pertussis
ggcgcaucgacagcgcgcccg

SEQ ID NO: 360523 - RNA, 17 nt, Bordetella pertussis
ggcgcaugacggcgucg

SEQ ID NO: 360524 - RNA, 17 nt, Bordetella pertussis
ggcgcaugacggggugc

SEQ ID NO: 360525 - RNA, 16 nt, Bordetella pertussis
ggcgcaugagccggca

SEQ ID NO: 360526 - RNA, 17 nt, Bordetella pertussis
ggcgcaugauggccggc

SEQ ID NO: 360527 - RNA, 20 nt, Bordetella pertussis
ggcgcaugauggccggccug

SEQ ID NO: 360528 - RNA, 17 nt, Bordetella pertussis
ggcgcauggccggcgug

SEQ ID NO: 360529 - RNA, 15 nt, Bordetella pertussis
ggcgcauucgccgga

SEQ ID NO: 360530 - RNA, 16 nt, Bordetella pertussis
ggcgcauucgcgccug

SEQ ID NO: 360531 - RNA, 19 nt, Bordetella pertussis
ggcgcauucgcgccugagc

SEQ ID NO: 360532 - RNA, 14 nt, Bordetella pertussis
ggcgcauugccgcc

SEQ ID NO: 360533 - RNA, 14 nt, Bordetella pertussis
ggcgcauugccguc

SEQ ID NO: 360534 - RNA, 20 nt, Bordetella pertussis
ggcgcauugccgucggccgc

SEQ ID NO: 360535 - RNA, 14 nt, Bordetella pertussis
ggcgcauggcuggu

SEQ ID NO: 360536 - RNA, 17 nt, Bordetella pertussis
ggcgccaacccgccauc

SEQ ID NO: 360537 - RNA, 17 nt, Bordetella pertussis
ggcgccaagcggcaggc

SEQ ID NO: 360538 - RNA, 13 nt, Bordetella pertussis
ggcgccaggcuga

SEQ ID NO: 360539 - RNA, 18 nt, Bordetella pertussis
ggcgccaguagcgccggc

SEQ ID NO: 360540 - RNA, 19 nt, Bordetella pertussis
ggcgccaguagcgccggcu

SEQ ID NO: 360541 - RNA, 14 nt, Bordetella pertussis
ggcgccaucaaugc

SEQ ID NO: 360542 - RNA, 11 nt, Bordetella pertussis
ggcgccaugac

SEQ ID NO: 360543 - RNA, 18 nt, Bordetella pertussis
ggcgccaugaucgccggc

SEQ ID NO: 360544 - RNA, 19 nt, Bordetella pertussis
ggcgccaugcgacagcccg

SEQ ID NO: 360545 - RNA, 19 nt, Bordetella pertussis
ggcgccaugcgcaccaccg

SEQ ID NO: 360546 - RNA, 17 nt, Bordetella pertussis
ggcgccaugcgcccggc

SEQ ID NO: 360547 - RNA, 19 nt, Bordetella pertussis
ggcgccaugcgcccggcca

SEQ ID NO: 360548 - RNA, 20 nt, Bordetella pertussis
ggcgccaugcgcccggccac

SEQ ID NO: 360549 - RNA, 22 nt, Bordetella pertussis
ggcgccaugugcguugccagcc

SEQ ID NO: 360550 - RNA, 15 nt, Bordetella pertussis
ggcgcccagcgccau

SEQ ID NO: 360551 - RNA, 15 nt, Bordetella pertussis
ggcgcccagcugcuu

SEQ ID NO: 360552 - RNA, 23 nt, Bordetella pertussis
ggcgcccagguacaucaucccca

SEQ ID NO: 360553 - RNA, 23 nt, Bordetella pertussis
ggcgcccauuccgagcgggcccg

SEQ ID NO: 360554 - RNA, 21 nt, Bordetella pertussis
ggcgccccaacgcggccagcg

SEQ ID NO: 360555 - RNA, 14 nt, Bordetella pertussis
ggcgccccacccgg

SEQ ID NO: 360556 - RNA, 18 nt, Bordetella pertussis
ggcgcccaucgcggucau

SEQ ID NO: 360557 - RNA, 17 nt, Bordetella pertussis
ggcgcccccagcagcga

SEQ ID NO: 360558 - RNA, 18 nt, Bordetella pertussis
ggcgccccgaucggcgcc

SEQ ID NO: 360559 - RNA, 21 nt, Bordetella pertussis
ggcgccccgaucggcgccgcg

SEQ ID NO: 360560 - RNA, 17 nt, Bordetella pertussis
ggcgccccgugccaugg

SEQ ID NO: 360561 - RNA, 17 nt, Bordetella pertussis
ggcgcccgacggcgcgc

SEQ ID NO: 360562 - RNA, 18 nt, Bordetella pertussis
ggcgccgacgaugccgcc

SEQ ID NO: 360563 - RNA, 20 nt, Bordetella pertussis
ggcgccgaccgggccgacca

SEQ ID NO: 360564 - RNA, 20 nt, Bordetella pertussis
ggcgccgauccagggccgca

SEQ ID NO: 360565 - RNA, 16 nt, Bordetella pertussis
ggcgccgauccggcgc

SEQ ID NO: 360566 - RNA, 17 nt, Bordetella pertussis
ggcgccgauccggcgca

SEQ ID NO: 360567 - RNA, 13 nt, Bordetella pertussis
ggcgccgauggcg

SEQ ID NO: 360568 - RNA, 16 nt, Bordetella pertussis
ggcgccgauggcgccg

SEQ ID NO: 360569 - RNA, 18 nt, Bordetella pertussis
ggcgccgauggcgccgcu

SEQ ID NO: 360570 - RNA, 23 nt, Bordetella pertussis
ggcgccgauggcgccgcugucgc

SEQ ID NO: 360571 - RNA, 17 nt, Bordetella pertussis
ggcgccgccggcggccu

SEQ ID NO: 360572 - RNA, 17 nt, Bordetella pertussis
ggcgccgccgugcgcgg

SEQ ID NO: 360573 - RNA, 20 nt, Bordetella pertussis
ggcgccgccgugcgcgggcg

SEQ ID NO: 360574 - RNA, 21 nt, Bordetella pertussis
ggcgccgccgugcgcgggcgc

SEQ ID NO: 360575 - RNA, 22 nt, Bordetella pertussis
ggcgccgccucaggccggcgcc

SEQ ID NO: 360576 - RNA, 16 nt, Bordetella pertussis
ggcgccgccucgggca

SEQ ID NO: 360577 - RNA, 12 nt, Bordetella pertussis
ggcgccgcgccc

SEQ ID NO: 360578 - RNA, 13 nt, Bordetella pertussis
ggcgccgcgcccc

SEQ ID NO: 360579 - RNA, 17 nt, Bordetella pertussis
ggcgccgcgcccggccg

SEQ ID NO: 360580 - RNA, 18 nt, Bordetella pertussis
ggcgccgcgcccggccgg

SEQ ID NO: 360581 - RNA, 13 nt, Bordetella pertussis
ggcgccgcgccgc

SEQ ID NO: 360582 - RNA, 19 nt, Bordetella pertussis
ggcgccgcgccggggcggc

SEQ ID NO: 360583 - RNA, 11 nt, Bordetella pertussis
ggcgccgcgcg

SEQ ID NO: 360584 - RNA, 14 nt, Bordetella pertussis
ggcgccgcgcgccg

SEQ ID NO: 360585 - RNA, 16 nt, Bordetella pertussis
ggcgccgcgcgcggcc

SEQ ID NO: 360586 - RNA, 13 nt, Bordetella pertussis
ggcgccgcgcgcu

SEQ ID NO: 360587 - RNA, 16 nt, Bordetella pertussis
ggcgccgcgcgcuggu

SEQ ID NO: 360588 - RNA, 14 nt, Bordetella pertussis
ggcgccgcgcucgc

SEQ ID NO: 360589 - RNA, 20 nt, Bordetella pertussis
ggcgccgcgcucgcgccagg

SEQ ID NO: 360590 - RNA, 14 nt, Bordetella pertussis
ggcgccgcgcugau

SEQ ID NO: 360591 - RNA, 11 nt, Bordetella pertussis
ggcgccgcggc

SEQ ID NO: 360592 - RNA, 15 nt, Bordetella pertussis
ggcgccgcggcggcg

SEQ ID NO: 360593 - RNA, 14 nt, Bordetella pertussis
ggcgccgcgggccu

SEQ ID NO: 360594 - RNA, 13 nt, Bordetella pertussis
ggcgccgcggggc

SEQ ID NO: 360595 - RNA, 13 nt, Bordetella pertussis
ggcgccgcguccg

SEQ ID NO: 360596 - RNA, 17 nt, Bordetella pertussis
ggcgccgcguccggcgc

SEQ ID NO: 360597 - RNA, 19 nt, Bordetella pertussis
ggcgccgcguucacgccgg

SEQ ID NO: 360598 - RNA, 20 nt, Bordetella pertussis
ggcgccgcguucacgccggc

SEQ ID NO: 360599 - RNA, 17 nt, Bordetella pertussis
ggcgccgcucagcgcgg

SEQ ID NO: 360600 - RNA, 14 nt, Bordetella pertussis
ggcgccgcuggcca

SEQ ID NO: 360601 - RNA, 19 nt, Bordetella pertussis
ggcgccgcuuccggcauga

SEQ ID NO: 360602 - RNA, 20 nt, Bordetella pertussis
ggcgccggaucggccggcag

SEQ ID NO: 360603 - RNA, 18 nt, Bordetella pertussis
ggcgccggcaaacccggc

SEQ ID NO: 360604 - RNA, 12 nt, Bordetella pertussis
ggcgccggccac

SEQ ID NO: 360605 - RNA, 13 nt, Bordetella pertussis
ggcgccggaucgg

SEQ ID NO: 360606 - RNA, 14 nt, Bordetella pertussis
ggcgccggccagga

SEQ ID NO: 360607 - RNA, 16 nt, Bordetella pertussis
ggcgccgggcuggugc

SEQ ID NO: 360608 - RNA, 17 nt, Bordetella pertussis
ggcgccgggcuggugcg

SEQ ID NO: 360609 - RNA, 23 nt, Bordetella pertussis
ggcgccgggcuggugcgccgugc

SEQ ID NO: 360610 - RNA, 22 nt, Bordetella pertussis
ggcgccggguggguucgggcgu

SEQ ID NO: 360611 - RNA, 20 nt, Bordetella pertussis
ggcgccggucugggcgcgga

SEQ ID NO: 360612 - RNA, 22 nt, Bordetella pertussis
ggcgccggugaccgccagcagg

SEQ ID NO: 360613 - RNA, 17 nt, Bordetella pertussis
ggcgccggugcgcggcg

SEQ ID NO: 360614 - RNA, 19 nt, Bordetella pertussis
ggcgccggugcgcggcgcc

SEQ ID NO: 360615 - RNA, 20 nt, Bordetella pertussis
ggcgccguccagcgcggcau

SEQ ID NO: 360616 - RNA, 12 nt, Bordetella pertussis
ggcgccgucgaa

SEQ ID NO: 360617 - RNA, 16 nt, Bordetella pertussis
ggcgccucgcgacggc

SEQ ID NO: 360618 - RNA, 15 nt, Bordetella pertussis
ggcgccugagccgau

SEQ ID NO: 360619 - RNA, 17 nt, Bordetella pertussis
ggcgccugccccggcag

SEQ ID NO: 360620 - RNA, 14 nt, Bordetella pertussis
ggcgccugcccugc

SEQ ID NO: 360621 - RNA, 12 nt, Bordetella pertussis
ggcgccugcgcc

SEQ ID NO: 360622 - RNA, 20 nt, Bordetella pertussis
ggcgccugcggcaggccgca

SEQ ID NO: 360623 - RNA, 19 nt, Bordetella pertussis
ggcgccugcggcauggugu

SEQ ID NO: 360624 - RNA, 18 nt, Bordetella pertussis
ggcgccugcggggccgcu

SEQ ID NO: 360625 - RNA, 17 nt, Bordetella pertussis
ggcgccugcgucguugc

SEQ ID NO: 360626 - RNA, 18 nt, Bordetella pertussis
ggcgccugcucacgcccc

SEQ ID NO: 360627 - RNA, 12 nt, Bordetella pertussis
ggcgccuggccc

SEQ ID NO: 360628 - RNA, 13 nt, Bordetella pertussis
ggcgccuggccgc

SEQ ID NO: 360629 - RNA, 18 nt, Bordetella pertussis
ggcgccuggccgcccagc

SEQ ID NO: 360630 - RNA, 13 nt, Bordetella pertussis
ggcgccuggcgca

SEQ ID NO: 360631 - RNA, 13 nt, Bordetella pertussis
ggcgccuggcugc

SEQ ID NO: 360632 - RNA, 13 nt, Bordetella pertussis
ggcgccuggggcg

SEQ ID NO: 360633 - RNA, 18 nt, Bordetella pertussis
ggcgccuggggcgggcgg

SEQ ID NO: 360634 - RNA, 16 nt, Bordetella pertussis
ggcgccuggggcgugc

SEQ ID NO: 360635 - RNA, 19 nt, Bordetella pertussis
ggcgccuggggcgugcccu

SEQ ID NO: 360636 - RNA, 14 nt, Bordetella pertussis
ggcgccuggucgcg

SEQ ID NO: 360637 - RNA, 21 nt, Bordetella pertussis
ggcgccuggucgcgcgccugc

SEQ ID NO: 360638 - RNA, 17 nt, Bordetella pertussis
ggcgccuguccccgcag

SEQ ID NO: 360639 - RNA, 15 nt, Bordetella pertussis
ggcgccuuccggcag

SEQ ID NO: 360640 - RNA, 19 nt, Bordetella pertussis
ggcgccuuccggcagcggc

SEQ ID NO: 360641 - RNA, 15 nt, Bordetella pertussis
ggcgccuucgaacuc

SEQ ID NO: 360642 - RNA, 14 nt, Bordetella pertussis
ggcgccuucgaucu

SEQ ID NO: 360643 - RNA, 15 nt, Bordetella pertussis
ggcgccuucggcgcg

SEQ ID NO: 360644 - RNA, 17 nt, Bordetella pertussis
ggcgccuugccgccgcg

SEQ ID NO: 360645 - RNA, 18 nt, Bordetella pertussis
ggcgccuugccgccgcgc

SEQ ID NO: 360646 - RNA, 19 nt, Bordetella pertussis
ggcgccuuucccgcgccga

SEQ ID NO: 360647 - RNA, 17 nt, Bordetella pertussis
ggcgcgaacaccggcag

SEQ ID NO: 360648 - RNA, 23 nt, Bordetella pertussis
ggcgcgaacaccggcaggccgcg

SEQ ID NO: 360649 - RNA, 20 nt, Bordetella pertussis
ggcgcgaaccccuccggcgu

SEQ ID NO: 360650 - RNA, 16 nt, Bordetella pertussis
ggcgcgaacggcuuga

SEQ ID NO: 360651 - RNA, 22 nt, Bordetella pertussis
ggcgcgacagauagaacgaggu

SEQ ID NO: 360652 - RNA, 20 nt, Bordetella pertussis
ggcgcgacaggcggugcgcg

SEQ ID NO: 360653 - RNA, 15 nt, Bordetella pertussis
ggcgcgaccugcgcg

SEQ ID NO: 360654 - RNA, 14 nt, Bordetella pertussis
ggcgcgacgccagc

SEQ ID NO: 360655 - RNA, 21 nt, Bordetella pertussis
ggcgcgacgccagcgcgccau

SEQ ID NO: 360656 - RNA, 23 nt, Bordetella pertussis
ggcgcgacgccagcgcgccaugg

SEQ ID NO: 360657 - RNA, 15 nt, Bordetella pertussis
ggcgcgacgccugcg

SEQ ID NO: 360658 - RNA, 23 nt, Bordetella pertussis
ggcgcgcgccugcagcacggcca

SEQ ID NO: 360659 - RNA, 14 nt, Bordetella pertussis
ggcgcgcgcgccgc

SEQ ID NO: 360660 - RNA, 20 nt, Bordetella pertussis
ggcgcgcgcgcgccgcacgc

SEQ ID NO: 360661 - RNA, 13 nt, Bordetella pertussis
ggcgcgcgcggcc

SEQ ID NO: 360662 - RNA, 15 nt, Bordetella pertussis
ggcgcgcgcggccag

SEQ ID NO: 360663 - RNA, 15 nt, Bordetella pertussis
ggcgcgcgcggcgcc

SEQ ID NO: 360664 - RNA, 22 nt, Bordetella pertussis
ggcgcgcgcggcgccuggggcg

SEQ ID NO: 360665 - RNA, 22 nt, Bordetella pertussis
ggcgcgcggaugaucgcgcagc

SEQ ID NO: 360666 - RNA, 14 nt, Bordetella pertussis
ggcgcgcggccucg

SEQ ID NO: 360667 - RNA, 17 nt, Bordetella pertussis
ggcgcgcggccugggcg

SEQ ID NO: 360668 - RNA, 20 nt, Bordetella pertussis
ggcgcgcgggaagcugucgg

SEQ ID NO: 360669 - RNA, 15 nt, Bordetella pertussis
ggcgcgcgggggugc

SEQ ID NO: 360670 - RNA, 21 nt, Bordetella pertussis
ggcgcgcgguggcacgacgcg

SEQ ID NO: 360671 - RNA, 21 nt, Bordetella pertussis
ggcgcgcgugcugggccaugc

SEQ ID NO: 360672 - RNA, 17 nt, Bordetella pertussis
ggcgcgcguugaccgcc

SEQ ID NO: 360673 - RNA, 18 nt, Bordetella pertussis
ggcgcgcucagcgccauc

SEQ ID NO: 360674 - RNA, 19 nt, Bordetella pertussis
ggcgcgcucaggccgccgg

SEQ ID NO: 360675 - RNA, 16 nt, Bordetella pertussis
ggcgcgcuccagcaug

SEQ ID NO: 360676 - RNA, 15 nt, Bordetella pertussis
ggcgcgcugcccagc

SEQ ID NO: 360677 - RNA, 12 nt, Bordetella pertussis
ggcgcgcuggcg

SEQ ID NO: 360678 - RNA, 16 nt, Bordetella pertussis
ggcgcgcuguucauca

SEQ ID NO: 360679 - RNA, 23 nt, Bordetella pertussis
ggcgcgcuucuuggcgaccaggc

SEQ ID NO: 360680 - RNA, 19 nt, Bordetella pertussis
ggcgcgcuugagcggcucg

SEQ ID NO: 360681 - RNA, 22 nt, Bordetella pertussis
ggcgcgcuggcgcucgggcgcg

SEQ ID NO: 360682 - RNA, 13 nt, Bordetella pertussis
ggcgcggaucaug

SEQ ID NO: 360683 - RNA, 20 nt, Bordetella pertussis
ggcgcggaucaugggcucgc

SEQ ID NO: 360684 - RNA, 22 nt, Bordetella pertussis
ggcgcggaucaugggcucgcgc

SEQ ID NO: 360685 - RNA, 19 nt, Bordetella pertussis
ggcgcggaucgugcgccac

SEQ ID NO: 360686 - RNA, 17 nt, Bordetella pertussis
ggcgcggcuuucgccgg

SEQ ID NO: 360687 - RNA, 22 nt, Bordetella pertussis
ggcgcggaugccguccacgccg

SEQ ID NO: 360688 - RNA, 21 nt, Bordetella pertussis
ggcgcgggcacucggccaugg

SEQ ID NO: 360689 - RNA, 16 nt, Bordetella pertussis
ggcgcgggcagcaccg

SEQ ID NO: 360690 - RNA, 14 nt, Bordetella pertussis
ggcgcgggccagcu

SEQ ID NO: 360691 - RNA, 17 nt, Bordetella pertussis
ggcgcgggcgcaggcgu

SEQ ID NO: 360692 - RNA, 12 nt, Bordetella pertussis
ggcgcgggcggc

SEQ ID NO: 360693 - RNA, 18 nt, Bordetella pertussis
ggcgcgggcggccuauca

SEQ ID NO: 360694 - RNA, 19 nt, Bordetella pertussis
ggcgcgggcggucggcgcg

SEQ ID NO: 360695 - RNA, 15 nt, Bordetella pertussis
ggcgcgggcugucgc

SEQ ID NO: 360696 - RNA, 16 nt, Bordetella pertussis
ggcgcgguauggccgc

SEQ ID NO: 360697 - RNA, 21 nt, Bordetella pertussis
ggcgcgguauggccgcccagc

SEQ ID NO: 360698 - RNA, 23 nt, Bordetella pertussis
ggcgcgguauucgcgcuggcgcg

SEQ ID NO: 360699 - RNA, 13 nt, Bordetella pertussis
ggcgcggucagca

SEQ ID NO: 360700 - RNA, 15 nt, Bordetella pertussis
ggcgcgguccacgcc

SEQ ID NO: 360701 - RNA, 18 nt, Bordetella pertussis
ggcgcgguccacgcgggc

SEQ ID NO: 360702 - RNA, 19 nt, Bordetella pertussis
ggcgcgguccacgcgggca

SEQ ID NO: 360703 - RNA, 14 nt, Bordetella pertussis
ggcgcgguccagca

SEQ ID NO: 360704 - RNA, 14 nt, Bordetella pertussis
ggcgcggucgacga

SEQ ID NO: 360705 - RNA, 14 nt, Bordetella pertussis
ggcgcggucuuggc

SEQ ID NO: 360706 - RNA, 22 nt, Bordetella pertussis
ggcgcggugccugugcccgcag

SEQ ID NO: 360707 - RNA, 16 nt, Bordetella pertussis
ggcgcggugcgcacca

SEQ ID NO: 360708 - RNA, 13 nt, Bordetella pertussis
ggcgcgguggcca

SEQ ID NO: 360709 - RNA, 22 nt, Bordetella pertussis
ggcgcgguggccaugcugggcg

SEQ ID NO: 360710 - RNA, 19 nt, Bordetella pertussis
ggcgcgucacaaagacggc

SEQ ID NO: 360711 - RNA, 15 nt, Bordetella pertussis
ggcgcgucaggccgg

SEQ ID NO: 360712 - RNA, 22 nt, Bordetella pertussis
ggcgcgucaguugggcgcgccc

SEQ ID NO: 360713 - RNA, 19 nt, Bordetella pertussis
ggcgcguucagcagcaggc

SEQ ID NO: 360714 - RNA, 19 nt, Bordetella pertussis
ggcgcguucagggcgccgc

SEQ ID NO: 360715 - RNA, 22 nt, Bordetella pertussis
ggcgcguucagggcgccgcggc

SEQ ID NO: 360716 - RNA, 21 nt, Bordetella pertussis
ggcgcguucucagccgcccgc

SEQ ID NO: 360717 - RNA, 21 nt, Bordetella pertussis
ggcgcguugcgcaucgcgcac

SEQ ID NO: 360718 - RNA, 16 nt, Bordetella pertussis
ggcgcguugcgcuugc

SEQ ID NO: 360719 - RNA, 17 nt, Bordetella pertussis
ggcgcguuucggucagg

SEQ ID NO: 360720 - RNA, 18 nt, Bordetella pertussis
ggcgcuccaugcggcggc

SEQ ID NO: 360721 - RNA, 13 nt, Bordetella pertussis
ggcgcuccauggc

SEQ ID NO: 360722 - RNA, 17 nt, Bordetella pertussis
ggcgcuccagcaccugc

SEQ ID NO: 360723 - RNA, 18 nt, Bordetella pertussis
ggcgcucgaaggcgccga

SEQ ID NO: 360724 - RNA, 17 nt, Bordetella pertussis
ggcgcucgagcgccugc

SEQ ID NO: 360725 - RNA, 14 nt, Bordetella pertussis
ggcgcucgaggcgc

SEQ ID NO: 360726 - RNA, 18 nt, Bordetella pertussis
ggcgcucgccccggcgcg

SEQ ID NO: 360727 - RNA, 12 nt, Bordetella pertussis
ggcgcucgcccu

SEQ ID NO: 360728 - RNA, 16 nt, Bordetella pertussis
ggcgcucgcgcgccag

SEQ ID NO: 360729 - RNA, 17 nt, Bordetella pertussis
ggcgcucgcgcgccagc

SEQ ID NO: 360730 - RNA, 19 nt, Bordetella pertussis
ggcgcucgcgcgccagcag

SEQ ID NO: 360731 - RNA, 16 nt, Bordetella pertussis
ggcgcucgcgcaccgc

SEQ ID NO: 360732 - RNA, 14 nt, Bordetella pertussis
ggcgcucgcgccca

SEQ ID NO: 360733 - RNA, 15 nt, Bordetella pertussis
ggcgcucggccagcg

SEQ ID NO: 360734 - RNA, 16 nt, Bordetella pertussis
ggcgcucggccagcga

SEQ ID NO: 360735 - RNA, 14 nt, Bordetella pertussis
ggcgcucgggcgcg

SEQ ID NO: 360736 - RNA, 13 nt, Bordetella pertussis
ggcgcugcagcgc

SEQ ID NO: 360737 - RNA, 14 nt, Bordetella pertussis
ggcgcugaugccgu

SEQ ID NO: 360738 - RNA, 19 nt, Bordetella pertussis
ggcgcugccgaccagcacg

SEQ ID NO: 360739 - RNA, 20 nt, Bordetella pertussis
ggcgcugccgaccagcacgg

SEQ ID NO: 360740 - RNA, 15 nt, Bordetella pertussis
ggcgcugccugccgg

SEQ ID NO: 360741 - RNA, 21 nt, Bordetella pertussis
ggcgcugccugccggccggcc

SEQ ID NO: 360742 - RNA, 12 nt, Bordetella pertussis
ggcgcugcgcgg

SEQ ID NO: 360743 - RNA, 15 nt, Bordetella pertussis
ggcgcugcgccggcg

SEQ ID NO: 360744 - RNA, 16 nt, Bordetella pertussis
ggcgcugcgccggcgg

SEQ ID NO: 360745 - RNA, 12 nt, Bordetella pertussis
ggcgcugcgcga

SEQ ID NO: 360746 - RNA, 19 nt, Bordetella pertussis
ggcgcugcugcuggcugcc

SEQ ID NO: 360747 - RNA, 20 nt, Bordetella pertussis
ggcgcugcuggccggccagc

SEQ ID NO: 360748 - RNA, 15 nt, Bordetella pertussis
ggcgcugcugucgcg

SEQ ID NO: 360749 - RNA, 22 nt, Bordetella pertussis
ggcgcuggauggcucgggcagc

SEQ ID NO: 360750 - RNA, 23 nt, Bordetella pertussis
ggcgcuggauggcucgggcagca

SEQ ID NO: 360751 - RNA, 13 nt, Bordetella pertussis
ggcgcuggccauc

SEQ ID NO: 360752 - RNA, 15 nt, Bordetella pertussis
ggcgcuggccgcccg

SEQ ID NO: 360753 - RNA, 16 nt, Bordetella pertussis
ggcgcuggccgcccgc

SEQ ID NO: 360754 - RNA, 13 nt, Bordetella pertussis
ggcgcuggccugc

SEQ ID NO: 360755 - RNA, 14 nt, Bordetella pertussis
ggcgcuggccugcc

SEQ ID NO: 360756 - RNA, 22 nt, Bordetella pertussis
ggcgcuggccugccgcgccgac

SEQ ID NO: 360757 - RNA, 17 nt, Bordetella pertussis
ggcgcuggccuggccgc

SEQ ID NO: 360758 - RNA, 18 nt, Bordetella pertussis
ggcgcuggccuggccgcc

SEQ ID NO: 360759 - RNA, 15 nt, Bordetella pertussis
ggcgcuggcgccgcg

SEQ ID NO: 360760 - RNA, 21 nt, Bordetella pertussis
ggcgcuggcgccgcgcgccau

SEQ ID NO: 360761 - RNA, 18 nt, Bordetella pertussis
ggcgcuggcggcugcgcg

SEQ ID NO: 360762 - RNA, 16 nt, Bordetella pertussis
ggcgcuggcguccagc

SEQ ID NO: 360763 - RNA, 19 nt, Bordetella pertussis
ggcgcuggcguccagccug

SEQ ID NO: 360764 - RNA, 18 nt, Bordetella pertussis
ggcgcuggcguucagcgg

SEQ ID NO: 360765 - RNA, 22 nt, Bordetella pertussis
ggcgcuggcguucagcgggcgc

SEQ ID NO: 360766 - RNA, 18 nt, Bordetella pertussis
ggcgcugggcaggcuggc

SEQ ID NO: 360767 - RNA, 16 nt, Bordetella pertussis
ggcgcuggggaagcgc

SEQ ID NO: 360768 - RNA, 19 nt, Bordetella pertussis
ggcgcugguaaagggcgcg

SEQ ID NO: 360769 - RNA, 23 nt, Bordetella pertussis
ggcgcuguucgauacggccacgc

SEQ ID NO: 360770 - RNA, 24 nt, Bordetella pertussis
ggcgcuguucgauacggccacgca

SEQ ID NO: 360771 - RNA, 16 nt, Bordetella pertussis
ggcgcuguuggccggc

SEQ ID NO: 360772 - RNA, 17 nt, Bordetella pertussis
ggcgcuguuggccggcg

SEQ ID NO: 360773 - RNA, 18 nt, Bordetella pertussis
ggcgcuguuggccgucgc

SEQ ID NO: 360774 - RNA, 18 nt, Bordetella pertussis
ggcgcuuaccgcgccggc

SEQ ID NO: 360775 - RNA, 19 nt, Bordetella pertussis
ggcgcuuaccgcgccggcu

SEQ ID NO: 360776 - RNA, 20 nt, Bordetella pertussis
ggcgcuucgucggccgccag

SEQ ID NO: 360777 - RNA, 21 nt, Bordetella pertussis
ggcgcuucgucggccgccagc

SEQ ID NO: 360778 - RNA, 23 nt, Bordetella pertussis
ggcgcuugcgcagggcgggcggu

SEQ ID NO: 360779 - RNA, 20 nt, Bordetella pertussis
ggcgcuuggcccugcagcgg

SEQ ID NO: 360780 - RNA, 22 nt, Bordetella pertussis
ggcggaucgaacgccucgggcg

SEQ ID NO: 360781 - RNA, 23 nt, Bordetella pertussis
ggcggaucgccgaagucggcgcg

SEQ ID NO: 360782 - RNA, 15 nt, Bordetella pertussis
ggcggaucucggcca

SEQ ID NO: 360783 - RNA, 18 nt, Bordetella pertussis
ggcggaucucggccagca

SEQ ID NO: 360784 - RNA, 21 nt, Bordetella pertussis
ggcggaucucggccagcagcg

SEQ ID NO: 360785 - RNA, 23 nt, Bordetella pertussis
ggcggaucucggccagcagcgcc

SEQ ID NO: 360786 - RNA, 20 nt, Bordetella pertussis
ggcggaucuucccgccaugg

SEQ ID NO: 360787 - RNA, 15 nt, Bordetella pertussis
ggcggauucaggcga

SEQ ID NO: 360788 - RNA, 18 nt, Bordetella pertussis
ggcggauuugcucgcguc

SEQ ID NO: 360789 - RNA, 23 nt, Bordetella pertussis
ggcggcaaaaaaaaccgcgcgcc

SEQ ID NO: 360790 - RNA, 15 nt, Bordetella pertussis
ggcggcagaaggcga

SEQ ID NO: 360791 - RNA, 20 nt, Bordetella pertussis
ggcggcagaaggcgacaucg

SEQ ID NO: 360792 - RNA, 16 nt, Bordetella pertussis
ggcggcagcaggcgcg

SEQ ID NO: 360793 - RNA, 17 nt, Bordetella pertussis
ggcggcagccggccaug

SEQ ID NO: 360794 - RNA, 18 nt, Bordetella pertussis
ggcggcagccggccaugg

SEQ ID NO: 360795 - RNA, 23 nt, Bordetella pertussis
ggcggcagccggccauggccgcc

SEQ ID NO: 360796 - RNA, 18 nt, Bordetella pertussis
ggcggcagcuugaccgcc

SEQ ID NO: 360797 - RNA, 13 nt, Bordetella pertussis
ggcggcaggcgcc

SEQ ID NO: 360798 - RNA, 14 nt, Bordetella pertussis
ggcggcaggcgccg

SEQ ID NO: 360799 - RNA, 13 nt, Bordetella pertussis
ggcggcaggucgc

SEQ ID NO: 360800 - RNA, 19 nt, Bordetella pertussis
ggcggcaggucgcgcgacg

SEQ ID NO: 360801 - RNA, 22 nt, Bordetella pertussis
ggcggcaggugcgccagcacgg

SEQ ID NO: 360802 - RNA, 16 nt, Bordetella pertussis
ggcggccaucgccaug

SEQ ID NO: 360803 - RNA, 18 nt, Bordetella pertussis
ggcggccaucgccauggc

SEQ ID NO: 360804 - RNA, 21 nt, Bordetella pertussis
ggcggccaucgccgccacgug

SEQ ID NO: 360805 - RNA, 18 nt, Bordetella pertussis
ggcggccaucuuggugcg

SEQ ID NO: 360806 - RNA, 23 nt, Bordetella pertussis
ggcggccaugccgucaccggcua

SEQ ID NO: 360807 - RNA, 17 nt, Bordetella pertussis
ggcggcccacagcgccc

SEQ ID NO: 360808 - RNA, 14 nt, Bordetella pertussis
ggcggcccagcgug

SEQ ID NO: 360809 - RNA, 14 nt, Bordetella pertussis
ggcggcccaggcgu

SEQ ID NO: 360810 - RNA, 18 nt, Bordetella pertussis
ggcggcccauucgcgcac

SEQ ID NO: 360811 - RNA, 21 nt, Bordetella pertussis
ggcggcccggccgccgccggc

SEQ ID NO: 360812 - RNA, 23 nt, Bordetella pertussis
ggcggccgacagcuugcgcuggc

SEQ ID NO: 360813 - RNA, 18 nt, Bordetella pertussis
ggcggccgacgggcggcu

SEQ ID NO: 360814 - RNA, 23 nt, Bordetella pertussis
ggcggccgacgggcggcugcugg

SEQ ID NO: 360815 - RNA, 15 nt, Bordetella pertussis
ggcggccgaagcgca

SEQ ID NO: 360816 - RNA, 19 nt, Bordetella pertussis
ggcggccgccagcgccaug

SEQ ID NO: 360817 - RNA, 15 nt, Bordetella pertussis
ggcggccgcgggcgg

SEQ ID NO: 360818 - RNA, 16 nt, Bordetella pertussis
ggcggccgcgggcggc

SEQ ID NO: 360819 - RNA, 18 nt, Bordetella pertussis
ggcggccgcgggcgugcu

SEQ ID NO: 360820 - RNA, 16 nt, Bordetella pertussis
ggcggccuggccgcgc

SEQ ID NO: 360821 - RNA, 19 nt, Bordetella pertussis
ggcggccuggccgcgcgcc

SEQ ID NO: 360822 - RNA, 20 nt, Bordetella pertussis
ggcggccuggccgcgcgccu

SEQ ID NO: 360823 - RNA, 22 nt, Bordetella pertussis
ggcggccuggccgcgcgccugc

SEQ ID NO: 360824 - RNA, 16 nt, Bordetella pertussis
ggcggccugggccaug

SEQ ID NO: 360825 - RNA, 18 nt, Bordetella pertussis
ggcggccugggcgggccg

SEQ ID NO: 360826 - RNA, 22 nt, Bordetella pertussis
ggcggccuucaugaucuggccg

SEQ ID NO: 360827 - RNA, 17 nt, Bordetella pertussis
ggcggccuugcgggccg

SEQ ID NO: 360828 - RNA, 20 nt, Bordetella pertussis
ggcggccuugcgggccggcu

SEQ ID NO: 360829 - RNA, 16 nt, Bordetella pertussis
ggcggccuuggccgca

SEQ ID NO: 360830 - RNA, 16 nt, Bordetella pertussis
ggcggcgagcgcggcg

SEQ ID NO: 360831 - RNA, 18 nt, Bordetella pertussis
ggcggcgagcgcggcgcg

SEQ ID NO: 360832 - RNA, 16 nt, Bordetella pertussis
ggcggcgagcuggccc

SEQ ID NO: 360833 - RNA, 21 nt, Bordetella pertussis
ggcggcgagcuggcccugggc

SEQ ID NO: 360834 - RNA, 22 nt, Bordetella pertussis
ggcggcgaucucgcgcgcgcgg

SEQ ID NO: 360835 - RNA, 19 nt, Bordetella pertussis
ggcggcgcagcaccaggcu

SEQ ID NO: 360836 - RNA, 22 nt, Bordetella pertussis
ggcggcgcagcauuucggcgcc

SEQ ID NO: 360837 - RNA, 14 nt, Bordetella pertussis
ggcggcgcagcgcc

SEQ ID NO: 360838 - RNA, 21 nt, Bordetella pertussis
ggcggcgcaggaugcgcuggc

SEQ ID NO: 360839 - RNA, 18 nt, Bordetella pertussis
ggcggcgcaucagcgcgc

SEQ ID NO: 360840 - RNA, 13 nt, Bordetella pertussis
ggcggcgccagcg

SEQ ID NO: 360841 - RNA, 14 nt, Bordetella pertussis
ggcggcgccagcgg

SEQ ID NO: 360842 - RNA, 14 nt, Bordetella pertussis
ggcggcgcccauca

SEQ ID NO: 360843 - RNA, 15 nt, Bordetella pertussis
ggcggcggcgguggu

SEQ ID NO: 360844 - RNA, 12 nt, Bordetella pertussis
ggcggcggcguc

SEQ ID NO: 360845 - RNA, 12 nt, Bordetella pertussis
ggcggcggcguu

SEQ ID NO: 360846 - RNA, 13 nt, Bordetella pertussis
ggcggcgggcugc

SEQ ID NO: 360847 - RNA, 13 nt, Bordetella pertussis
ggcggcggguggc

SEQ ID NO: 360848 - RNA, 21 nt, Bordetella pertussis
ggcggcgguagcgcucgucca

SEQ ID NO: 360849 - RNA, 15 nt, Bordetella pertussis
ggcggcguagagcgc

SEQ ID NO: 360850 - RNA, 13 nt, Bordetella pertussis
ggcggcgucgccg

SEQ ID NO: 360851 - RNA, 12 nt, Bordetella pertussis
ggcggcugccag

SEQ ID NO: 360852 - RNA, 14 nt, Bordetella pertussis
ggcggcugccagug

SEQ ID NO: 360853 - RNA, 12 nt, Bordetella pertussis
ggcggcugccca

SEQ ID NO: 360854 - RNA, 13 nt, Bordetella pertussis
ggcggcuggcgcg

SEQ ID NO: 360855 - RNA, 22 nt, Bordetella pertussis
ggcggcuggugccgacggcgcg

SEQ ID NO: 360856 - RNA, 21 nt, Bordetella pertussis
ggcggcugucgggcggcgccu

SEQ ID NO: 360857 - RNA, 16 nt, Bordetella pertussis
ggcggcuucaggcgcg

SEQ ID NO: 360858 - RNA, 22 nt, Bordetella pertussis
ggcggcuugccgucgaccgcga

SEQ ID NO: 360859 - RNA, 15 nt, Bordetella pertussis
ggcggcuuucauggg

SEQ ID NO: 360860 - RNA, 17 nt, Bordetella pertussis
ggcgggcaucgcccacc

SEQ ID NO: 360861 - RNA, 18 nt, Bordetella pertussis
ggcgggcaucgcccacca

SEQ ID NO: 360862 - RNA, 20 nt, Bordetella pertussis
ggcgggcaucgcccaccaug

SEQ ID NO: 360863 - RNA, 19 nt, Bordetella pertussis
ggcgggcaugacgaccgcg

SEQ ID NO: 360864 - RNA, 13 nt, Bordetella pertussis
ggcgggccgaggc

SEQ ID NO: 360865 - RNA, 13 nt, Bordetella pertussis
ggcgggccgcaug

SEQ ID NO: 360866 - RNA, 13 nt, Bordetella pertussis
ggcgggccgcgcc

SEQ ID NO: 360867 - RNA, 16 nt, Bordetella pertussis
ggcgggccgcgccgcg

SEQ ID NO: 360868 - RNA, 12 nt, Bordetella pertussis
ggcgggccgcgc

SEQ ID NO: 360869 - RNA, 17 nt, Bordetella pertussis
ggcgggccggcucggcg

SEQ ID NO: 360870 - RNA, 15 nt, Bordetella pertussis
ggcgggcgacauugc

SEQ ID NO: 360871 - RNA, 15 nt, Bordetella pertussis
ggcgggcgagaucag

SEQ ID NO: 360872 - RNA, 20 nt, Bordetella pertussis
ggcgggcgccccgaucggcg

SEQ ID NO: 360873 - RNA, 14 nt, Bordetella pertussis
ggcguccaggcgcg

SEQ ID NO: 360874 - RNA, 19 nt, Bordetella pertussis
ggcguccaggcgcgccagc

SEQ ID NO: 360875 - RNA, 12 nt, Bordetella pertussis
ggcguccaugcu

SEQ ID NO: 360876 - RNA, 14 nt, Bordetella pertussis
ggcgucccaggcca

SEQ ID NO: 360877 - RNA, 16 nt, Bordetella pertussis
ggcgucccaggccacg

SEQ ID NO: 360878 - RNA, 16 nt, Bordetella pertussis
ggcguccgcgucgccg

SEQ ID NO: 360879 - RNA, 13 nt, Bordetella pertussis
ggcguccucgcgg

SEQ ID NO: 360880 - RNA, 18 nt, Bordetella pertussis
ggcgucgaaacgcugcgc

SEQ ID NO: 360881 - RNA, 23 nt, Bordetella pertussis
ggcgucgaaacgcugcgcgaugc

SEQ ID NO: 360882 - RNA, 16 nt, Bordetella pertussis
ggcgucgaaggccgcc

SEQ ID NO: 360883 - RNA, 18 nt, Bordetella pertussis
ggcgucgaaggcggccgg

SEQ ID NO: 360884 - RNA, 20 nt, Bordetella pertussis
ggcgucgaaggcggccggca

SEQ ID NO: 360885 - RNA, 22 nt, Bordetella pertussis
ggcgucgaagguuucgcugcgc

SEQ ID NO: 360886 - RNA, 17 nt, Bordetella pertussis
ggcgucgaccgccaugc

SEQ ID NO: 360887 - RNA, 14 nt, Bordetella pertussis
ggcgucgacgcccg

SEQ ID NO: 360888 - RNA, 19 nt, Bordetella pertussis
ggcgucgacgcccgcgccc

SEQ ID NO: 360889 - RNA, 14 nt, Bordetella pertussis
ggcgucgagcacgc

SEQ ID NO: 360890 - RNA, 15 nt, Bordetella pertussis
ggcgucgagcacgcg

SEQ ID NO: 360891 - RNA, 23 nt, Bordetella pertussis
ggcgucgagcacgcggcgcggca

SEQ ID NO: 360892 - RNA, 13 nt, Bordetella pertussis
ggcgucgagcggc

SEQ ID NO: 360893 - RNA, 22 nt, Bordetella pertussis
ggcgucgaucuucgccugcaug

SEQ ID NO: 360894 - RNA, 13 nt, Bordetella pertussis
ggcgucgaugcgc

SEQ ID NO: 360895 - RNA, 21 nt, Bordetella pertussis
ggcgucgaugcgcgcgcggau

SEQ ID NO: 360896 - RNA, 14 nt, Bordetella pertussis
ggcgucgccggcca

SEQ ID NO: 360897 - RNA, 15 nt, Bordetella pertussis
ggcgucgccggccag

SEQ ID NO: 360898 - RNA, 15 nt, Bordetella pertussis
ggcgucgcggcguau

SEQ ID NO: 360899 - RNA, 17 nt, Bordetella pertussis
ggcgucgcugcuggcgg

SEQ ID NO: 360900 - RNA, 18 nt, Bordetella pertussis
ggcgucgcugcuggcggc

SEQ ID NO: 360901 - RNA, 17 nt, Bordetella pertussis
ggcgucgcuggcagccu

SEQ ID NO: 360902 - RNA, 18 nt, Bordetella pertussis
ggcgucgcuggcagccuu

SEQ ID NO: 360903 - RNA, 18 nt, Bordetella pertussis
ggcgucgcucugcgcggc

SEQ ID NO: 360904 - RNA, 19 nt, Bordetella pertussis
ggcgucgcucugcgcggca

SEQ ID NO: 360905 - RNA, 17 nt, Bordetella pertussis
ggcgucggccagcgcga

SEQ ID NO: 360906 - RNA, 15 nt, Bordetella pertussis
ggcgucggccauggc

SEQ ID NO: 360907 - RNA, 20 nt, Bordetella pertussis
ggcgucggccauggcgcugu

SEQ ID NO: 360908 - RNA, 14 nt, Bordetella pertussis
ggcgucggccgccg

SEQ ID NO: 360909 - RNA, 18 nt, Bordetella pertussis
ggcgucggccugguccgc

SEQ ID NO: 360910 - RNA, 21 nt, Bordetella pertussis
ggcgucggccugguccgccgc

SEQ ID NO: 360911 - RNA, 17 nt, Bordetella pertussis
ggcgucggcggcccaca

SEQ ID NO: 360912 - RNA, 16 nt, Bordetella pertussis
ggcgucggcgcccggc

SEQ ID NO: 360913 - RNA, 17 nt, Bordetella pertussis
ggcgucgggggcggccg

SEQ ID NO: 360914 - RNA, 23 nt, Bordetella pertussis
ggcgucgggguucuccuugagca

SEQ ID NO: 360915 - RNA, 17 nt, Bordetella pertussis
ggcgucguccguggccg

SEQ ID NO: 360916 - RNA, 20 nt, Bordetella pertussis
ggcgucguccguggccggcg

SEQ ID NO: 360917 - RNA, 22 nt, Bordetella pertussis
ggcgucguccguggccggcgcg

SEQ ID NO: 360918 - RNA, 23 nt, Bordetella pertussis
ggcgucguccguggccggcgcgg

SEQ ID NO: 360919 - RNA, 14 nt, Bordetella pertussis
ggcgucgucgccgu

SEQ ID NO: 360920 - RNA, 20 nt, Bordetella pertussis
ggcgucgucgcgguccagca

SEQ ID NO: 360921 - RNA, 12 nt, Bordetella pertussis
ggcgucguuggc

SEQ ID NO: 360922 - RNA, 17 nt, Bordetella pertussis
ggcgucguuggccgcgu

SEQ ID NO: 360923 - RNA, 21 nt, Bordetella pertussis
ggcgucucggaaaacuggcgg

SEQ ID NO: 360924 - RNA, 13 nt, Bordetella pertussis
ggcgucugcucgc

SEQ ID NO: 360925 - RNA, 16 nt, Bordetella pertussis
ggcgucugguacaaca

SEQ ID NO: 360926 - RNA, 16 nt, Bordetella pertussis
ggcgucuucgccgacc

SEQ ID NO: 360927 - RNA, 16 nt, Bordetella pertussis
ggcgugacgcgcgggu

SEQ ID NO: 360928 - RNA, 15 nt, Bordetella pertussis
ggcgugacguggccc

SEQ ID NO: 360929 - RNA, 13 nt, Bordetella pertussis
ggcgugagcgcca

SEQ ID NO: 360930 - RNA, 14 nt, Bordetella pertussis
ggcgugagcgccac

SEQ ID NO: 360931 - RNA, 17 nt, Bordetella pertussis
ggcgugaugccgaccag

SEQ ID NO: 360932 - RNA, 22 nt, Bordetella pertussis
ggcgugaugccgaccaggcccg

SEQ ID NO: 360933 - RNA, 21 nt, Bordetella pertussis
ggcgugcagcaagcccaccgg

SEQ ID NO: 360934 - RNA, 15 nt, Bordetella pertussis
ggcgugcaggccggc

SEQ ID NO: 360935 - RNA, 19 nt, Bordetella pertussis
ggcgugcagguacgccaug

SEQ ID NO: 360936 - RNA, 22 nt, Bordetella pertussis
ggcgugcagguacgccaugcga

SEQ ID NO: 360937 - RNA, 19 nt, Bordetella pertussis
ggcgugcagguacugggcc

SEQ ID NO: 360938 - RNA, 14 nt, Bordetella pertussis
ggcgugccaggugu

SEQ ID NO: 360939 - RNA, 22 nt, Bordetella pertussis
ggcgugcccugcggcgcggcca

SEQ ID NO: 360940 - RNA, 23 nt, Bordetella pertussis
ggcgugccgcgcugggcgcugcu

SEQ ID NO: 360941 - RNA, 13 nt, Bordetella pertussis
ggcgugcgccugc

SEQ ID NO: 360942 - RNA, 13 nt, Bordetella pertussis
ggcgugcgcgacc

SEQ ID NO: 360943 - RNA, 17 nt, Bordetella pertussis
ggcgugcgcgagcuggu

SEQ ID NO: 360944 - RNA, 13 nt, Bordetella pertussis
ggcgugcgcuggc

SEQ ID NO: 360945 - RNA, 19 nt, Bordetella pertussis
ggcgugcgcuggcugggcc

SEQ ID NO: 360946 - RNA, 20 nt, Bordetella pertussis
ggcgugcgcuugcgcauggc

SEQ ID NO: 360947 - RNA, 18 nt, Bordetella pertussis
ggcgugcggcccagccgc

SEQ ID NO: 360948 - RNA, 22 nt, Bordetella pertussis
ggcgugcugcgcguggccauca

SEQ ID NO: 360949 - RNA, 20 nt, Bordetella pertussis
ggcgugcugcggcugaucac

SEQ ID NO: 360950 - RNA, 20 nt, Bordetella pertussis
ggcguggcaggugcggccgc

SEQ ID NO: 360951 - RNA, 21 nt, Bordetella pertussis
ggcguggcgccgaaggcggcg

SEQ ID NO: 360952 - RNA, 15 nt, Bordetella pertussis
ggcguggcgcgcaac

SEQ ID NO: 360953 - RNA, 14 nt, Bordetella pertussis
ggcguggcgcgcac

SEQ ID NO: 360954 - RNA, 15 nt, Bordetella pertussis
ggcguggcgcgcaca

SEQ ID NO: 360955 - RNA, 15 nt, Bordetella pertussis
ggcguggcgcgcccg

SEQ ID NO: 360956 - RNA, 15 nt, Bordetella pertussis
ggcguggcgcgcgcc

SEQ ID NO: 360957 - RNA, 13 nt, Bordetella pertussis
ggcguggcggggc

SEQ ID NO: 360958 - RNA, 18 nt, Bordetella pertussis
ggcguggcggggcguucg

SEQ ID NO: 360959 - RNA, 13 nt, Bordetella pertussis
ggcguggcuggcg

SEQ ID NO: 360960 - RNA, 20 nt, Bordetella pertussis
ggcguggggagcgcggcccg

SEQ ID NO: 360961 - RNA, 16 nt, Bordetella pertussis
ggcguggggccggccg

SEQ ID NO: 360962 - RNA, 15 nt, Bordetella pertussis
ggcgugguaucgcgc

SEQ ID NO: 360963 - RNA, 23 nt, Bordetella pertussis
ggcguggucaucgauggccacga

SEQ ID NO: 360964 - RNA, 16 nt, Bordetella pertussis
ggcguggugcugacgg

SEQ ID NO: 360965 - RNA, 17 nt, Bordetella pertussis
ggcguguccagcggcgc

SEQ ID NO: 360966 - RNA, 18 nt, Bordetella pertussis
ggcguguccagcggcgcc

SEQ ID NO: 360967 - RNA, 19 nt, Bordetella pertussis
ggcgugucuccgggcggga

SEQ ID NO: 360968 - RNA, 23 nt, Bordetella pertussis
ggcguucaccaggaagcgcgccu

SEQ ID NO: 360969 - RNA, 14 nt, Bordetella pertussis
ggcguucggcaccg

SEQ ID NO: 360970 - RNA, 18 nt, Bordetella pertussis
ggcguucggcaccggcag

SEQ ID NO: 360971 - RNA, 20 nt, Bordetella pertussis
ggcguucucguugggaugga

SEQ ID NO: 360972 - RNA, 18 nt, Bordetella pertussis
ggcguucugcagcgcggu

SEQ ID NO: 360973 - RNA, 20 nt, Bordetella pertussis
ggcguugaccuggucgggcg

SEQ ID NO: 360974 - RNA, 16 nt, Bordetella pertussis
ggcguugccggccuga

SEQ ID NO: 360975 - RNA, 20 nt, Bordetella pertussis
ggcguugccgaagcgucggc

SEQ ID NO: 360976 - RNA, 18 nt, Bordetella pertussis
ggcguugcggcagcggcc

SEQ ID NO: 360977 - RNA, 17 nt, Bordetella pertussis
ggcguuggccgggucgc

SEQ ID NO: 360978 - RNA, 17 nt, Bordetella pertussis
ggcguugugccggcgca

SEQ ID NO: 360979 - RNA, 22 nt, Bordetella pertussis
ggcguuugcccuucgcggcugg

SEQ ID NO: 360980 - RNA, 16 nt, Bordetella pertussis
ggcguuugcgcgcgcg

SEQ ID NO: 360981 - RNA, 16 nt, Bordetella pertussis
ggcguuuuccagcauc

SEQ ID NO: 360982 - RNA, 15 nt, Bordetella pertussis
ggcuacgacccgcug

SEQ ID NO: 360983 - RNA, 17 nt, Bordetella pertussis
ggcuaucguggcuggcg

SEQ ID NO: 360984 - RNA, 12 nt, Bordetella pertussis
ggcucagcccgg

SEQ ID NO: 360985 - RNA, 12 nt, Bordetella pertussis
ggcucaggccag

SEQ ID NO: 360986 - RNA, 13 nt, Bordetella pertussis
ggcucaggccagc

SEQ ID NO: 360987 - RNA, 17 nt, Bordetella pertussis
ggcucaggccagcgacc

SEQ ID NO: 360988 - RNA, 21 nt, Bordetella pertussis
ggcucaggcugcgcgucggca

SEQ ID NO: 360989 - RNA, 21 nt, Bordetella pertussis
ggcucaugguuucgagcauca

SEQ ID NO: 360990 - RNA, 18 nt, Bordetella pertussis
ggcuccagcucagcagcg

SEQ ID NO: 360991 - RNA, 23 nt, Bordetella pertussis
ggcuccagcucagcagcgccagg

SEQ ID NO: 360992 - RNA, 14 nt, Bordetella pertussis
ggcucccaccggug

SEQ ID NO: 360993 - RNA, 22 nt, Bordetella pertussis
ggcuccaggcugagcgugacgu

SEQ ID NO: 360994 - RNA, 20 nt, Bordetella pertussis
ggcuccgauagcggcgccgc

SEQ ID NO: 360995 - RNA, 21 nt, Bordetella pertussis
ggcuccgauagcggcgccgcu

SEQ ID NO: 360996 - RNA, 14 nt, Bordetella pertussis
ggcuccgccauugc

SEQ ID NO: 360997 - RNA, 21 nt, Bordetella pertussis
ggcuccggucguggccagcgu

SEQ ID NO: 360998 - RNA, 21 nt, Bordetella pertussis
ggcuccucgcccgaccugcug

SEQ ID NO: 360999 - RNA, 13 nt, Bordetella pertussis
ggcucgaccgccg

SEQ ID NO: 361000 - RNA, 14 nt, Bordetella pertussis
ggcucgaccgccgc

SEQ ID NO: 361001 - RNA, 15 nt, Bordetella pertussis
ggcucgagcggcagc

SEQ ID NO: 361002 - RNA, 18 nt, Bordetella pertussis
ggcucgagcggcagcagc

SEQ ID NO: 361003 - RNA, 20 nt, Bordetella pertussis
ggcucgagcaagggccagac

SEQ ID NO: 361004 - RNA, 21 nt, Bordetella pertussis
ggcucgagcuggcuggccagc

SEQ ID NO: 361005 - RNA, 16 nt, Bordetella pertussis
ggcucgccggccgcgc

SEQ ID NO: 361006 - RNA, 21 nt, Bordetella pertussis
ggcucgccggccgcgcccagc

SEQ ID NO: 361007 - RNA, 21 nt, Bordetella pertussis
ggcucgcgcgcgcgggcgcgc

SEQ ID NO: 361008 - RNA, 24 nt, Bordetella pertussis
ggcucgcgcgcgcgggcgcgcagc

SEQ ID NO: 361009 - RNA, 17 nt, Bordetella pertussis
ggcucgcugaccggcgu

SEQ ID NO: 361010 - RNA, 18 nt, Bordetella pertussis
ggcucggaccuggccagc

SEQ ID NO: 361011 - RNA, 20 nt, Bordetella pertussis
ggcucggaccuggccagcgu

SEQ ID NO: 361012 - RNA, 17 nt, Bordetella pertussis
ggcucggccaccaugcg

SEQ ID NO: 361013 - RNA, 22 nt, Bordetella pertussis
ggcucggccaggugcgccaugc

SEQ ID NO: 361014 - RNA, 16 nt, Bordetella pertussis
ggcucggcgccggcgg

SEQ ID NO: 361015 - RNA, 16 nt, Bordetella pertussis
ggcucggucucgccca

SEQ ID NO: 361016 - RNA, 15 nt, Bordetella pertussis
ggcucguaggcgagg

SEQ ID NO: 361017 - RNA, 13 nt, Bordetella pertussis
ggcucgucgaaca

SEQ ID NO: 361018 - RNA, 15 nt, Bordetella pertussis
ggcucgugcagcagg

SEQ ID NO: 361019 - RNA, 18 nt, Bordetella pertussis
ggcucgugcagcaggggc

SEQ ID NO: 361020 - RNA, 22 nt, Bordetella pertussis
ggcucguacggcgucgggcagu

SEQ ID NO: 361021 - RNA, 17 nt, Bordetella pertussis
ggcucguucgcucggcg

SEQ ID NO: 361022 - RNA, 16 nt, Bordetella pertussis
ggcucuccgugcaucg

SEQ ID NO: 361023 - RNA, 12 nt, Bordetella pertussis
ggcucugaucgc

SEQ ID NO: 361024 - RNA, 17 nt, Bordetella pertussis
ggcucuggcugacgaug

SEQ ID NO: 361025 - RNA, 18 nt, Bordetella pertussis
ggcucuuuuucccggcgc

SEQ ID NO: 361026 - RNA, 20 nt, Bordetella pertussis
ggcugaagaagcccggcugc

SEQ ID NO: 361027 - RNA, 15 nt, Bordetella pertussis
ggcugaauuggcgcc

SEQ ID NO: 361028 - RNA, 21 nt, Bordetella pertussis
ggcugaauuggcgcccaucgc

SEQ ID NO: 361029 - RNA, 22 nt, Bordetella pertussis
ggcugacaccguuuuggcaggc

SEQ ID NO: 361030 - RNA, 18 nt, Bordetella pertussis
ggcugaccagcgcgucgc

SEQ ID NO: 361031 - RNA, 15 nt, Bordetella pertussis
ggcugacgcccggcu

SEQ ID NO: 361032 - RNA, 17 nt, Bordetella pertussis
ggcugagcaggccgaua

SEQ ID NO: 361033 - RNA, 21 nt, Bordetella pertussis
ggcugagccauuccggcuggu

SEQ ID NO: 361034 - RNA, 21 nt, Bordetella pertussis
ggcugaucacccacagcagcg

SEQ ID NO: 361035 - RNA, 16 nt, Bordetella pertussis
ggcugauccgcaccgg

SEQ ID NO: 361036 - RNA, 21 nt, Bordetella pertussis
ggcugcaagacgcccaggccc

SEQ ID NO: 361037 - RNA, 22 nt, Bordetella pertussis
ggcugcaagucuucuucagcau

SEQ ID NO: 361038 - RNA, 15 nt, Bordetella pertussis
ggcugcaccugccug

SEQ ID NO: 361039 - RNA, 22 nt, Bordetella pertussis
ggcugcacgauguugccgccgg

SEQ ID NO: 361040 - RNA, 12 nt, Bordetella pertussis
ggcugcagccag

SEQ ID NO: 361041 - RNA, 18 nt, Bordetella pertussis
ggcugcagcuugcgcgcc

SEQ ID NO: 361042 - RNA, 21 nt, Bordetella pertussis
ggcugcagcuugcgcgccagu

SEQ ID NO: 361043 - RNA, 14 nt, Bordetella pertussis
ggcugcaugcgcga

SEQ ID NO: 361044 - RNA, 21 nt, Bordetella pertussis
ggcugcaugcgcgaacgcgcg

SEQ ID NO: 361045 - RNA, 24 nt, Bordetella pertussis
ggcugcaugcgcgaacgcgcgccg

SEQ ID NO: 361046 - RNA, 15 nt, Bordetella pertussis
ggcugcccucgcccg

SEQ ID NO: 361047 - RNA, 22 nt, Bordetella pertussis
ggcugcccucgcccgugcgcgg

SEQ ID NO: 361048 - RNA, 22 nt, Bordetella pertussis
ggcugcccucggucagcgccag

SEQ ID NO: 361049 - RNA, 14 nt, Bordetella pertussis
ggcugcccuggcgc

SEQ ID NO: 361050 - RNA, 22 nt, Bordetella pertussis
ggcugccgauacgggcgcggcg

SEQ ID NO: 361051 - RNA, 14 nt, Bordetella pertussis
ggcugccgccggcg

SEQ ID NO: 361052 - RNA, 20 nt, Bordetella pertussis
ggcugccgcggauugccguc

SEQ ID NO: 361053 - RNA, 20 nt, Bordetella pertussis
ggcugccggcguuggccggg

SEQ ID NO: 361054 - RNA, 15 nt, Bordetella pertussis
ggcugccgucggcca

SEQ ID NO: 361055 - RNA, 16 nt, Bordetella pertussis
ggcugccgucggccag

SEQ ID NO: 361056 - RNA, 17 nt, Bordetella pertussis
ggcugcgaaaggccgag

SEQ ID NO: 361057 - RNA, 15 nt, Bordetella pertussis
ggcugcgcaggcgcc

SEQ ID NO: 361058 - RNA, 16 nt, Bordetella pertussis
ggcugcgcaggcgccg

SEQ ID NO: 361059 - RNA, 17 nt, Bordetella pertussis
ggcugcgaugcgggccu

SEQ ID NO: 361060 - RNA, 11 nt, Bordetella pertussis
ggcugcgcgcc

SEQ ID NO: 361061 - RNA, 13 nt, Bordetella pertussis
ggcugcgcgccga

SEQ ID NO: 361062 - RNA, 12 nt, Bordetella pertussis
ggcugcgcgcgc

SEQ ID NO: 361063 - RNA, 15 nt, Bordetella pertussis
ggcugcgcgcgccag

SEQ ID NO: 361064 - RNA, 15 nt, Bordetella pertussis
ggcugcgcgucggca

SEQ ID NO: 361065 - RNA, 12 nt, Bordetella pertussis
ggcugcgcggcc

SEQ ID NO: 361066 - RNA, 17 nt, Bordetella pertussis
ggcugcgcggccgagcg

SEQ ID NO: 361067 - RNA, 19 nt, Bordetella pertussis
ggcugcgcggguccggcgu

SEQ ID NO: 361068 - RNA, 13 nt, Bordetella pertussis
ggcugcggcggau

SEQ ID NO: 361069 - RNA, 17 nt, Bordetella pertussis
ggcugcggcguggcgcc

SEQ ID NO: 361070 - RNA, 19 nt, Bordetella pertussis
ggcugcggcguggcgccga

SEQ ID NO: 361071 - RNA, 21 nt, Bordetella pertussis
ggcugcggcuccugcuggcgc

SEQ ID NO: 361072 - RNA, 15 nt, Bordetella pertussis
ggcugcgggccggcg

SEQ ID NO: 361073 - RNA, 17 nt, Bordetella pertussis
ggcugcgggccggcgcc

SEQ ID NO: 361074 - RNA, 19 nt, Bordetella pertussis
ggcugcgugcgggacaggc

SEQ ID NO: 361075 - RNA, 19 nt, Bordetella pertussis
ggcugcucguucugcgcgc

SEQ ID NO: 361076 - RNA, 21 nt, Bordetella pertussis
ggcugcucguucugcgcgccc

SEQ ID NO: 361077 - RNA, 19 nt, Bordetella pertussis
ggcugcugcacgcgcgcgg

SEQ ID NO: 361078 - RNA, 22 nt, Bordetella pertussis
ggcugcugcacgcgcgcgggcg

SEQ ID NO: 361079 - RNA, 13 nt, Bordetella pertussis
ggcugcuggccca

SEQ ID NO: 361080 - RNA, 16 nt, Bordetella pertussis
ggcugcugggcaugga

SEQ ID NO: 361081 - RNA, 13 nt, Bordetella pertussis
ggcugcuugccca

SEQ ID NO: 361082 - RNA, 17 nt, Bordetella pertussis
ggcugcuugcccagcgg

SEQ ID NO: 361083 - RNA, 16 nt, Bordetella pertussis
ggcuggacgcgcgcgg

SEQ ID NO: 361084 - RNA, 20 nt, Bordetella pertussis
ggcuggacgcgcgcggcgac

SEQ ID NO: 361085 - RNA, 22 nt, Bordetella pertussis
ggcuggacgcgcgcggcgaccg

SEQ ID NO: 361086 - RNA, 16 nt, Bordetella pertussis
ggcuggauccggcgcu

SEQ ID NO: 361087 - RNA, 22 nt, Bordetella pertussis
ggcuggcauugagggcguacga

SEQ ID NO: 361088 - RNA, 18 nt, Bordetella pertussis
ggcuggccacuggccgcg

SEQ ID NO: 361089 - RNA, 22 nt, Bordetella pertussis
ggcuggccagcggggccgugac

SEQ ID NO: 361090 - RNA, 21 nt, Bordetella pertussis
ggcuggccagcuggcggcgca

SEQ ID NO: 361091 - RNA, 11 nt, Bordetella pertussis
ggcuggccgag

SEQ ID NO: 361092 - RNA, 16 nt, Bordetella pertussis
ggcuggccggccaaca

SEQ ID NO: 361093 - RNA, 12 nt, Bordetella pertussis
ggcuggccgccg

SEQ ID NO: 361094 - RNA, 14 nt, Bordetella pertussis
ggcuggccgccgcg

SEQ ID NO: 361095 - RNA, 14 nt, Bordetella pertussis
ggcuggccgccugc

SEQ ID NO: 361096 - RNA, 13 nt, Bordetella pertussis
ggcuggcgcacga

SEQ ID NO: 361097 - RNA, 13 nt, Bordetella pertussis
ggcuggcgcacgu

SEQ ID NO: 361098 - RNA, 20 nt, Bordetella pertussis
ggcuggcggugcgugcgccc

SEQ ID NO: 361099 - RNA, 18 nt, Bordetella pertussis
ggcuggcugggcgcgccg

SEQ ID NO: 361100 - RNA, 16 nt, Bordetella pertussis
ggcugggagagccggc

SEQ ID NO: 361101 - RNA, 21 nt, Bordetella pertussis
ggcuggggcaggcacuggcgc

SEQ ID NO: 361102 - RNA, 15 nt, Bordetella pertussis
ggcuggggccgagcg

SEQ ID NO: 361103 - RNA, 17 nt, Bordetella pertussis
ggcugggucggcgugac

SEQ ID NO: 361104 - RNA, 23 nt, Bordetella pertussis
ggcuggucagccuggggcaggcg

SEQ ID NO: 361105 - RNA, 19 nt, Bordetella pertussis
ggcuggucuucgagcgcga

SEQ ID NO: 361106 - RNA, 15 nt, Bordetella pertussis
ggcuggugccgacgg

SEQ ID NO: 361107 - RNA, 17 nt, Bordetella pertussis
ggcuggugcgccgugcc

SEQ ID NO: 361108 - RNA, 22 nt, Bordetella pertussis
ggcuggugcgccgugcccggcg

SEQ ID NO: 361109 - RNA, 14 nt, Bordetella pertussis
ggcugguggcgucg

SEQ ID NO: 361110 - RNA, 15 nt, Bordetella pertussis
ggcugguggugggcg

SEQ ID NO: 361111 - RNA, 18 nt, Bordetella pertussis
ggcuguaccuggcgaucg

SEQ ID NO: 361112 - RNA, 21 nt, Bordetella pertussis
ggcuguauagaugcgcggggc

SEQ ID NO: 361113 - RNA, 15 nt, Bordetella pertussis
ggcuguccccgcaug

SEQ ID NO: 361114 - RNA, 18 nt, Bordetella pertussis
ggcugucgcaacagcccc

SEQ ID NO: 361115 - RNA, 20 nt, Bordetella pertussis
ggcugucgcagucggggccg

SEQ ID NO: 361116 - RNA, 14 nt, Bordetella pertussis
ggcugucgcgcgca

SEQ ID NO: 361117 - RNA, 17 nt, Bordetella pertussis
ggcugucgucgucggca

SEQ ID NO: 361118 - RNA, 15 nt, Bordetella pertussis
ggcugucgggcggcg

SEQ ID NO: 361119 - RNA, 21 nt, Bordetella pertussis
ggcugucgggcggcgccuggu

SEQ ID NO: 361120 - RNA, 23 nt, Bordetella pertussis
ggcuguggccgcggcccagcgcg

SEQ ID NO: 361121 - RNA, 21 nt, Bordetella pertussis
ggcuuccagcagcaugccgcg

SEQ ID NO: 361122 - RNA, 13 nt, Bordetella pertussis
ggcuuccugcacc

SEQ ID NO: 361123 - RNA, 23 nt, Bordetella pertussis
ggcuuccuggucacccggcgcau

SEQ ID NO: 361124 - RNA, 13 nt, Bordetella pertussis
ggcuuccuugcgg

SEQ ID NO: 361125 - RNA, 15 nt, Bordetella pertussis
ggcuucgaccacgcg

SEQ ID NO: 361126 - RNA, 13 nt, Bordetella pertussis
ggcuucgcgcaca

SEQ ID NO: 361127 - RNA, 16 nt, Bordetella pertussis
ggcuucgcgcagcaag

SEQ ID NO: 361128 - RNA, 12 nt, Bordetella pertussis
ggcuucggucac

SEQ ID NO: 361129 - RNA, 20 nt, Bordetella pertussis
ggcuucggucacacugggcg

SEQ ID NO: 361130 - RNA, 14 nt, Bordetella pertussis
ggcuucgucauggu

SEQ ID NO: 361131 - RNA, 14 nt, Bordetella pertussis
ggcuucgucgccgg

SEQ ID NO: 361132 - RNA, 17 nt, Bordetella pertussis
ggcuucgucgccggcgu

SEQ ID NO: 361133 - RNA, 18 nt, Bordetella pertussis
ggcuucucgaccaggcgg

SEQ ID NO: 361134 - RNA, 13 nt, Bordetella pertussis
ggcuugacgcgcg

SEQ ID NO: 361135 - RNA, 12 nt, Bordetella pertussis
ggcuugcauggu

SEQ ID NO: 361136 - RNA, 13 nt, Bordetella pertussis
ggcuugccgcgcg

SEQ ID NO: 361137 - RNA, 17 nt, Bordetella pertussis
ggcuugccgcgcggcgu

SEQ ID NO: 361138 - RNA, 16 nt, Bordetella pertussis
ggcuugccgcggcgcg

SEQ ID NO: 361139 - RNA, 19 nt, Bordetella pertussis
ggcuugccgucgaccgcga

SEQ ID NO: 361140 - RNA, 22 nt, Bordetella pertussis
ggcuugcgcaccccggugucgc

SEQ ID NO: 361141 - RNA, 17 nt, Bordetella pertussis
ggcuugcgccacgcccg

SEQ ID NO: 361142 - RNA, 17 nt, Bordetella pertussis
ggcuugcgccagccacg

SEQ ID NO: 361143 - RNA, 15 nt, Bordetella pertussis
ggcuugcggcgcugg

SEQ ID NO: 361144 - RNA, 15 nt, Bordetella pertussis
ggcuugcgcggcgcg

SEQ ID NO: 361145 - RNA, 19 nt, Bordetella pertussis
ggcuugcgcggcgcgucgc

SEQ ID NO: 361146 - RNA, 19 nt, Bordetella pertussis
ggcuuggccucggccggca

SEQ ID NO: 361147 - RNA, 16 nt, Bordetella pertussis
ggcuuggccgaacaua

SEQ ID NO: 361148 - RNA, 16 nt, Bordetella pertussis
ggcuugggcccggcgu

SEQ ID NO: 361149 - RNA, 22 nt, Bordetella pertussis
ggcuuguuuuccaucagcucga

SEQ ID NO: 361150 - RNA, 22 nt, Bordetella pertussis
ggcuuucagcgccgagcgccag

SEQ ID NO: 361151 - RNA, 20 nt, Bordetella pertussis
ggcuuucgcaauacgucgcg

SEQ ID NO: 361152 - RNA, 17 nt, Bordetella pertussis
ggcuuucgccgcgggcc

SEQ ID NO: 361153 - RNA, 22 nt, Bordetella pertussis
ggcuuucuaucaucaggcccac

SEQ ID NO: 361154 - RNA, 16 nt, Bordetella pertussis
ggcuuugcuggccaua

SEQ ID NO: 361155 - RNA, 21 nt, Bordetella pertussis
ggcuuuggcguagccggugcg

SEQ ID NO: 361156 - RNA, 15 nt, Bordetella pertussis
ggcuuuguggcgucg

SEQ ID NO: 361157 - RNA, 19 nt, Bordetella pertussis
gggaaaagccggcggccgg

SEQ ID NO: 361158 - RNA, 14 nt, Bordetella pertussis
gggaaccgcaccgg

SEQ ID NO: 361159 - RNA, 22 nt, Bordetella pertussis
gggaagauguggucggcgccga

SEQ ID NO: 361160 - RNA, 14 nt, Bordetella pertussis
gggaagccgccggc

SEQ ID NO: 361161 - RNA, 16 nt, Bordetella pertussis
gggaagcgcucgcgca

SEQ ID NO: 361162 - RNA, 18 nt, Bordetella pertussis
gggaagcgcucgucgggg

SEQ ID NO: 361163 - RNA, 13 nt, Bordetella pertussis
gggaaggccgcgc

SEQ ID NO: 361164 - RNA, 20 nt, Bordetella pertussis
gggaaggccgcgccgcggca

SEQ ID NO: 361165 - RNA, 17 nt, Bordetella pertussis
gggaaggggcggcuuca

SEQ ID NO: 361166 - RNA, 21 nt, Bordetella pertussis
gggaauccgcugcgccgaggc

SEQ ID NO: 361167 - RNA, 21 nt, Bordetella pertussis
gggacaggcacaccgugccgc

SEQ ID NO: 361168 - RNA, 17 nt, Bordetella pertussis
gggacaggcaccgccgc

SEQ ID NO: 361169 - RNA, 21 nt, Bordetella pertussis
ggggcaacgacgcaggcgccg

SEQ ID NO: 361170 - RNA, 21 nt, Bordetella pertussis
ggggcagccauccucgcccag

SEQ ID NO: 361171 - RNA, 17 nt, Bordetella pertussis
ggggcaggacgccggcg

SEQ ID NO: 361172 - RNA, 18 nt, Bordetella pertussis
ggggcaggacgccggcgc

SEQ ID NO: 361173 - RNA, 22 nt, Bordetella pertussis
ggggcaggacgccggcgccggc

SEQ ID NO: 361174 - RNA, 14 nt, Bordetella pertussis
ggggcaggccuggu

SEQ ID NO: 361175 - RNA, 13 nt, Bordetella pertussis
ggggcaggcugga

SEQ ID NO: 361176 - RNA, 14 nt, Bordetella pertussis
ggggcauggcgccg

SEQ ID NO: 361177 - RNA, 16 nt, Bordetella pertussis
ggggccagccuggccu

SEQ ID NO: 361178 - RNA, 18 nt, Bordetella pertussis
ggggcccgcgggcgcccg

SEQ ID NO: 361179 - RNA, 14 nt, Bordetella pertussis
ggggcgcggcggcg

SEQ ID NO: 361180 - RNA, 13 nt, Bordetella pertussis
ggggcgcuggucg

SEQ ID NO: 361181 - RNA, 20 nt, Bordetella pertussis
ggggcggaugagcaggccgg

SEQ ID NO: 361182 - RNA, 14 nt, Bordetella pertussis
ggggcgggcgcugc

SEQ ID NO: 361183 - RNA, 16 nt, Bordetella pertussis
ggggcgggcgcugcgc

SEQ ID NO: 361184 - RNA, 15 nt, Bordetella pertussis
ggggcguccaccgcc

SEQ ID NO: 361185 - RNA, 14 nt, Bordetella pertussis
ggggcguggccgca

SEQ ID NO: 361186 - RNA, 20 nt, Bordetella pertussis
ggggcguucgacgggcaggc

SEQ ID NO: 361187 - RNA, 12 nt, Bordetella pertussis
ggggcucggcca

SEQ ID NO: 361188 - RNA, 14 nt, Bordetella pertussis
ggggcugcugggcc

SEQ ID NO: 361189 - RNA, 19 nt, Bordetella pertussis
ggggcugucgcgcgcaucg

SEQ ID NO: 361190 - RNA, 18 nt, Bordetella pertussis
gggggucuggcaccugcc

SEQ ID NO: 361191 - RNA, 12 nt, Bordetella pertussis
ggggguucgugg

SEQ ID NO: 361192 - RNA, 12 nt, Bordetella pertussis
ggggucagcgcc

SEQ ID NO: 361193 - RNA, 13 nt, Bordetella pertussis
ggggucagcgccg

SEQ ID NO: 361194 - RNA, 13 nt, Bordetella pertussis
ggggucgccgggc

SEQ ID NO: 361195 - RNA, 17 nt, Bordetella pertussis
ggggugaucugcgccau

SEQ ID NO: 361196 - RNA, 21 nt, Bordetella pertussis
ggggugcuccugccaggcgcc

SEQ ID NO: 361197 - RNA, 15 nt, Bordetella pertussis
ggguacgacggccgg

SEQ ID NO: 361198 - RNA, 13 nt, Bordetella pertussis
ggguacuggccga

SEQ ID NO: 361199 - RNA, 22 nt, Bordetella pertussis
ggguagucggccaccaggccgu

SEQ ID NO: 361200 - RNA, 14 nt, Bordetella pertussis
gggucaaggcgcgg

SEQ ID NO: 361201 - RNA, 16 nt, Bordetella pertussis
gggucagcccgccauc

SEQ ID NO: 361202 - RNA, 18 nt, Bordetella pertussis
gggucagcgccggcacgc

SEQ ID NO: 361203 - RNA, 16 nt, Bordetella pertussis
gggucagcggccggcc

SEQ ID NO: 361204 - RNA, 22 nt, Bordetella pertussis
gggucaucagcacgaucuggcg

SEQ ID NO: 361205 - RNA, 20 nt, Bordetella pertussis
ggguccagcaaaugggccgc

SEQ ID NO: 361206 - RNA, 16 nt, Bordetella pertussis
ggguccguggcggccg

SEQ ID NO: 361207 - RNA, 20 nt, Bordetella pertussis
ggguccugaggccaggccgg

SEQ ID NO: 361208 - RNA, 19 nt, Bordetella pertussis
gggucgaguugcgcgccau

SEQ ID NO: 361209 - RNA, 21 nt, Bordetella pertussis
gggucgaguugcgcgccauga

SEQ ID NO: 361210 - RNA, 19 nt, Bordetella pertussis
gggucgaucauggccagcc

SEQ ID NO: 361211 - RNA, 17 nt, Bordetella pertussis
gggucgcuguagcgcag

SEQ ID NO: 361212 - RNA, 17 nt, Bordetella pertussis
gggucgcugugcgcggc

SEQ ID NO: 361213 - RNA, 15 nt, Bordetella pertussis
gggucggcgccauga

SEQ ID NO: 361214 - RNA, 16 nt, Bordetella pertussis
gggucgucggcgcugc

SEQ ID NO: 361215 - RNA, 15 nt, Bordetella pertussis
gggucucggccacgg

SEQ ID NO: 361216 - RNA, 12 nt, Bordetella pertussis
gggucugcgcga

SEQ ID NO: 361217 - RNA, 14 nt, Bordetella pertussis
gggucuggcggccg

SEQ ID NO: 361218 - RNA, 18 nt, Bordetella pertussis
gggugaucacggccguca

SEQ ID NO: 361219 - RNA, 17 nt, Bordetella pertussis
gggugaucugcgccauc

SEQ ID NO: 361220 - RNA, 21 nt, Bordetella pertussis
gggugccguucggccagcgcg

SEQ ID NO: 361221 - RNA, 13 nt, Bordetella pertussis
gggugccuguccc

SEQ ID NO: 361222 - RNA, 20 nt, Bordetella pertussis
gggugccuguccccgcaggg

SEQ ID NO: 361223 - RNA, 19 nt, Bordetella pertussis
gggugccuguccccgcgga

SEQ ID NO: 361224 - RNA, 20 nt, Bordetella pertussis
gggugccuguccccgcgggg

SEQ ID NO: 361225 - RNA, 20 nt, Bordetella pertussis
gggugcgccaaucggcguug

SEQ ID NO: 361226 - RNA, 15 nt, Bordetella pertussis
gggugcuccugccag

SEQ ID NO: 361227 - RNA, 15 nt, Bordetella pertussis
ggguuggccuugcgc

SEQ ID NO: 361228 - RNA, 16 nt, Bordetella pertussis
ggguugugggccguca

SEQ ID NO: 361229 - RNA, 17 nt, Bordetella pertussis
ggguuuccagcccgugg

SEQ ID NO: 361230 - RNA, 17 nt, Bordetella pertussis
gguacagccaggccagc

SEQ ID NO: 361231 - RNA, 18 nt, Bordetella pertussis
gguacagccaggccagca

SEQ ID NO: 361232 - RNA, 19 nt, Bordetella pertussis
gguacagccaggccagcag

SEQ ID NO: 361233 - RNA, 23 nt, Bordetella pertussis
gguacaggccggcggcgagcgcg

SEQ ID NO: 361234 - RNA, 22 nt, Bordetella pertussis
gguacagcgcgcccgaugccuu

SEQ ID NO: 361235 - RNA, 21 nt, Bordetella pertussis
gguaccacaguucggccagcg

SEQ ID NO: 361236 - RNA, 17 nt, Bordetella pertussis
gguacgacgagcgcacc

SEQ ID NO: 361237 - RNA, 21 nt, Bordetella pertussis
gguacuccuugacgcgcgcgg

SEQ ID NO: 361238 - RNA, 19 nt, Bordetella pertussis
gguacguggccccaggcgu

SEQ ID NO: 361239 - RNA, 19 nt, Bordetella pertussis
gguagacaugcucgaugcc

SEQ ID NO: 361240 - RNA, 18 nt, Bordetella pertussis
gguagccgccgucgaugu

SEQ ID NO: 361241 - RNA, 21 nt, Bordetella pertussis
gguagccggcgacguggcgcu

SEQ ID NO: 361242 - RNA, 18 nt, Bordetella pertussis
gguagcgcacgcaccgcg

SEQ ID NO: 361243 - RNA, 13 nt, Bordetella pertussis
gguagcgcgcagc

SEQ ID NO: 361244 - RNA, 16 nt, Bordetella pertussis
gguagcgcugggcgcc

SEQ ID NO: 361245 - RNA, 14 nt, Bordetella pertussis
gguagggcagcagg

SEQ ID NO: 361246 - RNA, 18 nt, Bordetella pertussis
gguagguggacacgccca

SEQ ID NO: 361247 - RNA, 16 nt, Bordetella pertussis
gguaguucagcagcgc

SEQ ID NO: 361248 - RNA, 19 nt, Bordetella pertussis
gguaguucagcagcgccac

SEQ ID NO: 361249 - RNA, 20 nt, Bordetella pertussis
ggucagcggccggcccgugc

SEQ ID NO: 361250 - RNA, 19 nt, Bordetella pertussis
ggucagcuggaacgcgccg

SEQ ID NO: 361251 - RNA, 12 nt, Bordetella pertussis
ggucaggaugcg

SEQ ID NO: 361252 - RNA, 15 nt, Bordetella pertussis
ggucaggaugcgcgc

SEQ ID NO: 361253 - RNA, 19 nt, Bordetella pertussis
ggucaggaugcgcgccagg

SEQ ID NO: 361254 - RNA, 14 nt, Bordetella pertussis
ggucagggccgccc

SEQ ID NO: 361255 - RNA, 15 nt, Bordetella pertussis
ggucagggccgccca

SEQ ID NO: 361256 - RNA, 16 nt, Bordetella pertussis
ggucagggcgaagcgc

SEQ ID NO: 361257 - RNA, 19 nt, Bordetella pertussis
ggucagggcgaagcgcgcc

SEQ ID NO: 361258 - RNA, 16 nt, Bordetella pertussis
ggucaggucgcugccc

SEQ ID NO: 361259 - RNA, 20 nt, Bordetella pertussis
ggucaggucgcugcccagca

SEQ ID NO: 361260 - RNA, 20 nt, Bordetella pertussis
ggucaucgaugcgccgcacc

SEQ ID NO: 361261 - RNA, 21 nt, Bordetella pertussis
ggucaucgaugcgccgcacca

SEQ ID NO: 361262 - RNA, 14 nt, Bordetella pertussis
ggucaucgccaugc

SEQ ID NO: 361263 - RNA, 22 nt, Bordetella pertussis
ggucaugcccaugccgccaugc

SEQ ID NO: 361264 - RNA, 14 nt, Bordetella pertussis
ggucauguccagcg

SEQ ID NO: 361265 - RNA, 20 nt, Bordetella pertussis
ggucauguccagcgccaggc

SEQ ID NO: 361266 - RNA, 21 nt, Bordetella pertussis
ggucauguccagcgccaggcc

SEQ ID NO: 361267 - RNA, 14 nt, Bordetella pertussis
ggucauugaccugc

SEQ ID NO: 361268 - RNA, 19 nt, Bordetella pertussis
gguccagccccacgccgac

SEQ ID NO: 361269 - RNA, 18 nt, Bordetella pertussis
gguccagcugcgcgcgag

SEQ ID NO: 361270 - RNA, 19 nt, Bordetella pertussis
gguccagcugcgcgcgagc

SEQ ID NO: 361271 - RNA, 23 nt, Bordetella pertussis
gguccaggcccgaaacgcgcagc

SEQ ID NO: 361272 - RNA, 15 nt, Bordetella pertussis
gguccaggcccggca

SEQ ID NO: 361273 - RNA, 12 nt, Bordetella pertussis
gguccaggcggu

SEQ ID NO: 361274 - RNA, 18 nt, Bordetella pertussis
gguccagguggcccgcac

SEQ ID NO: 361275 - RNA, 17 nt, Bordetella pertussis
gguccaguacaccaggu

SEQ ID NO: 361276 - RNA, 20 nt, Bordetella pertussis
gguccaugaacgccgcgccc

SEQ ID NO: 361277 - RNA, 20 nt, Bordetella pertussis
gguccaugcgaaagcggcca

SEQ ID NO: 361278 - RNA, 14 nt, Bordetella pertussis
gguccgccgcgacc

SEQ ID NO: 361279 - RNA, 17 nt, Bordetella pertussis
gguccgccggcacgcgc

SEQ ID NO: 361280 - RNA, 18 nt, Bordetella pertussis
gguccgccggcacgcgcg

SEQ ID NO: 361281 - RNA, 20 nt, Bordetella pertussis
gguccuggcggccgcccagc

SEQ ID NO: 361282 - RNA, 21 nt, Bordetella pertussis
gguccuggcggccgcccagca

SEQ ID NO: 361283 - RNA, 17 nt, Bordetella pertussis
gguccuugagguaccac

SEQ ID NO: 361284 - RNA, 14 nt, Bordetella pertussis
ggucgacgccggcg

SEQ ID NO: 361285 - RNA, 17 nt, Bordetella pertussis
ggucgacgccggcgacg

SEQ ID NO: 361286 - RNA, 17 nt, Bordetella pertussis
ggucgagagccugggcg

SEQ ID NO: 361287 - RNA, 17 nt, Bordetella pertussis
ggucgagaccagcagcg

SEQ ID NO: 361288 - RNA, 18 nt, Bordetella pertussis
ggucgagaccagcagcgg

SEQ ID NO: 361289 - RNA, 15 nt, Bordetella pertussis
ggucgagacgauggc

SEQ ID NO: 361290 - RNA, 17 nt, Bordetella pertussis
ggucgaucagccccugc

SEQ ID NO: 361291 - RNA, 18 nt, Bordetella pertussis
ggucgaucauggccagcc

SEQ ID NO: 361292 - RNA, 21 nt, Bordetella pertussis
ggucgaucgucuugaccagca

SEQ ID NO: 361293 - RNA, 18 nt, Bordetella pertussis
ggucgaucucgggauagg

SEQ ID NO: 361294 - RNA, 21 nt, Bordetella pertussis
ggucgaugaccucgcgcugca

SEQ ID NO: 361295 - RNA, 20 nt, Bordetella pertussis
ggucgccagcacgcgcagcu

SEQ ID NO: 361296 - RNA, 14 nt, Bordetella pertussis
ggucgccagcaggc

SEQ ID NO: 361297 - RNA, 23 nt, Bordetella pertussis
ggucgccagcaggcccugggcga

SEQ ID NO: 361298 - RNA, 23 nt, Bordetella pertussis
ggucgcccaacccggcgaggccg

SEQ ID NO: 361299 - RNA, 23 nt, Bordetella pertussis
ggucgcccagcagauaccggcau

SEQ ID NO: 361300 - RNA, 13 nt, Bordetella pertussis
ggucgcccgccgc

SEQ ID NO: 361301 - RNA, 14 nt, Bordetella pertussis
ggucgcccgccgcg

SEQ ID NO: 361302 - RNA, 22 nt, Bordetella pertussis
ggucgcccuugggcucgucgac

SEQ ID NO: 361303 - RNA, 23 nt, Bordetella pertussis
ggucgcccuugggcucgucgacg

SEQ ID NO: 361304 - RNA, 18 nt, Bordetella pertussis
ggucgcgaccucggcggc

SEQ ID NO: 361305 - RNA, 19 nt, Bordetella pertussis
ggucgcgaccucggcggcg

SEQ ID NO: 361306 - RNA, 20 nt, Bordetella pertussis
ggucgcgaugcgucaggggc

SEQ ID NO: 361307 - RNA, 22 nt, Bordetella pertussis
ggucgcgauugaguucgcgcgc

SEQ ID NO: 361308 - RNA, 24 nt, Bordetella pertussis
ggucgcgauugaguucgcgcgccg

SEQ ID NO: 361309 - RNA, 12 nt, Bordetella pertussis
ggucgcgcaccu

SEQ ID NO: 361310 - RNA, 18 nt, Bordetella pertussis
ggucgcgcagcugccuga

SEQ ID NO: 361311 - RNA, 15 nt, Bordetella pertussis
ggucgcgcccgccgu

SEQ ID NO: 361312 - RNA, 20 nt, Bordetella pertussis
ggucgcgcgugcaggccgcg

SEQ ID NO: 361313 - RNA, 20 nt, Bordetella pertussis
ggucgcggccgaggccagcg

SEQ ID NO: 361314 - RNA, 15 nt, Bordetella pertussis
ggucgcugcccagca

SEQ ID NO: 361315 - RNA, 13 nt, Bordetella pertussis
ggucgcuggcgcc

SEQ ID NO: 361316 - RNA, 14 nt, Bordetella pertussis
ggucgcuggcgccg

SEQ ID NO: 361317 - RNA, 17 nt, Bordetella pertussis
ggucgcugugcgcggcg

SEQ ID NO: 361318 - RNA, 23 nt, Bordetella pertussis
ggucggaaacacguccagcgccg

SEQ ID NO: 361319 - RNA, 16 nt, Bordetella pertussis
ggucggagucggcgcc

SEQ ID NO: 361320 - RNA, 20 nt, Bordetella pertussis
ggucggagucggcgccgcgc

SEQ ID NO: 361321 - RNA, 23 nt, Bordetella pertussis
ggucggagucggcgccgcgcagc

SEQ ID NO: 361322 - RNA, 20 nt, Bordetella pertussis
ggucggauagaguucggcgc

SEQ ID NO: 361323 - RNA, 21 nt, Bordetella pertussis
ggucggauagaguucggcgcg

SEQ ID NO: 361324 - RNA, 23 nt, Bordetella pertussis
ggucggauagaguucggcgcggc

SEQ ID NO: 361325 - RNA, 17 nt, Bordetella pertussis
ggucggccaccaccagg

SEQ ID NO: 361326 - RNA, 15 nt, Bordetella pertussis
ggucggcaugucgau

SEQ ID NO: 361327 - RNA, 14 nt, Bordetella pertussis
ggucggcgaugcgc

SEQ ID NO: 361328 - RNA, 19 nt, Bordetella pertussis
ggucggcgaugcgcggggc

SEQ ID NO: 361329 - RNA, 12 nt, Bordetella pertussis
ggucggcgccga

SEQ ID NO: 361330 - RNA, 13 nt, Bordetella pertussis
ggucggcgcggcc

SEQ ID NO: 361331 - RNA, 18 nt, Bordetella pertussis
ggucggcgcggcgccguc

SEQ ID NO: 361332 - RNA, 15 nt, Bordetella pertussis
ggucggcgcggggca

SEQ ID NO: 361333 - RNA, 12 nt, Bordetella pertussis
ggucggcgcgua

SEQ ID NO: 361334 - RNA, 14 nt, Bordetella pertussis
ggucggcgucgucg

SEQ ID NO: 361335 - RNA, 14 nt, Bordetella pertussis
ggucggucgccugu

SEQ ID NO: 361336 - RNA, 21 nt, Bordetella pertussis
ggucggucugcgugcgcggcg

SEQ ID NO: 361337 - RNA, 23 nt, Bordetella pertussis
ggucggugcacacgccuucggcg

SEQ ID NO: 361338 - RNA, 15 nt, Bordetella pertussis
ggucggugccgccga

SEQ ID NO: 361339 - RNA, 15 nt, Bordetella pertussis
ggucguacagcgccu

SEQ ID NO: 361340 - RNA, 18 nt, Bordetella pertussis
ggucguccaauucgagca

SEQ ID NO: 361341 - RNA, 23 nt, Bordetella pertussis
ggucgucgggcggcgcgaacggc

SEQ ID NO: 361342 - RNA, 12 nt, Bordetella pertussis
ggucucggcguc

SEQ ID NO: 361343 - RNA, 18 nt, Bordetella pertussis
ggucucguagaccggcac

SEQ ID NO: 361344 - RNA, 21 nt, Bordetella pertussis
ggucucguuccagaugcgcag

SEQ ID NO: 361345 - RNA, 15 nt, Bordetella pertussis
ggugaaacagcauca

SEQ ID NO: 361346 - RNA, 16 nt, Bordetella pertussis
ggugaacaccagggug

SEQ ID NO: 361347 - RNA, 13 nt, Bordetella pertussis
ggugaacgacagc

SEQ ID NO: 361348 - RNA, 16 nt, Bordetella pertussis
ggugaacgacagcgac

SEQ ID NO: 361349 - RNA, 14 nt, Bordetella pertussis
ggugaccuuggucg

SEQ ID NO: 361350 - RNA, 19 nt, Bordetella pertussis
ggugacgcuggagcgcggc

SEQ ID NO: 361351 - RNA, 22 nt, Bordetella pertussis
ggugacgcuggagcgcggcggc

SEQ ID NO: 361352 - RNA, 14 nt, Bordetella pertussis
ggugacgggcuggg

SEQ ID NO: 361353 - RNA, 16 nt, Bordetella pertussis
ggugagggccacgcgc

SEQ ID NO: 361354 - RNA, 15 nt, Bordetella pertussis
ggugaggggccagcc

SEQ ID NO: 361355 - RNA, 17 nt, Bordetella pertussis
ggugaggggccagccug

SEQ ID NO: 361356 - RNA, 21 nt, Bordetella pertussis
ggugaucugguccacggcggc

SEQ ID NO: 361357 - RNA, 16 nt, Bordetella pertussis
ggugaugauggccagg

SEQ ID NO: 361358 - RNA, 17 nt, Bordetella pertussis
ggugaugauggccaggu

SEQ ID NO: 361359 - RNA, 15 nt, Bordetella pertussis
ggugaugcgcgcggc

SEQ ID NO: 361360 - RNA, 17 nt, Bordetella pertussis
ggugaugcggcgcgccg

SEQ ID NO: 361361 - RNA, 20 nt, Bordetella pertussis
ggugauguacgcaucggcgc

SEQ ID NO: 361362 - RNA, 14 nt, Bordetella pertussis
ggugcuccugccag

SEQ ID NO: 361363 - RNA, 15 nt, Bordetella pertussis
ggugcucuggcccgc

SEQ ID NO: 361364 - RNA, 20 nt, Bordetella pertussis
ggugcugccgcugcccaccu

SEQ ID NO: 361365 - RNA, 19 nt, Bordetella pertussis
ggugcugcucaacggccac

SEQ ID NO: 361366 - RNA, 21 nt, Bordetella pertussis
ggugcugcucaacggccacca

SEQ ID NO: 361367 - RNA, 15 nt, Bordetella pertussis
ggugcugcugggcgc

SEQ ID NO: 361368 - RNA, 20 nt, Bordetella pertussis
ggugcugcugggcgccaugc

SEQ ID NO: 361369 - RNA, 19 nt, Bordetella pertussis
ggugcugggucaucagcac

SEQ ID NO: 361370 - RNA, 22 nt, Bordetella pertussis
gguggacaggaacuccggcggc

SEQ ID NO: 361371 - RNA, 22 nt, Bordetella pertussis
gguggaccugccguucgcgcug

SEQ ID NO: 361372 - RNA, 19 nt, Bordetella pertussis
gguggccgcgguccgggcc

SEQ ID NO: 361373 - RNA, 22 nt, Bordetella pertussis
gguggccgcuccagagcgcgca

SEQ ID NO: 361374 - RNA, 16 nt, Bordetella pertussis
gguggccgcuucggcg

SEQ ID NO: 361375 - RNA, 18 nt, Bordetella pertussis
gguggccggaucgagcgc

SEQ ID NO: 361376 - RNA, 12 nt, Bordetella pertussis
gguggccucgcc

SEQ ID NO: 361377 - RNA, 23 nt, Bordetella pertussis
gguggcgauccauguggccagcu

SEQ ID NO: 361378 - RNA, 13 nt, Bordetella pertussis
gguggcgccaugu

SEQ ID NO: 361379 - RNA, 14 nt, Bordetella pertussis
gguggcgccggcca

SEQ ID NO: 361380 - RNA, 13 nt, Bordetella pertussis
gguggcgcgcaac

SEQ ID NO: 361381 - RNA, 19 nt, Bordetella pertussis
gguggcgcgcaacacgcgc

SEQ ID NO: 361382 - RNA, 16 nt, Bordetella pertussis
gguggcgcucgcgccc

SEQ ID NO: 361383 - RNA, 14 nt, Bordetella pertussis
gguggcggacaggc

SEQ ID NO: 361384 - RNA, 18 nt, Bordetella pertussis
gguggcggccgucggggc

SEQ ID NO: 361385 - RNA, 17 nt, Bordetella pertussis
gguggcggccguuggcg

SEQ ID NO: 361386 - RNA, 12 nt, Bordetella pertussis
gguggcggcggc

SEQ ID NO: 361387 - RNA, 12 nt, Bordetella pertussis
gguggcgggcgc

SEQ ID NO: 361388 - RNA, 14 nt, Bordetella pertussis
gguggcgggcgugc

SEQ ID NO: 361389 - RNA, 18 nt, Bordetella pertussis
gguggcguguccgccgua

SEQ ID NO: 361390 - RNA, 16 nt, Bordetella pertussis
ggugggaaucggcacc

SEQ ID NO: 361391 - RNA, 17 nt, Bordetella pertussis
ggugggcacgcgcgcgg

SEQ ID NO: 361392 - RNA, 15 nt, Bordetella pertussis
ggugggcauccagcg

SEQ ID NO: 361393 - RNA, 17 nt, Bordetella pertussis
ggugggcagcgcgucga

SEQ ID NO: 361394 - RNA, 16 nt, Bordetella pertussis
ggugggcagcggcauc

SEQ ID NO: 361395 - RNA, 16 nt, Bordetella pertussis
ggugggcgacgcggcg

SEQ ID NO: 361396 - RNA, 16 nt, Bordetella pertussis
ggugggcgcgccgcga

SEQ ID NO: 361397 - RNA, 16 nt, Bordetella pertussis
gguggggcuggccgcc

SEQ ID NO: 361398 - RNA, 16 nt, Bordetella pertussis
gguggguguggccaug

SEQ ID NO: 361399 - RNA, 15 nt, Bordetella pertussis
gguggucagcauggu

SEQ ID NO: 361400 - RNA, 21 nt, Bordetella pertussis
gguggucaucgaugcgccgca

SEQ ID NO: 361401 - RNA, 13 nt, Bordetella pertussis
gguggucgcgccc

SEQ ID NO: 361402 - RNA, 24 nt, Bordetella pertussis
gguggucugccaguccauccagcg

SEQ ID NO: 361403 - RNA, 20 nt, Bordetella pertussis
gguggucuuccaggcgcagg

SEQ ID NO: 361404 - RNA, 15 nt, Bordetella pertussis
gguggugaccacggc

SEQ ID NO: 361405 - RNA, 21 nt, Bordetella pertussis
gguggugaccacggcgcgccc

SEQ ID NO: 361406 - RNA, 13 nt, Bordetella pertussis
gguggugcagcgg

SEQ ID NO: 361407 - RNA, 18 nt, Bordetella pertussis
gguggugcccaucgcgcu

SEQ ID NO: 361408 - RNA, 12 nt, Bordetella pertussis
gguggugcgccu

SEQ ID NO: 361409 - RNA, 22 nt, Bordetella pertussis
gguggugcugcucaacggccac

SEQ ID NO: 361410 - RNA, 17 nt, Bordetella pertussis
gguguagcugcccgcga

SEQ ID NO: 361411 - RNA, 13 nt, Bordetella pertussis
gguguaggcgggc

SEQ ID NO: 361412 - RNA, 20 nt, Bordetella pertussis
gguguccuggucggcgcggc

SEQ ID NO: 361413 - RNA, 17 nt, Bordetella pertussis
ggugucgccccccaugc

SEQ ID NO: 361414 - RNA, 18 nt, Bordetella pertussis
ggugucgcucccccaugc

SEQ ID NO: 361415 - RNA, 14 nt, Bordetella pertussis
ggugucggcggcca

SEQ ID NO: 361416 - RNA, 22 nt, Bordetella pertussis
gguguggccaugcaccagcaca

SEQ ID NO: 361417 - RNA, 14 nt, Bordetella pertussis
gguguucgcgcacc

SEQ ID NO: 361418 - RNA, 18 nt, Bordetella pertussis
gguguucgcgcaccagcg

SEQ ID NO: 361419 - RNA, 21 nt, Bordetella pertussis
gguguugaccaccacgcuggc

SEQ ID NO: 361420 - RNA, 22 nt, Bordetella pertussis
gguguugagauuggccgagcgc

SEQ ID NO: 361421 - RNA, 17 nt, Bordetella pertussis
gguguugccgaggucgc

SEQ ID NO: 361422 - RNA, 14 nt, Bordetella pertussis
gguucaaccggcgu

SEQ ID NO: 361423 - RNA, 16 nt, Bordetella pertussis
gguucagcgcgccagc

SEQ ID NO: 361424 - RNA, 18 nt, Bordetella pertussis
gguucaggguggccgcga

SEQ ID NO: 361425 - RNA, 20 nt, Bordetella pertussis
gguucgaauccucucgcccc

SEQ ID NO: 361426 - RNA, 19 nt, Bordetella pertussis
gguucgauguaguagccgc

SEQ ID NO: 361427 - RNA, 16 nt, Bordetella pertussis
gguucggccucgccca

SEQ ID NO: 361428 - RNA, 16 nt, Bordetella pertussis
gguucguagccgguau

SEQ ID NO: 361429 - RNA, 21 nt, Bordetella pertussis
gguucucgauguggcgcuggc

SEQ ID NO: 361430 - RNA, 13 nt, Bordetella pertussis
gguugagcgccag

SEQ ID NO: 361431 - RNA, 20 nt, Bordetella pertussis
gguugcagcgcgccaggcgc

SEQ ID NO: 361432 - RNA, 23 nt, Bordetella pertussis
gguugcgcgccagcucgcgcagc

SEQ ID NO: 361433 - RNA, 13 nt, Bordetella pertussis
gguugcgcgccga

SEQ ID NO: 361434 - RNA, 21 nt, Bordetella pertussis
gguugcggcggacacgcaugc

SEQ ID NO: 361435 - RNA, 18 nt, Bordetella pertussis
gguugcgguaguucagca

SEQ ID NO: 361436 - RNA, 18 nt, Bordetella pertussis
gguuggccacaucaucga

SEQ ID NO: 361437 - RNA, 18 nt, Bordetella pertussis
gguuggccacgaagcgca

SEQ ID NO: 361438 - RNA, 21 nt, Bordetella pertussis
gguuggccuugacggcgcgga

SEQ ID NO: 361439 - RNA, 17 nt, Bordetella pertussis
gguugggaucgcgccag

SEQ ID NO: 361440 - RNA, 21 nt, Bordetella pertussis
gguugggcaccaccaccgccc

SEQ ID NO: 361441 - RNA, 22 nt, Bordetella pertussis
gguugggcaccaccaccgcccg

SEQ ID NO: 361442 - RNA, 22 nt, Bordetella pertussis
gguuguauugcaugaccgccgg

SEQ ID NO: 361443 - RNA, 22 nt, Bordetella pertussis
gguuguccaccacccaggccca

SEQ ID NO: 361444 - RNA, 14 nt, Bordetella pertussis
gguugucgcgcacc

SEQ ID NO: 361445 - RNA, 15 nt, Bordetella pertussis
gguugugcccgcccg

SEQ ID NO: 361446 - RNA, 17 nt, Bordetella pertussis
gguuucaaagucgacgu

SEQ ID NO: 361447 - RNA, 23 nt, Bordetella pertussis
gguuucggccugcaggcccagca

SEQ ID NO: 361448 - RNA, 20 nt, Bordetella pertussis
gguuucucggccuugggcgc

SEQ ID NO: 361449 - RNA, 17 nt, Bordetella pertussis
gguuugcuggcgcagca

SEQ ID NO: 361450 - RNA, 19 nt, Bordetella pertussis
guaacccgaguccuugacg

SEQ ID NO: 361451 - RNA, 18 nt, Bordetella pertussis
guaaccgacgcagcgcac

SEQ ID NO: 361452 - RNA, 18 nt, Bordetella pertussis
guacagcagcagcacggc

SEQ ID NO: 361453 - RNA, 22 nt, Bordetella pertussis
guacagccaggccagcagcucg

SEQ ID NO: 361454 - RNA, 19 nt, Bordetella pertussis
guacagccgccuggcgcgg

SEQ ID NO: 361455 - RNA, 20 nt, Bordetella pertussis
guacagccgccuggcgcggc

SEQ ID NO: 361456 - RNA, 11 nt, Bordetella pertussis
guacagccgcg

SEQ ID NO: 361457 - RNA, 17 nt, Bordetella pertussis
guacagcgccugcgcgg

SEQ ID NO: 361458 - RNA, 13 nt, Bordetella pertussis
guacagcgcgccc

SEQ ID NO: 361459 - RNA, 19 nt, Bordetella pertussis
guaccacaguucggccagc

SEQ ID NO: 361460 - RNA, 22 nt, Bordetella pertussis
guaccacaguucggccagcggc

SEQ ID NO: 361461 - RNA, 17 nt, Bordetella pertussis
guaccacgcgaacacgc

SEQ ID NO: 361462 - RNA, 20 nt, Bordetella pertussis
guaccagaugagacacggca

SEQ ID NO: 361463 - RNA, 15 nt, Bordetella pertussis
guaccaggcagccgg

SEQ ID NO: 361464 - RNA, 16 nt, Bordetella pertussis
guaccaggcagccggc

SEQ ID NO: 361465 - RNA, 18 nt, Bordetella pertussis
guaccaggcagccggccc

SEQ ID NO: 361466 - RNA, 16 nt, Bordetella pertussis
guaccaggcgcugacc

SEQ ID NO: 361467 - RNA, 13 nt, Bordetella pertussis
guaccaggcggcg

SEQ ID NO: 361468 - RNA, 15 nt, Bordetella pertussis
guaccaggugcgcau

SEQ ID NO: 361469 - RNA, 16 nt, Bordetella pertussis
guaccgggccgacgcg

SEQ ID NO: 361470 - RNA, 14 nt, Bordetella pertussis
guaccgggcggucc

SEQ ID NO: 361471 - RNA, 20 nt, Bordetella pertussis
guacgauagcggaugauggg

SEQ ID NO: 361472 - RNA, 20 nt, Bordetella pertussis
guacgaucaggcggcgcggc

SEQ ID NO: 361473 - RNA, 16 nt, Bordetella pertussis
guacgcaucggcgccg

SEQ ID NO: 361474 - RNA, 15 nt, Bordetella pertussis
guacgcccagcuggg

SEQ ID NO: 361475 - RNA, 13 nt, Bordetella pertussis
guacgcccggccg

SEQ ID NO: 361476 - RNA, 14 nt, Bordetella pertussis
guacgcccggccgc

SEQ ID NO: 361477 - RNA, 15 nt, Bordetella pertussis
guacgccggccugac

SEQ ID NO: 361478 - RNA, 17 nt, Bordetella pertussis
guacgccggccugacgc

SEQ ID NO: 361479 - RNA, 18 nt, Bordetella pertussis
guacgcuuaucgcggcgc

SEQ ID NO: 361480 - RNA, 19 nt, Bordetella pertussis
guacgcuuaucgcggcgcg

SEQ ID NO: 361481 - RNA, 21 nt, Bordetella pertussis
guacgcuuaucgcggcgcggc

SEQ ID NO: 361482 - RNA, 15 nt, Bordetella pertussis
guacggccggcuccg

SEQ ID NO: 361483 - RNA, 18 nt, Bordetella pertussis
guacggcgaugccggcgc

SEQ ID NO: 361484 - RNA, 18 nt, Bordetella pertussis
guacguggccccaggcgu

SEQ ID NO: 361485 - RNA, 22 nt, Bordetella pertussis
guacuacaguaugggcugucgc

SEQ ID NO: 361486 - RNA, 22 nt, Bordetella pertussis
guacuccaucuguucggcgccg

SEQ ID NO: 361487 - RNA, 23 nt, Bordetella pertussis
guacuccuaucuuucgggcgcgg

SEQ ID NO: 361488 - RNA, 20 nt, Bordetella pertussis
guacuccuugacgcgcgcgg

SEQ ID NO: 361489 - RNA, 16 nt, Bordetella pertussis
guacucgccggcgcug

SEQ ID NO: 361490 - RNA, 17 nt, Bordetella pertussis
guacucgccggucgcgg

SEQ ID NO: 361491 - RNA, 15 nt, Bordetella pertussis
guacucgccgucgaa

SEQ ID NO: 361492 - RNA, 15 nt, Bordetella pertussis
guacucgcugcgcgg

SEQ ID NO: 361493 - RNA, 14 nt, Bordetella pertussis
guacucggccaggc

SEQ ID NO: 361494 - RNA, 15 nt, Bordetella pertussis
guacucggccaggcc

SEQ ID NO: 361495 - RNA, 22 nt, Bordetella pertussis
guacucggccaggccauggcgc

SEQ ID NO: 361496 - RNA, 15 nt, Bordetella pertussis
guacuuggcgauggc

SEQ ID NO: 361497 - RNA, 19 nt, Bordetella pertussis
guagaagaacagcagaugg

SEQ ID NO: 361498 - RNA, 18 nt, Bordetella pertussis
guagaaguaggcggccag

SEQ ID NO: 361499 - RNA, 16 nt, Bordetella pertussis
guagaccaccagcagg

SEQ ID NO: 361500 - RNA, 22 nt, Bordetella pertussis
guagagcaggccgcccagcgca

SEQ ID NO: 361501 - RNA, 18 nt, Bordetella pertussis
guagagcugcggcgcggc

SEQ ID NO: 361502 - RNA, 17 nt, Bordetella pertussis
guagauccaggcggcca

SEQ ID NO: 361503 - RNA, 20 nt, Bordetella pertussis
guagcccagguccagcgcca

SEQ ID NO: 361504 - RNA, 14 nt, Bordetella pertussis
guagcccuggcgcu

SEQ ID NO: 361505 - RNA, 17 nt, Bordetella pertussis
guagccgaauccggcca

SEQ ID NO: 361506 - RNA, 19 nt, Bordetella pertussis
guagccgaauccggccagc

SEQ ID NO: 361507 - RNA, 21 nt, Bordetella pertussis
guagccgaugaccggccaggc

SEQ ID NO: 361508 - RNA, 22 nt, Bordetella pertussis
guagccgaugaccggccaggcg

SEQ ID NO: 361509 - RNA, 17 nt, Bordetella pertussis
guagccgccgcugucgg

SEQ ID NO: 361510 - RNA, 23 nt, Bordetella pertussis
guagccgccgcugucggucagca

SEQ ID NO: 361511 - RNA, 13 nt, Bordetella pertussis
guagccggcgacg

SEQ ID NO: 361512 - RNA, 19 nt, Bordetella pertussis
guagccgggucuggccggc

SEQ ID NO: 361513 - RNA, 18 nt, Bordetella pertussis
guagcgggcggcggcgcg

SEQ ID NO: 361514 - RNA, 19 nt, Bordetella pertussis
guagcgguagccggcgugg

SEQ ID NO: 361515 - RNA, 14 nt, Bordetella pertussis
guagcgguccagcu

SEQ ID NO: 361516 - RNA, 17 nt, Bordetella pertussis
guagcgguccggggcgg

SEQ ID NO: 361517 - RNA, 17 nt, Bordetella pertussis
guaggacagccccagca

SEQ ID NO: 361518 - RNA, 22 nt, Bordetella pertussis
guaggccauugaaagcgcgagc

SEQ ID NO: 361519 - RNA, 14 nt, Bordetella pertussis
guaggccggcgcga

SEQ ID NO: 361520 - RNA, 19 nt, Bordetella pertussis
guaggccggcacguccggc

SEQ ID NO: 361521 - RNA, 14 nt, Bordetella pertussis
guaggcgagcaggu

SEQ ID NO: 361522 - RNA, 16 nt, Bordetella pertussis
guaggcgccccaggcg

SEQ ID NO: 361523 - RNA, 20 nt, Bordetella pertussis
guaggcgcccgacggcgcgc

SEQ ID NO: 361524 - RNA, 23 nt, Bordetella pertussis
guaggcgcccgacggcgcgcccg

SEQ ID NO: 361525 - RNA, 16 nt, Bordetella pertussis
guaggcgccggcgccg

SEQ ID NO: 361526 - RNA, 20 nt, Bordetella pertussis
guaggcgccgguccagcgcc

SEQ ID NO: 361527 - RNA, 15 nt, Bordetella pertussis
guaggcgcgcgcauc

SEQ ID NO: 361528 - RNA, 21 nt, Bordetella pertussis
guaggcgcgcgcaucggccgg

SEQ ID NO: 361529 - RNA, 14 nt, Bordetella pertussis
guaggcggccaggc

SEQ ID NO: 361530 - RNA, 13 nt, Bordetella pertussis
guaggcggccggc

SEQ ID NO: 361531 - RNA, 16 nt, Bordetella pertussis
guaggcggcgcgcccg

SEQ ID NO: 361532 - RNA, 15 nt, Bordetella pertussis
guaggcgggacuggc

SEQ ID NO: 361533 - RNA, 20 nt, Bordetella pertussis
guaggcgggcagcggcgacg

SEQ ID NO: 361534 - RNA, 18 nt, Bordetella pertussis
guaggucaggcccacgcc

SEQ ID NO: 361535 - RNA, 18 nt, Bordetella pertussis
guaguguuccugguagcc

SEQ ID NO: 361536 - RNA, 20 nt, Bordetella pertussis
guaguguucgauggcggcca

SEQ ID NO: 361537 - RNA, 20 nt, Bordetella pertussis
guaguucggcgcgugcggau

SEQ ID NO: 361538 - RNA, 22 nt, Bordetella pertussis
guaguucggcgcgugcggaugc

SEQ ID NO: 361539 - RNA, 21 nt, Bordetella pertussis
guaguugguggcaggcgccca

SEQ ID NO: 361540 - RNA, 14 nt, Bordetella pertussis
guauccuggcgcgg

SEQ ID NO: 361541 - RNA, 16 nt, Bordetella pertussis
guaucgacccaggccg

SEQ ID NO: 361542 - RNA, 17 nt, Bordetella pertussis
guaucgacccaggccgg

SEQ ID NO: 361543 - RNA, 18 nt, Bordetella pertussis
guaucgacccaggccggc

SEQ ID NO: 361544 - RNA, 13 nt, Bordetella pertussis
guaucgacgcgcg

SEQ ID NO: 361545 - RNA, 19 nt, Bordetella pertussis
guaucgagguuuccgccau

SEQ ID NO: 361546 - RNA, 18 nt, Bordetella pertussis
guaucgcccgcgcgguau

SEQ ID NO: 361547 - RNA, 18 nt, Bordetella pertussis
gucagcucgaucaggcgc

SEQ ID NO: 361548 - RNA, 17 nt, Bordetella pertussis
gucagcuugccgcccag

SEQ ID NO: 361549 - RNA, 14 nt, Bordetella pertussis
gucaggaugcgcgc

SEQ ID NO: 361550 - RNA, 16 nt, Bordetella pertussis
gucaggaugcgcgcca

SEQ ID NO: 361551 - RNA, 12 nt, Bordetella pertussis
gucagggccgca

SEQ ID NO: 361552 - RNA, 19 nt, Bordetella pertussis
gucagggcgaagcgcgccu

SEQ ID NO: 361553 - RNA, 23 nt, Bordetella pertussis
gucaggggcaggcgcacgccgcc

SEQ ID NO: 361554 - RNA, 14 nt, Bordetella pertussis
gucaggucgcugcc

SEQ ID NO: 361555 - RNA, 16 nt, Bordetella pertussis
gucagguuagcggcag

SEQ ID NO: 361556 - RNA, 15 nt, Bordetella pertussis
gucaguccgcccagc

SEQ ID NO: 361557 - RNA, 16 nt, Bordetella pertussis
gucaguccgcccagcc

SEQ ID NO: 361558 - RNA, 21 nt, Bordetella pertussis
gucaguccucaugcgggacag

SEQ ID NO: 361559 - RNA, 22 nt, Bordetella pertussis
gucagucgggacggcgcgggca

SEQ ID NO: 361560 - RNA, 17 nt, Bordetella pertussis
gucaguugggcgcgccc

SEQ ID NO: 361561 - RNA, 21 nt, Bordetella pertussis
gucaguuuccaucggggggca

SEQ ID NO: 361562 - RNA, 16 nt, Bordetella pertussis
gucauacacggcgcgg

SEQ ID NO: 361563 - RNA, 19 nt, Bordetella pertussis
gucaucgggugcggcgccu

SEQ ID NO: 361564 - RNA, 21 nt, Bordetella pertussis
gucaucgggugcggcgccugc

SEQ ID NO: 361565 - RNA, 17 nt, Bordetella pertussis
gucaucggugcggccgg

SEQ ID NO: 361566 - RNA, 16 nt, Bordetella pertussis
gucaucguggccgcgc

SEQ ID NO: 361567 - RNA, 17 nt, Bordetella pertussis
gucaucguggccgcgca

SEQ ID NO: 361568 - RNA, 22 nt, Bordetella pertussis
gucaucuacagcgccuggcggc

SEQ ID NO: 361569 - RNA, 16 nt, Bordetella pertussis
gucaugacgggcggcg

SEQ ID NO: 361570 - RNA, 17 nt, Bordetella pertussis
gucaugaucccgcgccu

SEQ ID NO: 361571 - RNA, 22 nt, Bordetella pertussis
gucaugauguagcccauguucu

SEQ ID NO: 361572 - RNA, 21 nt, Bordetella pertussis
gucaugcccuccucggccagg

SEQ ID NO: 361573 - RNA, 12 nt, Bordetella pertussis
gucaugccgaac

SEQ ID NO: 361574 - RNA, 13 nt, Bordetella pertussis
gucaugcgccgca

SEQ ID NO: 361575 - RNA, 21 nt, Bordetella pertussis
gucaugcgcuugucgccgcug

SEQ ID NO: 361576 - RNA, 18 nt, Bordetella pertussis
gucaugcgccaugaacgc

SEQ ID NO: 361577 - RNA, 17 nt, Bordetella pertussis
gucaugcgugaacuggu

SEQ ID NO: 361578 - RNA, 15 nt, Bordetella pertussis
gucauggccuggccc

SEQ ID NO: 361579 - RNA, 16 nt, Bordetella pertussis
gucauggccuggccca

SEQ ID NO: 361580 - RNA, 13 nt, Bordetella pertussis
gucaugggcgggg

SEQ ID NO: 361581 - RNA, 14 nt, Bordetella pertussis
gucaugggcggggc

SEQ ID NO: 361582 - RNA, 16 nt, Bordetella pertussis
gucauguccagcgcca

SEQ ID NO: 361583 - RNA, 20 nt, Bordetella pertussis
gucaugugcugcggcagcca

SEQ ID NO: 361584 - RNA, 19 nt, Bordetella pertussis
guccaaggaaagcccggcc

SEQ ID NO: 361585 - RNA, 20 nt, Bordetella pertussis
guccaaggaaagcccggccc

SEQ ID NO: 361586 - RNA, 21 nt, Bordetella pertussis
guccaauucgagcaggcgcag

SEQ ID NO: 361587 - RNA, 15 nt, Bordetella pertussis
guccacagcccggcc

SEQ ID NO: 361588 - RNA, 17 nt, Bordetella pertussis
guccacauccgcgcugc

SEQ ID NO: 361589 - RNA, 19 nt, Bordetella pertussis
guccacauccgcgcugcug

SEQ ID NO: 361590 - RNA, 16 nt, Bordetella pertussis
guccaccaccaggccg

SEQ ID NO: 361591 - RNA, 17 nt, Bordetella pertussis
guccaccacccaggccc

SEQ ID NO: 361592 - RNA, 13 nt, Bordetella pertussis
guccaccagccgg

SEQ ID NO: 361593 - RNA, 15 nt, Bordetella pertussis
guccaccagccggcc

SEQ ID NO: 361594 - RNA, 20 nt, Bordetella pertussis
guccaccucgucguccagcg

SEQ ID NO: 361595 - RNA, 16 nt, Bordetella pertussis
guccacgaaggcagca

SEQ ID NO: 361596 - RNA, 18 nt, Bordetella pertussis
guccacgcccggugccug

SEQ ID NO: 361597 - RNA, 19 nt, Bordetella pertussis
guccacgcccuggcuggcg

SEQ ID NO: 361598 - RNA, 15 nt, Bordetella pertussis
guccacgccguggcg

SEQ ID NO: 361599 - RNA, 17 nt, Bordetella pertussis
guccacgccguggcgca

SEQ ID NO: 361600 - RNA, 20 nt, Bordetella pertussis
guccacgcggguggugcugc

SEQ ID NO: 361601 - RNA, 21 nt, Bordetella pertussis
guccacgcggguggugcugcu

SEQ ID NO: 361602 - RNA, 14 nt, Bordetella pertussis
guccacggcaucgg

SEQ ID NO: 361603 - RNA, 20 nt, Bordetella pertussis
guccacggcaucggccagca

SEQ ID NO: 361604 - RNA, 13 nt, Bordetella pertussis
guccacggcaugg

SEQ ID NO: 361605 - RNA, 14 nt, Bordetella pertussis
guccacggcauggc

SEQ ID NO: 361606 - RNA, 21 nt, Bordetella pertussis
guccacggccugcgcgccgac

SEQ ID NO: 361607 - RNA, 23 nt, Bordetella pertussis
guccacggccugcgcgccgacca

SEQ ID NO: 361608 - RNA, 15 nt, Bordetella pertussis
guccacggucgccgg

SEQ ID NO: 361609 - RNA, 16 nt, Bordetella pertussis
guccacggucgccggc

SEQ ID NO: 361610 - RNA, 15 nt, Bordetella pertussis
guccacguggcgacg

SEQ ID NO: 361611 - RNA, 16 nt, Bordetella pertussis
guccacguggcgacgu

SEQ ID NO: 361612 - RNA, 22 nt, Bordetella pertussis
guccacugaaagaaccgccuuc

SEQ ID NO: 361613 - RNA, 23 nt, Bordetella pertussis
guccacugaaagaaccgccuucg

SEQ ID NO: 361614 - RNA, 23 nt, Bordetella pertussis
guccagaugauggucggugccgc

SEQ ID NO: 361615 - RNA, 18 nt, Bordetella pertussis
guccagcaccagggcgcg

SEQ ID NO: 361616 - RNA, 19 nt, Bordetella pertussis
guccagcaccagggcgcgc

SEQ ID NO: 361617 - RNA, 21 nt, Bordetella pertussis
guccagcaccagggcgcgcag

SEQ ID NO: 361618 - RNA, 18 nt, Bordetella pertussis
guccagcaccggcugcca

SEQ ID NO: 361619 - RNA, 23 nt, Bordetella pertussis
guccagcaccggcugccagggcc

SEQ ID NO: 361620 - RNA, 16 nt, Bordetella pertussis
guccagcacggccgcg

SEQ ID NO: 361621 - RNA, 20 nt, Bordetella pertussis
guccagcacggccgcggccg

SEQ ID NO: 361622 - RNA, 13 nt, Bordetella pertussis
guccagcacgcgg

SEQ ID NO: 361623 - RNA, 18 nt, Bordetella pertussis
guccagcagcagcgccgc

SEQ ID NO: 361624 - RNA, 12 nt, Bordetella pertussis
guccagcagcgu

SEQ ID NO: 361625 - RNA, 13 nt, Bordetella pertussis
guccagcagcgug

SEQ ID NO: 361626 - RNA, 23 nt, Bordetella pertussis
guccagcagcgugaugccgucga

SEQ ID NO: 361627 - RNA, 17 nt, Bordetella pertussis
guccagcaggauggcga

SEQ ID NO: 361628 - RNA, 18 nt, Bordetella pertussis
guccagccccugcccguc

SEQ ID NO: 361629 - RNA, 20 nt, Bordetella pertussis
guccagcgacuccggccggg

SEQ ID NO: 361630 - RNA, 20 nt, Bordetella pertussis
guccagcgacucggucagca

SEQ ID NO: 361631 - RNA, 17 nt, Bordetella pertussis
guccagcgccaccagca

SEQ ID NO: 361632 - RNA, 17 nt, Bordetella pertussis
guccagcgccacggcgg

SEQ ID NO: 361633 - RNA, 18 nt, Bordetella pertussis
guccagcgccacggcggu

SEQ ID NO: 361634 - RNA, 13 nt, Bordetella pertussis
guccagcgccagc

SEQ ID NO: 361635 - RNA, 16 nt, Bordetella pertussis
guccagcgccagcagg

SEQ ID NO: 361636 - RNA, 12 nt, Bordetella pertussis
guccagcgcccg

SEQ ID NO: 361637 - RNA, 13 nt, Bordetella pertussis
guccagcgccgcg

SEQ ID NO: 361638 - RNA, 22 nt, Bordetella pertussis
guccagcgcgcccagcgcgccg

SEQ ID NO: 361639 - RNA, 13 nt, Bordetella pertussis
guccagcgcgccg

SEQ ID NO: 361640 - RNA, 15 nt, Bordetella pertussis
guccagcgcgccgcg

SEQ ID NO: 361641 - RNA, 16 nt, Bordetella pertussis
guccagcgcgccgcga

SEQ ID NO: 361642 - RNA, 16 nt, Bordetella pertussis
guccagcgcgcggccu

SEQ ID NO: 361643 - RNA, 14 nt, Bordetella pertussis
guccagcggcgcca

SEQ ID NO: 361644 - RNA, 19 nt, Bordetella pertussis
guccagcggcgccagcgga

SEQ ID NO: 361645 - RNA, 16 nt, Bordetella pertussis
guccagcggcgcgacg

SEQ ID NO: 361646 - RNA, 20 nt, Bordetella pertussis
guccagcggcgcgacgcgcu

SEQ ID NO: 361647 - RNA, 21 nt, Bordetella pertussis
guccagcggcgcgacgcgcuu

SEQ ID NO: 361648 - RNA, 16 nt, Bordetella pertussis
guccagcggcagcggg

SEQ ID NO: 361649 - RNA, 14 nt, Bordetella pertussis
guccagcgugguga

SEQ ID NO: 361650 - RNA, 20 nt, Bordetella pertussis
guccagcuccagcgcuucgu

SEQ ID NO: 361651 - RNA, 20 nt, Bordetella pertussis
guccagcuuggacagcgcgu

SEQ ID NO: 361652 - RNA, 16 nt, Bordetella pertussis
guccaggacgcgaaga

SEQ ID NO: 361653 - RNA, 17 nt, Bordetella pertussis
guccaggcccagcgcgu

SEQ ID NO: 361654 - RNA, 23 nt, Bordetella pertussis
guccaggcccgaaacgcgcagca

SEQ ID NO: 361655 - RNA, 20 nt, Bordetella pertussis
guccaggcccuggcggcgca

SEQ ID NO: 361656 - RNA, 15 nt, Bordetella pertussis
guccagcugcgcgcg

SEQ ID NO: 361657 - RNA, 21 nt, Bordetella pertussis
guccagcugcgcgcgagcggc

SEQ ID NO: 361658 - RNA, 16 nt, Bordetella pertussis
guccaggccggccugc

SEQ ID NO: 361659 - RNA, 17 nt, Bordetella pertussis
guccaggccggccugca

SEQ ID NO: 361660 - RNA, 16 nt, Bordetella pertussis
guccaggccggggccg

SEQ ID NO: 361661 - RNA, 23 nt, Bordetella pertussis
guccaggccggggccgcccagca

SEQ ID NO: 361662 - RNA, 14 nt, Bordetella pertussis
guccaggcgccgca

SEQ ID NO: 361663 - RNA, 13 nt, Bordetella pertussis
guccaggcgcgca

SEQ ID NO: 361664 - RNA, 14 nt, Bordetella pertussis
guccaggcgcgcca

SEQ ID NO: 361665 - RNA, 16 nt, Bordetella pertussis
guccaggcggccaucg

SEQ ID NO: 361666 - RNA, 22 nt, Bordetella pertussis
guccaggcggccaucgccgcca

SEQ ID NO: 361667 - RNA, 13 nt, Bordetella pertussis
guccaggcggccg

SEQ ID NO: 361668 - RNA, 15 nt, Bordetella pertussis
guccaggcggccgcg

SEQ ID NO: 361669 - RNA, 13 nt, Bordetella pertussis
guccaggcggugc

SEQ ID NO: 361670 - RNA, 16 nt, Bordetella pertussis
guccaggcugccggcg

SEQ ID NO: 361671 - RNA, 18 nt, Bordetella pertussis
guccaggugcggcggcga

SEQ ID NO: 361672 - RNA, 16 nt, Bordetella pertussis
guccaguacaccaggu

SEQ ID NO: 361673 - RNA, 18 nt, Bordetella pertussis
guccaucuggaccgcgcg

SEQ ID NO: 361674 - RNA, 12 nt, Bordetella pertussis
guccaugaacgc

SEQ ID NO: 361675 - RNA, 18 nt, Bordetella pertussis
guccaugaacgccgcgcc

SEQ ID NO: 361676 - RNA, 14 nt, Bordetella pertussis
guccaugccgccca

SEQ ID NO: 361677 - RNA, 13 nt, Bordetella pertussis
guccaugccggcc

SEQ ID NO: 361678 - RNA, 16 nt, Bordetella pertussis
guccaugccggccaug

SEQ ID NO: 361679 - RNA, 21 nt, Bordetella pertussis
guccaugcgaaugaucucgcg

SEQ ID NO: 361680 - RNA, 13 nt, Bordetella pertussis
guccauggcgugc

SEQ ID NO: 361681 - RNA, 14 nt, Bordetella pertussis
gucccacaggcgcg

SEQ ID NO: 361682 - RNA, 15 nt, Bordetella pertussis
gucccacaggcgcgc

SEQ ID NO: 361683 - RNA, 22 nt, Bordetella pertussis
gucccacaggcgcgcggcguug

SEQ ID NO: 361684 - RNA, 16 nt, Bordetella pertussis
guccccaugcggggac

SEQ ID NO: 361685 - RNA, 21 nt, Bordetella pertussis
guccccaugcggggacuggca

SEQ ID NO: 361686 - RNA, 15 nt, Bordetella pertussis
gucccccgcggggac

SEQ ID NO: 361687 - RNA, 21 nt, Bordetella pertussis
guccccgaacggggacuggca

SEQ ID NO: 361688 - RNA, 22 nt, Bordetella pertussis
guccccgcaagggggacuggca

SEQ ID NO: 361689 - RNA, 21 nt, Bordetella pertussis
guccccgcacggggacuggca

SEQ ID NO: 361690 - RNA, 21 nt, Bordetella pertussis
guccccgcauggagaccggcg

SEQ ID NO: 361691 - RNA, 20 nt, Bordetella pertussis
guccccgcaugggggcuggc

SEQ ID NO: 361692 - RNA, 21 nt, Bordetella pertussis
guccccgcaugggggcuggcg

SEQ ID NO: 361693 - RNA, 22 nt, Bordetella pertussis
guccccgcaugggggcuggcgc

SEQ ID NO: 361694 - RNA, 14 nt, Bordetella pertussis
guccccgccggggc

SEQ ID NO: 361695 - RNA, 19 nt, Bordetella pertussis
guccccgcggggacaggca

SEQ ID NO: 361696 - RNA, 20 nt, Bordetella pertussis
guccccgcggggacaggcac

SEQ ID NO: 361697 - RNA, 22 nt, Bordetella pertussis
guccccgcggggacaggcaccu

SEQ ID NO: 361698 - RNA, 19 nt, Bordetella pertussis
guccccgcggggacaggcu

SEQ ID NO: 361699 - RNA, 19 nt, Bordetella pertussis
guccccgcugggacaggca

SEQ ID NO: 361700 - RNA, 19 nt, Bordetella pertussis
gucccugcggggacuggcu

SEQ ID NO: 361701 - RNA, 11 nt, Bordetella pertussis
gucccuggcca

SEQ ID NO: 361702 - RNA, 19 nt, Bordetella pertussis
gucccuggcccuggcgggc

SEQ ID NO: 361703 - RNA, 20 nt, Bordetella pertussis
gucccuggcccuggcgggcc

SEQ ID NO: 361704 - RNA, 23 nt, Bordetella pertussis
gucccuggcccuggcgggccgga

SEQ ID NO: 361705 - RNA, 17 nt, Bordetella pertussis
gucccugguccagcagc

SEQ ID NO: 361706 - RNA, 15 nt, Bordetella pertussis
guccgagcccgggcg

SEQ ID NO: 361707 - RNA, 17 nt, Bordetella pertussis
guccgagcccgggcgug

SEQ ID NO: 361708 - RNA, 19 nt, Bordetella pertussis
guccgacgguagccggguc

SEQ ID NO: 361709 - RNA, 21 nt, Bordetella pertussis
guccgauggcgauguaggcca

SEQ ID NO: 361710 - RNA, 15 nt, Bordetella pertussis
guccgaugucgagga

SEQ ID NO: 361711 - RNA, 12 nt, Bordetella pertussis
guccgcagcgca

SEQ ID NO: 361712 - RNA, 13 nt, Bordetella pertussis
guccgcagcgcag

SEQ ID NO: 361713 - RNA, 18 nt, Bordetella pertussis
guccgcagcgcagcgcca

SEQ ID NO: 361714 - RNA, 14 nt, Bordetella pertussis
guccgcagcgcucg

SEQ ID NO: 361715 - RNA, 13 nt, Bordetella pertussis
guccgcaucgcgc

SEQ ID NO: 361716 - RNA, 18 nt, Bordetella pertussis
guccgccacccuggcacg

SEQ ID NO: 361717 - RNA, 17 nt, Bordetella pertussis
guccgccacgccggcca

SEQ ID NO: 361718 - RNA, 11 nt, Bordetella pertussis
guccgccaugc

SEQ ID NO: 361719 - RNA, 15 nt, Bordetella pertussis
guccgccugcggacg

SEQ ID NO: 361720 - RNA, 17 nt, Bordetella pertussis
guccgccugcggacggc

SEQ ID NO: 361721 - RNA, 20 nt, Bordetella pertussis
guccgccugcggacggcggg

SEQ ID NO: 361722 - RNA, 21 nt, Bordetella pertussis
guccgccugcggacggcgggc

SEQ ID NO: 361723 - RNA, 14 nt, Bordetella pertussis
guccgcgacggucc

SEQ ID NO: 361724 - RNA, 22 nt, Bordetella pertussis
guccgcgcccauuucgauggcc

SEQ ID NO: 361725 - RNA, 13 nt, Bordetella pertussis
guccgcgccggga

SEQ ID NO: 361726 - RNA, 14 nt, Bordetella pertussis
guccgcgcgcagcg

SEQ ID NO: 361727 - RNA, 15 nt, Bordetella pertussis
guccgcgcucgccca

SEQ ID NO: 361728 - RNA, 19 nt, Bordetella pertussis
guccgcgcucgcccagccg

SEQ ID NO: 361729 - RNA, 19 nt, Bordetella pertussis
guccggcgcccgccgccgg

SEQ ID NO: 361730 - RNA, 13 nt, Bordetella pertussis
guccggcgcucgc

SEQ ID NO: 361731 - RNA, 19 nt, Bordetella pertussis
guccggcgcucgccccggc

SEQ ID NO: 361732 - RNA, 22 nt, Bordetella pertussis
guccggcgcucgccccggcgcg

SEQ ID NO: 361733 - RNA, 23 nt, Bordetella pertussis
guccggcgcucgccccggcgcgc

SEQ ID NO: 361734 - RNA, 17 nt, Bordetella pertussis
guccggcgugccaugga

SEQ ID NO: 361735 - RNA, 22 nt, Bordetella pertussis
guccgggccgguuucggccugc

SEQ ID NO: 361736 - RNA, 12 nt, Bordetella pertussis
guccgggcggcg

SEQ ID NO: 361737 - RNA, 13 nt, Bordetella pertussis
guccgggcggcgu

SEQ ID NO: 361738 - RNA, 15 nt, Bordetella pertussis
guccggggcgggcgc

SEQ ID NO: 361739 - RNA, 14 nt, Bordetella pertussis
guccuggucgacca

SEQ ID NO: 361740 - RNA, 18 nt, Bordetella pertussis
guccuggucggcgcggca

SEQ ID NO: 361741 - RNA, 18 nt, Bordetella pertussis
guccuuacuugcgcacgg

SEQ ID NO: 361742 - RNA, 14 nt, Bordetella pertussis
guccuucagcacgc

SEQ ID NO: 361743 - RNA, 15 nt, Bordetella pertussis
guccuugacgccgcc

SEQ ID NO: 361744 - RNA, 16 nt, Bordetella pertussis
guccuugacgccgccg

SEQ ID NO: 361745 - RNA, 20 nt, Bordetella pertussis
guccuugacgccgccgaacg

SEQ ID NO: 361746 - RNA, 15 nt, Bordetella pertussis
guccuugagcgccag

SEQ ID NO: 361747 - RNA, 15 nt, Bordetella pertussis
guccuucucuucgcg

SEQ ID NO: 361748 - RNA, 14 nt, Bordetella pertussis
guccuugccgggcu

SEQ ID NO: 361749 - RNA, 19 nt, Bordetella pertussis
guccuuggcgccggcgaug

SEQ ID NO: 361750 - RNA, 14 nt, Bordetella pertussis
gucgaacagcauca

SEQ ID NO: 361751 - RNA, 23 nt, Bordetella pertussis
gucgaacaggcgcuugcgcucgg

SEQ ID NO: 361752 - RNA, 14 nt, Bordetella pertussis
gucgaaccagccgu

SEQ ID NO: 361753 - RNA, 23 nt, Bordetella pertussis
gucgaaccagccguucaucagcg

SEQ ID NO: 361754 - RNA, 22 nt, Bordetella pertussis
gucgaacgcuuccugggccugc

SEQ ID NO: 361755 - RNA, 15 nt, Bordetella pertussis
gucgaacggccgggc

SEQ ID NO: 361756 - RNA, 16 nt, Bordetella pertussis
gucgaacuccucgacg

SEQ ID NO: 361757 - RNA, 21 nt, Bordetella pertussis
gucgaacucgaacacgccgac

SEQ ID NO: 361758 - RNA, 23 nt, Bordetella pertussis
gucgaccacgccggcggccauga

SEQ ID NO: 361759 - RNA, 20 nt, Bordetella pertussis
gucgaccagcagccgguugg

SEQ ID NO: 361760 - RNA, 12 nt, Bordetella pertussis
gucgaccaggcc

SEQ ID NO: 361761 - RNA, 18 nt, Bordetella pertussis
gucgaccaguucggccag

SEQ ID NO: 361762 - RNA, 20 nt, Bordetella pertussis
gucgaccaguucggccagca

SEQ ID NO: 361763 - RNA, 22 nt, Bordetella pertussis
gucgaccaguucggccagcagc

SEQ ID NO: 361764 - RNA, 17 nt, Bordetella pertussis
gucgaccaguuggcccu

SEQ ID NO: 361765 - RNA, 20 nt, Bordetella pertussis
gucgaccaggccggugcgca

SEQ ID NO: 361766 - RNA, 17 nt, Bordetella pertussis
gucgacccaccuggcca

SEQ ID NO: 361767 - RNA, 14 nt, Bordetella pertussis
gucgacgaucucgc

SEQ ID NO: 361768 - RNA, 15 nt, Bordetella pertussis
gucgacgaucucgcg

SEQ ID NO: 361769 - RNA, 18 nt, Bordetella pertussis
gucgacgaucucgcggcu

SEQ ID NO: 361770 - RNA, 21 nt, Bordetella pertussis
gucgacgaucucgcggcuggu

SEQ ID NO: 361771 - RNA, 23 nt, Bordetella pertussis
gucgacgaucaggcccuggggcc

SEQ ID NO: 361772 - RNA, 18 nt, Bordetella pertussis
gucgacgcccgcgcccag

SEQ ID NO: 361773 - RNA, 15 nt, Bordetella pertussis
gucgacgccgaaggu

SEQ ID NO: 361774 - RNA, 13 nt, Bordetella pertussis
gucgacgccggcg

SEQ ID NO: 361775 - RNA, 15 nt, Bordetella pertussis
gucgacgccggcgac

SEQ ID NO: 361776 - RNA, 16 nt, Bordetella pertussis
gucgacgcgaugcccg

SEQ ID NO: 361777 - RNA, 17 nt, Bordetella pertussis
gucgagagccugggcgc

SEQ ID NO: 361778 - RNA, 13 nt, Bordetella pertussis
gucgagcaccgcg

SEQ ID NO: 361779 - RNA, 21 nt, Bordetella pertussis
gucgagcacgcggcgcggcag

SEQ ID NO: 361780 - RNA, 22 nt, Bordetella pertussis
gucgagcacgcggcgcggcagg

SEQ ID NO: 361781 - RNA, 15 nt, Bordetella pertussis
gucgagcaggccggc

SEQ ID NO: 361782 - RNA, 17 nt, Bordetella pertussis
gucgagcaggccggcgu

SEQ ID NO: 361783 - RNA, 15 nt, Bordetella pertussis
gucgagcaucccggc

SEQ ID NO: 361784 - RNA, 20 nt, Bordetella pertussis
gucgagcaucccggcgcuca

SEQ ID NO: 361785 - RNA, 23 nt, Bordetella pertussis
gucgagcaucccggcgcucagcg

SEQ ID NO: 361786 - RNA, 13 nt, Bordetella pertussis
gucgagccaggug

SEQ ID NO: 361787 - RNA, 22 nt, Bordetella pertussis
gucgagccagguggacagcgcc

SEQ ID NO: 361788 - RNA, 20 nt, Bordetella pertussis
gucgagccgggccacgcgca

SEQ ID NO: 361789 - RNA, 19 nt, Bordetella pertussis
gucgaggaucaaggcccgg

SEQ ID NO: 361790 - RNA, 23 nt, Bordetella pertussis
gucgaggaucaugucguccucgg

SEQ ID NO: 361791 - RNA, 22 nt, Bordetella pertussis
gucgauccggcagcagcagcgu

SEQ ID NO: 361792 - RNA, 13 nt, Bordetella pertussis
gucgaucgccacc

SEQ ID NO: 361793 - RNA, 19 nt, Bordetella pertussis
gucgaucgccaccagcguc

SEQ ID NO: 361794 - RNA, 21 nt, Bordetella pertussis
gucgaugaacaagguacccgc

SEQ ID NO: 361795 - RNA, 17 nt, Bordetella pertussis
gucgaugaaggcgccga

SEQ ID NO: 361796 - RNA, 18 nt, Bordetella pertussis
gucgaugaaggcgccgac

SEQ ID NO: 361797 - RNA, 17 nt, Bordetella pertussis
gucgaucuucgccugca

SEQ ID NO: 361798 - RNA, 19 nt, Bordetella pertussis
gucgaugaccagcgccggc

SEQ ID NO: 361799 - RNA, 20 nt, Bordetella pertussis
gucgaugaccagcgccggcg

SEQ ID NO: 361800 - RNA, 13 nt, Bordetella pertussis
gucgaugacgcgc

SEQ ID NO: 361801 - RNA, 19 nt, Bordetella pertussis
gucgaugacgcgccgcgcc

SEQ ID NO: 361802 - RNA, 23 nt, Bordetella pertussis
gucgaugauccacagucggucgc

SEQ ID NO: 361803 - RNA, 22 nt, Bordetella pertussis
gucgaugaugcgguugaucagg

SEQ ID NO: 361804 - RNA, 20 nt, Bordetella pertussis
gucgaugcccucccagaaac

SEQ ID NO: 361805 - RNA, 16 nt, Bordetella pertussis
gucgaugccgaccagg

SEQ ID NO: 361806 - RNA, 15 nt, Bordetella pertussis
gucgaugcgcacgcc

SEQ ID NO: 361807 - RNA, 18 nt, Bordetella pertussis
gucgaugcgcacgcccag

SEQ ID NO: 361808 - RNA, 22 nt, Bordetella pertussis
gucgaugcgguuguugccgcgu

SEQ ID NO: 361809 - RNA, 17 nt, Bordetella pertussis
gucgauggcccgcaggu

SEQ ID NO: 361810 - RNA, 19 nt, Bordetella pertussis
gucgaugggcccgggcagg

SEQ ID NO: 361811 - RNA, 20 nt, Bordetella pertussis
gucgaugggguagucggcca

SEQ ID NO: 361812 - RNA, 21 nt, Bordetella pertussis
gucgaugggguagucggccac

SEQ ID NO: 361813 - RNA, 23 nt, Bordetella pertussis
gucgaugggguagucggccacca

SEQ ID NO: 361814 - RNA, 22 nt, Bordetella pertussis
gucgauggucaguccgcccagc

SEQ ID NO: 361815 - RNA, 16 nt, Bordetella pertussis
gucgauguccagcgcc

SEQ ID NO: 361816 - RNA, 20 nt, Bordetella pertussis
gucgauuaugccgcccgcaa

SEQ ID NO: 361817 - RNA, 15 nt, Bordetella pertussis
gucgcagcacgccca

SEQ ID NO: 361818 - RNA, 18 nt, Bordetella pertussis
gucgcccaccacgccgcc

SEQ ID NO: 361819 - RNA, 22 nt, Bordetella pertussis
gucgcccacauagaccggcugc

SEQ ID NO: 361820 - RNA, 23 nt, Bordetella pertussis
gucgccccgacgcgcuuccagga

SEQ ID NO: 361821 - RNA, 21 nt, Bordetella pertussis
gucgcccuggauggcggccgc

SEQ ID NO: 361822 - RNA, 14 nt, Bordetella pertussis
gucgcccuggcggc

SEQ ID NO: 361823 - RNA, 22 nt, Bordetella pertussis
gucgcccuugggcucgucgacg

SEQ ID NO: 361824 - RNA, 12 nt, Bordetella pertussis
gucgccggccag

SEQ ID NO: 361825 - RNA, 15 nt, Bordetella pertussis
gucgccggcgcugcu

SEQ ID NO: 361826 - RNA, 20 nt, Bordetella pertussis
gucgccggcgcugcugucgc

SEQ ID NO: 361827 - RNA, 13 nt, Bordetella pertussis
gucgccggcgaug

SEQ ID NO: 361828 - RNA, 18 nt, Bordetella pertussis
gucgccggcgaugacggc

SEQ ID NO: 361829 - RNA, 15 nt, Bordetella pertussis
gucgccggcgcaacg

SEQ ID NO: 361830 - RNA, 20 nt, Bordetella pertussis
gucgccggggcgcaccggca

SEQ ID NO: 361831 - RNA, 22 nt, Bordetella pertussis
gucgccggggcgcaccggcacg

SEQ ID NO: 361832 - RNA, 23 nt, Bordetella pertussis
gucgccgguggugucgaacagcg

SEQ ID NO: 361833 - RNA, 21 nt, Bordetella pertussis
gucgccguacucgccggucgc

SEQ ID NO: 361834 - RNA, 22 nt, Bordetella pertussis
gucgccgucaggaucaggccgg

SEQ ID NO: 361835 - RNA, 23 nt, Bordetella pertussis
gucgccgucaggaucaggccggc

SEQ ID NO: 361836 - RNA, 17 nt, Bordetella pertussis
gucgccguccaggcgcc

SEQ ID NO: 361837 - RNA, 19 nt, Bordetella pertussis
gucgccguucuggcugcgc

SEQ ID NO: 361838 - RNA, 23 nt, Bordetella pertussis
gucgccucccauugcgcggccag

SEQ ID NO: 361839 - RNA, 19 nt, Bordetella pertussis
gucgccugcccgcacgggc

SEQ ID NO: 361840 - RNA, 23 nt, Bordetella pertussis
gucgccugcccgcacgggccgac

SEQ ID NO: 361841 - RNA, 18 nt, Bordetella pertussis
gucgccuggucgacgccg

SEQ ID NO: 361842 - RNA, 15 nt, Bordetella pertussis
gucgccuguaucagc

SEQ ID NO: 361843 - RNA, 19 nt, Bordetella pertussis
gucgcgcauggacgccgcc

SEQ ID NO: 361844 - RNA, 15 nt, Bordetella pertussis
gucgcgccagcggcc

SEQ ID NO: 361845 - RNA, 14 nt, Bordetella pertussis
gucgcgccaggccg

SEQ ID NO: 361846 - RNA, 17 nt, Bordetella pertussis
gucgcgccaggccggcg

SEQ ID NO: 361847 - RNA, 16 nt, Bordetella pertussis
gucgcgcccgccgugg

SEQ ID NO: 361848 - RNA, 17 nt, Bordetella pertussis
gucgcgcccgccguggc

SEQ ID NO: 361849 - RNA, 19 nt, Bordetella pertussis
gucgcgcccgccguggcca

SEQ ID NO: 361850 - RNA, 18 nt, Bordetella pertussis
gucgcgcgagaccagcgg

SEQ ID NO: 361851 - RNA, 13 nt, Bordetella pertussis
gucgcgcgcacgc

SEQ ID NO: 361852 - RNA, 17 nt, Bordetella pertussis
gucgcgcgcacgcgcuc

SEQ ID NO: 361853 - RNA, 12 nt, Bordetella pertussis
gucgcgcgcauc

SEQ ID NO: 361854 - RNA, 22 nt, Bordetella pertussis
gucgcgcgccugcgcgccgccu

SEQ ID NO: 361855 - RNA, 16 nt, Bordetella pertussis
gucgcgcggcggcacc

SEQ ID NO: 361856 - RNA, 22 nt, Bordetella pertussis
gucgcgcggcggcaccagcagg

SEQ ID NO: 361857 - RNA, 17 nt, Bordetella pertussis
gucgcgcuacagcgugg

SEQ ID NO: 361858 - RNA, 23 nt, Bordetella pertussis
gucgcgcgacgugucggccacca

SEQ ID NO: 361859 - RNA, 14 nt, Bordetella pertussis
gucgcgcgacuggc

SEQ ID NO: 361860 - RNA, 15 nt, Bordetella pertussis
gucgcgcucggacgc

SEQ ID NO: 361861 - RNA, 22 nt, Bordetella pertussis
gucgcgcugcgacagcagcaug

SEQ ID NO: 361862 - RNA, 13 nt, Bordetella pertussis
gucgcgcuggccc

SEQ ID NO: 361863 - RNA, 20 nt, Bordetella pertussis
gucgcgcuggcccgcgcgag

SEQ ID NO: 361864 - RNA, 23 nt, Bordetella pertussis
gucgcgcugcaauugcgcggcca

SEQ ID NO: 361865 - RNA, 21 nt, Bordetella pertussis
gucgcggcgucgaccgcgggc

SEQ ID NO: 361866 - RNA, 22 nt, Bordetella pertussis
gucgcgggagaucuguaccgcc

SEQ ID NO: 361867 - RNA, 20 nt, Bordetella pertussis
gucgcggcguuguagccgua

SEQ ID NO: 361868 - RNA, 14 nt, Bordetella pertussis
gucgcgggccaggc

SEQ ID NO: 361869 - RNA, 18 nt, Bordetella pertussis
gucggcgaagccuugcgc

SEQ ID NO: 361870 - RNA, 23 nt, Bordetella pertussis
gucggcgaagccuugcgcggcca

SEQ ID NO: 361871 - RNA, 13 nt, Bordetella pertussis
gucggcgcccggc

SEQ ID NO: 361872 - RNA, 14 nt, Bordetella pertussis
gucggcgcccagcu

SEQ ID NO: 361873 - RNA, 14 nt, Bordetella pertussis
gucggcgccgcgca

SEQ ID NO: 361874 - RNA, 15 nt, Bordetella pertussis
gucggcgccgcgcag

SEQ ID NO: 361875 - RNA, 17 nt, Bordetella pertussis
gucggcgccgcgcagca

SEQ ID NO: 361876 - RNA, 19 nt, Bordetella pertussis
gucggcgccgaucagcagg

SEQ ID NO: 361877 - RNA, 14 nt, Bordetella pertussis
gucggcgccgaugg

SEQ ID NO: 361878 - RNA, 13 nt, Bordetella pertussis
gucggcgggacgc

SEQ ID NO: 361879 - RNA, 20 nt, Bordetella pertussis
gucggcgggacgcaggccca

SEQ ID NO: 361880 - RNA, 19 nt, Bordetella pertussis
gucggcguaaggccgccgg

SEQ ID NO: 361881 - RNA, 20 nt, Bordetella pertussis
gucggcguaaggccgccggc

SEQ ID NO: 361882 - RNA, 21 nt, Bordetella pertussis
gucggcguaaggccgccggcc

SEQ ID NO: 361883 - RNA, 21 nt, Bordetella pertussis
gucggcguugugccggcgcag

SEQ ID NO: 361884 - RNA, 19 nt, Bordetella pertussis
gucggcucggugaugaugg

SEQ ID NO: 361885 - RNA, 16 nt, Bordetella pertussis
gucggcucgucgaaca

SEQ ID NO: 361886 - RNA, 16 nt, Bordetella pertussis
gucggcuuccaucagg

SEQ ID NO: 361887 - RNA, 22 nt, Bordetella pertussis
gucgggaccgaacaccaccgag

SEQ ID NO: 361888 - RNA, 13 nt, Bordetella pertussis
gucgggaccggcg

SEQ ID NO: 361889 - RNA, 16 nt, Bordetella pertussis
gucgggaccggcgcgu

SEQ ID NO: 361890 - RNA, 17 nt, Bordetella pertussis
gucgggauaguccagca

SEQ ID NO: 361891 - RNA, 17 nt, Bordetella pertussis
gucgggcaagcggcgua

SEQ ID NO: 361892 - RNA, 14 nt, Bordetella pertussis
gucgggcaccagca

SEQ ID NO: 361893 - RNA, 15 nt, Bordetella pertussis
gucgggcaccagcac

SEQ ID NO: 361894 - RNA, 15 nt, Bordetella pertussis
gucgggcagcgcccg

SEQ ID NO: 361895 - RNA, 21 nt, Bordetella pertussis
gucgggcagcgcccgcgccau

SEQ ID NO: 361896 - RNA, 18 nt, Bordetella pertussis
gucgggcagcgcggcggc

SEQ ID NO: 361897 - RNA, 19 nt, Bordetella pertussis
gucgggcagggugggcacg

SEQ ID NO: 361898 - RNA, 19 nt, Bordetella pertussis
gucgggcaggucggcgcgg

SEQ ID NO: 361899 - RNA, 22 nt, Bordetella pertussis
gucgggcaguugcuggcggccg

SEQ ID NO: 361900 - RNA, 12 nt, Bordetella pertussis
gucgggcggcgc

SEQ ID NO: 361901 - RNA, 14 nt, Bordetella pertussis
gucgggcggcgcga

SEQ ID NO: 361902 - RNA, 13 nt, Bordetella pertussis
gucgggcggcggc

SEQ ID NO: 361903 - RNA, 18 nt, Bordetella pertussis
gucgggcgccgcaacgcc

SEQ ID NO: 361904 - RNA, 17 nt, Bordetella pertussis
gucgggcuugccguuca

SEQ ID NO: 361905 - RNA, 22 nt, Bordetella pertussis
gucgggcuugccguucaugccg

SEQ ID NO: 361906 - RNA, 14 nt, Bordetella pertussis
gucggggcaggccu

SEQ ID NO: 361907 - RNA, 17 nt, Bordetella pertussis
gucggggccgggccggc

SEQ ID NO: 361908 - RNA, 17 nt, Bordetella pertussis
gucgggggccggcucgc

SEQ ID NO: 361909 - RNA, 14 nt, Bordetella pertussis
gucgggggcggccg

SEQ ID NO: 361910 - RNA, 14 nt, Bordetella pertussis
gucggggucggcca

SEQ ID NO: 361911 - RNA, 15 nt, Bordetella pertussis
gucggggucggccac

SEQ ID NO: 361912 - RNA, 16 nt, Bordetella pertussis
gucggggugccguucg

SEQ ID NO: 361913 - RNA, 23 nt, Bordetella pertussis
gucgggguggucuuccaggcgca

SEQ ID NO: 361914 - RNA, 13 nt, Bordetella pertussis
gucggguccagca

SEQ ID NO: 361915 - RNA, 21 nt, Bordetella pertussis
gucggguugcccugcgcaucg

SEQ ID NO: 361916 - RNA, 17 nt, Bordetella pertussis
gucggguugccgcugca

SEQ ID NO: 361917 - RNA, 18 nt, Bordetella pertussis
gucggucaucacgcgguc

SEQ ID NO: 361918 - RNA, 15 nt, Bordetella pertussis
gucggucgccuguau

SEQ ID NO: 361919 - RNA, 22 nt, Bordetella pertussis
gucggucgccuguaucagcgcc

SEQ ID NO: 361920 - RNA, 18 nt, Bordetella pertussis
gucggugaugauccugcu

SEQ ID NO: 361921 - RNA, 15 nt, Bordetella pertussis
gucggugcacacgcc

SEQ ID NO: 361922 - RNA, 19 nt, Bordetella pertussis
gucggugcacacgccuucg

SEQ ID NO: 361923 - RNA, 14 nt, Bordetella pertussis
gucgguggccagcc

SEQ ID NO: 361924 - RNA, 23 nt, Bordetella pertussis
gucgguggccagccaggcggugg

SEQ ID NO: 361925 - RNA, 19 nt, Bordetella pertussis
gucggugggaaucggcacc

SEQ ID NO: 361926 - RNA, 15 nt, Bordetella pertussis
gucgguggggcaggu

SEQ ID NO: 361927 - RNA, 18 nt, Bordetella pertussis
gucgguggggcaggucgc

SEQ ID NO: 361928 - RNA, 14 nt, Bordetella pertussis
gucgguggugacca

SEQ ID NO: 361929 - RNA, 20 nt, Bordetella pertussis
gucguagaacacgucgauca

SEQ ID NO: 361930 - RNA, 14 nt, Bordetella pertussis
gucguagcgccagc

SEQ ID NO: 361931 - RNA, 18 nt, Bordetella pertussis
gucguagcgcugcagcca

SEQ ID NO: 361932 - RNA, 16 nt, Bordetella pertussis
gucguagugcgcgccg

SEQ ID NO: 361933 - RNA, 14 nt, Bordetella pertussis
gucgucagcacgcc

SEQ ID NO: 361934 - RNA, 15 nt, Bordetella pertussis
gucgucagcgccgcg

SEQ ID NO: 361935 - RNA, 17 nt, Bordetella pertussis
gucguccaauucgagca

SEQ ID NO: 361936 - RNA, 21 nt, Bordetella pertussis
gucguccagcacgcggcgcag

SEQ ID NO: 361937 - RNA, 17 nt, Bordetella pertussis
gucguccagcgucaugc

SEQ ID NO: 361938 - RNA, 21 nt, Bordetella pertussis
gucguccagcgucaugcgcac

SEQ ID NO: 361939 - RNA, 14 nt, Bordetella pertussis
gucguccaggcgca

SEQ ID NO: 361940 - RNA, 14 nt, Bordetella pertussis
gucguccagcgugg

SEQ ID NO: 361941 - RNA, 18 nt, Bordetella pertussis
gucguccccaauacccgc

SEQ ID NO: 361942 - RNA, 16 nt, Bordetella pertussis
gucguccucgaugacg

SEQ ID NO: 361943 - RNA, 18 nt, Bordetella pertussis
gucguccucggcacggcc

SEQ ID NO: 361944 - RNA, 20 nt, Bordetella pertussis
gucguccucggcacggccag

SEQ ID NO: 361945 - RNA, 15 nt, Bordetella pertussis
gucguccucggccac

SEQ ID NO: 361946 - RNA, 20 nt, Bordetella pertussis
gucguccucggccacgucgg

SEQ ID NO: 361947 - RNA, 21 nt, Bordetella pertussis
gucgucgaaggcgcgcuccag

SEQ ID NO: 361948 - RNA, 23 nt, Bordetella pertussis
gucgucgaugaugacgaccuugc

SEQ ID NO: 361949 - RNA, 13 nt, Bordetella pertussis
gucgucgaugccg

SEQ ID NO: 361950 - RNA, 21 nt, Bordetella pertussis
gucgucgaugccgaccaggcu

SEQ ID NO: 361951 - RNA, 15 nt, Bordetella pertussis
gucgucgccaccgcc

SEQ ID NO: 361952 - RNA, 15 nt, Bordetella pertussis
gucgucgccgucgcc

SEQ ID NO: 361953 - RNA, 14 nt, Bordetella pertussis
gucgucgcgcuggc

SEQ ID NO: 361954 - RNA, 16 nt, Bordetella pertussis
gucgucgcgguccagc

SEQ ID NO: 361955 - RNA, 23 nt, Bordetella pertussis
gucgucggcaccuucgcgcagcg

SEQ ID NO: 361956 - RNA, 18 nt, Bordetella pertussis
gucgucggcgcugcagcg

SEQ ID NO: 361957 - RNA, 16 nt, Bordetella pertussis
gucgucgggaccggcg

SEQ ID NO: 361958 - RNA, 17 nt, Bordetella pertussis
gucgucgggcggcgcga

SEQ ID NO: 361959 - RNA, 21 nt, Bordetella pertussis
gucgucgggcggcgcgaacgg

SEQ ID NO: 361960 - RNA, 22 nt, Bordetella pertussis
gucgucguccacgcccggugcc

SEQ ID NO: 361961 - RNA, 18 nt, Bordetella pertussis
gucgugaucgccagcgcc

SEQ ID NO: 361962 - RNA, 20 nt, Bordetella pertussis
gucgugaucgccagcgccgg

SEQ ID NO: 361963 - RNA, 13 nt, Bordetella pertussis
gucgugcaggacc

SEQ ID NO: 361964 - RNA, 15 nt, Bordetella pertussis
gucgugcccgccacc

SEQ ID NO: 361965 - RNA, 23 nt, Bordetella pertussis
gucgugcccucgggaaacaggcc

SEQ ID NO: 361966 - RNA, 18 nt, Bordetella pertussis
gucgugcggcacgcacag

SEQ ID NO: 361967 - RNA, 13 nt, Bordetella pertussis
gucgugcuggcgc

SEQ ID NO: 361968 - RNA, 14 nt, Bordetella pertussis
gucgugcuggcuga

SEQ ID NO: 361969 - RNA, 16 nt, Bordetella pertussis
gucguggcccagccgg

SEQ ID NO: 361970 - RNA, 21 nt, Bordetella pertussis
gucguggcccagccggugcgc

SEQ ID NO: 361971 - RNA, 16 nt, Bordetella pertussis
gucguggcgauagcgc

SEQ ID NO: 361972 - RNA, 14 nt, Bordetella pertussis
gucguggggcgcgg

SEQ ID NO: 361973 - RNA, 21 nt, Bordetella pertussis
gucguggggcgcggcggcguu

SEQ ID NO: 361974 - RNA, 13 nt, Bordetella pertussis
gucguggucgaca

SEQ ID NO: 361975 - RNA, 22 nt, Bordetella pertussis
gucguggucgacauagacgcgc

SEQ ID NO: 361976 - RNA, 17 nt, Bordetella pertussis
gucguucggcugagcuc

SEQ ID NO: 361977 - RNA, 19 nt, Bordetella pertussis
gucguucugcguggcggcg

SEQ ID NO: 361978 - RNA, 23 nt, Bordetella pertussis
gucguugacggggacgccggcgg

SEQ ID NO: 361979 - RNA, 16 nt, Bordetella pertussis
gucguugccggccagc

SEQ ID NO: 361980 - RNA, 19 nt, Bordetella pertussis
gucguugccggccagcacg

SEQ ID NO: 361981 - RNA, 17 nt, Bordetella pertussis
gucuacgccaugagcgc

SEQ ID NO: 361982 - RNA, 16 nt, Bordetella pertussis
gucuaugucgaggacc

SEQ ID NO: 361983 - RNA, 23 nt, Bordetella pertussis
gucuccacgaagucgaaccagcc

SEQ ID NO: 361984 - RNA, 15 nt, Bordetella pertussis
gucuccagcgcggcg

SEQ ID NO: 361985 - RNA, 19 nt, Bordetella pertussis
gucuccaggcucaggcggc

SEQ ID NO: 361986 - RNA, 16 nt, Bordetella pertussis
gucucccccucggccu

SEQ ID NO: 361987 - RNA, 17 nt, Bordetella pertussis
gucucccccucggccug

SEQ ID NO: 361988 - RNA, 15 nt, Bordetella pertussis
gucucccggcaugau

SEQ ID NO: 361989 - RNA, 18 nt, Bordetella pertussis
gucuccgguucggcgcgg

SEQ ID NO: 361990 - RNA, 15 nt, Bordetella pertussis
gucucgaacgccgcg

SEQ ID NO: 361991 - RNA, 21 nt, Bordetella pertussis
gucucgcccacccccggcacc

SEQ ID NO: 361992 - RNA, 19 nt, Bordetella pertussis
gucucgcccaggcccagca

SEQ ID NO: 361993 - RNA, 19 nt, Bordetella pertussis
gucucgcgcgccaggugca

SEQ ID NO: 361994 - RNA, 19 nt, Bordetella pertussis
gucucggccacggucggca

SEQ ID NO: 361995 - RNA, 17 nt, Bordetella pertussis
gucucgguggaggacgc

SEQ ID NO: 361996 - RNA, 21 nt, Bordetella pertussis
gucucguuccagaugcgcagc

SEQ ID NO: 361997 - RNA, 13 nt, Bordetella pertussis
gucugagcgccgg

SEQ ID NO: 361998 - RNA, 19 nt, Bordetella pertussis
gucugcaagguggcgugca

SEQ ID NO: 361999 - RNA, 22 nt, Bordetella pertussis
gucugcaccggcuugucgacca

SEQ ID NO: 362000 - RNA, 13 nt, Bordetella pertussis
gucugcacgccgg

SEQ ID NO: 362001 - RNA, 15 nt, Bordetella pertussis
gucugcccgcggucc

SEQ ID NO: 362002 - RNA, 21 nt, Bordetella pertussis
gucugcccgcgguccagcacg

SEQ ID NO: 362003 - RNA, 19 nt, Bordetella pertussis
gucugccguuccagcugcu

SEQ ID NO: 362004 - RNA, 15 nt, Bordetella pertussis
gucugccuggcgaac

SEQ ID NO: 362005 - RNA, 13 nt, Bordetella pertussis
gucugcgugcgcg

SEQ ID NO: 362006 - RNA, 16 nt, Bordetella pertussis
gucugcgugcgcggcg

SEQ ID NO: 362007 - RNA, 16 nt, Bordetella pertussis
gucugcgugugccgcc

SEQ ID NO: 362008 - RNA, 18 nt, Bordetella pertussis
gucugcgugugccgccag

SEQ ID NO: 362009 - RNA, 20 nt, Bordetella pertussis
gucugcgugugccgccagcg

SEQ ID NO: 362010 - RNA, 17 nt, Bordetella pertussis
gucugcuacaccgugcu

SEQ ID NO: 362011 - RNA, 20 nt, Bordetella pertussis
gucugcuacaccgugcuggc

SEQ ID NO: 362012 - RNA, 22 nt, Bordetella pertussis
gucugcuacaccgugcuggccg

SEQ ID NO: 362013 - RNA, 16 nt, Bordetella pertussis
gucuggagcggccugg

SEQ ID NO: 362014 - RNA, 17 nt, Bordetella pertussis
gucuggagcggccuggc

SEQ ID NO: 362015 - RNA, 19 nt, Bordetella pertussis
gucuggagcggccuggccc

SEQ ID NO: 362016 - RNA, 13 nt, Bordetella pertussis
gucuggaggacga

SEQ ID NO: 362017 - RNA, 16 nt, Bordetella pertussis
gucuggcaccugccga

SEQ ID NO: 362018 - RNA, 16 nt, Bordetella pertussis
gucuggcccacgcgca

SEQ ID NO: 362019 - RNA, 18 nt, Bordetella pertussis
gucuggcccacgcgcacg

SEQ ID NO: 362020 - RNA, 15 nt, Bordetella pertussis
gucuggccggccgcg

SEQ ID NO: 362021 - RNA, 15 nt, Bordetella pertussis
gucuggcuucguugg

SEQ ID NO: 362022 - RNA, 21 nt, Bordetella pertussis
gucugggcgucccaggccacg

SEQ ID NO: 362023 - RNA, 13 nt, Bordetella pertussis
gucugugggcggu

SEQ ID NO: 362024 - RNA, 18 nt, Bordetella pertussis
gucuuccgguacgcgcag

SEQ ID NO: 362025 - RNA, 14 nt, Bordetella pertussis
gucuucggcgcggc

SEQ ID NO: 362026 - RNA, 15 nt, Bordetella pertussis
gucuucggcgcggcg

SEQ ID NO: 362027 - RNA, 19 nt, Bordetella pertussis
gucuugaggauaucggcca

SEQ ID NO: 362028 - RNA, 20 nt, Bordetella pertussis
gucuugcccgccagcgcggc

SEQ ID NO: 362029 - RNA, 21 nt, Bordetella pertussis
gucuugcccgccagcgcggcu

SEQ ID NO: 362030 - RNA, 13 nt, Bordetella pertussis
gucuugccgcgca

SEQ ID NO: 362031 - RNA, 14 nt, Bordetella pertussis
gucuuggcgggcac

SEQ ID NO: 362032 - RNA, 20 nt, Bordetella pertussis
gugaaacagcaucagcggca

SEQ ID NO: 362033 - RNA, 22 nt, Bordetella pertussis
gugaaacagcaucagcggcagc

SEQ ID NO: 362034 - RNA, 20 nt, Bordetella pertussis
gugaacaccaggguggcgcc

SEQ ID NO: 362035 - RNA, 18 nt, Bordetella pertussis
gugaacgccccggccgau

SEQ ID NO: 362036 - RNA, 19 nt, Bordetella pertussis
gugaacgccaccaggccga

SEQ ID NO: 362037 - RNA, 15 nt, Bordetella pertussis
gugaacucggggugg

SEQ ID NO: 362038 - RNA, 17 nt, Bordetella pertussis
gugaaggcgcccgggcu

SEQ ID NO: 362039 - RNA, 12 nt, Bordetella pertussis
gugaaggugccg

SEQ ID NO: 362040 - RNA, 14 nt, Bordetella pertussis
gugaagucggcccu

SEQ ID NO: 362041 - RNA, 14 nt, Bordetella pertussis
gugaccaccaggcc

SEQ ID NO: 362042 - RNA, 15 nt, Bordetella pertussis
gugaccaccaggccg

SEQ ID NO: 362043 - RNA, 13 nt, Bordetella pertussis
gugacccgguggc

SEQ ID NO: 362044 - RNA, 15 nt, Bordetella pertussis
gugaccgccagcagg

SEQ ID NO: 362045 - RNA, 19 nt, Bordetella pertussis
gugaccgccagcaggcgcu

SEQ ID NO: 362046 - RNA, 14 nt, Bordetella pertussis
gugaccgcgacgcg

SEQ ID NO: 362047 - RNA, 18 nt, Bordetella pertussis
gugaccgcgacgcgccug

SEQ ID NO: 362048 - RNA, 19 nt, Bordetella pertussis
gugaccgcguaggccuuca

SEQ ID NO: 362049 - RNA, 21 nt, Bordetella pertussis
gugaccugcgucugcgugccg

SEQ ID NO: 362050 - RNA, 20 nt, Bordetella pertussis
gugaccuggcgcgcgaacgg

SEQ ID NO: 362051 - RNA, 23 nt, Bordetella pertussis
gugacgacgcguuguucgggccg

SEQ ID NO: 362052 - RNA, 17 nt, Bordetella pertussis
gugacgauauccaggcg

SEQ ID NO: 362053 - RNA, 17 nt, Bordetella pertussis
gugacgauggugcgcag

SEQ ID NO: 362054 - RNA, 17 nt, Bordetella pertussis
gugacgcuggagauggc

SEQ ID NO: 362055 - RNA, 22 nt, Bordetella pertussis
gugacgcuggagauggcgccga

SEQ ID NO: 362056 - RNA, 19 nt, Bordetella pertussis
gugacgcuggagcgcggcg

SEQ ID NO: 362057 - RNA, 14 nt, Bordetella pertussis
gugacgcugauggc

SEQ ID NO: 362058 - RNA, 20 nt, Bordetella pertussis
gugacggccgccacgcccug

SEQ ID NO: 362059 - RNA, 17 nt, Bordetella pertussis
gugacguugaccuugcc

SEQ ID NO: 362060 - RNA, 16 nt, Bordetella pertussis
gugacguugccgcgcg

SEQ ID NO: 362061 - RNA, 17 nt, Bordetella pertussis
gugacguugccgcgcgc

SEQ ID NO: 362062 - RNA, 22 nt, Bordetella pertussis
gugacguugccgcgcgcguaug

SEQ ID NO: 362063 - RNA, 14 nt, Bordetella pertussis
gugacuucggccgc

SEQ ID NO: 362064 - RNA, 22 nt, Bordetella pertussis
gugacuucggccgccagccggc

SEQ ID NO: 362065 - RNA, 12 nt, Bordetella pertussis
gugagcgccacc

SEQ ID NO: 362066 - RNA, 16 nt, Bordetella pertussis
gugagcgccgccgcca

SEQ ID NO: 362067 - RNA, 18 nt, Bordetella pertussis
gugagcguaagcccacuc

SEQ ID NO: 362068 - RNA, 15 nt, Bordetella pertussis
gugauagacauugcc

SEQ ID NO: 362069 - RNA, 22 nt, Bordetella pertussis
gugauagacauugcccagcacc

SEQ ID NO: 362070 - RNA, 21 nt, Bordetella pertussis
gugcaccacgcgcuccaugau

SEQ ID NO: 362071 - RNA, 16 nt, Bordetella pertussis
gugcagcccagcacca

SEQ ID NO: 362072 - RNA, 13 nt, Bordetella pertussis
gugcagcgcacgg

SEQ ID NO: 362073 - RNA, 20 nt, Bordetella pertussis
gugcagcgacuugucgcgcc

SEQ ID NO: 362074 - RNA, 15 nt, Bordetella pertussis
gugcagcgccgcgcg

SEQ ID NO: 362075 - RNA, 19 nt, Bordetella pertussis
gugcagcgcgugggccagu

SEQ ID NO: 362076 - RNA, 12 nt, Bordetella pertussis
gugcagcggcag

SEQ ID NO: 362077 - RNA, 19 nt, Bordetella pertussis
gugcagcggcagcauggcg

SEQ ID NO: 362078 - RNA, 22 nt, Bordetella pertussis
gugcaggccgcgcagcacgccc

SEQ ID NO: 362079 - RNA, 14 nt, Bordetella pertussis
gugcaugcgcgcca

SEQ ID NO: 362080 - RNA, 21 nt, Bordetella pertussis
gugccagucccccgcggggac

SEQ ID NO: 362081 - RNA, 22 nt, Bordetella pertussis
gugccaguccccguucggggac

SEQ ID NO: 362082 - RNA, 19 nt, Bordetella pertussis
gugccagucuccaggcuca

SEQ ID NO: 362083 - RNA, 15 nt, Bordetella pertussis
gugccauggacgccg

SEQ ID NO: 362084 - RNA, 22 nt, Bordetella pertussis
gugcccgcgaagcagccggcca

SEQ ID NO: 362085 - RNA, 14 nt, Bordetella pertussis
gugcccgcuggcca

SEQ ID NO: 362086 - RNA, 14 nt, Bordetella pertussis
gugcccggcgggcc

SEQ ID NO: 362087 - RNA, 17 nt, Bordetella pertussis
gugcccguugccgcgcg

SEQ ID NO: 362088 - RNA, 18 nt, Bordetella pertussis
gugcccguugccgcgcgc

SEQ ID NO: 362089 - RNA, 22 nt, Bordetella pertussis
gugccgcacgguggcgccgucg

SEQ ID NO: 362090 - RNA, 17 nt, Bordetella pertussis
gugccgcaggccagccc

SEQ ID NO: 362091 - RNA, 20 nt, Bordetella pertussis
gugccgcccgguucgccguc

SEQ ID NO: 362092 - RNA, 13 nt, Bordetella pertussis
gugccgccgagca

SEQ ID NO: 362093 - RNA, 13 nt, Bordetella pertussis
gugccgccgagga

SEQ ID NO: 362094 - RNA, 15 nt, Bordetella pertussis
gugccgccggcgcgg

SEQ ID NO: 362095 - RNA, 16 nt, Bordetella pertussis
gugccgccggcgcggc

SEQ ID NO: 362096 - RNA, 17 nt, Bordetella pertussis
gugccgccuggccagau

SEQ ID NO: 362097 - RNA, 21 nt, Bordetella pertussis
gugccgcgccggucgccgcgg

SEQ ID NO: 362098 - RNA, 17 nt, Bordetella pertussis
gugccgcgcgcggccgg

SEQ ID NO: 362099 - RNA, 19 nt, Bordetella pertussis
gugccgcgcgcggccggca

SEQ ID NO: 362100 - RNA, 20 nt, Bordetella pertussis
gugccgcgcgcggccggcac

SEQ ID NO: 362101 - RNA, 19 nt, Bordetella pertussis
gugccgcgcacccaggccc

SEQ ID NO: 362102 - RNA, 14 nt, Bordetella pertussis
gugccgcgcagguc

SEQ ID NO: 362103 - RNA, 18 nt, Bordetella pertussis
gugccgggaugcugcucg

SEQ ID NO: 362104 - RNA, 16 nt, Bordetella pertussis
gugccgggcagcauca

SEQ ID NO: 362105 - RNA, 15 nt, Bordetella pertussis
gugccgggccuggug

SEQ ID NO: 362106 - RNA, 15 nt, Bordetella pertussis
gugccgggcuugcgc

SEQ ID NO: 362107 - RNA, 20 nt, Bordetella pertussis
gugccgggcuugcgcacccc

SEQ ID NO: 362108 - RNA, 22 nt, Bordetella pertussis
gugccggggaucaccagcccgg

SEQ ID NO: 362109 - RNA, 16 nt, Bordetella pertussis
gugccguccagcgcgg

SEQ ID NO: 362110 - RNA, 21 nt, Bordetella pertussis
gugccguccagcgcggcgcca

SEQ ID NO: 362111 - RNA, 18 nt, Bordetella pertussis
gugccuguccccacaggg

SEQ ID NO: 362112 - RNA, 22 nt, Bordetella pertussis
gugccuguccccacagggggac

SEQ ID NO: 362113 - RNA, 19 nt, Bordetella pertussis
gugccuguccccaccggga

SEQ ID NO: 362114 - RNA, 18 nt, Bordetella pertussis
gugccuguccccgcacgg

SEQ ID NO: 362115 - RNA, 20 nt, Bordetella pertussis
gugccuguccccgcagggac

SEQ ID NO: 362116 - RNA, 16 nt, Bordetella pertussis
gugccuguccccgccg

SEQ ID NO: 362117 - RNA, 20 nt, Bordetella pertussis
gugccuguccccgccgggac

SEQ ID NO: 362118 - RNA, 20 nt, Bordetella pertussis
gugccuguccccgcggggac

SEQ ID NO: 362119 - RNA, 16 nt, Bordetella pertussis
gugccugucccggcug

SEQ ID NO: 362120 - RNA, 20 nt, Bordetella pertussis
gugccugucccggcugggac

SEQ ID NO: 362121 - RNA, 14 nt, Bordetella pertussis
gugccuugccggcc

SEQ ID NO: 362122 - RNA, 16 nt, Bordetella pertussis
gugccuugcggcgccg

SEQ ID NO: 362123 - RNA, 20 nt, Bordetella pertussis
gugcgaauuccgguucacca

SEQ ID NO: 362124 - RNA, 22 nt, Bordetella pertussis
gugcgagcagaugcaccggcca

SEQ ID NO: 362125 - RNA, 17 nt, Bordetella pertussis
gugcgaggccacggcaa

SEQ ID NO: 362126 - RNA, 20 nt, Bordetella pertussis
gugcgaggcgaacaggcaca

SEQ ID NO: 362127 - RNA, 18 nt, Bordetella pertussis
gugcgagggcucgaccgc

SEQ ID NO: 362128 - RNA, 15 nt, Bordetella pertussis
gugcgauagcgccgc

SEQ ID NO: 362129 - RNA, 14 nt, Bordetella pertussis
gugcgauggcacgg

SEQ ID NO: 362130 - RNA, 13 nt, Bordetella pertussis
gugcgauggaacu

SEQ ID NO: 362131 - RNA, 15 nt, Bordetella pertussis
gugcgcacaucgccc

SEQ ID NO: 362132 - RNA, 17 nt, Bordetella pertussis
gugcgcaacgcgcgcgc

SEQ ID NO: 362133 - RNA, 13 nt, Bordetella pertussis
gugcgccagcgcg

SEQ ID NO: 362134 - RNA, 14 nt, Bordetella pertussis
gugcgccagcgcga

SEQ ID NO: 362135 - RNA, 23 nt, Bordetella pertussis
gugcgccaggcaaaggcccaggc

SEQ ID NO: 362136 - RNA, 15 nt, Bordetella pertussis
gugcgcccauggcgc

SEQ ID NO: 362137 - RNA, 19 nt, Bordetella pertussis
gugcgccgcaugcggcggc

SEQ ID NO: 362138 - RNA, 23 nt, Bordetella pertussis
gugcgccgccgccgcggccuggc

SEQ ID NO: 362139 - RNA, 15 nt, Bordetella pertussis
gugcggaggcggccg

SEQ ID NO: 362140 - RNA, 16 nt, Bordetella pertussis
gugcggaggcggccgc

SEQ ID NO: 362141 - RNA, 19 nt, Bordetella pertussis
gugcggaucaagcggcccg

SEQ ID NO: 362142 - RNA, 20 nt, Bordetella pertussis
gugcggaucaagcggcccgc

SEQ ID NO: 362143 - RNA, 15 nt, Bordetella pertussis
gugcggaucaugggc

SEQ ID NO: 362144 - RNA, 16 nt, Bordetella pertussis
gugcggaugcagcagc

SEQ ID NO: 362145 - RNA, 19 nt, Bordetella pertussis
gugcggcacgcacagcaug

SEQ ID NO: 362146 - RNA, 17 nt, Bordetella pertussis
gugcggccucggcgggc

SEQ ID NO: 362147 - RNA, 12 nt, Bordetella pertussis
gugcggcgccac

SEQ ID NO: 362148 - RNA, 15 nt, Bordetella pertussis
gugcggcgccagcug

SEQ ID NO: 362149 - RNA, 16 nt, Bordetella pertussis
gugcggcgccugcguc

SEQ ID NO: 362150 - RNA, 13 nt, Bordetella pertussis
gugcggcggcgac

SEQ ID NO: 362151 - RNA, 18 nt, Bordetella pertussis
gugcgggcaaacggcggc

SEQ ID NO: 362152 - RNA, 13 nt, Bordetella pertussis
gugcgggccggcg

SEQ ID NO: 362153 - RNA, 16 nt, Bordetella pertussis
gugcgggccggcgcgc

SEQ ID NO: 362154 - RNA, 14 nt, Bordetella pertussis
gugcguaccagccc

SEQ ID NO: 362155 - RNA, 20 nt, Bordetella pertussis
gugcgucacgcacagcaccu

SEQ ID NO: 362156 - RNA, 15 nt, Bordetella pertussis
gugcguccaggacgc

SEQ ID NO: 362157 - RNA, 15 nt, Bordetella pertussis
gugcuccugccaggc

SEQ ID NO: 362158 - RNA, 19 nt, Bordetella pertussis
gugcuguucaggcgcucga

SEQ ID NO: 362159 - RNA, 16 nt, Bordetella pertussis
gugcuguucggcgacc

SEQ ID NO: 362160 - RNA, 12 nt, Bordetella pertussis
gugcuugccgca

SEQ ID NO: 362161 - RNA, 13 nt, Bordetella pertussis
gugcuugccgcag

SEQ ID NO: 362162 - RNA, 15 nt, Bordetella pertussis
gugcuugccgcagcg

SEQ ID NO: 362163 - RNA, 16 nt, Bordetella pertussis
gugcuugccgcagcgg

SEQ ID NO: 362164 - RNA, 14 nt, Bordetella pertussis
guggaacgaccacg

SEQ ID NO: 362165 - RNA, 23 nt, Bordetella pertussis
guggaagaucacauaggccggca

SEQ ID NO: 362166 - RNA, 17 nt, Bordetella pertussis
guggaagguccacggca

SEQ ID NO: 362167 - RNA, 21 nt, Bordetella pertussis
guggacaggaacuccggcggc

SEQ ID NO: 362168 - RNA, 24 nt, Bordetella pertussis
guggacaggaacuccggcggcgca

SEQ ID NO: 362169 - RNA, 24 nt, Bordetella pertussis
guggacaggcaccugcgaccgagc

SEQ ID NO: 362170 - RNA, 18 nt, Bordetella pertussis
guggacgaauacgcuggc

SEQ ID NO: 362171 - RNA, 20 nt, Bordetella pertussis
guggacgaauacgcuggcgc

SEQ ID NO: 362172 - RNA, 21 nt, Bordetella pertussis
guggacgaauacgcuggcgcg

SEQ ID NO: 362173 - RNA, 13 nt, Bordetella pertussis
guggacggccagc

SEQ ID NO: 362174 - RNA, 15 nt, Bordetella pertussis
guggagcgcggcgcu

SEQ ID NO: 362175 - RNA, 17 nt, Bordetella pertussis
guggagcgcggcgcugg

SEQ ID NO: 362176 - RNA, 14 nt, Bordetella pertussis
guggaggacgccga

SEQ ID NO: 362177 - RNA, 20 nt, Bordetella pertussis
guggaggacgccgaccucgg

SEQ ID NO: 362178 - RNA, 22 nt, Bordetella pertussis
guggaugggcuuugacgccggc

SEQ ID NO: 362179 - RNA, 14 nt, Bordetella pertussis
guggcacagccgca

SEQ ID NO: 362180 - RNA, 19 nt, Bordetella pertussis
guggcacaucagcgugccg

SEQ ID NO: 362181 - RNA, 21 nt, Bordetella pertussis
guggcagagggcgacggcggc

SEQ ID NO: 362182 - RNA, 19 nt, Bordetella pertussis
guggcauugacgcccacgc

SEQ ID NO: 362183 - RNA, 16 nt, Bordetella pertussis
guggccaccagcccca

SEQ ID NO: 362184 - RNA, 21 nt, Bordetella pertussis
guggccaccaggcgcgcgcca

SEQ ID NO: 362185 - RNA, 22 nt, Bordetella pertussis
guggccaccaggcgcgcgccau

SEQ ID NO: 362186 - RNA, 15 nt, Bordetella pertussis
guggcugcgcagguc

SEQ ID NO: 362187 - RNA, 13 nt, Bordetella pertussis
gugggacaggcac

SEQ ID NO: 362188 - RNA, 15 nt, Bordetella pertussis
gugggccaguccgca

SEQ ID NO: 362189 - RNA, 23 nt, Bordetella pertussis
gugggccaguccgcagcgcagcg

SEQ ID NO: 362190 - RNA, 23 nt, Bordetella pertussis
gugggccucgcuggagaccggca

SEQ ID NO: 362191 - RNA, 16 nt, Bordetella pertussis
gugggcgacgcggcgu

SEQ ID NO: 362192 - RNA, 21 nt, Bordetella pertussis
gugggcgaugcauucggcggc

SEQ ID NO: 362193 - RNA, 18 nt, Bordetella pertussis
gugggcgccuacggcggc

SEQ ID NO: 362194 - RNA, 19 nt, Bordetella pertussis
gugggcgccuacggcggcg

SEQ ID NO: 362195 - RNA, 12 nt, Bordetella pertussis
gugggcgcgccg

SEQ ID NO: 362196 - RNA, 13 nt, Bordetella pertussis
guggguguggcca

SEQ ID NO: 362197 - RNA, 15 nt, Bordetella pertussis
gugguagccgccguc

SEQ ID NO: 362198 - RNA, 13 nt, Bordetella pertussis
guggucaacggca

SEQ ID NO: 362199 - RNA, 17 nt, Bordetella pertussis
guggucacguucgaccu

SEQ ID NO: 362200 - RNA, 22 nt, Bordetella pertussis
guggucgccguucuggugggca

SEQ ID NO: 362201 - RNA, 22 nt, Bordetella pertussis
guggucgccagcacgcgcagcu

SEQ ID NO: 362202 - RNA, 13 nt, Bordetella pertussis
guggucggcgccg

SEQ ID NO: 362203 - RNA, 18 nt, Bordetella pertussis
guggucuuccaggcgcag

SEQ ID NO: 362204 - RNA, 18 nt, Bordetella pertussis
guggugaaagccgccggc

SEQ ID NO: 362205 - RNA, 15 nt, Bordetella pertussis
guggugugcgaggac

SEQ ID NO: 362206 - RNA, 17 nt, Bordetella pertussis
gugucauagcgccagcg

SEQ ID NO: 362207 - RNA, 21 nt, Bordetella pertussis
gugucccggcggggcaggcgc

SEQ ID NO: 362208 - RNA, 18 nt, Bordetella pertussis
guguccgccguagcgcgc

SEQ ID NO: 362209 - RNA, 22 nt, Bordetella pertussis
guguccugccggggcacccagg

SEQ ID NO: 362210 - RNA, 17 nt, Bordetella pertussis
guguccuggucggcgcg

SEQ ID NO: 362211 - RNA, 12 nt, Bordetella pertussis
gugucgccgggg

SEQ ID NO: 362212 - RNA, 17 nt, Bordetella pertussis
gugucgccggggcgcac

SEQ ID NO: 362213 - RNA, 20 nt, Bordetella pertussis
gugucggccaccacgauggc

SEQ ID NO: 362214 - RNA, 12 nt, Bordetella pertussis
gugucggccagg

SEQ ID NO: 362215 - RNA, 13 nt, Bordetella pertussis
gugucggccaggg

SEQ ID NO: 362216 - RNA, 22 nt, Bordetella pertussis
gugucgcgcagcgaguagacgc

SEQ ID NO: 362217 - RNA, 13 nt, Bordetella pertussis
gugucggcggcca

SEQ ID NO: 362218 - RNA, 21 nt, Bordetella pertussis
gugucggcuuuuuugcguucg

SEQ ID NO: 362219 - RNA, 22 nt, Bordetella pertussis
gugucggggccgggccggcggg

SEQ ID NO: 362220 - RNA, 21 nt, Bordetella pertussis
gugucgguauccacguagcgc

SEQ ID NO: 362221 - RNA, 13 nt, Bordetella pertussis
guguggcaggcca

SEQ ID NO: 362222 - RNA, 18 nt, Bordetella pertussis
guguggcaggccagcgcc

SEQ ID NO: 362223 - RNA, 21 nt, Bordetella pertussis
guucaccaggaagcgcgccug

SEQ ID NO: 362224 - RNA, 16 nt, Bordetella pertussis
guucacgccggcgcgc

SEQ ID NO: 362225 - RNA, 15 nt, Bordetella pertussis
guucacgcgcagcgu

SEQ ID NO: 362226 - RNA, 23 nt, Bordetella pertussis
guucacguagaaauacgcgcgcg

SEQ ID NO: 362227 - RNA, 13 nt, Bordetella pertussis
guucagcagcagg

SEQ ID NO: 362228 - RNA, 16 nt, Bordetella pertussis
guucagcgcgcgcgcc

SEQ ID NO: 362229 - RNA, 17 nt, Bordetella pertussis
guucagcgcgcgcgccg

SEQ ID NO: 362230 - RNA, 17 nt, Bordetella pertussis
guucagcgggcgcgccc

SEQ ID NO: 362231 - RNA, 20 nt, Bordetella pertussis
guucagcgggcgcgcccggc

SEQ ID NO: 362232 - RNA, 17 nt, Bordetella pertussis
guucagcgucucgggcu

SEQ ID NO: 362233 - RNA, 19 nt, Bordetella pertussis
guucaggccaugcugggcc

SEQ ID NO: 362234 - RNA, 20 nt, Bordetella pertussis
guucaggccuguucggccgg

SEQ ID NO: 362235 - RNA, 21 nt, Bordetella pertussis
guucaggccuguucggccggg

SEQ ID NO: 362236 - RNA, 15 nt, Bordetella pertussis
guucaggcgagcggc

SEQ ID NO: 362237 - RNA, 19 nt, Bordetella pertussis
guucagggacgggccagcc

SEQ ID NO: 362238 - RNA, 20 nt, Bordetella pertussis
guucagggacgggccagccc

SEQ ID NO: 362239 - RNA, 22 nt, Bordetella pertussis
guucagggcgccgcggcggcga

SEQ ID NO: 362240 - RNA, 23 nt, Bordetella pertussis
guucaucagcgcgcgcagccgcg

SEQ ID NO: 362241 - RNA, 17 nt, Bordetella pertussis
guucaugaccaucgcgc

SEQ ID NO: 362242 - RNA, 23 nt, Bordetella pertussis
guucauggcguaauugggcuggu

SEQ ID NO: 362243 - RNA, 14 nt, Bordetella pertussis
guuccacagcgccg

SEQ ID NO: 362244 - RNA, 15 nt, Bordetella pertussis
guuccacagcgccga

SEQ ID NO: 362245 - RNA, 15 nt, Bordetella pertussis
guuccaccugcaugc

SEQ ID NO: 362246 - RNA, 14 nt, Bordetella pertussis
guuccacgcggccg

SEQ ID NO: 362247 - RNA, 19 nt, Bordetella pertussis
guuccacgcggccguggcg

SEQ ID NO: 362248 - RNA, 23 nt, Bordetella pertussis
guuccacgcggccguggcggccu

SEQ ID NO: 362249 - RNA, 15 nt, Bordetella pertussis
guuccagacgauggu

SEQ ID NO: 362250 - RNA, 22 nt, Bordetella pertussis
guuccagacgauggugccggcc

SEQ ID NO: 362251 - RNA, 23 nt, Bordetella pertussis
guuccagacgauggugccggccg

SEQ ID NO: 362252 - RNA, 16 nt, Bordetella pertussis
guuccagaugcgcagc

SEQ ID NO: 362253 - RNA, 21 nt, Bordetella pertussis
guuccagauuuccggaccggu

SEQ ID NO: 362254 - RNA, 17 nt, Bordetella pertussis
guuccagcacgacgacg

SEQ ID NO: 362255 - RNA, 16 nt, Bordetella pertussis
guuccagcgccuggcg

SEQ ID NO: 362256 - RNA, 15 nt, Bordetella pertussis
guuccaguccagcgu

SEQ ID NO: 362257 - RNA, 21 nt, Bordetella pertussis
guuccaugacguccagcgcca

SEQ ID NO: 362258 - RNA, 21 nt, Bordetella pertussis
guugaaccgcaacgccagcag

SEQ ID NO: 362259 - RNA, 15 nt, Bordetella pertussis
guugauccagcgcuc

SEQ ID NO: 362260 - RNA, 14 nt, Bordetella pertussis
guugcacagcacgu

SEQ ID NO: 362261 - RNA, 14 nt, Bordetella pertussis
guugcagcgcgcca

SEQ ID NO: 362262 - RNA, 16 nt, Bordetella pertussis
guugcaguucgccggc

SEQ ID NO: 362263 - RNA, 20 nt, Bordetella pertussis
guugcaguucgccggcgccg

SEQ ID NO: 362264 - RNA, 18 nt, Bordetella pertussis
guugcauaccucgauggc

SEQ ID NO: 362265 - RNA, 19 nt, Bordetella pertussis
guugccaagauggcccagg

SEQ ID NO: 362266 - RNA, 15 nt, Bordetella pertussis
guugcccgcccgacg

SEQ ID NO: 362267 - RNA, 21 nt, Bordetella pertussis
guugccgaagcgucggccugc

SEQ ID NO: 362268 - RNA, 17 nt, Bordetella pertussis
guugcggcagcgccgca

SEQ ID NO: 362269 - RNA, 18 nt, Bordetella pertussis
guugcggcagcggcccac

SEQ ID NO: 362270 - RNA, 14 nt, Bordetella pertussis
guugcggcccgccg

SEQ ID NO: 362271 - RNA, 13 nt, Bordetella pertussis
guugcggccgcca

SEQ ID NO: 362272 - RNA, 17 nt, Bordetella pertussis
guugcggccgugcgcca

SEQ ID NO: 362273 - RNA, 14 nt, Bordetella pertussis
guugcgucuccagc

SEQ ID NO: 362274 - RNA, 18 nt, Bordetella pertussis
guugcgucuccagcgcgg

SEQ ID NO: 362275 - RNA, 23 nt, Bordetella pertussis
guugcgucuccagcgcggcggac

SEQ ID NO: 362276 - RNA, 15 nt, Bordetella pertussis
guugcuccagccagg

SEQ ID NO: 362277 - RNA, 15 nt, Bordetella pertussis
guugcucgcgcgcag

SEQ ID NO: 362278 - RNA, 20 nt, Bordetella pertussis
guugcucuugaccugggcca

SEQ ID NO: 362279 - RNA, 23 nt, Bordetella pertussis
guugcuggcaaagcgcgcguccu

SEQ ID NO: 362280 - RNA, 15 nt, Bordetella pertussis
guugcuggccacccg

SEQ ID NO: 362281 - RNA, 14 nt, Bordetella pertussis
guuggccggcgcgc

SEQ ID NO: 362282 - RNA, 22 nt, Bordetella pertussis
guuggccgggucgcgcagcagg

SEQ ID NO: 362283 - RNA, 12 nt, Bordetella pertussis
guuggccugcca

SEQ ID NO: 362284 - RNA, 21 nt, Bordetella pertussis
guuggccugccauccggccgc

SEQ ID NO: 362285 - RNA, 19 nt, Bordetella pertussis
guuggcgauggcgcggccg

SEQ ID NO: 362286 - RNA, 14 nt, Bordetella pertussis
guuggcgcccagcg

SEQ ID NO: 362287 - RNA, 14 nt, Bordetella pertussis
guuggcgccggccg

SEQ ID NO: 362288 - RNA, 14 nt, Bordetella pertussis
guuggcgccuuccg

SEQ ID NO: 362289 - RNA, 21 nt, Bordetella pertussis
guugggaucgcgccaggcgua

SEQ ID NO: 362290 - RNA, 23 nt, Bordetella pertussis
guugggauggaugccgucggccu

SEQ ID NO: 362291 - RNA, 19 nt, Bordetella pertussis
guugggcaccaccaccgcc

SEQ ID NO: 362292 - RNA, 16 nt, Bordetella pertussis
guugggccaccuggca

SEQ ID NO: 362293 - RNA, 13 nt, Bordetella pertussis
guugggcgcgccc

SEQ ID NO: 362294 - RNA, 18 nt, Bordetella pertussis
guugggcgcgcccagccc

SEQ ID NO: 362295 - RNA, 16 nt, Bordetella pertussis
guuggucgccacgcca

SEQ ID NO: 362296 - RNA, 21 nt, Bordetella pertussis
guuggugacgauggugcgcag

SEQ ID NO: 362297 - RNA, 16 nt, Bordetella pertussis
guuggugcccagcgag

SEQ ID NO: 362298 - RNA, 14 nt, Bordetella pertussis
guuggugcgcaccu

SEQ ID NO: 362299 - RNA, 16 nt, Bordetella pertussis
guugguggcaggcgcc

SEQ ID NO: 362300 - RNA, 20 nt, Bordetella pertussis
guugguuugcggcgcgaccu

SEQ ID NO: 362301 - RNA, 19 nt, Bordetella pertussis
guuucgagcaucauggcgc

SEQ ID NO: 362302 - RNA, 15 nt, Bordetella pertussis
guuucggccugcagg

SEQ ID NO: 362303 - RNA, 13 nt, Bordetella pertussis
guuucggccugcu

SEQ ID NO: 362304 - RNA, 14 nt, Bordetella pertussis
guuucggcgacgac

SEQ ID NO: 362305 - RNA, 22 nt, Bordetella pertussis
guuucggcggguuucucggccu

SEQ ID NO: 362306 - RNA, 23 nt, Bordetella pertussis
guuucggucagggcgaagcgcgc

SEQ ID NO: 362307 - RNA, 15 nt, Bordetella pertussis
guuucgucggcgcgc

SEQ ID NO: 362308 - RNA, 14 nt, Bordetella pertussis
guuucucagcgcgc

SEQ ID NO: 362309 - RNA, 15 nt, Bordetella pertussis
guuucucagcgcgcu

SEQ ID NO: 362310 - RNA, 21 nt, Bordetella pertussis
guuucucggccuugggcgcgg

SEQ ID NO: 362311 - RNA, 16 nt, Bordetella pertussis
guuugcggacgggcca

SEQ ID NO: 362312 - RNA, 13 nt, Bordetella pertussis
guuugcggcgcga

SEQ ID NO: 362313 - RNA, 17 nt, Bordetella pertussis
guuugcgcaguggcgag

SEQ ID NO: 362314 - RNA, 18 nt, Bordetella pertussis
guuugguagcaggcgcgc

SEQ ID NO: 362315 - RNA, 20 nt, Bordetella pertussis
guuuuccuuuugcgcggccg

SEQ ID NO: 362316 - RNA, 22 nt, Bordetella pertussis
guuuuuuuuugggaaggccgcg

SEQ ID NO: 362317 - RNA, 21 nt, Bordetella pertussis
uaacgccacuugcaggccgcg

SEQ ID NO: 362318 - RNA, 18 nt, Bordetella pertussis
uaauagcuggcggcgcgc

SEQ ID NO: 362319 - RNA, 13 nt, Bordetella pertussis
uacaaggcgcggc

SEQ ID NO: 362320 - RNA, 19 nt, Bordetella pertussis
uacaaggugccuguccccg

SEQ ID NO: 362321 - RNA, 22 nt, Bordetella pertussis
uacaccgugcuggccgacgcgc

SEQ ID NO: 362322 - RNA, 14 nt, Bordetella pertussis
uacacggccagcac

SEQ ID NO: 362323 - RNA, 13 nt, Bordetella pertussis
uacacggcgcggg

SEQ ID NO: 362324 - RNA, 16 nt, Bordetella pertussis
uacagaucgccgccgc

SEQ ID NO: 362325 - RNA, 22 nt, Bordetella pertussis
uacagaucgccgccgcccgccc

SEQ ID NO: 362326 - RNA, 23 nt, Bordetella pertussis
uacagcaaggacaaggcgcguau

SEQ ID NO: 362327 - RNA, 17 nt, Bordetella pertussis
uacagcagcagcacggc

SEQ ID NO: 362328 - RNA, 14 nt, Bordetella pertussis
uacagccgccuggc

SEQ ID NO: 362329 - RNA, 16 nt, Bordetella pertussis
uacagccgccuggcgc

SEQ ID NO: 362330 - RNA, 19 nt, Bordetella pertussis
uacagccgccuggcgcggc

SEQ ID NO: 362331 - RNA, 12 nt, Bordetella pertussis
uacagccgcggc

SEQ ID NO: 362332 - RNA, 17 nt, Bordetella pertussis
uacagccccagcgccag

SEQ ID NO: 362333 - RNA, 14 nt, Bordetella pertussis
uacagcgccugcgc

SEQ ID NO: 362334 - RNA, 23 nt, Bordetella pertussis
uacagcgucaugugcugcggcag

SEQ ID NO: 362335 - RNA, 14 nt, Bordetella pertussis
uacaggcagcggcc

SEQ ID NO: 362336 - RNA, 20 nt, Bordetella pertussis
uacaggcccagcgccagcag

SEQ ID NO: 362337 - RNA, 14 nt, Bordetella pertussis
uacaggccgccggu

SEQ ID NO: 362338 - RNA, 22 nt, Bordetella pertussis
uacaggccgccggucacugccg

SEQ ID NO: 362339 - RNA, 17 nt, Bordetella pertussis
uacaggcugccgucggc

SEQ ID NO: 362340 - RNA, 19 nt, Bordetella pertussis
uacaggcuguggccgcggc

SEQ ID NO: 362341 - RNA, 22 nt, Bordetella pertussis
uacagugguucaucgggccggc

SEQ ID NO: 362342 - RNA, 13 nt, Bordetella pertussis
uacaugccgcgcg

SEQ ID NO: 362343 - RNA, 14 nt, Bordetella pertussis
uacaugcagccgcc

SEQ ID NO: 362344 - RNA, 18 nt, Bordetella pertussis
uaccacaguucggccagc

SEQ ID NO: 362345 - RNA, 14 nt, Bordetella pertussis
uaccagcccggcgc

SEQ ID NO: 362346 - RNA, 17 nt, Bordetella pertussis
uaccagcccggcgcgac

SEQ ID NO: 362347 - RNA, 15 nt, Bordetella pertussis
uaccaggcagccggc

SEQ ID NO: 362348 - RNA, 18 nt, Bordetella pertussis
uaccaggccgacgaggcg

SEQ ID NO: 362349 - RNA, 22 nt, Bordetella pertussis
uaccaggcggcgacgaugccgc

SEQ ID NO: 362350 - RNA, 16 nt, Bordetella pertussis
uacgaaaccaggccgg

SEQ ID NO: 362351 - RNA, 14 nt, Bordetella pertussis
uacgacacgccgcg

SEQ ID NO: 362352 - RNA, 16 nt, Bordetella pertussis
uacgcauagguaucgg

SEQ ID NO: 362353 - RNA, 23 nt, Bordetella pertussis
uacgcauagguaucggcccgcgc

SEQ ID NO: 362354 - RNA, 21 nt, Bordetella pertussis
uacgcaucggcgccggcgucc

SEQ ID NO: 362355 - RNA, 14 nt, Bordetella pertussis
uacgcgaugccgau

SEQ ID NO: 362356 - RNA, 12 nt, Bordetella pertussis
uacgcgcuggcg

SEQ ID NO: 362357 - RNA, 15 nt, Bordetella pertussis
uacgcgcuggcgcag

SEQ ID NO: 362358 - RNA, 12 nt, Bordetella pertussis
uacgcggcgcgc

SEQ ID NO: 362359 - RNA, 11 nt, Bordetella pertussis
uacgcggcguc

SEQ ID NO: 362360 - RNA, 20 nt, Bordetella pertussis
uacgcggguucgacgccggc

SEQ ID NO: 362361 - RNA, 14 nt, Bordetella pertussis
uacgcgugcgcggc

SEQ ID NO: 362362 - RNA, 15 nt, Bordetella pertussis
uacgcgugggcggcg

SEQ ID NO: 362363 - RNA, 17 nt, Bordetella pertussis
uacggccacgcagcgcg

SEQ ID NO: 362364 - RNA, 13 nt, Bordetella pertussis
uacggcgaugccg

SEQ ID NO: 362365 - RNA, 14 nt, Bordetella pertussis
uacggcgaugccgg

SEQ ID NO: 362366 - RNA, 16 nt, Bordetella pertussis
uacggcgaugccggcg

SEQ ID NO: 362367 - RNA, 20 nt, Bordetella pertussis
uacggcgaugccggcgcugc

SEQ ID NO: 362368 - RNA, 10 nt, Bordetella pertussis
uacggcgcga

SEQ ID NO: 362369 - RNA, 21 nt, Bordetella pertussis
uacggcggacuggccgcgccg

SEQ ID NO: 362370 - RNA, 22 nt, Bordetella pertussis
uacggcggacuggccgcgccgc

SEQ ID NO: 362371 - RNA, 16 nt, Bordetella pertussis
uacggcggcggccauc

SEQ ID NO: 362372 - RNA, 23 nt, Bordetella pertussis
uacgugguggugcgggccgcgcu

SEQ ID NO: 362373 - RNA, 13 nt, Bordetella pertussis
uagaccaccagca

SEQ ID NO: 362374 - RNA, 17 nt, Bordetella pertussis
uagaccagcagcucggc

SEQ ID NO: 362375 - RNA, 13 nt, Bordetella pertussis
uagcacacgccga

SEQ ID NO: 362376 - RNA, 14 nt, Bordetella pertussis
uagcacacgccgau

SEQ ID NO: 362377 - RNA, 13 nt, Bordetella pertussis
uagcccggcgcga

SEQ ID NO: 362378 - RNA, 13 nt, Bordetella pertussis
uagcccuggcgcu

SEQ ID NO: 362379 - RNA, 18 nt, Bordetella pertussis
uagccgaaguugucgcca

SEQ ID NO: 362380 - RNA, 17 nt, Bordetella pertussis
uagccgaauccggccag

SEQ ID NO: 362381 - RNA, 18 nt, Bordetella pertussis
uagccgaauccggccagc

SEQ ID NO: 362382 - RNA, 19 nt, Bordetella pertussis
uagccgaauccggccagca

SEQ ID NO: 362383 - RNA, 14 nt, Bordetella pertussis
uagccgccgacgau

SEQ ID NO: 362384 - RNA, 21 nt, Bordetella pertussis
uagccguccucgcgggccugg

SEQ ID NO: 362385 - RNA, 16 nt, Bordetella pertussis
uagcgcuccagcguca

SEQ ID NO: 362386 - RNA, 18 nt, Bordetella pertussis
uagcgcucgacuucgucg

SEQ ID NO: 362387 - RNA, 15 nt, Bordetella pertussis
uagcgcugcagccau

SEQ ID NO: 362388 - RNA, 14 nt, Bordetella pertussis
uagcgcugggcgcc

SEQ ID NO: 362389 - RNA, 18 nt, Bordetella pertussis
uagcggaucgcggcgcgg

SEQ ID NO: 362390 - RNA, 17 nt, Bordetella pertussis
uagcguuggcggccggc

SEQ ID NO: 362391 - RNA, 16 nt, Bordetella pertussis
uaggacggcagcaccg

SEQ ID NO: 362392 - RNA, 14 nt, Bordetella pertussis
uaggcaaagcgcgg

SEQ ID NO: 362393 - RNA, 20 nt, Bordetella pertussis
uaggccaccccguugcagcc

SEQ ID NO: 362394 - RNA, 15 nt, Bordetella pertussis
uaggccuucaccuug

SEQ ID NO: 362395 - RNA, 22 nt, Bordetella pertussis
uaggccuugccgccgccgcgcg

SEQ ID NO: 362396 - RNA, 15 nt, Bordetella pertussis
uaggcgaagcgcggg

SEQ ID NO: 362397 - RNA, 13 nt, Bordetella pertussis
uaggcgcagcagg

SEQ ID NO: 362398 - RNA, 17 nt, Bordetella pertussis
uaggcgcgguccaccuc

SEQ ID NO: 362399 - RNA, 16 nt, Bordetella pertussis
uaggcggccaggccga

SEQ ID NO: 362400 - RNA, 17 nt, Bordetella pertussis
uaggcggccaggccgaa

SEQ ID NO: 362401 - RNA, 15 nt, Bordetella pertussis
uaggcggcgcgcccg

SEQ ID NO: 362402 - RNA, 14 nt, Bordetella pertussis
uaggcggcccaggc

SEQ ID NO: 362403 - RNA, 15 nt, Bordetella pertussis
uaggcuugcagcuug

SEQ ID NO: 362404 - RNA, 11 nt, Bordetella pertussis
uagggcgcggc

SEQ ID NO: 362405 - RNA, 12 nt, Bordetella pertussis
uauacggcgcga

SEQ ID NO: 362406 - RNA, 20 nt, Bordetella pertussis
uauccagguaggcggcgcgc

SEQ ID NO: 362407 - RNA, 18 nt, Bordetella pertussis
uaucccugcggcagcgac

SEQ ID NO: 362408 - RNA, 12 nt, Bordetella pertussis
uauccgcgcaug

SEQ ID NO: 362409 - RNA, 19 nt, Bordetella pertussis
uaucucagcgcgccgcgcc

SEQ ID NO: 362410 - RNA, 20 nt, Bordetella pertussis
uaucugucccggcggggaca

SEQ ID NO: 362411 - RNA, 13 nt, Bordetella pertussis
uaugcaaccggca

SEQ ID NO: 362412 - RNA, 14 nt, Bordetella pertussis
uaugcacgaugccg

SEQ ID NO: 362413 - RNA, 13 nt, Bordetella pertussis
ucaacccgccggc

SEQ ID NO: 362414 - RNA, 17 nt, Bordetella pertussis
ucaaccguucauggcgu

SEQ ID NO: 362415 - RNA, 14 nt, Bordetella pertussis
ucaaccucgacgcg

SEQ ID NO: 362416 - RNA, 22 nt, Bordetella pertussis
ucaacuacacggugggcgacgc

SEQ ID NO: 362417 - RNA, 20 nt, Bordetella pertussis
ucaacuggccggccuggcgc

SEQ ID NO: 362418 - RNA, 22 nt, Bordetella pertussis
ucaacuggccggccuggcgcgc

SEQ ID NO: 362419 - RNA, 23 nt, Bordetella pertussis
ucaacuggccggccuggcgcgca

SEQ ID NO: 362420 - RNA, 16 nt, Bordetella pertussis
ucaacuuccagcgccc

SEQ ID NO: 362421 - RNA, 15 nt, Bordetella pertussis
ucaagcagcgccggc

SEQ ID NO: 362422 - RNA, 17 nt, Bordetella pertussis
ucaagccagcggcgcgg

SEQ ID NO: 362423 - RNA, 23 nt, Bordetella pertussis
ucaagccagcggcgcggcgcgcu

SEQ ID NO: 362424 - RNA, 17 nt, Bordetella pertussis
ucaagcggcccgcgccc

SEQ ID NO: 362425 - RNA, 20 nt, Bordetella pertussis
ucaaggaaaucgucgacacc

SEQ ID NO: 362426 - RNA, 21 nt, Bordetella pertussis
ucaaggccgaauugccgccgc

SEQ ID NO: 362427 - RNA, 16 nt, Bordetella pertussis
ucaaggcgcggccguc

SEQ ID NO: 362428 - RNA, 20 nt, Bordetella pertussis
ucaaggggcuguaccuggcg

SEQ ID NO: 362429 - RNA, 21 nt, Bordetella pertussis
ucaaggggcuguaccuggcga

SEQ ID NO: 362430 - RNA, 15 nt, Bordetella pertussis
ucaccgacuucaccg

SEQ ID NO: 362431 - RNA, 22 nt, Bordetella pertussis
ucacgaugcgaucgucgcugcg

SEQ ID NO: 362432 - RNA, 12 nt, Bordetella pertussis
ucacgcccagga

SEQ ID NO: 362433 - RNA, 22 nt, Bordetella pertussis
ucacgcccagucccaggccgac

SEQ ID NO: 362434 - RNA, 21 nt, Bordetella pertussis
ucacgcgugaauaccgcgcac

SEQ ID NO: 362435 - RNA, 15 nt, Bordetella pertussis
ucacgcuggccgcgc

SEQ ID NO: 362436 - RNA, 16 nt, Bordetella pertussis
ucacgcuggccgcgcc

SEQ ID NO: 362437 - RNA, 22 nt, Bordetella pertussis
ucacggcaagacggcgcucggc

SEQ ID NO: 362438 - RNA, 13 nt, Bordetella pertussis
ucacggcgcgcgc

SEQ ID NO: 362439 - RNA, 14 nt, Bordetella pertussis
ucacggcgcgcgcc

SEQ ID NO: 362440 - RNA, 13 nt, Bordetella pertussis
ucacgggcgccag

SEQ ID NO: 362441 - RNA, 15 nt, Bordetella pertussis
ucacgggcgccagca

SEQ ID NO: 362442 - RNA, 21 nt, Bordetella pertussis
ucacggggcugucgcgcgcau

SEQ ID NO: 362443 - RNA, 15 nt, Bordetella pertussis
ucacguucagcgccg

SEQ ID NO: 362444 - RNA, 19 nt, Bordetella pertussis
ucacguucagcgccggcau

SEQ ID NO: 362445 - RNA, 14 nt, Bordetella pertussis
ucacguucgaccug

SEQ ID NO: 362446 - RNA, 18 nt, Bordetella pertussis
ucagcauaucgucgcugc

SEQ ID NO: 362447 - RNA, 14 nt, Bordetella pertussis
ucagcaucagcaga

SEQ ID NO: 362448 - RNA, 21 nt, Bordetella pertussis
ucagcaugaagcgguggcggc

SEQ ID NO: 362449 - RNA, 12 nt, Bordetella pertussis
ucagcauggcgu

SEQ ID NO: 362450 - RNA, 23 nt, Bordetella pertussis
ucagcauuucgcaaagaagcugc

SEQ ID NO: 362451 - RNA, 19 nt, Bordetella pertussis
ucagccacacgaucagcgc

SEQ ID NO: 362452 - RNA, 20 nt, Bordetella pertussis
ucagccacacgaucagcgcc

SEQ ID NO: 362453 - RNA, 17 nt, Bordetella pertussis
ucagccacgugaagcgc

SEQ ID NO: 362454 - RNA, 22 nt, Bordetella pertussis
ucagccacgugaagcgccgcgc

SEQ ID NO: 362455 - RNA, 11 nt, Bordetella pertussis
ucagcccaggc

SEQ ID NO: 362456 - RNA, 14 nt, Bordetella pertussis
ucagccccaggcgc

SEQ ID NO: 362457 - RNA, 20 nt, Bordetella pertussis
ucagccccccguaggcggcc

SEQ ID NO: 362458 - RNA, 14 nt, Bordetella pertussis
ucagcccgccuggc

SEQ ID NO: 362459 - RNA, 18 nt, Bordetella pertussis
ucagcccgccuggcgccg

SEQ ID NO: 362460 - RNA, 22 nt, Bordetella pertussis
ucagcccgccuggcgccgcgcc

SEQ ID NO: 362461 - RNA, 19 nt, Bordetella pertussis
ucagcccgcguucaggcgc

SEQ ID NO: 362462 - RNA, 22 nt, Bordetella pertussis
ucagcccgcguucaggcgcggc

SEQ ID NO: 362463 - RNA, 14 nt, Bordetella pertussis
ucagccggugccag

SEQ ID NO: 362464 - RNA, 20 nt, Bordetella pertussis
ucagccucgagguggcgcau

SEQ ID NO: 362465 - RNA, 23 nt, Bordetella pertussis
ucagccugauucccaggcccggc

SEQ ID NO: 362466 - RNA, 14 nt, Bordetella pertussis
ucagccugggcgcc

SEQ ID NO: 362467 - RNA, 17 nt, Bordetella pertussis
ucagccuugucgcgggc

SEQ ID NO: 362468 - RNA, 15 nt, Bordetella pertussis
ucagcgacagcaggg

SEQ ID NO: 362469 - RNA, 20 nt, Bordetella pertussis
ucagcgacgcgcgccggcgc

SEQ ID NO: 362470 - RNA, 16 nt, Bordetella pertussis
ucagcgcgccgcgccg

SEQ ID NO: 362471 - RNA, 22 nt, Bordetella pertussis
ucagcgcgccgcgccgggcgcg

SEQ ID NO: 362472 - RNA, 23 nt, Bordetella pertussis
ucagcgcgccgcgccgggcgcgc

SEQ ID NO: 362473 - RNA, 15 nt, Bordetella pertussis
ucagcgcgcgcagcc

SEQ ID NO: 362474 - RNA, 24 nt, Bordetella pertussis
ucagcgcggcgcacagggcgucgc

SEQ ID NO: 362475 - RNA, 19 nt, Bordetella pertussis
ucagcgcggcgccggccuc

SEQ ID NO: 362476 - RNA, 14 nt, Bordetella pertussis
ucagcgcggcgcgg

SEQ ID NO: 362477 - RNA, 19 nt, Bordetella pertussis
ucagcgcggcgcggccagc

SEQ ID NO: 362478 - RNA, 19 nt, Bordetella pertussis
ucagcggauugaccagcgc

SEQ ID NO: 362479 - RNA, 18 nt, Bordetella pertussis
ucagcgugccgccggcgc

SEQ ID NO: 362480 - RNA, 14 nt, Bordetella pertussis
ucagcgugcgcccc

SEQ ID NO: 362481 - RNA, 22 nt, Bordetella pertussis
ucagcuggaacgcgccgcuggc

SEQ ID NO: 362482 - RNA, 23 nt, Bordetella pertussis
ucagcuucuggaucaccgccggc

SEQ ID NO: 362483 - RNA, 16 nt, Bordetella pertussis
ucagcuugccgcccag

SEQ ID NO: 362484 - RNA, 18 nt, Bordetella pertussis
ucaggaagucggucagcu

SEQ ID NO: 362485 - RNA, 19 nt, Bordetella pertussis
ucaggaucaggccggcgau

SEQ ID NO: 362486 - RNA, 16 nt, Bordetella pertussis
ucaggaugggcgcggc

SEQ ID NO: 362487 - RNA, 14 nt, Bordetella pertussis
ucaggcaggcgcgc

SEQ ID NO: 362488 - RNA, 15 nt, Bordetella pertussis
ucaggccagcgaccc

SEQ ID NO: 362489 - RNA, 22 nt, Bordetella pertussis
ucaggcccacgaugcgggcauc

SEQ ID NO: 362490 - RNA, 14 nt, Bordetella pertussis
ucaggccccggccg

SEQ ID NO: 362491 - RNA, 18 nt, Bordetella pertussis
ucaggcccgcggcgccag

SEQ ID NO: 362492 - RNA, 15 nt, Bordetella pertussis
ucaguugacgccggc

SEQ ID NO: 362493 - RNA, 15 nt, Bordetella pertussis
ucauacacggcgcgg

SEQ ID NO: 362494 - RNA, 22 nt, Bordetella pertussis
ucaucagcgcgcgcagccgcgc

SEQ ID NO: 362495 - RNA, 15 nt, Bordetella pertussis
ucauccugggcgcgc

SEQ ID NO: 362496 - RNA, 17 nt, Bordetella pertussis
ucaucgaccaccagcgg

SEQ ID NO: 362497 - RNA, 14 nt, Bordetella pertussis
ucaucgagcaccgc

SEQ ID NO: 362498 - RNA, 15 nt, Bordetella pertussis
ucaugggcggcgagc

SEQ ID NO: 362499 - RNA, 22 nt, Bordetella pertussis
ucaugguuucgucaccgaacug

SEQ ID NO: 362500 - RNA, 14 nt, Bordetella pertussis
ucauguagcggccg

SEQ ID NO: 362501 - RNA, 17 nt, Bordetella pertussis
ucaugugcugcggcagc

SEQ ID NO: 362502 - RNA, 14 nt, Bordetella pertussis
ucauucggcgcgcu

SEQ ID NO: 362503 - RNA, 21 nt, Bordetella pertussis
ucauuucggcgccgcgcugau

SEQ ID NO: 362504 - RNA, 19 nt, Bordetella pertussis
uccaagcagacccgcgccc

SEQ ID NO: 362505 - RNA, 18 nt, Bordetella pertussis
uccaagcgcguggccauc

SEQ ID NO: 362506 - RNA, 13 nt, Bordetella pertussis
uccacagcccggc

SEQ ID NO: 362507 - RNA, 23 nt, Bordetella pertussis
uccacagcccggcccccagccca

SEQ ID NO: 362508 - RNA, 19 nt, Bordetella pertussis
uccacagcgccgaccgcac

SEQ ID NO: 362509 - RNA, 20 nt, Bordetella pertussis
uccacauccgcgcugcugcc

SEQ ID NO: 362510 - RNA, 23 nt, Bordetella pertussis
uccacauccgcgcugcugccguc

SEQ ID NO: 362511 - RNA, 17 nt, Bordetella pertussis
uccacugaaagaaccgc

SEQ ID NO: 362512 - RNA, 15 nt, Bordetella pertussis
uccagaacggcuugg

SEQ ID NO: 362513 - RNA, 16 nt, Bordetella pertussis
uccagaugcgcagcag

SEQ ID NO: 362514 - RNA, 17 nt, Bordetella pertussis
uccagcaaaugggccgc

SEQ ID NO: 362515 - RNA, 19 nt, Bordetella pertussis
uccagcacgcggcgcagca

SEQ ID NO: 362516 - RNA, 15 nt, Bordetella pertussis
uccagcacgacgacg

SEQ ID NO: 362517 - RNA, 20 nt, Bordetella pertussis
uccagcacgacgacggccgg

SEQ ID NO: 362518 - RNA, 17 nt, Bordetella pertussis
uccagcacggccgcggc

SEQ ID NO: 362519 - RNA, 22 nt, Bordetella pertussis
uccagcagcagcgccgcgccgc

SEQ ID NO: 362520 - RNA, 17 nt, Bordetella pertussis
uccagcccgugggcggc

SEQ ID NO: 362521 - RNA, 18 nt, Bordetella pertussis
uccagccgagccuggcgu

SEQ ID NO: 362522 - RNA, 23 nt, Bordetella pertussis
uccagccgaucagccggccaugg

SEQ ID NO: 362523 - RNA, 13 nt, Bordetella pertussis
uccagccgcccgu

SEQ ID NO: 362524 - RNA, 18 nt, Bordetella pertussis
uccagcgacuccggccgg

SEQ ID NO: 362525 - RNA, 15 nt, Bordetella pertussis
uccagcgagaccuug

SEQ ID NO: 362526 - RNA, 13 nt, Bordetella pertussis
uccagcggcagcg

SEQ ID NO: 362527 - RNA, 16 nt, Bordetella pertussis
uccagcggcagcgggu

SEQ ID NO: 362528 - RNA, 13 nt, Bordetella pertussis
uccagcggcgcga

SEQ ID NO: 362529 - RNA, 14 nt, Bordetella pertussis
uccagcggcgcgac

SEQ ID NO: 362530 - RNA, 20 nt, Bordetella pertussis
uccagcgucauggccuggcc

SEQ ID NO: 362531 - RNA, 23 nt, Bordetella pertussis
uccagcgucauggccuggcccag

SEQ ID NO: 362532 - RNA, 17 nt, Bordetella pertussis
uccagcucagcagcgcc

SEQ ID NO: 362533 - RNA, 20 nt, Bordetella pertussis
uccaggucgauaucgccauc

SEQ ID NO: 362534 - RNA, 16 nt, Bordetella pertussis
uccagucccguggcgc

SEQ ID NO: 362535 - RNA, 20 nt, Bordetella pertussis
uccaguugcgcgccgucggc

SEQ ID NO: 362536 - RNA, 17 nt, Bordetella pertussis
uccaguugcgggcgcac

SEQ ID NO: 362537 - RNA, 14 nt, Bordetella pertussis
uccaucgacgcggc

SEQ ID NO: 362538 - RNA, 20 nt, Bordetella pertussis
uccaucgcguccaggcccag

SEQ ID NO: 362539 - RNA, 21 nt, Bordetella pertussis
uccaucgcguccaggcccagc

SEQ ID NO: 362540 - RNA, 14 nt, Bordetella pertussis
uccaucggcgcgcg

SEQ ID NO: 362541 - RNA, 16 nt, Bordetella pertussis
uccaucggggggcagg

SEQ ID NO: 362542 - RNA, 17 nt, Bordetella pertussis
uccaucuacgugcugga

SEQ ID NO: 362543 - RNA, 17 nt, Bordetella pertussis
uccaucuggaccgcgcg

SEQ ID NO: 362544 - RNA, 18 nt, Bordetella pertussis
uccaucuggaccgcgcgc

SEQ ID NO: 362545 - RNA, 14 nt, Bordetella pertussis
uccaucuggcccgu

SEQ ID NO: 362546 - RNA, 17 nt, Bordetella pertussis
uccaucuggcccgucau

SEQ ID NO: 362547 - RNA, 19 nt, Bordetella pertussis
uccaucugguggugccguu

SEQ ID NO: 362548 - RNA, 17 nt, Bordetella pertussis
uccaucuguucggcgcc

SEQ ID NO: 362549 - RNA, 16 nt, Bordetella pertussis
uccaugaacgccgcgc

SEQ ID NO: 362550 - RNA, 20 nt, Bordetella pertussis
uccaugaggaacggcaccag

SEQ ID NO: 362551 - RNA, 11 nt, Bordetella pertussis
uccaugcggcg

SEQ ID NO: 362552 - RNA, 20 nt, Bordetella pertussis
uccauggcgccggcggccuc

SEQ ID NO: 362553 - RNA, 18 nt, Bordetella pertussis
ucccaaccgggacaggca

SEQ ID NO: 362554 - RNA, 20 nt, Bordetella pertussis
uccccguggggacaggcacc

SEQ ID NO: 362555 - RNA, 14 nt, Bordetella pertussis
uccccguucgggga

SEQ ID NO: 362556 - RNA, 16 nt, Bordetella pertussis
uccccguucggggaca

SEQ ID NO: 362557 - RNA, 21 nt, Bordetella pertussis
uccccugcggggacaggcacc

SEQ ID NO: 362558 - RNA, 18 nt, Bordetella pertussis
ucccgacggggacaggcu

SEQ ID NO: 362559 - RNA, 23 nt, Bordetella pertussis
ucccgauuccaggacgacaggca

SEQ ID NO: 362560 - RNA, 17 nt, Bordetella pertussis
ucccgauuucggagcgg

SEQ ID NO: 362561 - RNA, 20 nt, Bordetella pertussis
ucccgcaccgaccagcgcgc

SEQ ID NO: 362562 - RNA, 12 nt, Bordetella pertussis
ucccgcaccggg

SEQ ID NO: 362563 - RNA, 14 nt, Bordetella pertussis
ucccgcaccgggca

SEQ ID NO: 362564 - RNA, 15 nt, Bordetella pertussis
ucccgcacgcagccc

SEQ ID NO: 362565 - RNA, 12 nt, Bordetella pertussis
ucccgcaggccc

SEQ ID NO: 362566 - RNA, 15 nt, Bordetella pertussis
ucccgccaacacgau

SEQ ID NO: 362567 - RNA, 18 nt, Bordetella pertussis
ucccgcaugaccugcagg

SEQ ID NO: 362568 - RNA, 18 nt, Bordetella pertussis
ucccgcccagcgacgagg

SEQ ID NO: 362569 - RNA, 11 nt, Bordetella pertussis
ucccggcgcgg

SEQ ID NO: 362570 - RNA, 12 nt, Bordetella pertussis
ucccggcgcgga

SEQ ID NO: 362571 - RNA, 12 nt, Bordetella pertussis
ucccggcgccag

SEQ ID NO: 362572 - RNA, 19 nt, Bordetella pertussis
ucccggcgcucagcgcgcc

SEQ ID NO: 362573 - RNA, 18 nt, Bordetella pertussis
ucccggcgcuggccgcca

SEQ ID NO: 362574 - RNA, 18 nt, Bordetella pertussis
ucccggcggggacaggcg

SEQ ID NO: 362575 - RNA, 19 nt, Bordetella pertussis
ucccggcggggcaggcgcc

SEQ ID NO: 362576 - RNA, 22 nt, Bordetella pertussis
ucccggcugggacaggcacccu

SEQ ID NO: 362577 - RNA, 21 nt, Bordetella pertussis
ucccgggggcgccuguccccg

SEQ ID NO: 362578 - RNA, 16 nt, Bordetella pertussis
ucccggguggcgccau

SEQ ID NO: 362579 - RNA, 15 nt, Bordetella pertussis
uccgacagauggcgc

SEQ ID NO: 362580 - RNA, 13 nt, Bordetella pertussis
uccgacaggcgcc

SEQ ID NO: 362581 - RNA, 20 nt, Bordetella pertussis
uccgacgguagccgggucug

SEQ ID NO: 362582 - RNA, 14 nt, Bordetella pertussis
uccgagcccgacgc

SEQ ID NO: 362583 - RNA, 18 nt, Bordetella pertussis
uccgagcgggcccgacag

SEQ ID NO: 362584 - RNA, 15 nt, Bordetella pertussis
uccgaucagcacgau

SEQ ID NO: 362585 - RNA, 17 nt, Bordetella pertussis
uccgaucagcugcggcc

SEQ ID NO: 362586 - RNA, 17 nt, Bordetella pertussis
uccgaugaugcccagga

SEQ ID NO: 362587 - RNA, 22 nt, Bordetella pertussis
uccgaugcuggugugaaugaac

SEQ ID NO: 362588 - RNA, 23 nt, Bordetella pertussis
uccgauguuacagaugggcggcc

SEQ ID NO: 362589 - RNA, 19 nt, Bordetella pertussis
uccgcaacccagcagcggc

SEQ ID NO: 362590 - RNA, 18 nt, Bordetella pertussis
uccgcaaguucggcagcg

SEQ ID NO: 362591 - RNA, 22 nt, Bordetella pertussis
uccgcacccgguauccgcgcau

SEQ ID NO: 362592 - RNA, 11 nt, Bordetella pertussis
uccgcaccggc

SEQ ID NO: 362593 - RNA, 15 nt, Bordetella pertussis
uccgcaccggcgugc

SEQ ID NO: 362594 - RNA, 12 nt, Bordetella pertussis
uccgcagguagu

SEQ ID NO: 362595 - RNA, 16 nt, Bordetella pertussis
uccgccacccuggcac

SEQ ID NO: 362596 - RNA, 19 nt, Bordetella pertussis
uccgccacccuggcacgcu

SEQ ID NO: 362597 - RNA, 17 nt, Bordetella pertussis
uccgccaugcggcgcca

SEQ ID NO: 362598 - RNA, 19 nt, Bordetella pertussis
uccgccauggaggcgcagc

SEQ ID NO: 362599 - RNA, 21 nt, Bordetella pertussis
uccgccauggaggcgcagcgc

SEQ ID NO: 362600 - RNA, 24 nt, Bordetella pertussis
uccgccauggaggcgcagcgcggc

SEQ ID NO: 362601 - RNA, 15 nt, Bordetella pertussis
uccgccgcggccagc

SEQ ID NO: 362602 - RNA, 16 nt, Bordetella pertussis
uccgccguagcgcgcc

SEQ ID NO: 362603 - RNA, 17 nt, Bordetella pertussis
uccgccguagcgcgcca

SEQ ID NO: 362604 - RNA, 21 nt, Bordetella pertussis
uccgcgacgguccugcgcgcc

SEQ ID NO: 362605 - RNA, 17 nt, Bordetella pertussis
uccgcgcacagcgcggc

SEQ ID NO: 362606 - RNA, 21 nt, Bordetella pertussis
uccgcgcacagcgcggcgaug

SEQ ID NO: 362607 - RNA, 14 nt, Bordetella pertussis
uccgcuuccggccg

SEQ ID NO: 362608 - RNA, 17 nt, Bordetella pertussis
uccggcagcagcagcgu

SEQ ID NO: 362609 - RNA, 15 nt, Bordetella pertussis
uccggcagcggccag

SEQ ID NO: 362610 - RNA, 16 nt, Bordetella pertussis
uccggcagcggccagc

SEQ ID NO: 362611 - RNA, 21 nt, Bordetella pertussis
uccggcagcggccagcgcggc

SEQ ID NO: 362612 - RNA, 21 nt, Bordetella pertussis
uccggcaucaguucaggcugg

SEQ ID NO: 362613 - RNA, 19 nt, Bordetella pertussis
uccggcaugaccgcggacg

SEQ ID NO: 362614 - RNA, 13 nt, Bordetella pertussis
uccggccagcacg

SEQ ID NO: 362615 - RNA, 20 nt, Bordetella pertussis
uccggcgcaugauggccggc

SEQ ID NO: 362616 - RNA, 21 nt, Bordetella pertussis
uccggcgccgccucgggcacg

SEQ ID NO: 362617 - RNA, 23 nt, Bordetella pertussis
uccggcgccgccucgggcacggc

SEQ ID NO: 362618 - RNA, 16 nt, Bordetella pertussis
uccggcgccagcaugc

SEQ ID NO: 362619 - RNA, 22 nt, Bordetella pertussis
uccggcgccagcaugcgcgcgg

SEQ ID NO: 362620 - RNA, 22 nt, Bordetella pertussis
uccggcucggaccuggccagcg

SEQ ID NO: 362621 - RNA, 15 nt, Bordetella pertussis
uccggcugcgcgcgc

SEQ ID NO: 362622 - RNA, 20 nt, Bordetella pertussis
uccggcuggauggugccgcc

SEQ ID NO: 362623 - RNA, 14 nt, Bordetella pertussis
uccgggccuggcgu

SEQ ID NO: 362624 - RNA, 20 nt, Bordetella pertussis
uccgucgggcaagcggcgua

SEQ ID NO: 362625 - RNA, 17 nt, Bordetella pertussis
uccgugagugcagcgcu

SEQ ID NO: 362626 - RNA, 13 nt, Bordetella pertussis
uccgugcaucggc

SEQ ID NO: 362627 - RNA, 13 nt, Bordetella pertussis
uccgugcgcgccc

SEQ ID NO: 362628 - RNA, 20 nt, Bordetella pertussis
uccuaucuuucgggcgcggg

SEQ ID NO: 362629 - RNA, 20 nt, Bordetella pertussis
uccucccagaccugcgcgcc

SEQ ID NO: 362630 - RNA, 18 nt, Bordetella pertussis
uccuccccaacggggacg

SEQ ID NO: 362631 - RNA, 16 nt, Bordetella pertussis
uccuccgacaggcgcc

SEQ ID NO: 362632 - RNA, 14 nt, Bordetella pertussis
uccucgaccagcgc

SEQ ID NO: 362633 - RNA, 16 nt, Bordetella pertussis
uccucgaccagcgcgc

SEQ ID NO: 362634 - RNA, 13 nt, Bordetella pertussis
uccucgaccagga

SEQ ID NO: 362635 - RNA, 15 nt, Bordetella pertussis
uccucgacccgaagg

SEQ ID NO: 362636 - RNA, 14 nt, Bordetella pertussis
uccucgccagcggc

SEQ ID NO: 362637 - RNA, 17 nt, Bordetella pertussis
uccucgccagcggcagc

SEQ ID NO: 362638 - RNA, 15 nt, Bordetella pertussis
uccucgcccagcggc

SEQ ID NO: 362639 - RNA, 22 nt, Bordetella pertussis
uccucgccgacgaaagcggcaa

SEQ ID NO: 362640 - RNA, 14 nt, Bordetella pertussis
uccucgccgcccag

SEQ ID NO: 362641 - RNA, 19 nt, Bordetella pertussis
uccucgcuuuaccagcugu

SEQ ID NO: 362642 - RNA, 19 nt, Bordetella pertussis
uccucggcacggccagcau

SEQ ID NO: 362643 - RNA, 19 nt, Bordetella pertussis
uccucggccaggucgcgca

SEQ ID NO: 362644 - RNA, 16 nt, Bordetella pertussis
uccugugggggcgcgg

SEQ ID NO: 362645 - RNA, 18 nt, Bordetella pertussis
uccuucaucguggcugcc

SEQ ID NO: 362646 - RNA, 12 nt, Bordetella pertussis
uccuucguggug

SEQ ID NO: 362647 - RNA, 15 nt, Bordetella pertussis
uccuugaacgccuug

SEQ ID NO: 362648 - RNA, 20 nt, Bordetella pertussis
uccuugacgccgccgaacgg

SEQ ID NO: 362649 - RNA, 13 nt, Bordetella pertussis
ucgaaaccggcgc

SEQ ID NO: 362650 - RNA, 22 nt, Bordetella pertussis
ucgaaacccuuguagccggacu

SEQ ID NO: 362651 - RNA, 23 nt, Bordetella pertussis
ucgaaagccagcgccugcgcggc

SEQ ID NO: 362652 - RNA, 16 nt, Bordetella pertussis
ucgaacaacagcgccu

SEQ ID NO: 362653 - RNA, 21 nt, Bordetella pertussis
ucgaacaaggcgguggccagc

SEQ ID NO: 362654 - RNA, 17 nt, Bordetella pertussis
ucgaacgccucgggcgc

SEQ ID NO: 362655 - RNA, 23 nt, Bordetella pertussis
ucgaacggaaacccuucgcgcag

SEQ ID NO: 362656 - RNA, 21 nt, Bordetella pertussis
ucgaacgugcugacgguaagc

SEQ ID NO: 362657 - RNA, 13 nt, Bordetella pertussis
ucgaacucgccga

SEQ ID NO: 362658 - RNA, 22 nt, Bordetella pertussis
ucgaagaucaacaaggcgacgg

SEQ ID NO: 362659 - RNA, 14 nt, Bordetella pertussis
ucgaagcccggcag

SEQ ID NO: 362660 - RNA, 19 nt, Bordetella pertussis
ucgaauggcugcgcgccgu

SEQ ID NO: 362661 - RNA, 20 nt, Bordetella pertussis
ucgaauuccaguugcgcgcc

SEQ ID NO: 362662 - RNA, 23 nt, Bordetella pertussis
ucgaauuccaguugcgcgccguc

SEQ ID NO: 362663 - RNA, 20 nt, Bordetella pertussis
ucgacaacaagccgggcgcc

SEQ ID NO: 362664 - RNA, 22 nt, Bordetella pertussis
ucgacagcaugaacggcagcgc

SEQ ID NO: 362665 - RNA, 23 nt, Bordetella pertussis
ucgacagcaugaacggcagcgcg

SEQ ID NO: 362666 - RNA, 14 nt, Bordetella pertussis
ucgacagcgcgcag

SEQ ID NO: 362667 - RNA, 14 nt, Bordetella pertussis
ucgacagcgcgccc

SEQ ID NO: 362668 - RNA, 12 nt, Bordetella pertussis
ucgacagguagc

SEQ ID NO: 362669 - RNA, 14 nt, Bordetella pertussis
ucgacauacgcgau

SEQ ID NO: 362670 - RNA, 14 nt, Bordetella pertussis
ucgacccgaaggcg

SEQ ID NO: 362671 - RNA, 19 nt, Bordetella pertussis
ucgacccgcucggccacgc

SEQ ID NO: 362672 - RNA, 16 nt, Bordetella pertussis
ucgacccggacaacgc

SEQ ID NO: 362673 - RNA, 20 nt, Bordetella pertussis
ucgacccggacaacgcgcgc

SEQ ID NO: 362674 - RNA, 23 nt, Bordetella pertussis
ucgacccggacaacgcgcgccac

SEQ ID NO: 362675 - RNA, 23 nt, Bordetella pertussis
ucgaccgacagcacauggcgcgc

SEQ ID NO: 362676 - RNA, 18 nt, Bordetella pertussis
ucgaccgauucgcgcacc

SEQ ID NO: 362677 - RNA, 16 nt, Bordetella pertussis
ucgaccgccgccacgc

SEQ ID NO: 362678 - RNA, 23 nt, Bordetella pertussis
ucgaccgccgccacgcgcacggc

SEQ ID NO: 362679 - RNA, 19 nt, Bordetella pertussis
ucgaccgccgggacaggca

SEQ ID NO: 362680 - RNA, 18 nt, Bordetella pertussis
ucgaccgcgaagcgcgcc

SEQ ID NO: 362681 - RNA, 15 nt, Bordetella pertussis
ucgaccgcaugcggc

SEQ ID NO: 362682 - RNA, 16 nt, Bordetella pertussis
ucgaccgccagcaggc

SEQ ID NO: 362683 - RNA, 21 nt, Bordetella pertussis
ucgaccugcgcaccggccggc

SEQ ID NO: 362684 - RNA, 19 nt, Bordetella pertussis
ucgaccugcuuggcgaaca

SEQ ID NO: 362685 - RNA, 15 nt, Bordetella pertussis
ucgaccuugucgccc

SEQ ID NO: 362686 - RNA, 18 nt, Bordetella pertussis
ucgacgaaauagccgacc

SEQ ID NO: 362687 - RNA, 14 nt, Bordetella pertussis
ucgacgaagcgcgu

SEQ ID NO: 362688 - RNA, 13 nt, Bordetella pertussis
ucgacgccaucuc

SEQ ID NO: 362689 - RNA, 20 nt, Bordetella pertussis
ucgacgcccaugcgaucggc

SEQ ID NO: 362690 - RNA, 17 nt, Bordetella pertussis
ucgacgcccgcgcccag

SEQ ID NO: 362691 - RNA, 16 nt, Bordetella pertussis
ucgacgcccgggcggc

SEQ ID NO: 362692 - RNA, 13 nt, Bordetella pertussis
ucgacgccggcag

SEQ ID NO: 362693 - RNA, 17 nt, Bordetella pertussis
ucgacgccggcagcgac

SEQ ID NO: 362694 - RNA, 16 nt, Bordetella pertussis
ucgacgccggcgacgu

SEQ ID NO: 362695 - RNA, 17 nt, Bordetella pertussis
ucgacgccuuccuugaa

SEQ ID NO: 362696 - RNA, 12 nt, Bordetella pertussis
ucgacgcgacgc

SEQ ID NO: 362697 - RNA, 16 nt, Bordetella pertussis
ucgacgcgaugcccgc

SEQ ID NO: 362698 - RNA, 23 nt, Bordetella pertussis
ucgacgcgaugcccgcgcaccag

SEQ ID NO: 362699 - RNA, 15 nt, Bordetella pertussis
ucgacggccgccgga

SEQ ID NO: 362700 - RNA, 12 nt, Bordetella pertussis
ucgacgggcggc

SEQ ID NO: 362701 - RNA, 14 nt, Bordetella pertussis
ucgagcaccgcgcg

SEQ ID NO: 362702 - RNA, 17 nt, Bordetella pertussis
ucgagcaggccgccggg

SEQ ID NO: 362703 - RNA, 14 nt, Bordetella pertussis
ucgagcaggccggc

SEQ ID NO: 362704 - RNA, 16 nt, Bordetella pertussis
ucgagcaggcgcaggc

SEQ ID NO: 362705 - RNA, 21 nt, Bordetella pertussis
ucgagcaggcgcaggccgcgc

SEQ ID NO: 362706 - RNA, 14 nt, Bordetella pertussis
ucgagcaggcgcgc

SEQ ID NO: 362707 - RNA, 15 nt, Bordetella pertussis
ucgagcaggcgcgcg

SEQ ID NO: 362708 - RNA, 13 nt, Bordetella pertussis
ucgagccgggcca

SEQ ID NO: 362709 - RNA, 23 nt, Bordetella pertussis
ucgagcgccgaagucggcucguc

SEQ ID NO: 362710 - RNA, 16 nt, Bordetella pertussis
ucgagcgccugcgcca

SEQ ID NO: 362711 - RNA, 20 nt, Bordetella pertussis
ucgagcgccugcgccacguc

SEQ ID NO: 362712 - RNA, 13 nt, Bordetella pertussis
ucgagcgcgcgca

SEQ ID NO: 362713 - RNA, 22 nt, Bordetella pertussis
ucgagcgcggccaggcgcgugc

SEQ ID NO: 362714 - RNA, 18 nt, Bordetella pertussis
ucgagcgcggcgcgcgau

SEQ ID NO: 362715 - RNA, 17 nt, Bordetella pertussis
ucgagcgcggcgcgcgc

SEQ ID NO: 362716 - RNA, 19 nt, Bordetella pertussis
ucgaggcaaucagccccag

SEQ ID NO: 362717 - RNA, 12 nt, Bordetella pertussis
ucgaggcgcugg

SEQ ID NO: 362718 - RNA, 14 nt, Bordetella pertussis
ucgaggcggcgcag

SEQ ID NO: 362719 - RNA, 17 nt, Bordetella pertussis
ucgaggcguucggccac

SEQ ID NO: 362720 - RNA, 23 nt, Bordetella pertussis
ucgauacgccgggcgcguggccc

SEQ ID NO: 362721 - RNA, 15 nt, Bordetella pertussis
ucgauacggccacgc

SEQ ID NO: 362722 - RNA, 17 nt, Bordetella pertussis
ucgauacggccacgcag

SEQ ID NO: 362723 - RNA, 19 nt, Bordetella pertussis
ucgaucaccaccggcaagg

SEQ ID NO: 362724 - RNA, 21 nt, Bordetella pertussis
ucgaucagccagccggcggcc

SEQ ID NO: 362725 - RNA, 21 nt, Bordetella pertussis
ucgaucagcgaaugcgacagc

SEQ ID NO: 362726 - RNA, 21 nt, Bordetella pertussis
ucgaucaguaucucggcgccc

SEQ ID NO: 362727 - RNA, 14 nt, Bordetella pertussis
ucgaucaugcccgc

SEQ ID NO: 362728 - RNA, 15 nt, Bordetella pertussis
ucgaucaugcccgcc

SEQ ID NO: 362729 - RNA, 21 nt, Bordetella pertussis
ucgaugaucacgcgcuccggc

SEQ ID NO: 362730 - RNA, 14 nt, Bordetella pertussis
ucgaugaugagcgc

SEQ ID NO: 362731 - RNA, 16 nt, Bordetella pertussis
ucgaugcccagcaccg

SEQ ID NO: 362732 - RNA, 23 nt, Bordetella pertussis
ucgaugccgaccaggcugcgcgc

SEQ ID NO: 362733 - RNA, 13 nt, Bordetella pertussis
ucgaugccggccu

SEQ ID NO: 362734 - RNA, 19 nt, Bordetella pertussis
ucgaugccguacacguugg

SEQ ID NO: 362735 - RNA, 15 nt, Bordetella pertussis
ucgaugcgcaccaug

SEQ ID NO: 362736 - RNA, 15 nt, Bordetella pertussis
ucgaugcgcgaacgg

SEQ ID NO: 362737 - RNA, 18 nt, Bordetella pertussis
ucgaugcgcgaacgggca

SEQ ID NO: 362738 - RNA, 21 nt, Bordetella pertussis
ucgaugcgcgcgcggaucgac

SEQ ID NO: 362739 - RNA, 17 nt, Bordetella pertussis
ucgaugcggucggccgc

SEQ ID NO: 362740 - RNA, 21 nt, Bordetella pertussis
ucgaugcggucggccgcgccg

SEQ ID NO: 362741 - RNA, 14 nt, Bordetella pertussis
ucgaugcguccguc

SEQ ID NO: 362742 - RNA, 18 nt, Bordetella pertussis
ucgaugcguucgcccgug

SEQ ID NO: 362743 - RNA, 16 nt, Bordetella pertussis
ucgaugcuggcgcgga

SEQ ID NO: 362744 - RNA, 15 nt, Bordetella pertussis
ucgaugggcccgggc

SEQ ID NO: 362745 - RNA, 14 nt, Bordetella pertussis
ucgaugggcgcgcg

SEQ ID NO: 362746 - RNA, 16 nt, Bordetella pertussis
ucgauguccagcgcca

SEQ ID NO: 362747 - RNA, 17 nt, Bordetella pertussis
ucgauguccagcgccag

SEQ ID NO: 362748 - RNA, 19 nt, Bordetella pertussis
ucgauguccagcgccagca

SEQ ID NO: 362749 - RNA, 15 nt, Bordetella pertussis
ucgauguggcgcugg

SEQ ID NO: 362750 - RNA, 15 nt, Bordetella pertussis
ucgauugccuggucg

SEQ ID NO: 362751 - RNA, 17 nt, Bordetella pertussis
ucgauuucggggcgcga

SEQ ID NO: 362752 - RNA, 19 nt, Bordetella pertussis
ucgcacagccggggcgagc

SEQ ID NO: 362753 - RNA, 20 nt, Bordetella pertussis
ucgcacaguucgugcaccag

SEQ ID NO: 362754 - RNA, 21 nt, Bordetella pertussis
ucgcacaguucgugcaccagc

SEQ ID NO: 362755 - RNA, 20 nt, Bordetella pertussis
ucgcacgcggcuucgcccgg

SEQ ID NO: 362756 - RNA, 22 nt, Bordetella pertussis
ucgcacuggguuuuuccggcuc

SEQ ID NO: 362757 - RNA, 19 nt, Bordetella pertussis
ucgcagaaggucugggcca

SEQ ID NO: 362758 - RNA, 18 nt, Bordetella pertussis
ucgccaggucggccagcc

SEQ ID NO: 362759 - RNA, 21 nt, Bordetella pertussis
ucgccaggucggccagccggc

SEQ ID NO: 362760 - RNA, 13 nt, Bordetella pertussis
ucgcccagccgcc

SEQ ID NO: 362761 - RNA, 17 nt, Bordetella pertussis
ucgcccagccgccugag

SEQ ID NO: 362762 - RNA, 19 nt, Bordetella pertussis
ucgcccagcgagccggcca

SEQ ID NO: 362763 - RNA, 20 nt, Bordetella pertussis
ucgcccagcgagccggccag

SEQ ID NO: 362764 - RNA, 19 nt, Bordetella pertussis
ucgcccagcgcuugcacgc

SEQ ID NO: 362765 - RNA, 19 nt, Bordetella pertussis
ucgcccaggccgggcgagc

SEQ ID NO: 362766 - RNA, 20 nt, Bordetella pertussis
ucgcccaggccgggcgagcc

SEQ ID NO: 362767 - RNA, 23 nt, Bordetella pertussis
ucgcccaugaucagggccgugcc

SEQ ID NO: 362768 - RNA, 16 nt, Bordetella pertussis
ucgcccaugcgggcgu

SEQ ID NO: 362769 - RNA, 20 nt, Bordetella pertussis
ucgcccgcauagacgccgac

SEQ ID NO: 362770 - RNA, 18 nt, Bordetella pertussis
ucgcccgcccacauggcg

SEQ ID NO: 362771 - RNA, 24 nt, Bordetella pertussis
ucgcccgcccacauggcggcgaac

SEQ ID NO: 362772 - RNA, 19 nt, Bordetella pertussis
ucgcccggauacugcacgc

SEQ ID NO: 362773 - RNA, 13 nt, Bordetella pertussis
ucgcccggcgcca

SEQ ID NO: 362774 - RNA, 14 nt, Bordetella pertussis
ucgcccggcuccag

SEQ ID NO: 362775 - RNA, 14 nt, Bordetella pertussis
ucgcccgggcgccg

SEQ ID NO: 362776 - RNA, 16 nt, Bordetella pertussis
ucgcccggggcggcgu

SEQ ID NO: 362777 - RNA, 22 nt, Bordetella pertussis
ucgcccuugagcacggcgcggc

SEQ ID NO: 362778 - RNA, 20 nt, Bordetella pertussis
ucgccgaacugccggcgcgg

SEQ ID NO: 362779 - RNA, 19 nt, Bordetella pertussis
ucgccgagccgcugucgca

SEQ ID NO: 362780 - RNA, 21 nt, Bordetella pertussis
ucgccgaucgagcaggccgcc

SEQ ID NO: 362781 - RNA, 14 nt, Bordetella pertussis
ucgccgaucggcaa

SEQ ID NO: 362782 - RNA, 16 nt, Bordetella pertussis
ucgccgcaggcgugcc

SEQ ID NO: 362783 - RNA, 20 nt, Bordetella pertussis
ucgccgcaugggcgcgcccg

SEQ ID NO: 362784 - RNA, 19 nt, Bordetella pertussis
ucgccgccacgugcacgau

SEQ ID NO: 362785 - RNA, 20 nt, Bordetella pertussis
ucgccgccguuuucgcccgc

SEQ ID NO: 362786 - RNA, 12 nt, Bordetella pertussis
ucgccgccugca

SEQ ID NO: 362787 - RNA, 16 nt, Bordetella pertussis
ucgccgcgcacgaugg

SEQ ID NO: 362788 - RNA, 15 nt, Bordetella pertussis
ucgccgcgcacgggc

SEQ ID NO: 362789 - RNA, 16 nt, Bordetella pertussis
ucgccgcgcacgggcg

SEQ ID NO: 362790 - RNA, 19 nt, Bordetella pertussis
ucgccgcgcacagcccgau

SEQ ID NO: 362791 - RNA, 10 nt, Bordetella pertussis
ucgccgcgcc

SEQ ID NO: 362792 - RNA, 19 nt, Bordetella pertussis
ucgccgcgcgacagccgcg

SEQ ID NO: 362793 - RNA, 21 nt, Bordetella pertussis
ucgccgcgcgacagccgcgcc

SEQ ID NO: 362794 - RNA, 23 nt, Bordetella pertussis
ucgccgcgcgugcugacggaaua

SEQ ID NO: 362795 - RNA, 13 nt, Bordetella pertussis
ucgccgcggccgg

SEQ ID NO: 362796 - RNA, 16 nt, Bordetella pertussis
ucgccgcggccggcgc

SEQ ID NO: 362797 - RNA, 17 nt, Bordetella pertussis
ucgccggaggcgcgcag

SEQ ID NO: 362798 - RNA, 17 nt, Bordetella pertussis
ucgccggcaacguggug

SEQ ID NO: 362799 - RNA, 20 nt, Bordetella pertussis
ucgccggccaguggcgcggc

SEQ ID NO: 362800 - RNA, 14 nt, Bordetella pertussis
ucgccggccgcgcc

SEQ ID NO: 362801 - RNA, 16 nt, Bordetella pertussis
ucgccggcuacggcaa

SEQ ID NO: 362802 - RNA, 16 nt, Bordetella pertussis
ucgccgggcagcgggc

SEQ ID NO: 362803 - RNA, 16 nt, Bordetella pertussis
ucgccgggcggcgcgg

SEQ ID NO: 362804 - RNA, 17 nt, Bordetella pertussis
ucgccgggcggcgcggg

SEQ ID NO: 362805 - RNA, 14 nt, Bordetella pertussis
ucgccgguagcgcu

SEQ ID NO: 362806 - RNA, 21 nt, Bordetella pertussis
ucgccgguagcgcugggcgcc

SEQ ID NO: 362807 - RNA, 22 nt, Bordetella pertussis
ucgccgguagcgcugggcgcca

SEQ ID NO: 362808 - RNA, 16 nt, Bordetella pertussis
ucgccggucgcggcgu

SEQ ID NO: 362809 - RNA, 15 nt, Bordetella pertussis
ucgccggucggccgc

SEQ ID NO: 362810 - RNA, 23 nt, Bordetella pertussis
ucgccggugggauaaggcgugcc

SEQ ID NO: 362811 - RNA, 22 nt, Bordetella pertussis
ucgccgucaggaucaggccggc

SEQ ID NO: 362812 - RNA, 15 nt, Bordetella pertussis
ucgcgcaccaccugg

SEQ ID NO: 362813 - RNA, 16 nt, Bordetella pertussis
ucgcgcacccgcaggc

SEQ ID NO: 362814 - RNA, 20 nt, Bordetella pertussis
ucgcgcaccgaggugccggc

SEQ ID NO: 362815 - RNA, 15 nt, Bordetella pertussis
ucgcgcaccgccugc

SEQ ID NO: 362816 - RNA, 23 nt, Bordetella pertussis
ucgcgcaccuguucggcggcgcc

SEQ ID NO: 362817 - RNA, 16 nt, Bordetella pertussis
ucgcgcagcggcgcgc

SEQ ID NO: 362818 - RNA, 21 nt, Bordetella pertussis
ucgcgcagcggcgcgcgcagg

SEQ ID NO: 362819 - RNA, 23 nt, Bordetella pertussis
ucgcgcagcugccugagcaccgc

SEQ ID NO: 362820 - RNA, 15 nt, Bordetella pertussis
ucgcgcagcgccugg

SEQ ID NO: 362821 - RNA, 21 nt, Bordetella pertussis
ucgcgcagcgccuggccgagc

SEQ ID NO: 362822 - RNA, 15 nt, Bordetella pertussis
ucgcgcagggcggcc

SEQ ID NO: 362823 - RNA, 19 nt, Bordetella pertussis
ucgcgccgcgaugcacgga

SEQ ID NO: 362824 - RNA, 22 nt, Bordetella pertussis
ucgcgccgcgucuucggcgcgg

SEQ ID NO: 362825 - RNA, 16 nt, Bordetella pertussis
ucgcgccggccgacgg

SEQ ID NO: 362826 - RNA, 17 nt, Bordetella pertussis
ucgcgccggccgacggc

SEQ ID NO: 362827 - RNA, 22 nt, Bordetella pertussis
ucgcgccggucaugcaccugca

SEQ ID NO: 362828 - RNA, 20 nt, Bordetella pertussis
ucgcgccuaccggcgccgac

SEQ ID NO: 362829 - RNA, 22 nt, Bordetella pertussis
ucgcgccuaccggcgccgacgc

SEQ ID NO: 362830 - RNA, 17 nt, Bordetella pertussis
ucgcgccuucggcgcgc

SEQ ID NO: 362831 - RNA, 15 nt, Bordetella pertussis
ucgcgcgugcaggcc

SEQ ID NO: 362832 - RNA, 17 nt, Bordetella pertussis
ucgcgcucgcccggcca

SEQ ID NO: 362833 - RNA, 18 nt, Bordetella pertussis
ucgcgcucgcccggccac

SEQ ID NO: 362834 - RNA, 17 nt, Bordetella pertussis
ucgcgcucgcgcucggc

SEQ ID NO: 362835 - RNA, 17 nt, Bordetella pertussis
ucgcgcucggccagcau

SEQ ID NO: 362836 - RNA, 14 nt, Bordetella pertussis
ucgcgcucgagcgc

SEQ ID NO: 362837 - RNA, 20 nt, Bordetella pertussis
ucgcgcugcaauugcgcggc

SEQ ID NO: 362838 - RNA, 16 nt, Bordetella pertussis
ucgcgcugcagcauga

SEQ ID NO: 362839 - RNA, 13 nt, Bordetella pertussis
ucgcgcugcgcgc

SEQ ID NO: 362840 - RNA, 19 nt, Bordetella pertussis
ucgcgcugcgcgccgccgc

SEQ ID NO: 362841 - RNA, 13 nt, Bordetella pertussis
ucgcgcuggcccc

SEQ ID NO: 362842 - RNA, 13 nt, Bordetella pertussis
ucgcgcuggcgcg

SEQ ID NO: 362843 - RNA, 14 nt, Bordetella pertussis
ucgcgcuggcgcgc

SEQ ID NO: 362844 - RNA, 19 nt, Bordetella pertussis
ucgcgcuggcgguggccgc

SEQ ID NO: 362845 - RNA, 20 nt, Bordetella pertussis
ucgcgcuguucgggcgcggu

SEQ ID NO: 362846 - RNA, 17 nt, Bordetella pertussis
ucgcgcuugcggccguc

SEQ ID NO: 362847 - RNA, 23 nt, Bordetella pertussis
ucgcggaagcugacgaaacgcgc

SEQ ID NO: 362848 - RNA, 14 nt, Bordetella pertussis
ucgcggaugaccug

SEQ ID NO: 362849 - RNA, 13 nt, Bordetella pertussis
ucgcggcagcccg

SEQ ID NO: 362850 - RNA, 15 nt, Bordetella pertussis
ucgcggcagcccggc

SEQ ID NO: 362851 - RNA, 15 nt, Bordetella pertussis
ucgcggccagccggg

SEQ ID NO: 362852 - RNA, 14 nt, Bordetella pertussis
ucgcggccagcggc

SEQ ID NO: 362853 - RNA, 14 nt, Bordetella pertussis
ucgcggcccacggc

SEQ ID NO: 362854 - RNA, 16 nt, Bordetella pertussis
ucgcggcccugggcca

SEQ ID NO: 362855 - RNA, 24 nt, Bordetella pertussis
ucgcggccgagcuccucgagcgug

SEQ ID NO: 362856 - RNA, 13 nt, Bordetella pertussis
ucgcggccgaggc

SEQ ID NO: 362857 - RNA, 15 nt, Bordetella pertussis
ucgcggccggccugc

SEQ ID NO: 362858 - RNA, 13 nt, Bordetella pertussis
ucgcggcgcagcg

SEQ ID NO: 362859 - RNA, 14 nt, Bordetella pertussis
ucgcggcgcagcgc

SEQ ID NO: 362860 - RNA, 13 nt, Bordetella pertussis
ucgcggcgcaggc

SEQ ID NO: 362861 - RNA, 13 nt, Bordetella pertussis
ucgcggcgcguau

SEQ ID NO: 362862 - RNA, 19 nt, Bordetella pertussis
ucgcggcggguggccucgc

SEQ ID NO: 362863 - RNA, 15 nt, Bordetella pertussis
ucgcggcuccagcuc

SEQ ID NO: 362864 - RNA, 16 nt, Bordetella pertussis
ucgcggcuccagcuca

SEQ ID NO: 362865 - RNA, 14 nt, Bordetella pertussis
ucgcggcugggcaa

SEQ ID NO: 362866 - RNA, 18 nt, Bordetella pertussis
ucgcggcuggucgccguc

SEQ ID NO: 362867 - RNA, 21 nt, Bordetella pertussis
ucgcgggcccgcucggccagc

SEQ ID NO: 362868 - RNA, 15 nt, Bordetella pertussis
ucgcgggccuggcgg

SEQ ID NO: 362869 - RNA, 12 nt, Bordetella pertussis
ucgcugcccagc

SEQ ID NO: 362870 - RNA, 12 nt, Bordetella pertussis
ucgcuggcgccg

SEQ ID NO: 362871 - RNA, 22 nt, Bordetella pertussis
ucgcugggauggguacgccggc

SEQ ID NO: 362872 - RNA, 24 nt, Bordetella pertussis
ucgcugggauggguacgccggccu

SEQ ID NO: 362873 - RNA, 13 nt, Bordetella pertussis
ucgcugggcgcgc

SEQ ID NO: 362874 - RNA, 19 nt, Bordetella pertussis
ucgcugucgugccgcacgg

SEQ ID NO: 362875 - RNA, 13 nt, Bordetella pertussis
ucgcugugcgcgg

SEQ ID NO: 362876 - RNA, 22 nt, Bordetella pertussis
ucggacaggucggcgcccacgc

SEQ ID NO: 362877 - RNA, 17 nt, Bordetella pertussis
ucggcagcgaggcgcag

SEQ ID NO: 362878 - RNA, 20 nt, Bordetella pertussis
ucggcagcgaggcgcagcgc

SEQ ID NO: 362879 - RNA, 20 nt, Bordetella pertussis
ucggcaggagccuguccccg

SEQ ID NO: 362880 - RNA, 13 nt, Bordetella pertussis
ucggcaggccggc

SEQ ID NO: 362881 - RNA, 18 nt, Bordetella pertussis
ucggcaggccggcgcgcg

SEQ ID NO: 362882 - RNA, 15 nt, Bordetella pertussis
ucggcaggcgccggc

SEQ ID NO: 362883 - RNA, 19 nt, Bordetella pertussis
ucggcaggcgccggcuggc

SEQ ID NO: 362884 - RNA, 22 nt, Bordetella pertussis
ucggccagcauacccugcgcgc

SEQ ID NO: 362885 - RNA, 18 nt, Bordetella pertussis
ucggccagccccaccuug

SEQ ID NO: 362886 - RNA, 19 nt, Bordetella pertussis
ucggccagccccaccuugc

SEQ ID NO: 362887 - RNA, 13 nt, Bordetella pertussis
ucggccagccggc

SEQ ID NO: 362888 - RNA, 16 nt, Bordetella pertussis
ucggccagcgaggccg

SEQ ID NO: 362889 - RNA, 20 nt, Bordetella pertussis
ucggccagcgcgcggccggc

SEQ ID NO: 362890 - RNA, 23 nt, Bordetella pertussis
ucggccagcgcgcggcgcagcgc

SEQ ID NO: 362891 - RNA, 15 nt, Bordetella pertussis
ucggccaugcgcgcc

SEQ ID NO: 362892 - RNA, 16 nt, Bordetella pertussis
ucggccaugcgcgcca

SEQ ID NO: 362893 - RNA, 16 nt, Bordetella pertussis
ucggccagcgcgcgcc

SEQ ID NO: 362894 - RNA, 15 nt, Bordetella pertussis
ucggccagcgcgcgg

SEQ ID NO: 362895 - RNA, 16 nt, Bordetella pertussis
ucggccaugugcgcca

SEQ ID NO: 362896 - RNA, 20 nt, Bordetella pertussis
ucggcccauugcggcaccug

SEQ ID NO: 362897 - RNA, 18 nt, Bordetella pertussis
ucggcccgcgccagcgcc

SEQ ID NO: 362898 - RNA, 22 nt, Bordetella pertussis
ucggccggaugcgcaggacggc

SEQ ID NO: 362899 - RNA, 14 nt, Bordetella pertussis
ucggccggcagcgc

SEQ ID NO: 362900 - RNA, 15 nt, Bordetella pertussis
ucggccggcagcggc

SEQ ID NO: 362901 - RNA, 19 nt, Bordetella pertussis
ucggccggcagcggcgcca

SEQ ID NO: 362902 - RNA, 17 nt, Bordetella pertussis
ucggccggccgggccgc

SEQ ID NO: 362903 - RNA, 12 nt, Bordetella pertussis
ucggccggcggu

SEQ ID NO: 362904 - RNA, 17 nt, Bordetella pertussis
ucggccggcugcgcgcc

SEQ ID NO: 362905 - RNA, 19 nt, Bordetella pertussis
ucggccgucagcagcaggc

SEQ ID NO: 362906 - RNA, 16 nt, Bordetella pertussis
ucggccgucugggcgu

SEQ ID NO: 362907 - RNA, 18 nt, Bordetella pertussis
ucggccucaucgagcgcc

SEQ ID NO: 362908 - RNA, 18 nt, Bordetella pertussis
ucggccucgcuggcgaag

SEQ ID NO: 362909 - RNA, 14 nt, Bordetella pertussis
ucggccugcaggcc

SEQ ID NO: 362910 - RNA, 20 nt, Bordetella pertussis
ucggccugccaccagcgcgc

SEQ ID NO: 362911 - RNA, 21 nt, Bordetella pertussis
ucggccugccaccagcgcgcc

SEQ ID NO: 362912 - RNA, 13 nt, Bordetella pertussis
ucggccugccggc

SEQ ID NO: 362913 - RNA, 21 nt, Bordetella pertussis
ucggcgccacaggugcgcggc

SEQ ID NO: 362914 - RNA, 17 nt, Bordetella pertussis
ucggcgcaucggcgcca

SEQ ID NO: 362915 - RNA, 17 nt, Bordetella pertussis
ucggcgccaguagcgcc

SEQ ID NO: 362916 - RNA, 20 nt, Bordetella pertussis
ucggcgccaugcuggccgcc

SEQ ID NO: 362917 - RNA, 14 nt, Bordetella pertussis
ucggcgcccagcuc

SEQ ID NO: 362918 - RNA, 15 nt, Bordetella pertussis
ucggcgcccagcugc

SEQ ID NO: 362919 - RNA, 18 nt, Bordetella pertussis
ucggcgcccgcggccugc

SEQ ID NO: 362920 - RNA, 19 nt, Bordetella pertussis
ucggcgcccggcgccgcgc

SEQ ID NO: 362921 - RNA, 20 nt, Bordetella pertussis
ucggcgcccggcgccgcgcg

SEQ ID NO: 362922 - RNA, 13 nt, Bordetella pertussis
ucggcgccgagca

SEQ ID NO: 362923 - RNA, 18 nt, Bordetella pertussis
ucggcgcgguauucgcgc

SEQ ID NO: 362924 - RNA, 14 nt, Bordetella pertussis
ucggcgcucaggaa

SEQ ID NO: 362925 - RNA, 14 nt, Bordetella pertussis
ucggcgcuggccau

SEQ ID NO: 362926 - RNA, 15 nt, Bordetella pertussis
ucggcgcuggcgcgc

SEQ ID NO: 362927 - RNA, 15 nt, Bordetella pertussis
ucggcggcaagcagc

SEQ ID NO: 362928 - RNA, 12 nt, Bordetella pertussis
ucggcggccagc

SEQ ID NO: 362929 - RNA, 16 nt, Bordetella pertussis
ucggcggccagccggc

SEQ ID NO: 362930 - RNA, 13 nt, Bordetella pertussis
ucggcggccaggc

SEQ ID NO: 362931 - RNA, 18 nt, Bordetella pertussis
ucggcggccagcgcgccc

SEQ ID NO: 362932 - RNA, 22 nt, Bordetella pertussis
ucggcggccugcuuggcagccu

SEQ ID NO: 362933 - RNA, 24 nt, Bordetella pertussis
ucggcggccugcuuggcagccuug

SEQ ID NO: 362934 - RNA, 17 nt, Bordetella pertussis
ucggcggcgagcuggcc

SEQ ID NO: 362935 - RNA, 13 nt, Bordetella pertussis
ucggcggcgcgcu

SEQ ID NO: 362936 - RNA, 17 nt, Bordetella pertussis
ucggcggucagcgcggc

SEQ ID NO: 362937 - RNA, 20 nt, Bordetella pertussis
ucggcgguccacagcccggc

SEQ ID NO: 362938 - RNA, 18 nt, Bordetella pertussis
ucggcggugaugucgccg

SEQ ID NO: 362939 - RNA, 18 nt, Bordetella pertussis
ucggcgguuccagccugg

SEQ ID NO: 362940 - RNA, 19 nt, Bordetella pertussis
ucggcguaaggccgccggc

SEQ ID NO: 362941 - RNA, 13 nt, Bordetella pertussis
ucggcgucagcgc

SEQ ID NO: 362942 - RNA, 15 nt, Bordetella pertussis
ucggcgucagcgccc

SEQ ID NO: 362943 - RNA, 17 nt, Bordetella pertussis
ucggcgucggugccguc

SEQ ID NO: 362944 - RNA, 20 nt, Bordetella pertussis
ucggcgugacguugccgcgc

SEQ ID NO: 362945 - RNA, 16 nt, Bordetella pertussis
ucggcgugcagcaagc

SEQ ID NO: 362946 - RNA, 17 nt, Bordetella pertussis
ucggcguggucgcaguc

SEQ ID NO: 362947 - RNA, 16 nt, Bordetella pertussis
ucggcguuccuggcgc

SEQ ID NO: 362948 - RNA, 13 nt, Bordetella pertussis
ucggcguugaccg

SEQ ID NO: 362949 - RNA, 23 nt, Bordetella pertussis
ucggcguugcuggcaaagcgcgc

SEQ ID NO: 362950 - RNA, 16 nt, Bordetella pertussis
ucggcguugugccggc

SEQ ID NO: 362951 - RNA, 18 nt, Bordetella pertussis
ucggcguugugccggcgc

SEQ ID NO: 362952 - RNA, 23 nt, Bordetella pertussis
ucggcguugugccggcgcaggaa

SEQ ID NO: 362953 - RNA, 20 nt, Bordetella pertussis
ucggcucggugaugauggcc

SEQ ID NO: 362954 - RNA, 17 nt, Bordetella pertussis
ucggucucgcgcggccg

SEQ ID NO: 362955 - RNA, 16 nt, Bordetella pertussis
ucggugaaggccacgc

SEQ ID NO: 362956 - RNA, 17 nt, Bordetella pertussis
ucggugccgccgagcag

SEQ ID NO: 362957 - RNA, 20 nt, Bordetella pertussis
ucggugccguccagcgcggc

SEQ ID NO: 362958 - RNA, 13 nt, Bordetella pertussis
ucggugccugucc

SEQ ID NO: 362959 - RNA, 16 nt, Bordetella pertussis
ucggugcgcagcggca

SEQ ID NO: 362960 - RNA, 13 nt, Bordetella pertussis
ucggugcgcgcgc

SEQ ID NO: 362961 - RNA, 14 nt, Bordetella pertussis
ucggugcggccggu

SEQ ID NO: 362962 - RNA, 14 nt, Bordetella pertussis
ucggugcucuggcc

SEQ ID NO: 362963 - RNA, 17 nt, Bordetella pertussis
ucggugcucuggcccgc

SEQ ID NO: 362964 - RNA, 23 nt, Bordetella pertussis
ucggugcggaucaagcggcccgc

SEQ ID NO: 362965 - RNA, 17 nt, Bordetella pertussis
ucgguggccagccaggc

SEQ ID NO: 362966 - RNA, 14 nt, Bordetella pertussis
ucgguggcgcgcag

SEQ ID NO: 362967 - RNA, 15 nt, Bordetella pertussis
ucguacagcggcaau

SEQ ID NO: 362968 - RNA, 17 nt, Bordetella pertussis
ucguacgcgugggcggc

SEQ ID NO: 362969 - RNA, 17 nt, Bordetella pertussis
ucguagaacacgucgau

SEQ ID NO: 362970 - RNA, 15 nt, Bordetella pertussis
ucgucagcagcacgc

SEQ ID NO: 362971 - RNA, 18 nt, Bordetella pertussis
ucgucaggcaggcgcgcc

SEQ ID NO: 362972 - RNA, 20 nt, Bordetella pertussis
ucgucaucaccaagggcgcc

SEQ ID NO: 362973 - RNA, 21 nt, Bordetella pertussis
ucgucccccuacugcccucgc

SEQ ID NO: 362974 - RNA, 23 nt, Bordetella pertussis
ucguccgcuucgucgggcagcgc

SEQ ID NO: 362975 - RNA, 19 nt, Bordetella pertussis
ucguccguuucgucggcgc

SEQ ID NO: 362976 - RNA, 16 nt, Bordetella pertussis
ucguccucggcacggc

SEQ ID NO: 362977 - RNA, 24 nt, Bordetella pertussis
ucguccucgucggccaugcgcgcc

SEQ ID NO: 362978 - RNA, 13 nt, Bordetella pertussis
ucguccugcaggc

SEQ ID NO: 362979 - RNA, 19 nt, Bordetella pertussis
ucgucgagccgggccacgc

SEQ ID NO: 362980 - RNA, 18 nt, Bordetella pertussis
ucgucgaggucagcggcu

SEQ ID NO: 362981 - RNA, 15 nt, Bordetella pertussis
ucgucgcgcaacgcc

SEQ ID NO: 362982 - RNA, 17 nt, Bordetella pertussis
ucgucgcgcacccgcag

SEQ ID NO: 362983 - RNA, 15 nt, Bordetella pertussis
ucgucgcugccgcgc

SEQ ID NO: 362984 - RNA, 18 nt, Bordetella pertussis
ucgucgcugccgcgcgau

SEQ ID NO: 362985 - RNA, 15 nt, Bordetella pertussis
ucgucgcuggcccac

SEQ ID NO: 362986 - RNA, 13 nt, Bordetella pertussis
ucgucggccacgc

SEQ ID NO: 362987 - RNA, 23 nt, Bordetella pertussis
ucgucggccaugcgcgccagcau

SEQ ID NO: 362988 - RNA, 14 nt, Bordetella pertussis
ucgucggccgccag

SEQ ID NO: 362989 - RNA, 14 nt, Bordetella pertussis
ucgucggccgccgc

SEQ ID NO: 362990 - RNA, 15 nt, Bordetella pertussis
ucgugcagcaggggc

SEQ ID NO: 362991 - RNA, 15 nt, Bordetella pertussis
ucgugcaucgugaca

SEQ ID NO: 362992 - RNA, 22 nt, Bordetella pertussis
ucgugccggagauccggccuuc

SEQ ID NO: 362993 - RNA, 20 nt, Bordetella pertussis
ucgugcgaggccacggcaau

SEQ ID NO: 362994 - RNA, 15 nt, Bordetella pertussis
ucgugcgccuggcgg

SEQ ID NO: 362995 - RNA, 19 nt, Bordetella pertussis
ucgugcggcacgcacagca

SEQ ID NO: 362996 - RNA, 13 nt, Bordetella pertussis
ucgugcuggccau

SEQ ID NO: 362997 - RNA, 14 nt, Bordetella pertussis
ucgugcuggccauc

SEQ ID NO: 362998 - RNA, 12 nt, Bordetella pertussis
ucguucgaaguc

SEQ ID NO: 362999 - RNA, 18 nt, Bordetella pertussis
ucguucuugagaauggcg

SEQ ID NO: 363000 - RNA, 16 nt, Bordetella pertussis
ucguugacgccgacga

SEQ ID NO: 363001 - RNA, 15 nt, Bordetella pertussis
ucguugacggggacg

SEQ ID NO: 363002 - RNA, 18 nt, Bordetella pertussis
ucguugaucucgcccagc

SEQ ID NO: 363003 - RNA, 22 nt, Bordetella pertussis
ucguugcauugcacaacgggca

SEQ ID NO: 363004 - RNA, 12 nt, Bordetella pertussis
ucguugccggcc

SEQ ID NO: 363005 - RNA, 18 nt, Bordetella pertussis
ucguuggccagcgcgccu

SEQ ID NO: 363006 - RNA, 15 nt, Bordetella pertussis
ucguuggccgcguag

SEQ ID NO: 363007 - RNA, 22 nt, Bordetella pertussis
ucguuggucggguugcccugcg

SEQ ID NO: 363008 - RNA, 11 nt, Bordetella pertussis
ucuacgcgcgc

SEQ ID NO: 363009 - RNA, 18 nt, Bordetella pertussis
ucuacugggugcuggcca

SEQ ID NO: 363010 - RNA, 15 nt, Bordetella pertussis
ucuaugucgccggcc

SEQ ID NO: 363011 - RNA, 14 nt, Bordetella pertussis
ucuccacgaaggcg

SEQ ID NO: 363012 - RNA, 19 nt, Bordetella pertussis
ucuccagcgccggcagccc

SEQ ID NO: 363013 - RNA, 19 nt, Bordetella pertussis
ucuccaggcucaggcggcc

SEQ ID NO: 363014 - RNA, 15 nt, Bordetella pertussis
ucuccuugagcacgu

SEQ ID NO: 363015 - RNA, 16 nt, Bordetella pertussis
ucucgaccaggcgggc

SEQ ID NO: 363016 - RNA, 15 nt, Bordetella pertussis
ucugcggaaacagau

SEQ ID NO: 363017 - RNA, 15 nt, Bordetella pertussis
ucugcgugcgcggcg

SEQ ID NO: 363018 - RNA, 20 nt, Bordetella pertussis
ucugcuacaccgugcuggcc

SEQ ID NO: 363019 - RNA, 16 nt, Bordetella pertussis
ucuggcgcgcgaccag

SEQ ID NO: 363020 - RNA, 12 nt, Bordetella pertussis
ucuggcgcguca

SEQ ID NO: 363021 - RNA, 16 nt, Bordetella pertussis
ucuggcucacgaugcg

SEQ ID NO: 363022 - RNA, 14 nt, Bordetella pertussis
ucuggcugcgcgcc

SEQ ID NO: 363023 - RNA, 20 nt, Bordetella pertussis
ucugggccucggccagcugg

SEQ ID NO: 363024 - RNA, 20 nt, Bordetella pertussis
ucuggucagccgugucgccc

SEQ ID NO: 363025 - RNA, 12 nt, Bordetella pertussis
ucuggucggcga

SEQ ID NO: 363026 - RNA, 15 nt, Bordetella pertussis
ucuggugcgcguccu

SEQ ID NO: 363027 - RNA, 13 nt, Bordetella pertussis
ucuguaccagcau

SEQ ID NO: 363028 - RNA, 14 nt, Bordetella pertussis
ucuguaccgccggg

SEQ ID NO: 363029 - RNA, 23 nt, Bordetella pertussis
ucugucacucaacaguacuacag

SEQ ID NO: 363030 - RNA, 20 nt, Bordetella pertussis
ucugucccggcggggacagg

SEQ ID NO: 363031 - RNA, 20 nt, Bordetella pertussis
ucuugaacucggccagcagc

SEQ ID NO: 363032 - RNA, 15 nt, Bordetella pertussis
ucuugaccagcaggc

SEQ ID NO: 363033 - RNA, 15 nt, Bordetella pertussis
ucuugagcgcggccu

SEQ ID NO: 363034 - RNA, 12 nt, Bordetella pertussis
ucuugaugccgc

SEQ ID NO: 363035 - RNA, 13 nt, Bordetella pertussis
ucuugcccgccag

SEQ ID NO: 363036 - RNA, 19 nt, Bordetella pertussis
ucuugcccgccagcgcggc

SEQ ID NO: 363037 - RNA, 15 nt, Bordetella pertussis
ugaacgcuugacggc

SEQ ID NO: 363038 - RNA, 17 nt, Bordetella pertussis
ugaacgcuugacggcca

SEQ ID NO: 363039 - RNA, 16 nt, Bordetella pertussis
ugaacggccccgccag

SEQ ID NO: 363040 - RNA, 14 nt, Bordetella pertussis
ugaacggcgcggcc

SEQ ID NO: 363041 - RNA, 20 nt, Bordetella pertussis
ugaagccguccuuggcgccg

SEQ ID NO: 363042 - RNA, 13 nt, Bordetella pertussis
ugaagggcggcgc

SEQ ID NO: 363043 - RNA, 14 nt, Bordetella pertussis
ugaaggcggccagc

SEQ ID NO: 363044 - RNA, 23 nt, Bordetella pertussis
ugaaggucgcuucgguggcgcgc

SEQ ID NO: 363045 - RNA, 17 nt, Bordetella pertussis
ugacagggugccugucc

SEQ ID NO: 363046 - RNA, 20 nt, Bordetella pertussis
ugacagggugccuguccccg

SEQ ID NO: 363047 - RNA, 23 nt, Bordetella pertussis
ugacauccucgggcgacuccagc

SEQ ID NO: 363048 - RNA, 21 nt, Bordetella pertussis
ugacaucgccgcugcgcagca

SEQ ID NO: 363049 - RNA, 22 nt, Bordetella pertussis
ugaccacgcccuggaucagggu

SEQ ID NO: 363050 - RNA, 14 nt, Bordetella pertussis
ugaccacggccagc

SEQ ID NO: 363051 - RNA, 16 nt, Bordetella pertussis
ugaccacggccagcag

SEQ ID NO: 363052 - RNA, 14 nt, Bordetella pertussis
ugaccacggcgcgc

SEQ ID NO: 363053 - RNA, 22 nt, Bordetella pertussis
ugaccacgucgaucaggcccag

SEQ ID NO: 363054 - RNA, 21 nt, Bordetella pertussis
ugaccagcaccagcgccugcc

SEQ ID NO: 363055 - RNA, 15 nt, Bordetella pertussis
ugaccagcgccggcg

SEQ ID NO: 363056 - RNA, 12 nt, Bordetella pertussis
ugaccagcgcgg

SEQ ID NO: 363057 - RNA, 16 nt, Bordetella pertussis
ugaccagcgcggccgu

SEQ ID NO: 363058 - RNA, 16 nt, Bordetella pertussis
ugaccagcugcaccag

SEQ ID NO: 363059 - RNA, 23 nt, Bordetella pertussis
ugaccagcuugucgaccaccggc

SEQ ID NO: 363060 - RNA, 19 nt, Bordetella pertussis
ugaccaguucgcgcagcgc

SEQ ID NO: 363061 - RNA, 14 nt, Bordetella pertussis
ugaccaugccggcc

SEQ ID NO: 363062 - RNA, 17 nt, Bordetella pertussis
ugaccaugccggccugc

SEQ ID NO: 363063 - RNA, 22 nt, Bordetella pertussis
ugaccauguugcuuggcgucag

SEQ ID NO: 363064 - RNA, 17 nt, Bordetella pertussis
ugacccccgccguggcg

SEQ ID NO: 363065 - RNA, 22 nt, Bordetella pertussis
ugacguagcggaucgcggcgcg

SEQ ID NO: 363066 - RNA, 21 nt, Bordetella pertussis
ugacguccagcgccaccagca

SEQ ID NO: 363067 - RNA, 17 nt, Bordetella pertussis
ugacugcggugccuguc

SEQ ID NO: 363068 - RNA, 15 nt, Bordetella pertussis
ugacugugcagccac

SEQ ID NO: 363069 - RNA, 16 nt, Bordetella pertussis
ugacuucggccgccag

SEQ ID NO: 363070 - RNA, 13 nt, Bordetella pertussis
ugagcaccgccgc

SEQ ID NO: 363071 - RNA, 16 nt, Bordetella pertussis
ugagcacgcaugcgac

SEQ ID NO: 363072 - RNA, 15 nt, Bordetella pertussis
ugagcaggccggguc

SEQ ID NO: 363073 - RNA, 16 nt, Bordetella pertussis
ugagcaugauuuccug

SEQ ID NO: 363074 - RNA, 17 nt, Bordetella pertussis
ugagccauuccggcugg

SEQ ID NO: 363075 - RNA, 13 nt, Bordetella pertussis
ugagcggcacgac

SEQ ID NO: 363076 - RNA, 20 nt, Bordetella pertussis
ugagcuacccccugaccggc

SEQ ID NO: 363077 - RNA, 14 nt, Bordetella pertussis
ugagcuucgccccc

SEQ ID NO: 363078 - RNA, 17 nt, Bordetella pertussis
ugaggcuuucgaagcgc

SEQ ID NO: 363079 - RNA, 18 nt, Bordetella pertussis
ugaggcuuucgaagcgcu

SEQ ID NO: 363080 - RNA, 19 nt, Bordetella pertussis
ugaggcuuucgaagcgcuc

SEQ ID NO: 363081 - RNA, 13 nt, Bordetella pertussis
ugaggucgcgcgu

SEQ ID NO: 363082 - RNA, 16 nt, Bordetella pertussis
ugaucagggccgccag

SEQ ID NO: 363083 - RNA, 22 nt, Bordetella pertussis
ugauccacagucggucgccgca

SEQ ID NO: 363084 - RNA, 23 nt, Bordetella pertussis
ugauccgcaccggugggagccag

SEQ ID NO: 363085 - RNA, 15 nt, Bordetella pertussis
ugaugauccugcugg

SEQ ID NO: 363086 - RNA, 16 nt, Bordetella pertussis
ugaugcccagcgccag

SEQ ID NO: 363087 - RNA, 19 nt, Bordetella pertussis
ugaugcccagcgccagggc

SEQ ID NO: 363088 - RNA, 12 nt, Bordetella pertussis
ugaugcccaggc

SEQ ID NO: 363089 - RNA, 13 nt, Bordetella pertussis
ugaugccgcccag

SEQ ID NO: 363090 - RNA, 20 nt, Bordetella pertussis
ugaugucggccagggaggcg

SEQ ID NO: 363091 - RNA, 18 nt, Bordetella pertussis
ugaugugguagccgccgu

SEQ ID NO: 363092 - RNA, 13 nt, Bordetella pertussis
ugcaagcggccgg

SEQ ID NO: 363093 - RNA, 14 nt, Bordetella pertussis
ugcaagcggccggc

SEQ ID NO: 363094 - RNA, 13 nt, Bordetella pertussis
ugcaaggccugcu

SEQ ID NO: 363095 - RNA, 15 nt, Bordetella pertussis
ugcaaugcggccagg

SEQ ID NO: 363096 - RNA, 14 nt, Bordetella pertussis
ugcaccgccgcgcg

SEQ ID NO: 363097 - RNA, 24 nt, Bordetella pertussis
ugcaccgccgcgcggugcucggcg

SEQ ID NO: 363098 - RNA, 21 nt, Bordetella pertussis
ugcaccgccgcguugcgcgac

SEQ ID NO: 363099 - RNA, 18 nt, Bordetella pertussis
ugcaccgcgucggccugc

SEQ ID NO: 363100 - RNA, 16 nt, Bordetella pertussis
ugcaccgucaggugca

SEQ ID NO: 363101 - RNA, 18 nt, Bordetella pertussis
ugcaccugccugccgccu

SEQ ID NO: 363102 - RNA, 17 nt, Bordetella pertussis
ugcaccuugggcgccug

SEQ ID NO: 363103 - RNA, 14 nt, Bordetella pertussis
ugcaggccgccggc

SEQ ID NO: 363104 - RNA, 17 nt, Bordetella pertussis
ugcaggccgccggccag

SEQ ID NO: 363105 - RNA, 20 nt, Bordetella pertussis
ugcaggccgccggccagcgc

SEQ ID NO: 363106 - RNA, 17 nt, Bordetella pertussis
ugcaggccgcgaacaga

SEQ ID NO: 363107 - RNA, 13 nt, Bordetella pertussis
ugcaggccgcgca

SEQ ID NO: 363108 - RNA, 15 nt, Bordetella pertussis
ugcaggccggcgcgc

SEQ ID NO: 363109 - RNA, 13 nt, Bordetella pertussis
ugcaggcggcgca

SEQ ID NO: 363110 - RNA, 19 nt, Bordetella pertussis
ugcaggcuuugcuggccau

SEQ ID NO: 363111 - RNA, 22 nt, Bordetella pertussis
ugcaggggccgcacgcgcggca

SEQ ID NO: 363112 - RNA, 20 nt, Bordetella pertussis
ugcagggucagggugucgcc

SEQ ID NO: 363113 - RNA, 13 nt, Bordetella pertussis
ugcagguccgguc

SEQ ID NO: 363114 - RNA, 22 nt, Bordetella pertussis
ugcagguagucgaugaaggcgc

SEQ ID NO: 363115 - RNA, 17 nt, Bordetella pertussis
ugcaggucuucgggcgu

SEQ ID NO: 363116 - RNA, 17 nt, Bordetella pertussis
ugcaucgccaugccggc

SEQ ID NO: 363117 - RNA, 18 nt, Bordetella pertussis
ugcaucgccaugccggcc

SEQ ID NO: 363118 - RNA, 20 nt, Bordetella pertussis
ugcaucgugacaugcacgau

SEQ ID NO: 363119 - RNA, 17 nt, Bordetella pertussis
ugcaugaccgccgccag

SEQ ID NO: 363120 - RNA, 20 nt, Bordetella pertussis
ugcaugaccgccggcaccag

SEQ ID NO: 363121 - RNA, 21 nt, Bordetella pertussis
ugcaugacggccaggauggcg

SEQ ID NO: 363122 - RNA, 17 nt, Bordetella pertussis
ugcauucggcggccggc

SEQ ID NO: 363123 - RNA, 19 nt, Bordetella pertussis
ugccaauagcgguggcggg

SEQ ID NO: 363124 - RNA, 19 nt, Bordetella pertussis
ugccacagcgugacggcgg

SEQ ID NO: 363125 - RNA, 19 nt, Bordetella pertussis
ugccaccagcgcgccagca

SEQ ID NO: 363126 - RNA, 19 nt, Bordetella pertussis
ugccaccgcccaggcgcag

SEQ ID NO: 363127 - RNA, 16 nt, Bordetella pertussis
ugccagcuugcaggcg

SEQ ID NO: 363128 - RNA, 15 nt, Bordetella pertussis
ugccaggcccggcgc

SEQ ID NO: 363129 - RNA, 20 nt, Bordetella pertussis
ugccaggcgagcgccgcgcu

SEQ ID NO: 363130 - RNA, 18 nt, Bordetella pertussis
ugccaggcgccgcguccg

SEQ ID NO: 363131 - RNA, 20 nt, Bordetella pertussis
ugccaggcgccgcguccggc

SEQ ID NO: 363132 - RNA, 22 nt, Bordetella pertussis
ugccaggcuaucguggcuggcg

SEQ ID NO: 363133 - RNA, 14 nt, Bordetella pertussis
ugccagggccuggc

SEQ ID NO: 363134 - RNA, 19 nt, Bordetella pertussis
ugccagggugaccuggcgc

SEQ ID NO: 363135 - RNA, 20 nt, Bordetella pertussis
ugccagggugaccuggcgcg

SEQ ID NO: 363136 - RNA, 21 nt, Bordetella pertussis
ugccagggugaccuggcgcgc

SEQ ID NO: 363137 - RNA, 14 nt, Bordetella pertussis
ugccaguccaucca

SEQ ID NO: 363138 - RNA, 21 nt, Bordetella pertussis
ugccagucccccgcggggaca

SEQ ID NO: 363139 - RNA, 16 nt, Bordetella pertussis
ugccagucuccaggcu

SEQ ID NO: 363140 - RNA, 23 nt, Bordetella pertussis
ugccaguugaaccgcaacgccag

SEQ ID NO: 363141 - RNA, 22 nt, Bordetella pertussis
ugccaguugccgccgccggcgc

SEQ ID NO: 363142 - RNA, 22 nt, Bordetella pertussis
ugccaguuguagugguguagcc

SEQ ID NO: 363143 - RNA, 24 nt, Bordetella pertussis
ugccauaaggcuucucgaccaggc

SEQ ID NO: 363144 - RNA, 18 nt, Bordetella pertussis
ugccauugcgcggccugc

SEQ ID NO: 363145 - RNA, 20 nt, Bordetella pertussis
ugccauuggucugugggcgg

SEQ ID NO: 363146 - RNA, 12 nt, Bordetella pertussis
ugcccaccgcca

SEQ ID NO: 363147 - RNA, 13 nt, Bordetella pertussis
ugcccaccgccag

SEQ ID NO: 363148 - RNA, 14 nt, Bordetella pertussis
ugcccaccgccagg

SEQ ID NO: 363149 - RNA, 23 nt, Bordetella pertussis
ugcccaccgacaugaccgcgucc

SEQ ID NO: 363150 - RNA, 17 nt, Bordetella pertussis
ugcccaccuuccugcug

SEQ ID NO: 363151 - RNA, 21 nt, Bordetella pertussis
ugcccauggagacggaugccg

SEQ ID NO: 363152 - RNA, 23 nt, Bordetella pertussis
ugcccauggggugcuccugccag

SEQ ID NO: 363153 - RNA, 16 nt, Bordetella pertussis
ugccccaacggcgcac

SEQ ID NO: 363154 - RNA, 17 nt, Bordetella pertussis
ugccccaacggcgcacc

SEQ ID NO: 363155 - RNA, 14 nt, Bordetella pertussis
ugccccacgccgau

SEQ ID NO: 363156 - RNA, 18 nt, Bordetella pertussis
ugccccacgccgaugccg

SEQ ID NO: 363157 - RNA, 14 nt, Bordetella pertussis
ugccccagcacgaa

SEQ ID NO: 363158 - RNA, 17 nt, Bordetella pertussis
ugccccagcggcuggcg

SEQ ID NO: 363159 - RNA, 18 nt, Bordetella pertussis
ugccccaguccaggccgg

SEQ ID NO: 363160 - RNA, 24 nt, Bordetella pertussis
ugccccauccagcggacgggccag

SEQ ID NO: 363161 - RNA, 14 nt, Bordetella pertussis
ugccccaugcgcgg

SEQ ID NO: 363162 - RNA, 18 nt, Bordetella pertussis
ugccccauggcaugcacc

SEQ ID NO: 363163 - RNA, 21 nt, Bordetella pertussis
ugccccuccgggucgcggcac

SEQ ID NO: 363164 - RNA, 15 nt, Bordetella pertussis
ugccccugcggggac

SEQ ID NO: 363165 - RNA, 16 nt, Bordetella pertussis
ugcccgaagcgcagca

SEQ ID NO: 363166 - RNA, 14 nt, Bordetella pertussis
ugcccgacgccgcg

SEQ ID NO: 363167 - RNA, 16 nt, Bordetella pertussis
ugcccgacggcgccga

SEQ ID NO: 363168 - RNA, 16 nt, Bordetella pertussis
ugcccgugcgugugcc

SEQ ID NO: 363169 - RNA, 17 nt, Bordetella pertussis
ugcccguucacgcgcag

SEQ ID NO: 363170 - RNA, 19 nt, Bordetella pertussis
ugcccguucacgcgcagcg

SEQ ID NO: 363171 - RNA, 16 nt, Bordetella pertussis
ugcccguugccgcgcg

SEQ ID NO: 363172 - RNA, 17 nt, Bordetella pertussis
ugcccguugccgcgcgc

SEQ ID NO: 363173 - RNA, 23 nt, Bordetella pertussis
ugcccucccagaaacuggcgcug

SEQ ID NO: 363174 - RNA, 20 nt, Bordetella pertussis
ugcccucgcgcacggugcgc

SEQ ID NO: 363175 - RNA, 16 nt, Bordetella pertussis
ugcccucggucagcgc

SEQ ID NO: 363176 - RNA, 19 nt, Bordetella pertussis
ugcccucggucagcgccag

SEQ ID NO: 363177 - RNA, 18 nt, Bordetella pertussis
ugccgaacugucgcgcca

SEQ ID NO: 363178 - RNA, 21 nt, Bordetella pertussis
ugccgaagaaauagcccgcgg

SEQ ID NO: 363179 - RNA, 14 nt, Bordetella pertussis
ugccgaagcgcgcg

SEQ ID NO: 363180 - RNA, 19 nt, Bordetella pertussis
ugccgaccaccagcaccga

SEQ ID NO: 363181 - RNA, 20 nt, Bordetella pertussis
ugccgaccaccagcaccgau

SEQ ID NO: 363182 - RNA, 13 nt, Bordetella pertussis
ugccgaccagcac

SEQ ID NO: 363183 - RNA, 14 nt, Bordetella pertussis
ugccgagacggccg

SEQ ID NO: 363184 - RNA, 12 nt, Bordetella pertussis
ugccgagcagau

SEQ ID NO: 363185 - RNA, 20 nt, Bordetella pertussis
ugccgauacgggcgcggcgu

SEQ ID NO: 363186 - RNA, 18 nt, Bordetella pertussis
ugccgaucagcgggcugg

SEQ ID NO: 363187 - RNA, 21 nt, Bordetella pertussis
ugccgaucagcgggcuggcca

SEQ ID NO: 363188 - RNA, 13 nt, Bordetella pertussis
ugccgaucggcgu

SEQ ID NO: 363189 - RNA, 16 nt, Bordetella pertussis
ugccgaugauggccau

SEQ ID NO: 363190 - RNA, 11 nt, Bordetella pertussis
ugccgaugccg

SEQ ID NO: 363191 - RNA, 22 nt, Bordetella pertussis
ugccgaugcgguaggcccagca

SEQ ID NO: 363192 - RNA, 21 nt, Bordetella pertussis
ugccgauugugcaugacggcc

SEQ ID NO: 363193 - RNA, 17 nt, Bordetella pertussis
ugccgcacgguggcgcc

SEQ ID NO: 363194 - RNA, 18 nt, Bordetella pertussis
ugccgcacgguggcgccg

SEQ ID NO: 363195 - RNA, 18 nt, Bordetella pertussis
ugccgcagauggccagca

SEQ ID NO: 363196 - RNA, 13 nt, Bordetella pertussis
ugccgcagcacca

SEQ ID NO: 363197 - RNA, 21 nt, Bordetella pertussis
ugccgcagcaccacaucgccg

SEQ ID NO: 363198 - RNA, 15 nt, Bordetella pertussis
ugccgcagcccgcgc

SEQ ID NO: 363199 - RNA, 17 nt, Bordetella pertussis
ugccgcagcccgcgcgc

SEQ ID NO: 363200 - RNA, 20 nt, Bordetella pertussis
ugccgcagcccgcgcgccug

SEQ ID NO: 363201 - RNA, 13 nt, Bordetella pertussis
ugccgcagcggcc

SEQ ID NO: 363202 - RNA, 15 nt, Bordetella pertussis
ugccgcagcggccau

SEQ ID NO: 363203 - RNA, 17 nt, Bordetella pertussis
ugccgcagcggccaugg

SEQ ID NO: 363204 - RNA, 15 nt, Bordetella pertussis
ugccgcagcggggac

SEQ ID NO: 363205 - RNA, 20 nt, Bordetella pertussis
ugccgcaggccagcccgcgc

SEQ ID NO: 363206 - RNA, 20 nt, Bordetella pertussis
ugccgcaguugaacacgcgg

SEQ ID NO: 363207 - RNA, 21 nt, Bordetella pertussis
ugccgcaucccgcccccgccg

SEQ ID NO: 363208 - RNA, 15 nt, Bordetella pertussis
ugccgccaacgcggc

SEQ ID NO: 363209 - RNA, 19 nt, Bordetella pertussis
ugccgccaacgcggcgcgu

SEQ ID NO: 363210 - RNA, 20 nt, Bordetella pertussis
ugccgccaagggcgcgccag

SEQ ID NO: 363211 - RNA, 19 nt, Bordetella pertussis
ugccgccacgggcccgcgc

SEQ ID NO: 363212 - RNA, 22 nt, Bordetella pertussis
ugccgccacgggcccgcgcaga

SEQ ID NO: 363213 - RNA, 18 nt, Bordetella pertussis
ugccgccaugcgccagca

SEQ ID NO: 363214 - RNA, 17 nt, Bordetella pertussis
ugccgcccacgaucacc

SEQ ID NO: 363215 - RNA, 13 nt, Bordetella pertussis
ugccgcccacugc

SEQ ID NO: 363216 - RNA, 11 nt, Bordetella pertussis
ugccgcccagc

SEQ ID NO: 363217 - RNA, 13 nt, Bordetella pertussis
ugccgcccagcau

SEQ ID NO: 363218 - RNA, 21 nt, Bordetella pertussis
ugccgcccagcaugcgcgcga

SEQ ID NO: 363219 - RNA, 13 nt, Bordetella pertussis
ugccgcccaggag

SEQ ID NO: 363220 - RNA, 24 nt, Bordetella pertussis
ugccgcccaggucggacgcgccgg

SEQ ID NO: 363221 - RNA, 15 nt, Bordetella pertussis
ugccgcccuggcgca

SEQ ID NO: 363222 - RNA, 21 nt, Bordetella pertussis
ugccgccgaaccagcgcacca

SEQ ID NO: 363223 - RNA, 14 nt, Bordetella pertussis
ugccgccgccgcgc

SEQ ID NO: 363224 - RNA, 16 nt, Bordetella pertussis
ugccgccgccgcgcgc

SEQ ID NO: 363225 - RNA, 19 nt, Bordetella pertussis
ugccgccgccgcgcgcggc

SEQ ID NO: 363226 - RNA, 19 nt, Bordetella pertussis
ugccgccgaugugcggcgu

SEQ ID NO: 363227 - RNA, 13 nt, Bordetella pertussis
ugccgccgccggc

SEQ ID NO: 363228 - RNA, 15 nt, Bordetella pertussis
ugccgccgccggcgc

SEQ ID NO: 363229 - RNA, 18 nt, Bordetella pertussis
ugccgccgccggcgcggu

SEQ ID NO: 363230 - RNA, 14 nt, Bordetella pertussis
ugccgccgcugccg

SEQ ID NO: 363231 - RNA, 17 nt, Bordetella pertussis
ugccgccgcugccggcc

SEQ ID NO: 363232 - RNA, 15 nt, Bordetella pertussis
ugccgccggacggcg

SEQ ID NO: 363233 - RNA, 13 nt, Bordetella pertussis
ugccgccggccag

SEQ ID NO: 363234 - RNA, 14 nt, Bordetella pertussis
ugccgccggccagg

SEQ ID NO: 363235 - RNA, 13 nt, Bordetella pertussis
ugccgccggcggg

SEQ ID NO: 363236 - RNA, 13 nt, Bordetella pertussis
ugccgccugccag

SEQ ID NO: 363237 - RNA, 16 nt, Bordetella pertussis
ugccgcgcaccugggc

SEQ ID NO: 363238 - RNA, 18 nt, Bordetella pertussis
ugccgcgcaccugggcgu

SEQ ID NO: 363239 - RNA, 19 nt, Bordetella pertussis
ugccgcgcaccugggcguc

SEQ ID NO: 363240 - RNA, 22 nt, Bordetella pertussis
ugccgcgcauuugccgcggcga

SEQ ID NO: 363241 - RNA, 17 nt, Bordetella pertussis
ugccgcgcgauccggcg

SEQ ID NO: 363242 - RNA, 20 nt, Bordetella pertussis
ugccgcgcgcaccggcuugg

SEQ ID NO: 363243 - RNA, 20 nt, Bordetella pertussis
ugccgcgcgccggcgccggc

SEQ ID NO: 363244 - RNA, 24 nt, Bordetella pertussis
ugccgcgcgcgcagacgcgcucag

SEQ ID NO: 363245 - RNA, 21 nt, Bordetella pertussis
ugccgcgcgcguauggcggcg

SEQ ID NO: 363246 - RNA, 15 nt, Bordetella pertussis
ugccgcgcggcgcgu

SEQ ID NO: 363247 - RNA, 18 nt, Bordetella pertussis
ugccgcgcggcgcguuca

SEQ ID NO: 363248 - RNA, 14 nt, Bordetella pertussis
ugccgcgcggcgua

SEQ ID NO: 363249 - RNA, 23 nt, Bordetella pertussis
ugccgcgcggcguauggcgcggg

SEQ ID NO: 363250 - RNA, 12 nt, Bordetella pertussis
ugccgcgcguac

SEQ ID NO: 363251 - RNA, 21 nt, Bordetella pertussis
ugccgcgcguacgcggcgcgg

SEQ ID NO: 363252 - RNA, 21 nt, Bordetella pertussis
ugccgcggauugccguccugg

SEQ ID NO: 363253 - RNA, 13 nt, Bordetella pertussis
ugccgcggcaugc

SEQ ID NO: 363254 - RNA, 13 nt, Bordetella pertussis
ugccgcggccgcc

SEQ ID NO: 363255 - RNA, 13 nt, Bordetella pertussis
ugccgcggcgcgg

SEQ ID NO: 363256 - RNA, 14 nt, Bordetella pertussis
ugccgcggcgcggc

SEQ ID NO: 363257 - RNA, 19 nt, Bordetella pertussis
ugccgcggcgcggcccgcc

SEQ ID NO: 363258 - RNA, 18 nt, Bordetella pertussis
ugccgcgguggcgggcgu

SEQ ID NO: 363259 - RNA, 21 nt, Bordetella pertussis
ugccgcgguggcgggcgugcg

SEQ ID NO: 363260 - RNA, 18 nt, Bordetella pertussis
ugccgcguaugcggcagc

SEQ ID NO: 363261 - RNA, 16 nt, Bordetella pertussis
ugccguaccaguacac

SEQ ID NO: 363262 - RNA, 17 nt, Bordetella pertussis
ugccguaggcgccggcc

SEQ ID NO: 363263 - RNA, 20 nt, Bordetella pertussis
ugccguaggcgccggccuug

SEQ ID NO: 363264 - RNA, 16 nt, Bordetella pertussis
ugccguaggguucgcc

SEQ ID NO: 363265 - RNA, 18 nt, Bordetella pertussis
ugccguccacgcccagcg

SEQ ID NO: 363266 - RNA, 13 nt, Bordetella pertussis
ugccguccagcgc

SEQ ID NO: 363267 - RNA, 14 nt, Bordetella pertussis
ugccgucuggcggc

SEQ ID NO: 363268 - RNA, 21 nt, Bordetella pertussis
ugccucaacuggccggccugg

SEQ ID NO: 363269 - RNA, 23 nt, Bordetella pertussis
ugccucagaccacgacggucugg

SEQ ID NO: 363270 - RNA, 16 nt, Bordetella pertussis
ugccuccaggcgcaag

SEQ ID NO: 363271 - RNA, 21 nt, Bordetella pertussis
ugccuccaggcgcaagccugg

SEQ ID NO: 363272 - RNA, 14 nt, Bordetella pertussis
ugccucgcggcagu

SEQ ID NO: 363273 - RNA, 16 nt, Bordetella pertussis
ugccucgcggcagugg

SEQ ID NO: 363274 - RNA, 19 nt, Bordetella pertussis
ugccucguucaugucgcgg

SEQ ID NO: 363275 - RNA, 15 nt, Bordetella pertussis
ugccugacgugcgcc

SEQ ID NO: 363276 - RNA, 16 nt, Bordetella pertussis
ugccugagcaccgccg

SEQ ID NO: 363277 - RNA, 22 nt, Bordetella pertussis
ugccugagcaccgccgcguccu

SEQ ID NO: 363278 - RNA, 13 nt, Bordetella pertussis
ugccugcagcgcg

SEQ ID NO: 363279 - RNA, 18 nt, Bordetella pertussis
ugccugccagcccaccag

SEQ ID NO: 363280 - RNA, 21 nt, Bordetella pertussis
ugccugccagcccaccagcgc

SEQ ID NO: 363281 - RNA, 19 nt, Bordetella pertussis
ugccugccggccggccagu

SEQ ID NO: 363282 - RNA, 18 nt, Bordetella pertussis
ugccugcgaugccggcgu

SEQ ID NO: 363283 - RNA, 20 nt, Bordetella pertussis
ugccugcgaugccggcgugg

SEQ ID NO: 363284 - RNA, 18 nt, Bordetella pertussis
ugccuggcuccccgggca

SEQ ID NO: 363285 - RNA, 13 nt, Bordetella pertussis
ugcgacagcgaca

SEQ ID NO: 363286 - RNA, 12 nt, Bordetella pertussis
ugcgacaggcgc

SEQ ID NO: 363287 - RNA, 16 nt, Bordetella pertussis
ugcgacgauccggcga

SEQ ID NO: 363288 - RNA, 18 nt, Bordetella pertussis
ugcgaggcgaacauggcc

SEQ ID NO: 363289 - RNA, 16 nt, Bordetella pertussis
ugcgaggugcccgcga

SEQ ID NO: 363290 - RNA, 20 nt, Bordetella pertussis
ugcgaggugcccgcgaagca

SEQ ID NO: 363291 - RNA, 18 nt, Bordetella pertussis
ugcgauaucccgggcucc

SEQ ID NO: 363292 - RNA, 16 nt, Bordetella pertussis
ugcgauccagggcgau

SEQ ID NO: 363293 - RNA, 14 nt, Bordetella pertussis
ugcgcagcagcgcg

SEQ ID NO: 363294 - RNA, 18 nt, Bordetella pertussis
ugcgcagcaggcgcgugc

SEQ ID NO: 363295 - RNA, 12 nt, Bordetella pertussis
ugcgcagccggg

SEQ ID NO: 363296 - RNA, 21 nt, Bordetella pertussis
ugcgcagccgggcugccggca

SEQ ID NO: 363297 - RNA, 12 nt, Bordetella pertussis
ugcgcagcgagu

SEQ ID NO: 363298 - RNA, 21 nt, Bordetella pertussis
ugcgcagcgcgucggcgcggu

SEQ ID NO: 363299 - RNA, 19 nt, Bordetella pertussis
ugcgcagcucguggcgcgc

SEQ ID NO: 363300 - RNA, 17 nt, Bordetella pertussis
ugcgcaggacggcgccg

SEQ ID NO: 363301 - RNA, 15 nt, Bordetella pertussis
ugcgcaggcccgaca

SEQ ID NO: 363302 - RNA, 15 nt, Bordetella pertussis
ugcgcaggcgccgca

SEQ ID NO: 363303 - RNA, 16 nt, Bordetella pertussis
ugcgcagggcgggcgg

SEQ ID NO: 363304 - RNA, 20 nt, Bordetella pertussis
ugcgcaggguuuccgacacc

SEQ ID NO: 363305 - RNA, 19 nt, Bordetella pertussis
ugcgcaucgaucagcgcgc

SEQ ID NO: 363306 - RNA, 14 nt, Bordetella pertussis
ugcgcaucgaugcg

SEQ ID NO: 363307 - RNA, 16 nt, Bordetella pertussis
ugcgcaucgaugcggc

SEQ ID NO: 363308 - RNA, 16 nt, Bordetella pertussis
ugcgcaucgcgaccgc

SEQ ID NO: 363309 - RNA, 13 nt, Bordetella pertussis
ugcgcauggccag

SEQ ID NO: 363310 - RNA, 16 nt, Bordetella pertussis
ugcgcauggccagcgc

SEQ ID NO: 363311 - RNA, 18 nt, Bordetella pertussis
ugcgcauggccagcgcgc

SEQ ID NO: 363312 - RNA, 22 nt, Bordetella pertussis
ugcgcauggccagcgcgcaggu

SEQ ID NO: 363313 - RNA, 13 nt, Bordetella pertussis
ugcgcaugggcgc

SEQ ID NO: 363314 - RNA, 19 nt, Bordetella pertussis
ugcgcaugggcgcaggccg

SEQ ID NO: 363315 - RNA, 15 nt, Bordetella pertussis
ugcgcauggucgcga

SEQ ID NO: 363316 - RNA, 18 nt, Bordetella pertussis
ugcgccgcaugcggcggc

SEQ ID NO: 363317 - RNA, 17 nt, Bordetella pertussis
ugcgccgcccgugccag

SEQ ID NO: 363318 - RNA, 22 nt, Bordetella pertussis
ugcgccgcccgugccaguucac

SEQ ID NO: 363319 - RNA, 19 nt, Bordetella pertussis
ugcgccgccgccgcggccu

SEQ ID NO: 363320 - RNA, 16 nt, Bordetella pertussis
ugcgccgccgcgcgcu

SEQ ID NO: 363321 - RNA, 13 nt, Bordetella pertussis
ugcgccgccccag

SEQ ID NO: 363322 - RNA, 17 nt, Bordetella pertussis
ugcgccgccccaguugc

SEQ ID NO: 363323 - RNA, 14 nt, Bordetella pertussis
ugcgccgcggcgcu

SEQ ID NO: 363324 - RNA, 16 nt, Bordetella pertussis
ugcgccgcggcgcugg

SEQ ID NO: 363325 - RNA, 21 nt, Bordetella pertussis
ugcgccgcuacgcggcgucag

SEQ ID NO: 363326 - RNA, 16 nt, Bordetella pertussis
ugcgccggccuggcgc

SEQ ID NO: 363327 - RNA, 18 nt, Bordetella pertussis
ugcgccggccuggcgcga

SEQ ID NO: 363328 - RNA, 14 nt, Bordetella pertussis
ugcgccggcgcggc

SEQ ID NO: 363329 - RNA, 14 nt, Bordetella pertussis
ugcgccugcagcgc

SEQ ID NO: 363330 - RNA, 19 nt, Bordetella pertussis
ugcgccugggcggcgcagu

SEQ ID NO: 363331 - RNA, 15 nt, Bordetella pertussis
ugcgccuuggcgcgc

SEQ ID NO: 363332 - RNA, 16 nt, Bordetella pertussis
ugcgccuuggcgcgca

SEQ ID NO: 363333 - RNA, 17 nt, Bordetella pertussis
ugcgccuuggcgcgcag

SEQ ID NO: 363334 - RNA, 17 nt, Bordetella pertussis
ugcgcgaacgcgcgccg

SEQ ID NO: 363335 - RNA, 21 nt, Bordetella pertussis
ugcgcgaacgcgcgccggcca

SEQ ID NO: 363336 - RNA, 16 nt, Bordetella pertussis
ugcgcgaacgcggcca

SEQ ID NO: 363337 - RNA, 19 nt, Bordetella pertussis
ugcgcgaacggcaggugca

SEQ ID NO: 363338 - RNA, 21 nt, Bordetella pertussis
ugcgcgaaacccccuggguga

SEQ ID NO: 363339 - RNA, 16 nt, Bordetella pertussis
ugcgcgaaacggccgg

SEQ ID NO: 363340 - RNA, 13 nt, Bordetella pertussis
ugcgcgaagcgcu

SEQ ID NO: 363341 - RNA, 22 nt, Bordetella pertussis
ugcgcgaagcggaaacgcgcgc

SEQ ID NO: 363342 - RNA, 13 nt, Bordetella pertussis
ugcgcgacaggcc

SEQ ID NO: 363343 - RNA, 18 nt, Bordetella pertussis
ugcgcgacaggcccgcgg

SEQ ID NO: 363344 - RNA, 20 nt, Bordetella pertussis
ugcgcgacaaccgcggcgac

SEQ ID NO: 363345 - RNA, 22 nt, Bordetella pertussis
ugcgcgacgaaucggucacgau

SEQ ID NO: 363346 - RNA, 11 nt, Bordetella pertussis
ugcgcgacggc

SEQ ID NO: 363347 - RNA, 13 nt, Bordetella pertussis
ugcgcgacggcga

SEQ ID NO: 363348 - RNA, 16 nt, Bordetella pertussis
ugcgcgacggcggccu

SEQ ID NO: 363349 - RNA, 19 nt, Bordetella pertussis
ugcgcgaggugggcggcag

SEQ ID NO: 363350 - RNA, 19 nt, Bordetella pertussis
ugcgcgaugagcuggcgca

SEQ ID NO: 363351 - RNA, 16 nt, Bordetella pertussis
ugcgcgaugcgcgcgu

SEQ ID NO: 363352 - RNA, 18 nt, Bordetella pertussis
ugcgcgaugcgcgcgugc

SEQ ID NO: 363353 - RNA, 19 nt, Bordetella pertussis
ugcgcgaugcgcgcgugca

SEQ ID NO: 363354 - RNA, 20 nt, Bordetella pertussis
ugcgcgaucucguggcccag

SEQ ID NO: 363355 - RNA, 22 nt, Bordetella pertussis
ugcgcgccacauccugcacggc

SEQ ID NO: 363356 - RNA, 13 nt, Bordetella pertussis
ugcgcgccagcuc

SEQ ID NO: 363357 - RNA, 20 nt, Bordetella pertussis
ugcgcgccaggucgcgcacc

SEQ ID NO: 363358 - RNA, 20 nt, Bordetella pertussis
ugcgcgccaguucaaggcgc

SEQ ID NO: 363359 - RNA, 14 nt, Bordetella pertussis
ugcgcgccaugcaa

SEQ ID NO: 363360 - RNA, 15 nt, Bordetella pertussis
ugcgcgccaugcaac

SEQ ID NO: 363361 - RNA, 20 nt, Bordetella pertussis
ugcgcgccaugcaacacgac

SEQ ID NO: 363362 - RNA, 19 nt, Bordetella pertussis
ugcgcgccccgucggccgu

SEQ ID NO: 363363 - RNA, 19 nt, Bordetella pertussis
ugcgcgccgaccaccugca

SEQ ID NO: 363364 - RNA, 23 nt, Bordetella pertussis
ugcgcgccgccggugcaccaggc

SEQ ID NO: 363365 - RNA, 23 nt, Bordetella pertussis
ugcgcgccguacagccgcggcag

SEQ ID NO: 363366 - RNA, 22 nt, Bordetella pertussis
ugcgcgccggcgccuuggccug

SEQ ID NO: 363367 - RNA, 14 nt, Bordetella pertussis
ugcgcgccugcugg

SEQ ID NO: 363368 - RNA, 12 nt, Bordetella pertussis
ugcgcgcggccu

SEQ ID NO: 363369 - RNA, 13 nt, Bordetella pertussis
ugcgcgcggccug

SEQ ID NO: 363370 - RNA, 14 nt, Bordetella pertussis
ugcgcgcggccagc

SEQ ID NO: 363371 - RNA, 16 nt, Bordetella pertussis
ugcgcgcucauggcgc

SEQ ID NO: 363372 - RNA, 17 nt, Bordetella pertussis
ugcgcgcgugcagcgcc

SEQ ID NO: 363373 - RNA, 14 nt, Bordetella pertussis
ugcgcggccacccu

SEQ ID NO: 363374 - RNA, 15 nt, Bordetella pertussis
ugcgcggccaugccg

SEQ ID NO: 363375 - RNA, 12 nt, Bordetella pertussis
ugcgcggccgag

SEQ ID NO: 363376 - RNA, 20 nt, Bordetella pertussis
ugcgcggccgagcgggccag

SEQ ID NO: 363377 - RNA, 15 nt, Bordetella pertussis
ugcgcggccgcgcgc

SEQ ID NO: 363378 - RNA, 12 nt, Bordetella pertussis
ugcgcggccguu

SEQ ID NO: 363379 - RNA, 20 nt, Bordetella pertussis
ugcgcggccugcuccggcgu

SEQ ID NO: 363380 - RNA, 22 nt, Bordetella pertussis
ugcgcggccugcuccggcguga

SEQ ID NO: 363381 - RNA, 14 nt, Bordetella pertussis
ugcgcggcgagccg

SEQ ID NO: 363382 - RNA, 20 nt, Bordetella pertussis
ugcgcggcgagcgccgccag

SEQ ID NO: 363383 - RNA, 20 nt, Bordetella pertussis
ugcgcggcgaucgacagccu

SEQ ID NO: 363384 - RNA, 22 nt, Bordetella pertussis
ugcgcggcgcgucgcgcgccag

SEQ ID NO: 363385 - RNA, 22 nt, Bordetella pertussis
ugcgcggcgggaccgugccgcc

SEQ ID NO: 363386 - RNA, 19 nt, Bordetella pertussis
ugcgcggcgggccccgcag

SEQ ID NO: 363387 - RNA, 22 nt, Bordetella pertussis
ugcgcggcggugccgcccaccg

SEQ ID NO: 363388 - RNA, 23 nt, Bordetella pertussis
ugcgcggcuugcagcggacggcg

SEQ ID NO: 363389 - RNA, 14 nt, Bordetella pertussis
ugcgcggcgcagcc

SEQ ID NO: 363390 - RNA, 12 nt, Bordetella pertussis
ugcgcgggcgcc

SEQ ID NO: 363391 - RNA, 13 nt, Bordetella pertussis
ugcgcgggcgcgg

SEQ ID NO: 363392 - RNA, 16 nt, Bordetella pertussis
ugcgcgggcgcggcag

SEQ ID NO: 363393 - RNA, 14 nt, Bordetella pertussis
ugcgcgggcgcggg

SEQ ID NO: 363394 - RNA, 20 nt, Bordetella pertussis
ugcgcggggccgguccgcuc

SEQ ID NO: 363395 - RNA, 15 nt, Bordetella pertussis
ugcgcguaggcgcgc

SEQ ID NO: 363396 - RNA, 16 nt, Bordetella pertussis
ugcgcguaggcgcgcg

SEQ ID NO: 363397 - RNA, 23 nt, Bordetella pertussis
ugcgcguaggcgcgcgcaucggc

SEQ ID NO: 363398 - RNA, 22 nt, Bordetella pertussis
ugcgcguaguccgagcccgggc

SEQ ID NO: 363399 - RNA, 16 nt, Bordetella pertussis
ugcgcguauccagcau

SEQ ID NO: 363400 - RNA, 13 nt, Bordetella pertussis
ugcgcguccuggc

SEQ ID NO: 363401 - RNA, 16 nt, Bordetella pertussis
ugcgcguccuggcgcg

SEQ ID NO: 363402 - RNA, 17 nt, Bordetella pertussis
ugcgcguccuggcgcga

SEQ ID NO: 363403 - RNA, 19 nt, Bordetella pertussis
ugcgcguccuggcgcgaga

SEQ ID NO: 363404 - RNA, 23 nt, Bordetella pertussis
ugcgcguccugggccgagcgcgc

SEQ ID NO: 363405 - RNA, 18 nt, Bordetella pertussis
ugcgcgucaggcgagcgc

SEQ ID NO: 363406 - RNA, 15 nt, Bordetella pertussis
ugcgcguccaggcca

SEQ ID NO: 363407 - RNA, 17 nt, Bordetella pertussis
ugcgcguccaggcgguc

SEQ ID NO: 363408 - RNA, 18 nt, Bordetella pertussis
ugcgcgucuccagcgccg

SEQ ID NO: 363409 - RNA, 12 nt, Bordetella pertussis
ugcgcgugacga

SEQ ID NO: 363410 - RNA, 13 nt, Bordetella pertussis
ugcgcgugcacga

SEQ ID NO: 363411 - RNA, 21 nt, Bordetella pertussis
ugcgcguuccggccgcgccag

SEQ ID NO: 363412 - RNA, 14 nt, Bordetella pertussis
ugcgcucgcccagc

SEQ ID NO: 363413 - RNA, 19 nt, Bordetella pertussis
ugcgcucggucauguccag

SEQ ID NO: 363414 - RNA, 20 nt, Bordetella pertussis
ugcgcucggucauguccagc

SEQ ID NO: 363415 - RNA, 13 nt, Bordetella pertussis
ugcgcucggucca

SEQ ID NO: 363416 - RNA, 20 nt, Bordetella pertussis
ugcgcucgguguggauggcg

SEQ ID NO: 363417 - RNA, 15 nt, Bordetella pertussis
ugcgcugcccgucgc

SEQ ID NO: 363418 - RNA, 15 nt, Bordetella pertussis
ugcgcugcucgucca

SEQ ID NO: 363419 - RNA, 14 nt, Bordetella pertussis
ugcgcugcuggcca

SEQ ID NO: 363420 - RNA, 13 nt, Bordetella pertussis
ugcgcuggcgcgc

SEQ ID NO: 363421 - RNA, 17 nt, Bordetella pertussis
ugcgcuggcugggccug

SEQ ID NO: 363422 - RNA, 20 nt, Bordetella pertussis
ugcgcuggcugggccugcug

SEQ ID NO: 363423 - RNA, 19 nt, Bordetella pertussis
ugcgcugggcaugggcggc

SEQ ID NO: 363424 - RNA, 20 nt, Bordetella pertussis
ugcgcugggcaugggcggcc

SEQ ID NO: 363425 - RNA, 13 nt, Bordetella pertussis
ugcgcugggccag

SEQ ID NO: 363426 - RNA, 20 nt, Bordetella pertussis
ugcgcugggccaggccggcc

SEQ ID NO: 363427 - RNA, 14 nt, Bordetella pertussis
ugcgcuggccggcc

SEQ ID NO: 363428 - RNA, 15 nt, Bordetella pertussis
ugcgcuggccggccg

SEQ ID NO: 363429 - RNA, 14 nt, Bordetella pertussis
ugcgcuggcgcaag

SEQ ID NO: 363430 - RNA, 12 nt, Bordetella pertussis
ugcgcugggcgg

SEQ ID NO: 363431 - RNA, 14 nt, Bordetella pertussis
ugcgcuggucgcgc

SEQ ID NO: 363432 - RNA, 16 nt, Bordetella pertussis
ugcgcuggucgcgcag

SEQ ID NO: 363433 - RNA, 18 nt, Bordetella pertussis
ugcgcuggucgcgcagca

SEQ ID NO: 363434 - RNA, 21 nt, Bordetella pertussis
ugcggacccaguucggccgcc

SEQ ID NO: 363435 - RNA, 23 nt, Bordetella pertussis
ugcggacccaguucggccgccag

SEQ ID NO: 363436 - RNA, 14 nt, Bordetella pertussis
ugcggacgggccag

SEQ ID NO: 363437 - RNA, 17 nt, Bordetella pertussis
ugcggcacgugccggau

SEQ ID NO: 363438 - RNA, 22 nt, Bordetella pertussis
ugcggcacgugccggauggcgc

SEQ ID NO: 363439 - RNA, 17 nt, Bordetella pertussis
ugcggcagcgccgcaac

SEQ ID NO: 363440 - RNA, 14 nt, Bordetella pertussis
ugcggcagggccuc

SEQ ID NO: 363441 - RNA, 22 nt, Bordetella pertussis
ugcggcccagccgcucggccac

SEQ ID NO: 363442 - RNA, 22 nt, Bordetella pertussis
ugcggccggugaucuugccgau

SEQ ID NO: 363443 - RNA, 17 nt, Bordetella pertussis
ugcggccuucgccggug

SEQ ID NO: 363444 - RNA, 18 nt, Bordetella pertussis
ugcggcgacagggcgucg

SEQ ID NO: 363445 - RNA, 20 nt, Bordetella pertussis
ugcggcgauuucuacgccga

SEQ ID NO: 363446 - RNA, 19 nt, Bordetella pertussis
ugcggcgcaugcugcgcga

SEQ ID NO: 363447 - RNA, 11 nt, Bordetella pertussis
ugcggcgccac

SEQ ID NO: 363448 - RNA, 14 nt, Bordetella pertussis
ugcggcgccacugc

SEQ ID NO: 363449 - RNA, 14 nt, Bordetella pertussis
ugcggcgccagcgc

SEQ ID NO: 363450 - RNA, 21 nt, Bordetella pertussis
ugcggcgcccaggcccagcgc

SEQ ID NO: 363451 - RNA, 20 nt, Bordetella pertussis
ugcggcgccggugcgcggcg

SEQ ID NO: 363452 - RNA, 18 nt, Bordetella pertussis
ugcggcgcgcacgggcga

SEQ ID NO: 363453 - RNA, 12 nt, Bordetella pertussis
ugcggcgcgccg

SEQ ID NO: 363454 - RNA, 14 nt, Bordetella pertussis
ugcggcgcggccag

SEQ ID NO: 363455 - RNA, 17 nt, Bordetella pertussis
ugcggcgcggcgcgugc

SEQ ID NO: 363456 - RNA, 20 nt, Bordetella pertussis
ugcggcgcggcgcgugccag

SEQ ID NO: 363457 - RNA, 14 nt, Bordetella pertussis
ugcggcgcggcggu

SEQ ID NO: 363458 - RNA, 18 nt, Bordetella pertussis
ugcgucacgcacagcacc

SEQ ID NO: 363459 - RNA, 15 nt, Bordetella pertussis
ugcgugcgcggcgug

SEQ ID NO: 363460 - RNA, 17 nt, Bordetella pertussis
ugcgugcgggacaggca

SEQ ID NO: 363461 - RNA, 15 nt, Bordetella pertussis
ugcguggccgccggg

SEQ ID NO: 363462 - RNA, 15 nt, Bordetella pertussis
ugcguggccggcggg

SEQ ID NO: 363463 - RNA, 14 nt, Bordetella pertussis
ugcguggcggcguc

SEQ ID NO: 363464 - RNA, 14 nt, Bordetella pertussis
ugcguuggcgcggc

SEQ ID NO: 363465 - RNA, 22 nt, Bordetella pertussis
ugcuaguacaccgucgcgcgca

SEQ ID NO: 363466 - RNA, 21 nt, Bordetella pertussis
ugcucggccagcgcgcgccag

SEQ ID NO: 363467 - RNA, 21 nt, Bordetella pertussis
ugcucggcgaacugggcgucg

SEQ ID NO: 363468 - RNA, 15 nt, Bordetella pertussis
ugcucggcggcaagu

SEQ ID NO: 363469 - RNA, 16 nt, Bordetella pertussis
ugcucgggcugcggcu

SEQ ID NO: 363470 - RNA, 19 nt, Bordetella pertussis
ugcucggugcgggccggcg

SEQ ID NO: 363471 - RNA, 23 nt, Bordetella pertussis
ugcucguucugcgcgcccguguc

SEQ ID NO: 363472 - RNA, 14 nt, Bordetella pertussis
ugcucuggcccgcc

SEQ ID NO: 363473 - RNA, 13 nt, Bordetella pertussis
ugcucuuggcaac

SEQ ID NO: 363474 - RNA, 16 nt, Bordetella pertussis
ugcugaaccugcuggc

SEQ ID NO: 363475 - RNA, 20 nt, Bordetella pertussis
ugcugaaccugcuggccgcc

SEQ ID NO: 363476 - RNA, 16 nt, Bordetella pertussis
ugcugaauugcgggcc

SEQ ID NO: 363477 - RNA, 14 nt, Bordetella pertussis
ugcugaccaccggg

SEQ ID NO: 363478 - RNA, 19 nt, Bordetella pertussis
ugcugaccaccgggaugcc

SEQ ID NO: 363479 - RNA, 20 nt, Bordetella pertussis
ugcugcagcgucuggcacgc

SEQ ID NO: 363480 - RNA, 23 nt, Bordetella pertussis
ugcugcagcgucuggcacgcuug

SEQ ID NO: 363481 - RNA, 15 nt, Bordetella pertussis
ugcugcaggccggcg

SEQ ID NO: 363482 - RNA, 19 nt, Bordetella pertussis
ugcugcaggccggcgcgca

SEQ ID NO: 363483 - RNA, 15 nt, Bordetella pertussis
ugcugcaggcgcggg

SEQ ID NO: 363484 - RNA, 19 nt, Bordetella pertussis
ugcugacgguaagcaccag

SEQ ID NO: 363485 - RNA, 16 nt, Bordetella pertussis
ugcugccaugccgcgc

SEQ ID NO: 363486 - RNA, 19 nt, Bordetella pertussis
ugcugccaugccgcgcgcc

SEQ ID NO: 363487 - RNA, 17 nt, Bordetella pertussis
ugcugccccccgagggg

SEQ ID NO: 363488 - RNA, 13 nt, Bordetella pertussis
ugcugcccgacgg

SEQ ID NO: 363489 - RNA, 16 nt, Bordetella pertussis
ugcugccggauuggcg

SEQ ID NO: 363490 - RNA, 19 nt, Bordetella pertussis
ugcugccguuucucaaccc

SEQ ID NO: 363491 - RNA, 21 nt, Bordetella pertussis
ugcuggccaacgccacgccca

SEQ ID NO: 363492 - RNA, 23 nt, Bordetella pertussis
ugcuggccaacgccacgcccauc

SEQ ID NO: 363493 - RNA, 18 nt, Bordetella pertussis
ugcuggccaagcgcgccg

SEQ ID NO: 363494 - RNA, 21 nt, Bordetella pertussis
ugcuggcccagaccaagcgcc

SEQ ID NO: 363495 - RNA, 16 nt, Bordetella pertussis
ugcuggccgccgcgcu

SEQ ID NO: 363496 - RNA, 14 nt, Bordetella pertussis
ugcuggccgccggc

SEQ ID NO: 363497 - RNA, 15 nt, Bordetella pertussis
ugcuggccggccagc

SEQ ID NO: 363498 - RNA, 13 nt, Bordetella pertussis
ugcuggcgcagca

SEQ ID NO: 363499 - RNA, 18 nt, Bordetella pertussis
ugcuggcgcagcagcgcc

SEQ ID NO: 363500 - RNA, 21 nt, Bordetella pertussis
ugcuggcgcgcaccaucgccg

SEQ ID NO: 363501 - RNA, 14 nt, Bordetella pertussis
ugcuggcgcgccag

SEQ ID NO: 363502 - RNA, 11 nt, Bordetella pertussis
ugcuggcgcgg

SEQ ID NO: 363503 - RNA, 19 nt, Bordetella pertussis
ugcuggcguuugcgcgcgc

SEQ ID NO: 363504 - RNA, 18 nt, Bordetella pertussis
ugcuggcuucggcgcugg

SEQ ID NO: 363505 - RNA, 20 nt, Bordetella pertussis
ugcugggguggagcgcggcg

SEQ ID NO: 363506 - RNA, 24 nt, Bordetella pertussis
ugcugggguggagcgcggcgcugg

SEQ ID NO: 363507 - RNA, 17 nt, Bordetella pertussis
ugcugguacagccccag

SEQ ID NO: 363508 - RNA, 20 nt, Bordetella pertussis
ugcugguacagccccagcgc

SEQ ID NO: 363509 - RNA, 19 nt, Bordetella pertussis
ugcuggucagccugggcgc

SEQ ID NO: 363510 - RNA, 17 nt, Bordetella pertussis
ugcuggucgccaucugc

SEQ ID NO: 363511 - RNA, 12 nt, Bordetella pertussis
ugcuggucgcgg

SEQ ID NO: 363512 - RNA, 17 nt, Bordetella pertussis
ugcuguaccucagccug

SEQ ID NO: 363513 - RNA, 20 nt, Bordetella pertussis
ugcuguaccucagccugcug

SEQ ID NO: 363514 - RNA, 22 nt, Bordetella pertussis
ugcugucgcgcugcccguuggc

SEQ ID NO: 363515 - RNA, 22 nt, Bordetella pertussis
uggaaccgccgcuuucgaccuu

SEQ ID NO: 363516 - RNA, 19 nt, Bordetella pertussis
uggaaccgguuggccagcu

SEQ ID NO: 363517 - RNA, 22 nt, Bordetella pertussis
uggaaccgguuggccagcucca

SEQ ID NO: 363518 - RNA, 15 nt, Bordetella pertussis
uggaagacguggccc

SEQ ID NO: 363519 - RNA, 17 nt, Bordetella pertussis
uggaagacguggcccgc

SEQ ID NO: 363520 - RNA, 15 nt, Bordetella pertussis
uggaagcuggccagc

SEQ ID NO: 363521 - RNA, 16 nt, Bordetella pertussis
uggaagugaugccgcc

SEQ ID NO: 363522 - RNA, 14 nt, Bordetella pertussis
uggaccgcgcgcga

SEQ ID NO: 363523 - RNA, 20 nt, Bordetella pertussis
uggaccgcgcgguggccgcc

SEQ ID NO: 363524 - RNA, 18 nt, Bordetella pertussis
uggacgagcucgucgguc

SEQ ID NO: 363525 - RNA, 22 nt, Bordetella pertussis
uggacgagcucgucggucagcu

SEQ ID NO: 363526 - RNA, 15 nt, Bordetella pertussis
uggacgaggcgaugg

SEQ ID NO: 363527 - RNA, 17 nt, Bordetella pertussis
uggacgagggccggcgc

SEQ ID NO: 363528 - RNA, 19 nt, Bordetella pertussis
uggacgagggccggcgcca

SEQ ID NO: 363529 - RNA, 22 nt, Bordetella pertussis
uggacgagggccggcgccagca

SEQ ID NO: 363530 - RNA, 14 nt, Bordetella pertussis
uggacgaugcgcga

SEQ ID NO: 363531 - RNA, 11 nt, Bordetella pertussis
uggacgccgaa

SEQ ID NO: 363532 - RNA, 19 nt, Bordetella pertussis
uggacgcgcgcggcgaccg

SEQ ID NO: 363533 - RNA, 21 nt, Bordetella pertussis
uggacgcgcuguaggcgccgg

SEQ ID NO: 363534 - RNA, 18 nt, Bordetella pertussis
uggacgcuuucggggcgc

SEQ ID NO: 363535 - RNA, 14 nt, Bordetella pertussis
uggacggccagcag

SEQ ID NO: 363536 - RNA, 12 nt, Bordetella pertussis
uggacggcgagg

SEQ ID NO: 363537 - RNA, 20 nt, Bordetella pertussis
uggacgugcgcgaccgcgcg

SEQ ID NO: 363538 - RNA, 19 nt, Bordetella pertussis
uggacuauggccuggaugu

SEQ ID NO: 363539 - RNA, 15 nt, Bordetella pertussis
uggagaacgagccgg

SEQ ID NO: 363540 - RNA, 15 nt, Bordetella pertussis
uggagaccggcaugg

SEQ ID NO: 363541 - RNA, 19 nt, Bordetella pertussis
uggagaccggcgccugcgg

SEQ ID NO: 363542 - RNA, 22 nt, Bordetella pertussis
uggagaucaugaccacgucgau

SEQ ID NO: 363543 - RNA, 14 nt, Bordetella pertussis
uggagaucgccgag

SEQ ID NO: 363544 - RNA, 15 nt, Bordetella pertussis
uggagaucgccgagc

SEQ ID NO: 363545 - RNA, 19 nt, Bordetella pertussis
uggagaucgccgccgaagc

SEQ ID NO: 363546 - RNA, 13 nt, Bordetella pertussis
uggagauggcgcc

SEQ ID NO: 363547 - RNA, 16 nt, Bordetella pertussis
uggagaugugcccgag

SEQ ID NO: 363548 - RNA, 16 nt, Bordetella pertussis
uggagcgcggcgcugg

SEQ ID NO: 363549 - RNA, 17 nt, Bordetella pertussis
uggagcgcggcggcgug

SEQ ID NO: 363550 - RNA, 17 nt, Bordetella pertussis
uggagcggccuggcccc

SEQ ID NO: 363551 - RNA, 19 nt, Bordetella pertussis
uggagcucgggugggccgg

SEQ ID NO: 363552 - RNA, 20 nt, Bordetella pertussis
uggagcuggggccgcgcgcc

SEQ ID NO: 363553 - RNA, 16 nt, Bordetella pertussis
uggaggccuuccacca

SEQ ID NO: 363554 - RNA, 14 nt, Bordetella pertussis
uggaggcgcagcgc

SEQ ID NO: 363555 - RNA, 16 nt, Bordetella pertussis
uggaggcggcggccgu

SEQ ID NO: 363556 - RNA, 17 nt, Bordetella pertussis
uggaucaggaugggcgc

SEQ ID NO: 363557 - RNA, 21 nt, Bordetella pertussis
uggaucccggcgaucaugccg

SEQ ID NO: 363558 - RNA, 22 nt, Bordetella pertussis
uggauccgccggugucggggcc

SEQ ID NO: 363559 - RNA, 21 nt, Bordetella pertussis
uggaucgccgaucggcaaagc

SEQ ID NO: 363560 - RNA, 23 nt, Bordetella pertussis
uggaucuggugaaacagcaucag

SEQ ID NO: 363561 - RNA, 23 nt, Bordetella pertussis
uggaugaagcguucggccuugcc

SEQ ID NO: 363562 - RNA, 17 nt, Bordetella pertussis
uggaugccaugccgggc

SEQ ID NO: 363563 - RNA, 12 nt, Bordetella pertussis
uggaugcgcgcc

SEQ ID NO: 363564 - RNA, 17 nt, Bordetella pertussis
uggauggccugcucgcc

SEQ ID NO: 363565 - RNA, 21 nt, Bordetella pertussis
uggauggcgguaaagaccuug

SEQ ID NO: 363566 - RNA, 19 nt, Bordetella pertussis
uggauggucacgcccaggc

SEQ ID NO: 363567 - RNA, 22 nt, Bordetella pertussis
uggauggucuugccgaugucga

SEQ ID NO: 363568 - RNA, 20 nt, Bordetella pertussis
uggcaacgggucgcgcagca

SEQ ID NO: 363569 - RNA, 14 nt, Bordetella pertussis
uggcaccugccgac

SEQ ID NO: 363570 - RNA, 19 nt, Bordetella pertussis
uggcacgacguggccuacc

SEQ ID NO: 363571 - RNA, 23 nt, Bordetella pertussis
uggcacugucggcguuccuggcg

SEQ ID NO: 363572 - RNA, 20 nt, Bordetella pertussis
uggcagacguacuugaucug

SEQ ID NO: 363573 - RNA, 17 nt, Bordetella pertussis
uggcagaugcgcgccag

SEQ ID NO: 363574 - RNA, 15 nt, Bordetella pertussis
uggcagcuggcgcgg

SEQ ID NO: 363575 - RNA, 16 nt, Bordetella pertussis
uggcagcuggcgcggg

SEQ ID NO: 363576 - RNA, 19 nt, Bordetella pertussis
uggcagcuggcgcgggcgg

SEQ ID NO: 363577 - RNA, 21 nt, Bordetella pertussis
uggcaggccgcuucgaugcug

SEQ ID NO: 363578 - RNA, 14 nt, Bordetella pertussis
uggcaggugcggcc

SEQ ID NO: 363579 - RNA, 20 nt, Bordetella pertussis
uggcagguguuguugcacga

SEQ ID NO: 363580 - RNA, 19 nt, Bordetella pertussis
uggcaguacguacgcccgg

SEQ ID NO: 363581 - RNA, 13 nt, Bordetella pertussis
uggcagugcgcgu

SEQ ID NO: 363582 - RNA, 23 nt, Bordetella pertussis
uggcauagaugccgaacagccag

SEQ ID NO: 363583 - RNA, 19 nt, Bordetella pertussis
uggcaucgaccacgcgcgc

SEQ ID NO: 363584 - RNA, 20 nt, Bordetella pertussis
uggcaugaaaaagggcgcac

SEQ ID NO: 363585 - RNA, 12 nt, Bordetella pertussis
uggcaugagcgc

SEQ ID NO: 363586 - RNA, 13 nt, Bordetella pertussis
uggcaugagcgcc

SEQ ID NO: 363587 - RNA, 14 nt, Bordetella pertussis
uggcaugcaccgcg

SEQ ID NO: 363588 - RNA, 13 nt, Bordetella pertussis
uggcauggcgcgu

SEQ ID NO: 363589 - RNA, 20 nt, Bordetella pertussis
uggcauggcgcgugcgcgcg

SEQ ID NO: 363590 - RNA, 16 nt, Bordetella pertussis
uggcauugacgcccac

SEQ ID NO: 363591 - RNA, 19 nt, Bordetella pertussis
uggccggcaucgcgcugac

SEQ ID NO: 363592 - RNA, 23 nt, Bordetella pertussis
uggccggccaacagcucgcgcca

SEQ ID NO: 363593 - RNA, 19 nt, Bordetella pertussis
uggccggccccauccucau

SEQ ID NO: 363594 - RNA, 12 nt, Bordetella pertussis
uggccggccugc

SEQ ID NO: 363595 - RNA, 17 nt, Bordetella pertussis
uggccggccugccggcg

SEQ ID NO: 363596 - RNA, 19 nt, Bordetella pertussis
uggccggccugccggcgca

SEQ ID NO: 363597 - RNA, 16 nt, Bordetella pertussis
uggccggccuggcgcg

SEQ ID NO: 363598 - RNA, 19 nt, Bordetella pertussis
uggccggccgcguggccgc

SEQ ID NO: 363599 - RNA, 16 nt, Bordetella pertussis
uggccggcgacggcau

SEQ ID NO: 363600 - RNA, 13 nt, Bordetella pertussis
uggccggcgcgcc

SEQ ID NO: 363601 - RNA, 16 nt, Bordetella pertussis
uggccggcgcgcccuu

SEQ ID NO: 363602 - RNA, 18 nt, Bordetella pertussis
uggccggcgcgcggccgu

SEQ ID NO: 363603 - RNA, 13 nt, Bordetella pertussis
uggccggcgcgcu

SEQ ID NO: 363604 - RNA, 19 nt, Bordetella pertussis
uggccggcgauugcgccag

SEQ ID NO: 363605 - RNA, 23 nt, Bordetella pertussis
uggccggcgauugcgccagcgcu

SEQ ID NO: 363606 - RNA, 14 nt, Bordetella pertussis
uggccggcgcggca

SEQ ID NO: 363607 - RNA, 20 nt, Bordetella pertussis
uggccggcgcugggcaggcu

SEQ ID NO: 363608 - RNA, 18 nt, Bordetella pertussis
uggccgucuuuucguccu

SEQ ID NO: 363609 - RNA, 16 nt, Bordetella pertussis
uggccgugcgcccgac

SEQ ID NO: 363610 - RNA, 21 nt, Bordetella pertussis
uggccgugaucuugaugccgc

SEQ ID NO: 363611 - RNA, 18 nt, Bordetella pertussis
uggccguggcgugcaggc

SEQ ID NO: 363612 - RNA, 16 nt, Bordetella pertussis
uggccguuggccagcg

SEQ ID NO: 363613 - RNA, 14 nt, Bordetella pertussis
uggccucgcccugg

SEQ ID NO: 363614 - RNA, 15 nt, Bordetella pertussis
uggccucggcauggc

SEQ ID NO: 363615 - RNA, 17 nt, Bordetella pertussis
uggccucggcauggcgc

SEQ ID NO: 363616 - RNA, 19 nt, Bordetella pertussis
uggccucggcauggcgcgc

SEQ ID NO: 363617 - RNA, 13 nt, Bordetella pertussis
uggccucggccgg

SEQ ID NO: 363618 - RNA, 14 nt, Bordetella pertussis
uggccucggccggc

SEQ ID NO: 363619 - RNA, 13 nt, Bordetella pertussis
uggccucggcggc

SEQ ID NO: 363620 - RNA, 21 nt, Bordetella pertussis
uggccugcaggaugggccguc

SEQ ID NO: 363621 - RNA, 15 nt, Bordetella pertussis
uggccugcgccgccg

SEQ ID NO: 363622 - RNA, 18 nt, Bordetella pertussis
uggccugcucgcccacau

SEQ ID NO: 363623 - RNA, 22 nt, Bordetella pertussis
uggccugcuugaagacgcccag

SEQ ID NO: 363624 - RNA, 18 nt, Bordetella pertussis
uggccuggaugugcaggc

SEQ ID NO: 363625 - RNA, 13 nt, Bordetella pertussis
uggccuggcccag

SEQ ID NO: 363626 - RNA, 16 nt, Bordetella pertussis
uggccuggccgccggc

SEQ ID NO: 363627 - RNA, 17 nt, Bordetella pertussis
uggccuggccgccggcg

SEQ ID NO: 363628 - RNA, 13 nt, Bordetella pertussis
uggccugggccag

SEQ ID NO: 363629 - RNA, 13 nt, Bordetella pertussis
uggccugggccga

SEQ ID NO: 363630 - RNA, 17 nt, Bordetella pertussis
uggccugguuggccgcc

SEQ ID NO: 363631 - RNA, 21 nt, Bordetella pertussis
uggccuuccugcugacaggcg

SEQ ID NO: 363632 - RNA, 17 nt, Bordetella pertussis
uggccuugacggcgcgg

SEQ ID NO: 363633 - RNA, 16 nt, Bordetella pertussis
uggccuuggcaucgac

SEQ ID NO: 363634 - RNA, 19 nt, Bordetella pertussis
uggcgaaacuggccgacga

SEQ ID NO: 363635 - RNA, 23 nt, Bordetella pertussis
uggcgaaaggcaccgagcacagc

SEQ ID NO: 363636 - RNA, 20 nt, Bordetella pertussis
uggcgaacaccaggguggcg

SEQ ID NO: 363637 - RNA, 19 nt, Bordetella pertussis
uggcgacgcccagccugcc

SEQ ID NO: 363638 - RNA, 21 nt, Bordetella pertussis
uggcgacgcccagccugccgg

SEQ ID NO: 363639 - RNA, 16 nt, Bordetella pertussis
uggcgacgcgcugccg

SEQ ID NO: 363640 - RNA, 15 nt, Bordetella pertussis
uggcgcagcacgccg

SEQ ID NO: 363641 - RNA, 15 nt, Bordetella pertussis
uggcgcagcagcgcc

SEQ ID NO: 363642 - RNA, 16 nt, Bordetella pertussis
uggcgcagcagcgccg

SEQ ID NO: 363643 - RNA, 18 nt, Bordetella pertussis
uggcgcagcagcgccggc

SEQ ID NO: 363644 - RNA, 13 nt, Bordetella pertussis
uggcgcagcaggc

SEQ ID NO: 363645 - RNA, 18 nt, Bordetella pertussis
uggcgcagaugggcggcg

SEQ ID NO: 363646 - RNA, 12 nt, Bordetella pertussis
uggcgcaggaac

SEQ ID NO: 363647 - RNA, 20 nt, Bordetella pertussis
uggcgcaggccggcggccag

SEQ ID NO: 363648 - RNA, 21 nt, Bordetella pertussis
uggcgcaggccggcggccagc

SEQ ID NO: 363649 - RNA, 20 nt, Bordetella pertussis
uggcgcagcaaggcgcgcca

SEQ ID NO: 363650 - RNA, 14 nt, Bordetella pertussis
uggcgcaggcgcgc

SEQ ID NO: 363651 - RNA, 21 nt, Bordetella pertussis
uggcgcaguaucccggccagg

SEQ ID NO: 363652 - RNA, 20 nt, Bordetella pertussis
uggcgcagucgagcaccgcg

SEQ ID NO: 363653 - RNA, 16 nt, Bordetella pertussis
uggcgcagugggccag

SEQ ID NO: 363654 - RNA, 17 nt, Bordetella pertussis
uggcgcauggccggcgu

SEQ ID NO: 363655 - RNA, 17 nt, Bordetella pertussis
uggcgcauucgccggac

SEQ ID NO: 363656 - RNA, 17 nt, Bordetella pertussis
uggcgccaacccgccau

SEQ ID NO: 363657 - RNA, 13 nt, Bordetella pertussis
uggcgccagcugg

SEQ ID NO: 363658 - RNA, 13 nt, Bordetella pertussis
uggcgcccagcgc

SEQ ID NO: 363659 - RNA, 16 nt, Bordetella pertussis
uggcgcccagcgccau

SEQ ID NO: 363660 - RNA, 13 nt, Bordetella pertussis
uggcgcccgccug

SEQ ID NO: 363661 - RNA, 19 nt, Bordetella pertussis
uggcgcccgccugcgccag

SEQ ID NO: 363662 - RNA, 18 nt, Bordetella pertussis
uggcgcccggcggcgcgg

SEQ ID NO: 363663 - RNA, 21 nt, Bordetella pertussis
uggcgccgaaggcggcgccgg

SEQ ID NO: 363664 - RNA, 14 nt, Bordetella pertussis
uggcgccgauggcg

SEQ ID NO: 363665 - RNA, 17 nt, Bordetella pertussis
uggcgccgauggcgccg

SEQ ID NO: 363666 - RNA, 18 nt, Bordetella pertussis
uggcgccgauggcgccgc

SEQ ID NO: 363667 - RNA, 21 nt, Bordetella pertussis
uggcgccgcacaucgucgacg

SEQ ID NO: 363668 - RNA, 14 nt, Bordetella pertussis
uggcgccgcgcccg

SEQ ID NO: 363669 - RNA, 21 nt, Bordetella pertussis
uggcgccgcgccgccgccugg

SEQ ID NO: 363670 - RNA, 16 nt, Bordetella pertussis
uggcgccgcgcgccau

SEQ ID NO: 363671 - RNA, 22 nt, Bordetella pertussis
uggcgccgcgcgccgcggccug

SEQ ID NO: 363672 - RNA, 20 nt, Bordetella pertussis
uggcgccgcgcucgcgccag

SEQ ID NO: 363673 - RNA, 15 nt, Bordetella pertussis
uggcgccgcgggccu

SEQ ID NO: 363674 - RNA, 20 nt, Bordetella pertussis
uggcgccggacugggcgucg

SEQ ID NO: 363675 - RNA, 14 nt, Bordetella pertussis
uggcgccggccagc

SEQ ID NO: 363676 - RNA, 18 nt, Bordetella pertussis
uggcgccggccagcgcgc

SEQ ID NO: 363677 - RNA, 20 nt, Bordetella pertussis
uggcgccggccgcgcgcgcc

SEQ ID NO: 363678 - RNA, 18 nt, Bordetella pertussis
uggcgcgcacacuggcca

SEQ ID NO: 363679 - RNA, 18 nt, Bordetella pertussis
uggcgcgcaccaucgccg

SEQ ID NO: 363680 - RNA, 15 nt, Bordetella pertussis
uggcgcgcaccuggg

SEQ ID NO: 363681 - RNA, 22 nt, Bordetella pertussis
uggcgcgcagauugcgcucggu

SEQ ID NO: 363682 - RNA, 23 nt, Bordetella pertussis
uggcgcgcagauugcgcucgguc

SEQ ID NO: 363683 - RNA, 16 nt, Bordetella pertussis
uggcgcgcaucggcgc

SEQ ID NO: 363684 - RNA, 19 nt, Bordetella pertussis
uggcgcgcaucggcgccga

SEQ ID NO: 363685 - RNA, 18 nt, Bordetella pertussis
uggcgcgccaggcgaugg

SEQ ID NO: 363686 - RNA, 14 nt, Bordetella pertussis
uggcgcgccggauc

SEQ ID NO: 363687 - RNA, 15 nt, Bordetella pertussis
uggcgcgccggccgg

SEQ ID NO: 363688 - RNA, 15 nt, Bordetella pertussis
uggcgcgccguggcu

SEQ ID NO: 363689 - RNA, 21 nt, Bordetella pertussis
uggcgcgcccgcacgaugccg

SEQ ID NO: 363690 - RNA, 19 nt, Bordetella pertussis
uggcgcgccuugcgcggcg

SEQ ID NO: 363691 - RNA, 13 nt, Bordetella pertussis
uggcgcgcgaaca

SEQ ID NO: 363692 - RNA, 16 nt, Bordetella pertussis
uggcgcgcgaccaggc

SEQ ID NO: 363693 - RNA, 18 nt, Bordetella pertussis
uggcgcgcgacggcgccg

SEQ ID NO: 363694 - RNA, 21 nt, Bordetella pertussis
uggcgcgcgcacgcugggcga

SEQ ID NO: 363695 - RNA, 13 nt, Bordetella pertussis
uggcgcgcgccag

SEQ ID NO: 363696 - RNA, 19 nt, Bordetella pertussis
uggcgcgcgccgaugcgcc

SEQ ID NO: 363697 - RNA, 21 nt, Bordetella pertussis
uggcgcgcgccgaugcgccag

SEQ ID NO: 363698 - RNA, 13 nt, Bordetella pertussis
uggcgcgcggccu

SEQ ID NO: 363699 - RNA, 19 nt, Bordetella pertussis
uggcgcgcggccugggcgg

SEQ ID NO: 363700 - RNA, 23 nt, Bordetella pertussis
uggcgcgcggcuggggcugcugg

SEQ ID NO: 363701 - RNA, 16 nt, Bordetella pertussis
uggcgcgcuguucggc

SEQ ID NO: 363702 - RNA, 19 nt, Bordetella pertussis
uggcgcgcuguucggcgau

SEQ ID NO: 363703 - RNA, 22 nt, Bordetella pertussis
uggcgcggaugaccugcgccag

SEQ ID NO: 363704 - RNA, 20 nt, Bordetella pertussis
uggcgcggccccaugcgcgg

SEQ ID NO: 363705 - RNA, 15 nt, Bordetella pertussis
uggcgcggccgccag

SEQ ID NO: 363706 - RNA, 23 nt, Bordetella pertussis
uggcggcagcucgcgcugcgcgc

SEQ ID NO: 363707 - RNA, 11 nt, Bordetella pertussis
uggcggccagg

SEQ ID NO: 363708 - RNA, 21 nt, Bordetella pertussis
uggcggccaggaucgcggcca

SEQ ID NO: 363709 - RNA, 22 nt, Bordetella pertussis
uggcggccaggaucgcggccag

SEQ ID NO: 363710 - RNA, 18 nt, Bordetella pertussis
uggcggccaggcgcgccg

SEQ ID NO: 363711 - RNA, 13 nt, Bordetella pertussis
uggcggccgacag

SEQ ID NO: 363712 - RNA, 13 nt, Bordetella pertussis
uggcggccgccag

SEQ ID NO: 363713 - RNA, 19 nt, Bordetella pertussis
uggcggccgccgccagcgc

SEQ ID NO: 363714 - RNA, 16 nt, Bordetella pertussis
uggcggccgcgggcgu

SEQ ID NO: 363715 - RNA, 17 nt, Bordetella pertussis
uggcggccggccagcca

SEQ ID NO: 363716 - RNA, 13 nt, Bordetella pertussis
uggcggugguggc

SEQ ID NO: 363717 - RNA, 15 nt, Bordetella pertussis
uggcgguuucggcgg

SEQ ID NO: 363718 - RNA, 17 nt, Bordetella pertussis
uggcguaggcggccuug

SEQ ID NO: 363719 - RNA, 20 nt, Bordetella pertussis
uggcguauggaauacgccga

SEQ ID NO: 363720 - RNA, 19 nt, Bordetella pertussis
uggcgucgggggcggccgg

SEQ ID NO: 363721 - RNA, 13 nt, Bordetella pertussis
uggcgucaagcca

SEQ ID NO: 363722 - RNA, 17 nt, Bordetella pertussis
uggcgucguggggcgcg

SEQ ID NO: 363723 - RNA, 14 nt, Bordetella pertussis
uggcgugcagccau

SEQ ID NO: 363724 - RNA, 17 nt, Bordetella pertussis
uggcgugcaggccggcg

SEQ ID NO: 363725 - RNA, 15 nt, Bordetella pertussis
uggcguggcuggcgu

SEQ ID NO: 363726 - RNA, 16 nt, Bordetella pertussis
uggcguggcuggcguc

SEQ ID NO: 363727 - RNA, 16 nt, Bordetella pertussis
uggcguucaaucgcgc

SEQ ID NO: 363728 - RNA, 18 nt, Bordetella pertussis
uggcguucagcgggcgcg

SEQ ID NO: 363729 - RNA, 16 nt, Bordetella pertussis
uggcguucgcgcgcgg

SEQ ID NO: 363730 - RNA, 15 nt, Bordetella pertussis
uggcguugacggccc

SEQ ID NO: 363731 - RNA, 23 nt, Bordetella pertussis
uggcguugaugaugaucggcgcc

SEQ ID NO: 363732 - RNA, 15 nt, Bordetella pertussis
uggcguuugcgcgcg

SEQ ID NO: 363733 - RNA, 17 nt, Bordetella pertussis
uggcucagucggccugg

SEQ ID NO: 363734 - RNA, 14 nt, Bordetella pertussis
uggcucccgaggga

SEQ ID NO: 363735 - RNA, 19 nt, Bordetella pertussis
uggcucuccgugcaucggc

SEQ ID NO: 363736 - RNA, 18 nt, Bordetella pertussis
uggcugcaccugccugcc

SEQ ID NO: 363737 - RNA, 12 nt, Bordetella pertussis
uggcugcgcgcc

SEQ ID NO: 363738 - RNA, 17 nt, Bordetella pertussis
uggcuggacgcgcgcgg

SEQ ID NO: 363739 - RNA, 14 nt, Bordetella pertussis
uggcugggcgcgcc

SEQ ID NO: 363740 - RNA, 13 nt, Bordetella pertussis
uggcuggucacgu

SEQ ID NO: 363741 - RNA, 19 nt, Bordetella pertussis
uggcuguaucuggccuguc

SEQ ID NO: 363742 - RNA, 19 nt, Bordetella pertussis
uggcuucccgguccaggcc

SEQ ID NO: 363743 - RNA, 17 nt, Bordetella pertussis
uggcuucgucgccggcg

SEQ ID NO: 363744 - RNA, 18 nt, Bordetella pertussis
uggcuucgucgccggcgu

SEQ ID NO: 363745 - RNA, 13 nt, Bordetella pertussis
uggcuugcagcgc

SEQ ID NO: 363746 - RNA, 16 nt, Bordetella pertussis
uggcuuggcgcaggaa

SEQ ID NO: 363747 - RNA, 15 nt, Bordetella pertussis
uggcuuggcgcuuac

SEQ ID NO: 363748 - RNA, 15 nt, Bordetella pertussis
uggcuuggcggccag

SEQ ID NO: 363749 - RNA, 22 nt, Bordetella pertussis
ugggacaggcacucugccgugg

SEQ ID NO: 363750 - RNA, 13 nt, Bordetella pertussis
ugggacgcggccu

SEQ ID NO: 363751 - RNA, 21 nt, Bordetella pertussis
ugggagagccggccacgcgcu

SEQ ID NO: 363752 - RNA, 16 nt, Bordetella pertussis
ugggauaaggcgugcc

SEQ ID NO: 363753 - RNA, 14 nt, Bordetella pertussis
ugggcaaaacgcgc

SEQ ID NO: 363754 - RNA, 16 nt, Bordetella pertussis
ugggcaagccgauccg

SEQ ID NO: 363755 - RNA, 17 nt, Bordetella pertussis
ugggcaaggugaacaug

SEQ ID NO: 363756 - RNA, 21 nt, Bordetella pertussis
ugggcaauaccuucggcaugg

SEQ ID NO: 363757 - RNA, 19 nt, Bordetella pertussis
ugggcacauccagcgccag

SEQ ID NO: 363758 - RNA, 18 nt, Bordetella pertussis
ugggcaccaccaccgccc

SEQ ID NO: 363759 - RNA, 19 nt, Bordetella pertussis
ugggcaccgugaugcgcgc

SEQ ID NO: 363760 - RNA, 17 nt, Bordetella pertussis
ugggcacgccggccuug

SEQ ID NO: 363761 - RNA, 13 nt, Bordetella pertussis
ugggcacgcgcgc

SEQ ID NO: 363762 - RNA, 17 nt, Bordetella pertussis
ugggcaggcuggcgcgg

SEQ ID NO: 363763 - RNA, 16 nt, Bordetella pertussis
ugggcaggucgggcag

SEQ ID NO: 363764 - RNA, 16 nt, Bordetella pertussis
ugggcaguucgcccgg

SEQ ID NO: 363765 - RNA, 17 nt, Bordetella pertussis
ugggcaguucgcccggc

SEQ ID NO: 363766 - RNA, 20 nt, Bordetella pertussis
ugggcagcggacgguagcgc

SEQ ID NO: 363767 - RNA, 13 nt, Bordetella pertussis
ugggcaucaacac

SEQ ID NO: 363768 - RNA, 17 nt, Bordetella pertussis
ugggcaucaacacgcug

SEQ ID NO: 363769 - RNA, 13 nt, Bordetella pertussis
ugggcaucagggg

SEQ ID NO: 363770 - RNA, 22 nt, Bordetella pertussis
ugggcaucaggggcucggccag

SEQ ID NO: 363771 - RNA, 14 nt, Bordetella pertussis
ugggcauggaccug

SEQ ID NO: 363772 - RNA, 18 nt, Bordetella pertussis
ugggcaugggcggcccgg

SEQ ID NO: 363773 - RNA, 22 nt, Bordetella pertussis
ugggcauuucccagccgucgcg

SEQ ID NO: 363774 - RNA, 18 nt, Bordetella pertussis
ugggccagcaacuggugc

SEQ ID NO: 363775 - RNA, 20 nt, Bordetella pertussis
ugggccagcagcuggcgcag

SEQ ID NO: 363776 - RNA, 17 nt, Bordetella pertussis
ugggccggcgcgcgcag

SEQ ID NO: 363777 - RNA, 22 nt, Bordetella pertussis
ugggccggcgcgcgcaggcgcu

SEQ ID NO: 363778 - RNA, 13 nt, Bordetella pertussis
ugggccggcgcgc

SEQ ID NO: 363779 - RNA, 14 nt, Bordetella pertussis
ugggccugaucggg

SEQ ID NO: 363780 - RNA, 17 nt, Bordetella pertussis
ugggccugaucggggcc

SEQ ID NO: 363781 - RNA, 15 nt, Bordetella pertussis
ugggccugcggcguc

SEQ ID NO: 363782 - RNA, 16 nt, Bordetella pertussis
ugggcgaagccacggc

SEQ ID NO: 363783 - RNA, 18 nt, Bordetella pertussis
ugggcgaauccaccggcg

SEQ ID NO: 363784 - RNA, 23 nt, Bordetella pertussis
ugggcgaauccaccggcgcgcgc

SEQ ID NO: 363785 - RNA, 15 nt, Bordetella pertussis
uggguacgacggccg

SEQ ID NO: 363786 - RNA, 17 nt, Bordetella pertussis
uggguacgccggccuga

SEQ ID NO: 363787 - RNA, 11 nt, Bordetella pertussis
ugguagaccgg

SEQ ID NO: 363788 - RNA, 15 nt, Bordetella pertussis
ugguagcaggcgcgc

SEQ ID NO: 363789 - RNA, 15 nt, Bordetella pertussis
ugguagaugcgcgcg

SEQ ID NO: 363790 - RNA, 16 nt, Bordetella pertussis
ugguagaugcgcgcga

SEQ ID NO: 363791 - RNA, 22 nt, Bordetella pertussis
uggucacguucgaccugccgcc

SEQ ID NO: 363792 - RNA, 17 nt, Bordetella pertussis
uggucagccugggcgcc

SEQ ID NO: 363793 - RNA, 20 nt, Bordetella pertussis
uggucagccugggcgccugg

SEQ ID NO: 363794 - RNA, 19 nt, Bordetella pertussis
uggucaguccgcccagcca

SEQ ID NO: 363795 - RNA, 20 nt, Bordetella pertussis
ugguccuaaauugccgcgag

SEQ ID NO: 363796 - RNA, 22 nt, Bordetella pertussis
ugguccugggccgucaugcgcc

SEQ ID NO: 363797 - RNA, 15 nt, Bordetella pertussis
uggucgaccagcagc

SEQ ID NO: 363798 - RNA, 21 nt, Bordetella pertussis
uggucgaccaggccggugcgc

SEQ ID NO: 363799 - RNA, 14 nt, Bordetella pertussis
uggucgacgccggc

SEQ ID NO: 363800 - RNA, 15 nt, Bordetella pertussis
uggucgagcgggcgc

SEQ ID NO: 363801 - RNA, 17 nt, Bordetella pertussis
uggucgagcgggcgcca

SEQ ID NO: 363802 - RNA, 17 nt, Bordetella pertussis
uggucgcacgacagcau

SEQ ID NO: 363803 - RNA, 19 nt, Bordetella pertussis
uggucgccagcacgcgcag

SEQ ID NO: 363804 - RNA, 21 nt, Bordetella pertussis
uggucgcgaccucggcggcgu

SEQ ID NO: 363805 - RNA, 22 nt, Bordetella pertussis
uggucgcgggugguggccguga

SEQ ID NO: 363806 - RNA, 14 nt, Bordetella pertussis
uggucgcuggcgcc

SEQ ID NO: 363807 - RNA, 16 nt, Bordetella pertussis
uggucggcauggccau

SEQ ID NO: 363808 - RNA, 17 nt, Bordetella pertussis
uggucggccggaugcgc

SEQ ID NO: 363809 - RNA, 16 nt, Bordetella pertussis
uggucggccucggcga

SEQ ID NO: 363810 - RNA, 16 nt, Bordetella pertussis
uggucggcgcggcagu

SEQ ID NO: 363811 - RNA, 18 nt, Bordetella pertussis
uggucgggcgugagcgcc

SEQ ID NO: 363812 - RNA, 18 nt, Bordetella pertussis
uggucggguccagcacgc

SEQ ID NO: 363813 - RNA, 14 nt, Bordetella pertussis
uggucggugccgcc

SEQ ID NO: 363814 - RNA, 22 nt, Bordetella pertussis
uggucguccaauucgagcaggc

SEQ ID NO: 363815 - RNA, 15 nt, Bordetella pertussis
uggucgugcuggcgc

SEQ ID NO: 363816 - RNA, 23 nt, Bordetella pertussis
uggucuauucgcauacggacgag

SEQ ID NO: 363817 - RNA, 15 nt, Bordetella pertussis
uggugaccggcguga

SEQ ID NO: 363818 - RNA, 15 nt, Bordetella pertussis
uggugagcacgcgca

SEQ ID NO: 363819 - RNA, 17 nt, Bordetella pertussis
uggugaucgcgcgggcu

SEQ ID NO: 363820 - RNA, 15 nt, Bordetella pertussis
ugguggugccgcgca

SEQ ID NO: 363821 - RNA, 16 nt, Bordetella pertussis
ugguggugcgggccgc

SEQ ID NO: 363822 - RNA, 13 nt, Bordetella pertussis
uggugguggggga

SEQ ID NO: 363823 - RNA, 17 nt, Bordetella pertussis
uggugucgaagccgugc

SEQ ID NO: 363824 - RNA, 17 nt, Bordetella pertussis
uggugugccuguccccg

SEQ ID NO: 363825 - RNA, 12 nt, Bordetella pertussis
uguaacaacacg

SEQ ID NO: 363826 - RNA, 22 nt, Bordetella pertussis
uguauggcugcaccugccugcc

SEQ ID NO: 363827 - RNA, 21 nt, Bordetella pertussis
ugucaguccucaugcgggaca

SEQ ID NO: 363828 - RNA, 16 nt, Bordetella pertussis
uguccaccauccugcc

SEQ ID NO: 363829 - RNA, 13 nt, Bordetella pertussis
uguccacgccgaa

SEQ ID NO: 363830 - RNA, 21 nt, Bordetella pertussis
uguccagcgcgcccagcgcgc

SEQ ID NO: 363831 - RNA, 16 nt, Bordetella pertussis
uguccagcggcgccag

SEQ ID NO: 363832 - RNA, 16 nt, Bordetella pertussis
uguccagcuccagcgc

SEQ ID NO: 363833 - RNA, 24 nt, Bordetella pertussis
uguccaggccgaucagcgacagca

SEQ ID NO: 363834 - RNA, 19 nt, Bordetella pertussis
uguccaggccggggccgcc

SEQ ID NO: 363835 - RNA, 14 nt, Bordetella pertussis
uguccagguagcgc

SEQ ID NO: 363836 - RNA, 14 nt, Bordetella pertussis
uguccauggccugc

SEQ ID NO: 363837 - RNA, 21 nt, Bordetella pertussis
uguccauggccugcaggaagc

SEQ ID NO: 363838 - RNA, 16 nt, Bordetella pertussis
ugucccacaggcgcgc

SEQ ID NO: 363839 - RNA, 20 nt, Bordetella pertussis
ugucccacaggcgcgcggcg

SEQ ID NO: 363840 - RNA, 21 nt, Bordetella pertussis
ugucccacaggcgcgcggcgu

SEQ ID NO: 363841 - RNA, 18 nt, Bordetella pertussis
ugucccagcggggacagg

SEQ ID NO: 363842 - RNA, 22 nt, Bordetella pertussis
uguccccacauggggacuggca

SEQ ID NO: 363843 - RNA, 20 nt, Bordetella pertussis
uguccccaccgggacaggca

SEQ ID NO: 363844 - RNA, 20 nt, Bordetella pertussis
uguccccacguggacaggca

SEQ ID NO: 363845 - RNA, 22 nt, Bordetella pertussis
uguccccacugggggacuggca

SEQ ID NO: 363846 - RNA, 22 nt, Bordetella pertussis
uguccccccauggggacuggca

SEQ ID NO: 363847 - RNA, 22 nt, Bordetella pertussis
uguccccgcacggggacaggca

SEQ ID NO: 363848 - RNA, 22 nt, Bordetella pertussis
uguccccgcacggggacuggca

SEQ ID NO: 363849 - RNA, 20 nt, Bordetella pertussis
uguccccgcagggacaggca

SEQ ID NO: 363850 - RNA, 20 nt, Bordetella pertussis
uguccccgcggggacaggca

SEQ ID NO: 363851 - RNA, 20 nt, Bordetella pertussis
uguccccgucgggacaggcu

SEQ ID NO: 363852 - RNA, 18 nt, Bordetella pertussis
ugucccgaggcgccccag

SEQ ID NO: 363853 - RNA, 15 nt, Bordetella pertussis
uguccccgccggggc

SEQ ID NO: 363854 - RNA, 20 nt, Bordetella pertussis
ugucccggcggggacaggcg

SEQ ID NO: 363855 - RNA, 15 nt, Bordetella pertussis
ugucccggcggggca

SEQ ID NO: 363856 - RNA, 14 nt, Bordetella pertussis
ugucccucggagcc

SEQ ID NO: 363857 - RNA, 20 nt, Bordetella pertussis
ugucccugcgggggcaggca

SEQ ID NO: 363858 - RNA, 19 nt, Bordetella pertussis
uguccgccaugcgaugcug

SEQ ID NO: 363859 - RNA, 19 nt, Bordetella pertussis
uguccgccugcggacggcg

SEQ ID NO: 363860 - RNA, 16 nt, Bordetella pertussis
uguccuggcgcgccag

SEQ ID NO: 363861 - RNA, 13 nt, Bordetella pertussis
uguccuggucggc

SEQ ID NO: 363862 - RNA, 18 nt, Bordetella pertussis
uguccuucguggcgccgg

SEQ ID NO: 363863 - RNA, 14 nt, Bordetella pertussis
ugucgaacagcugc

SEQ ID NO: 363864 - RNA, 18 nt, Bordetella pertussis
ugucgaagccgugcucgu

SEQ ID NO: 363865 - RNA, 16 nt, Bordetella pertussis
ugucgacgcgaugccc

SEQ ID NO: 363866 - RNA, 24 nt, Bordetella pertussis
ugucgaucgccaccagcgucagca

SEQ ID NO: 363867 - RNA, 15 nt, Bordetella pertussis
ugucgcaaucgacga

SEQ ID NO: 363868 - RNA, 18 nt, Bordetella pertussis
ugucgcagucggggccgc

SEQ ID NO: 363869 - RNA, 15 nt, Bordetella pertussis
ugucgccacgggcgu

SEQ ID NO: 363870 - RNA, 19 nt, Bordetella pertussis
ugucgccgacccgggcggg

SEQ ID NO: 363871 - RNA, 15 nt, Bordetella pertussis
ugucgccgccgcgcc

SEQ ID NO: 363872 - RNA, 16 nt, Bordetella pertussis
ugucgccgccgcgccg

SEQ ID NO: 363873 - RNA, 12 nt, Bordetella pertussis
ugucgccgcugc

SEQ ID NO: 363874 - RNA, 13 nt, Bordetella pertussis
ugucgccggccag

SEQ ID NO: 363875 - RNA, 23 nt, Bordetella pertussis
ugucgccggccaguggcgcggcg

SEQ ID NO: 363876 - RNA, 13 nt, Bordetella pertussis
ugucgccggucac

SEQ ID NO: 363877 - RNA, 19 nt, Bordetella pertussis
ugucgccguggcgggucca

SEQ ID NO: 363878 - RNA, 19 nt, Bordetella pertussis
ugucgcgcaccgccugcgg

SEQ ID NO: 363879 - RNA, 19 nt, Bordetella pertussis
ugucgcgcaccgccugcug

SEQ ID NO: 363880 - RNA, 19 nt, Bordetella pertussis
ugucgcgcgacuggcccag

SEQ ID NO: 363881 - RNA, 13 nt, Bordetella pertussis
ugucgcgcagcgc

SEQ ID NO: 363882 - RNA, 17 nt, Bordetella pertussis
ugucgcgcccgaagccg

SEQ ID NO: 363883 - RNA, 23 nt, Bordetella pertussis
ugucgcucccccaugcggggaca

SEQ ID NO: 363884 - RNA, 20 nt, Bordetella pertussis
ugucggacaacugcgcgaau

SEQ ID NO: 363885 - RNA, 20 nt, Bordetella pertussis
ugucggccaccacgauggcg

SEQ ID NO: 363886 - RNA, 11 nt, Bordetella pertussis
ugucggccagg

SEQ ID NO: 363887 - RNA, 21 nt, Bordetella pertussis
ugucggccaugcgauaggcga

SEQ ID NO: 363888 - RNA, 22 nt, Bordetella pertussis
ugucggcccacuggaucgccga

SEQ ID NO: 363889 - RNA, 19 nt, Bordetella pertussis
ugucggccuucugcgccag

SEQ ID NO: 363890 - RNA, 14 nt, Bordetella pertussis
ugucggcggccagc

SEQ ID NO: 363891 - RNA, 15 nt, Bordetella pertussis
ugucggcggccagca

SEQ ID NO: 363892 - RNA, 20 nt, Bordetella pertussis
ugucggcggccagcagcggc

SEQ ID NO: 363893 - RNA, 21 nt, Bordetella pertussis
ugucggcggccagcagcggca

SEQ ID NO: 363894 - RNA, 14 nt, Bordetella pertussis
ugucggcggcgagc

SEQ ID NO: 363895 - RNA, 12 nt, Bordetella pertussis
ugucggcgcaga

SEQ ID NO: 363896 - RNA, 20 nt, Bordetella pertussis
ugucggcgcagauggcggcg

SEQ ID NO: 363897 - RNA, 13 nt, Bordetella pertussis
ugugguuggcgcu

SEQ ID NO: 363898 - RNA, 20 nt, Bordetella pertussis
uguucacgcccaggaaggcg

SEQ ID NO: 363899 - RNA, 15 nt, Bordetella pertussis
uguucagcgcgcgcg

SEQ ID NO: 363900 - RNA, 14 nt, Bordetella pertussis
uguuccggcgcgcg

SEQ ID NO: 363901 - RNA, 16 nt, Bordetella pertussis
uguucgacacuucggu

SEQ ID NO: 363902 - RNA, 21 nt, Bordetella pertussis
uguucgacacuucggucgcgu

SEQ ID NO: 363903 - RNA, 22 nt, Bordetella pertussis
uguugcgaaacccgcugggcca

SEQ ID NO: 363904 - RNA, 17 nt, Bordetella pertussis
uguucgagcaggcgcgc

SEQ ID NO: 363905 - RNA, 16 nt, Bordetella pertussis
uguugcgguggugcgc

SEQ ID NO: 363906 - RNA, 17 nt, Bordetella pertussis
uguugcucgugcuggcc

SEQ ID NO: 363907 - RNA, 17 nt, Bordetella pertussis
uguuggaaaucgugccg

SEQ ID NO: 363908 - RNA, 13 nt, Bordetella pertussis
uguuggccgccag

SEQ ID NO: 363909 - RNA, 19 nt, Bordetella pertussis
uguuggcgccggccgcgcg

SEQ ID NO: 363910 - RNA, 14 nt, Bordetella pertussis
uguuguucagguug

SEQ ID NO: 363911 - RNA, 14 nt, Bordetella pertussis
uguuguuggucgcc

SEQ ID NO: 363912 - RNA, 19 nt, Bordetella pertussis
uucaccccgccaccgcccc

SEQ ID NO: 363913 - RNA, 14 nt, Bordetella pertussis
uucaccgcuggacg

SEQ ID NO: 363914 - RNA, 12 nt, Bordetella pertussis
uucaccggcccc

SEQ ID NO: 363915 - RNA, 15 nt, Bordetella pertussis
uucagcccggcgcgc

SEQ ID NO: 363916 - RNA, 16 nt, Bordetella pertussis
uucagcgcgcgcgccg

SEQ ID NO: 363917 - RNA, 21 nt, Bordetella pertussis
uucccaggcgaggcuggcgcc

SEQ ID NO: 363918 - RNA, 16 nt, Bordetella pertussis
uucccgcccagcgacg

SEQ ID NO: 363919 - RNA, 19 nt, Bordetella pertussis
uuccggcucggaccuggcc

SEQ ID NO: 363920 - RNA, 20 nt, Bordetella pertussis
uuccggcucggaccuggcca

SEQ ID NO: 363921 - RNA, 19 nt, Bordetella pertussis
uuccgguacgcgcaguccg

SEQ ID NO: 363922 - RNA, 21 nt, Bordetella pertussis
uuccgguucaccauugaaacg

SEQ ID NO: 363923 - RNA, 14 nt, Bordetella pertussis
uuccucgaccaggu

SEQ ID NO: 363924 - RNA, 22 nt, Bordetella pertussis
uuccucgcggcuguccuggcgu

SEQ ID NO: 363925 - RNA, 13 nt, Bordetella pertussis
uuccucggcgcgc

SEQ ID NO: 363926 - RNA, 15 nt, Bordetella pertussis
uuccucggcgcgcgc

SEQ ID NO: 363927 - RNA, 11 nt, Bordetella pertussis
uuccugaacga

SEQ ID NO: 363928 - RNA, 19 nt, Bordetella pertussis
uuccugcugcgccuggcgg

SEQ ID NO: 363929 - RNA, 20 nt, Bordetella pertussis
uuccugcugcgccuggcgga

SEQ ID NO: 363930 - RNA, 11 nt, Bordetella pertussis
uuccugcugga

SEQ ID NO: 363931 - RNA, 21 nt, Bordetella pertussis
uuccugcucgggaaugcgggu

SEQ ID NO: 363932 - RNA, 23 nt, Bordetella pertussis
uuccugcuuugagcaggcgcugg

SEQ ID NO: 363933 - RNA, 14 nt, Bordetella pertussis
uuccuggccggcgc

SEQ ID NO: 363934 - RNA, 13 nt, Bordetella pertussis
uuccuggcgcugu

SEQ ID NO: 363935 - RNA, 18 nt, Bordetella pertussis
uuccugggugcugccgcc

SEQ ID NO: 363936 - RNA, 19 nt, Bordetella pertussis
uuccuggucacccggcgca

SEQ ID NO: 363937 - RNA, 22 nt, Bordetella pertussis
uucgacccggacaacgcgcgcc

SEQ ID NO: 363938 - RNA, 16 nt, Bordetella pertussis
uucgaccuugcugacg

SEQ ID NO: 363939 - RNA, 14 nt, Bordetella pertussis
uucgacgccggcag

SEQ ID NO: 363940 - RNA, 15 nt, Bordetella pertussis
uucgacguccagccc

SEQ ID NO: 363941 - RNA, 14 nt, Bordetella pertussis
uucgagcgcgcgca

SEQ ID NO: 363942 - RNA, 21 nt, Bordetella pertussis
uucgaguuccgcgacgcggac

SEQ ID NO: 363943 - RNA, 16 nt, Bordetella pertussis
uucgaucgccuggggc

SEQ ID NO: 363944 - RNA, 15 nt, Bordetella pertussis
uucgaugcuggcgcg

SEQ ID NO: 363945 - RNA, 16 nt, Bordetella pertussis
uucgcagcggaugccg

SEQ ID NO: 363946 - RNA, 17 nt, Bordetella pertussis
uucgcagcggaugccgc

SEQ ID NO: 363947 - RNA, 18 nt, Bordetella pertussis
uucgcagcggaugccgcc

SEQ ID NO: 363948 - RNA, 23 nt, Bordetella pertussis
uucgcauacggacgagcgcagca

SEQ ID NO: 363949 - RNA, 11 nt, Bordetella pertussis
uucgccgcgca

SEQ ID NO: 363950 - RNA, 22 nt, Bordetella pertussis
uucgccggaggcgcgcagcucc

SEQ ID NO: 363951 - RNA, 14 nt, Bordetella pertussis
uucgccgggcggcg

SEQ ID NO: 363952 - RNA, 19 nt, Bordetella pertussis
uucgcgaaagcgcugcgcc

SEQ ID NO: 363953 - RNA, 19 nt, Bordetella pertussis
uucgcgaccugcgggcgca

SEQ ID NO: 363954 - RNA, 16 nt, Bordetella pertussis
uucgcgauccagcagc

SEQ ID NO: 363955 - RNA, 18 nt, Bordetella pertussis
uucgcggugggcagcggc

SEQ ID NO: 363956 - RNA, 22 nt, Bordetella pertussis
uucgcuggcggaccgaacggcc

SEQ ID NO: 363957 - RNA, 16 nt, Bordetella pertussis
uucggccgccagguag

SEQ ID NO: 363958 - RNA, 21 nt, Bordetella pertussis
uucggccugcaggcccagcac

SEQ ID NO: 363959 - RNA, 14 nt, Bordetella pertussis
uucggcgaccaggu

SEQ ID NO: 363960 - RNA, 20 nt, Bordetella pertussis
uucgggugaggggccagccu

SEQ ID NO: 363961 - RNA, 17 nt, Bordetella pertussis
uucggugcgcagcggca

SEQ ID NO: 363962 - RNA, 18 nt, Bordetella pertussis
uucucggccagcgccgaa

SEQ ID NO: 363963 - RNA, 23 nt, Bordetella pertussis
uucucggccucgcggcgcagcau

SEQ ID NO: 363964 - RNA, 14 nt, Bordetella pertussis
uucugcaucggcau

SEQ ID NO: 363965 - RNA, 17 nt, Bordetella pertussis
uucugccagacggccag

SEQ ID NO: 363966 - RNA, 12 nt, Bordetella pertussis
uucuugccggcc

SEQ ID NO: 363967 - RNA, 21 nt, Bordetella pertussis
uucuugcugcuguuggcgugg

SEQ ID NO: 363968 - RNA, 20 nt, Bordetella pertussis
uugaacaccccggucagcag

SEQ ID NO: 363969 - RNA, 22 nt, Bordetella pertussis
uugaacagccgccccagcagca

SEQ ID NO: 363970 - RNA, 14 nt, Bordetella pertussis
uugaacugcgcggu

SEQ ID NO: 363971 - RNA, 22 nt, Bordetella pertussis
uugaagcgguauucguugccga

SEQ ID NO: 363972 - RNA, 13 nt, Bordetella pertussis
uugaccagcacca

SEQ ID NO: 363973 - RNA, 16 nt, Bordetella pertussis
uugaccggcuggcgca

SEQ ID NO: 363974 - RNA, 19 nt, Bordetella pertussis
uugaccggcuggcgcacgu

SEQ ID NO: 363975 - RNA, 16 nt, Bordetella pertussis
uugacgaugcccaggu

SEQ ID NO: 363976 - RNA, 14 nt, Bordetella pertussis
uugacgccgccgaa

SEQ ID NO: 363977 - RNA, 14 nt, Bordetella pertussis
uugacggcccagcu

SEQ ID NO: 363978 - RNA, 22 nt, Bordetella pertussis
uugacggucacggucuggccca

SEQ ID NO: 363979 - RNA, 19 nt, Bordetella pertussis
uugacgguggccgcggcgu

SEQ ID NO: 363980 - RNA, 16 nt, Bordetella pertussis
uugagcaacgugcgca

SEQ ID NO: 363981 - RNA, 13 nt, Bordetella pertussis
uugaggccagcac

SEQ ID NO: 363982 - RNA, 14 nt, Bordetella pertussis
uugagggcguacga

SEQ ID NO: 363983 - RNA, 17 nt, Bordetella pertussis
uugauccagcgcucggg

SEQ ID NO: 363984 - RNA, 18 nt, Bordetella pertussis
uugccugggugcuggugc

SEQ ID NO: 363985 - RNA, 18 nt, Bordetella pertussis
uugcgaaacccgcugggc

SEQ ID NO: 363986 - RNA, 20 nt, Bordetella pertussis
uugcgauaggugcgcagccg

SEQ ID NO: 363987 - RNA, 22 nt, Bordetella pertussis
uugcgcaagccggccgcgccgc

SEQ ID NO: 363988 - RNA, 15 nt, Bordetella pertussis
uugcgcaccaugugc

SEQ ID NO: 363989 - RNA, 15 nt, Bordetella pertussis
uugcgcacggcggcg

SEQ ID NO: 363990 - RNA, 12 nt, Bordetella pertussis
uugcgcagcgcg

SEQ ID NO: 363991 - RNA, 15 nt, Bordetella pertussis
uugcgcagcgcggcg

SEQ ID NO: 363992 - RNA, 11 nt, Bordetella pertussis
uugcgcgccau

SEQ ID NO: 363993 - RNA, 13 nt, Bordetella pertussis
uugcgcggcgcgu

SEQ ID NO: 363994 - RNA, 21 nt, Bordetella pertussis
uugcgcggcgcgucgcgcgcc

SEQ ID NO: 363995 - RNA, 22 nt, Bordetella pertussis
uugcgcugcccgucgcuggcgc

SEQ ID NO: 363996 - RNA, 13 nt, Bordetella pertussis
uugcggcagcgcc

SEQ ID NO: 363997 - RNA, 22 nt, Bordetella pertussis
uugcggcgaugcacccaggcgc

SEQ ID NO: 363998 - RNA, 18 nt, Bordetella pertussis
uugcggcgcgaccugcgc

SEQ ID NO: 363999 - RNA, 13 nt, Bordetella pertussis
uugcgggccggcg

SEQ ID NO: 364000 - RNA, 21 nt, Bordetella pertussis
uugcgggccggcugggcggcc

SEQ ID NO: 364001 - RNA, 17 nt, Bordetella pertussis
uugcgggcugcgcgggu

SEQ ID NO: 364002 - RNA, 14 nt, Bordetella pertussis
uugcggggcggcgu

SEQ ID NO: 364003 - RNA, 20 nt, Bordetella pertussis
uugcgggucgucccagcgca

SEQ ID NO: 364004 - RNA, 21 nt, Bordetella pertussis
uugcgguaguucagcagcgcc

SEQ ID NO: 364005 - RNA, 15 nt, Bordetella pertussis
uugcgucccaccugc

SEQ ID NO: 364006 - RNA, 15 nt, Bordetella pertussis
uugcguccggcgcgc

SEQ ID NO: 364007 - RNA, 18 nt, Bordetella pertussis
uugcgucuccacgccgcc

SEQ ID NO: 364008 - RNA, 15 nt, Bordetella pertussis
uugcgucuccagcgc

SEQ ID NO: 364009 - RNA, 11 nt, Bordetella pertussis
uugcgugacga

SEQ ID NO: 364010 - RNA, 17 nt, Bordetella pertussis
uugcguuggcauggcgc

SEQ ID NO: 364011 - RNA, 16 nt, Bordetella pertussis
uugcuccaggccggca

SEQ ID NO: 364012 - RNA, 22 nt, Bordetella pertussis
uugcuccggcgugacguggccc

SEQ ID NO: 364013 - RNA, 17 nt, Bordetella pertussis
uugcuguacucguacga

SEQ ID NO: 364014 - RNA, 23 nt, Bordetella pertussis
uuggaccccaguuccagcacgac

SEQ ID NO: 364015 - RNA, 19 nt, Bordetella pertussis
uuggaguagccgcucaggu

SEQ ID NO: 364016 - RNA, 16 nt, Bordetella pertussis
uuggcccugcagcggc

SEQ ID NO: 364017 - RNA, 22 nt, Bordetella pertussis
uuggccgaacauauccacgcca

SEQ ID NO: 364018 - RNA, 16 nt, Bordetella pertussis
uuggccgccagccggc

SEQ ID NO: 364019 - RNA, 22 nt, Bordetella pertussis
uuggccgccagccggcccgaca

SEQ ID NO: 364020 - RNA, 22 nt, Bordetella pertussis
uuggccguccacgaaggcagca

SEQ ID NO: 364021 - RNA, 13 nt, Bordetella pertussis
uuggccugccauc

SEQ ID NO: 364022 - RNA, 19 nt, Bordetella pertussis
uuggccugggcgcggucca

SEQ ID NO: 364023 - RNA, 17 nt, Bordetella pertussis
uuggccuugcgcgucca

SEQ ID NO: 364024 - RNA, 17 nt, Bordetella pertussis
uuggcgaacgugcgcgc

SEQ ID NO: 364025 - RNA, 21 nt, Bordetella pertussis
uuggcggccuggccgcgcgcc

SEQ ID NO: 364026 - RNA, 17 nt, Bordetella pertussis
uuggcguagauccaggc

SEQ ID NO: 364027 - RNA, 13 nt, Bordetella pertussis
uuggcgugcgcga

SEQ ID NO: 364028 - RNA, 18 nt, Bordetella pertussis
uugggauggaugccgucg

SEQ ID NO: 364029 - RNA, 18 nt, Bordetella pertussis
uugggcaaaaaaagaggc

SEQ ID NO: 364030 - RNA, 12 nt, Bordetella pertussis
uugggccgcgcc

SEQ ID NO: 364031 - RNA, 21 nt, Bordetella pertussis
aauccgugguggggccgggcu

SEQ ID NO: 364032 - RNA, 16 nt, Bordetella pertussis
aauccuggugccaguc

SEQ ID NO: 364033 - RNA, 14 nt, Bordetella pertussis
uuguucgcgcgcgg

SEQ ID NO: 364034 - RNA, 14 nt, Bordetella pertussis
uuucaggaugccgc

SEQ ID NO: 364035 - RNA, 18 nt, Bordetella pertussis
uuucgaccgcaugcggca

SEQ ID NO: 364036 - RNA, 14 nt, Bordetella pertussis
uuucguggucgugc

SEQ ID NO: 364037 - RNA, 19 nt, Bordetella pertussis
aaucugccgcugaccggcg

SEQ ID NO: 364038 - RNA, 11 nt, Bordetella pertussis
aaugcccaguu

SEQ ID NO: 364039 - RNA, 21 nt, Bordetella pertussis
aaugccccacggguaccaggc

SEQ ID NO: 364040 - RNA, 20 nt, Bordetella pertussis
aaugccgccgugaugccgcc

SEQ ID NO: 364041 - RNA, 21 nt, Bordetella pertussis
aaugccgccgugaugccgccc

SEQ ID NO: 364042 - RNA, 22 nt, Bordetella pertussis
aaugccggccgauagccgcggc

SEQ ID NO: 364043 - RNA, 15 nt, Bordetella pertussis
aauucaagccgcacc

SEQ ID NO: 364044 - RNA, 18 nt, Bordetella pertussis
aauucguuggagcaagcg

SEQ ID NO: 364045 - RNA, 19 nt, Bordetella pertussis
acaccaccuccaccgccag

SEQ ID NO: 364046 - RNA, 14 nt, Bordetella pertussis
acaccagcgccagg

SEQ ID NO: 364047 - RNA, 23 nt, Bordetella pertussis
acaccaggaagagcuggcgcugc

SEQ ID NO: 364048 - RNA, 16 nt, Bordetella pertussis
acaccaggguggcgcc

SEQ ID NO: 364049 - RNA, 20 nt, Bordetella pertussis
acaccaggguggcgccggcc

SEQ ID NO: 364050 - RNA, 22 nt, Bordetella pertussis
acaccaucaacgggccgcuggu

SEQ ID NO: 364051 - RNA, 23 nt, Bordetella pertussis
acaccaucaagaugaacgcgauc

SEQ ID NO: 364052 - RNA, 16 nt, Bordetella pertussis
acaccaugauggccgc

SEQ ID NO: 364053 - RNA, 17 nt, Bordetella pertussis
acaccccggucagcagg

SEQ ID NO: 364054 - RNA, 12 nt, Bordetella pertussis
acaccggcgugc

SEQ ID NO: 364055 - RNA, 22 nt, Bordetella pertussis
acaccggcgugcagagcaccac

SEQ ID NO: 364056 - RNA, 21 nt, Bordetella pertussis
acaccuuguuggcgccggccg

SEQ ID NO: 364057 - RNA, 17 nt, Bordetella pertussis
acacggcggugccgcgc

SEQ ID NO: 364058 - RNA, 22 nt, Bordetella pertussis
acacggugggcgacgcggcgua

SEQ ID NO: 364059 - RNA, 12 nt, Bordetella pertussis
acacguccagcg

SEQ ID NO: 364060 - RNA, 19 nt, Bordetella pertussis
acacguuggggaaccgcac

SEQ ID NO: 364061 - RNA, 22 nt, Bordetella pertussis
acacuuucaucaaacgcggcgc

SEQ ID NO: 364062 - RNA, 20 nt, Bordetella pertussis
acagacccgggccgcuggcc

SEQ ID NO: 364063 - RNA, 20 nt, Bordetella pertussis
acagauaccgccuuggccgu

SEQ ID NO: 364064 - RNA, 17 nt, Bordetella pertussis
acagauccagcgcggcc

SEQ ID NO: 364065 - RNA, 18 nt, Bordetella pertussis
acagauugaacugcugga

SEQ ID NO: 364066 - RNA, 19 nt, Bordetella pertussis
acagcaaggacaaggcgcg

SEQ ID NO: 364067 - RNA, 13 nt, Bordetella pertussis
acagcagcgcgcc

SEQ ID NO: 364068 - RNA, 23 nt, Bordetella pertussis
acagcagcgcgccgccgauguug

SEQ ID NO: 364069 - RNA, 15 nt, Bordetella pertussis
acagcaguucggccg

SEQ ID NO: 364070 - RNA, 17 nt, Bordetella pertussis
acagcaguucggccggc

SEQ ID NO: 364071 - RNA, 18 nt, Bordetella pertussis
acagcaucagcggcagca

SEQ ID NO: 364072 - RNA, 16 nt, Bordetella pertussis
acagcaucuuggccgc

SEQ ID NO: 364073 - RNA, 18 nt, Bordetella pertussis
acagccgcgccagcgccu

SEQ ID NO: 364074 - RNA, 13 nt, Bordetella pertussis
acagccgcugcag

SEQ ID NO: 364075 - RNA, 22 nt, Bordetella pertussis
acagccgcugcagaucaucggc

SEQ ID NO: 364076 - RNA, 18 nt, Bordetella pertussis
acagcgugacggcggcgc

SEQ ID NO: 364077 - RNA, 23 nt, Bordetella pertussis
acagcgugacggcggcgcgcgga

SEQ ID NO: 364078 - RNA, 17 nt, Bordetella pertussis
acagcucgcgccagggc

SEQ ID NO: 364079 - RNA, 22 nt, Bordetella pertussis
acagcuggugccgguugcgcgc

SEQ ID NO: 364080 - RNA, 19 nt, Bordetella pertussis
acagcuugaugggcgaggc

SEQ ID NO: 364081 - RNA, 18 nt, Bordetella pertussis
acagcuugcccacgcgcu

SEQ ID NO: 364082 - RNA, 19 nt, Bordetella pertussis
acagcuugcgcuggcgcgc

SEQ ID NO: 364083 - RNA, 20 nt, Bordetella pertussis
acagcuugcgcuggcgcgcg

SEQ ID NO: 364084 - RNA, 22 nt, Bordetella pertussis
acaggaaggcgagcgcggcaua

SEQ ID NO: 364085 - RNA, 12 nt, Bordetella pertussis
acaggauggcga

SEQ ID NO: 364086 - RNA, 21 nt, Bordetella pertussis
acaggcacaccacgcgaugcg

SEQ ID NO: 364087 - RNA, 14 nt, Bordetella pertussis
acaggcaccuuggc

SEQ ID NO: 364088 - RNA, 23 nt, Bordetella pertussis
acaggcacuccggauaccgccgc

SEQ ID NO: 364089 - RNA, 14 nt, Bordetella pertussis
acaggcacucggua

SEQ ID NO: 364090 - RNA, 13 nt, Bordetella pertussis
acaggcagcugcg

SEQ ID NO: 364091 - RNA, 15 nt, Bordetella pertussis
acaggcagcugcgcg

SEQ ID NO: 364092 - RNA, 12 nt, Bordetella pertussis
acaggcccagcc

SEQ ID NO: 364093 - RNA, 14 nt, Bordetella pertussis
acaggcccagcccg

SEQ ID NO: 364094 - RNA, 13 nt, Bordetella pertussis
acaggcccagcgc

SEQ ID NO: 364095 - RNA, 17 nt, Bordetella pertussis
acaggcccagcgccagc

SEQ ID NO: 364096 - RNA, 16 nt, Bordetella pertussis
acaggccagugccugg

SEQ ID NO: 364097 - RNA, 22 nt, Bordetella pertussis
acaggccuucguaaacaucgcg

SEQ ID NO: 364098 - RNA, 23 nt, Bordetella pertussis
acaggccuggcuuggcggccagg

SEQ ID NO: 364099 - RNA, 18 nt, Bordetella pertussis
acaggcgcgcaggcgggc

SEQ ID NO: 364100 - RNA, 13 nt, Bordetella pertussis
acaggcgcgccag

SEQ ID NO: 364101 - RNA, 21 nt, Bordetella pertussis
acaggcgcgccagccgcgcga

SEQ ID NO: 364102 - RNA, 14 nt, Bordetella pertussis
acaggcgcggcacg

SEQ ID NO: 364103 - RNA, 12 nt, Bordetella pertussis
acaggcgccgca

SEQ ID NO: 364104 - RNA, 12 nt, Bordetella pertussis
acaggcgccguc

SEQ ID NO: 364105 - RNA, 22 nt, Bordetella pertussis
acaggcgcuugcgcucggugug

SEQ ID NO: 364106 - RNA, 22 nt, Bordetella pertussis
acaggcggucuucgaugcuggc

SEQ ID NO: 364107 - RNA, 16 nt, Bordetella pertussis
acaggcggugcgcgcg

SEQ ID NO: 364108 - RNA, 12 nt, Bordetella pertussis
acaggcgugcgc

SEQ ID NO: 364109 - RNA, 17 nt, Bordetella pertussis
acaggcugguggcgucg

SEQ ID NO: 364110 - RNA, 22 nt, Bordetella pertussis
acagggcgucgcgaugcgccag

SEQ ID NO: 364111 - RNA, 14 nt, Bordetella pertussis
acagggcgucgucg

SEQ ID NO: 364112 - RNA, 16 nt, Bordetella pertussis
acagggucaaggcgcg

SEQ ID NO: 364113 - RNA, 15 nt, Bordetella pertussis
acagggugccgcgcc

SEQ ID NO: 364114 - RNA, 17 nt, Bordetella pertussis
acaggguggcgcccagg

SEQ ID NO: 364115 - RNA, 15 nt, Bordetella pertussis
acagguaggcgccgg

SEQ ID NO: 364116 - RNA, 13 nt, Bordetella pertussis
acaggucggcgcc

SEQ ID NO: 364117 - RNA, 15 nt, Bordetella pertussis
acaggugcgcggcgc

SEQ ID NO: 364118 - RNA, 21 nt, Bordetella pertussis
acaggugcgcggcgcgccguc

SEQ ID NO: 364119 - RNA, 19 nt, Bordetella pertussis
acaucaaugacauggccac

SEQ ID NO: 364120 - RNA, 16 nt, Bordetella pertussis
acaucagcgugccgcc

SEQ ID NO: 364121 - RNA, 23 nt, Bordetella pertussis
acaucaucgaccaccagcggcug

SEQ ID NO: 364122 - RNA, 19 nt, Bordetella pertussis
acaucaugggcgaagccac

SEQ ID NO: 364123 - RNA, 19 nt, Bordetella pertussis
acaucgagggcgucaucgg

SEQ ID NO: 364124 - RNA, 14 nt, Bordetella pertussis
acaucgcgcauggc

SEQ ID NO: 364125 - RNA, 13 nt, Bordetella pertussis
acaucggcagcga

SEQ ID NO: 364126 - RNA, 12 nt, Bordetella pertussis
acaugccgcgcg

SEQ ID NO: 364127 - RNA, 18 nt, Bordetella pertussis
acaugcucgaugccggcc

SEQ ID NO: 364128 - RNA, 14 nt, Bordetella pertussis
acauggcgcgccgg

SEQ ID NO: 364129 - RNA, 17 nt, Bordetella pertussis
acauggcgcgcgccagc

SEQ ID NO: 364130 - RNA, 12 nt, Bordetella pertussis
acauggcggcga

SEQ ID NO: 364131 - RNA, 22 nt, Bordetella pertussis
acauggggacuggcacccgcaa

SEQ ID NO: 364132 - RNA, 21 nt, Bordetella pertussis
accacaaggauggacuggccg

SEQ ID NO: 364133 - RNA, 17 nt, Bordetella pertussis
accaccagcaccaugcc

SEQ ID NO: 364134 - RNA, 16 nt, Bordetella pertussis
accaccaggccgccua

SEQ ID NO: 364135 - RNA, 14 nt, Bordetella pertussis
accaccaggccggc

SEQ ID NO: 364136 - RNA, 16 nt, Bordetella pertussis
accaccaggccggcca

SEQ ID NO: 364137 - RNA, 16 nt, Bordetella pertussis
accacgaccggcucgg

SEQ ID NO: 364138 - RNA, 14 nt, Bordetella pertussis
accacgaccuuggc

SEQ ID NO: 364139 - RNA, 21 nt, Bordetella pertussis
accacgaccuuggcggccgac

SEQ ID NO: 364140 - RNA, 22 nt, Bordetella pertussis
accacgagcugcagcccggcca

SEQ ID NO: 364141 - RNA, 15 nt, Bordetella pertussis
accacgauggccggc

SEQ ID NO: 364142 - RNA, 19 nt, Bordetella pertussis
accacgauggccggcgcga

SEQ ID NO: 364143 - RNA, 18 nt, Bordetella pertussis
accacgcccaucugccag

SEQ ID NO: 364144 - RNA, 13 nt, Bordetella pertussis
accacgccgccca

SEQ ID NO: 364145 - RNA, 20 nt, Bordetella pertussis
accacgccgcccagcgcgug

SEQ ID NO: 364146 - RNA, 18 nt, Bordetella pertussis
accacgccuucgagcacc

SEQ ID NO: 364147 - RNA, 16 nt, Bordetella pertussis
accacgcgaugcgggu

SEQ ID NO: 364148 - RNA, 20 nt, Bordetella pertussis
accacgcgcggcggcggauc

SEQ ID NO: 364149 - RNA, 17 nt, Bordetella pertussis
accacgcgcugcgcgcc

SEQ ID NO: 364150 - RNA, 17 nt, Bordetella pertussis
accacgcgguugggcgg

SEQ ID NO: 364151 - RNA, 20 nt, Bordetella pertussis
accacgcugggccagaccgc

SEQ ID NO: 364152 - RNA, 18 nt, Bordetella pertussis
accacggucuggcgcgac

SEQ ID NO: 364153 - RNA, 20 nt, Bordetella pertussis
accacguccuggggcgcggu

SEQ ID NO: 364154 - RNA, 16 nt, Bordetella pertussis
accagcaccagcgccu

SEQ ID NO: 364155 - RNA, 20 nt, Bordetella pertussis
accagcaccagcgccugccg

SEQ ID NO: 364156 - RNA, 22 nt, Bordetella pertussis
accagcaccaugccgaugccgc

SEQ ID NO: 364157 - RNA, 13 nt, Bordetella pertussis
accagcaccagcg

SEQ ID NO: 364158 - RNA, 16 nt, Bordetella pertussis
accagcaccgaugcgc

SEQ ID NO: 364159 - RNA, 17 nt, Bordetella pertussis
accagcaccgaugcgcc

SEQ ID NO: 364160 - RNA, 22 nt, Bordetella pertussis
accagcaccgaugcgccggccu

SEQ ID NO: 364161 - RNA, 15 nt, Bordetella pertussis
accagcaccgccacg

SEQ ID NO: 364162 - RNA, 17 nt, Bordetella pertussis
accagcaccgccacgcg

SEQ ID NO: 364163 - RNA, 15 nt, Bordetella pertussis
accagcagguggcgc

SEQ ID NO: 364164 - RNA, 16 nt, Bordetella pertussis
accagcaucgcgccuu

SEQ ID NO: 364165 - RNA, 21 nt, Bordetella pertussis
accagccagccgccgcgcggc

SEQ ID NO: 364166 - RNA, 18 nt, Bordetella pertussis
accagccauucgauggcg

SEQ ID NO: 364167 - RNA, 16 nt, Bordetella pertussis
accagcccgaugcgcc

SEQ ID NO: 364168 - RNA, 22 nt, Bordetella pertussis
accagcgaggcggcaagcggcg

SEQ ID NO: 364169 - RNA, 21 nt, Bordetella pertussis
accagcgaguuguccuggccg

SEQ ID NO: 364170 - RNA, 19 nt, Bordetella pertussis
accagcgcaccaccagcac

SEQ ID NO: 364171 - RNA, 22 nt, Bordetella pertussis
accagcgccaggaacagcgccg

SEQ ID NO: 364172 - RNA, 23 nt, Bordetella pertussis
accagcgccaggaacagcgccgg

SEQ ID NO: 364173 - RNA, 12 nt, Bordetella pertussis
accagcgccacg

SEQ ID NO: 364174 - RNA, 14 nt, Bordetella pertussis
accagcgccggcgc

SEQ ID NO: 364175 - RNA, 21 nt, Bordetella pertussis
accagcgccugccgaucgugc

SEQ ID NO: 364176 - RNA, 20 nt, Bordetella pertussis
accagcgcgaacgccugcca

SEQ ID NO: 364177 - RNA, 14 nt, Bordetella pertussis
accagcgcgccagc

SEQ ID NO: 364178 - RNA, 21 nt, Bordetella pertussis
accagcgcgccgaucaccacg

SEQ ID NO: 364179 - RNA, 16 nt, Bordetella pertussis
accagcgcgccgcgcg

SEQ ID NO: 364180 - RNA, 20 nt, Bordetella pertussis
accagcgcgccgcgcgcggc

SEQ ID NO: 364181 - RNA, 11 nt, Bordetella pertussis
accagcgcgcg

SEQ ID NO: 364182 - RNA, 15 nt, Bordetella pertussis
accagcgcggccguc

SEQ ID NO: 364183 - RNA, 20 nt, Bordetella pertussis
accagcgcgucgccgccauu

SEQ ID NO: 364184 - RNA, 17 nt, Bordetella pertussis
accagcggaucgccggg

SEQ ID NO: 364185 - RNA, 15 nt, Bordetella pertussis
accaggcccgccacg

SEQ ID NO: 364186 - RNA, 18 nt, Bordetella pertussis
accaggcccgccacggcg

SEQ ID NO: 364187 - RNA, 18 nt, Bordetella pertussis
accaggccgacgaggcgc

SEQ ID NO: 364188 - RNA, 11 nt, Bordetella pertussis
accaggccgaa

SEQ ID NO: 364189 - RNA, 16 nt, Bordetella pertussis
accaggccgccggcca

SEQ ID NO: 364190 - RNA, 13 nt, Bordetella pertussis
accaggccggcca

SEQ ID NO: 364191 - RNA, 15 nt, Bordetella pertussis
accaggccggccagg

SEQ ID NO: 364192 - RNA, 15 nt, Bordetella pertussis
accaggccggcggcg

SEQ ID NO: 364193 - RNA, 22 nt, Bordetella pertussis
accaggccggugcgcacauggc

SEQ ID NO: 364194 - RNA, 19 nt, Bordetella pertussis
accaggccugcgggugcgc

SEQ ID NO: 364195 - RNA, 21 nt, Bordetella pertussis
accaggcgcacggcggcauau

SEQ ID NO: 364196 - RNA, 14 nt, Bordetella pertussis
accaggcgcucgcg

SEQ ID NO: 364197 - RNA, 20 nt, Bordetella pertussis
accaggcgcucgcgcgccag

SEQ ID NO: 364198 - RNA, 20 nt, Bordetella pertussis
accaggcgcgcgccaucgac

SEQ ID NO: 364199 - RNA, 17 nt, Bordetella pertussis
accaggcgggcaucgcc

SEQ ID NO: 364200 - RNA, 21 nt, Bordetella pertussis
accaggcugcccuggcccagg

SEQ ID NO: 364201 - RNA, 15 nt, Bordetella pertussis
accaggcugcgcgcc

SEQ ID NO: 364202 - RNA, 20 nt, Bordetella pertussis
accaggcugcgcgccggcgc

SEQ ID NO: 364203 - RNA, 23 nt, Bordetella pertussis
accaggcuuucgaagccgcccca

SEQ ID NO: 364204 - RNA, 18 nt, Bordetella pertussis
accaggcuuugcgcgcca

SEQ ID NO: 364205 - RNA, 20 nt, Bordetella pertussis
accaggcuuugcgcgccaug

SEQ ID NO: 364206 - RNA, 13 nt, Bordetella pertussis
accagggcccgga

SEQ ID NO: 364207 - RNA, 18 nt, Bordetella pertussis
accagggcgccgaccggg

SEQ ID NO: 364208 - RNA, 20 nt, Bordetella pertussis
accagggcggugggcagcgc

SEQ ID NO: 364209 - RNA, 14 nt, Bordetella pertussis
accaggggcggcgc

SEQ ID NO: 364210 - RNA, 17 nt, Bordetella pertussis
accaggggcggcgcggc

SEQ ID NO: 364211 - RNA, 22 nt, Bordetella pertussis
accaggggcggcgcggcgcugg

SEQ ID NO: 364212 - RNA, 20 nt, Bordetella pertussis
accaggguuuccucgccgac

SEQ ID NO: 364213 - RNA, 15 nt, Bordetella pertussis
accaggguggcgggc

SEQ ID NO: 364214 - RNA, 17 nt, Bordetella pertussis
accagguccuggcggcc

SEQ ID NO: 364215 - RNA, 13 nt, Bordetella pertussis
accaggugggcgc

SEQ ID NO: 364216 - RNA, 22 nt, Bordetella pertussis
accagguugcauccggcccggu

SEQ ID NO: 364217 - RNA, 19 nt, Bordetella pertussis
accaguacaccggcgugca

SEQ ID NO: 364218 - RNA, 19 nt, Bordetella pertussis
accaguagcacacgccgau

SEQ ID NO: 364219 - RNA, 20 nt, Bordetella pertussis
accagugcaggggguggcgg

SEQ ID NO: 364220 - RNA, 21 nt, Bordetella pertussis
accagugcaggggguggcggc

SEQ ID NO: 364221 - RNA, 22 nt, Bordetella pertussis
accagugcaggggguggcggcc

SEQ ID NO: 364222 - RNA, 19 nt, Bordetella pertussis
accagugcgccggcggcgg

SEQ ID NO: 364223 - RNA, 21 nt, Bordetella pertussis
accagugcgccggcggcgguc

SEQ ID NO: 364224 - RNA, 17 nt, Bordetella pertussis
accaguucgcgcagcgc

SEQ ID NO: 364225 - RNA, 17 nt, Bordetella pertussis
accaucaacgggccgcu

SEQ ID NO: 364226 - RNA, 17 nt, Bordetella pertussis
accaucgccgagccgcu

SEQ ID NO: 364227 - RNA, 14 nt, Bordetella pertussis
accaucgccgccug

SEQ ID NO: 364228 - RNA, 19 nt, Bordetella pertussis
accaucucccgcaggccca

SEQ ID NO: 364229 - RNA, 23 nt, Bordetella pertussis
accaucuuguccuucagcacgcu

SEQ ID NO: 364230 - RNA, 17 nt, Bordetella pertussis
accaugccggccugcga

SEQ ID NO: 364231 - RNA, 14 nt, Bordetella pertussis
accaugcggccguc

SEQ ID NO: 364232 - RNA, 22 nt, Bordetella pertussis
accaugcggccgucgccgccca

SEQ ID NO: 364233 - RNA, 12 nt, Bordetella pertussis
accaugcggucg

SEQ ID NO: 364234 - RNA, 21 nt, Bordetella pertussis
accauggcgcccacggccgca

SEQ ID NO: 364235 - RNA, 22 nt, Bordetella pertussis
accauggcgcccacggccgcau

SEQ ID NO: 364236 - RNA, 22 nt, Bordetella pertussis
accaugggcgucgucgccgucg

SEQ ID NO: 364237 - RNA, 16 nt, Bordetella pertussis
accaugucccuggcca

SEQ ID NO: 364238 - RNA, 16 nt, Bordetella pertussis
acccacccccagcagc

SEQ ID NO: 364239 - RNA, 21 nt, Bordetella pertussis
acccgagcccuggcuuggccg

SEQ ID NO: 364240 - RNA, 23 nt, Bordetella pertussis
acccgaguccuugacgccgccga

SEQ ID NO: 364241 - RNA, 16 nt, Bordetella pertussis
acccgaugacggggcg

SEQ ID NO: 364242 - RNA, 18 nt, Bordetella pertussis
acccgaugcgccucggcg

SEQ ID NO: 364243 - RNA, 18 nt, Bordetella pertussis
acccgcaaaaccgggccc

SEQ ID NO: 364244 - RNA, 19 nt, Bordetella pertussis
acccgcaaaccugaugccu

SEQ ID NO: 364245 - RNA, 14 nt, Bordetella pertussis
acccgcacgccggc

SEQ ID NO: 364246 - RNA, 15 nt, Bordetella pertussis
acccgcacgccggcc

SEQ ID NO: 364247 - RNA, 12 nt, Bordetella pertussis
acccgcgccggc

SEQ ID NO: 364248 - RNA, 17 nt, Bordetella pertussis
acccgcgccggcggcaa

SEQ ID NO: 364249 - RNA, 13 nt, Bordetella pertussis
acccgcgccgucg

SEQ ID NO: 364250 - RNA, 14 nt, Bordetella pertussis
acccgcgcgcagcg

SEQ ID NO: 364251 - RNA, 14 nt, Bordetella pertussis
acccgcucggccac

SEQ ID NO: 364252 - RNA, 15 nt, Bordetella pertussis
acccgcucggccacg

SEQ ID NO: 364253 - RNA, 17 nt, Bordetella pertussis
acccgcucggccacgcg

SEQ ID NO: 364254 - RNA, 21 nt, Bordetella pertussis
acccggguacguggccccagg

SEQ ID NO: 364255 - RNA, 22 nt, Bordetella pertussis
acccggguacguggccccaggc

SEQ ID NO: 364256 - RNA, 15 nt, Bordetella pertussis
acccgguauccgcgc

SEQ ID NO: 364257 - RNA, 16 nt, Bordetella pertussis
acccggucggcccagg

SEQ ID NO: 364258 - RNA, 22 nt, Bordetella pertussis
acccucagcccgcaccgcccgc

SEQ ID NO: 364259 - RNA, 22 nt, Bordetella pertussis
acccuccucgcuuuaccagcug

SEQ ID NO: 364260 - RNA, 19 nt, Bordetella pertussis
acccucgcacggccgucaa

SEQ ID NO: 364261 - RNA, 23 nt, Bordetella pertussis
accgaacccugccucagaccacg

SEQ ID NO: 364262 - RNA, 12 nt, Bordetella pertussis
accgaacgggcg

SEQ ID NO: 364263 - RNA, 14 nt, Bordetella pertussis
accgaagcggcguu

SEQ ID NO: 364264 - RNA, 13 nt, Bordetella pertussis
accgacggcagcc

SEQ ID NO: 364265 - RNA, 16 nt, Bordetella pertussis
accgacggcagccccg

SEQ ID NO: 364266 - RNA, 13 nt, Bordetella pertussis
accgacggcgcgg

SEQ ID NO: 364267 - RNA, 16 nt, Bordetella pertussis
accgacggcgcggcga

SEQ ID NO: 364268 - RNA, 15 nt, Bordetella pertussis
accgagcacagcaac

SEQ ID NO: 364269 - RNA, 16 nt, Bordetella pertussis
accgagcgcgcccgcu

SEQ ID NO: 364270 - RNA, 21 nt, Bordetella pertussis
accgagcugagcaccagcagc

SEQ ID NO: 364271 - RNA, 15 nt, Bordetella pertussis
accgaggugccggcg

SEQ ID NO: 364272 - RNA, 16 nt, Bordetella pertussis
accgaggugccggcgg

SEQ ID NO: 364273 - RNA, 19 nt, Bordetella pertussis
accgaggugccggcgguga

SEQ ID NO: 364274 - RNA, 14 nt, Bordetella pertussis
accgaugcgccggc

SEQ ID NO: 364275 - RNA, 20 nt, Bordetella pertussis
accgauucgaacucgccgaa

SEQ ID NO: 364276 - RNA, 15 nt, Bordetella pertussis
accgauucgcgcacc

SEQ ID NO: 364277 - RNA, 14 nt, Bordetella pertussis
accgcaaggaagug

SEQ ID NO: 364278 - RNA, 19 nt, Bordetella pertussis
accgcaccggaggcgccgc

SEQ ID NO: 364279 - RNA, 17 nt, Bordetella pertussis
accgcacgauggcgcgc

SEQ ID NO: 364280 - RNA, 18 nt, Bordetella pertussis
accgccacgcgguccagc

SEQ ID NO: 364281 - RNA, 24 nt, Bordetella pertussis
accgccagcucggccugcggcucg

SEQ ID NO: 364282 - RNA, 23 nt, Bordetella pertussis
accgccaggaagaucggcccggc

SEQ ID NO: 364283 - RNA, 15 nt, Bordetella pertussis
accgccauggcggcc

SEQ ID NO: 364284 - RNA, 19 nt, Bordetella pertussis
accgcccccgccgccaugc

SEQ ID NO: 364285 - RNA, 19 nt, Bordetella pertussis
accgccgcccgccaggcca

SEQ ID NO: 364286 - RNA, 20 nt, Bordetella pertussis
accgccgcccgccaggccag

SEQ ID NO: 364287 - RNA, 14 nt, Bordetella pertussis
accgccgccgccac

SEQ ID NO: 364288 - RNA, 17 nt, Bordetella pertussis
accgccgccgcgccgcu

SEQ ID NO: 364289 - RNA, 21 nt, Bordetella pertussis
accgccggccggugcaucggc

SEQ ID NO: 364290 - RNA, 18 nt, Bordetella pertussis
accgccgggacaggcacc

SEQ ID NO: 364291 - RNA, 16 nt, Bordetella pertussis
accgccgguucggucg

SEQ ID NO: 364292 - RNA, 19 nt, Bordetella pertussis
accgccgguucggucgacg

SEQ ID NO: 364293 - RNA, 15 nt, Bordetella pertussis
accgcggacgccaug

SEQ ID NO: 364294 - RNA, 23 nt, Bordetella pertussis
accgcggacgccauggcggcggc

SEQ ID NO: 364295 - RNA, 23 nt, Bordetella pertussis
accgcggccgcgcuggcgcuggc

SEQ ID NO: 364296 - RNA, 18 nt, Bordetella pertussis
accgcggcggaccacacg

SEQ ID NO: 364297 - RNA, 12 nt, Bordetella pertussis
accgcggcgggc

SEQ ID NO: 364298 - RNA, 21 nt, Bordetella pertussis
accgcggcgggcucggcgccg

SEQ ID NO: 364299 - RNA, 13 nt, Bordetella pertussis
accgcgggcgcgc

SEQ ID NO: 364300 - RNA, 15 nt, Bordetella pertussis
accgcgguacgcggg

SEQ ID NO: 364301 - RNA, 20 nt, Bordetella pertussis
accgcgucauacacggcgcg

SEQ ID NO: 364302 - RNA, 23 nt, Bordetella pertussis
accggaauagauaugggccugau

SEQ ID NO: 364303 - RNA, 12 nt, Bordetella pertussis
accggagcggcu

SEQ ID NO: 364304 - RNA, 14 nt, Bordetella pertussis
accggcaucccugc

SEQ ID NO: 364305 - RNA, 20 nt, Bordetella pertussis
accggcaucccugcuugcgc

SEQ ID NO: 364306 - RNA, 15 nt, Bordetella pertussis
accggcaugccgucc

SEQ ID NO: 364307 - RNA, 16 nt, Bordetella pertussis
accggccaggcgcgga

SEQ ID NO: 364308 - RNA, 19 nt, Bordetella pertussis
accggccaggggcgcuggu

SEQ ID NO: 364309 - RNA, 22 nt, Bordetella pertussis
accggccaggggcgcuggucga

SEQ ID NO: 364310 - RNA, 17 nt, Bordetella pertussis
accggccagucgcggug

SEQ ID NO: 364311 - RNA, 17 nt, Bordetella pertussis
accggccccaccuggcg

SEQ ID NO: 364312 - RNA, 20 nt, Bordetella pertussis
accggccccaucauguugua

SEQ ID NO: 364313 - RNA, 21 nt, Bordetella pertussis
accggcccgcaccuugccugc

SEQ ID NO: 364314 - RNA, 21 nt, Bordetella pertussis
accggccgccgcaugccgggc

SEQ ID NO: 364315 - RNA, 12 nt, Bordetella pertussis
accggcgccacg

SEQ ID NO: 364316 - RNA, 14 nt, Bordetella pertussis
accggcgccgacgc

SEQ ID NO: 364317 - RNA, 14 nt, Bordetella pertussis
accggcgccggcuc

SEQ ID NO: 364318 - RNA, 16 nt, Bordetella pertussis
accggcgccugcggca

SEQ ID NO: 364319 - RNA, 21 nt, Bordetella pertussis
accggcgcgaacaccggcagg

SEQ ID NO: 364320 - RNA, 16 nt, Bordetella pertussis
accggcgugacgcgcg

SEQ ID NO: 364321 - RNA, 23 nt, Bordetella pertussis
accggcgugcagagcaccacggc

SEQ ID NO: 364322 - RNA, 21 nt, Bordetella pertussis
accggcgugcgcuggcugggc

SEQ ID NO: 364323 - RNA, 19 nt, Bordetella pertussis
accggcguguccagcggcg

SEQ ID NO: 364324 - RNA, 21 nt, Bordetella pertussis
accggcguguccagcggcgcc

SEQ ID NO: 364325 - RNA, 17 nt, Bordetella pertussis
accggcguucuggcgca

SEQ ID NO: 364326 - RNA, 13 nt, Bordetella pertussis
accggcuugccgu

SEQ ID NO: 364327 - RNA, 19 nt, Bordetella pertussis
accggcuuggccucggccg

SEQ ID NO: 364328 - RNA, 15 nt, Bordetella pertussis
accggcuuggggcgc

SEQ ID NO: 364329 - RNA, 17 nt, Bordetella pertussis
accggcuuggggcgcgc

SEQ ID NO: 364330 - RNA, 19 nt, Bordetella pertussis
accgguugcagcgcgccag

SEQ ID NO: 364331 - RNA, 14 nt, Bordetella pertussis
accgguuggccagc

SEQ ID NO: 364332 - RNA, 20 nt, Bordetella pertussis
accgguuggccagcuccagg

SEQ ID NO: 364333 - RNA, 13 nt, Bordetella pertussis
accguacccgcgc

SEQ ID NO: 364334 - RNA, 17 nt, Bordetella pertussis
accguacccgcgccguc

SEQ ID NO: 364335 - RNA, 13 nt, Bordetella pertussis
accgucagcaugc

SEQ ID NO: 364336 - RNA, 18 nt, Bordetella pertussis
accguccuugagcgccag

SEQ ID NO: 364337 - RNA, 18 nt, Bordetella pertussis
accgucgaugaccagcgc

SEQ ID NO: 364338 - RNA, 16 nt, Bordetella pertussis
accgucgcgcgcacgc

SEQ ID NO: 364339 - RNA, 21 nt, Bordetella pertussis
accgucgacuucgacccggac

SEQ ID NO: 364340 - RNA, 23 nt, Bordetella pertussis
accgucggugaugcucugcccgu

SEQ ID NO: 364341 - RNA, 17 nt, Bordetella pertussis
accgucuugcccgccag

SEQ ID NO: 364342 - RNA, 17 nt, Bordetella pertussis
accgucuuggccgucaa

SEQ ID NO: 364343 - RNA, 13 nt, Bordetella pertussis
accgugaccugcg

SEQ ID NO: 364344 - RNA, 16 nt, Bordetella pertussis
accgugaucggcgcaa

SEQ ID NO: 364345 - RNA, 20 nt, Bordetella pertussis
accgugaugcgcgccgcucu

SEQ ID NO: 364346 - RNA, 18 nt, Bordetella pertussis
accgugaugucgccgucg

SEQ ID NO: 364347 - RNA, 19 nt, Bordetella pertussis
accgugcgccaacgcgucg

SEQ ID NO: 364348 - RNA, 15 nt, Bordetella pertussis
accgugcuggccgac

SEQ ID NO: 364349 - RNA, 18 nt, Bordetella pertussis
accguggccacggccgcg

SEQ ID NO: 364350 - RNA, 18 nt, Bordetella pertussis
accguggaaaccgcgucg

SEQ ID NO: 364351 - RNA, 14 nt, Bordetella pertussis
accuggucggccuu

SEQ ID NO: 364352 - RNA, 17 nt, Bordetella pertussis
accuggucggccuucau

SEQ ID NO: 364353 - RNA, 15 nt, Bordetella pertussis
accugguggcgcugg

SEQ ID NO: 364354 - RNA, 16 nt, Bordetella pertussis
accugguggcgcuggc

SEQ ID NO: 364355 - RNA, 19 nt, Bordetella pertussis
accugguggcgcuggccca

SEQ ID NO: 364356 - RNA, 20 nt, Bordetella pertussis
accuuccuccgacaggcgcc

SEQ ID NO: 364357 - RNA, 20 nt, Bordetella pertussis
accuucucgaugcgcgccac

SEQ ID NO: 364358 - RNA, 17 nt, Bordetella pertussis
accuucuuccaggcgcc

SEQ ID NO: 364359 - RNA, 14 nt, Bordetella pertussis
acgaaaccaggccg

SEQ ID NO: 364360 - RNA, 18 nt, Bordetella pertussis
acgaaauagccgaccacc

SEQ ID NO: 364361 - RNA, 19 nt, Bordetella pertussis
acgaaauagccgaccaccc

SEQ ID NO: 364362 - RNA, 23 nt, Bordetella pertussis
acgaaagcggcaaagccgcugcg

SEQ ID NO: 364363 - RNA, 14 nt, Bordetella pertussis
acgaacagcgccag

SEQ ID NO: 364364 - RNA, 23 nt, Bordetella pertussis
acgaacccgcccgaaccggcauc

SEQ ID NO: 364365 - RNA, 23 nt, Bordetella pertussis
acgaagcaggugaugcgcgcggc

SEQ ID NO: 364366 - RNA, 13 nt, Bordetella pertussis
acgaaggcgccgg

SEQ ID NO: 364367 - RNA, 16 nt, Bordetella pertussis
acgaaggcgccggcca

SEQ ID NO: 364368 - RNA, 18 nt, Bordetella pertussis
acgaagggauagcgccgu

SEQ ID NO: 364369 - RNA, 15 nt, Bordetella pertussis
acgacacgucaucgu

SEQ ID NO: 364370 - RNA, 19 nt, Bordetella pertussis
acgacacgucaucguggcc

SEQ ID NO: 364371 - RNA, 23 nt, Bordetella pertussis
acgacacgucaucguggccgcgc

SEQ ID NO: 364372 - RNA, 20 nt, Bordetella pertussis
acgacagaccguagcgcagg

SEQ ID NO: 364373 - RNA, 23 nt, Bordetella pertussis
acgacaggguccagguggcccgc

SEQ ID NO: 364374 - RNA, 17 nt, Bordetella pertussis
acgaccaaccugaccgc

SEQ ID NO: 364375 - RNA, 18 nt, Bordetella pertussis
acgacggcaagucgacgc

SEQ ID NO: 364376 - RNA, 19 nt, Bordetella pertussis
acgacguagucggcgccca

SEQ ID NO: 364377 - RNA, 14 nt, Bordetella pertussis
acgagaugccgaug

SEQ ID NO: 364378 - RNA, 19 nt, Bordetella pertussis
acgaggccgaguagcggcg

SEQ ID NO: 364379 - RNA, 13 nt, Bordetella pertussis
acgagggcgccau

SEQ ID NO: 364380 - RNA, 14 nt, Bordetella pertussis
acgaguaccgccgc

SEQ ID NO: 364381 - RNA, 13 nt, Bordetella pertussis
acgauauccaggc

SEQ ID NO: 364382 - RNA, 19 nt, Bordetella pertussis
acgauauuggcgucggccg

SEQ ID NO: 364383 - RNA, 14 nt, Bordetella pertussis
acgaucaccacgcc

SEQ ID NO: 364384 - RNA, 20 nt, Bordetella pertussis
acgaucaccacgcccgcgcc

SEQ ID NO: 364385 - RNA, 15 nt, Bordetella pertussis
acgaucaggcggcgc

SEQ ID NO: 364386 - RNA, 16 nt, Bordetella pertussis
acgauccacggccggc

SEQ ID NO: 364387 - RNA, 17 nt, Bordetella pertussis
acgauccacggccggcg

SEQ ID NO: 364388 - RNA, 19 nt, Bordetella pertussis
acgauccacggccggcgca

SEQ ID NO: 364389 - RNA, 20 nt, Bordetella pertussis
acgaucccgacgauccgcgg

SEQ ID NO: 364390 - RNA, 18 nt, Bordetella pertussis
acgaucccgucauggcgg

SEQ ID NO: 364391 - RNA, 23 nt, Bordetella pertussis
acgaucccgucauggcggcaggc

SEQ ID NO: 364392 - RNA, 13 nt, Bordetella pertussis
acgaucgcggcgc

SEQ ID NO: 364393 - RNA, 20 nt, Bordetella pertussis
acgaucgcggcgcuggcgaa

SEQ ID NO: 364394 - RNA, 20 nt, Bordetella pertussis
acgaucgucagcagcacgcc

SEQ ID NO: 364395 - RNA, 14 nt, Bordetella pertussis
acgaugcccagggc

SEQ ID NO: 364396 - RNA, 19 nt, Bordetella pertussis
acgaugcccagggccgcgc

SEQ ID NO: 364397 - RNA, 24 nt, Bordetella pertussis
acgaugccggucuccagcgcgucg

SEQ ID NO: 364398 - RNA, 17 nt, Bordetella pertussis
acgauggaaaugccguc

SEQ ID NO: 364399 - RNA, 20 nt, Bordetella pertussis
acgauggccgaaugcccgcc

SEQ ID NO: 364400 - RNA, 14 nt, Bordetella pertussis
acgauggccgcgcc

SEQ ID NO: 364401 - RNA, 14 nt, Bordetella pertussis
acgauucggucgcc

SEQ ID NO: 364402 - RNA, 22 nt, Bordetella pertussis
acgauucuuuccuggccggcgc

SEQ ID NO: 364403 - RNA, 21 nt, Bordetella pertussis
acgauggccugugcggcccau

SEQ ID NO: 364404 - RNA, 14 nt, Bordetella pertussis
acgcaagcccggca

SEQ ID NO: 364405 - RNA, 18 nt, Bordetella pertussis
acgcaccgccgccggccc

SEQ ID NO: 364406 - RNA, 15 nt, Bordetella pertussis
acgcaccgcgccagc

SEQ ID NO: 364407 - RNA, 17 nt, Bordetella pertussis
acgcaccgcgccagcgc

SEQ ID NO: 364408 - RNA, 20 nt, Bordetella pertussis
acgcaccuuucugcugcucg

SEQ ID NO: 364409 - RNA, 12 nt, Bordetella pertussis
acgcagcuucuu

SEQ ID NO: 364410 - RNA, 15 nt, Bordetella pertussis
acgcaggcgggcgcc

SEQ ID NO: 364411 - RNA, 19 nt, Bordetella pertussis
acgcaggcgggcgccgcgc

SEQ ID NO: 364412 - RNA, 16 nt, Bordetella pertussis
acgcaucggcgccggc

SEQ ID NO: 364413 - RNA, 21 nt, Bordetella pertussis
acgcaugcgacaugagcugcg

SEQ ID NO: 364414 - RNA, 14 nt, Bordetella pertussis
acgcaugcgugcgc

SEQ ID NO: 364415 - RNA, 18 nt, Bordetella pertussis
acgcauuugcagcggcgg

SEQ ID NO: 364416 - RNA, 15 nt, Bordetella pertussis
acgccaagaccgcgg

SEQ ID NO: 364417 - RNA, 18 nt, Bordetella pertussis
acgccaagaccgcggccg

SEQ ID NO: 364418 - RNA, 21 nt, Bordetella pertussis
acgccaagaccgcggccgcgc

SEQ ID NO: 364419 - RNA, 15 nt, Bordetella pertussis
acgccacgcccaucu

SEQ ID NO: 364420 - RNA, 13 nt, Bordetella pertussis
acgccacgcgcgg

SEQ ID NO: 364421 - RNA, 17 nt, Bordetella pertussis
acgccacuugcaggccg

SEQ ID NO: 364422 - RNA, 22 nt, Bordetella pertussis
acgccagcaggcgaaacgccag

SEQ ID NO: 364423 - RNA, 21 nt, Bordetella pertussis
acgccaucgacgcuugccggc

SEQ ID NO: 364424 - RNA, 22 nt, Bordetella pertussis
acgccaucuugcaggcgccagu

SEQ ID NO: 364425 - RNA, 12 nt, Bordetella pertussis
acgcccaggccc

SEQ ID NO: 364426 - RNA, 13 nt, Bordetella pertussis
acgcccaggccca

SEQ ID NO: 364427 - RNA, 17 nt, Bordetella pertussis
acgcccaggcccaccgc

SEQ ID NO: 364428 - RNA, 18 nt, Bordetella pertussis
acgcccagguugcggccg

SEQ ID NO: 364429 - RNA, 22 nt, Bordetella pertussis
acgcccagguugcggccgccac

SEQ ID NO: 364430 - RNA, 21 nt, Bordetella pertussis
acgcccaguauggugaccggc

SEQ ID NO: 364431 - RNA, 12 nt, Bordetella pertussis
acgcccaguccc

SEQ ID NO: 364432 - RNA, 14 nt, Bordetella pertussis
acgcccagguccga

SEQ ID NO: 364433 - RNA, 23 nt, Bordetella pertussis
acgcccagguccgaaccgaccgc

SEQ ID NO: 364434 - RNA, 13 nt, Bordetella pertussis
acgcccaugcgau

SEQ ID NO: 364435 - RNA, 13 nt, Bordetella pertussis
acgcccggccgcc

SEQ ID NO: 364436 - RNA, 23 nt, Bordetella pertussis
acgcccggccgccucaccgcgcc

SEQ ID NO: 364437 - RNA, 14 nt, Bordetella pertussis
acgcccggcgcggu

SEQ ID NO: 364438 - RNA, 18 nt, Bordetella pertussis
acgcccgucucgcgcgcc

SEQ ID NO: 364439 - RNA, 17 nt, Bordetella pertussis
acgcccuggcagcuggc

SEQ ID NO: 364440 - RNA, 20 nt, Bordetella pertussis
acgcccuggcagcuggcgcg

SEQ ID NO: 364441 - RNA, 12 nt, Bordetella pertussis
acgcccuggccg

SEQ ID NO: 364442 - RNA, 21 nt, Bordetella pertussis
acgcccuggccuucgaccugc

SEQ ID NO: 364443 - RNA, 22 nt, Bordetella pertussis
acgcccuggcgcaggccggcgg

SEQ ID NO: 364444 - RNA, 16 nt, Bordetella pertussis
acgccgaacacaucga

SEQ ID NO: 364445 - RNA, 23 nt, Bordetella pertussis
acgccgaacacaucgagggcguc

SEQ ID NO: 364446 - RNA, 19 nt, Bordetella pertussis
acgccgccggcagggccag

SEQ ID NO: 364447 - RNA, 22 nt, Bordetella pertussis
acgccgccggcagggccagcgc

SEQ ID NO: 364448 - RNA, 13 nt, Bordetella pertussis
acgccgccggcca

SEQ ID NO: 364449 - RNA, 14 nt, Bordetella pertussis
acgccgccggccag

SEQ ID NO: 364450 - RNA, 21 nt, Bordetella pertussis
acgccgcgacacaaggcggcc

SEQ ID NO: 364451 - RNA, 10 nt, Bordetella pertussis
acgccgcgcc

SEQ ID NO: 364452 - RNA, 13 nt, Bordetella pertussis
acgccgcgccagg

SEQ ID NO: 364453 - RNA, 15 nt, Bordetella pertussis
acgccgccggcgcac

SEQ ID NO: 364454 - RNA, 13 nt, Bordetella pertussis
acgccgcgccggc

SEQ ID NO: 364455 - RNA, 16 nt, Bordetella pertussis
acgccgcgcgaucgcc

SEQ ID NO: 364456 - RNA, 22 nt, Bordetella pertussis
acgccgcgcucguugcgcguga

SEQ ID NO: 364457 - RNA, 12 nt, Bordetella pertussis
acgccggcgcgc

SEQ ID NO: 364458 - RNA, 18 nt, Bordetella pertussis
acgccggcgcgccggccg

SEQ ID NO: 364459 - RNA, 13 nt, Bordetella pertussis
acgccggcggcac

SEQ ID NO: 364460 - RNA, 13 nt, Bordetella pertussis
acgccggcgccgg

SEQ ID NO: 364461 - RNA, 13 nt, Bordetella pertussis
acgccggcggcgc

SEQ ID NO: 364462 - RNA, 13 nt, Bordetella pertussis
acgccggcggcgu

SEQ ID NO: 364463 - RNA, 14 nt, Bordetella pertussis
acgccggcggcgug

SEQ ID NO: 364464 - RNA, 23 nt, Bordetella pertussis
acgccggcggcgugcgccugcug

SEQ ID NO: 364465 - RNA, 21 nt, Bordetella pertussis
acgccggcgggcaggcuccac

SEQ ID NO: 364466 - RNA, 14 nt, Bordetella pertussis
acgccggcggucac

SEQ ID NO: 364467 - RNA, 14 nt, Bordetella pertussis
acgccgggcgcgcu

SEQ ID NO: 364468 - RNA, 14 nt, Bordetella pertussis
acgccgggcgcggc

SEQ ID NO: 364469 - RNA, 21 nt, Bordetella pertussis
acgccgggcgcggcccggcgu

SEQ ID NO: 364470 - RNA, 18 nt, Bordetella pertussis
acgccgggccgugcgccg

SEQ ID NO: 364471 - RNA, 16 nt, Bordetella pertussis
acgccggguugcggcg

SEQ ID NO: 364472 - RNA, 21 nt, Bordetella pertussis
acgccgguguucucgcuggug

SEQ ID NO: 364473 - RNA, 21 nt, Bordetella pertussis
acgccgucagcgacaucgugc

SEQ ID NO: 364474 - RNA, 15 nt, Bordetella pertussis
acgccgucgaccccg

SEQ ID NO: 364475 - RNA, 16 nt, Bordetella pertussis
acgccgucgaccccgu

SEQ ID NO: 364476 - RNA, 19 nt, Bordetella pertussis
acgccgucgaccccgucga

SEQ ID NO: 364477 - RNA, 15 nt, Bordetella pertussis
acgccguggcgcaag

SEQ ID NO: 364478 - RNA, 14 nt, Bordetella pertussis
acgccucgggcgca

SEQ ID NO: 364479 - RNA, 16 nt, Bordetella pertussis
acgccucgggcgcaac

SEQ ID NO: 364480 - RNA, 14 nt, Bordetella pertussis
acgccugccgcgcc

SEQ ID NO: 364481 - RNA, 17 nt, Bordetella pertussis
acgccugccgcgcccgg

SEQ ID NO: 364482 - RNA, 20 nt, Bordetella pertussis
acgccugcgccauggcgcgc

SEQ ID NO: 364483 - RNA, 22 nt, Bordetella pertussis
acgccugcgccggguccggccg

SEQ ID NO: 364484 - RNA, 22 nt, Bordetella pertussis
acgccuuguucgcgcgcgguau

SEQ ID NO: 364485 - RNA, 16 nt, Bordetella pertussis
acgcgaaccccgccuu

SEQ ID NO: 364486 - RNA, 21 nt, Bordetella pertussis
acgcgaacccgaucgcgaugg

SEQ ID NO: 364487 - RNA, 15 nt, Bordetella pertussis
acgcgaaccaggcca

SEQ ID NO: 364488 - RNA, 19 nt, Bordetella pertussis
acgcgaagaucccgccgga

SEQ ID NO: 364489 - RNA, 13 nt, Bordetella pertussis
acgcgacagcgcu

SEQ ID NO: 364490 - RNA, 18 nt, Bordetella pertussis
acgcgacacgcagcaacg

SEQ ID NO: 364491 - RNA, 24 nt, Bordetella pertussis
acgcgaccagcuucugcgccugcu

SEQ ID NO: 364492 - RNA, 14 nt, Bordetella pertussis
acgcgacgcgccgg

SEQ ID NO: 364493 - RNA, 15 nt, Bordetella pertussis
acgcgacgcgccgga

SEQ ID NO: 364494 - RNA, 16 nt, Bordetella pertussis
acgcgacgcgccggau

SEQ ID NO: 364495 - RNA, 18 nt, Bordetella pertussis
acgcgacgcgacgcgggc

SEQ ID NO: 364496 - RNA, 12 nt, Bordetella pertussis
acgcgacgcgcc

SEQ ID NO: 364497 - RNA, 21 nt, Bordetella pertussis
acgcgccggcccaggcgcgcu

SEQ ID NO: 364498 - RNA, 18 nt, Bordetella pertussis
acgcgcgacgccguggug

SEQ ID NO: 364499 - RNA, 20 nt, Bordetella pertussis
acgcgcgacgccgugguggu

SEQ ID NO: 364500 - RNA, 18 nt, Bordetella pertussis
acgcgcgauccgcgccag

SEQ ID NO: 364501 - RNA, 19 nt, Bordetella pertussis
acgcgcgauccgcgccagg

SEQ ID NO: 364502 - RNA, 13 nt, Bordetella pertussis
acgcgccugcgcg

SEQ ID NO: 364503 - RNA, 12 nt, Bordetella pertussis
acgcgcgccagc

SEQ ID NO: 364504 - RNA, 14 nt, Bordetella pertussis
acgcgcgccagcug

SEQ ID NO: 364505 - RNA, 15 nt, Bordetella pertussis
acgcgcgccggcgcu

SEQ ID NO: 364506 - RNA, 14 nt, Bordetella pertussis
acgcgcgcgccgcc

SEQ ID NO: 364507 - RNA, 18 nt, Bordetella pertussis
acgcgcgcgccgccggcc

SEQ ID NO: 364508 - RNA, 13 nt, Bordetella pertussis
acgcgcgcgccgg

SEQ ID NO: 364509 - RNA, 17 nt, Bordetella pertussis
acgcgcgcgcgcacagg

SEQ ID NO: 364510 - RNA, 17 nt, Bordetella pertussis
acgcgcgcggcgcggcu

SEQ ID NO: 364511 - RNA, 17 nt, Bordetella pertussis
acgcgcucgggcagcuc

SEQ ID NO: 364512 - RNA, 13 nt, Bordetella pertussis
acgcgcugcgcgc

SEQ ID NO: 364513 - RNA, 15 nt, Bordetella pertussis
acgcgcugcgcgccg

SEQ ID NO: 364514 - RNA, 13 nt, Bordetella pertussis
acgcgcuggccga

SEQ ID NO: 364515 - RNA, 15 nt, Bordetella pertussis
acgcgcuggcgcagg

SEQ ID NO: 364516 - RNA, 15 nt, Bordetella pertussis
acgcgcugggcgugg

SEQ ID NO: 364517 - RNA, 19 nt, Bordetella pertussis
acgcgcugggcguggcgcg

SEQ ID NO: 364518 - RNA, 21 nt, Bordetella pertussis
acgcgcugguccgccgccgcg

SEQ ID NO: 364519 - RNA, 20 nt, Bordetella pertussis
acgcgcuguaggcgccggcg

SEQ ID NO: 364520 - RNA, 22 nt, Bordetella pertussis
acgcgcuguccgaugcgcugcu

SEQ ID NO: 364521 - RNA, 15 nt, Bordetella pertussis
acgcgcuugcgcgcc

SEQ ID NO: 364522 - RNA, 17 nt, Bordetella pertussis
acgcgcuugcgcgccac

SEQ ID NO: 364523 - RNA, 17 nt, Bordetella pertussis
acgcggcgcggcagguu

SEQ ID NO: 364524 - RNA, 22 nt, Bordetella pertussis
acgcggcgcugcuggccggcca

SEQ ID NO: 364525 - RNA, 23 nt, Bordetella pertussis
acgcggcgcugcuggccggccag

SEQ ID NO: 364526 - RNA, 18 nt, Bordetella pertussis
acgcggcguacuggcgcg

SEQ ID NO: 364527 - RNA, 19 nt, Bordetella pertussis
acgcggcguacuggcgcgg

SEQ ID NO: 364528 - RNA, 14 nt, Bordetella pertussis
acgcgggccggccg

SEQ ID NO: 364529 - RNA, 16 nt, Bordetella pertussis
acgcgggcgcugacgc

SEQ ID NO: 364530 - RNA, 15 nt, Bordetella pertussis
acgcgggcggccgac

SEQ ID NO: 364531 - RNA, 16 nt, Bordetella pertussis
acgcggucgaugcgca

SEQ ID NO: 364532 - RNA, 17 nt, Bordetella pertussis
acgcggucgaugcgcac

SEQ ID NO: 364533 - RNA, 19 nt, Bordetella pertussis
acgcggucgcauuggccgc

SEQ ID NO: 364534 - RNA, 18 nt, Bordetella pertussis
acgcgguccagccccugc

SEQ ID NO: 364535 - RNA, 15 nt, Bordetella pertussis
acgcguccucggcca

SEQ ID NO: 364536 - RNA, 22 nt, Bordetella pertussis
acgcgugaauaccgcgcacagg

SEQ ID NO: 364537 - RNA, 20 nt, Bordetella pertussis
acgcgugggcggcggcaugc

SEQ ID NO: 364538 - RNA, 20 nt, Bordetella pertussis
acgcguucgggcggcaggug

SEQ ID NO: 364539 - RNA, 18 nt, Bordetella pertussis
acgcguuguucgggccgg

SEQ ID NO: 364540 - RNA, 19 nt, Bordetella pertussis
acgcuagggcguggcgcga

SEQ ID NO: 364541 - RNA, 17 nt, Bordetella pertussis
acgcucgaugcgccagu

SEQ ID NO: 364542 - RNA, 23 nt, Bordetella pertussis
acgcucuacacggccgccaccug

SEQ ID NO: 364543 - RNA, 17 nt, Bordetella pertussis
acgcucuugcgcgcgcc

SEQ ID NO: 364544 - RNA, 17 nt, Bordetella pertussis
acgcugaagcgccgcca

SEQ ID NO: 364545 - RNA, 18 nt, Bordetella pertussis
acgcugacccuggccgaa

SEQ ID NO: 364546 - RNA, 21 nt, Bordetella pertussis
acgcugacccuggccgaacgc

SEQ ID NO: 364547 - RNA, 23 nt, Bordetella pertussis
acgcugaccgaagcgggcgagga

SEQ ID NO: 364548 - RNA, 17 nt, Bordetella pertussis
acgcugacugcggugcc

SEQ ID NO: 364549 - RNA, 16 nt, Bordetella pertussis
acgcugaucgccggcg

SEQ ID NO: 364550 - RNA, 17 nt, Bordetella pertussis
acgcugaucgccggcgc

SEQ ID NO: 364551 - RNA, 14 nt, Bordetella pertussis
acgcugaucggccg

SEQ ID NO: 364552 - RNA, 13 nt, Bordetella pertussis
acgcugaucucgg

SEQ ID NO: 364553 - RNA, 18 nt, Bordetella pertussis
acgcugaucucggccugc

SEQ ID NO: 364554 - RNA, 14 nt, Bordetella pertussis
acgcugaugcgcgu

SEQ ID NO: 364555 - RNA, 17 nt, Bordetella pertussis
acgcugcgcaggcgcgc

SEQ ID NO: 364556 - RNA, 16 nt, Bordetella pertussis
acgcugcgcggcggcu

SEQ ID NO: 364557 - RNA, 21 nt, Bordetella pertussis
acgcugggcuacgacccgcug

SEQ ID NO: 364558 - RNA, 23 nt, Bordetella pertussis
acgcuguagaggcgcggcucgcc

SEQ ID NO: 364559 - RNA, 16 nt, Bordetella pertussis
acgcugucgcgcccgg

SEQ ID NO: 364560 - RNA, 16 nt, Bordetella pertussis
acgcugucggggugcc

SEQ ID NO: 364561 - RNA, 22 nt, Bordetella pertussis
acgcugucggggugccguucgg

SEQ ID NO: 364562 - RNA, 16 nt, Bordetella pertussis
acggaaacgcccagcc

SEQ ID NO: 364563 - RNA, 14 nt, Bordetella pertussis
acggaaacguugcg

SEQ ID NO: 364564 - RNA, 22 nt, Bordetella pertussis
acggaacgugccgucgggcgcc

SEQ ID NO: 364565 - RNA, 23 nt, Bordetella pertussis
acggaaguccugcaucgccaugc

SEQ ID NO: 364566 - RNA, 20 nt, Bordetella pertussis
acggacagcccgcgcuggcg

SEQ ID NO: 364567 - RNA, 16 nt, Bordetella pertussis
acggacuggcugguca

SEQ ID NO: 364568 - RNA, 21 nt, Bordetella pertussis
acggaggcuuuguggcgucgg

SEQ ID NO: 364569 - RNA, 15 nt, Bordetella pertussis
acggcaagagccugg

SEQ ID NO: 364570 - RNA, 16 nt, Bordetella pertussis
acggcaaucuugccgc

SEQ ID NO: 364571 - RNA, 16 nt, Bordetella pertussis
acggcaaugccugcgc

SEQ ID NO: 364572 - RNA, 12 nt, Bordetella pertussis
acggcaccagcc

SEQ ID NO: 364573 - RNA, 13 nt, Bordetella pertussis
acggcggugccgc

SEQ ID NO: 364574 - RNA, 16 nt, Bordetella pertussis
acggcggugccgcgca

SEQ ID NO: 364575 - RNA, 15 nt, Bordetella pertussis
acggcggugcugaac

SEQ ID NO: 364576 - RNA, 20 nt, Bordetella pertussis
acggcguagccgaucuggcc

SEQ ID NO: 364577 - RNA, 15 nt, Bordetella pertussis
acggcgucgaugcgc

SEQ ID NO: 364578 - RNA, 16 nt, Bordetella pertussis
acggcgucgccggcca

SEQ ID NO: 364579 - RNA, 22 nt, Bordetella pertussis
acggcgucgggcagcaggcgca

SEQ ID NO: 364580 - RNA, 17 nt, Bordetella pertussis
acggcgucgggcaguug

SEQ ID NO: 364581 - RNA, 15 nt, Bordetella pertussis
acggcguggcgcgca

SEQ ID NO: 364582 - RNA, 19 nt, Bordetella pertussis
acggcuggagauacuggcc

SEQ ID NO: 364583 - RNA, 15 nt, Bordetella pertussis
acggcuggccgucga

SEQ ID NO: 364584 - RNA, 22 nt, Bordetella pertussis
acggcuggcugggcgcgccgcu

SEQ ID NO: 364585 - RNA, 23 nt, Bordetella pertussis
acgggauugccgucacgcgugaa

SEQ ID NO: 364586 - RNA, 16 nt, Bordetella pertussis
acggggacgccggcgg

SEQ ID NO: 364587 - RNA, 19 nt, Bordetella pertussis
acggggacuggcacgcgcu

SEQ ID NO: 364588 - RNA, 22 nt, Bordetella pertussis
acggggacuggcacgcgcugaa

SEQ ID NO: 364589 - RNA, 22 nt, Bordetella pertussis
acggggccgccaacgccaagcu

SEQ ID NO: 364590 - RNA, 23 nt, Bordetella pertussis
acggggccgccaacgccaagcug

SEQ ID NO: 364591 - RNA, 12 nt, Bordetella pertussis
acggggccgccu

SEQ ID NO: 364592 - RNA, 21 nt, Bordetella pertussis
acgggguggccggcgcgcggc

SEQ ID NO: 364593 - RNA, 21 nt, Bordetella pertussis
acgggucacccgccgcaccag

SEQ ID NO: 364594 - RNA, 14 nt, Bordetella pertussis
acggguaccaggcu

SEQ ID NO: 364595 - RNA, 23 nt, Bordetella pertussis
acggucaggggcaggcgcacgcc

SEQ ID NO: 364596 - RNA, 17 nt, Bordetella pertussis
acgguccaggcggccgc

SEQ ID NO: 364597 - RNA, 19 nt, Bordetella pertussis
acggugccagucccccugc

SEQ ID NO: 364598 - RNA, 14 nt, Bordetella pertussis
acggugccgccgau

SEQ ID NO: 364599 - RNA, 15 nt, Bordetella pertussis
acggugccgcgcgcu

SEQ ID NO: 364600 - RNA, 17 nt, Bordetella pertussis
acggugccggccagccu

SEQ ID NO: 364601 - RNA, 17 nt, Bordetella pertussis
acggugcgagaucucga

SEQ ID NO: 364602 - RNA, 14 nt, Bordetella pertussis
acggugcgcgccac

SEQ ID NO: 364603 - RNA, 23 nt, Bordetella pertussis
acggugcgcgccacggcgucgcc

SEQ ID NO: 364604 - RNA, 17 nt, Bordetella pertussis
acgguggcgaaggccgc

SEQ ID NO: 364605 - RNA, 18 nt, Bordetella pertussis
acgguggcgaaggccgcc

SEQ ID NO: 364606 - RNA, 20 nt, Bordetella pertussis
acgguggcgcccggcggcgc

SEQ ID NO: 364607 - RNA, 13 nt, Bordetella pertussis
acgguggcgccgu

SEQ ID NO: 364608 - RNA, 15 nt, Bordetella pertussis
acgguggcgccgucg

SEQ ID NO: 364609 - RNA, 12 nt, Bordetella pertussis
acggugggcagc

SEQ ID NO: 364610 - RNA, 14 nt, Bordetella pertussis
acggugggcagcag

SEQ ID NO: 364611 - RNA, 17 nt, Bordetella pertussis
acggugggcagcagcac

SEQ ID NO: 364612 - RNA, 21 nt, Bordetella pertussis
acgguggcguaguagcccagg

SEQ ID NO: 364613 - RNA, 12 nt, Bordetella pertussis
acgguguugcuc

SEQ ID NO: 364614 - RNA, 18 nt, Bordetella pertussis
acgguucagcgcgccagc

SEQ ID NO: 364615 - RNA, 18 nt, Bordetella pertussis
acgguucuggaucgcgcc

SEQ ID NO: 364616 - RNA, 21 nt, Bordetella pertussis
acguaaucgagcuggcccacg

SEQ ID NO: 364617 - RNA, 19 nt, Bordetella pertussis
acguacuucucgucgcgca

SEQ ID NO: 364618 - RNA, 17 nt, Bordetella pertussis
acguagaaauacgcgcg

SEQ ID NO: 364619 - RNA, 17 nt, Bordetella pertussis
acgucacggaucagccg

SEQ ID NO: 364620 - RNA, 17 nt, Bordetella pertussis
acguccggcgggccgcu

SEQ ID NO: 364621 - RNA, 23 nt, Bordetella pertussis
acgucgaauuccaguugcgcgcc

SEQ ID NO: 364622 - RNA, 21 nt, Bordetella pertussis
acgucgcccuggauggcggcc

SEQ ID NO: 364623 - RNA, 17 nt, Bordetella pertussis
acgucgccggcguucuu

SEQ ID NO: 364624 - RNA, 17 nt, Bordetella pertussis
acguggacucgauggcg

SEQ ID NO: 364625 - RNA, 15 nt, Bordetella pertussis
acguggccccaggcg

SEQ ID NO: 364626 - RNA, 22 nt, Bordetella pertussis
acguggcccgcgugacggccgc

SEQ ID NO: 364627 - RNA, 22 nt, Bordetella pertussis
acguggccugcuugaagacgcc

SEQ ID NO: 364628 - RNA, 14 nt, Bordetella pertussis
acguggcgacgucg

SEQ ID NO: 364629 - RNA, 13 nt, Bordetella pertussis
acguggcgcggcu

SEQ ID NO: 364630 - RNA, 12 nt, Bordetella pertussis
acguggcggcga

SEQ ID NO: 364631 - RNA, 23 nt, Bordetella pertussis
acguggcggcgauguggcgcgcc

SEQ ID NO: 364632 - RNA, 16 nt, Bordetella pertussis
acguggcguccacgcg

SEQ ID NO: 364633 - RNA, 16 nt, Bordetella pertussis
acgugggcacgccggc

SEQ ID NO: 364634 - RNA, 17 nt, Bordetella pertussis
acgugguggugcgggcc

SEQ ID NO: 364635 - RNA, 14 nt, Bordetella pertussis
acgugucggccacc

SEQ ID NO: 364636 - RNA, 20 nt, Bordetella pertussis
acgugucggccaccacgaug

SEQ ID NO: 364637 - RNA, 17 nt, Bordetella pertussis
acguugaccuugccgau

SEQ ID NO: 364638 - RNA, 18 nt, Bordetella pertussis
acguugaccuugccgauc

SEQ ID NO: 364639 - RNA, 19 nt, Bordetella pertussis
acuauggcgcgcgcacgcu

SEQ ID NO: 364640 - RNA, 11 nt, Bordetella pertussis
acucggccagc

SEQ ID NO: 364641 - RNA, 14 nt, Bordetella pertussis
acucggccagcagc

SEQ ID NO: 364642 - RNA, 16 nt, Bordetella pertussis
acucggccagcagcuu

SEQ ID NO: 364643 - RNA, 15 nt, Bordetella pertussis
acucggccagcgcgc

SEQ ID NO: 364644 - RNA, 17 nt, Bordetella pertussis
acucggccagcgcgcgg

SEQ ID NO: 364645 - RNA, 22 nt, Bordetella pertussis
acucggccaggccauggcgcga

SEQ ID NO: 364646 - RNA, 18 nt, Bordetella pertussis
acucgggcaugcgccugc

SEQ ID NO: 364647 - RNA, 18 nt, Bordetella pertussis
acucugcccgaagcggcc

SEQ ID NO: 364648 - RNA, 18 nt, Bordetella pertussis
acucuguguugauccgcc

SEQ ID NO: 364649 - RNA, 21 nt, Bordetella pertussis
acucuguucuaccugaucgcc

SEQ ID NO: 364650 - RNA, 17 nt, Bordetella pertussis
acugagaaaggccgcca

SEQ ID NO: 364651 - RNA, 18 nt, Bordetella pertussis
acugagaaaggccgccac

SEQ ID NO: 364652 - RNA, 15 nt, Bordetella pertussis
acugcaaggcccgcc

SEQ ID NO: 364653 - RNA, 16 nt, Bordetella pertussis
acugcaggccaucgcg

SEQ ID NO: 364654 - RNA, 13 nt, Bordetella pertussis
acugcaggccgcc

SEQ ID NO: 364655 - RNA, 17 nt, Bordetella pertussis
acugcaggccgccggcc

SEQ ID NO: 364656 - RNA, 19 nt, Bordetella pertussis
acugcaggccgccggccuc

SEQ ID NO: 364657 - RNA, 14 nt, Bordetella pertussis
acugcaggcgcugc

SEQ ID NO: 364658 - RNA, 13 nt, Bordetella pertussis
acugcaucguggg

SEQ ID NO: 364659 - RNA, 18 nt, Bordetella pertussis
acugcgccugggcggcgc

SEQ ID NO: 364660 - RNA, 15 nt, Bordetella pertussis
acugcggcgccuggg

SEQ ID NO: 364661 - RNA, 15 nt, Bordetella pertussis
acuggacggcgcugg

SEQ ID NO: 364662 - RNA, 23 nt, Bordetella pertussis
acuggacggcgcuggggaagcgc

SEQ ID NO: 364663 - RNA, 16 nt, Bordetella pertussis
acuggauauggcgccg

SEQ ID NO: 364664 - RNA, 14 nt, Bordetella pertussis
acuggaucgccgau

SEQ ID NO: 364665 - RNA, 20 nt, Bordetella pertussis
acuggcaacgggucgcgcag

SEQ ID NO: 364666 - RNA, 17 nt, Bordetella pertussis
acuggcaccggccaagc

SEQ ID NO: 364667 - RNA, 19 nt, Bordetella pertussis
acuggccagcaagcgcucg

SEQ ID NO: 364668 - RNA, 15 nt, Bordetella pertussis
acuggccgcgacaua

SEQ ID NO: 364669 - RNA, 18 nt, Bordetella pertussis
acuggccgcgcucaggcc

SEQ ID NO: 364670 - RNA, 19 nt, Bordetella pertussis
acuggccuugugcgccguc

SEQ ID NO: 364671 - RNA, 12 nt, Bordetella pertussis
acuggcgcgcgc

SEQ ID NO: 364672 - RNA, 22 nt, Bordetella pertussis
acuggcgcgcgcaagccgccgc

SEQ ID NO: 364673 - RNA, 23 nt, Bordetella pertussis
acuggcgcggcgcuacgccgccg

SEQ ID NO: 364674 - RNA, 18 nt, Bordetella pertussis
acuggcgcggcggccagg

SEQ ID NO: 364675 - RNA, 18 nt, Bordetella pertussis
acuggcggcugcgggcgc

SEQ ID NO: 364676 - RNA, 19 nt, Bordetella pertussis
acuggcuggucuucgagcg

SEQ ID NO: 364677 - RNA, 14 nt, Bordetella pertussis
acugggacaggccc

SEQ ID NO: 364678 - RNA, 16 nt, Bordetella pertussis
acugggcaccacgaug

SEQ ID NO: 364679 - RNA, 16 nt, Bordetella pertussis
acugggcgccggccag

SEQ ID NO: 364680 - RNA, 17 nt, Bordetella pertussis
acugggcgccggccagg

SEQ ID NO: 364681 - RNA, 17 nt, Bordetella pertussis
acugggcuugccggugc

SEQ ID NO: 364682 - RNA, 12 nt, Bordetella pertussis
acugggcgucgc

SEQ ID NO: 364683 - RNA, 17 nt, Bordetella pertussis
acugggugcgccugacc

SEQ ID NO: 364684 - RNA, 23 nt, Bordetella pertussis
acuggguggccagcgccgccagc

SEQ ID NO: 364685 - RNA, 20 nt, Bordetella pertussis
acugguagugcggcgccagc

SEQ ID NO: 364686 - RNA, 19 nt, Bordetella pertussis
acugguccuaaauugccgc

SEQ ID NO: 364687 - RNA, 16 nt, Bordetella pertussis
acugucgcgccacggc

SEQ ID NO: 364688 - RNA, 15 nt, Bordetella pertussis
acuucaccgaggcgc

SEQ ID NO: 364689 - RNA, 17 nt, Bordetella pertussis
acuuccucgaccagccc

SEQ ID NO: 364690 - RNA, 14 nt, Bordetella pertussis
acuuccucgacccg

SEQ ID NO: 364691 - RNA, 18 nt, Bordetella pertussis
acuuccucggcgcgcgcg

SEQ ID NO: 364692 - RNA, 19 nt, Bordetella pertussis
acuuccugguacaccgcga

SEQ ID NO: 364693 - RNA, 13 nt, Bordetella pertussis
acuuccugguggg

SEQ ID NO: 364694 - RNA, 18 nt, Bordetella pertussis
acuucgccgaucgagcag

SEQ ID NO: 364695 - RNA, 21 nt, Bordetella pertussis
acuucgccgaucgagcaggcc

SEQ ID NO: 364696 - RNA, 14 nt, Bordetella pertussis
acuucggucagcuu

SEQ ID NO: 364697 - RNA, 15 nt, Bordetella pertussis
acuucguccggcgcg

SEQ ID NO: 364698 - RNA, 16 nt, Bordetella pertussis
acuucgucgggcucgg

SEQ ID NO: 364699 - RNA, 16 nt, Bordetella pertussis
acuucguggcgcagcu

SEQ ID NO: 364700 - RNA, 17 nt, Bordetella pertussis
acuugaacggcgcggcc

SEQ ID NO: 364701 - RNA, 18 nt, Bordetella pertussis
acuugccggcgcucagcg

SEQ ID NO: 364702 - RNA, 21 nt, Bordetella pertussis
acuugccggcgcucagcgacg

SEQ ID NO: 364703 - RNA, 23 nt, Bordetella pertussis
acuugcgcagcgcggcguugacc

SEQ ID NO: 364704 - RNA, 14 nt, Bordetella pertussis
acuugcggcacgug

SEQ ID NO: 364705 - RNA, 16 nt, Bordetella pertussis
acuugcuccgguacgc

SEQ ID NO: 364706 - RNA, 19 nt, Bordetella pertussis
acuugcuccgguacgccug

SEQ ID NO: 364707 - RNA, 13 nt, Bordetella pertussis
acuugggcaggcc

SEQ ID NO: 364708 - RNA, 13 nt, Bordetella pertussis
acuugucgcgccc

SEQ ID NO: 364709 - RNA, 21 nt, Bordetella pertussis
acuuguugcgugccgcccagg

SEQ ID NO: 364710 - RNA, 14 nt, Bordetella pertussis
agaaagcgcggccg

SEQ ID NO: 364711 - RNA, 14 nt, Bordetella pertussis
agacguggcccgcg

SEQ ID NO: 364712 - RNA, 19 nt, Bordetella pertussis
agagcaccgagaccgggcg

SEQ ID NO: 364713 - RNA, 17 nt, Bordetella pertussis
agagcugcggcgcggcg

SEQ ID NO: 364714 - RNA, 20 nt, Bordetella pertussis
agaggcgcggcucgccggcc

SEQ ID NO: 364715 - RNA, 13 nt, Bordetella pertussis
agagggccugguc

SEQ ID NO: 364716 - RNA, 23 nt, Bordetella pertussis
agaucgcauuucucggccugggc

SEQ ID NO: 364717 - RNA, 21 nt, Bordetella pertussis
agaucgccaacgucggcagcc

SEQ ID NO: 364718 - RNA, 22 nt, Bordetella pertussis
agaucgauaccgucgcgcucga

SEQ ID NO: 364719 - RNA, 22 nt, Bordetella pertussis
agaucgcgccuaccggcgccga

SEQ ID NO: 364720 - RNA, 19 nt, Bordetella pertussis
agaucggcccggcgccggu

SEQ ID NO: 364721 - RNA, 16 nt, Bordetella pertussis
agaucggcgcuggccu

SEQ ID NO: 364722 - RNA, 22 nt, Bordetella pertussis
agaucggcgcuggccuggccgc

SEQ ID NO: 364723 - RNA, 16 nt, Bordetella pertussis
agaucguccagcgacu

SEQ ID NO: 364724 - RNA, 15 nt, Bordetella pertussis
agaucuggcgcguca

SEQ ID NO: 364725 - RNA, 14 nt, Bordetella pertussis
agaucuugccggcc

SEQ ID NO: 364726 - RNA, 19 nt, Bordetella pertussis
agaugaucuacgcgcgcgc

SEQ ID NO: 364727 - RNA, 20 nt, Bordetella pertussis
agaugaucuacgcgcgcgcc

SEQ ID NO: 364728 - RNA, 23 nt, Bordetella pertussis
agaugccagcggcgcagccggcc

SEQ ID NO: 364729 - RNA, 20 nt, Bordetella pertussis
agaugccgaacagccagggc

SEQ ID NO: 364730 - RNA, 23 nt, Bordetella pertussis
agaugccggucaggaugcgcgcc

SEQ ID NO: 364731 - RNA, 17 nt, Bordetella pertussis
agaugccguccuggccg

SEQ ID NO: 364732 - RNA, 12 nt, Bordetella pertussis
agaugcgccgca

SEQ ID NO: 364733 - RNA, 14 nt, Bordetella pertussis
agaugcgcgccagg

SEQ ID NO: 364734 - RNA, 15 nt, Bordetella pertussis
agaugcgcgccaggc

SEQ ID NO: 364735 - RNA, 18 nt, Bordetella pertussis
agauggccagcagcgccg

SEQ ID NO: 364736 - RNA, 20 nt, Bordetella pertussis
agauggccagcagcgccgcc

SEQ ID NO: 364737 - RNA, 18 nt, Bordetella pertussis
agauggguacagcgcgcc

SEQ ID NO: 364738 - RNA, 22 nt, Bordetella pertussis
agauguaccagcccagcccgcc

SEQ ID NO: 364739 - RNA, 15 nt, Bordetella pertussis
agcaaccccagcagc

SEQ ID NO: 364740 - RNA, 19 nt, Bordetella pertussis
agcaaccggaacaccagca

SEQ ID NO: 364741 - RNA, 20 nt, Bordetella pertussis
agcaacgccacgcgcggauc

SEQ ID NO: 364742 - RNA, 20 nt, Bordetella pertussis
agcaacggugagccggccac

SEQ ID NO: 364743 - RNA, 14 nt, Bordetella pertussis
agcaacuggggcgc

SEQ ID NO: 364744 - RNA, 19 nt, Bordetella pertussis
agcaaugacgacgccggcu

SEQ ID NO: 364745 - RNA, 20 nt, Bordetella pertussis
agcaauucguugaucuggcc

SEQ ID NO: 364746 - RNA, 17 nt, Bordetella pertussis
agcaauuaugcguggcc

SEQ ID NO: 364747 - RNA, 20 nt, Bordetella pertussis
agcaauuaugcguggccgcc

SEQ ID NO: 364748 - RNA, 18 nt, Bordetella pertussis
agcaccagcagccccagc

SEQ ID NO: 364749 - RNA, 22 nt, Bordetella pertussis
agcaccgaugcgccggccuggc

SEQ ID NO: 364750 - RNA, 12 nt, Bordetella pertussis
agcaccgccacg

SEQ ID NO: 364751 - RNA, 23 nt, Bordetella pertussis
agcaccgccacgcgguccagccc

SEQ ID NO: 364752 - RNA, 13 nt, Bordetella pertussis
agcaccgccagcg

SEQ ID NO: 364753 - RNA, 20 nt, Bordetella pertussis
agcaccgccagcgcgucguc

SEQ ID NO: 364754 - RNA, 18 nt, Bordetella pertussis
agcacggccacggccggc

SEQ ID NO: 364755 - RNA, 22 nt, Bordetella pertussis
agcacggccacggccggcagcg

SEQ ID NO: 364756 - RNA, 12 nt, Bordetella pertussis
agcacggccgcg

SEQ ID NO: 364757 - RNA, 15 nt, Bordetella pertussis
agcacggccgcggcc

SEQ ID NO: 364758 - RNA, 21 nt, Bordetella pertussis
agcacggccgcggccggcacg

SEQ ID NO: 364759 - RNA, 20 nt, Bordetella pertussis
agcacggcgaggaugccgcg

SEQ ID NO: 364760 - RNA, 17 nt, Bordetella pertussis
agcacggcguggcgcgc

SEQ ID NO: 364761 - RNA, 15 nt, Bordetella pertussis
agcacggucggcgcg

SEQ ID NO: 364762 - RNA, 13 nt, Bordetella pertussis
agcacguccagcg

SEQ ID NO: 364763 - RNA, 16 nt, Bordetella pertussis
agcacguccagcggcg

SEQ ID NO: 364764 - RNA, 19 nt, Bordetella pertussis
agcacguccagcggcgcga

SEQ ID NO: 364765 - RNA, 14 nt, Bordetella pertussis
agcacgucgcgcaa

SEQ ID NO: 364766 - RNA, 16 nt, Bordetella pertussis
agcacgucguagcgcu

SEQ ID NO: 364767 - RNA, 18 nt, Bordetella pertussis
agcagacgcuucaggccg

SEQ ID NO: 364768 - RNA, 13 nt, Bordetella pertussis
agcagcacgccca

SEQ ID NO: 364769 - RNA, 14 nt, Bordetella pertussis
agcagcacggccac

SEQ ID NO: 364770 - RNA, 13 nt, Bordetella pertussis
agcagcagcgggc

SEQ ID NO: 364771 - RNA, 23 nt, Bordetella pertussis
agcagcaggaacaggcugcgcag

SEQ ID NO: 364772 - RNA, 14 nt, Bordetella pertussis
agcagcaggccgua

SEQ ID NO: 364773 - RNA, 19 nt, Bordetella pertussis
agcagcaguugcagcauga

SEQ ID NO: 364774 - RNA, 16 nt, Bordetella pertussis
agcagcauggcgggcg

SEQ ID NO: 364775 - RNA, 17 nt, Bordetella pertussis
agcagcauuucgaugcg

SEQ ID NO: 364776 - RNA, 18 nt, Bordetella pertussis
agcaggcgcgcucaggcc

SEQ ID NO: 364777 - RNA, 15 nt, Bordetella pertussis
agcaggcgcgugcuc

SEQ ID NO: 364778 - RNA, 16 nt, Bordetella pertussis
agcaggcgcucggcuu

SEQ ID NO: 364779 - RNA, 14 nt, Bordetella pertussis
agcaggcgguacag

SEQ ID NO: 364780 - RNA, 16 nt, Bordetella pertussis
agcaggcucagcgggc

SEQ ID NO: 364781 - RNA, 16 nt, Bordetella pertussis
agcagggccacgccca

SEQ ID NO: 364782 - RNA, 13 nt, Bordetella pertussis
agcagggcgccga

SEQ ID NO: 364783 - RNA, 12 nt, Bordetella pertussis
agcagggcggcg

SEQ ID NO: 364784 - RNA, 19 nt, Bordetella pertussis
agcaggugaugcgcgcggc

SEQ ID NO: 364785 - RNA, 13 nt, Bordetella pertussis
agcagguggcgcu

SEQ ID NO: 364786 - RNA, 15 nt, Bordetella pertussis
agcagguggcgcugu

SEQ ID NO: 364787 - RNA, 21 nt, Bordetella pertussis
agcaguacacgcgcaacaugg

SEQ ID NO: 364788 - RNA, 14 nt, Bordetella pertussis
agcagucgcgcagc

SEQ ID NO: 364789 - RNA, 14 nt, Bordetella pertussis
agcauccgcgccag

SEQ ID NO: 364790 - RNA, 15 nt, Bordetella pertussis
agcaucuuggccgcc

SEQ ID NO: 364791 - RNA, 17 nt, Bordetella pertussis
agcaucuuggccgccac

SEQ ID NO: 364792 - RNA, 16 nt, Bordetella pertussis
agcaugaacggcagcg

SEQ ID NO: 364793 - RNA, 17 nt, Bordetella pertussis
agcaugaacggcagcgc

SEQ ID NO: 364794 - RNA, 21 nt, Bordetella pertussis
agcaugaucuugccgaccgcg

SEQ ID NO: 364795 - RNA, 21 nt, Bordetella pertussis
agcaugccgauguuguuggcc

SEQ ID NO: 364796 - RNA, 12 nt, Bordetella pertussis
agcaugcgcgcg

SEQ ID NO: 364797 - RNA, 16 nt, Bordetella pertussis
agcaugcgcgcgacuu

SEQ ID NO: 364798 - RNA, 16 nt, Bordetella pertussis
agcauggcgccagcug

SEQ ID NO: 364799 - RNA, 14 nt, Bordetella pertussis
agcauggcgccaug

SEQ ID NO: 364800 - RNA, 12 nt, Bordetella pertussis
agcauggcgcgc

SEQ ID NO: 364801 - RNA, 21 nt, Bordetella pertussis
agcauuugcgcgacggcggcc

SEQ ID NO: 364802 - RNA, 17 nt, Bordetella pertussis
agccacgccggcgcgcc

SEQ ID NO: 364803 - RNA, 13 nt, Bordetella pertussis
agccacggcccgc

SEQ ID NO: 364804 - RNA, 22 nt, Bordetella pertussis
agccacgugaagcgccgcgccu

SEQ ID NO: 364805 - RNA, 18 nt, Bordetella pertussis
agccacugcggcccgagc

SEQ ID NO: 364806 - RNA, 16 nt, Bordetella pertussis
agccagauaaaggccg

SEQ ID NO: 364807 - RNA, 12 nt, Bordetella pertussis
agccagauaccg

SEQ ID NO: 364808 - RNA, 18 nt, Bordetella pertussis
agccagcccuggcccagc

SEQ ID NO: 364809 - RNA, 19 nt, Bordetella pertussis
agccagccgccgcgcggcg

SEQ ID NO: 364810 - RNA, 18 nt, Bordetella pertussis
agccagcgccugcgcggc

SEQ ID NO: 364811 - RNA, 20 nt, Bordetella pertussis
agccagcgccugcgcggccu

SEQ ID NO: 364812 - RNA, 23 nt, Bordetella pertussis
agccaggauuucauggcaucggc

SEQ ID NO: 364813 - RNA, 16 nt, Bordetella pertussis
agccaggccucggcuc

SEQ ID NO: 364814 - RNA, 15 nt, Bordetella pertussis
agccaggcgccagcg

SEQ ID NO: 364815 - RNA, 19 nt, Bordetella pertussis
agccagguaagcuggcgcu

SEQ ID NO: 364816 - RNA, 15 nt, Bordetella pertussis
agccaucaucaucgu

SEQ ID NO: 364817 - RNA, 22 nt, Bordetella pertussis
agccaucaucaucgucggcgcc

SEQ ID NO: 364818 - RNA, 17 nt, Bordetella pertussis
agccauucgauggcggc

SEQ ID NO: 364819 - RNA, 21 nt, Bordetella pertussis
agccauucgauggcggcgcug

SEQ ID NO: 364820 - RNA, 13 nt, Bordetella pertussis
agccauucggcca

SEQ ID NO: 364821 - RNA, 16 nt, Bordetella pertussis
agccauugcccacagc

SEQ ID NO: 364822 - RNA, 12 nt, Bordetella pertussis
agcccaccagcg

SEQ ID NO: 364823 - RNA, 22 nt, Bordetella pertussis
agcccaccagcgccacgccggc

SEQ ID NO: 364824 - RNA, 16 nt, Bordetella pertussis
agcccaccgggccggc

SEQ ID NO: 364825 - RNA, 18 nt, Bordetella pertussis
agcccaccgggccggccu

SEQ ID NO: 364826 - RNA, 19 nt, Bordetella pertussis
agcccaccgggccggccug

SEQ ID NO: 364827 - RNA, 20 nt, Bordetella pertussis
agcccaccgggccggccugc

SEQ ID NO: 364828 - RNA, 15 nt, Bordetella pertussis
agcccagcacgacga

SEQ ID NO: 364829 - RNA, 20 nt, Bordetella pertussis
agcccaggcccacgccgcgu

SEQ ID NO: 364830 - RNA, 13 nt, Bordetella pertussis
agcccaggccgcc

SEQ ID NO: 364831 - RNA, 17 nt, Bordetella pertussis
agcccaggccgccggcg

SEQ ID NO: 364832 - RNA, 20 nt, Bordetella pertussis
agcccaggccgccggcggcg

SEQ ID NO: 364833 - RNA, 21 nt, Bordetella pertussis
agcccaggccgccggcggcgu

SEQ ID NO: 364834 - RNA, 16 nt, Bordetella pertussis
agcccaggcggcccag

SEQ ID NO: 364835 - RNA, 19 nt, Bordetella pertussis
agcccagguccagcgccac

SEQ ID NO: 364836 - RNA, 18 nt, Bordetella pertussis
agcccaguugcuggccca

SEQ ID NO: 364837 - RNA, 19 nt, Bordetella pertussis
agcccauguugaacugcag

SEQ ID NO: 364838 - RNA, 22 nt, Bordetella pertussis
agcccauguugaacugcaggcc

SEQ ID NO: 364839 - RNA, 16 nt, Bordetella pertussis
agccccacgccgaccu

SEQ ID NO: 364840 - RNA, 23 nt, Bordetella pertussis
agccccaggcaggcgggcccgca

SEQ ID NO: 364841 - RNA, 12 nt, Bordetella pertussis
agcccccgcgcu

SEQ ID NO: 364842 - RNA, 13 nt, Bordetella pertussis
agcccccugcggg

SEQ ID NO: 364843 - RNA, 15 nt, Bordetella pertussis
agccccgcggccgcg

SEQ ID NO: 364844 - RNA, 12 nt, Bordetella pertussis
agccccggcgcg

SEQ ID NO: 364845 - RNA, 12 nt, Bordetella pertussis
agccccugcggg

SEQ ID NO: 364846 - RNA, 14 nt, Bordetella pertussis
agcccgacggccag

SEQ ID NO: 364847 - RNA, 16 nt, Bordetella pertussis
agcccgacggccagcg

SEQ ID NO: 364848 - RNA, 16 nt, Bordetella pertussis
agcccgagcggcgcca

SEQ ID NO: 364849 - RNA, 21 nt, Bordetella pertussis
agcccgaggcacaaggccgag

SEQ ID NO: 364850 - RNA, 17 nt, Bordetella pertussis
agcccgauaugcagccg

SEQ ID NO: 364851 - RNA, 14 nt, Bordetella pertussis
agcccgaucgacgg

SEQ ID NO: 364852 - RNA, 15 nt, Bordetella pertussis
agcccgaucgacggc

SEQ ID NO: 364853 - RNA, 18 nt, Bordetella pertussis
agcccgaucgacggccgc

SEQ ID NO: 364854 - RNA, 16 nt, Bordetella pertussis
agcccgaugcgccagg

SEQ ID NO: 364855 - RNA, 18 nt, Bordetella pertussis
agcccgaugcgccaggcc

SEQ ID NO: 364856 - RNA, 17 nt, Bordetella pertussis
agcccgaugccgccaug

SEQ ID NO: 364857 - RNA, 23 nt, Bordetella pertussis
agcccgcacauacaaggcgcggc

SEQ ID NO: 364858 - RNA, 14 nt, Bordetella pertussis
agcccgcaccgccc

SEQ ID NO: 364859 - RNA, 15 nt, Bordetella pertussis
agcccgccaucgcgc

SEQ ID NO: 364860 - RNA, 13 nt, Bordetella pertussis
agcccgccaucgc

SEQ ID NO: 364861 - RNA, 18 nt, Bordetella pertussis
agcccgcccgcgagcggc

SEQ ID NO: 364862 - RNA, 21 nt, Bordetella pertussis
agcccgcccgcgagcggccag

SEQ ID NO: 364863 - RNA, 16 nt, Bordetella pertussis
agcccgccgagucggc

SEQ ID NO: 364864 - RNA, 14 nt, Bordetella pertussis
agcccgccggcgcg

SEQ ID NO: 364865 - RNA, 17 nt, Bordetella pertussis
agcccgccggcgcgcgc

SEQ ID NO: 364866 - RNA, 18 nt, Bordetella pertussis
agcccgccuggcgccgcg

SEQ ID NO: 364867 - RNA, 12 nt, Bordetella pertussis
agcccgcgccac

SEQ ID NO: 364868 - RNA, 13 nt, Bordetella pertussis
agcccgcgccacc

SEQ ID NO: 364869 - RNA, 16 nt, Bordetella pertussis
agcccgcgcgcguuca

SEQ ID NO: 364870 - RNA, 16 nt, Bordetella pertussis
agcccgcgcuggcgca

SEQ ID NO: 364871 - RNA, 17 nt, Bordetella pertussis
agcccgcgcuggcgcag

SEQ ID NO: 364872 - RNA, 11 nt, Bordetella pertussis
agcccgcggcc

SEQ ID NO: 364873 - RNA, 20 nt, Bordetella pertussis
agcccgcugccgagacggcc

SEQ ID NO: 364874 - RNA, 17 nt, Bordetella pertussis
agcccggccccaggccg

SEQ ID NO: 364875 - RNA, 12 nt, Bordetella pertussis
agcccggccgcc

SEQ ID NO: 364876 - RNA, 15 nt, Bordetella pertussis
agcccuacccugauc

SEQ ID NO: 364877 - RNA, 17 nt, Bordetella pertussis
agcccucgucgcggccg

SEQ ID NO: 364878 - RNA, 23 nt, Bordetella pertussis
agcccucgucgcggccguuggcg

SEQ ID NO: 364879 - RNA, 12 nt, Bordetella pertussis
agcccuggcgcu

SEQ ID NO: 364880 - RNA, 18 nt, Bordetella pertussis
agcccuggcgcugcagcg

SEQ ID NO: 364881 - RNA, 18 nt, Bordetella pertussis
agcccuggcuuggccgaa

SEQ ID NO: 364882 - RNA, 20 nt, Bordetella pertussis
agcccuucgacgcggcggcc

SEQ ID NO: 364883 - RNA, 21 nt, Bordetella pertussis
agcccuucgacgcggcggccg

SEQ ID NO: 364884 - RNA, 14 nt, Bordetella pertussis
agccgacaggcgcg

SEQ ID NO: 364885 - RNA, 14 nt, Bordetella pertussis
agccgaccgcgcgc

SEQ ID NO: 364886 - RNA, 15 nt, Bordetella pertussis
agccgaguggcgggc

SEQ ID NO: 364887 - RNA, 16 nt, Bordetella pertussis
agccgauacaggcgcu

SEQ ID NO: 364888 - RNA, 22 nt, Bordetella pertussis
agccgauaguccuggaauacgc

SEQ ID NO: 364889 - RNA, 13 nt, Bordetella pertussis
agccgauccgcga

SEQ ID NO: 364890 - RNA, 16 nt, Bordetella pertussis
agccgccagcgccugg

SEQ ID NO: 364891 - RNA, 18 nt, Bordetella pertussis
agccgccagcgccuggac

SEQ ID NO: 364892 - RNA, 19 nt, Bordetella pertussis
agccgccauaggcgcgcac

SEQ ID NO: 364893 - RNA, 21 nt, Bordetella pertussis
agccgccccacgagaagccga

SEQ ID NO: 364894 - RNA, 17 nt, Bordetella pertussis
agccgccccagcagcag

SEQ ID NO: 364895 - RNA, 20 nt, Bordetella pertussis
agccgccccggcgcggcgcg

SEQ ID NO: 364896 - RNA, 12 nt, Bordetella pertussis
agccgcccgccg

SEQ ID NO: 364897 - RNA, 19 nt, Bordetella pertussis
agccgcccgcggcggcccg

SEQ ID NO: 364898 - RNA, 22 nt, Bordetella pertussis
agccgcccggccggcacggccg

SEQ ID NO: 364899 - RNA, 23 nt, Bordetella pertussis
agccgccgacguagucgcgccag

SEQ ID NO: 364900 - RNA, 14 nt, Bordetella pertussis
agccgccgccauag

SEQ ID NO: 364901 - RNA, 13 nt, Bordetella pertussis
agccgcgccagcg

SEQ ID NO: 364902 - RNA, 14 nt, Bordetella pertussis
agccgcgccagcgc

SEQ ID NO: 364903 - RNA, 17 nt, Bordetella pertussis
agccgcgcgaccuuguc

SEQ ID NO: 364904 - RNA, 21 nt, Bordetella pertussis
agccguccucgcgggccuggc

SEQ ID NO: 364905 - RNA, 13 nt, Bordetella pertussis
agccgucgcgcug

SEQ ID NO: 364906 - RNA, 16 nt, Bordetella pertussis
agccgucgcgcugcaa

SEQ ID NO: 364907 - RNA, 14 nt, Bordetella pertussis
agccgucggcaugg

SEQ ID NO: 364908 - RNA, 13 nt, Bordetella pertussis
agccgucggccac

SEQ ID NO: 364909 - RNA, 18 nt, Bordetella pertussis
agccgucggccacguccg

SEQ ID NO: 364910 - RNA, 21 nt, Bordetella pertussis
agccgugaagaccaagaucaa

SEQ ID NO: 364911 - RNA, 15 nt, Bordetella pertussis
agccgugccgcgcgc

SEQ ID NO: 364912 - RNA, 18 nt, Bordetella pertussis
agccgugcucgugcgcau

SEQ ID NO: 364913 - RNA, 23 nt, Bordetella pertussis
agccguuggcgcccagcgccauc

SEQ ID NO: 364914 - RNA, 16 nt, Bordetella pertussis
agccguugcgccagcg

SEQ ID NO: 364915 - RNA, 20 nt, Bordetella pertussis
agccguugcgccagcggcga

SEQ ID NO: 364916 - RNA, 14 nt, Bordetella pertussis
agccuucggccggc

SEQ ID NO: 364917 - RNA, 16 nt, Bordetella pertussis
agccuucggccggcug

SEQ ID NO: 364918 - RNA, 18 nt, Bordetella pertussis
agccuucggccggcugcg

SEQ ID NO: 364919 - RNA, 14 nt, Bordetella pertussis
agccuugcgcggcc

SEQ ID NO: 364920 - RNA, 14 nt, Bordetella pertussis
agccuuggcccacu

SEQ ID NO: 364921 - RNA, 18 nt, Bordetella pertussis
agccuuggucagcgaauc

SEQ ID NO: 364922 - RNA, 21 nt, Bordetella pertussis
agccuuuccuccugccggcgg

SEQ ID NO: 364923 - RNA, 16 nt, Bordetella pertussis
agcgaaucguaggcgc

SEQ ID NO: 364924 - RNA, 21 nt, Bordetella pertussis
agcgacagcagggucggcccc

SEQ ID NO: 364925 - RNA, 15 nt, Bordetella pertussis
agcgacaucgugcug

SEQ ID NO: 364926 - RNA, 14 nt, Bordetella pertussis
agcgagagcgccac

SEQ ID NO: 364927 - RNA, 14 nt, Bordetella pertussis
agcgagccggccag

SEQ ID NO: 364928 - RNA, 16 nt, Bordetella pertussis
agcgaggcggcaagcg

SEQ ID NO: 364929 - RNA, 16 nt, Bordetella pertussis
agcgaguagacgcagc

SEQ ID NO: 364930 - RNA, 16 nt, Bordetella pertussis
agcgagucgaccaguu

SEQ ID NO: 364931 - RNA, 20 nt, Bordetella pertussis
agcgagugcgccccgccacg

SEQ ID NO: 364932 - RNA, 17 nt, Bordetella pertussis
agcgauccgaugcccgg

SEQ ID NO: 364933 - RNA, 21 nt, Bordetella pertussis
agcgcaauggacacagcggcg

SEQ ID NO: 364934 - RNA, 22 nt, Bordetella pertussis
agcgcaauggacacagcggcgc

SEQ ID NO: 364935 - RNA, 15 nt, Bordetella pertussis
agcgcacaggcggcg

SEQ ID NO: 364936 - RNA, 16 nt, Bordetella pertussis
agcgcacaggcggcgc

SEQ ID NO: 364937 - RNA, 17 nt, Bordetella pertussis
agcgcacaggcggcgcc

SEQ ID NO: 364938 - RNA, 18 nt, Bordetella pertussis
agcgcacaggcggcgccg

SEQ ID NO: 364939 - RNA, 20 nt, Bordetella pertussis
agcgcacaggcggcgccggc

SEQ ID NO: 364940 - RNA, 22 nt, Bordetella pertussis
agcgcacaggcggcgccggcac

SEQ ID NO: 364941 - RNA, 16 nt, Bordetella pertussis
agcgcaccaccaccau

SEQ ID NO: 364942 - RNA, 15 nt, Bordetella pertussis
agcgcaccaccagca

SEQ ID NO: 364943 - RNA, 22 nt, Bordetella pertussis
agcgcaccaccagcaccgccac

SEQ ID NO: 364944 - RNA, 13 nt, Bordetella pertussis
agcgcaccauggc

SEQ ID NO: 364945 - RNA, 17 nt, Bordetella pertussis
agcgcaccccggccgac

SEQ ID NO: 364946 - RNA, 23 nt, Bordetella pertussis
agcgcaccccggccgacggcaag

SEQ ID NO: 364947 - RNA, 16 nt, Bordetella pertussis
agcgcaccgacggcag

SEQ ID NO: 364948 - RNA, 18 nt, Bordetella pertussis
agcgcaccgacggcagcc

SEQ ID NO: 364949 - RNA, 22 nt, Bordetella pertussis
agcgcaccaguuucucggccac

SEQ ID NO: 364950 - RNA, 19 nt, Bordetella pertussis
agcgcacgcaccgcgccag

SEQ ID NO: 364951 - RNA, 21 nt, Bordetella pertussis
agcgcacgcaccgcgccagcg

SEQ ID NO: 364952 - RNA, 18 nt, Bordetella pertussis
agcgcacgcagcgcucau

SEQ ID NO: 364953 - RNA, 12 nt, Bordetella pertussis
agcgcacgcgca

SEQ ID NO: 364954 - RNA, 14 nt, Bordetella pertussis
agcgcacgcgcagc

SEQ ID NO: 364955 - RNA, 18 nt, Bordetella pertussis
agcgcacgcgcagcacgc

SEQ ID NO: 364956 - RNA, 14 nt, Bordetella pertussis
agcgcacgguccag

SEQ ID NO: 364957 - RNA, 22 nt, Bordetella pertussis
agcgcacgguccaggcggccgc

SEQ ID NO: 364958 - RNA, 14 nt, Bordetella pertussis
agcgcacgcugggc

SEQ ID NO: 364959 - RNA, 19 nt, Bordetella pertussis
agcgcagcaagcugcugcu

SEQ ID NO: 364960 - RNA, 18 nt, Bordetella pertussis
agcgcagcaccgcgcgca

SEQ ID NO: 364961 - RNA, 15 nt, Bordetella pertussis
agcgcagcaccggca

SEQ ID NO: 364962 - RNA, 13 nt, Bordetella pertussis
agcgcagcgccac

SEQ ID NO: 364963 - RNA, 14 nt, Bordetella pertussis
agcgcagcgccacg

SEQ ID NO: 364964 - RNA, 22 nt, Bordetella pertussis
agcgcaggaugggcagcucgcc

SEQ ID NO: 364965 - RNA, 24 nt, Bordetella pertussis
agcgcaucgccgcaggcgugcccu

SEQ ID NO: 364966 - RNA, 15 nt, Bordetella pertussis
agcgcaugccgucga

SEQ ID NO: 364967 - RNA, 17 nt, Bordetella pertussis
agcgcaugaugcugccg

SEQ ID NO: 364968 - RNA, 15 nt, Bordetella pertussis
agcgcauugccgccg

SEQ ID NO: 364969 - RNA, 14 nt, Bordetella pertussis
agcgccacagcgcc

SEQ ID NO: 364970 - RNA, 20 nt, Bordetella pertussis
agcgccaccaccggcacgcc

SEQ ID NO: 364971 - RNA, 23 nt, Bordetella pertussis
agcgccaccaccggcacgccggc

SEQ ID NO: 364972 - RNA, 13 nt, Bordetella pertussis
agcgccaccagca

SEQ ID NO: 364973 - RNA, 14 nt, Bordetella pertussis
agcgccaccggcug

SEQ ID NO: 364974 - RNA, 16 nt, Bordetella pertussis
agcgccacgacgccgu

SEQ ID NO: 364975 - RNA, 19 nt, Bordetella pertussis
agcgccacgccagcggcga

SEQ ID NO: 364976 - RNA, 14 nt, Bordetella pertussis
agcgccacgcccag

SEQ ID NO: 364977 - RNA, 20 nt, Bordetella pertussis
agcgccacgcccaggccgcu

SEQ ID NO: 364978 - RNA, 20 nt, Bordetella pertussis
agcgccacgcccuggcgguc

SEQ ID NO: 364979 - RNA, 12 nt, Bordetella pertussis
agcgccacgccg

SEQ ID NO: 364980 - RNA, 14 nt, Bordetella pertussis
agcgccacgccggc

SEQ ID NO: 364981 - RNA, 15 nt, Bordetella pertussis
agcgccacgccggcc

SEQ ID NO: 364982 - RNA, 16 nt, Bordetella pertussis
agcgccacgccggcca

SEQ ID NO: 364983 - RNA, 17 nt, Bordetella pertussis
agcgccacgccggccag

SEQ ID NO: 364984 - RNA, 13 nt, Bordetella pertussis
agcgccacgccgu

SEQ ID NO: 364985 - RNA, 16 nt, Bordetella pertussis
agcgccacggcgguga

SEQ ID NO: 364986 - RNA, 20 nt, Bordetella pertussis
agcgccagaaagcgcggccg

SEQ ID NO: 364987 - RNA, 14 nt, Bordetella pertussis
agcgccagcagggu

SEQ ID NO: 364988 - RNA, 17 nt, Bordetella pertussis
agcgccagcaccggcac

SEQ ID NO: 364989 - RNA, 18 nt, Bordetella pertussis
agcgccagcaccggcacg

SEQ ID NO: 364990 - RNA, 18 nt, Bordetella pertussis
agcgccagcgucaggcug

SEQ ID NO: 364991 - RNA, 15 nt, Bordetella pertussis
agcgccagcguggcc

SEQ ID NO: 364992 - RNA, 14 nt, Bordetella pertussis
agcgccccucgcgg

SEQ ID NO: 364993 - RNA, 15 nt, Bordetella pertussis
agcgccccucgcgga

SEQ ID NO: 364994 - RNA, 12 nt, Bordetella pertussis
agcgcccgccuu

SEQ ID NO: 364995 - RNA, 22 nt, Bordetella pertussis
agcgcccgccuucgcugacgcg

SEQ ID NO: 364996 - RNA, 14 nt, Bordetella pertussis
agcgcccgcgccau

SEQ ID NO: 364997 - RNA, 16 nt, Bordetella pertussis
agcgcccgcgccaucg

SEQ ID NO: 364998 - RNA, 20 nt, Bordetella pertussis
agcgcccgcgccaucgcguc

SEQ ID NO: 364999 - RNA, 22 nt, Bordetella pertussis
agcgcccgcgccaucgcgucga

SEQ ID NO: 365000 - RNA, 14 nt, Bordetella pertussis
agcgccgcggccac

SEQ ID NO: 365001 - RNA, 13 nt, Bordetella pertussis
agcgccgcggccg

SEQ ID NO: 365002 - RNA, 15 nt, Bordetella pertussis
agcgccgcggccggc

SEQ ID NO: 365003 - RNA, 20 nt, Bordetella pertussis
agcgccgcggccggcggcgc

SEQ ID NO: 365004 - RNA, 14 nt, Bordetella pertussis
agcgccgcgcgcuc

SEQ ID NO: 365005 - RNA, 18 nt, Bordetella pertussis
agcgccgcgucgagcgcg

SEQ ID NO: 365006 - RNA, 21 nt, Bordetella pertussis
agcgccgcgugguggcgcaga

SEQ ID NO: 365007 - RNA, 23 nt, Bordetella pertussis
agcgccgcucgacgucgcccugg

SEQ ID NO: 365008 - RNA, 13 nt, Bordetella pertussis
agcgccggcagcc

SEQ ID NO: 365009 - RNA, 14 nt, Bordetella pertussis
agcgccggcagccc

SEQ ID NO: 365010 - RNA, 22 nt, Bordetella pertussis
agcgccggcagccccagcgccc

SEQ ID NO: 365011 - RNA, 15 nt, Bordetella pertussis
agcgccggcaggcgc

SEQ ID NO: 365012 - RNA, 16 nt, Bordetella pertussis
agcgccggcaggcgcg

SEQ ID NO: 365013 - RNA, 20 nt, Bordetella pertussis
agcgccggcaggcgcgccag

SEQ ID NO: 365014 - RNA, 11 nt, Bordetella pertussis
agcgccggccc

SEQ ID NO: 365015 - RNA, 17 nt, Bordetella pertussis
agcgccucgcaucggcc

SEQ ID NO: 365016 - RNA, 17 nt, Bordetella pertussis
agcgccucgucgcgcaa

SEQ ID NO: 365017 - RNA, 13 nt, Bordetella pertussis
agcgccucguucc

SEQ ID NO: 365018 - RNA, 15 nt, Bordetella pertussis
agcgccucguuccug

SEQ ID NO: 365019 - RNA, 13 nt, Bordetella pertussis
agcgccugcagcg

SEQ ID NO: 365020 - RNA, 20 nt, Bordetella pertussis
agcgccugcauccggcccag

SEQ ID NO: 365021 - RNA, 13 nt, Bordetella pertussis
agcgccugccgcg

SEQ ID NO: 365022 - RNA, 16 nt, Bordetella pertussis
agcgccugcgcggccu

SEQ ID NO: 365023 - RNA, 13 nt, Bordetella pertussis
agcgccuggccga

SEQ ID NO: 365024 - RNA, 18 nt, Bordetella pertussis
agcgccuggccgagcgcg

SEQ ID NO: 365025 - RNA, 20 nt, Bordetella pertussis
agcgccuggccgagcgcggc

SEQ ID NO: 365026 - RNA, 13 nt, Bordetella pertussis
agcgccugcgcgg

SEQ ID NO: 365027 - RNA, 12 nt, Bordetella pertussis
agcgccuggcgg

SEQ ID NO: 365028 - RNA, 14 nt, Bordetella pertussis
agcgccuggcgggc

SEQ ID NO: 365029 - RNA, 15 nt, Bordetella pertussis
agcgcgaccggcgcg

SEQ ID NO: 365030 - RNA, 14 nt, Bordetella pertussis
agcgcgacggccuc

SEQ ID NO: 365031 - RNA, 17 nt, Bordetella pertussis
agcgcgaucucgcgcag

SEQ ID NO: 365032 - RNA, 16 nt, Bordetella pertussis
agcgcgaugccaucgc

SEQ ID NO: 365033 - RNA, 19 nt, Bordetella pertussis
agcgcgauucccuggcgcg

SEQ ID NO: 365034 - RNA, 23 nt, Bordetella pertussis
agcgcgauucccuggcgcgccag

SEQ ID NO: 365035 - RNA, 21 nt, Bordetella pertussis
agcgcgcacaaacgcacgauu

SEQ ID NO: 365036 - RNA, 22 nt, Bordetella pertussis
agcgcgccgggcgggucggcga

SEQ ID NO: 365037 - RNA, 15 nt, Bordetella pertussis
agcgcgccgggggcg

SEQ ID NO: 365038 - RNA, 16 nt, Bordetella pertussis
agcgcgccgcgcgcac

SEQ ID NO: 365039 - RNA, 21 nt, Bordetella pertussis
agcgcgccgcgcgcggcggcc

SEQ ID NO: 365040 - RNA, 13 nt, Bordetella pertussis
agcgcgccucgug

SEQ ID NO: 365041 - RNA, 22 nt, Bordetella pertussis
agcgcgccugcccaggccagcg

SEQ ID NO: 365042 - RNA, 16 nt, Bordetella pertussis
agcgcgcgcagccgcg

SEQ ID NO: 365043 - RNA, 20 nt, Bordetella pertussis
agcgcgcgcagccgcgccaa

SEQ ID NO: 365044 - RNA, 17 nt, Bordetella pertussis
agcgcgcgccggccgac

SEQ ID NO: 365045 - RNA, 10 nt, Bordetella pertussis
agcgcgcgcg

SEQ ID NO: 365046 - RNA, 18 nt, Bordetella pertussis
agcgcgcgcgaggcggcg

SEQ ID NO: 365047 - RNA, 21 nt, Bordetella pertussis
agcgcgcgcgaggcggcggcc

SEQ ID NO: 365048 - RNA, 15 nt, Bordetella pertussis
agcgcgcgcgccgac

SEQ ID NO: 365049 - RNA, 18 nt, Bordetella pertussis
agcgcgcggccggccgcg

SEQ ID NO: 365050 - RNA, 19 nt, Bordetella pertussis
agcgcgcggccggccgcgc

SEQ ID NO: 365051 - RNA, 20 nt, Bordetella pertussis
agcgcgcggccggccgcgcc

SEQ ID NO: 365052 - RNA, 13 nt, Bordetella pertussis
agcgcgcggccuc

SEQ ID NO: 365053 - RNA, 17 nt, Bordetella pertussis
agcgcgcggugccgccu

SEQ ID NO: 365054 - RNA, 17 nt, Bordetella pertussis
agcgcggcccgugccac

SEQ ID NO: 365055 - RNA, 14 nt, Bordetella pertussis
agcgcggccgggcu

SEQ ID NO: 365056 - RNA, 20 nt, Bordetella pertussis
agcgcggccgucaccgccgc

SEQ ID NO: 365057 - RNA, 12 nt, Bordetella pertussis
agcgcggccucg

SEQ ID NO: 365058 - RNA, 12 nt, Bordetella pertussis
agcgcggcgcca

SEQ ID NO: 365059 - RNA, 15 nt, Bordetella pertussis
agcgcggcgccggcc

SEQ ID NO: 365060 - RNA, 17 nt, Bordetella pertussis
agcgcggcgccggccuc

SEQ ID NO: 365061 - RNA, 18 nt, Bordetella pertussis
agcgcggcgccggccucc

SEQ ID NO: 365062 - RNA, 15 nt, Bordetella pertussis
agcgcggcgcgcgau

SEQ ID NO: 365063 - RNA, 15 nt, Bordetella pertussis
agcgcggcgcgcgcc

SEQ ID NO: 365064 - RNA, 17 nt, Bordetella pertussis
agcgcggcgcgcgccag

SEQ ID NO: 365065 - RNA, 18 nt, Bordetella pertussis
agcgcggcggccaugccc

SEQ ID NO: 365066 - RNA, 13 nt, Bordetella pertussis
agcgcggcggcga

SEQ ID NO: 365067 - RNA, 14 nt, Bordetella pertussis
agcgcggcggcgac

SEQ ID NO: 365068 - RNA, 21 nt, Bordetella pertussis
agcgcggcggcgaccggcgcc

SEQ ID NO: 365069 - RNA, 19 nt, Bordetella pertussis
agcgcggcggacugcgccg

SEQ ID NO: 365070 - RNA, 15 nt, Bordetella pertussis
agcgcggcggcagcg

SEQ ID NO: 365071 - RNA, 16 nt, Bordetella pertussis
agcgcggcgcggccag

SEQ ID NO: 365072 - RNA, 13 nt, Bordetella pertussis
agcgcggcggcgu

SEQ ID NO: 365073 - RNA, 15 nt, Bordetella pertussis
agcgcggcggcguga

SEQ ID NO: 365074 - RNA, 18 nt, Bordetella pertussis
agcgcggcgggcggcgcg

SEQ ID NO: 365075 - RNA, 19 nt, Bordetella pertussis
agcgcgguugacugcagcc

SEQ ID NO: 365076 - RNA, 14 nt, Bordetella pertussis
agcgcgucacgcug

SEQ ID NO: 365077 - RNA, 14 nt, Bordetella pertussis
agcgcguccaggug

SEQ ID NO: 365078 - RNA, 22 nt, Bordetella pertussis
agcgcguccaggugcggcggcg

SEQ ID NO: 365079 - RNA, 23 nt, Bordetella pertussis
agcgcguccaggugcggcggcga

SEQ ID NO: 365080 - RNA, 16 nt, Bordetella pertussis
agcgcgucgagcagcg

SEQ ID NO: 365081 - RNA, 18 nt, Bordetella pertussis
agcgcgucgagcaggccg

SEQ ID NO: 365082 - RNA, 19 nt, Bordetella pertussis
agcgcgucgagcaggccgg

SEQ ID NO: 365083 - RNA, 20 nt, Bordetella pertussis
agcgcgucgagcaggccggc

SEQ ID NO: 365084 - RNA, 22 nt, Bordetella pertussis
agcgcgucgagcaggccggcgu

SEQ ID NO: 365085 - RNA, 19 nt, Bordetella pertussis
agcgcgucgauggagucgg

SEQ ID NO: 365086 - RNA, 20 nt, Bordetella pertussis
agcgcucauguucgggcgcg

SEQ ID NO: 365087 - RNA, 18 nt, Bordetella pertussis
agcgcuccagcgucaugg

SEQ ID NO: 365088 - RNA, 15 nt, Bordetella pertussis
agcgcucccgccaac

SEQ ID NO: 365089 - RNA, 15 nt, Bordetella pertussis
agcgcucgccggcgc

SEQ ID NO: 365090 - RNA, 19 nt, Bordetella pertussis
agcgcucguccaugccggc

SEQ ID NO: 365091 - RNA, 14 nt, Bordetella pertussis
agcgcucuucgcgg

SEQ ID NO: 365092 - RNA, 23 nt, Bordetella pertussis
agcgcucuucgcgguacgcccag

SEQ ID NO: 365093 - RNA, 22 nt, Bordetella pertussis
agcgcuucugccagacggccag

SEQ ID NO: 365094 - RNA, 17 nt, Bordetella pertussis
agcgcuugcacgccaua

SEQ ID NO: 365095 - RNA, 17 nt, Bordetella pertussis
agcgcuugccugacgug

SEQ ID NO: 365096 - RNA, 20 nt, Bordetella pertussis
agcgcuugccugacgugcgc

SEQ ID NO: 365097 - RNA, 22 nt, Bordetella pertussis
agcggaaguauucgcgcggcga

SEQ ID NO: 365098 - RNA, 16 nt, Bordetella pertussis
agcggaaugauggugg

SEQ ID NO: 365099 - RNA, 16 nt, Bordetella pertussis
agcggaucgccgggca

SEQ ID NO: 365100 - RNA, 15 nt, Bordetella pertussis
agcggaucgcggcgc

SEQ ID NO: 365101 - RNA, 17 nt, Bordetella pertussis
agcggaugaugcggcgc

SEQ ID NO: 365102 - RNA, 14 nt, Bordetella pertussis
agcggcgauccgcc

SEQ ID NO: 365103 - RNA, 19 nt, Bordetella pertussis
agcggcgcaacccggccuc

SEQ ID NO: 365104 - RNA, 23 nt, Bordetella pertussis
agcggcgcaacccggccucgcug

SEQ ID NO: 365105 - RNA, 17 nt, Bordetella pertussis
agcggcgcagccggccg

SEQ ID NO: 365106 - RNA, 12 nt, Bordetella pertussis
agcggcgccagu

SEQ ID NO: 365107 - RNA, 12 nt, Bordetella pertussis
agcggcgccgcu

SEQ ID NO: 365108 - RNA, 15 nt, Bordetella pertussis
agcggcgccgcuucc

SEQ ID NO: 365109 - RNA, 16 nt, Bordetella pertussis
agcggcgcgacgcgcu

SEQ ID NO: 365110 - RNA, 15 nt, Bordetella pertussis
agcggcgcgagcgca

SEQ ID NO: 365111 - RNA, 12 nt, Bordetella pertussis
agcggcgcgcgc

SEQ ID NO: 365112 - RNA, 20 nt, Bordetella pertussis
agcggcgcgcccaccagggu

SEQ ID NO: 365113 - RNA, 18 nt, Bordetella pertussis
agcggcgugaugcccagg

SEQ ID NO: 365114 - RNA, 14 nt, Bordetella pertussis
agcggcgugcgcgu

SEQ ID NO: 365115 - RNA, 16 nt, Bordetella pertussis
agcggcgugcgcgugc

SEQ ID NO: 365116 - RNA, 16 nt, Bordetella pertussis
agcggcguggcgccga

SEQ ID NO: 365117 - RNA, 18 nt, Bordetella pertussis
agcggcguggcggccagg

SEQ ID NO: 365118 - RNA, 22 nt, Bordetella pertussis
agcggcguggcggccaggccgg

SEQ ID NO: 365119 - RNA, 19 nt, Bordetella pertussis
agcggcguggggccggccg

SEQ ID NO: 365120 - RNA, 21 nt, Bordetella pertussis
agcggcguggggccggccgcg

SEQ ID NO: 365121 - RNA, 21 nt, Bordetella pertussis
agcggcgugugcccagcacca

SEQ ID NO: 365122 - RNA, 23 nt, Bordetella pertussis
agcggcgugugcccagcaccagg

SEQ ID NO: 365123 - RNA, 17 nt, Bordetella pertussis
agcggcguucugcagcg

SEQ ID NO: 365124 - RNA, 13 nt, Bordetella pertussis
agcggcucaggcg

SEQ ID NO: 365125 - RNA, 13 nt, Bordetella pertussis
agcggcucgccuc

SEQ ID NO: 365126 - RNA, 17 nt, Bordetella pertussis
agcggcucgacgccgua

SEQ ID NO: 365127 - RNA, 19 nt, Bordetella pertussis
agcggcucgagcggcagca

SEQ ID NO: 365128 - RNA, 19 nt, Bordetella pertussis
agcggcuggccacuggccg

SEQ ID NO: 365129 - RNA, 23 nt, Bordetella pertussis
agcggcuggccacuggccgcgcu

SEQ ID NO: 365130 - RNA, 15 nt, Bordetella pertussis
agcggcuggcggugc

SEQ ID NO: 365131 - RNA, 17 nt, Bordetella pertussis
agcggcuucaugccggc

SEQ ID NO: 365132 - RNA, 16 nt, Bordetella pertussis
agcggcuucgagcgcg

SEQ ID NO: 365133 - RNA, 18 nt, Bordetella pertussis
agcgggcccgacagcgcc

SEQ ID NO: 365134 - RNA, 19 nt, Bordetella pertussis
agcgggcccgucgcgccag

SEQ ID NO: 365135 - RNA, 18 nt, Bordetella pertussis
agcgggccggcaccacga

SEQ ID NO: 365136 - RNA, 15 nt, Bordetella pertussis
agcgggccggucgcg

SEQ ID NO: 365137 - RNA, 18 nt, Bordetella pertussis
agcgggccggucgcgauc

SEQ ID NO: 365138 - RNA, 19 nt, Bordetella pertussis
agcgggugaugcugcagcg

SEQ ID NO: 365139 - RNA, 20 nt, Bordetella pertussis
agcggucgauguccagcgcc

SEQ ID NO: 365140 - RNA, 17 nt, Bordetella pertussis
agcggguugcgcgccag

SEQ ID NO: 365141 - RNA, 22 nt, Bordetella pertussis
agcggguugcggcagcgccgca

SEQ ID NO: 365142 - RNA, 15 nt, Bordetella pertussis
agcggugcgcggcgc

SEQ ID NO: 365143 - RNA, 20 nt, Bordetella pertussis
agcggugcggauacgcguca

SEQ ID NO: 365144 - RNA, 16 nt, Bordetella pertussis
agcguccgcgcgccgc

SEQ ID NO: 365145 - RNA, 20 nt, Bordetella pertussis
agcgucgcggcgucgaccgc

SEQ ID NO: 365146 - RNA, 18 nt, Bordetella pertussis
agcgucggccugcacgcu

SEQ ID NO: 365147 - RNA, 10 nt, Bordetella pertussis
agcgucggcg

SEQ ID NO: 365148 - RNA, 18 nt, Bordetella pertussis
agcgugaagucggccggc

SEQ ID NO: 365149 - RNA, 18 nt, Bordetella pertussis
agcgugaccgacaggccu

SEQ ID NO: 365150 - RNA, 21 nt, Bordetella pertussis
agcgugaugccgucgagcgcg

SEQ ID NO: 365151 - RNA, 21 nt, Bordetella pertussis
agcgugaugcggucggccaca

SEQ ID NO: 365152 - RNA, 21 nt, Bordetella pertussis
agcgugauggggccgggcgcc

SEQ ID NO: 365153 - RNA, 17 nt, Bordetella pertussis
agcgugccgccggcgcg

SEQ ID NO: 365154 - RNA, 15 nt, Bordetella pertussis
agcgugccgggaugc

SEQ ID NO: 365155 - RNA, 17 nt, Bordetella pertussis
agcgugcgccccgccuc

SEQ ID NO: 365156 - RNA, 17 nt, Bordetella pertussis
agcguggagcugcucac

SEQ ID NO: 365157 - RNA, 22 nt, Bordetella pertussis
agcguggcgcggguggccggau

SEQ ID NO: 365158 - RNA, 14 nt, Bordetella pertussis
agcguggccgccac

SEQ ID NO: 365159 - RNA, 20 nt, Bordetella pertussis
agcguggccgccaccagcgc

SEQ ID NO: 365160 - RNA, 20 nt, Bordetella pertussis
agcguggggacgcgggccac

SEQ ID NO: 365161 - RNA, 17 nt, Bordetella pertussis
agcguguagagcaggcc

SEQ ID NO: 365162 - RNA, 15 nt, Bordetella pertussis
agcguguaggcggcc

SEQ ID NO: 365163 - RNA, 18 nt, Bordetella pertussis
agcguguaggcggccggc

SEQ ID NO: 365164 - RNA, 20 nt, Bordetella pertussis
agcgugugucccggcggggc

SEQ ID NO: 365165 - RNA, 22 nt, Bordetella pertussis
agcgugugucccggcggggcag

SEQ ID NO: 365166 - RNA, 13 nt, Bordetella pertussis
agcguucauggcg

SEQ ID NO: 365167 - RNA, 13 nt, Bordetella pertussis
agcguucgcgcuu

SEQ ID NO: 365168 - RNA, 13 nt, Bordetella pertussis
agcguucggccac

SEQ ID NO: 365169 - RNA, 19 nt, Bordetella pertussis
agcguuggcggccggccag

SEQ ID NO: 365170 - RNA, 18 nt, Bordetella pertussis
agcguuuccagggcgcgc

SEQ ID NO: 365171 - RNA, 21 nt, Bordetella pertussis
agcguuuccagggcgcgccgc

SEQ ID NO: 365172 - RNA, 22 nt, Bordetella pertussis
agcguuuccagggcgcgccgca

SEQ ID NO: 365173 - RNA, 14 nt, Bordetella pertussis
agcucagcagcgcc

SEQ ID NO: 365174 - RNA, 20 nt, Bordetella pertussis
agcucauggcacagcgcggc

SEQ ID NO: 365175 - RNA, 14 nt, Bordetella pertussis
agcuccacgcacac

SEQ ID NO: 365176 - RNA, 22 nt, Bordetella pertussis
agcuccacgcacaccgcccgaa

SEQ ID NO: 365177 - RNA, 23 nt, Bordetella pertussis
agcuccaccccgguguaggcggg

SEQ ID NO: 365178 - RNA, 13 nt, Bordetella pertussis
agcuccagccgca

SEQ ID NO: 365179 - RNA, 13 nt, Bordetella pertussis
agcuccagccggg

SEQ ID NO: 365180 - RNA, 22 nt, Bordetella pertussis
agcuccagcgcuucgugcagcg

SEQ ID NO: 365181 - RNA, 22 nt, Bordetella pertussis
agcuccccgggcgugaccagcu

SEQ ID NO: 365182 - RNA, 21 nt, Bordetella pertussis
agcuccgauucucaccagcgc

SEQ ID NO: 365183 - RNA, 14 nt, Bordetella pertussis
agcuccggcggcag

SEQ ID NO: 365184 - RNA, 16 nt, Bordetella pertussis
agcuccggcggcagcg

SEQ ID NO: 365185 - RNA, 22 nt, Bordetella pertussis
agcuccucggccugccggcgcg

SEQ ID NO: 365186 - RNA, 20 nt, Bordetella pertussis
agcuccugcaggauggggcg

SEQ ID NO: 365187 - RNA, 15 nt, Bordetella pertussis
agcuccugcucgauc

SEQ ID NO: 365188 - RNA, 22 nt, Bordetella pertussis
agcuccugcucgauccgggcac

SEQ ID NO: 365189 - RNA, 22 nt, Bordetella pertussis
agcucgaccacggcggcuucgg

SEQ ID NO: 365190 - RNA, 13 nt, Bordetella pertussis
agcucgacgccau

SEQ ID NO: 365191 - RNA, 15 nt, Bordetella pertussis
agcucgacgccaucu

SEQ ID NO: 365192 - RNA, 22 nt, Bordetella pertussis
agcucgacgccaucucgcgcgc

SEQ ID NO: 365193 - RNA, 23 nt, Bordetella pertussis
agcucgacgccaucucgcgcgcu

SEQ ID NO: 365194 - RNA, 13 nt, Bordetella pertussis
agcucgacgcgcu

SEQ ID NO: 365195 - RNA, 20 nt, Bordetella pertussis
agcucgaccgucagcaugcc

SEQ ID NO: 365196 - RNA, 20 nt, Bordetella pertussis
agcucgauggcuucgcgcac

SEQ ID NO: 365197 - RNA, 21 nt, Bordetella pertussis
agcucgauggcuucgcgcaca

SEQ ID NO: 365198 - RNA, 22 nt, Bordetella pertussis
agcucgauggcuucgcgcacau

SEQ ID NO: 365199 - RNA, 13 nt, Bordetella pertussis
agcucgccggcga

SEQ ID NO: 365200 - RNA, 17 nt, Bordetella pertussis
agcucgccuucgcgauc

SEQ ID NO: 365201 - RNA, 12 nt, Bordetella pertussis
agcucgcgccag

SEQ ID NO: 365202 - RNA, 22 nt, Bordetella pertussis
agcucgcgcugcgcgccgccgc

SEQ ID NO: 365203 - RNA, 12 nt, Bordetella pertussis
agcucgcgcgcu

SEQ ID NO: 365204 - RNA, 23 nt, Bordetella pertussis
agcucgcguccgcucaugccggc

SEQ ID NO: 365205 - RNA, 12 nt, Bordetella pertussis
agcucggcaugg

SEQ ID NO: 365206 - RNA, 21 nt, Bordetella pertussis
agcucggcccauugcggcacc

SEQ ID NO: 365207 - RNA, 17 nt, Bordetella pertussis
agcucggcgaagccgca

SEQ ID NO: 365208 - RNA, 19 nt, Bordetella pertussis
agcucggcgaagccgcagc

SEQ ID NO: 365209 - RNA, 16 nt, Bordetella pertussis
agcucggcgaucugcg

SEQ ID NO: 365210 - RNA, 17 nt, Bordetella pertussis
agcucggcgaugcgcga

SEQ ID NO: 365211 - RNA, 16 nt, Bordetella pertussis
agcucggcggccgccu

SEQ ID NO: 365212 - RNA, 20 nt, Bordetella pertussis
agcucguccagguugcccga

SEQ ID NO: 365213 - RNA, 18 nt, Bordetella pertussis
agcucguguagggccugg

SEQ ID NO: 365214 - RNA, 22 nt, Bordetella pertussis
agcucguguagggccuggcgua

SEQ ID NO: 365215 - RNA, 18 nt, Bordetella pertussis
agcucuaugucgccggcc

SEQ ID NO: 365216 - RNA, 19 nt, Bordetella pertussis
agcucuaugucgccggcca

SEQ ID NO: 365217 - RNA, 20 nt, Bordetella pertussis
agcucuaugucgccggccag

SEQ ID NO: 365218 - RNA, 22 nt, Bordetella pertussis
agcucucgaagaagcagccgcg

SEQ ID NO: 365219 - RNA, 20 nt, Bordetella pertussis
agcucugguccaggcggugc

SEQ ID NO: 365220 - RNA, 20 nt, Bordetella pertussis
agcucuucgagcgcggcgcg

SEQ ID NO: 365221 - RNA, 23 nt, Bordetella pertussis
agcucuucgagcgcggcgcgcga

SEQ ID NO: 365222 - RNA, 15 nt, Bordetella pertussis
agcugacgaaacgcg

SEQ ID NO: 365223 - RNA, 14 nt, Bordetella pertussis
agcugaugcucgcc

SEQ ID NO: 365224 - RNA, 20 nt, Bordetella pertussis
agcugcacaagguccguuuc

SEQ ID NO: 365225 - RNA, 15 nt, Bordetella pertussis
agcugcacccacacu

SEQ ID NO: 365226 - RNA, 17 nt, Bordetella pertussis
agcugcagcccggccag

SEQ ID NO: 365227 - RNA, 20 nt, Bordetella pertussis
agcugcagcccggccagagc

SEQ ID NO: 365228 - RNA, 22 nt, Bordetella pertussis
agcugcaguaugcaaccggcac

SEQ ID NO: 365229 - RNA, 16 nt, Bordetella pertussis
agcugccggcauugcc

SEQ ID NO: 365230 - RNA, 20 nt, Bordetella pertussis
agcugccugagcaccgccgc

SEQ ID NO: 365231 - RNA, 17 nt, Bordetella pertussis
agcugcgaaagcgcguc

SEQ ID NO: 365232 - RNA, 16 nt, Bordetella pertussis
agcugcgcagcgacuc

SEQ ID NO: 365233 - RNA, 17 nt, Bordetella pertussis
agcugcggcgcggcgcg

SEQ ID NO: 365234 - RNA, 18 nt, Bordetella pertussis
aggaugcgcaccggccag

SEQ ID NO: 365235 - RNA, 15 nt, Bordetella pertussis
aggaugcgcgccagg

SEQ ID NO: 365236 - RNA, 14 nt, Bordetella pertussis
aggaugcgcgcggc

SEQ ID NO: 365237 - RNA, 17 nt, Bordetella pertussis
aggaugcgcggcacguu

SEQ ID NO: 365238 - RNA, 14 nt, Bordetella pertussis
aggaugggcagcuc

SEQ ID NO: 365239 - RNA, 21 nt, Bordetella pertussis
aggaugggcgcggcgcgcgcc

SEQ ID NO: 365240 - RNA, 12 nt, Bordetella pertussis
aggauggcgucg

SEQ ID NO: 365241 - RNA, 18 nt, Bordetella pertussis
aggauggcgucgaccgcc

SEQ ID NO: 365242 - RNA, 18 nt, Bordetella pertussis
aggauguccacggucgcc

SEQ ID NO: 365243 - RNA, 17 nt, Bordetella pertussis
aggcaugcgccagcgcc

SEQ ID NO: 365244 - RNA, 15 nt, Bordetella pertussis
aggcauucgaacaac

SEQ ID NO: 365245 - RNA, 21 nt, Bordetella pertussis
aggcauucgugaugccccagg

SEQ ID NO: 365246 - RNA, 15 nt, Bordetella pertussis
aggcauuggcggcgg

SEQ ID NO: 365247 - RNA, 18 nt, Bordetella pertussis
aggccaaaaaaaaccggc

SEQ ID NO: 365248 - RNA, 12 nt, Bordetella pertussis
aggccagcggcg

SEQ ID NO: 365249 - RNA, 15 nt, Bordetella pertussis
aggccaggcccucgc

SEQ ID NO: 365250 - RNA, 19 nt, Bordetella pertussis
aggccaggcccucgcggcc

SEQ ID NO: 365251 - RNA, 16 nt, Bordetella pertussis
aggccaggaagcggcg

SEQ ID NO: 365252 - RNA, 14 nt, Bordetella pertussis
aggccaggcugacc

SEQ ID NO: 365253 - RNA, 13 nt, Bordetella pertussis
aggccagcugcgc

SEQ ID NO: 365254 - RNA, 16 nt, Bordetella pertussis
aggccagugccuggac

SEQ ID NO: 365255 - RNA, 19 nt, Bordetella pertussis
aggccaguuccgugcgcgc

SEQ ID NO: 365256 - RNA, 21 nt, Bordetella pertussis
aggccaguuccgugcgcgccc

SEQ ID NO: 365257 - RNA, 15 nt, Bordetella pertussis
aggccaugaucaggc

SEQ ID NO: 365258 - RNA, 18 nt, Bordetella pertussis
aggccaugaucaggccga

SEQ ID NO: 365259 - RNA, 12 nt, Bordetella pertussis
aggccaucggcg

SEQ ID NO: 365260 - RNA, 20 nt, Bordetella pertussis
aggccaugcucguccaucgc

SEQ ID NO: 365261 - RNA, 20 nt, Bordetella pertussis
aggccauugaaagcgcgagc

SEQ ID NO: 365262 - RNA, 17 nt, Bordetella pertussis
aggccauugcuggcgcg

SEQ ID NO: 365263 - RNA, 19 nt, Bordetella pertussis
aggcccaccgcaucgcgca

SEQ ID NO: 365264 - RNA, 19 nt, Bordetella pertussis
aggcccacggcaucgccgc

SEQ ID NO: 365265 - RNA, 20 nt, Bordetella pertussis
aggcccagcacgcgcgccag

SEQ ID NO: 365266 - RNA, 22 nt, Bordetella pertussis
aggcccagcacgcgcgccagcu

SEQ ID NO: 365267 - RNA, 20 nt, Bordetella pertussis
aggcccagcaucaggcccga

SEQ ID NO: 365268 - RNA, 14 nt, Bordetella pertussis
aggcccagcgcgcc

SEQ ID NO: 365269 - RNA, 14 nt, Bordetella pertussis
aggcccagccagcc

SEQ ID NO: 365270 - RNA, 22 nt, Bordetella pertussis
aggcccagccagcccuggccca

SEQ ID NO: 365271 - RNA, 16 nt, Bordetella pertussis
aggcccagggccaggu

SEQ ID NO: 365272 - RNA, 17 nt, Bordetella pertussis
aggcccauaugccgccg

SEQ ID NO: 365273 - RNA, 21 nt, Bordetella pertussis
aggcccauaugccgccggccu

SEQ ID NO: 365274 - RNA, 23 nt, Bordetella pertussis
aggcccauaugccgccggccugc

SEQ ID NO: 365275 - RNA, 17 nt, Bordetella pertussis
aggcccaugacgccggu

SEQ ID NO: 365276 - RNA, 20 nt, Bordetella pertussis
aggccccgccgggccgcgcc

SEQ ID NO: 365277 - RNA, 12 nt, Bordetella pertussis
aggcccugcgcg

SEQ ID NO: 365278 - RNA, 18 nt, Bordetella pertussis
aggccgaaauggcggcgg

SEQ ID NO: 365279 - RNA, 17 nt, Bordetella pertussis
aggccgaauugccgccg

SEQ ID NO: 365280 - RNA, 12 nt, Bordetella pertussis
aggcccuggcgg

SEQ ID NO: 365281 - RNA, 17 nt, Bordetella pertussis
aggcccugggccagcag

SEQ ID NO: 365282 - RNA, 17 nt, Bordetella pertussis
aggccgacgcgcugucc

SEQ ID NO: 365283 - RNA, 21 nt, Bordetella pertussis
aggccgcagcgggcccgucgc

SEQ ID NO: 365284 - RNA, 22 nt, Bordetella pertussis
aggccgcauacgacacgucauc

SEQ ID NO: 365285 - RNA, 23 nt, Bordetella pertussis
aggccgcauacgacacgucaucg

SEQ ID NO: 365286 - RNA, 20 nt, Bordetella pertussis
aggccgcccagccgcgccag

SEQ ID NO: 365287 - RNA, 21 nt, Bordetella pertussis
aggccgcccagccgcgccagg

SEQ ID NO: 365288 - RNA, 22 nt, Bordetella pertussis
aggccgccgcgugcgccgggcu

SEQ ID NO: 365289 - RNA, 24 nt, Bordetella pertussis
aggccgccggccaccagcggcgcc

SEQ ID NO: 365290 - RNA, 14 nt, Bordetella pertussis
aggccgccggccag

SEQ ID NO: 365291 - RNA, 13 nt, Bordetella pertussis
aggccgccggccu

SEQ ID NO: 365292 - RNA, 12 nt, Bordetella pertussis
aggccgccggcg

SEQ ID NO: 365293 - RNA, 14 nt, Bordetella pertussis
aggccgccggcgcg

SEQ ID NO: 365294 - RNA, 17 nt, Bordetella pertussis
aggccgccggcggcguc

SEQ ID NO: 365295 - RNA, 13 nt, Bordetella pertussis
aggccgccggcca

SEQ ID NO: 365296 - RNA, 16 nt, Bordetella pertussis
aggccgcgaacgcgcc

SEQ ID NO: 365297 - RNA, 21 nt, Bordetella pertussis
aggccgcgaacgcgccggccc

SEQ ID NO: 365298 - RNA, 18 nt, Bordetella pertussis
aggccgcgaugucgcgcg

SEQ ID NO: 365299 - RNA, 19 nt, Bordetella pertussis
aggccgcgaugucgcgcgc

SEQ ID NO: 365300 - RNA, 20 nt, Bordetella pertussis
aggccgcgaugucgcgcgcg

SEQ ID NO: 365301 - RNA, 15 nt, Bordetella pertussis
aggccgcgcagcacg

SEQ ID NO: 365302 - RNA, 21 nt, Bordetella pertussis
aggccgcgcagcacgcccgcg

SEQ ID NO: 365303 - RNA, 12 nt, Bordetella pertussis
aggccgcgccac

SEQ ID NO: 365304 - RNA, 20 nt, Bordetella pertussis
aggccgccuauguaggcgcc

SEQ ID NO: 365305 - RNA, 14 nt, Bordetella pertussis
aggccgcgccggcu

SEQ ID NO: 365306 - RNA, 22 nt, Bordetella pertussis
aggccgcgccggcucccgcgcu

SEQ ID NO: 365307 - RNA, 23 nt, Bordetella pertussis
aggccgcgccggcucccgcgcug

SEQ ID NO: 365308 - RNA, 20 nt, Bordetella pertussis
aggccgcgccuauaucgacg

SEQ ID NO: 365309 - RNA, 15 nt, Bordetella pertussis
aggccgcgcgugcgg

SEQ ID NO: 365310 - RNA, 19 nt, Bordetella pertussis
aggccgcgcgugcggggcg

SEQ ID NO: 365311 - RNA, 13 nt, Bordetella pertussis
aggccgcgcugcc

SEQ ID NO: 365312 - RNA, 21 nt, Bordetella pertussis
aggccgcgcuggugcuggccg

SEQ ID NO: 365313 - RNA, 16 nt, Bordetella pertussis
aggccgcuacggcggu

SEQ ID NO: 365314 - RNA, 15 nt, Bordetella pertussis
aggccgcugggcaca

SEQ ID NO: 365315 - RNA, 17 nt, Bordetella pertussis
aggccgcuucgugcggc

SEQ ID NO: 365316 - RNA, 19 nt, Bordetella pertussis
aggccgcuucgugcggccg

SEQ ID NO: 365317 - RNA, 21 nt, Bordetella pertussis
aggccgcuuucgaccagcgac

SEQ ID NO: 365318 - RNA, 19 nt, Bordetella pertussis
aggccggaaaugccgcgcg

SEQ ID NO: 365319 - RNA, 23 nt, Bordetella pertussis
aggccggcaagaugccggccugu

SEQ ID NO: 365320 - RNA, 20 nt, Bordetella pertussis
aggccggcacguccggcacg

SEQ ID NO: 365321 - RNA, 16 nt, Bordetella pertussis
aggccggcaugcgccg

SEQ ID NO: 365322 - RNA, 20 nt, Bordetella pertussis
aggccggcaugcgccggccc

SEQ ID NO: 365323 - RNA, 13 nt, Bordetella pertussis
aggccggcccagu

SEQ ID NO: 365324 - RNA, 17 nt, Bordetella pertussis
aggccggcccgccccac

SEQ ID NO: 365325 - RNA, 23 nt, Bordetella pertussis
aggccggcccgccccacggcgag

SEQ ID NO: 365326 - RNA, 24 nt, Bordetella pertussis
aggccggccugcaaugcggccagg

SEQ ID NO: 365327 - RNA, 15 nt, Bordetella pertussis
aggccggccagcaag

SEQ ID NO: 365328 - RNA, 16 nt, Bordetella pertussis
aggccggcgcgccggc

SEQ ID NO: 365329 - RNA, 18 nt, Bordetella pertussis
aggccggcgcgccggccc

SEQ ID NO: 365330 - RNA, 16 nt, Bordetella pertussis
aggccggcgcgcgcgu

SEQ ID NO: 365331 - RNA, 22 nt, Bordetella pertussis
aggccggcgcgcgcguacagcc

SEQ ID NO: 365332 - RNA, 14 nt, Bordetella pertussis
aggccggcggcacg

SEQ ID NO: 365333 - RNA, 17 nt, Bordetella pertussis
aggccggcggccagcgc

SEQ ID NO: 365334 - RNA, 20 nt, Bordetella pertussis
aggccggcggccagcgcgcc

SEQ ID NO: 365335 - RNA, 22 nt, Bordetella pertussis
aggccggcggccagcgcgccgc

SEQ ID NO: 365336 - RNA, 13 nt, Bordetella pertussis
aggccggcggcga

SEQ ID NO: 365337 - RNA, 14 nt, Bordetella pertussis
aggccggcggcggg

SEQ ID NO: 365338 - RNA, 13 nt, Bordetella pertussis
aggccggcggcgu

SEQ ID NO: 365339 - RNA, 14 nt, Bordetella pertussis
aggccggcgccagc

SEQ ID NO: 365340 - RNA, 18 nt, Bordetella pertussis
aggccggcgucuggagcg

SEQ ID NO: 365341 - RNA, 16 nt, Bordetella pertussis
aggccggcucgccgca

SEQ ID NO: 365342 - RNA, 15 nt, Bordetella pertussis
aggccggggccgccc

SEQ ID NO: 365343 - RNA, 17 nt, Bordetella pertussis
aggccggggccgcccag

SEQ ID NO: 365344 - RNA, 20 nt, Bordetella pertussis
aggccguaaccggccagucc

SEQ ID NO: 365345 - RNA, 20 nt, Bordetella pertussis
aggccguggcccagccgcau

SEQ ID NO: 365346 - RNA, 17 nt, Bordetella pertussis
aggccguggcgcaccag

SEQ ID NO: 365347 - RNA, 19 nt, Bordetella pertussis
aggccguggcgcaccaggu

SEQ ID NO: 365348 - RNA, 18 nt, Bordetella pertussis
aggccguuccaguccagc

SEQ ID NO: 365349 - RNA, 23 nt, Bordetella pertussis
aggccguugccgcuguggcgcgc

SEQ ID NO: 365350 - RNA, 14 nt, Bordetella pertussis
aggccguuggccgc

SEQ ID NO: 365351 - RNA, 17 nt, Bordetella pertussis
aggccguuggccgcgcg

SEQ ID NO: 365352 - RNA, 23 nt, Bordetella pertussis
aggccguuguccuggcgcgccag

SEQ ID NO: 365353 - RNA, 15 nt, Bordetella pertussis
aggcgauccaggcca

SEQ ID NO: 365354 - RNA, 16 nt, Bordetella pertussis
aggcgauccaggccac

SEQ ID NO: 365355 - RNA, 23 nt, Bordetella pertussis
aggcgauggccgggagcggccag

SEQ ID NO: 365356 - RNA, 13 nt, Bordetella pertussis
aggcgcaugccac

SEQ ID NO: 365357 - RNA, 21 nt, Bordetella pertussis
aggcgcauguccgccacgccg

SEQ ID NO: 365358 - RNA, 18 nt, Bordetella pertussis
aggcgcauucgcgccuga

SEQ ID NO: 365359 - RNA, 19 nt, Bordetella pertussis
aggcgcauucgcgccugag

SEQ ID NO: 365360 - RNA, 14 nt, Bordetella pertussis
aggcgcccggcgug

SEQ ID NO: 365361 - RNA, 15 nt, Bordetella pertussis
aggcgcccggcguga

SEQ ID NO: 365362 - RNA, 16 nt, Bordetella pertussis
aggcgcccggcgugac

SEQ ID NO: 365363 - RNA, 18 nt, Bordetella pertussis
aggcgcccgugcgcggcg

SEQ ID NO: 365364 - RNA, 12 nt, Bordetella pertussis
aggcgccgcaac

SEQ ID NO: 365365 - RNA, 14 nt, Bordetella pertussis
aggcgccgccgccc

SEQ ID NO: 365366 - RNA, 16 nt, Bordetella pertussis
aggcgccgccgcccgg

SEQ ID NO: 365367 - RNA, 20 nt, Bordetella pertussis
aggcgccgccgcccggcaac

SEQ ID NO: 365368 - RNA, 17 nt, Bordetella pertussis
aggcgccgccgugcgcg

SEQ ID NO: 365369 - RNA, 21 nt, Bordetella pertussis
aggcgccgccgugcgcgggcg

SEQ ID NO: 365370 - RNA, 23 nt, Bordetella pertussis
aggcgccgccgugcgcgggcgcg

SEQ ID NO: 365371 - RNA, 13 nt, Bordetella pertussis
aggcgccgcgccc

SEQ ID NO: 365372 - RNA, 21 nt, Bordetella pertussis
aggcgccgcgcccguccacgg

SEQ ID NO: 365373 - RNA, 19 nt, Bordetella pertussis
aggcgccgcguccggcgcc

SEQ ID NO: 365374 - RNA, 17 nt, Bordetella pertussis
aggcgcccgacggcgcg

SEQ ID NO: 365375 - RNA, 12 nt, Bordetella pertussis
aggcgcggcaaa

SEQ ID NO: 365376 - RNA, 18 nt, Bordetella pertussis
aggcgcggcucgccggcc

SEQ ID NO: 365377 - RNA, 20 nt, Bordetella pertussis
aggcgcgugaggucgcgcgu

SEQ ID NO: 365378 - RNA, 19 nt, Bordetella pertussis
aggcgcgugcgcaggcgcg

SEQ ID NO: 365379 - RNA, 22 nt, Bordetella pertussis
aggcgcucagccgugccgcgcg

SEQ ID NO: 365380 - RNA, 13 nt, Bordetella pertussis
aggcgcuccaugg

SEQ ID NO: 365381 - RNA, 17 nt, Bordetella pertussis
aggcgcuccauggcgcc

SEQ ID NO: 365382 - RNA, 19 nt, Bordetella pertussis
aggcgcuccauggcgccgg

SEQ ID NO: 365383 - RNA, 13 nt, Bordetella pertussis
aggcgcucgcgcg

SEQ ID NO: 365384 - RNA, 14 nt, Bordetella pertussis
aggcgcucgcgcgc

SEQ ID NO: 365385 - RNA, 16 nt, Bordetella pertussis
aggcgcucgcgcgcca

SEQ ID NO: 365386 - RNA, 17 nt, Bordetella pertussis
aggcgcucgcgcgccag

SEQ ID NO: 365387 - RNA, 14 nt, Bordetella pertussis
aggcgcucgcgcug

SEQ ID NO: 365388 - RNA, 23 nt, Bordetella pertussis
aggcgcucgaucggauagcggug

SEQ ID NO: 365389 - RNA, 14 nt, Bordetella pertussis
aggcgcucggccag

SEQ ID NO: 365390 - RNA, 12 nt, Bordetella pertussis
aggcgcugcgcg

SEQ ID NO: 365391 - RNA, 12 nt, Bordetella pertussis
aggcgcuggccg

SEQ ID NO: 365392 - RNA, 20 nt, Bordetella pertussis
aggcgcuggccggcgugccc

SEQ ID NO: 365393 - RNA, 20 nt, Bordetella pertussis
aggcgcugguaguaggccac

SEQ ID NO: 365394 - RNA, 22 nt, Bordetella pertussis
aggcgcuguucgauacggccac

SEQ ID NO: 365395 - RNA, 16 nt, Bordetella pertussis
aggcgggacuggcgag

SEQ ID NO: 365396 - RNA, 20 nt, Bordetella pertussis
aggcgggcagcauggcgcca

SEQ ID NO: 365397 - RNA, 22 nt, Bordetella pertussis
aggcgggcagcauggcgccaug

SEQ ID NO: 365398 - RNA, 15 nt, Bordetella pertussis
aggcgggcagcggcg

SEQ ID NO: 365399 - RNA, 17 nt, Bordetella pertussis
aggcgggcaucgcccac

SEQ ID NO: 365400 - RNA, 19 nt, Bordetella pertussis
aggcgggcgccgcgcccgg

SEQ ID NO: 365401 - RNA, 21 nt, Bordetella pertussis
aggcgggguggcacagccgca

SEQ ID NO: 365402 - RNA, 18 nt, Bordetella pertussis
aggcgggcuggucgcgcc

SEQ ID NO: 365403 - RNA, 21 nt, Bordetella pertussis
aggcgguacaggccggcggcg

SEQ ID NO: 365404 - RNA, 23 nt, Bordetella pertussis
aggcggguguagaagaacagcag

SEQ ID NO: 365405 - RNA, 22 nt, Bordetella pertussis
aggcggucauagacggcgucgg

SEQ ID NO: 365406 - RNA, 18 nt, Bordetella pertussis
aggcggugccccggccuc

SEQ ID NO: 365407 - RNA, 23 nt, Bordetella pertussis
aggcgucugcuacaccgugcugg

SEQ ID NO: 365408 - RNA, 21 nt, Bordetella pertussis
aggcgugaacgccccggccga

SEQ ID NO: 365409 - RNA, 21 nt, Bordetella pertussis
aggcgugcgcgggcgccaucg

SEQ ID NO: 365410 - RNA, 22 nt, Bordetella pertussis
aggcgugcccgguucugcggcg

SEQ ID NO: 365411 - RNA, 15 nt, Bordetella pertussis
aggcgugccgcgcag

SEQ ID NO: 365412 - RNA, 15 nt, Bordetella pertussis
aggcgugcugcaccu

SEQ ID NO: 365413 - RNA, 14 nt, Bordetella pertussis
aggcguucggccac

SEQ ID NO: 365414 - RNA, 15 nt, Bordetella pertussis
aggcucaccucgcgc

SEQ ID NO: 365415 - RNA, 14 nt, Bordetella pertussis
aggcucaggcggcc

SEQ ID NO: 365416 - RNA, 16 nt, Bordetella pertussis
aggcucaggcggccag

SEQ ID NO: 365417 - RNA, 17 nt, Bordetella pertussis
aggcugcagcuugcgcg

SEQ ID NO: 365418 - RNA, 19 nt, Bordetella pertussis
aggcugcagcuugcgcgcc

SEQ ID NO: 365419 - RNA, 21 nt, Bordetella pertussis
aggcugcagcuugcgcgccag

SEQ ID NO: 365420 - RNA, 23 nt, Bordetella pertussis
aggcugcccuggcccaggccgaa

SEQ ID NO: 365421 - RNA, 16 nt, Bordetella pertussis
aggcugcgcaggcgcc

SEQ ID NO: 365422 - RNA, 18 nt, Bordetella pertussis
aggcugcgcaggcgccgc

SEQ ID NO: 365423 - RNA, 17 nt, Bordetella pertussis
aggcugcgcgccggcgc

SEQ ID NO: 365424 - RNA, 18 nt, Bordetella pertussis
aggcugcgcgccggcgcc

SEQ ID NO: 365425 - RNA, 16 nt, Bordetella pertussis
aggcugcgcgcgccag

SEQ ID NO: 365426 - RNA, 19 nt, Bordetella pertussis
aggcugcgcgcgccagcgc

SEQ ID NO: 365427 - RNA, 21 nt, Bordetella pertussis
aggcugcggcggauucaggcg

SEQ ID NO: 365428 - RNA, 23 nt, Bordetella pertussis
aggcuuugucguugauggggccg

SEQ ID NO: 365429 - RNA, 19 nt, Bordetella pertussis
agggaaaacagcgcgggcg

SEQ ID NO: 365430 - RNA, 23 nt, Bordetella pertussis
aggcuuucgcaauacgucgcgac

SEQ ID NO: 365431 - RNA, 22 nt, Bordetella pertussis
aggcuuucgcacagccggggcg

SEQ ID NO: 365432 - RNA, 16 nt, Bordetella pertussis
agggacgggccagccc

SEQ ID NO: 365433 - RNA, 16 nt, Bordetella pertussis
agggaucagcccaguu

SEQ ID NO: 365434 - RNA, 16 nt, Bordetella pertussis
agggcacaucggccac

SEQ ID NO: 365435 - RNA, 20 nt, Bordetella pertussis
agggcacaucggccacccgg

SEQ ID NO: 365436 - RNA, 15 nt, Bordetella pertussis
agggcagcggccaga

SEQ ID NO: 365437 - RNA, 13 nt, Bordetella pertussis
agggcagggcgcc

SEQ ID NO: 365438 - RNA, 15 nt, Bordetella pertussis
agggcagggcgccgu

SEQ ID NO: 365439 - RNA, 16 nt, Bordetella pertussis
agggcagggcgccguc

SEQ ID NO: 365440 - RNA, 18 nt, Bordetella pertussis
agggcaugggcccgggcg

SEQ ID NO: 365441 - RNA, 14 nt, Bordetella pertussis
agggccacgcccac

SEQ ID NO: 365442 - RNA, 14 nt, Bordetella pertussis
agggccacgccggc

SEQ ID NO: 365443 - RNA, 18 nt, Bordetella pertussis
agggccacgcgcuugcgc

SEQ ID NO: 365444 - RNA, 19 nt, Bordetella pertussis
agggccacgcgcuugcgcg

SEQ ID NO: 365445 - RNA, 23 nt, Bordetella pertussis
agggccacgcgcuugcgcgccac

SEQ ID NO: 365446 - RNA, 14 nt, Bordetella pertussis
agggccagcgccag

SEQ ID NO: 365447 - RNA, 20 nt, Bordetella pertussis
agggguccguggcggccgcg

SEQ ID NO: 365448 - RNA, 18 nt, Bordetella pertussis
agggucaaggcgcggccg

SEQ ID NO: 365449 - RNA, 15 nt, Bordetella pertussis
agggugccgccuucg

SEQ ID NO: 365450 - RNA, 14 nt, Bordetella pertussis
agggugcggcgcca

SEQ ID NO: 365451 - RNA, 18 nt, Bordetella pertussis
agggugggcacgcgcgcg

SEQ ID NO: 365452 - RNA, 17 nt, Bordetella pertussis
agggugucgccggggcg

SEQ ID NO: 365453 - RNA, 20 nt, Bordetella pertussis
agguacccccagcggcgcac

SEQ ID NO: 365454 - RNA, 21 nt, Bordetella pertussis
agguacccccagcggcgcacc

SEQ ID NO: 365455 - RNA, 17 nt, Bordetella pertussis
agguacccgcgccggcg

SEQ ID NO: 365456 - RNA, 23 nt, Bordetella pertussis
agguagaccacgcgcugcgcgcc

SEQ ID NO: 365457 - RNA, 15 nt, Bordetella pertussis
agguaggccggcgcg

SEQ ID NO: 365458 - RNA, 13 nt, Bordetella pertussis
agguaggcggcgc

SEQ ID NO: 365459 - RNA, 15 nt, Bordetella pertussis
aggucagcccggcgg

SEQ ID NO: 365460 - RNA, 17 nt, Bordetella pertussis
aggucaucaccagggug

SEQ ID NO: 365461 - RNA, 19 nt, Bordetella pertussis
aggucaucgccaggcgcgu

SEQ ID NO: 365462 - RNA, 23 nt, Bordetella pertussis
aggucaugcagaacagggugccg

SEQ ID NO: 365463 - RNA, 17 nt, Bordetella pertussis
agguccagcgccacggc

SEQ ID NO: 365464 - RNA, 21 nt, Bordetella pertussis
aggucgaugccggcggccugc

SEQ ID NO: 365465 - RNA, 13 nt, Bordetella pertussis
aggucggcgccca

SEQ ID NO: 365466 - RNA, 18 nt, Bordetella pertussis
aggucggcgcccacgccg

SEQ ID NO: 365467 - RNA, 15 nt, Bordetella pertussis
aggucggcggccagc

SEQ ID NO: 365468 - RNA, 14 nt, Bordetella pertussis
aggucggcgucguc

SEQ ID NO: 365469 - RNA, 19 nt, Bordetella pertussis
aggucgggauaguccagca

SEQ ID NO: 365470 - RNA, 23 nt, Bordetella pertussis
aggucgggcacgaucaccgccgc

SEQ ID NO: 365471 - RNA, 21 nt, Bordetella pertussis
aggucguacagcgccugcgcg

SEQ ID NO: 365472 - RNA, 21 nt, Bordetella pertussis
aggucguagaccgccgcgccc

SEQ ID NO: 365473 - RNA, 21 nt, Bordetella pertussis
aggucugcacgaggcgcucgg

SEQ ID NO: 365474 - RNA, 21 nt, Bordetella pertussis
aggucugggccagcaggcuca

SEQ ID NO: 365475 - RNA, 19 nt, Bordetella pertussis
aggugaucugguccacggc

SEQ ID NO: 365476 - RNA, 17 nt, Bordetella pertussis
aggugaugauggccgag

SEQ ID NO: 365477 - RNA, 22 nt, Bordetella pertussis
aggugaugcgcgcggccagcgc

SEQ ID NO: 365478 - RNA, 23 nt, Bordetella pertussis
aggugcacgugggcacgccggcc

SEQ ID NO: 365479 - RNA, 18 nt, Bordetella pertussis
aggugcccaucaggccga

SEQ ID NO: 365480 - RNA, 14 nt, Bordetella pertussis
aggugccgccggcg

SEQ ID NO: 365481 - RNA, 23 nt, Bordetella pertussis
aggugccgcguaugcggcagcag

SEQ ID NO: 365482 - RNA, 16 nt, Bordetella pertussis
aggugccggacgcccu

SEQ ID NO: 365483 - RNA, 16 nt, Bordetella pertussis
aggugccguccggcac

SEQ ID NO: 365484 - RNA, 21 nt, Bordetella pertussis
aggugccguccggcaccucga

SEQ ID NO: 365485 - RNA, 14 nt, Bordetella pertussis
aggugcgcagccgg

SEQ ID NO: 365486 - RNA, 15 nt, Bordetella pertussis
aggugcgcagccggg

SEQ ID NO: 365487 - RNA, 14 nt, Bordetella pertussis
aggugcgccgcucg

SEQ ID NO: 365488 - RNA, 13 nt, Bordetella pertussis
aggugcggccgca

SEQ ID NO: 365489 - RNA, 16 nt, Bordetella pertussis
agguggacacgcccau

SEQ ID NO: 365490 - RNA, 17 nt, Bordetella pertussis
agguggacagcgccagc

SEQ ID NO: 365491 - RNA, 12 nt, Bordetella pertussis
agguggcacauc

SEQ ID NO: 365492 - RNA, 13 nt, Bordetella pertussis
agguggccagccc

SEQ ID NO: 365493 - RNA, 14 nt, Bordetella pertussis
agguggcgaugccg

SEQ ID NO: 365494 - RNA, 17 nt, Bordetella pertussis
agguggcgaugccgggc

SEQ ID NO: 365495 - RNA, 12 nt, Bordetella pertussis
agguggcggcgg

SEQ ID NO: 365496 - RNA, 14 nt, Bordetella pertussis
aggugggcgcgcuc

SEQ ID NO: 365497 - RNA, 13 nt, Bordetella pertussis
agguggucagcau

SEQ ID NO: 365498 - RNA, 18 nt, Bordetella pertussis
agguguaaucgugccgga

SEQ ID NO: 365499 - RNA, 14 nt, Bordetella pertussis
agguguucgcgcac

SEQ ID NO: 365500 - RNA, 16 nt, Bordetella pertussis
agguguugaccacgcc

SEQ ID NO: 365501 - RNA, 22 nt, Bordetella pertussis
agguucugcgcguccuggcgcg

SEQ ID NO: 365502 - RNA, 14 nt, Bordetella pertussis
agguugaagccgac

SEQ ID NO: 365503 - RNA, 15 nt, Bordetella pertussis
agguugaaguugcuc

SEQ ID NO: 365504 - RNA, 22 nt, Bordetella pertussis
agguugaaguugcucggcggca

SEQ ID NO: 365505 - RNA, 14 nt, Bordetella pertussis
agguugcgccggcu

SEQ ID NO: 365506 - RNA, 24 nt, Bordetella pertussis
agguugcgguaguucagcagcgcc

SEQ ID NO: 365507 - RNA, 21 nt, Bordetella pertussis
agguuguccagcgcgcccagc

SEQ ID NO: 365508 - RNA, 23 nt, Bordetella pertussis
agguuuuccacagccaggccgau

SEQ ID NO: 365509 - RNA, 23 nt, Bordetella pertussis
aguaaucgcgcgccaccgccaga

SEQ ID NO: 365510 - RNA, 14 nt, Bordetella pertussis
aguacacggccagc

SEQ ID NO: 365511 - RNA, 16 nt, Bordetella pertussis
agucauguagcggccg

SEQ ID NO: 365512 - RNA, 19 nt, Bordetella pertussis
agucauguagcggccgccc

SEQ ID NO: 365513 - RNA, 16 nt, Bordetella pertussis
agucccgcaccgggca

SEQ ID NO: 365514 - RNA, 20 nt, Bordetella pertussis
aguccgacgacaaacccgac

SEQ ID NO: 365515 - RNA, 22 nt, Bordetella pertussis
aguccgcgcucgcccagccgcc

SEQ ID NO: 365516 - RNA, 18 nt, Bordetella pertussis
aguccugcaucgccaugc

SEQ ID NO: 365517 - RNA, 19 nt, Bordetella pertussis
aguccugcgaucaguucgg

SEQ ID NO: 365518 - RNA, 22 nt, Bordetella pertussis
aguccugguuggccucgcgcuc

SEQ ID NO: 365519 - RNA, 19 nt, Bordetella pertussis
aguccuucagccgcugacu

SEQ ID NO: 365520 - RNA, 17 nt, Bordetella pertussis
agucgagcaccgcgcgg

SEQ ID NO: 365521 - RNA, 21 nt, Bordetella pertussis
agugguaugaccggcgcggcc

SEQ ID NO: 365522 - RNA, 14 nt, Bordetella pertussis
aguggucgccggcg

SEQ ID NO: 365523 - RNA, 15 nt, Bordetella pertussis
aguggucgccggcgc

SEQ ID NO: 365524 - RNA, 13 nt, Bordetella pertussis
aguggugcgcggu

SEQ ID NO: 365525 - RNA, 21 nt, Bordetella pertussis
agugguggugcagcggcagca

SEQ ID NO: 365526 - RNA, 19 nt, Bordetella pertussis
aguucaucaucgccgacgc

SEQ ID NO: 365527 - RNA, 22 nt, Bordetella pertussis
aguuccaggcauucccgcccag

SEQ ID NO: 365528 - RNA, 15 nt, Bordetella pertussis
aguuccgugcgcgcc

SEQ ID NO: 365529 - RNA, 12 nt, Bordetella pertussis
aguucggugcgg

SEQ ID NO: 365530 - RNA, 23 nt, Bordetella pertussis
aguucgucccagggggucagggc

SEQ ID NO: 365531 - RNA, 20 nt, Bordetella pertussis
aguucgucgucggucggcuu

SEQ ID NO: 365532 - RNA, 21 nt, Bordetella pertussis
aguugaaccgcaacgccagca

SEQ ID NO: 365533 - RNA, 16 nt, Bordetella pertussis
aguugaaucggcgcga

SEQ ID NO: 365534 - RNA, 21 nt, Bordetella pertussis
aguugacgccggcggcgugcg

SEQ ID NO: 365535 - RNA, 23 nt, Bordetella pertussis
aguugacccauaccagcccggcg

SEQ ID NO: 365536 - RNA, 17 nt, Bordetella pertussis
aguugaggaugcgcgcg

SEQ ID NO: 365537 - RNA, 23 nt, Bordetella pertussis
aguugcaccagugcgccggcgcg

SEQ ID NO: 365538 - RNA, 14 nt, Bordetella pertussis
aguugucgccauac

SEQ ID NO: 365539 - RNA, 13 nt, Bordetella pertussis
auaaggcgugccg

SEQ ID NO: 365540 - RNA, 18 nt, Bordetella pertussis
auaaggcuucucgaccag

SEQ ID NO: 365541 - RNA, 20 nt, Bordetella pertussis
auaaggcuucucgaccaggc

SEQ ID NO: 365542 - RNA, 16 nt, Bordetella pertussis
auacagcuuggcgcgc

SEQ ID NO: 365543 - RNA, 18 nt, Bordetella pertussis
auacccgcuucgacggcu

SEQ ID NO: 365544 - RNA, 23 nt, Bordetella pertussis
auaccgaaucgaacuuggcgcgg

SEQ ID NO: 365545 - RNA, 17 nt, Bordetella pertussis
auaccgccgccgcucgu

SEQ ID NO: 365546 - RNA, 16 nt, Bordetella pertussis
auaccgcuggccaggc

SEQ ID NO: 365547 - RNA, 19 nt, Bordetella pertussis
auacguccuuuggcgucga

SEQ ID NO: 365548 - RNA, 20 nt, Bordetella pertussis
auacgucgcagcacgcccag

SEQ ID NO: 365549 - RNA, 20 nt, Bordetella pertussis
auacugcgcaugggcgcagg

SEQ ID NO: 365550 - RNA, 14 nt, Bordetella pertussis
auagacggcgucgg

SEQ ID NO: 365551 - RNA, 20 nt, Bordetella pertussis
auagcccgcggccaccaggc

SEQ ID NO: 365552 - RNA, 17 nt, Bordetella pertussis
auagcccgugcgggccu

SEQ ID NO: 365553 - RNA, 14 nt, Bordetella pertussis
auauccaggcgcgu

SEQ ID NO: 365554 - RNA, 22 nt, Bordetella pertussis
auauccagguaggcggcgcgcc

SEQ ID NO: 365555 - RNA, 20 nt, Bordetella pertussis
auaucccugcggcagcgacu

SEQ ID NO: 365556 - RNA, 22 nt, Bordetella pertussis
auaugcgagacgaaggcgccgg

SEQ ID NO: 365557 - RNA, 19 nt, Bordetella pertussis
aucaacgggccgcugguca

SEQ ID NO: 365558 - RNA, 13 nt, Bordetella pertussis
aucaaggcccgga

SEQ ID NO: 365559 - RNA, 16 nt, Bordetella pertussis
aucaaggccgauagcg

SEQ ID NO: 365560 - RNA, 22 nt, Bordetella pertussis
aucaaugccaaucaugcgcugc

SEQ ID NO: 365561 - RNA, 15 nt, Bordetella pertussis
aucacauaggccggc

SEQ ID NO: 365562 - RNA, 20 nt, Bordetella pertussis
aucaccacgggcacgauggc

SEQ ID NO: 365563 - RNA, 14 nt, Bordetella pertussis
aucacgagcagguu

SEQ ID NO: 365564 - RNA, 19 nt, Bordetella pertussis
aucacgccgaucuucugga

SEQ ID NO: 365565 - RNA, 23 nt, Bordetella pertussis
aucacgcgcuccggcugcgcgcg

SEQ ID NO: 365566 - RNA, 19 nt, Bordetella pertussis
aucacgcguacggcccugg

SEQ ID NO: 365567 - RNA, 19 nt, Bordetella pertussis
aucacgcuaaauacgcugg

SEQ ID NO: 365568 - RNA, 18 nt, Bordetella pertussis
aucacgggaaugaagcgc

SEQ ID NO: 365569 - RNA, 19 nt, Bordetella pertussis
aucacgggcgccagcagcg

SEQ ID NO: 365570 - RNA, 21 nt, Bordetella pertussis
aucacgggcgccagcagcggg

SEQ ID NO: 365571 - RNA, 23 nt, Bordetella pertussis
aucacggugucgaugggcccggg

SEQ ID NO: 365572 - RNA, 16 nt, Bordetella pertussis
aucagaaaggcagcgg

SEQ ID NO: 365573 - RNA, 15 nt, Bordetella pertussis
aucagauggcgcagc

SEQ ID NO: 365574 - RNA, 16 nt, Bordetella pertussis
aucagcacgaucuggc

SEQ ID NO: 365575 - RNA, 20 nt, Bordetella pertussis
aucagcacgaucuggcgcgc

SEQ ID NO: 365576 - RNA, 16 nt, Bordetella pertussis
aucagcacgauggugu

SEQ ID NO: 365577 - RNA, 16 nt, Bordetella pertussis
aucagcagacccuggc

SEQ ID NO: 365578 - RNA, 23 nt, Bordetella pertussis
aucagcagacccuggcgcgcguu

SEQ ID NO: 365579 - RNA, 16 nt, Bordetella pertussis
aucagcauaucgucgc

SEQ ID NO: 365580 - RNA, 15 nt, Bordetella pertussis
aucagcauggcgugc

SEQ ID NO: 365581 - RNA, 14 nt, Bordetella pertussis
aucagcgcgccguc

SEQ ID NO: 365582 - RNA, 16 nt, Bordetella pertussis
aucagcgcgucggcgc

SEQ ID NO: 365583 - RNA, 19 nt, Bordetella pertussis
aucagcgcgucggcgccga

SEQ ID NO: 365584 - RNA, 20 nt, Bordetella pertussis
aucagcggauugaccagcgc

SEQ ID NO: 365585 - RNA, 20 nt, Bordetella pertussis
aucagcggcagcacgauggc

SEQ ID NO: 365586 - RNA, 19 nt, Bordetella pertussis
aucagcggcggcacgcgcg

SEQ ID NO: 365587 - RNA, 15 nt, Bordetella pertussis
aucagcgggcuggcc

SEQ ID NO: 365588 - RNA, 17 nt, Bordetella pertussis
aucagcgugccgccggc

SEQ ID NO: 365589 - RNA, 15 nt, Bordetella pertussis
aucccugcggcagcg

SEQ ID NO: 365590 - RNA, 18 nt, Bordetella pertussis
aucccuugugcgcgccaa

SEQ ID NO: 365591 - RNA, 19 nt, Bordetella pertussis
auccgcaaaguccucgcac

SEQ ID NO: 365592 - RNA, 16 nt, Bordetella pertussis
auccgcggguucggcg

SEQ ID NO: 365593 - RNA, 21 nt, Bordetella pertussis
auccggcgugguaucgcgcca

SEQ ID NO: 365594 - RNA, 13 nt, Bordetella pertussis
auccgggcccggu

SEQ ID NO: 365595 - RNA, 13 nt, Bordetella pertussis
auccgggccuggc

SEQ ID NO: 365596 - RNA, 17 nt, Bordetella pertussis
auccgggcgcugcgccg

SEQ ID NO: 365597 - RNA, 17 nt, Bordetella pertussis
auccuagucaugcguga

SEQ ID NO: 365598 - RNA, 16 nt, Bordetella pertussis
auccucgccagcggca

SEQ ID NO: 365599 - RNA, 17 nt, Bordetella pertussis
auccucgcccagcggcg

SEQ ID NO: 365600 - RNA, 16 nt, Bordetella pertussis
auccucgcugccggcg

SEQ ID NO: 365601 - RNA, 13 nt, Bordetella pertussis
auccugcggcgcg

SEQ ID NO: 365602 - RNA, 15 nt, Bordetella pertussis
auccugcggcgcggu

SEQ ID NO: 365603 - RNA, 22 nt, Bordetella pertussis
auccuggcucugaucgcgcugg

SEQ ID NO: 365604 - RNA, 13 nt, Bordetella pertussis
auccuugcgcucg

SEQ ID NO: 365605 - RNA, 22 nt, Bordetella pertussis
auccuuuuuguuuuggcgcacg

SEQ ID NO: 365606 - RNA, 16 nt, Bordetella pertussis
aucgaacgcggccaga

SEQ ID NO: 365607 - RNA, 16 nt, Bordetella pertussis
aucgaacucgauccgg

SEQ ID NO: 365608 - RNA, 16 nt, Bordetella pertussis
aucgaacuuggcgcgg

SEQ ID NO: 365609 - RNA, 16 nt, Bordetella pertussis
aucgaauggucggccu

SEQ ID NO: 365610 - RNA, 12 nt, Bordetella pertussis
aucgacaagcgc

SEQ ID NO: 365611 - RNA, 14 nt, Bordetella pertussis
aucgacagcgcgcc

SEQ ID NO: 365612 - RNA, 16 nt, Bordetella pertussis
aucgacaggaacagca

SEQ ID NO: 365613 - RNA, 18 nt, Bordetella pertussis
aucgacccaggccggcgc

SEQ ID NO: 365614 - RNA, 20 nt, Bordetella pertussis
aucgacccaggccggcgcca

SEQ ID NO: 365615 - RNA, 19 nt, Bordetella pertussis
aucgaccgcauagcgcaug

SEQ ID NO: 365616 - RNA, 14 nt, Bordetella pertussis
aucgacaugcuggc

SEQ ID NO: 365617 - RNA, 12 nt, Bordetella pertussis
aucgacgcgcgu

SEQ ID NO: 365618 - RNA, 13 nt, Bordetella pertussis
aucgacgcggcga

SEQ ID NO: 365619 - RNA, 16 nt, Bordetella pertussis
aucgacgcggcgacgu

SEQ ID NO: 365620 - RNA, 16 nt, Bordetella pertussis
aucgacgggcggcugc

SEQ ID NO: 365621 - RNA, 15 nt, Bordetella pertussis
aucgacgucggccuc

SEQ ID NO: 365622 - RNA, 14 nt, Bordetella pertussis
aucgacucggccga

SEQ ID NO: 365623 - RNA, 20 nt, Bordetella pertussis
aucgagcgccugggcggcca

SEQ ID NO: 365624 - RNA, 17 nt, Bordetella pertussis
aucgagcgcgguggccg

SEQ ID NO: 365625 - RNA, 14 nt, Bordetella pertussis
aucgccaugccggc

SEQ ID NO: 365626 - RNA, 16 nt, Bordetella pertussis
aucgcccaccaugagc

SEQ ID NO: 365627 - RNA, 16 nt, Bordetella pertussis
aucgcccauugcggcg

SEQ ID NO: 365628 - RNA, 19 nt, Bordetella pertussis
aucgcccgcgugcgugccg

SEQ ID NO: 365629 - RNA, 16 nt, Bordetella pertussis
aucgcccgggcgccgg

SEQ ID NO: 365630 - RNA, 20 nt, Bordetella pertussis
aucgcccgggcgccggcacg

SEQ ID NO: 365631 - RNA, 16 nt, Bordetella pertussis
aucgccgccagcuugg

SEQ ID NO: 365632 - RNA, 12 nt, Bordetella pertussis
aucgccgccgaa

SEQ ID NO: 365633 - RNA, 15 nt, Bordetella pertussis
aucgccgccgccggc

SEQ ID NO: 365634 - RNA, 13 nt, Bordetella pertussis
aucgccgccggca

SEQ ID NO: 365635 - RNA, 18 nt, Bordetella pertussis
aucgccgccugcaucacg

SEQ ID NO: 365636 - RNA, 17 nt, Bordetella pertussis
aucgccgggcaggcauu

SEQ ID NO: 365637 - RNA, 20 nt, Bordetella pertussis
aucgccgguagcgcugggcg

SEQ ID NO: 365638 - RNA, 20 nt, Bordetella pertussis
aucgcgcagcgugcggacca

SEQ ID NO: 365639 - RNA, 15 nt, Bordetella pertussis
aucgcgcauggcgau

SEQ ID NO: 365640 - RNA, 17 nt, Bordetella pertussis
aucgcgccagcgccgcg

SEQ ID NO: 365641 - RNA, 20 nt, Bordetella pertussis
aucgcgccagcgccgcgcgc

SEQ ID NO: 365642 - RNA, 21 nt, Bordetella pertussis
aucgcgccagcgccgcgcgcg

SEQ ID NO: 365643 - RNA, 12 nt, Bordetella pertussis
aucgcgcccagc

SEQ ID NO: 365644 - RNA, 22 nt, Bordetella pertussis
aucgcgccggccugggcggcgg

SEQ ID NO: 365645 - RNA, 16 nt, Bordetella pertussis
aucgcgcugacagcgc

SEQ ID NO: 365646 - RNA, 14 nt, Bordetella pertussis
aucgcgcuggcgcg

SEQ ID NO: 365647 - RNA, 21 nt, Bordetella pertussis
aucgcgcuggcgcgcgacggc

SEQ ID NO: 365648 - RNA, 23 nt, Bordetella pertussis
aucgcgcuggcgguggccgcgca

SEQ ID NO: 365649 - RNA, 23 nt, Bordetella pertussis
aucgcgcuucucggugcgccgcc

SEQ ID NO: 365650 - RNA, 12 nt, Bordetella pertussis
aucgcggcagcc

SEQ ID NO: 365651 - RNA, 21 nt, Bordetella pertussis
aucgcggcagcccggcacguc

SEQ ID NO: 365652 - RNA, 17 nt, Bordetella pertussis
aucgcuaugcagcugcg

SEQ ID NO: 365653 - RNA, 14 nt, Bordetella pertussis
aucggcaaggcgca

SEQ ID NO: 365654 - RNA, 18 nt, Bordetella pertussis
aucggcaccucggcgccg

SEQ ID NO: 365655 - RNA, 15 nt, Bordetella pertussis
aucggccaggccggc

SEQ ID NO: 365656 - RNA, 19 nt, Bordetella pertussis
aucggcccgcgccagcgcc

SEQ ID NO: 365657 - RNA, 21 nt, Bordetella pertussis
aucggcccgcgccagcgccac

SEQ ID NO: 365658 - RNA, 21 nt, Bordetella pertussis
aucggcccguuccacaggcga

SEQ ID NO: 365659 - RNA, 19 nt, Bordetella pertussis
aucggccggcggucgcgcu

SEQ ID NO: 365660 - RNA, 23 nt, Bordetella pertussis
aucggccggcggucgcgcuggcc

SEQ ID NO: 365661 - RNA, 16 nt, Bordetella pertussis
aucggcgaaguccugc

SEQ ID NO: 365662 - RNA, 18 nt, Bordetella pertussis
aucggcgacgaucccgac

SEQ ID NO: 365663 - RNA, 11 nt, Bordetella pertussis
aucggcgccgc

SEQ ID NO: 365664 - RNA, 16 nt, Bordetella pertussis
aucggcgccuggccgc

SEQ ID NO: 365665 - RNA, 15 nt, Bordetella pertussis
aucggcgcgagcgau

SEQ ID NO: 365666 - RNA, 18 nt, Bordetella pertussis
aucggcgcgcgcugcacg

SEQ ID NO: 365667 - RNA, 13 nt, Bordetella pertussis
aucggcggcaggu

SEQ ID NO: 365668 - RNA, 13 nt, Bordetella pertussis
aucggcgucggca

SEQ ID NO: 365669 - RNA, 15 nt, Bordetella pertussis
aucgucuacgcgaac

SEQ ID NO: 365670 - RNA, 23 nt, Bordetella pertussis
aucgugcacgcccgcggcgccca

SEQ ID NO: 365671 - RNA, 13 nt, Bordetella pertussis
aucgugccgggga

SEQ ID NO: 365672 - RNA, 23 nt, Bordetella pertussis
aucgugccggggaucaccagccc

SEQ ID NO: 365673 - RNA, 15 nt, Bordetella pertussis
aucguugucgcgccg

SEQ ID NO: 365674 - RNA, 13 nt, Bordetella pertussis
aucuacgcgcgcg

SEQ ID NO: 365675 - RNA, 19 nt, Bordetella pertussis
aucucggccagcagcgccu

SEQ ID NO: 365676 - RNA, 18 nt, Bordetella pertussis
aucucgggcgaggucagc

SEQ ID NO: 365677 - RNA, 12 nt, Bordetella pertussis
aucugcggcacc

SEQ ID NO: 365678 - RNA, 19 nt, Bordetella pertussis
aucugcggcaccucggccg

SEQ ID NO: 365679 - RNA, 12 nt, Bordetella pertussis
aucugcggcacg

SEQ ID NO: 365680 - RNA, 12 nt, Bordetella pertussis
aucugcggcgug

SEQ ID NO: 365681 - RNA, 16 nt, Bordetella pertussis
aucugcuugccguuca

SEQ ID NO: 365682 - RNA, 15 nt, Bordetella pertussis
aucuggaccgcgcgc

SEQ ID NO: 365683 - RNA, 23 nt, Bordetella pertussis
aucuggcaaucgggguggcgccg

SEQ ID NO: 365684 - RNA, 19 nt, Bordetella pertussis
aucuggccugucugguggc

SEQ ID NO: 365685 - RNA, 19 nt, Bordetella pertussis
aucuggcgcgcgaccaggc

SEQ ID NO: 365686 - RNA, 21 nt, Bordetella pertussis
aucuggcgcgucaggccgggc

SEQ ID NO: 365687 - RNA, 18 nt, Bordetella pertussis
aucugggccucggccagc

SEQ ID NO: 365688 - RNA, 22 nt, Bordetella pertussis
aucugggcgucgaaggcggccg

SEQ ID NO: 365689 - RNA, 21 nt, Bordetella pertussis
aucugguagugcaggccgcgc

SEQ ID NO: 365690 - RNA, 23 nt, Bordetella pertussis
aucugguuggccacaucaucgac

SEQ ID NO: 365691 - RNA, 17 nt, Bordetella pertussis
aucuucgugcuggccau

SEQ ID NO: 365692 - RNA, 16 nt, Bordetella pertussis
aucuucugcgccacgg

SEQ ID NO: 365693 - RNA, 21 nt, Bordetella pertussis
aucuugccaggcccggcgcgc

SEQ ID NO: 365694 - RNA, 19 nt, Bordetella pertussis
aucuugaugccgcccagca

SEQ ID NO: 365695 - RNA, 20 nt, Bordetella pertussis
aucuugaugccgcccagcau

SEQ ID NO: 365696 - RNA, 13 nt, Bordetella pertussis
aucuugcgccgcu

SEQ ID NO: 365697 - RNA, 18 nt, Bordetella pertussis
augaacacuugacggcca

SEQ ID NO: 365698 - RNA, 21 nt, Bordetella pertussis
augaacagcggcacgccggcg

SEQ ID NO: 365699 - RNA, 22 nt, Bordetella pertussis
augaacggcagcgcgcgcguga

SEQ ID NO: 365700 - RNA, 21 nt, Bordetella pertussis
augaacucgcgcucggcgacg

SEQ ID NO: 365701 - RNA, 16 nt, Bordetella pertussis
augaagaugccgaacc

SEQ ID NO: 365702 - RNA, 18 nt, Bordetella pertussis
augaagcccgagcggcgc

SEQ ID NO: 365703 - RNA, 19 nt, Bordetella pertussis
augaagggcuggccggcca

SEQ ID NO: 365704 - RNA, 22 nt, Bordetella pertussis
augaagggcuggccggccaaca

SEQ ID NO: 365705 - RNA, 20 nt, Bordetella pertussis
augaauugcgccacgcccac

SEQ ID NO: 365706 - RNA, 15 nt, Bordetella pertussis
augacaugcgggccu

SEQ ID NO: 365707 - RNA, 16 nt, Bordetella pertussis
augacauggccacggc

SEQ ID NO: 365708 - RNA, 20 nt, Bordetella pertussis
augaccacgucgaucaggcc

SEQ ID NO: 365709 - RNA, 15 nt, Bordetella pertussis
augaccagccagccg

SEQ ID NO: 365710 - RNA, 15 nt, Bordetella pertussis
augaccagcggcgug

SEQ ID NO: 365711 - RNA, 16 nt, Bordetella pertussis
augaccagggcgccga

SEQ ID NO: 365712 - RNA, 19 nt, Bordetella pertussis
augaccagggcgccgaccg

SEQ ID NO: 365713 - RNA, 16 nt, Bordetella pertussis
augaccaucacgagca

SEQ ID NO: 365714 - RNA, 14 nt, Bordetella pertussis
augaccgccgcgcc

SEQ ID NO: 365715 - RNA, 16 nt, Bordetella pertussis
augaccgccgcgccgg

SEQ ID NO: 365716 - RNA, 13 nt, Bordetella pertussis
augaccgccggca

SEQ ID NO: 365717 - RNA, 14 nt, Bordetella pertussis
augaccggccaggc

SEQ ID NO: 365718 - RNA, 13 nt, Bordetella pertussis
augaccggcgcgg

SEQ ID NO: 365719 - RNA, 14 nt, Bordetella pertussis
augaccggcgcggc

SEQ ID NO: 365720 - RNA, 16 nt, Bordetella pertussis
augaccggcgcggccu

SEQ ID NO: 365721 - RNA, 17 nt, Bordetella pertussis
augaccggcgcggccug

SEQ ID NO: 365722 - RNA, 21 nt, Bordetella pertussis
augaccgggucgucgggcggc

SEQ ID NO: 365723 - RNA, 14 nt, Bordetella pertussis
augaccucggccug

SEQ ID NO: 365724 - RNA, 17 nt, Bordetella pertussis
augaccugcgccaggug

SEQ ID NO: 365725 - RNA, 20 nt, Bordetella pertussis
augaccuugagaugccagcg

SEQ ID NO: 365726 - RNA, 19 nt, Bordetella pertussis
augacgaccuugcggccgc

SEQ ID NO: 365727 - RNA, 22 nt, Bordetella pertussis
augacgaccuugcggccgcgca

SEQ ID NO: 365728 - RNA, 23 nt, Bordetella pertussis
augacgacgaaacccgggccguc

SEQ ID NO: 365729 - RNA, 14 nt, Bordetella pertussis
augacgacgccggc

SEQ ID NO: 365730 - RNA, 22 nt, Bordetella pertussis
augauacccauggccgugcgcc

SEQ ID NO: 365731 - RNA, 18 nt, Bordetella pertussis
augaucgcgcagcaccgc

SEQ ID NO: 365732 - RNA, 12 nt, Bordetella pertussis
augaucggcgcc

SEQ ID NO: 365733 - RNA, 15 nt, Bordetella pertussis
augauggaggccagg

SEQ ID NO: 365734 - RNA, 18 nt, Bordetella pertussis
augauggauucgcgccgg

SEQ ID NO: 365735 - RNA, 19 nt, Bordetella pertussis
augauggauucgcgccggc

SEQ ID NO: 365736 - RNA, 13 nt, Bordetella pertussis
augauggccaggu

SEQ ID NO: 365737 - RNA, 15 nt, Bordetella pertussis
augauggccgcgcgc

SEQ ID NO: 365738 - RNA, 17 nt, Bordetella pertussis
augauggugaacgccac

SEQ ID NO: 365739 - RNA, 15 nt, Bordetella pertussis
augaugucgcgggcc

SEQ ID NO: 365740 - RNA, 19 nt, Bordetella pertussis
augcagaacagggugccgc

SEQ ID NO: 365741 - RNA, 20 nt, Bordetella pertussis
augcagcacgucggcgucgg

SEQ ID NO: 365742 - RNA, 19 nt, Bordetella pertussis
augcagccgcaccagcgca

SEQ ID NO: 365743 - RNA, 16 nt, Bordetella pertussis
augcagcugcgccagc

SEQ ID NO: 365744 - RNA, 18 nt, Bordetella pertussis
augcagcuggauggccug

SEQ ID NO: 365745 - RNA, 19 nt, Bordetella pertussis
augcaugaaccgcagcgcc

SEQ ID NO: 365746 - RNA, 16 nt, Bordetella pertussis
augcgcaccaugcgca

SEQ ID NO: 365747 - RNA, 21 nt, Bordetella pertussis
augcgcaccaugcgcagcaac

SEQ ID NO: 365748 - RNA, 13 nt, Bordetella pertussis
augcgcacgccca

SEQ ID NO: 365749 - RNA, 13 nt, Bordetella pertussis
augcgcacgcgcg

SEQ ID NO: 365750 - RNA, 16 nt, Bordetella pertussis
augcgcacucgaccgc

SEQ ID NO: 365751 - RNA, 13 nt, Bordetella pertussis
augcgcaccaggc

SEQ ID NO: 365752 - RNA, 19 nt, Bordetella pertussis
augcgcagcaggcgcgugc

SEQ ID NO: 365753 - RNA, 14 nt, Bordetella pertussis
augcgcagcgcguc

SEQ ID NO: 365754 - RNA, 16 nt, Bordetella pertussis
augcgcagcgcgucgg

SEQ ID NO: 365755 - RNA, 19 nt, Bordetella pertussis
augcgcauggccagcgcgc

SEQ ID NO: 365756 - RNA, 20 nt, Bordetella pertussis
augcgcaugggaaauccgcc

SEQ ID NO: 365757 - RNA, 22 nt, Bordetella pertussis
augcgcaugggaaauccgccgg

SEQ ID NO: 365758 - RNA, 17 nt, Bordetella pertussis
augcgcauuaucgcuag

SEQ ID NO: 365759 - RNA, 17 nt, Bordetella pertussis
augcgccaggcgcucgg

SEQ ID NO: 365760 - RNA, 19 nt, Bordetella pertussis
augcgccaguccagcgcgc

SEQ ID NO: 365761 - RNA, 20 nt, Bordetella pertussis
augcgccgcaccagcgccga

SEQ ID NO: 365762 - RNA, 19 nt, Bordetella pertussis
augcgccgcaccagcggcg

SEQ ID NO: 365763 - RNA, 13 nt, Bordetella pertussis
augcgccgcacgu

SEQ ID NO: 365764 - RNA, 14 nt, Bordetella pertussis
augcgccggccugg

SEQ ID NO: 365765 - RNA, 14 nt, Bordetella pertussis
augcgccgcgccaa

SEQ ID NO: 365766 - RNA, 17 nt, Bordetella pertussis
augcggcagcagggcca

SEQ ID NO: 365767 - RNA, 20 nt, Bordetella pertussis
augcggccuucgccggugaa

SEQ ID NO: 365768 - RNA, 22 nt, Bordetella pertussis
augcggcgcaugcugcgcgagg

SEQ ID NO: 365769 - RNA, 20 nt, Bordetella pertussis
augcggcgccggugcgcggc

SEQ ID NO: 365770 - RNA, 15 nt, Bordetella pertussis
augcggcgcgccgcg

SEQ ID NO: 365771 - RNA, 18 nt, Bordetella pertussis
augcgggcaucgcccugc

SEQ ID NO: 365772 - RNA, 15 nt, Bordetella pertussis
augcgggccacgccg

SEQ ID NO: 365773 - RNA, 17 nt, Bordetella pertussis
augcgggccaugucggc

SEQ ID NO: 365774 - RNA, 14 nt, Bordetella pertussis
augcgggcggcggu

SEQ ID NO: 365775 - RNA, 20 nt, Bordetella pertussis
augcggggacuggcaccagg

SEQ ID NO: 365776 - RNA, 18 nt, Bordetella pertussis
augcgggucggcgccaug

SEQ ID NO: 365777 - RNA, 16 nt, Bordetella pertussis
augcgggucaaggcgg

SEQ ID NO: 365778 - RNA, 16 nt, Bordetella pertussis
augcggguuggcaguc

SEQ ID NO: 365779 - RNA, 19 nt, Bordetella pertussis
augcggucggccgcgccgc

SEQ ID NO: 365780 - RNA, 20 nt, Bordetella pertussis
augcggugggucucggcguc

SEQ ID NO: 365781 - RNA, 23 nt, Bordetella pertussis
augcgguugaucagggccgccag

SEQ ID NO: 365782 - RNA, 15 nt, Bordetella pertussis
augcguaucggcagc

SEQ ID NO: 365783 - RNA, 22 nt, Bordetella pertussis
augcgucaggggcaugccggca

SEQ ID NO: 365784 - RNA, 13 nt, Bordetella pertussis
augcguccgccgu

SEQ ID NO: 365785 - RNA, 18 nt, Bordetella pertussis
augcugaauugcgggccg

SEQ ID NO: 365786 - RNA, 20 nt, Bordetella pertussis
augcugaauugcgggccggc

SEQ ID NO: 365787 - RNA, 16 nt, Bordetella pertussis
augcugcagggccugg

SEQ ID NO: 365788 - RNA, 14 nt, Bordetella pertussis
augcugccgggcau

SEQ ID NO: 365789 - RNA, 16 nt, Bordetella pertussis
augcugcucggccaug

SEQ ID NO: 365790 - RNA, 15 nt, Bordetella pertussis
augcuggcccagcug

SEQ ID NO: 365791 - RNA, 15 nt, Bordetella pertussis
augcuggccgccgcg

SEQ ID NO: 365792 - RNA, 15 nt, Bordetella pertussis
augcuggucagccug

SEQ ID NO: 365793 - RNA, 24 nt, Bordetella pertussis
augcuggucagccugggcgccugg

SEQ ID NO: 365794 - RNA, 23 nt, Bordetella pertussis
augcuggucgccaucugcugcga

SEQ ID NO: 365795 - RNA, 11 nt, Bordetella pertussis
augcugggcgg

SEQ ID NO: 365796 - RNA, 14 nt, Bordetella pertussis
augcuggucgcgca

SEQ ID NO: 365797 - RNA, 18 nt, Bordetella pertussis
augcuugccauaggccag

SEQ ID NO: 365798 - RNA, 15 nt, Bordetella pertussis
auggaagcggcagac

SEQ ID NO: 365799 - RNA, 15 nt, Bordetella pertussis
auggaauacgccgau

SEQ ID NO: 365800 - RNA, 15 nt, Bordetella pertussis
auggaccgccgccgu

SEQ ID NO: 365801 - RNA, 12 nt, Bordetella pertussis
auggacgccggg

SEQ ID NO: 365802 - RNA, 15 nt, Bordetella pertussis
auggagaccggcgcc

SEQ ID NO: 365803 - RNA, 15 nt, Bordetella pertussis
auggaggcgcagcgc

SEQ ID NO: 365804 - RNA, 19 nt, Bordetella pertussis
auggaugcgcgccccgucg

SEQ ID NO: 365805 - RNA, 13 nt, Bordetella pertussis
auggcacagcgcg

SEQ ID NO: 365806 - RNA, 16 nt, Bordetella pertussis
auggcagggcgccgcg

SEQ ID NO: 365807 - RNA, 23 nt, Bordetella pertussis
auggcaugaaaaagggcgcacca

SEQ ID NO: 365808 - RNA, 14 nt, Bordetella pertussis
auggccacgaccac

SEQ ID NO: 365809 - RNA, 20 nt, Bordetella pertussis
auggccagcacauacgccgc

SEQ ID NO: 365810 - RNA, 23 nt, Bordetella pertussis
auggccagcacauacgccgccga

SEQ ID NO: 365811 - RNA, 19 nt, Bordetella pertussis
auggccagcagcgccgcca

SEQ ID NO: 365812 - RNA, 14 nt, Bordetella pertussis
auggccagccgcuu

SEQ ID NO: 365813 - RNA, 14 nt, Bordetella pertussis
auggccagcgcgca

SEQ ID NO: 365814 - RNA, 23 nt, Bordetella pertussis
auggccagguacaggccgccggu

SEQ ID NO: 365815 - RNA, 18 nt, Bordetella pertussis
auggccagguggcggcgg

SEQ ID NO: 365816 - RNA, 15 nt, Bordetella pertussis
auggccaucgacgcc

SEQ ID NO: 365817 - RNA, 21 nt, Bordetella pertussis
auggccaucgcgguccugacc

SEQ ID NO: 365818 - RNA, 22 nt, Bordetella pertussis
auggcccgccaccacggcgcgg

SEQ ID NO: 365819 - RNA, 17 nt, Bordetella pertussis
auggccgugcgcccgac

SEQ ID NO: 365820 - RNA, 20 nt, Bordetella pertussis
auggccguggcgugcaggcc

SEQ ID NO: 365821 - RNA, 23 nt, Bordetella pertussis
auggccguggcgugcaggccggc

SEQ ID NO: 365822 - RNA, 23 nt, Bordetella pertussis
auggccucgucgaccacgccggc

SEQ ID NO: 365823 - RNA, 20 nt, Bordetella pertussis
auggccuggaugugcaggcc

SEQ ID NO: 365824 - RNA, 16 nt, Bordetella pertussis
auggccuggcccagcu

SEQ ID NO: 365825 - RNA, 20 nt, Bordetella pertussis
auggcgaucuucugggcggc

SEQ ID NO: 365826 - RNA, 14 nt, Bordetella pertussis
auggcuucgcgcac

SEQ ID NO: 365827 - RNA, 18 nt, Bordetella pertussis
augggcagcucgccuucg

SEQ ID NO: 365828 - RNA, 15 nt, Bordetella pertussis
augggccguccggcc

SEQ ID NO: 365829 - RNA, 20 nt, Bordetella pertussis
augggccugcccauggccug

SEQ ID NO: 365830 - RNA, 12 nt, Bordetella pertussis
augggcgccgug

SEQ ID NO: 365831 - RNA, 15 nt, Bordetella pertussis
augggcgcuuggccc

SEQ ID NO: 365832 - RNA, 13 nt, Bordetella pertussis
augggcggcgacg

SEQ ID NO: 365833 - RNA, 16 nt, Bordetella pertussis
augggcgugccgcgcu

SEQ ID NO: 365834 - RNA, 16 nt, Bordetella pertussis
augggcuuugacgccg

SEQ ID NO: 365835 - RNA, 18 nt, Bordetella pertussis
augggcuuugacgccggc

SEQ ID NO: 365836 - RNA, 23 nt, Bordetella pertussis
auggggcaggcgcagcggcggcg

SEQ ID NO: 365837 - RNA, 18 nt, Bordetella pertussis
auggggccauggcacagg

SEQ ID NO: 365838 - RNA, 22 nt, Bordetella pertussis
auggggguggaaaugccggcgg

SEQ ID NO: 365839 - RNA, 21 nt, Bordetella pertussis
auggguaaagcgccggcccgc

SEQ ID NO: 365840 - RNA, 16 nt, Bordetella pertussis
auggguacagcgcgcc

SEQ ID NO: 365841 - RNA, 16 nt, Bordetella pertussis
augguagcgguccagc

SEQ ID NO: 365842 - RNA, 17 nt, Bordetella pertussis
augguagcgguccagcu

SEQ ID NO: 365843 - RNA, 22 nt, Bordetella pertussis
augguaguacucgcugcgcgga

SEQ ID NO: 365844 - RNA, 17 nt, Bordetella pertussis
augguagaugcgcgcga

SEQ ID NO: 365845 - RNA, 20 nt, Bordetella pertussis
auggucaagcggcugcccuu

SEQ ID NO: 365846 - RNA, 21 nt, Bordetella pertussis
auguaaaaacccggccugcgc

SEQ ID NO: 365847 - RNA, 14 nt, Bordetella pertussis
auguccagcgccag

SEQ ID NO: 365848 - RNA, 15 nt, Bordetella pertussis
auguccagcggcgua

SEQ ID NO: 365849 - RNA, 16 nt, Bordetella pertussis
auguccacgaaggcgc

SEQ ID NO: 365850 - RNA, 19 nt, Bordetella pertussis
auguccacgaaggcgccga

SEQ ID NO: 365851 - RNA, 15 nt, Bordetella pertussis
augucggugaaggcc

SEQ ID NO: 365852 - RNA, 20 nt, Bordetella pertussis
augucgugaucgccagcgcc

SEQ ID NO: 365853 - RNA, 15 nt, Bordetella pertussis
augugcaugccgucg

SEQ ID NO: 365854 - RNA, 16 nt, Bordetella pertussis
augugccaccgcccag

SEQ ID NO: 365855 - RNA, 17 nt, Bordetella pertussis
augugcgagagcuccag

SEQ ID NO: 365856 - RNA, 14 nt, Bordetella pertussis
augugcgccgcgcc

SEQ ID NO: 365857 - RNA, 16 nt, Bordetella pertussis
augugcgccgcgccgu

SEQ ID NO: 365858 - RNA, 13 nt, Bordetella pertussis
augugcgcgggcg

SEQ ID NO: 365859 - RNA, 20 nt, Bordetella pertussis
augugcugacggugccggcc

SEQ ID NO: 365860 - RNA, 15 nt, Bordetella pertussis
auguggcgcagcguu

SEQ ID NO: 365861 - RNA, 13 nt, Bordetella pertussis
auguucaggccau

SEQ ID NO: 365862 - RNA, 20 nt, Bordetella pertussis
auuaugccgcccgcaaggac

SEQ ID NO: 365863 - RNA, 12 nt, Bordetella pertussis
auucacgccgcg

SEQ ID NO: 365864 - RNA, 20 nt, Bordetella pertussis
auucccuggcgcgccagcuc

SEQ ID NO: 365865 - RNA, 20 nt, Bordetella pertussis
auuccucgccgcccagccgg

SEQ ID NO: 365866 - RNA, 16 nt, Bordetella pertussis
auuccugaacgccggg

SEQ ID NO: 365867 - RNA, 12 nt, Bordetella pertussis
auuccugcuggu

SEQ ID NO: 365868 - RNA, 17 nt, Bordetella pertussis
auucgaacaacagcgcc

SEQ ID NO: 365869 - RNA, 13 nt, Bordetella pertussis
auucgagcaggcg

SEQ ID NO: 365870 - RNA, 16 nt, Bordetella pertussis
auucgccggucggccg

SEQ ID NO: 365871 - RNA, 13 nt, Bordetella pertussis
auucgcgcaccga

SEQ ID NO: 365872 - RNA, 20 nt, Bordetella pertussis
auucgcggugcaagcggccg

SEQ ID NO: 365873 - RNA, 19 nt, Bordetella pertussis
auucggacgccucgccggu

SEQ ID NO: 365874 - RNA, 22 nt, Bordetella pertussis
auucggccacuuucgcgcgcgc

SEQ ID NO: 365875 - RNA, 21 nt, Bordetella pertussis
auucggcgcgcucggcgccgg

SEQ ID NO: 365876 - RNA, 14 nt, Bordetella pertussis
auucgguggcgcgc

SEQ ID NO: 365877 - RNA, 19 nt, Bordetella pertussis
auucguugaucuggccguc

SEQ ID NO: 365878 - RNA, 17 nt, Bordetella pertussis
auugaccagcaccagcg

SEQ ID NO: 365879 - RNA, 12 nt, Bordetella pertussis
auugagggcgua

SEQ ID NO: 365880 - RNA, 22 nt, Bordetella pertussis
auugaugcccaugcgcugcgcc

SEQ ID NO: 365881 - RNA, 16 nt, Bordetella pertussis
auugaugucgcgcacc

SEQ ID NO: 365882 - RNA, 18 nt, Bordetella pertussis
auugcacggugccgcgcg

SEQ ID NO: 365883 - RNA, 14 nt, Bordetella pertussis
auugcccaccacgg

SEQ ID NO: 365884 - RNA, 16 nt, Bordetella pertussis
auugccgcacgaucgc

SEQ ID NO: 365885 - RNA, 20 nt, Bordetella pertussis
auugccgcacgaucgcgccg

SEQ ID NO: 365886 - RNA, 19 nt, Bordetella pertussis
auugccgccgcugccggcc

SEQ ID NO: 365887 - RNA, 22 nt, Bordetella pertussis
auugccgccgcugccggccgac

SEQ ID NO: 365888 - RNA, 21 nt, Bordetella pertussis
auugccguccuggcgaccggc

SEQ ID NO: 365889 - RNA, 18 nt, Bordetella pertussis
auugccgucggccgcgcc

SEQ ID NO: 365890 - RNA, 15 nt, Bordetella pertussis
auugcgccacgccca

SEQ ID NO: 365891 - RNA, 18 nt, Bordetella pertussis
auugcgccagcgcugucc

SEQ ID NO: 365892 - RNA, 18 nt, Bordetella pertussis
auugcggcccgcggccuu

SEQ ID NO: 365893 - RNA, 19 nt, Bordetella pertussis
auugcgguccaggaagcgc

SEQ ID NO: 365894 - RNA, 16 nt, Bordetella pertussis
auugcggugcccuugc

SEQ ID NO: 365895 - RNA, 15 nt, Bordetella pertussis
auugcugcugcuggc

SEQ ID NO: 365896 - RNA, 16 nt, Bordetella pertussis
auugcugcugcuggcu

SEQ ID NO: 365897 - RNA, 15 nt, Bordetella pertussis
auuggcggcggcguu

SEQ ID NO: 365898 - RNA, 17 nt, Bordetella pertussis
auuggcuguaucuggcc

SEQ ID NO: 365899 - RNA, 14 nt, Bordetella pertussis
auugggcguggcgg

SEQ ID NO: 365900 - RNA, 14 nt, Bordetella pertussis
auuguccagcggca

SEQ ID NO: 365901 - RNA, 19 nt, Bordetella pertussis
auugugcaugacggccagg

SEQ ID NO: 365902 - RNA, 20 nt, Bordetella pertussis
caaaccgucgaugaccagcg

SEQ ID NO: 365903 - RNA, 22 nt, Bordetella pertussis
caaaccgucgaugaccagcgcc

SEQ ID NO: 365904 - RNA, 22 nt, Bordetella pertussis
caaagcgguccccagauccgca

SEQ ID NO: 365905 - RNA, 16 nt, Bordetella pertussis
caacacgaccagcagg

SEQ ID NO: 365906 - RNA, 17 nt, Bordetella pertussis
caacacgaccagcaggc

SEQ ID NO: 365907 - RNA, 18 nt, Bordetella pertussis
caacacgauccacggccg

SEQ ID NO: 365908 - RNA, 17 nt, Bordetella pertussis
caacacgaugaucgcgc

SEQ ID NO: 365909 - RNA, 16 nt, Bordetella pertussis
caacaugccggacaag

SEQ ID NO: 365910 - RNA, 15 nt, Bordetella pertussis
caacccagcagcggc

SEQ ID NO: 365911 - RNA, 17 nt, Bordetella pertussis
caaccccgagggcgcgg

SEQ ID NO: 365912 - RNA, 19 nt, Bordetella pertussis
caacccgccauccuggccg

SEQ ID NO: 365913 - RNA, 16 nt, Bordetella pertussis
caacccgcccacgcgg

SEQ ID NO: 365914 - RNA, 13 nt, Bordetella pertussis
caacccgccggcc

SEQ ID NO: 365915 - RNA, 18 nt, Bordetella pertussis
caacccggccucagcggc

SEQ ID NO: 365916 - RNA, 19 nt, Bordetella pertussis
caaccgcgcguaucggcgc

SEQ ID NO: 365917 - RNA, 15 nt, Bordetella pertussis
caaccggcacgucau

SEQ ID NO: 365918 - RNA, 14 nt, Bordetella pertussis
caaccggucggccg

SEQ ID NO: 365919 - RNA, 15 nt, Bordetella pertussis
caaccggucggccgg

SEQ ID NO: 365920 - RNA, 17 nt, Bordetella pertussis
caaccggucggccggca

SEQ ID NO: 365921 - RNA, 20 nt, Bordetella pertussis
caaccgucgaccggcccgca

SEQ ID NO: 365922 - RNA, 13 nt, Bordetella pertussis
caaccgucgguga

SEQ ID NO: 365923 - RNA, 16 nt, Bordetella pertussis
caaccguucauggcgu

SEQ ID NO: 365924 - RNA, 16 nt, Bordetella pertussis
caaccucgccgcgcca

SEQ ID NO: 365925 - RNA, 23 nt, Bordetella pertussis
caaccugcuggccaccgucgcca

SEQ ID NO: 365926 - RNA, 17 nt, Bordetella pertussis
caaccuggucaagggcg

SEQ ID NO: 365927 - RNA, 21 nt, Bordetella pertussis
caaccuggucaagggcggcca

SEQ ID NO: 365928 - RNA, 13 nt, Bordetella pertussis
caacggcgugcug

SEQ ID NO: 365929 - RNA, 14 nt, Bordetella pertussis
caacggcgugcugc

SEQ ID NO: 365930 - RNA, 15 nt, Bordetella pertussis
caacgggauccggca

SEQ ID NO: 365931 - RNA, 20 nt, Bordetella pertussis
caacgugcgccaggcaaagg

SEQ ID NO: 365932 - RNA, 13 nt, Bordetella pertussis
caacucggccacc

SEQ ID NO: 365933 - RNA, 21 nt, Bordetella pertussis
caagccgggcgccggcggcaa

SEQ ID NO: 365934 - RNA, 14 nt, Bordetella pertussis
caagccuugcggcc

SEQ ID NO: 365935 - RNA, 19 nt, Bordetella pertussis
caagcgcacgcgcagcacg

SEQ ID NO: 365936 - RNA, 14 nt, Bordetella pertussis
caagcgcacgcugg

SEQ ID NO: 365937 - RNA, 14 nt, Bordetella pertussis
caagcgcgccauga

SEQ ID NO: 365938 - RNA, 16 nt, Bordetella pertussis
caagcucgcgcaugca

SEQ ID NO: 365939 - RNA, 23 nt, Bordetella pertussis
caagcucgcgcaugcagcgagcg

SEQ ID NO: 365940 - RNA, 14 nt, Bordetella pertussis
caagcugcuggccg

SEQ ID NO: 365941 - RNA, 20 nt, Bordetella pertussis
caagcugcuggccggcccca

SEQ ID NO: 365942 - RNA, 18 nt, Bordetella pertussis
caagcugcuggcgcgcca

SEQ ID NO: 365943 - RNA, 18 nt, Bordetella pertussis
caagcuggagaagcgccg

SEQ ID NO: 365944 - RNA, 18 nt, Bordetella pertussis
caagcuggccgaugucgc

SEQ ID NO: 365945 - RNA, 20 nt, Bordetella pertussis
caaggccggcgcgucgcgcg

SEQ ID NO: 365946 - RNA, 13 nt, Bordetella pertussis
caaggccggcggc

SEQ ID NO: 365947 - RNA, 21 nt, Bordetella pertussis
caaggccggcggcacgcugcg

SEQ ID NO: 365948 - RNA, 23 nt, Bordetella pertussis
caaggcgcgaguauucacgccgc

SEQ ID NO: 365949 - RNA, 13 nt, Bordetella pertussis
caaggcgcgcgcc

SEQ ID NO: 365950 - RNA, 16 nt, Bordetella pertussis
caaggcggcaaacccg

SEQ ID NO: 365951 - RNA, 14 nt, Bordetella pertussis
caaggcggcccggc

SEQ ID NO: 365952 - RNA, 19 nt, Bordetella pertussis
caaggcggcccggccgccg

SEQ ID NO: 365953 - RNA, 16 nt, Bordetella pertussis
caaggcgggcuggucg

SEQ ID NO: 365954 - RNA, 19 nt, Bordetella pertussis
caaggcguaauccuucauc

SEQ ID NO: 365955 - RNA, 14 nt, Bordetella pertussis
caaggcgucggcca

SEQ ID NO: 365956 - RNA, 16 nt, Bordetella pertussis
caaggcgucggccagg

SEQ ID NO: 365957 - RNA, 17 nt, Bordetella pertussis
caagggccccagcaucu

SEQ ID NO: 365958 - RNA, 21 nt, Bordetella pertussis
caagggccccccggcgcggcc

SEQ ID NO: 365959 - RNA, 14 nt, Bordetella pertussis
caagucagcccgcg

SEQ ID NO: 365960 - RNA, 19 nt, Bordetella pertussis
caagugcuggcccgccagc

SEQ ID NO: 365961 - RNA, 21 nt, Bordetella pertussis
caagugcuggcccgccagcaa

SEQ ID NO: 365962 - RNA, 21 nt, Bordetella pertussis
caauaacgccacuugcaggcc

SEQ ID NO: 365963 - RNA, 19 nt, Bordetella pertussis
caauaccuucagcccggcg

SEQ ID NO: 365964 - RNA, 17 nt, Bordetella pertussis
caauacgucgcgaccgc

SEQ ID NO: 365965 - RNA, 20 nt, Bordetella pertussis
caauacgucgcgaccgccgc

SEQ ID NO: 365966 - RNA, 18 nt, Bordetella pertussis
caauacuucguggcgcag

SEQ ID NO: 365967 - RNA, 13 nt, Bordetella pertussis
caauagcgcccgc

SEQ ID NO: 365968 - RNA, 18 nt, Bordetella pertussis
caauaggccgcgaugucg

SEQ ID NO: 365969 - RNA, 19 nt, Bordetella pertussis
caauaggccgcgaugucgc

SEQ ID NO: 365970 - RNA, 21 nt, Bordetella pertussis
caauccgccgccagcacgcca

SEQ ID NO: 365971 - RNA, 20 nt, Bordetella pertussis
caauccgucaggcagcaacc

SEQ ID NO: 365972 - RNA, 17 nt, Bordetella pertussis
caaucggcgugcagcaa

SEQ ID NO: 365973 - RNA, 22 nt, Bordetella pertussis
caaucggcgugcagcaagccca

SEQ ID NO: 365974 - RNA, 20 nt, Bordetella pertussis
caaucugcgucgccuggucg

SEQ ID NO: 365975 - RNA, 17 nt, Bordetella pertussis
caaugccaaucaugcgc

SEQ ID NO: 365976 - RNA, 20 nt, Bordetella pertussis
caaugccaaucaugcgcugc

SEQ ID NO: 365977 - RNA, 17 nt, Bordetella pertussis
caaugccagucgccgcg

SEQ ID NO: 365978 - RNA, 19 nt, Bordetella pertussis
caaugcccaguucguccca

SEQ ID NO: 365979 - RNA, 15 nt, Bordetella pertussis
caaugcgcaggcccg

SEQ ID NO: 365980 - RNA, 12 nt, Bordetella pertussis
caaugguccagc

SEQ ID NO: 365981 - RNA, 20 nt, Bordetella pertussis
caaugucgcaggccgcggcc

SEQ ID NO: 365982 - RNA, 19 nt, Bordetella pertussis
caauugccggaucagcgcc

SEQ ID NO: 365983 - RNA, 13 nt, Bordetella pertussis
caauugcgcggcc

SEQ ID NO: 365984 - RNA, 19 nt, Bordetella pertussis
cacaagcgcguggccggcg

SEQ ID NO: 365985 - RNA, 22 nt, Bordetella pertussis
cacaaggauggacuggccgcga

SEQ ID NO: 365986 - RNA, 15 nt, Bordetella pertussis
cacaaggcggccgcg

SEQ ID NO: 365987 - RNA, 16 nt, Bordetella pertussis
cacaaggcggccgcgc

SEQ ID NO: 365988 - RNA, 20 nt, Bordetella pertussis
cacaaggcggccgcgcccgc

SEQ ID NO: 365989 - RNA, 18 nt, Bordetella pertussis
cacaccccaccacgucgc

SEQ ID NO: 365990 - RNA, 23 nt, Bordetella pertussis
cacacgcgcugggcguggcgcgc

SEQ ID NO: 365991 - RNA, 12 nt, Bordetella pertussis
cacacgggcgcc

SEQ ID NO: 365992 - RNA, 22 nt, Bordetella pertussis
cacacggucagcaaccccagca

SEQ ID NO: 365993 - RNA, 13 nt, Bordetella pertussis
cacacugggcggc

SEQ ID NO: 365994 - RNA, 19 nt, Bordetella pertussis
cacacugucgccacgggcg

SEQ ID NO: 365995 - RNA, 18 nt, Bordetella pertussis
caccacaucgccggcggc

SEQ ID NO: 365996 - RNA, 14 nt, Bordetella pertussis
caccaccaccgccc

SEQ ID NO: 365997 - RNA, 16 nt, Bordetella pertussis
caccaccagcgcggcc

SEQ ID NO: 365998 - RNA, 20 nt, Bordetella pertussis
caccaccagcgcggccagca

SEQ ID NO: 365999 - RNA, 13 nt, Bordetella pertussis
caccaccagcggc

SEQ ID NO: 366000 - RNA, 14 nt, Bordetella pertussis
caccaccaggccca

SEQ ID NO: 366001 - RNA, 13 nt, Bordetella pertussis
caccaccaggccg

SEQ ID NO: 366002 - RNA, 15 nt, Bordetella pertussis
caccaccaggccggc

SEQ ID NO: 366003 - RNA, 17 nt, Bordetella pertussis
caccaccaggccggcca

SEQ ID NO: 366004 - RNA, 22 nt, Bordetella pertussis
caccaccaggccggccagggcc

SEQ ID NO: 366005 - RNA, 20 nt, Bordetella pertussis
caccaccaugugcuugccgc

SEQ ID NO: 366006 - RNA, 15 nt, Bordetella pertussis
caccacccaggccca

SEQ ID NO: 366007 - RNA, 13 nt, Bordetella pertussis
caccacccgcacg

SEQ ID NO: 366008 - RNA, 14 nt, Bordetella pertussis
caccaccgucucga

SEQ ID NO: 366009 - RNA, 21 nt, Bordetella pertussis
caccaccgucucgaacgccgc

SEQ ID NO: 366010 - RNA, 19 nt, Bordetella pertussis
caccaccuccaccgccagc

SEQ ID NO: 366011 - RNA, 22 nt, Bordetella pertussis
caccaccucggccucgcuggcg

SEQ ID NO: 366012 - RNA, 18 nt, Bordetella pertussis
caccaccuucagggcgcc

SEQ ID NO: 366013 - RNA, 19 nt, Bordetella pertussis
caccaccuucagggcgccg

SEQ ID NO: 366014 - RNA, 22 nt, Bordetella pertussis
caccacgcuggcuucgucgccg

SEQ ID NO: 366015 - RNA, 13 nt, Bordetella pertussis
caccacggcgcgc

SEQ ID NO: 366016 - RNA, 14 nt, Bordetella pertussis
caccacggcgcgga

SEQ ID NO: 366017 - RNA, 23 nt, Bordetella pertussis
caccacggcgcggaugccgucca

SEQ ID NO: 366018 - RNA, 16 nt, Bordetella pertussis
caccacgggcacgaug

SEQ ID NO: 366019 - RNA, 16 nt, Bordetella pertussis
caccacgggcucgcug

SEQ ID NO: 366020 - RNA, 16 nt, Bordetella pertussis
caccacggcggccagg

SEQ ID NO: 366021 - RNA, 15 nt, Bordetella pertussis
caccagcaagccggc

SEQ ID NO: 366022 - RNA, 23 nt, Bordetella pertussis
caccagcaagccggcggucccga

SEQ ID NO: 366023 - RNA, 20 nt, Bordetella pertussis
caccagcacaucgacgucgg

SEQ ID NO: 366024 - RNA, 19 nt, Bordetella pertussis
caccagcaccgaugcgccg

SEQ ID NO: 366025 - RNA, 14 nt, Bordetella pertussis
caccagcagcccca

SEQ ID NO: 366026 - RNA, 16 nt, Bordetella pertussis
caccagcagccccagc

SEQ ID NO: 366027 - RNA, 12 nt, Bordetella pertussis
caccagcagcgc

SEQ ID NO: 366028 - RNA, 16 nt, Bordetella pertussis
caccagcagcgccagg

SEQ ID NO: 366029 - RNA, 13 nt, Bordetella pertussis
caccagcaggccg

SEQ ID NO: 366030 - RNA, 14 nt, Bordetella pertussis
caccagcaggccgg

SEQ ID NO: 366031 - RNA, 14 nt, Bordetella pertussis
caccagcaggcggc

SEQ ID NO: 366032 - RNA, 18 nt, Bordetella pertussis
caccagcagguggcgcug

SEQ ID NO: 366033 - RNA, 16 nt, Bordetella pertussis
caccagcaggcggccg

SEQ ID NO: 366034 - RNA, 14 nt, Bordetella pertussis
caccagcaucgcgc

SEQ ID NO: 366035 - RNA, 20 nt, Bordetella pertussis
caccagcaugcgcgucucca

SEQ ID NO: 366036 - RNA, 18 nt, Bordetella pertussis
caccagccauucgauggc

SEQ ID NO: 366037 - RNA, 20 nt, Bordetella pertussis
caccagcccgaugcgccagg

SEQ ID NO: 366038 - RNA, 15 nt, Bordetella pertussis
caccagccggccgcc

SEQ ID NO: 366039 - RNA, 16 nt, Bordetella pertussis
caccagccggccgccg

SEQ ID NO: 366040 - RNA, 19 nt, Bordetella pertussis
caccagccugaugcgcaga

SEQ ID NO: 366041 - RNA, 19 nt, Bordetella pertussis
caccagcgccacgccggcc

SEQ ID NO: 366042 - RNA, 19 nt, Bordetella pertussis
caccagcgccugccgaucg

SEQ ID NO: 366043 - RNA, 13 nt, Bordetella pertussis
caccagcgcgccg

SEQ ID NO: 366044 - RNA, 19 nt, Bordetella pertussis
caccagcgcgccgaucacc

SEQ ID NO: 366045 - RNA, 14 nt, Bordetella pertussis
caccagcgcggcca

SEQ ID NO: 366046 - RNA, 15 nt, Bordetella pertussis
caccagcgcggccag

SEQ ID NO: 366047 - RNA, 21 nt, Bordetella pertussis
caccagcgcggccagcaccgg

SEQ ID NO: 366048 - RNA, 12 nt, Bordetella pertussis
caccagcgcguc

SEQ ID NO: 366049 - RNA, 13 nt, Bordetella pertussis
caccagcgcgucg

SEQ ID NO: 366050 - RNA, 16 nt, Bordetella pertussis
caccagcgcgucgccg

SEQ ID NO: 366051 - RNA, 14 nt, Bordetella pertussis
caccagcggcgccg

SEQ ID NO: 366052 - RNA, 15 nt, Bordetella pertussis
caccagcggcgccgg

SEQ ID NO: 366053 - RNA, 16 nt, Bordetella pertussis
caccagcggcgccgga

SEQ ID NO: 366054 - RNA, 23 nt, Bordetella pertussis
caccagcggcguggcggccaggc

SEQ ID NO: 366055 - RNA, 14 nt, Bordetella pertussis
caccagcuccucga

SEQ ID NO: 366056 - RNA, 14 nt, Bordetella pertussis
caccagcucgcggc

SEQ ID NO: 366057 - RNA, 13 nt, Bordetella pertussis
caccagcuugcgc

SEQ ID NO: 366058 - RNA, 14 nt, Bordetella pertussis
caccagcuuggccu

SEQ ID NO: 366059 - RNA, 19 nt, Bordetella pertussis
caccaggaacagcaacgcc

SEQ ID NO: 366060 - RNA, 20 nt, Bordetella pertussis
caccaggaacagcaacgcca

SEQ ID NO: 366061 - RNA, 17 nt, Bordetella pertussis
caccaggaagagcuggc

SEQ ID NO: 366062 - RNA, 19 nt, Bordetella pertussis
caccaggaagagcuggcgc

SEQ ID NO: 366063 - RNA, 14 nt, Bordetella pertussis
caccaggcccaggg

SEQ ID NO: 366064 - RNA, 13 nt, Bordetella pertussis
caccaggccgccg

SEQ ID NO: 366065 - RNA, 18 nt, Bordetella pertussis
caccaggccgccggccag

SEQ ID NO: 366066 - RNA, 19 nt, Bordetella pertussis
caccaggccgccggccagc

SEQ ID NO: 366067 - RNA, 15 nt, Bordetella pertussis
caccaggccgcggcg

SEQ ID NO: 366068 - RNA, 20 nt, Bordetella pertussis
caccagggcgcgcagcaggc

SEQ ID NO: 366069 - RNA, 16 nt, Bordetella pertussis
caccaggguggcgccg

SEQ ID NO: 366070 - RNA, 18 nt, Bordetella pertussis
caccaggguggcgccggc

SEQ ID NO: 366071 - RNA, 19 nt, Bordetella pertussis
caccaggguggcgccggcc

SEQ ID NO: 366072 - RNA, 20 nt, Bordetella pertussis
caccaggguggcgccggcca

SEQ ID NO: 366073 - RNA, 16 nt, Bordetella pertussis
caccaggguggcgucc

SEQ ID NO: 366074 - RNA, 19 nt, Bordetella pertussis
caccaggguggcguccugg

SEQ ID NO: 366075 - RNA, 19 nt, Bordetella pertussis
caccaggguuuccucgccg

SEQ ID NO: 366076 - RNA, 23 nt, Bordetella pertussis
caccaggguuuccucgccgacga

SEQ ID NO: 366077 - RNA, 20 nt, Bordetella pertussis
caccagguagggcagcaggu

SEQ ID NO: 366078 - RNA, 21 nt, Bordetella pertussis
caccagguagggcagcagguc

SEQ ID NO: 366079 - RNA, 14 nt, Bordetella pertussis
caccagguccuggc

SEQ ID NO: 366080 - RNA, 16 nt, Bordetella pertussis
caccagguccuggcgg

SEQ ID NO: 366081 - RNA, 18 nt, Bordetella pertussis
cacccacacuuggccggc

SEQ ID NO: 366082 - RNA, 20 nt, Bordetella pertussis
cacccacagcagcgcgccgc

SEQ ID NO: 366083 - RNA, 14 nt, Bordetella pertussis
cacccagccggacc

SEQ ID NO: 366084 - RNA, 19 nt, Bordetella pertussis
cacccagguaucggccagc

SEQ ID NO: 366085 - RNA, 20 nt, Bordetella pertussis
cacccagguaucggccagca

SEQ ID NO: 366086 - RNA, 16 nt, Bordetella pertussis
cacccccagggcgcgc

SEQ ID NO: 366087 - RNA, 17 nt, Bordetella pertussis
cacccccgaccgagcca

SEQ ID NO: 366088 - RNA, 14 nt, Bordetella pertussis
cacccccgggcgca

SEQ ID NO: 366089 - RNA, 22 nt, Bordetella pertussis
caccccgagauaggcggccagg

SEQ ID NO: 366090 - RNA, 23 nt, Bordetella pertussis
caccccgagauaggcggccaggc

SEQ ID NO: 366091 - RNA, 14 nt, Bordetella pertussis
cacccgccgccggc

SEQ ID NO: 366092 - RNA, 16 nt, Bordetella pertussis
cacccgccuggacggc

SEQ ID NO: 366093 - RNA, 12 nt, Bordetella pertussis
cacccgcgcgca

SEQ ID NO: 366094 - RNA, 12 nt, Bordetella pertussis
cacccgcggcca

SEQ ID NO: 366095 - RNA, 22 nt, Bordetella pertussis
cacccgcggcgcaugcagccgc

SEQ ID NO: 366096 - RNA, 17 nt, Bordetella pertussis
cacccgcuaccccggca

SEQ ID NO: 366097 - RNA, 22 nt, Bordetella pertussis
cacccgcuaccccggcagcguc

SEQ ID NO: 366098 - RNA, 17 nt, Bordetella pertussis
cacccgguauccgcgca

SEQ ID NO: 366099 - RNA, 14 nt, Bordetella pertussis
cacccggucggccc

SEQ ID NO: 366100 - RNA, 23 nt, Bordetella pertussis
cacccgucccugguccagcagcg

SEQ ID NO: 366101 - RNA, 23 nt, Bordetella pertussis
caccgaagcaucccagucgaugc

SEQ ID NO: 366102 - RNA, 18 nt, Bordetella pertussis
caccgacaagccggucga

SEQ ID NO: 366103 - RNA, 13 nt, Bordetella pertussis
caccgacacgcug

SEQ ID NO: 366104 - RNA, 18 nt, Bordetella pertussis
caccgacaggaugggcgc

SEQ ID NO: 366105 - RNA, 14 nt, Bordetella pertussis
caccgacaggccga

SEQ ID NO: 366106 - RNA, 17 nt, Bordetella pertussis
caccgaccagcgcgcgc

SEQ ID NO: 366107 - RNA, 20 nt, Bordetella pertussis
caccgaccagcgcgcgccgg

SEQ ID NO: 366108 - RNA, 22 nt, Bordetella pertussis
caccgaccagcgcgcgccggcc

SEQ ID NO: 366109 - RNA, 12 nt, Bordetella pertussis
caccgacggcgc

SEQ ID NO: 366110 - RNA, 15 nt, Bordetella pertussis
caccgacggcgcggc

SEQ ID NO: 366111 - RNA, 22 nt, Bordetella pertussis
caccgacggcgcggcgaucggc

SEQ ID NO: 366112 - RNA, 14 nt, Bordetella pertussis
caccgcgccagcgc

SEQ ID NO: 366113 - RNA, 16 nt, Bordetella pertussis
caccgcgccagcgccg

SEQ ID NO: 366114 - RNA, 13 nt, Bordetella pertussis
caccgcgcccagg

SEQ ID NO: 366115 - RNA, 13 nt, Bordetella pertussis
caccgcgccgggc

SEQ ID NO: 366116 - RNA, 21 nt, Bordetella pertussis
caccgcgccgcccacgccgcu

SEQ ID NO: 366117 - RNA, 19 nt, Bordetella pertussis
caccgcggcggaccacacg

SEQ ID NO: 366118 - RNA, 23 nt, Bordetella pertussis
caccgcggcgggcucggcgccgg

SEQ ID NO: 366119 - RNA, 17 nt, Bordetella pertussis
caccgcggugccgcgcg

SEQ ID NO: 366120 - RNA, 16 nt, Bordetella pertussis
caccgcgucauacacg

SEQ ID NO: 366121 - RNA, 23 nt, Bordetella pertussis
caccgcgucauacacggcgcggg

SEQ ID NO: 366122 - RNA, 19 nt, Bordetella pertussis
caccgcguugagcgccgac

SEQ ID NO: 366123 - RNA, 12 nt, Bordetella pertussis
caccgcugauca

SEQ ID NO: 366124 - RNA, 18 nt, Bordetella pertussis
caccgcugaucaggucca

SEQ ID NO: 366125 - RNA, 18 nt, Bordetella pertussis
caccgcuggacgaggcga

SEQ ID NO: 366126 - RNA, 17 nt, Bordetella pertussis
caccggauccugcggcg

SEQ ID NO: 366127 - RNA, 18 nt, Bordetella pertussis
caccggauccugcggcgc

SEQ ID NO: 366128 - RNA, 20 nt, Bordetella pertussis
caccggauccugcggcgcgg

SEQ ID NO: 366129 - RNA, 19 nt, Bordetella pertussis
caccggcaagccuugcggc

SEQ ID NO: 366130 - RNA, 17 nt, Bordetella pertussis
caccggcacgacggccu

SEQ ID NO: 366131 - RNA, 13 nt, Bordetella pertussis
caccggcacgccg

SEQ ID NO: 366132 - RNA, 14 nt, Bordetella pertussis
caccggcacgccgg

SEQ ID NO: 366133 - RNA, 18 nt, Bordetella pertussis
caccggcacgccggcggc

SEQ ID NO: 366134 - RNA, 19 nt, Bordetella pertussis
caccggcacgccggcggcg

SEQ ID NO: 366135 - RNA, 18 nt, Bordetella pertussis
caccggcagcguaucgcc

SEQ ID NO: 366136 - RNA, 23 nt, Bordetella pertussis
caccggcagcguaucgcccgcgc

SEQ ID NO: 366137 - RNA, 13 nt, Bordetella pertussis
caccggcaggccg

SEQ ID NO: 366138 - RNA, 18 nt, Bordetella pertussis
caccggcaggccgcgcug

SEQ ID NO: 366139 - RNA, 12 nt, Bordetella pertussis
caccggcaugcc

SEQ ID NO: 366140 - RNA, 16 nt, Bordetella pertussis
caccggccaggggcgc

SEQ ID NO: 366141 - RNA, 19 nt, Bordetella pertussis
caccggccaggggcgcugg

SEQ ID NO: 366142 - RNA, 16 nt, Bordetella pertussis
caccggccagucgcgg

SEQ ID NO: 366143 - RNA, 14 nt, Bordetella pertussis
caccggccgccgca

SEQ ID NO: 366144 - RNA, 15 nt, Bordetella pertussis
caccggcgcgccugg

SEQ ID NO: 366145 - RNA, 16 nt, Bordetella pertussis
caccggcgugagcgcc

SEQ ID NO: 366146 - RNA, 19 nt, Bordetella pertussis
caccggcgugagcgccacc

SEQ ID NO: 366147 - RNA, 16 nt, Bordetella pertussis
caccggcgugcgcugg

SEQ ID NO: 366148 - RNA, 14 nt, Bordetella pertussis
caccggcuuggccu

SEQ ID NO: 366149 - RNA, 20 nt, Bordetella pertussis
caccggcuuggccucggccg

SEQ ID NO: 366150 - RNA, 21 nt, Bordetella pertussis
caccggcuuggccucggccgg

SEQ ID NO: 366151 - RNA, 22 nt, Bordetella pertussis
caccggcuuggccucggccggc

SEQ ID NO: 366152 - RNA, 17 nt, Bordetella pertussis
caccggcuugggcgugc

SEQ ID NO: 366153 - RNA, 20 nt, Bordetella pertussis
caccggcuugggcgugcccu

SEQ ID NO: 366154 - RNA, 18 nt, Bordetella pertussis
caccggcuuggggcgcgc

SEQ ID NO: 366155 - RNA, 13 nt, Bordetella pertussis
caccgggccggcc

SEQ ID NO: 366156 - RNA, 22 nt, Bordetella pertussis
caccgggccggccugcgucgcc

SEQ ID NO: 366157 - RNA, 15 nt, Bordetella pertussis
caccgggcggcccgg

SEQ ID NO: 366158 - RNA, 22 nt, Bordetella pertussis
caccggggcagggcgggcggga

SEQ ID NO: 366159 - RNA, 16 nt, Bordetella pertussis
caccgggcugaacauc

SEQ ID NO: 366160 - RNA, 16 nt, Bordetella pertussis
caccggucuacgccau

SEQ ID NO: 366161 - RNA, 23 nt, Bordetella pertussis
caccgguugcagcgcgccaggcg

SEQ ID NO: 366162 - RNA, 20 nt, Bordetella pertussis
caccguauccucgaucagcg

SEQ ID NO: 366163 - RNA, 16 nt, Bordetella pertussis
caccgucacgcgcugg

SEQ ID NO: 366164 - RNA, 15 nt, Bordetella pertussis
caccgucgacuucga

SEQ ID NO: 366165 - RNA, 14 nt, Bordetella pertussis
caccgucgcgcgca

SEQ ID NO: 366166 - RNA, 14 nt, Bordetella pertussis
caccgucuggcgua

SEQ ID NO: 366167 - RNA, 15 nt, Bordetella pertussis
caccgucuugcccgc

SEQ ID NO: 366168 - RNA, 16 nt, Bordetella pertussis
caccgucuugcccgcc

SEQ ID NO: 366169 - RNA, 20 nt, Bordetella pertussis
caccgucuugcccgccagcg

SEQ ID NO: 366170 - RNA, 14 nt, Bordetella pertussis
caccgugaccagcg

SEQ ID NO: 366171 - RNA, 16 nt, Bordetella pertussis
caccgugauggcgcgg

SEQ ID NO: 366172 - RNA, 16 nt, Bordetella pertussis
caccgugaugucgccg

SEQ ID NO: 366173 - RNA, 21 nt, Bordetella pertussis
caccgugaugucgccgucggc

SEQ ID NO: 366174 - RNA, 22 nt, Bordetella pertussis
caccgugaugucgccgucggca

SEQ ID NO: 366175 - RNA, 19 nt, Bordetella pertussis
caccgugauauagaccagc

SEQ ID NO: 366176 - RNA, 18 nt, Bordetella pertussis
caccguggcaugccaugc

SEQ ID NO: 366177 - RNA, 20 nt, Bordetella pertussis
caccguggcaugccaugcgc

SEQ ID NO: 366178 - RNA, 20 nt, Bordetella pertussis
caccguggccacggccgcga

SEQ ID NO: 366179 - RNA, 15 nt, Bordetella pertussis
caccgugcuggccga

SEQ ID NO: 366180 - RNA, 16 nt, Bordetella pertussis
caccgugcuggccgac

SEQ ID NO: 366181 - RNA, 19 nt, Bordetella pertussis
caccgugugaucgccgacg

SEQ ID NO: 366182 - RNA, 19 nt, Bordetella pertussis
caccguucuuccgcacgcc

SEQ ID NO: 366183 - RNA, 17 nt, Bordetella pertussis
caccguuuccaagcgca

SEQ ID NO: 366184 - RNA, 19 nt, Bordetella pertussis
caccguuuuggcaggcugg

SEQ ID NO: 366185 - RNA, 22 nt, Bordetella pertussis
cacgccauucauccagcgcgcg

SEQ ID NO: 366186 - RNA, 19 nt, Bordetella pertussis
cacgcccacuuccucggcg

SEQ ID NO: 366187 - RNA, 23 nt, Bordetella pertussis
cacgcccacuuccucggcgcgcg

SEQ ID NO: 366188 - RNA, 14 nt, Bordetella pertussis
cacgcccagccgca

SEQ ID NO: 366189 - RNA, 17 nt, Bordetella pertussis
cacgcccagccgcagca

SEQ ID NO: 366190 - RNA, 18 nt, Bordetella pertussis
cacgcccacgcgccgcca

SEQ ID NO: 366191 - RNA, 15 nt, Bordetella pertussis
cacgcccagcgccgg

SEQ ID NO: 366192 - RNA, 14 nt, Bordetella pertussis
cacgcccaggccgu

SEQ ID NO: 366193 - RNA, 19 nt, Bordetella pertussis
cacgcccaggccguggcgc

SEQ ID NO: 366194 - RNA, 23 nt, Bordetella pertussis
cacgcccaggccguggcgcacca

SEQ ID NO: 366195 - RNA, 12 nt, Bordetella pertussis
cacgcccaggcg

SEQ ID NO: 366196 - RNA, 20 nt, Bordetella pertussis
cacgcccagucccaggccga

SEQ ID NO: 366197 - RNA, 23 nt, Bordetella pertussis
cacgcccaucugguugagcagca

SEQ ID NO: 366198 - RNA, 22 nt, Bordetella pertussis
cacgcccauguagaacgccagg

SEQ ID NO: 366199 - RNA, 23 nt, Bordetella pertussis
cacgccgaauacgcucaggguuu

SEQ ID NO: 366200 - RNA, 22 nt, Bordetella pertussis
cacgccgaccuggcgcccgacg

SEQ ID NO: 366201 - RNA, 18 nt, Bordetella pertussis
cacgccgaugaccagggc

SEQ ID NO: 366202 - RNA, 19 nt, Bordetella pertussis
cacgccgaugaccagggcg

SEQ ID NO: 366203 - RNA, 21 nt, Bordetella pertussis
cacgccgaugaccagggcgcc

SEQ ID NO: 366204 - RNA, 22 nt, Bordetella pertussis
cacgccgaugaccagggcgccg

SEQ ID NO: 366205 - RNA, 17 nt, Bordetella pertussis
cacgccgaugcacaggu

SEQ ID NO: 366206 - RNA, 16 nt, Bordetella pertussis
cacgccgaugccgcgc

SEQ ID NO: 366207 - RNA, 19 nt, Bordetella pertussis
cacgccgauugaggccagc

SEQ ID NO: 366208 - RNA, 20 nt, Bordetella pertussis
cacgccgauugaggccagca

SEQ ID NO: 366209 - RNA, 17 nt, Bordetella pertussis
cacgccggaccagucga

SEQ ID NO: 366210 - RNA, 19 nt, Bordetella pertussis
cacgccggccaggucggcg

SEQ ID NO: 366211 - RNA, 11 nt, Bordetella pertussis
cacgccggccg

SEQ ID NO: 366212 - RNA, 17 nt, Bordetella pertussis
cacgccggccugcgcca

SEQ ID NO: 366213 - RNA, 14 nt, Bordetella pertussis
cacgccggcgcgcc

SEQ ID NO: 366214 - RNA, 17 nt, Bordetella pertussis
cacgccggcgcgccggc

SEQ ID NO: 366215 - RNA, 21 nt, Bordetella pertussis
cacgccggcgcgccggccgcg

SEQ ID NO: 366216 - RNA, 14 nt, Bordetella pertussis
cacgccggcggcca

SEQ ID NO: 366217 - RNA, 14 nt, Bordetella pertussis
cacgccggcggcgc

SEQ ID NO: 366218 - RNA, 15 nt, Bordetella pertussis
cacgccggcggcgcu

SEQ ID NO: 366219 - RNA, 14 nt, Bordetella pertussis
cacgccggcgguca

SEQ ID NO: 366220 - RNA, 17 nt, Bordetella pertussis
cacgccgggcgcggccg

SEQ ID NO: 366221 - RNA, 19 nt, Bordetella pertussis
cacgccggguugcggcgga

SEQ ID NO: 366222 - RNA, 22 nt, Bordetella pertussis
cacgccgucagcgacaucgugc

SEQ ID NO: 366223 - RNA, 14 nt, Bordetella pertussis
cacgccugccgcgc

SEQ ID NO: 366224 - RNA, 15 nt, Bordetella pertussis
cacgccugccgcgcc

SEQ ID NO: 366225 - RNA, 22 nt, Bordetella pertussis
cacgcgcuccggcugcgcgcgc

SEQ ID NO: 366226 - RNA, 13 nt, Bordetella pertussis
cacgcgcucgggc

SEQ ID NO: 366227 - RNA, 14 nt, Bordetella pertussis
cacgcgcucgggca

SEQ ID NO: 366228 - RNA, 13 nt, Bordetella pertussis
cacgcgcuugcgc

SEQ ID NO: 366229 - RNA, 23 nt, Bordetella pertussis
cacgcgcuugcgcgccacgucga

SEQ ID NO: 366230 - RNA, 13 nt, Bordetella pertussis
cacgcggcgcggc

SEQ ID NO: 366231 - RNA, 19 nt, Bordetella pertussis
cacgcggcgcugcuggccg

SEQ ID NO: 366232 - RNA, 22 nt, Bordetella pertussis
cacgcggcgcugcuggccggcc

SEQ ID NO: 366233 - RNA, 23 nt, Bordetella pertussis
cacgcggcgcugcuggccggcca

SEQ ID NO: 366234 - RNA, 14 nt, Bordetella pertussis
cacgcggcgcagca

SEQ ID NO: 366235 - RNA, 20 nt, Bordetella pertussis
cacgcggccgcgggccgcug

SEQ ID NO: 366236 - RNA, 14 nt, Bordetella pertussis
cacgcgggccggcc

SEQ ID NO: 366237 - RNA, 18 nt, Bordetella pertussis
cacgcgguagguagcgcg

SEQ ID NO: 366238 - RNA, 23 nt, Bordetella pertussis
cacgcgguagguagcgcgcagcu

SEQ ID NO: 366239 - RNA, 18 nt, Bordetella pertussis
cacgcgguccacgccggg

SEQ ID NO: 366240 - RNA, 18 nt, Bordetella pertussis
cacgcggugcaucucggc

SEQ ID NO: 366241 - RNA, 15 nt, Bordetella pertussis
cacgcguacggcccu

SEQ ID NO: 366242 - RNA, 14 nt, Bordetella pertussis
cacgcggucgaugc

SEQ ID NO: 366243 - RNA, 21 nt, Bordetella pertussis
cacgcggucgaugcgcacgcc

SEQ ID NO: 366244 - RNA, 16 nt, Bordetella pertussis
cacgcguucgggcggc

SEQ ID NO: 366245 - RNA, 18 nt, Bordetella pertussis
cacgcuaaauacgcuggc

SEQ ID NO: 366246 - RNA, 15 nt, Bordetella pertussis
cacgcuagggcgugg

SEQ ID NO: 366247 - RNA, 19 nt, Bordetella pertussis
cacgcucagcaugcgcugg

SEQ ID NO: 366248 - RNA, 17 nt, Bordetella pertussis
cacgcucuacacggccg

SEQ ID NO: 366249 - RNA, 19 nt, Bordetella pertussis
cacgcucuacacggccgcc

SEQ ID NO: 366250 - RNA, 15 nt, Bordetella pertussis
cacgcucugcaccuu

SEQ ID NO: 366251 - RNA, 16 nt, Bordetella pertussis
cacgcucugcaccuug

SEQ ID NO: 366252 - RNA, 20 nt, Bordetella pertussis
cacgcucuugagcgcggccu

SEQ ID NO: 366253 - RNA, 19 nt, Bordetella pertussis
cacgcucuugcgcgcgccg

SEQ ID NO: 366254 - RNA, 19 nt, Bordetella pertussis
cacgcugaucgccggcgcc

SEQ ID NO: 366255 - RNA, 14 nt, Bordetella pertussis
cacgcugcgcaggc

SEQ ID NO: 366256 - RNA, 17 nt, Bordetella pertussis
cacgcugcgcaggcgcg

SEQ ID NO: 366257 - RNA, 17 nt, Bordetella pertussis
cacgcuggccgcgcccg

SEQ ID NO: 366258 - RNA, 18 nt, Bordetella pertussis
cacgcuggccgcgcccgc

SEQ ID NO: 366259 - RNA, 21 nt, Bordetella pertussis
cacgcuggccgcgcccgccgc

SEQ ID NO: 366260 - RNA, 16 nt, Bordetella pertussis
cacgcuggccgcgcug

SEQ ID NO: 366261 - RNA, 17 nt, Bordetella pertussis
cacgcuggcaucgucgc

SEQ ID NO: 366262 - RNA, 12 nt, Bordetella pertussis
cacgcuggccuu

SEQ ID NO: 366263 - RNA, 22 nt, Bordetella pertussis
cacgcuggcggacacgcccugg

SEQ ID NO: 366264 - RNA, 18 nt, Bordetella pertussis
cacgcugggcuacgaccc

SEQ ID NO: 366265 - RNA, 21 nt, Bordetella pertussis
cacgcugggccagaccgcgcg

SEQ ID NO: 366266 - RNA, 22 nt, Bordetella pertussis
cacgcuguacugguaccaggcg

SEQ ID NO: 366267 - RNA, 17 nt, Bordetella pertussis
cacgcuguuuucggccg

SEQ ID NO: 366268 - RNA, 18 nt, Bordetella pertussis
cacgcuguuuucggccga

SEQ ID NO: 366269 - RNA, 23 nt, Bordetella pertussis
cacgcuguuuucggccgacucga

SEQ ID NO: 366270 - RNA, 20 nt, Bordetella pertussis
cacggcacgccucgccggcc

SEQ ID NO: 366271 - RNA, 14 nt, Bordetella pertussis
cacggcaucgccgc

SEQ ID NO: 366272 - RNA, 14 nt, Bordetella pertussis
cacggcaucggcca

SEQ ID NO: 366273 - RNA, 22 nt, Bordetella pertussis
cacggccaacccucgcacggcc

SEQ ID NO: 366274 - RNA, 15 nt, Bordetella pertussis
cacggccacggccgg

SEQ ID NO: 366275 - RNA, 19 nt, Bordetella pertussis
cacggccacggccggcagc

SEQ ID NO: 366276 - RNA, 14 nt, Bordetella pertussis
cacggccagcacca

SEQ ID NO: 366277 - RNA, 17 nt, Bordetella pertussis
cacggccagcaccaugg

SEQ ID NO: 366278 - RNA, 19 nt, Bordetella pertussis
cacggccagcaccaugggc

SEQ ID NO: 366279 - RNA, 22 nt, Bordetella pertussis
cacggccagcagcacgaucgcg

SEQ ID NO: 366280 - RNA, 19 nt, Bordetella pertussis
cacggcgaggaugccgcgc

SEQ ID NO: 366281 - RNA, 23 nt, Bordetella pertussis
cacggcuuuggcguagccggugc

SEQ ID NO: 366282 - RNA, 22 nt, Bordetella pertussis
cacgggauguccgcgucggccg

SEQ ID NO: 366283 - RNA, 13 nt, Bordetella pertussis
cacgggccgacgg

SEQ ID NO: 366284 - RNA, 13 nt, Bordetella pertussis
cacgggcgccagc

SEQ ID NO: 366285 - RNA, 15 nt, Bordetella pertussis
cacgggcccgcgcag

SEQ ID NO: 366286 - RNA, 14 nt, Bordetella pertussis
cacggucagcaacc

SEQ ID NO: 366287 - RNA, 19 nt, Bordetella pertussis
cacggucgcgagcugcgcg

SEQ ID NO: 366288 - RNA, 21 nt, Bordetella pertussis
cacggucggcacgucgggcag

SEQ ID NO: 366289 - RNA, 15 nt, Bordetella pertussis
cacggucugcacgcc

SEQ ID NO: 366290 - RNA, 19 nt, Bordetella pertussis
cacggucugcacgccgggc

SEQ ID NO: 366291 - RNA, 17 nt, Bordetella pertussis
cacguacaaccgcgccg

SEQ ID NO: 366292 - RNA, 18 nt, Bordetella pertussis
cacguacaaccgcgccga

SEQ ID NO: 366293 - RNA, 19 nt, Bordetella pertussis
cacgguuucgccgugcugg

SEQ ID NO: 366294 - RNA, 13 nt, Bordetella pertussis
cacguaaucgaag

SEQ ID NO: 366295 - RNA, 19 nt, Bordetella pertussis
cacguaggcaaagcgcggc

SEQ ID NO: 366296 - RNA, 22 nt, Bordetella pertussis
cacguaggcaaagcgcggcugc

SEQ ID NO: 366297 - RNA, 16 nt, Bordetella pertussis
cacguaguacagcagc

SEQ ID NO: 366298 - RNA, 13 nt, Bordetella pertussis
cacgucaguccgu

SEQ ID NO: 366299 - RNA, 21 nt, Bordetella pertussis
cacgucaguccguggcgcggc

SEQ ID NO: 366300 - RNA, 23 nt, Bordetella pertussis
cacgucaguccguggcgcggcca

SEQ ID NO: 366301 - RNA, 17 nt, Bordetella pertussis
cacgucauccugggcgc

SEQ ID NO: 366302 - RNA, 19 nt, Bordetella pertussis
cacgucauccugggcgcgc

SEQ ID NO: 366303 - RNA, 12 nt, Bordetella pertussis
cacguccagcac

SEQ ID NO: 366304 - RNA, 16 nt, Bordetella pertussis
cacguccagcacggcc

SEQ ID NO: 366305 - RNA, 20 nt, Bordetella pertussis
cacgucauugcaucgcagca

SEQ ID NO: 366306 - RNA, 20 nt, Bordetella pertussis
cacgucgaccucgagcaccu

SEQ ID NO: 366307 - RNA, 23 nt, Bordetella pertussis
cacgucgaccucgagcaccuuga

SEQ ID NO: 366308 - RNA, 17 nt, Bordetella pertussis
cacgucgaucaggccca

SEQ ID NO: 366309 - RNA, 14 nt, Bordetella pertussis
cacgugccagccga

SEQ ID NO: 366310 - RNA, 15 nt, Bordetella pertussis
cacgugccagccgaa

SEQ ID NO: 366311 - RNA, 19 nt, Bordetella pertussis
cacgugccggauggcgcgg

SEQ ID NO: 366312 - RNA, 14 nt, Bordetella pertussis
cacgugcugcugga

SEQ ID NO: 366313 - RNA, 22 nt, Bordetella pertussis
cacgugcugcuggagaucgccg

SEQ ID NO: 366314 - RNA, 15 nt, Bordetella pertussis
cacguggcgacgucg

SEQ ID NO: 366315 - RNA, 16 nt, Bordetella pertussis
cacguggcgacgucgg

SEQ ID NO: 366316 - RNA, 14 nt, Bordetella pertussis
cacgugggcacgcc

SEQ ID NO: 366317 - RNA, 15 nt, Bordetella pertussis
cacgugggcacgccg

SEQ ID NO: 366318 - RNA, 16 nt, Bordetella pertussis
cacgugggcacgccgg

SEQ ID NO: 366319 - RNA, 18 nt, Bordetella pertussis
cacgugggcacgccggcc

SEQ ID NO: 366320 - RNA, 23 nt, Bordetella pertussis
cacguugucgagcaggccgccgc

SEQ ID NO: 366321 - RNA, 14 nt, Bordetella pertussis
cacguugucgcgcg

SEQ ID NO: 366322 - RNA, 14 nt, Bordetella pertussis
cacucacgcaaggc

SEQ ID NO: 366323 - RNA, 16 nt, Bordetella pertussis
cacuccauagcgccgc

SEQ ID NO: 366324 - RNA, 14 nt, Bordetella pertussis
cacucggugcgcgc

SEQ ID NO: 366325 - RNA, 19 nt, Bordetella pertussis
cacucggugcgcgcgccca

SEQ ID NO: 366326 - RNA, 22 nt, Bordetella pertussis
cacucugcccgaagcggcccgg

SEQ ID NO: 366327 - RNA, 13 nt, Bordetella pertussis
cacuuccuugcca

SEQ ID NO: 366328 - RNA, 23 nt, Bordetella pertussis
cacuuccucggcgcgcgcggucg

SEQ ID NO: 366329 - RNA, 15 nt, Bordetella pertussis
cacuucgccucggcg

SEQ ID NO: 366330 - RNA, 17 nt, Bordetella pertussis
cacuucgcggccgaugu

SEQ ID NO: 366331 - RNA, 14 nt, Bordetella pertussis
cacuugcaggccgc

SEQ ID NO: 366332 - RNA, 15 nt, Bordetella pertussis
cacuugccggccgcc

SEQ ID NO: 366333 - RNA, 19 nt, Bordetella pertussis
cacuugccggccgcccagg

SEQ ID NO: 366334 - RNA, 17 nt, Bordetella pertussis
cacuugcgaacggccgc

SEQ ID NO: 366335 - RNA, 19 nt, Bordetella pertussis
cacuugcgaacggccgccc

SEQ ID NO: 366336 - RNA, 17 nt, Bordetella pertussis
cagaaaaaauacccguc

SEQ ID NO: 366337 - RNA, 13 nt, Bordetella pertussis
cagaaaccccagg

SEQ ID NO: 366338 - RNA, 14 nt, Bordetella pertussis
cagaaacuggcgcu

SEQ ID NO: 366339 - RNA, 15 nt, Bordetella pertussis
cagaaaggcagcgga

SEQ ID NO: 366340 - RNA, 18 nt, Bordetella pertussis
cagaacggaaacgcccag

SEQ ID NO: 366341 - RNA, 19 nt, Bordetella pertussis
cagaacggaaacgcccagc

SEQ ID NO: 366342 - RNA, 22 nt, Bordetella pertussis
cagaacggaaacgcccagcccu

SEQ ID NO: 366343 - RNA, 14 nt, Bordetella pertussis
cagaagcagccgcg

SEQ ID NO: 366344 - RNA, 13 nt, Bordetella pertussis
cagacaggccggc

SEQ ID NO: 366345 - RNA, 20 nt, Bordetella pertussis
cagaccacgacggucugggc

SEQ ID NO: 366346 - RNA, 13 nt, Bordetella pertussis
cagaccacgccgg

SEQ ID NO: 366347 - RNA, 22 nt, Bordetella pertussis
cagacccgaaucucccggcgcc

SEQ ID NO: 366348 - RNA, 13 nt, Bordetella pertussis
cagacccgggccg

SEQ ID NO: 366349 - RNA, 14 nt, Bordetella pertussis
cagacccgggccgc

SEQ ID NO: 366350 - RNA, 14 nt, Bordetella pertussis
cagacccuggcgcg

SEQ ID NO: 366351 - RNA, 16 nt, Bordetella pertussis
cagaccgagcgcgccc

SEQ ID NO: 366352 - RNA, 18 nt, Bordetella pertussis
cagaccgagcgcgcccgc

SEQ ID NO: 366353 - RNA, 16 nt, Bordetella pertussis
cagaccuaccaggccg

SEQ ID NO: 366354 - RNA, 20 nt, Bordetella pertussis
cagaccuaccaggccgacga

SEQ ID NO: 366355 - RNA, 16 nt, Bordetella pertussis
cagaccugcgcgccgg

SEQ ID NO: 366356 - RNA, 18 nt, Bordetella pertussis
cagaccuugcgcgacggc

SEQ ID NO: 366357 - RNA, 20 nt, Bordetella pertussis
cagaccuugcgcgacggcga

SEQ ID NO: 366358 - RNA, 15 nt, Bordetella pertussis
cagacgaucacggug

SEQ ID NO: 366359 - RNA, 15 nt, Bordetella pertussis
cagacgcagaccacg

SEQ ID NO: 366360 - RNA, 21 nt, Bordetella pertussis
cagacgcaguggaaaucgugc

SEQ ID NO: 366361 - RNA, 21 nt, Bordetella pertussis
cagacgccaucuugcaggcgc

SEQ ID NO: 366362 - RNA, 17 nt, Bordetella pertussis
cagacgcgagaccauga

SEQ ID NO: 366363 - RNA, 23 nt, Bordetella pertussis
cagacgcgagaccaugacgucga

SEQ ID NO: 366364 - RNA, 15 nt, Bordetella pertussis
cagacgcuucaggcc

SEQ ID NO: 366365 - RNA, 17 nt, Bordetella pertussis
cagacgcuucaggccgu

SEQ ID NO: 366366 - RNA, 15 nt, Bordetella pertussis
cagacggccagcgcg

SEQ ID NO: 366367 - RNA, 17 nt, Bordetella pertussis
cagacggccagcgcgcg

SEQ ID NO: 366368 - RNA, 14 nt, Bordetella pertussis
cagacggcggcugg

SEQ ID NO: 366369 - RNA, 18 nt, Bordetella pertussis
cagacugcugccggauug

SEQ ID NO: 366370 - RNA, 22 nt, Bordetella pertussis
cagagcccuucgacgcggcggc

SEQ ID NO: 366371 - RNA, 22 nt, Bordetella pertussis
cagagcgggauggucgcggccg

SEQ ID NO: 366372 - RNA, 23 nt, Bordetella pertussis
cagagcuugccguacgagugcag

SEQ ID NO: 366373 - RNA, 22 nt, Bordetella pertussis
cagagggagcgacacccgcggc

SEQ ID NO: 366374 - RNA, 16 nt, Bordetella pertussis
cagaucaucggcgcca

SEQ ID NO: 366375 - RNA, 20 nt, Bordetella pertussis
cagauccacgcccgcgccga

SEQ ID NO: 366376 - RNA, 23 nt, Bordetella pertussis
cagauccacgcccgcgccgaagu

SEQ ID NO: 366377 - RNA, 15 nt, Bordetella pertussis
cagauccagcgcggc

SEQ ID NO: 366378 - RNA, 14 nt, Bordetella pertussis
cagaucccaggcgc

SEQ ID NO: 366379 - RNA, 15 nt, Bordetella pertussis
cagaucccaggcgcu

SEQ ID NO: 366380 - RNA, 14 nt, Bordetella pertussis
cagauccagcuugc

SEQ ID NO: 366381 - RNA, 13 nt, Bordetella pertussis
cagaucgaacacg

SEQ ID NO: 366382 - RNA, 14 nt, Bordetella pertussis
cagaucgccaacgu

SEQ ID NO: 366383 - RNA, 19 nt, Bordetella pertussis
cagaucgccaacgucggca

SEQ ID NO: 366384 - RNA, 13 nt, Bordetella pertussis
cagaucgccgccg

SEQ ID NO: 366385 - RNA, 15 nt, Bordetella pertussis
cagaucugcacgcug

SEQ ID NO: 366386 - RNA, 13 nt, Bordetella pertussis
cagaugcaccagu

SEQ ID NO: 366387 - RNA, 14 nt, Bordetella pertussis
cagaugcaccaguu

SEQ ID NO: 366388 - RNA, 15 nt, Bordetella pertussis
cagaugcaccggcca

SEQ ID NO: 366389 - RNA, 18 nt, Bordetella pertussis
cagauugaugcccaugcg

SEQ ID NO: 366390 - RNA, 23 nt, Bordetella pertussis
cagauugccuuccuugaccaccu

SEQ ID NO: 366391 - RNA, 16 nt, Bordetella pertussis
cagcaaccccagcagc

SEQ ID NO: 366392 - RNA, 17 nt, Bordetella pertussis
cagcaaccccagcagcg

SEQ ID NO: 366393 - RNA, 18 nt, Bordetella pertussis
cagcaaccccagcagcgc

SEQ ID NO: 366394 - RNA, 19 nt, Bordetella pertussis
cagcaaccccagcagcgcc

SEQ ID NO: 366395 - RNA, 20 nt, Bordetella pertussis
cagcaaccccagcagcgccg

SEQ ID NO: 366396 - RNA, 13 nt, Bordetella pertussis
cagcaagcccacc

SEQ ID NO: 366397 - RNA, 21 nt, Bordetella pertussis
cagcaagcccaccgggccggc

SEQ ID NO: 366398 - RNA, 14 nt, Bordetella pertussis
cagcaagcgcucgg

SEQ ID NO: 366399 - RNA, 20 nt, Bordetella pertussis
cagcaagcgcucggccacgc

SEQ ID NO: 366400 - RNA, 15 nt, Bordetella pertussis
cagcaagcugcugcu

SEQ ID NO: 366401 - RNA, 15 nt, Bordetella pertussis
cagcaaggcgcgcca

SEQ ID NO: 366402 - RNA, 18 nt, Bordetella pertussis
cagcaaggcgcgccaccg

SEQ ID NO: 366403 - RNA, 14 nt, Bordetella pertussis
cagcaaggcgucga

SEQ ID NO: 366404 - RNA, 18 nt, Bordetella pertussis
cagcaagggccccagcau

SEQ ID NO: 366405 - RNA, 23 nt, Bordetella pertussis
cagcaagggcgucuucgccgacc

SEQ ID NO: 366406 - RNA, 22 nt, Bordetella pertussis
cagcaagggguccguggcggcc

SEQ ID NO: 366407 - RNA, 15 nt, Bordetella pertussis
cagcacggucggcgc

SEQ ID NO: 366408 - RNA, 19 nt, Bordetella pertussis
cagcacggcuugcgcgccu

SEQ ID NO: 366409 - RNA, 20 nt, Bordetella pertussis
cagcacgggaugcuccagcu

SEQ ID NO: 366410 - RNA, 13 nt, Bordetella pertussis
cagcacgguggcg

SEQ ID NO: 366411 - RNA, 20 nt, Bordetella pertussis
cagcacgguggcgcccggcg

SEQ ID NO: 366412 - RNA, 22 nt, Bordetella pertussis
cagcacgguggcgcccggcggc

SEQ ID NO: 366413 - RNA, 23 nt, Bordetella pertussis
cagcacgucauccugggcgcgcg

SEQ ID NO: 366414 - RNA, 14 nt, Bordetella pertussis
cagcacgucgcgca

SEQ ID NO: 366415 - RNA, 21 nt, Bordetella pertussis
cagcacgucguagcgcugcag

SEQ ID NO: 366416 - RNA, 16 nt, Bordetella pertussis
cagcacuaccugcgcu

SEQ ID NO: 366417 - RNA, 16 nt, Bordetella pertussis
cagcacuugccggccg

SEQ ID NO: 366418 - RNA, 18 nt, Bordetella pertussis
cagcacuugccggccgcc

SEQ ID NO: 366419 - RNA, 23 nt, Bordetella pertussis
cagcacuugccggccgcccaggc

SEQ ID NO: 366420 - RNA, 19 nt, Bordetella pertussis
cagcagauucaugggcggc

SEQ ID NO: 366421 - RNA, 16 nt, Bordetella pertussis
cagcagauugccgcgc

SEQ ID NO: 366422 - RNA, 17 nt, Bordetella pertussis
cagcagauugccgcgcg

SEQ ID NO: 366423 - RNA, 20 nt, Bordetella pertussis
cagcagauugccgcgcggcg

SEQ ID NO: 366424 - RNA, 21 nt, Bordetella pertussis
cagcagauugccgcgcggcgc

SEQ ID NO: 366425 - RNA, 16 nt, Bordetella pertussis
cagcagcaccgugccg

SEQ ID NO: 366426 - RNA, 17 nt, Bordetella pertussis
cagcagcaccgugccgg

SEQ ID NO: 366427 - RNA, 19 nt, Bordetella pertussis
cagcagcaccgugccggcg

SEQ ID NO: 366428 - RNA, 21 nt, Bordetella pertussis
cagcagcaccgugccggcgua

SEQ ID NO: 366429 - RNA, 19 nt, Bordetella pertussis
cagcagcaccuucugccgc

SEQ ID NO: 366430 - RNA, 24 nt, Bordetella pertussis
cagcagcaccuucugccgccaggc

SEQ ID NO: 366431 - RNA, 16 nt, Bordetella pertussis
cagcagcacgcccaug

SEQ ID NO: 366432 - RNA, 15 nt, Bordetella pertussis
cagcagcccgcuggc

SEQ ID NO: 366433 - RNA, 15 nt, Bordetella pertussis
cagcagcgaaucgcc

SEQ ID NO: 366434 - RNA, 15 nt, Bordetella pertussis
cagcagcgcgccgcc

SEQ ID NO: 366435 - RNA, 15 nt, Bordetella pertussis
cagcagcgcgccggg

SEQ ID NO: 366436 - RNA, 16 nt, Bordetella pertussis
cagcagcgcgccgggc

SEQ ID NO: 366437 - RNA, 13 nt, Bordetella pertussis
cagcagcgcggcg

SEQ ID NO: 366438 - RNA, 20 nt, Bordetella pertussis
cagcagcgcgguggccagcg

SEQ ID NO: 366439 - RNA, 14 nt, Bordetella pertussis
cagcagcgcgguca

SEQ ID NO: 366440 - RNA, 16 nt, Bordetella pertussis
cagcagcggcucgagc

SEQ ID NO: 366441 - RNA, 19 nt, Bordetella pertussis
cagcagcggcucgagcggc

SEQ ID NO: 366442 - RNA, 15 nt, Bordetella pertussis
cagcagcggguugcg

SEQ ID NO: 366443 - RNA, 19 nt, Bordetella pertussis
cagcagcggguugcgcgcc

SEQ ID NO: 366444 - RNA, 20 nt, Bordetella pertussis
cagcagcggguugcgcgcca

SEQ ID NO: 366445 - RNA, 17 nt, Bordetella pertussis
cagcaggcccugggcga

SEQ ID NO: 366446 - RNA, 14 nt, Bordetella pertussis
cagcaggccgcgcg

SEQ ID NO: 366447 - RNA, 12 nt, Bordetella pertussis
cagcaggccggc

SEQ ID NO: 366448 - RNA, 16 nt, Bordetella pertussis
cagcaggccguugccg

SEQ ID NO: 366449 - RNA, 15 nt, Bordetella pertussis
cagcaggcgaaacgc

SEQ ID NO: 366450 - RNA, 13 nt, Bordetella pertussis
cagcaggcgcacc

SEQ ID NO: 366451 - RNA, 19 nt, Bordetella pertussis
cagcaggcgcaccagcgcg

SEQ ID NO: 366452 - RNA, 13 nt, Bordetella pertussis
cagcaggcgcgcg

SEQ ID NO: 366453 - RNA, 15 nt, Bordetella pertussis
cagcaggcgcgcggc

SEQ ID NO: 366454 - RNA, 20 nt, Bordetella pertussis
cagcaggcgcgcggccucga

SEQ ID NO: 366455 - RNA, 23 nt, Bordetella pertussis
cagcaggcggccgaccagcacga

SEQ ID NO: 366456 - RNA, 15 nt, Bordetella pertussis
cagcaggcuggccac

SEQ ID NO: 366457 - RNA, 22 nt, Bordetella pertussis
cagcaggcuuucgcacagccgg

SEQ ID NO: 366458 - RNA, 23 nt, Bordetella pertussis
cagcaggcuuucgcacagccggg

SEQ ID NO: 366459 - RNA, 20 nt, Bordetella pertussis
cagcagggacuugggcaggc

SEQ ID NO: 366460 - RNA, 19 nt, Bordetella pertussis
cagcagggccacgcccagg

SEQ ID NO: 366461 - RNA, 16 nt, Bordetella pertussis
cagcagggccaggccg

SEQ ID NO: 366462 - RNA, 14 nt, Bordetella pertussis
cagcagggccuggc

SEQ ID NO: 366463 - RNA, 17 nt, Bordetella pertussis
cagcagggcgccgacga

SEQ ID NO: 366464 - RNA, 18 nt, Bordetella pertussis
cagcagggcgccgacgau

SEQ ID NO: 366465 - RNA, 12 nt, Bordetella pertussis
cagcagggcggc

SEQ ID NO: 366466 - RNA, 18 nt, Bordetella pertussis
cagcagggucagcggccg

SEQ ID NO: 366467 - RNA, 21 nt, Bordetella pertussis
cagcagggucagcggccggcc

SEQ ID NO: 366468 - RNA, 14 nt, Bordetella pertussis
cagcagggucauga

SEQ ID NO: 366469 - RNA, 20 nt, Bordetella pertussis
cagcagggcgccgacgaugc

SEQ ID NO: 366470 - RNA, 19 nt, Bordetella pertussis
cagcagggucugcaggccg

SEQ ID NO: 366471 - RNA, 17 nt, Bordetella pertussis
cagcaggguggccacgc

SEQ ID NO: 366472 - RNA, 19 nt, Bordetella pertussis
cagcaggucgcgcacgcug

SEQ ID NO: 366473 - RNA, 20 nt, Bordetella pertussis
cagcaggucggagucggcgc

SEQ ID NO: 366474 - RNA, 22 nt, Bordetella pertussis
cagcaggucggagucggcgccg

SEQ ID NO: 366475 - RNA, 18 nt, Bordetella pertussis
cagcaggucggcgcggcc

SEQ ID NO: 366476 - RNA, 17 nt, Bordetella pertussis
cagcagguggaucgacg

SEQ ID NO: 366477 - RNA, 17 nt, Bordetella pertussis
cagcaguguuucggccu

SEQ ID NO: 366478 - RNA, 20 nt, Bordetella pertussis
cagcaguguuucggccugcu

SEQ ID NO: 366479 - RNA, 24 nt, Bordetella pertussis
cagcaguguuucggccugcucgca

SEQ ID NO: 366480 - RNA, 16 nt, Bordetella pertussis
cagcaguucggccggc

SEQ ID NO: 366481 - RNA, 23 nt, Bordetella pertussis
cagcaguucggucagcgcggcgc

SEQ ID NO: 366482 - RNA, 22 nt, Bordetella pertussis
cagcaguuucugcaccggcgcc

SEQ ID NO: 366483 - RNA, 20 nt, Bordetella pertussis
cagcaucgccgccagcuugg

SEQ ID NO: 366484 - RNA, 14 nt, Bordetella pertussis
cagcaucgcgccuu

SEQ ID NO: 366485 - RNA, 20 nt, Bordetella pertussis
cagcauggcggcgcccgcug

SEQ ID NO: 366486 - RNA, 21 nt, Bordetella pertussis
cagcauggcggcgcccgcugc

SEQ ID NO: 366487 - RNA, 22 nt, Bordetella pertussis
cagcauggcggcgcccgcugcg

SEQ ID NO: 366488 - RNA, 23 nt, Bordetella pertussis
cagcauggcggcgcccgcugcgu

SEQ ID NO: 366489 - RNA, 23 nt, Bordetella pertussis
cagcauggucggcauggccagga

SEQ ID NO: 366490 - RNA, 14 nt, Bordetella pertussis
cagcauguacagcg

SEQ ID NO: 366491 - RNA, 22 nt, Bordetella pertussis
cagcauguauucaucacgggcg

SEQ ID NO: 366492 - RNA, 24 nt, Bordetella pertussis
cagcauguauucaucacgggcgcc

SEQ ID NO: 366493 - RNA, 22 nt, Bordetella pertussis
cagcauguccguaucgcggccg

SEQ ID NO: 366494 - RNA, 15 nt, Bordetella pertussis
cagcaugucguggcg

SEQ ID NO: 366495 - RNA, 16 nt, Bordetella pertussis
cagcaugucguggcga

SEQ ID NO: 366496 - RNA, 19 nt, Bordetella pertussis
cagcaugugcgcggcguug

SEQ ID NO: 366497 - RNA, 20 nt, Bordetella pertussis
cagccacacgaucagcgccc

SEQ ID NO: 366498 - RNA, 13 nt, Bordetella pertussis
cagccacacgcug

SEQ ID NO: 366499 - RNA, 17 nt, Bordetella pertussis
cagccacacgcugaagc

SEQ ID NO: 366500 - RNA, 20 nt, Bordetella pertussis
cagccacacgcugaagcgcc

SEQ ID NO: 366501 - RNA, 17 nt, Bordetella pertussis
cagccacaggcccaugc

SEQ ID NO: 366502 - RNA, 20 nt, Bordetella pertussis
cagccacaggcccaugccgc

SEQ ID NO: 366503 - RNA, 18 nt, Bordetella pertussis
cagccaccccgucaucgc

SEQ ID NO: 366504 - RNA, 19 nt, Bordetella pertussis
cagccaccccgucaucgcc

SEQ ID NO: 366505 - RNA, 13 nt, Bordetella pertussis
cagccaccgguug

SEQ ID NO: 366506 - RNA, 18 nt, Bordetella pertussis
cagccaccgguugcagcg

SEQ ID NO: 366507 - RNA, 12 nt, Bordetella pertussis
cagccacgcgcg

SEQ ID NO: 366508 - RNA, 16 nt, Bordetella pertussis
cagccacgcgcgcugg

SEQ ID NO: 366509 - RNA, 18 nt, Bordetella pertussis
cagccacgcgcgcuggcg

SEQ ID NO: 366510 - RNA, 19 nt, Bordetella pertussis
cagccacgggauguccgcg

SEQ ID NO: 366511 - RNA, 14 nt, Bordetella pertussis
cagccacugcggcc

SEQ ID NO: 366512 - RNA, 21 nt, Bordetella pertussis
cagccacugcggcccgagcca

SEQ ID NO: 366513 - RNA, 20 nt, Bordetella pertussis
cagccacuggaacagcuugg

SEQ ID NO: 366514 - RNA, 15 nt, Bordetella pertussis
cagccaggccucggc

SEQ ID NO: 366515 - RNA, 23 nt, Bordetella pertussis
cagccagggcagggcgccgucca

SEQ ID NO: 366516 - RNA, 18 nt, Bordetella pertussis
cagccagguggcgaugcc

SEQ ID NO: 366517 - RNA, 14 nt, Bordetella pertussis
cagccaguugggcc

SEQ ID NO: 366518 - RNA, 17 nt, Bordetella pertussis
cagccaguugggccagg

SEQ ID NO: 366519 - RNA, 17 nt, Bordetella pertussis
cagccaucaucaucguc

SEQ ID NO: 366520 - RNA, 18 nt, Bordetella pertussis
cagccaucaucaucgucg

SEQ ID NO: 366521 - RNA, 23 nt, Bordetella pertussis
cagccaucaucaucgucggcgcc

SEQ ID NO: 366522 - RNA, 21 nt, Bordetella pertussis
cagccauccucgcccagcggc

SEQ ID NO: 366523 - RNA, 15 nt, Bordetella pertussis
cagccccagcgucca

SEQ ID NO: 366524 - RNA, 12 nt, Bordetella pertussis
cagccccaggcg

SEQ ID NO: 366525 - RNA, 14 nt, Bordetella pertussis
cagccccaggcgcg

SEQ ID NO: 366526 - RNA, 18 nt, Bordetella pertussis
cagccccccguaggcggc

SEQ ID NO: 366527 - RNA, 24 nt, Bordetella pertussis
cagccccccguaggcggcccaggc

SEQ ID NO: 366528 - RNA, 13 nt, Bordetella pertussis
cagccccgcggcc

SEQ ID NO: 366529 - RNA, 14 nt, Bordetella pertussis
cagccccgcggccg

SEQ ID NO: 366530 - RNA, 18 nt, Bordetella pertussis
cagccccgggugcagguc

SEQ ID NO: 366531 - RNA, 14 nt, Bordetella pertussis
cagcccgacggcca

SEQ ID NO: 366532 - RNA, 16 nt, Bordetella pertussis
cagcccgacggccagc

SEQ ID NO: 366533 - RNA, 18 nt, Bordetella pertussis
cagcccgaucgacggccg

SEQ ID NO: 366534 - RNA, 20 nt, Bordetella pertussis
cagcccgaucgacggccgca

SEQ ID NO: 366535 - RNA, 13 nt, Bordetella pertussis
cagcccgcgcgcc

SEQ ID NO: 366536 - RNA, 14 nt, Bordetella pertussis
cagcccgcgcuggc

SEQ ID NO: 366537 - RNA, 23 nt, Bordetella pertussis
cagcccgcgcuggcgcagcaggc

SEQ ID NO: 366538 - RNA, 21 nt, Bordetella pertussis
cagcccgcgucgcugucggcg

SEQ ID NO: 366539 - RNA, 19 nt, Bordetella pertussis
cagcccgcguucaggcgcg

SEQ ID NO: 366540 - RNA, 21 nt, Bordetella pertussis
cagcccgcguucaggcgcggc

SEQ ID NO: 366541 - RNA, 20 nt, Bordetella pertussis
cagcccgcggguucgcccgg

SEQ ID NO: 366542 - RNA, 13 nt, Bordetella pertussis
cagcccggccaga

SEQ ID NO: 366543 - RNA, 17 nt, Bordetella pertussis
cagcccggccgccagca

SEQ ID NO: 366544 - RNA, 22 nt, Bordetella pertussis
cagcccggccgccagcauggcg

SEQ ID NO: 366545 - RNA, 18 nt, Bordetella pertussis
cagccgacaggcgcgcag

SEQ ID NO: 366546 - RNA, 19 nt, Bordetella pertussis
cagccgacaggcgcgcagg

SEQ ID NO: 366547 - RNA, 17 nt, Bordetella pertussis
cagccgagccuggcgua

SEQ ID NO: 366548 - RNA, 18 nt, Bordetella pertussis
cagccgaucagccggcca

SEQ ID NO: 366549 - RNA, 19 nt, Bordetella pertussis
cagccgaucagccggccau

SEQ ID NO: 366550 - RNA, 15 nt, Bordetella pertussis
cagccgaugauggug

SEQ ID NO: 366551 - RNA, 23 nt, Bordetella pertussis
cagccgaugauggugaacgccac

SEQ ID NO: 366552 - RNA, 13 nt, Bordetella pertussis
cagccggcggcca

SEQ ID NO: 366553 - RNA, 14 nt, Bordetella pertussis
cagccgggcggcca

SEQ ID NO: 366554 - RNA, 15 nt, Bordetella pertussis
cagccgggcggccac

SEQ ID NO: 366555 - RNA, 24 nt, Bordetella pertussis
cagccggcugcaagacgcccaggc

SEQ ID NO: 366556 - RNA, 17 nt, Bordetella pertussis
cagccgggcugccggca

SEQ ID NO: 366557 - RNA, 19 nt, Bordetella pertussis
cagccgggcugccggcagc

SEQ ID NO: 366558 - RNA, 23 nt, Bordetella pertussis
cagccggggcgagcgcagccgcu

SEQ ID NO: 366559 - RNA, 21 nt, Bordetella pertussis
cagccgggcgaucgcgucggc

SEQ ID NO: 366560 - RNA, 23 nt, Bordetella pertussis
cagccgggcgaucgcgucggcca

SEQ ID NO: 366561 - RNA, 18 nt, Bordetella pertussis
cagccggugcgcggcuug

SEQ ID NO: 366562 - RNA, 22 nt, Bordetella pertussis
cagccggugcgcggcuugcagc

SEQ ID NO: 366563 - RNA, 16 nt, Bordetella pertussis
cagccgugucgcccuu

SEQ ID NO: 366564 - RNA, 21 nt, Bordetella pertussis
cagccguucaucagcgcgcgc

SEQ ID NO: 366565 - RNA, 16 nt, Bordetella pertussis
cagccguucauggcgu

SEQ ID NO: 366566 - RNA, 19 nt, Bordetella pertussis
cagccguugcgccagcggc

SEQ ID NO: 366567 - RNA, 21 nt, Bordetella pertussis
cagccguugcgccagcggcga

SEQ ID NO: 366568 - RNA, 16 nt, Bordetella pertussis
cagccguuggcgccca

SEQ ID NO: 366569 - RNA, 22 nt, Bordetella pertussis
cagccguuggcgcccagcgcca

SEQ ID NO: 366570 - RNA, 23 nt, Bordetella pertussis
cagccguuggcgcccagcgccau

SEQ ID NO: 366571 - RNA, 16 nt, Bordetella pertussis
cagccugggcgccugg

SEQ ID NO: 366572 - RNA, 15 nt, Bordetella pertussis
cagccuggggcaggc

SEQ ID NO: 366573 - RNA, 18 nt, Bordetella pertussis
cagccuggggcaggcggc

SEQ ID NO: 366574 - RNA, 19 nt, Bordetella pertussis
cagccuggggcaggcggcu

SEQ ID NO: 366575 - RNA, 17 nt, Bordetella pertussis
cagccugucguucggcu

SEQ ID NO: 366576 - RNA, 23 nt, Bordetella pertussis
cagccuugaaagaggcauuggcg

SEQ ID NO: 366577 - RNA, 17 nt, Bordetella pertussis
cagccuuggcccacuca

SEQ ID NO: 366578 - RNA, 15 nt, Bordetella pertussis
cagccuuggucagcg

SEQ ID NO: 366579 - RNA, 23 nt, Bordetella pertussis
cagccuuuccuccugccggcgga

SEQ ID NO: 366580 - RNA, 18 nt, Bordetella pertussis
cagcgaaagcacggcgau

SEQ ID NO: 366581 - RNA, 19 nt, Bordetella pertussis
cagcgaaaugccgaagcgc

SEQ ID NO: 366582 - RNA, 12 nt, Bordetella pertussis
cagcgacagcac

SEQ ID NO: 366583 - RNA, 14 nt, Bordetella pertussis
cagcgacagcacgg

SEQ ID NO: 366584 - RNA, 15 nt, Bordetella pertussis
cagcgacagcacggu

SEQ ID NO: 366585 - RNA, 13 nt, Bordetella pertussis
cagcgacagcagg

SEQ ID NO: 366586 - RNA, 13 nt, Bordetella pertussis
cagcgacagccag

SEQ ID NO: 366587 - RNA, 17 nt, Bordetella pertussis
cagcgacagccaggcca

SEQ ID NO: 366588 - RNA, 18 nt, Bordetella pertussis
cagcgacagccaggccag

SEQ ID NO: 366589 - RNA, 17 nt, Bordetella pertussis
cagcgacaucgugcugu

SEQ ID NO: 366590 - RNA, 16 nt, Bordetella pertussis
cagcgaccgcggcggu

SEQ ID NO: 366591 - RNA, 14 nt, Bordetella pertussis
cagcgagacggugu

SEQ ID NO: 366592 - RNA, 15 nt, Bordetella pertussis
cagcgagaucagcac

SEQ ID NO: 366593 - RNA, 21 nt, Bordetella pertussis
cagcgagaucagcaccgcgac

SEQ ID NO: 366594 - RNA, 14 nt, Bordetella pertussis
cagcgagagcgcca

SEQ ID NO: 366595 - RNA, 21 nt, Bordetella pertussis
cagcgagcccgccaucgccag

SEQ ID NO: 366596 - RNA, 14 nt, Bordetella pertussis
cagcgagccggcca

SEQ ID NO: 366597 - RNA, 16 nt, Bordetella pertussis
cagcgagccggccagc

SEQ ID NO: 366598 - RNA, 19 nt, Bordetella pertussis
cagcgagccggccagcgcc

SEQ ID NO: 366599 - RNA, 15 nt, Bordetella pertussis
cagcgagcggggcug

SEQ ID NO: 366600 - RNA, 16 nt, Bordetella pertussis
cagcgagcggggcugg

SEQ ID NO: 366601 - RNA, 21 nt, Bordetella pertussis
cagcgagcgaaagccgucggc

SEQ ID NO: 366602 - RNA, 18 nt, Bordetella pertussis
cagcgaggcaucgaaggc

SEQ ID NO: 366603 - RNA, 19 nt, Bordetella pertussis
cagcgaggccucgugcugc

SEQ ID NO: 366604 - RNA, 23 nt, Bordetella pertussis
cagcgaggccucgugcugcugca

SEQ ID NO: 366605 - RNA, 16 nt, Bordetella pertussis
cagcgaggcgcagcgc

SEQ ID NO: 366606 - RNA, 18 nt, Bordetella pertussis
cagcgaguagacgcagcc

SEQ ID NO: 366607 - RNA, 20 nt, Bordetella pertussis
cagcgaguuguccuggccgg

SEQ ID NO: 366608 - RNA, 20 nt, Bordetella pertussis
cagcgauacccgcuucgacg

SEQ ID NO: 366609 - RNA, 21 nt, Bordetella pertussis
cagcgcaccaccaccaugugc

SEQ ID NO: 366610 - RNA, 17 nt, Bordetella pertussis
cagcgcaccaccagcac

SEQ ID NO: 366611 - RNA, 18 nt, Bordetella pertussis
cagcgcaccgucgccagg

SEQ ID NO: 366612 - RNA, 23 nt, Bordetella pertussis
cagcgcacgguccaggcggccgc

SEQ ID NO: 366613 - RNA, 21 nt, Bordetella pertussis
cagcgcacugaucgccgccuu

SEQ ID NO: 366614 - RNA, 22 nt, Bordetella pertussis
cagcgcagcuucuaucugccgc

SEQ ID NO: 366615 - RNA, 13 nt, Bordetella pertussis
cagcgcaggcuga

SEQ ID NO: 366616 - RNA, 17 nt, Bordetella pertussis
cagcgcauaggacgcca

SEQ ID NO: 366617 - RNA, 16 nt, Bordetella pertussis
cagcgcaucgcgcgcg

SEQ ID NO: 366618 - RNA, 19 nt, Bordetella pertussis
cagcgcaucgcgcgcgccg

SEQ ID NO: 366619 - RNA, 21 nt, Bordetella pertussis
cagcgcaucgcgcgcgccggc

SEQ ID NO: 366620 - RNA, 20 nt, Bordetella pertussis
cagcgcaucgaucucggccu

SEQ ID NO: 366621 - RNA, 23 nt, Bordetella pertussis
cagcgcauuggugagcacgcgca

SEQ ID NO: 366622 - RNA, 17 nt, Bordetella pertussis
cagcgccaccaccggca

SEQ ID NO: 366623 - RNA, 19 nt, Bordetella pertussis
cagcgccaccaccggcacg

SEQ ID NO: 366624 - RNA, 23 nt, Bordetella pertussis
cagcgccaccaccggcacgccgg

SEQ ID NO: 366625 - RNA, 13 nt, Bordetella pertussis
cagcgccaccagc

SEQ ID NO: 366626 - RNA, 20 nt, Bordetella pertussis
cagcgccaccagcagcgcca

SEQ ID NO: 366627 - RNA, 15 nt, Bordetella pertussis
cagcgccaccguggc

SEQ ID NO: 366628 - RNA, 17 nt, Bordetella pertussis
cagcgccaccguggcca

SEQ ID NO: 366629 - RNA, 21 nt, Bordetella pertussis
cagcgccaccguggccacggc

SEQ ID NO: 366630 - RNA, 22 nt, Bordetella pertussis
cagcgccaccguggccacggcc

SEQ ID NO: 366631 - RNA, 16 nt, Bordetella pertussis
cagcgccacgacgccg

SEQ ID NO: 366632 - RNA, 21 nt, Bordetella pertussis
cagcgccacgcccaggccgcu

SEQ ID NO: 366633 - RNA, 14 nt, Bordetella pertussis
cagcgccacgcccu

SEQ ID NO: 366634 - RNA, 13 nt, Bordetella pertussis
cagcgccacgccg

SEQ ID NO: 366635 - RNA, 14 nt, Bordetella pertussis
cagcgccacgccgg

SEQ ID NO: 366636 - RNA, 23 nt, Bordetella pertussis
cagcgccacgccggccagcuuga

SEQ ID NO: 366637 - RNA, 13 nt, Bordetella pertussis
cagcgccacgcug

SEQ ID NO: 366638 - RNA, 23 nt, Bordetella pertussis
cagcgccacgcuguuuucggccg

SEQ ID NO: 366639 - RNA, 15 nt, Bordetella pertussis
cagcgccagaaagcg

SEQ ID NO: 366640 - RNA, 19 nt, Bordetella pertussis
cagcgccagaaagcgcggc

SEQ ID NO: 366641 - RNA, 14 nt, Bordetella pertussis
cagcgccagcaccg

SEQ ID NO: 366642 - RNA, 16 nt, Bordetella pertussis
cagcgccagcaccggc

SEQ ID NO: 366643 - RNA, 22 nt, Bordetella pertussis
cagcgccagcaccggcacgcgc

SEQ ID NO: 366644 - RNA, 17 nt, Bordetella pertussis
cagcgccagcaggguca

SEQ ID NO: 366645 - RNA, 23 nt, Bordetella pertussis
cagcgccagcagggucagcggcc

SEQ ID NO: 366646 - RNA, 15 nt, Bordetella pertussis
cagcgccagcccgcu

SEQ ID NO: 366647 - RNA, 22 nt, Bordetella pertussis
cagcgccagccgcuugcccguc

SEQ ID NO: 366648 - RNA, 18 nt, Bordetella pertussis
cagcgccagcagcaggcc

SEQ ID NO: 366649 - RNA, 20 nt, Bordetella pertussis
cagcgccagcagcaggccgu

SEQ ID NO: 366650 - RNA, 17 nt, Bordetella pertussis
cagcgccaggaacagcg

SEQ ID NO: 366651 - RNA, 22 nt, Bordetella pertussis
cagcgccaggaacagcgccggc

SEQ ID NO: 366652 - RNA, 23 nt, Bordetella pertussis
cagcgccaggaacagcgccggca

SEQ ID NO: 366653 - RNA, 20 nt, Bordetella pertussis
cagcgccaggaugaugaggu

SEQ ID NO: 366654 - RNA, 13 nt, Bordetella pertussis
cagcgccaggccg

SEQ ID NO: 366655 - RNA, 16 nt, Bordetella pertussis
cagcgccaggccgcgc

SEQ ID NO: 366656 - RNA, 17 nt, Bordetella pertussis
cagcgccaggccgcgca

SEQ ID NO: 366657 - RNA, 13 nt, Bordetella pertussis
cagcgccagggcc

SEQ ID NO: 366658 - RNA, 19 nt, Bordetella pertussis
cagcgccagggccaggccg

SEQ ID NO: 366659 - RNA, 14 nt, Bordetella pertussis
cagcgccagggccg

SEQ ID NO: 366660 - RNA, 18 nt, Bordetella pertussis
cagcgccagggccgccgc

SEQ ID NO: 366661 - RNA, 23 nt, Bordetella pertussis
cagcgccagggccgccgcgccca

SEQ ID NO: 366662 - RNA, 14 nt, Bordetella pertussis
cagcgccagggugc

SEQ ID NO: 366663 - RNA, 20 nt, Bordetella pertussis
cagcgccaucaagagcaccg

SEQ ID NO: 366664 - RNA, 14 nt, Bordetella pertussis
cagcgccaucgcgc

SEQ ID NO: 366665 - RNA, 15 nt, Bordetella pertussis
cagcgccaucgcgcg

SEQ ID NO: 366666 - RNA, 12 nt, Bordetella pertussis
cagcgccaucau

SEQ ID NO: 366667 - RNA, 17 nt, Bordetella pertussis
cagcgccaugaugucgc

SEQ ID NO: 366668 - RNA, 16 nt, Bordetella pertussis
cagcgccauuccgaug

SEQ ID NO: 366669 - RNA, 23 nt, Bordetella pertussis
cagcgcccaaucgggcagcacgc

SEQ ID NO: 366670 - RNA, 24 nt, Bordetella pertussis
cagcgcccaggcgaugcccagcgc

SEQ ID NO: 366671 - RNA, 18 nt, Bordetella pertussis
cagcgcccccagcacggu

SEQ ID NO: 366672 - RNA, 18 nt, Bordetella pertussis
cagcgcccgaaggugggc

SEQ ID NO: 366673 - RNA, 19 nt, Bordetella pertussis
cagcgcccgaaggugggcg

SEQ ID NO: 366674 - RNA, 15 nt, Bordetella pertussis
cagcgcccgcgccau

SEQ ID NO: 366675 - RNA, 16 nt, Bordetella pertussis
cagcgcccgcgccauc

SEQ ID NO: 366676 - RNA, 17 nt, Bordetella pertussis
cagcgcccgcgccaucg

SEQ ID NO: 366677 - RNA, 17 nt, Bordetella pertussis
cagcgcccgcggaaagc

SEQ ID NO: 366678 - RNA, 17 nt, Bordetella pertussis
cagcgccgaccgcacga

SEQ ID NO: 366679 - RNA, 23 nt, Bordetella pertussis
cagcgccgacgauaucgcgaaag

SEQ ID NO: 366680 - RNA, 13 nt, Bordetella pertussis
cagcgccgacggc

SEQ ID NO: 366681 - RNA, 14 nt, Bordetella pertussis
cagcgccgacggca

SEQ ID NO: 366682 - RNA, 14 nt, Bordetella pertussis
cagcgccgacucga

SEQ ID NO: 366683 - RNA, 14 nt, Bordetella pertussis
cagcgccgagcgcc

SEQ ID NO: 366684 - RNA, 21 nt, Bordetella pertussis
cagcgccgagcgccaguucga

SEQ ID NO: 366685 - RNA, 21 nt, Bordetella pertussis
cagcgccgccaccucggcguc

SEQ ID NO: 366686 - RNA, 19 nt, Bordetella pertussis
cagcgccgccagcauggcg

SEQ ID NO: 366687 - RNA, 23 nt, Bordetella pertussis
cagcgccgccagcauggcggcca

SEQ ID NO: 366688 - RNA, 17 nt, Bordetella pertussis
cagcgccgccagccgcu

SEQ ID NO: 366689 - RNA, 23 nt, Bordetella pertussis
cagcgccgccauggcggcgccca

SEQ ID NO: 366690 - RNA, 13 nt, Bordetella pertussis
cagcgccgccgac

SEQ ID NO: 366691 - RNA, 17 nt, Bordetella pertussis
cagcgccgccgacggca

SEQ ID NO: 366692 - RNA, 16 nt, Bordetella pertussis
cagcgccgccuucacc

SEQ ID NO: 366693 - RNA, 20 nt, Bordetella pertussis
cagcgccgccuucaccggcc

SEQ ID NO: 366694 - RNA, 18 nt, Bordetella pertussis
cagcgccgcgagcgccga

SEQ ID NO: 366695 - RNA, 13 nt, Bordetella pertussis
cagcgccgcgccg

SEQ ID NO: 366696 - RNA, 14 nt, Bordetella pertussis
cagcgccgcgccgc

SEQ ID NO: 366697 - RNA, 14 nt, Bordetella pertussis
cagcgccgcgcgcu

SEQ ID NO: 366698 - RNA, 14 nt, Bordetella pertussis
cagcgccgcgcgcg

SEQ ID NO: 366699 - RNA, 12 nt, Bordetella pertussis
cagcgccgcggc

SEQ ID NO: 366700 - RNA, 22 nt, Bordetella pertussis
cagcgccgcgucgagcgcgacg

SEQ ID NO: 366701 - RNA, 18 nt, Bordetella pertussis
cagcgccggcacgcugac

SEQ ID NO: 366702 - RNA, 18 nt, Bordetella pertussis
cagcgccggcacgcugau

SEQ ID NO: 366703 - RNA, 19 nt, Bordetella pertussis
cagcgccggcacgcugauc

SEQ ID NO: 366704 - RNA, 20 nt, Bordetella pertussis
cagcgccggcacgcugaucg

SEQ ID NO: 366705 - RNA, 14 nt, Bordetella pertussis
cagcgccggcagcg

SEQ ID NO: 366706 - RNA, 15 nt, Bordetella pertussis
cagcgccggcagcgc

SEQ ID NO: 366707 - RNA, 16 nt, Bordetella pertussis
cagcgccggcagcgca

SEQ ID NO: 366708 - RNA, 18 nt, Bordetella pertussis
cagcgccggcaggcgcgc

SEQ ID NO: 366709 - RNA, 20 nt, Bordetella pertussis
cagcgccggcaggcgcgcca

SEQ ID NO: 366710 - RNA, 13 nt, Bordetella pertussis
cagcgccggcaug

SEQ ID NO: 366711 - RNA, 13 nt, Bordetella pertussis
cagcgccggcgca

SEQ ID NO: 366712 - RNA, 22 nt, Bordetella pertussis
cagcgccggcgcaugagccggc

SEQ ID NO: 366713 - RNA, 15 nt, Bordetella pertussis
cagcgccggcgcguc

SEQ ID NO: 366714 - RNA, 14 nt, Bordetella pertussis
cagcgccgggaucg

SEQ ID NO: 366715 - RNA, 18 nt, Bordetella pertussis
cagcgccgggaucggcgu

SEQ ID NO: 366716 - RNA, 16 nt, Bordetella pertussis
cagcgccggggggcgc

SEQ ID NO: 366717 - RNA, 19 nt, Bordetella pertussis
cagcgccggggucagcgcc

SEQ ID NO: 366718 - RNA, 22 nt, Bordetella pertussis
cagcgccggggucagcgccggc

SEQ ID NO: 366719 - RNA, 21 nt, Bordetella pertussis
cagcgccgucagcagcgcggc

SEQ ID NO: 366720 - RNA, 19 nt, Bordetella pertussis
cagcgccgucaucugcgga

SEQ ID NO: 366721 - RNA, 20 nt, Bordetella pertussis
cagcgccgucaucugcggaa

SEQ ID NO: 366722 - RNA, 19 nt, Bordetella pertussis
cagcgccucgcgcucgagc

SEQ ID NO: 366723 - RNA, 14 nt, Bordetella pertussis
cagcgccugcaggu

SEQ ID NO: 366724 - RNA, 16 nt, Bordetella pertussis
cagcgccugcaggucu

SEQ ID NO: 366725 - RNA, 20 nt, Bordetella pertussis
cagcgccugcauccggccca

SEQ ID NO: 366726 - RNA, 17 nt, Bordetella pertussis
cagcgccugccgaucgu

SEQ ID NO: 366727 - RNA, 15 nt, Bordetella pertussis
cagcgccugcgcggc

SEQ ID NO: 366728 - RNA, 18 nt, Bordetella pertussis
cagcgccugcgcggccuc

SEQ ID NO: 366729 - RNA, 16 nt, Bordetella pertussis
cagcgccugcgcggcg

SEQ ID NO: 366730 - RNA, 21 nt, Bordetella pertussis
cagcgccugcucguagcuguc

SEQ ID NO: 366731 - RNA, 13 nt, Bordetella pertussis
cagcgccuggacc

SEQ ID NO: 366732 - RNA, 15 nt, Bordetella pertussis
cagcgccuggaccug

SEQ ID NO: 366733 - RNA, 14 nt, Bordetella pertussis
cagcgccuggccga

SEQ ID NO: 366734 - RNA, 21 nt, Bordetella pertussis
cagcgccuggccgagcgcggc

SEQ ID NO: 366735 - RNA, 12 nt, Bordetella pertussis
cagcgccuggcg

SEQ ID NO: 366736 - RNA, 17 nt, Bordetella pertussis
cagcgccuggcggcugg

SEQ ID NO: 366737 - RNA, 19 nt, Bordetella pertussis
cagcgccuggcgggccugg

SEQ ID NO: 366738 - RNA, 22 nt, Bordetella pertussis
cagcgccuggcgggccugggcg

SEQ ID NO: 366739 - RNA, 20 nt, Bordetella pertussis
cagcgccugggucaggucgg

SEQ ID NO: 366740 - RNA, 14 nt, Bordetella pertussis
cagcgccuugcggc

SEQ ID NO: 366741 - RNA, 17 nt, Bordetella pertussis
cagcgccuugcggcgcu

SEQ ID NO: 366742 - RNA, 19 nt, Bordetella pertussis
cagcgcgaaaugcccagcg

SEQ ID NO: 366743 - RNA, 24 nt, Bordetella pertussis
cagcgcgaacaacgggaucggcgu

SEQ ID NO: 366744 - RNA, 19 nt, Bordetella pertussis
cagcgcgaaaacccgcggc

SEQ ID NO: 366745 - RNA, 15 nt, Bordetella pertussis
cagcgcgaacgccug

SEQ ID NO: 366746 - RNA, 20 nt, Bordetella pertussis
cagcgcgaaguaccagcgca

SEQ ID NO: 366747 - RNA, 16 nt, Bordetella pertussis
cagcgcgacggccucg

SEQ ID NO: 366748 - RNA, 16 nt, Bordetella pertussis
cagcgcgaccggcgcg

SEQ ID NO: 366749 - RNA, 14 nt, Bordetella pertussis
cagcgcgacuucgc

SEQ ID NO: 366750 - RNA, 21 nt, Bordetella pertussis
cagcgcgacuucgcgaaagcg

SEQ ID NO: 366751 - RNA, 19 nt, Bordetella pertussis
cagcgcgcaacccacggcg

SEQ ID NO: 366752 - RNA, 12 nt, Bordetella pertussis
cagcgcgcaacu

SEQ ID NO: 366753 - RNA, 19 nt, Bordetella pertussis
cagcgcgaucucgcgcagg

SEQ ID NO: 366754 - RNA, 21 nt, Bordetella pertussis
cagcgcgauucccuggcgcgc

SEQ ID NO: 366755 - RNA, 16 nt, Bordetella pertussis
cagcgcgccauggccg

SEQ ID NO: 366756 - RNA, 13 nt, Bordetella pertussis
cagcgcgcccgau

SEQ ID NO: 366757 - RNA, 12 nt, Bordetella pertussis
cagcgcgcccgc

SEQ ID NO: 366758 - RNA, 19 nt, Bordetella pertussis
cagcgcgccgaggaucugg

SEQ ID NO: 366759 - RNA, 11 nt, Bordetella pertussis
cagcgcgccgc

SEQ ID NO: 366760 - RNA, 18 nt, Bordetella pertussis
cagcgggcccgucgcgcc

SEQ ID NO: 366761 - RNA, 14 nt, Bordetella pertussis
cagcgggccgcagc

SEQ ID NO: 366762 - RNA, 14 nt, Bordetella pertussis
cagcgggccggcac

SEQ ID NO: 366763 - RNA, 15 nt, Bordetella pertussis
cagcgggccggcacc

SEQ ID NO: 366764 - RNA, 19 nt, Bordetella pertussis
cagcgggccggcaccacga

SEQ ID NO: 366765 - RNA, 14 nt, Bordetella pertussis
cagcgggcgcgccc

SEQ ID NO: 366766 - RNA, 19 nt, Bordetella pertussis
cagcgggcgcgcccggcgc

SEQ ID NO: 366767 - RNA, 20 nt, Bordetella pertussis
cagcgggcuggggcaggcac

SEQ ID NO: 366768 - RNA, 19 nt, Bordetella pertussis
cagcggggacaggcacccc

SEQ ID NO: 366769 - RNA, 12 nt, Bordetella pertussis
cagcggugcgcg

SEQ ID NO: 366770 - RNA, 13 nt, Bordetella pertussis
cagcggugcgcgg

SEQ ID NO: 366771 - RNA, 14 nt, Bordetella pertussis
cagcggugcgcggc

SEQ ID NO: 366772 - RNA, 15 nt, Bordetella pertussis
cagcggugcgcggcg

SEQ ID NO: 366773 - RNA, 16 nt, Bordetella pertussis
cagcggugcgcggcgc

SEQ ID NO: 366774 - RNA, 17 nt, Bordetella pertussis
cagcgguucgucggcgc

SEQ ID NO: 366775 - RNA, 22 nt, Bordetella pertussis
cagcgguugcgccagcuugcgc

SEQ ID NO: 366776 - RNA, 17 nt, Bordetella pertussis
cagcguaucgccgccgc

SEQ ID NO: 366777 - RNA, 23 nt, Bordetella pertussis
cagcguauuccccuucucggccg

SEQ ID NO: 366778 - RNA, 17 nt, Bordetella pertussis
cagcgugaaggucggca

SEQ ID NO: 366779 - RNA, 13 nt, Bordetella pertussis
cagcgugaccgac

SEQ ID NO: 366780 - RNA, 17 nt, Bordetella pertussis
cagcgucgcggcgucga

SEQ ID NO: 366781 - RNA, 20 nt, Bordetella pertussis
cagcgugacggcggcgcgcg

SEQ ID NO: 366782 - RNA, 20 nt, Bordetella pertussis
cagcgugaugccgucgagcg

SEQ ID NO: 366783 - RNA, 23 nt, Bordetella pertussis
cagcgugauggggccgggcgcca

SEQ ID NO: 366784 - RNA, 17 nt, Bordetella pertussis
cagcgugccgccggcgc

SEQ ID NO: 366785 - RNA, 18 nt, Bordetella pertussis
cagcgugccgccggcgcg

SEQ ID NO: 366786 - RNA, 20 nt, Bordetella pertussis
cagcgugccggugacgacgc

SEQ ID NO: 366787 - RNA, 14 nt, Bordetella pertussis
cagcgugcgccccg

SEQ ID NO: 366788 - RNA, 19 nt, Bordetella pertussis
cagcgugcgccccgccucg

SEQ ID NO: 366789 - RNA, 23 nt, Bordetella pertussis
cagcgugcgccccgccucgacga

SEQ ID NO: 366790 - RNA, 17 nt, Bordetella pertussis
cagcguucgcgcuugcg

SEQ ID NO: 366791 - RNA, 14 nt, Bordetella pertussis
cagcguugcggcgu

SEQ ID NO: 366792 - RNA, 17 nt, Bordetella pertussis
cagcguugcggcgucga

SEQ ID NO: 366793 - RNA, 17 nt, Bordetella pertussis
cagcguuucaccgcugg

SEQ ID NO: 366794 - RNA, 16 nt, Bordetella pertussis
cagcguuuccagggcg

SEQ ID NO: 366795 - RNA, 21 nt, Bordetella pertussis
cagcguuuccagggcgcgccg

SEQ ID NO: 366796 - RNA, 15 nt, Bordetella pertussis
cagcuccaccgggcu

SEQ ID NO: 366797 - RNA, 14 nt, Bordetella pertussis
cagcuccagccgca

SEQ ID NO: 366798 - RNA, 13 nt, Bordetella pertussis
cagcuccagcugg

SEQ ID NO: 366799 - RNA, 23 nt, Bordetella pertussis
cagcuccagcuggcgcaccaggc

SEQ ID NO: 366800 - RNA, 22 nt, Bordetella pertussis
cagcucgaccacggcggcuucg

SEQ ID NO: 366801 - RNA, 21 nt, Bordetella pertussis
cagcucgaccgucagcaugcc

SEQ ID NO: 366802 - RNA, 13 nt, Bordetella pertussis
cagcucgacgcca

SEQ ID NO: 366803 - RNA, 14 nt, Bordetella pertussis
cagcucgccggcga

SEQ ID NO: 366804 - RNA, 15 nt, Bordetella pertussis
cagcucgcgcagcag

SEQ ID NO: 366805 - RNA, 19 nt, Bordetella pertussis
cagcucgcgcagcaggccg

SEQ ID NO: 366806 - RNA, 15 nt, Bordetella pertussis
cagcucgcgccaggg

SEQ ID NO: 366807 - RNA, 17 nt, Bordetella pertussis
cagcucgcgccagggcc

SEQ ID NO: 366808 - RNA, 21 nt, Bordetella pertussis
cagcucgcgcugcgcgccgcc

SEQ ID NO: 366809 - RNA, 14 nt, Bordetella pertussis
cagcucgcggucgu

SEQ ID NO: 366810 - RNA, 19 nt, Bordetella pertussis
cagcucgcguugcaccgcg

SEQ ID NO: 366811 - RNA, 20 nt, Bordetella pertussis
cagcucgcguugcaccgcgu

SEQ ID NO: 366812 - RNA, 17 nt, Bordetella pertussis
cagcucggacggauagu

SEQ ID NO: 366813 - RNA, 17 nt, Bordetella pertussis
cagcucggccaccgccg

SEQ ID NO: 366814 - RNA, 22 nt, Bordetella pertussis
cagcucggccaaggcauuggcg

SEQ ID NO: 366815 - RNA, 12 nt, Bordetella pertussis
cagcucggccac

SEQ ID NO: 366816 - RNA, 13 nt, Bordetella pertussis
cagcucggcgaag

SEQ ID NO: 366817 - RNA, 20 nt, Bordetella pertussis
cagcucggcgaccaggccca

SEQ ID NO: 366818 - RNA, 21 nt, Bordetella pertussis
cagcucggcgaucugcgcggc

SEQ ID NO: 366819 - RNA, 20 nt, Bordetella pertussis
cagcucggccugcggcucga

SEQ ID NO: 366820 - RNA, 23 nt, Bordetella pertussis
cagcucggcggccgccugcgccg

SEQ ID NO: 366821 - RNA, 17 nt, Bordetella pertussis
cagcucggcggcgauca

SEQ ID NO: 366822 - RNA, 13 nt, Bordetella pertussis
cagcucggugcag

SEQ ID NO: 366823 - RNA, 22 nt, Bordetella pertussis
cagcucguagaucuugccggcc

SEQ ID NO: 366824 - RNA, 17 nt, Bordetella pertussis
cagcucggugcagccca

SEQ ID NO: 366825 - RNA, 24 nt, Bordetella pertussis
cagcucguccagguugcccgagcg

SEQ ID NO: 366826 - RNA, 15 nt, Bordetella pertussis
cagcucgucgccgcu

SEQ ID NO: 366827 - RNA, 22 nt, Bordetella pertussis
cagcucuucgagcgcggcgcgc

SEQ ID NO: 366828 - RNA, 22 nt, Bordetella pertussis
cagcugaccucgcccaggccgg

SEQ ID NO: 366829 - RNA, 11 nt, Bordetella pertussis
cagcugcagcg

SEQ ID NO: 366830 - RNA, 14 nt, Bordetella pertussis
cagcugcagcgacu

SEQ ID NO: 366831 - RNA, 23 nt, Bordetella pertussis
cagcugcuguuggccuucggcga

SEQ ID NO: 366832 - RNA, 23 nt, Bordetella pertussis
cagcugcuucaguuccaggcgga

SEQ ID NO: 366833 - RNA, 19 nt, Bordetella pertussis
cagcugcuugcccaggccg

SEQ ID NO: 366834 - RNA, 20 nt, Bordetella pertussis
cagcugcuugcccaggccgg

SEQ ID NO: 366835 - RNA, 23 nt, Bordetella pertussis
cagcugcuugcccaggccggcgc

SEQ ID NO: 366836 - RNA, 13 nt, Bordetella pertussis
cagcuggaacgcg

SEQ ID NO: 366837 - RNA, 20 nt, Bordetella pertussis
cagcuggaagcgcgccaggc

SEQ ID NO: 366838 - RNA, 22 nt, Bordetella pertussis
cagcuggaagcgcgccaggcgc

SEQ ID NO: 366839 - RNA, 17 nt, Bordetella pertussis
cagcuggaccgccuggc

SEQ ID NO: 366840 - RNA, 14 nt, Bordetella pertussis
cagcuggaucuggu

SEQ ID NO: 366841 - RNA, 20 nt, Bordetella pertussis
cagcuggcccaguucggcga

SEQ ID NO: 366842 - RNA, 14 nt, Bordetella pertussis
cagcuggcccuggc

SEQ ID NO: 366843 - RNA, 20 nt, Bordetella pertussis
cagcuggcccuggcagacgu

SEQ ID NO: 366844 - RNA, 14 nt, Bordetella pertussis
cagcuggcgcagca

SEQ ID NO: 366845 - RNA, 19 nt, Bordetella pertussis
cagcuucuaucugccgcgc

SEQ ID NO: 366846 - RNA, 15 nt, Bordetella pertussis
cagcuucuccaugcg

SEQ ID NO: 366847 - RNA, 21 nt, Bordetella pertussis
cagcuucuggaucaccgccgg

SEQ ID NO: 366848 - RNA, 23 nt, Bordetella pertussis
cagcuucuucuuugcccuggcca

SEQ ID NO: 366849 - RNA, 23 nt, Bordetella pertussis
cagcuugaccuugagcacgcugg

SEQ ID NO: 366850 - RNA, 16 nt, Bordetella pertussis
cagcuugaugccggcg

SEQ ID NO: 366851 - RNA, 13 nt, Bordetella pertussis
cagcuugcccgcg

SEQ ID NO: 366852 - RNA, 17 nt, Bordetella pertussis
cagcuugcccgcgcgca

SEQ ID NO: 366853 - RNA, 14 nt, Bordetella pertussis
cagcuugcccggcg

SEQ ID NO: 366854 - RNA, 15 nt, Bordetella pertussis
cagcuugcgcgcccc

SEQ ID NO: 366855 - RNA, 22 nt, Bordetella pertussis
cagcuugcgcgcccccacgccg

SEQ ID NO: 366856 - RNA, 15 nt, Bordetella pertussis
cagcuugcgcgccuu

SEQ ID NO: 366857 - RNA, 19 nt, Bordetella pertussis
cagcuugcgcgccuuggcg

SEQ ID NO: 366858 - RNA, 13 nt, Bordetella pertussis
cagcuugcgcugg

SEQ ID NO: 366859 - RNA, 16 nt, Bordetella pertussis
cagcuugcgcuggcgc

SEQ ID NO: 366860 - RNA, 18 nt, Bordetella pertussis
cagcuugcgcuggcgcgc

SEQ ID NO: 366861 - RNA, 22 nt, Bordetella pertussis
cagcuugcgcuggcgcgcggcc

SEQ ID NO: 366862 - RNA, 12 nt, Bordetella pertussis
cagcuugccgcu

SEQ ID NO: 366863 - RNA, 14 nt, Bordetella pertussis
cagcuugcgcgcca

SEQ ID NO: 366864 - RNA, 20 nt, Bordetella pertussis
cagcuuggccaccacgccca

SEQ ID NO: 366865 - RNA, 21 nt, Bordetella pertussis
cagcuuggccugcggaugcag

SEQ ID NO: 366866 - RNA, 15 nt, Bordetella pertussis
caggaagcgcgccgc

SEQ ID NO: 366867 - RNA, 15 nt, Bordetella pertussis
caggaagcgcuggcc

SEQ ID NO: 366868 - RNA, 14 nt, Bordetella pertussis
caggaaggccgccg

SEQ ID NO: 366869 - RNA, 18 nt, Bordetella pertussis
caggaaggcgagcgcggc

SEQ ID NO: 366870 - RNA, 20 nt, Bordetella pertussis
caggaaguccugguuggccu

SEQ ID NO: 366871 - RNA, 20 nt, Bordetella pertussis
caggaaguccuucagccgcu

SEQ ID NO: 366872 - RNA, 15 nt, Bordetella pertussis
caggaagucggucag

SEQ ID NO: 366873 - RNA, 12 nt, Bordetella pertussis
caggaggcgcgg

SEQ ID NO: 366874 - RNA, 16 nt, Bordetella pertussis
caggauacgugcugca

SEQ ID NO: 366875 - RNA, 23 nt, Bordetella pertussis
caggauggggcgguggucaucga

SEQ ID NO: 366876 - RNA, 14 nt, Bordetella pertussis
caggauuucauggc

SEQ ID NO: 366877 - RNA, 21 nt, Bordetella pertussis
caggcaaucgaugaucacgcg

SEQ ID NO: 366878 - RNA, 17 nt, Bordetella pertussis
caggcacaccgugccgc

SEQ ID NO: 366879 - RNA, 20 nt, Bordetella pertussis
caggcacaccgugccgcaga

SEQ ID NO: 366880 - RNA, 19 nt, Bordetella pertussis
caggcacacgaccggcuug

SEQ ID NO: 366881 - RNA, 14 nt, Bordetella pertussis
caggcacccagggg

SEQ ID NO: 366882 - RNA, 15 nt, Bordetella pertussis
caggcacccaggggu

SEQ ID NO: 366883 - RNA, 17 nt, Bordetella pertussis
caggcaccccagcaccc

SEQ ID NO: 366884 - RNA, 15 nt, Bordetella pertussis
caggcacccuugccg

SEQ ID NO: 366885 - RNA, 20 nt, Bordetella pertussis
caggcacccuugccgcagcg

SEQ ID NO: 366886 - RNA, 11 nt, Bordetella pertussis
caggcaccgaa

SEQ ID NO: 366887 - RNA, 23 nt, Bordetella pertussis
caggcaccgaacgggcguggcgc

SEQ ID NO: 366888 - RNA, 14 nt, Bordetella pertussis
caggcaccgccgca

SEQ ID NO: 366889 - RNA, 15 nt, Bordetella pertussis
caggcacgccggggu

SEQ ID NO: 366890 - RNA, 21 nt, Bordetella pertussis
caggcacgccgggguuggagu

SEQ ID NO: 366891 - RNA, 16 nt, Bordetella pertussis
caggcccacggcaucg

SEQ ID NO: 366892 - RNA, 16 nt, Bordetella pertussis
caggcccacggcgcca

SEQ ID NO: 366893 - RNA, 20 nt, Bordetella pertussis
caggcccagcacgcgcgcca

SEQ ID NO: 366894 - RNA, 14 nt, Bordetella pertussis
caggcaccuuggcc

SEQ ID NO: 366895 - RNA, 22 nt, Bordetella pertussis
caggcccagccagcccuggccc

SEQ ID NO: 366896 - RNA, 13 nt, Bordetella pertussis
caggcccagcgcc

SEQ ID NO: 366897 - RNA, 18 nt, Bordetella pertussis
caggcccagcgccagcag

SEQ ID NO: 366898 - RNA, 13 nt, Bordetella pertussis
caggcccagcccg

SEQ ID NO: 366899 - RNA, 14 nt, Bordetella pertussis
caggcccagcuuga

SEQ ID NO: 366900 - RNA, 13 nt, Bordetella pertussis
caggcccagggcc

SEQ ID NO: 366901 - RNA, 14 nt, Bordetella pertussis
caggcccagggcga

SEQ ID NO: 366902 - RNA, 20 nt, Bordetella pertussis
caggcccaguacggccugca

SEQ ID NO: 366903 - RNA, 18 nt, Bordetella pertussis
caggcccaguucggcgcg

SEQ ID NO: 366904 - RNA, 13 nt, Bordetella pertussis
caggcccaggcga

SEQ ID NO: 366905 - RNA, 23 nt, Bordetella pertussis
caggcccaugaaggcggccagca

SEQ ID NO: 366906 - RNA, 21 nt, Bordetella pertussis
caggcccaugacgaccuugcg

SEQ ID NO: 366907 - RNA, 23 nt, Bordetella pertussis
caggcccaugacgaccuugcggc

SEQ ID NO: 366908 - RNA, 14 nt, Bordetella pertussis
caggcccaugccgc

SEQ ID NO: 366909 - RNA, 15 nt, Bordetella pertussis
caggcccaugccgcg

SEQ ID NO: 366910 - RNA, 15 nt, Bordetella pertussis
caggccccgccgggc

SEQ ID NO: 366911 - RNA, 16 nt, Bordetella pertussis
caggccccggcccggc

SEQ ID NO: 366912 - RNA, 23 nt, Bordetella pertussis
caggccccggcccggcgggccgg

SEQ ID NO: 366913 - RNA, 21 nt, Bordetella pertussis
caggcccauaugccgccggcc

SEQ ID NO: 366914 - RNA, 23 nt, Bordetella pertussis
caggcccgaaacgcgcagcaccg

SEQ ID NO: 366915 - RNA, 18 nt, Bordetella pertussis
caggcccgacaggaucga

SEQ ID NO: 366916 - RNA, 19 nt, Bordetella pertussis
caggcccgcgcggccagcg

SEQ ID NO: 366917 - RNA, 23 nt, Bordetella pertussis
caggcccgcgcggccagcgccgg

SEQ ID NO: 366918 - RNA, 13 nt, Bordetella pertussis
caggcccgcggcc

SEQ ID NO: 366919 - RNA, 16 nt, Bordetella pertussis
caggcccgcggccgcg

SEQ ID NO: 366920 - RNA, 15 nt, Bordetella pertussis
caggcccgcggcgcc

SEQ ID NO: 366921 - RNA, 16 nt, Bordetella pertussis
caggcccgcggcgcca

SEQ ID NO: 366922 - RNA, 17 nt, Bordetella pertussis
caggcccgcggcgccag

SEQ ID NO: 366923 - RNA, 14 nt, Bordetella pertussis
caggcccggccgca

SEQ ID NO: 366924 - RNA, 23 nt, Bordetella pertussis
caggcccggccgcagggcgugcg

SEQ ID NO: 366925 - RNA, 13 nt, Bordetella pertussis
caggcccggcgcg

SEQ ID NO: 366926 - RNA, 15 nt, Bordetella pertussis
caggcccggcgcgca

SEQ ID NO: 366927 - RNA, 15 nt, Bordetella pertussis
caggcccgugcucca

SEQ ID NO: 366928 - RNA, 16 nt, Bordetella pertussis
caggcccuccggcgcc

SEQ ID NO: 366929 - RNA, 20 nt, Bordetella pertussis
caggcccuccggcgccagca

SEQ ID NO: 366930 - RNA, 18 nt, Bordetella pertussis
caggcccucgcggccguc

SEQ ID NO: 366931 - RNA, 24 nt, Bordetella pertussis
caggcccucgcggccgucggcgcu

SEQ ID NO: 366932 - RNA, 19 nt, Bordetella pertussis
caggccgaggaccugcugg

SEQ ID NO: 366933 - RNA, 16 nt, Bordetella pertussis
caggccgaggcugcgc

SEQ ID NO: 366934 - RNA, 22 nt, Bordetella pertussis
caggccgaggcugcgcgcgcca

SEQ ID NO: 366935 - RNA, 21 nt, Bordetella pertussis
caggccgcuuucgaccagcga

SEQ ID NO: 366936 - RNA, 18 nt, Bordetella pertussis
caggccggaaaugccgcg

SEQ ID NO: 366937 - RNA, 19 nt, Bordetella pertussis
caggccggaaaugccgcgc

SEQ ID NO: 366938 - RNA, 22 nt, Bordetella pertussis
caggccggaaaugccgcgcgca

SEQ ID NO: 366939 - RNA, 14 nt, Bordetella pertussis
caggccggaccuug

SEQ ID NO: 366940 - RNA, 16 nt, Bordetella pertussis
caggccggaccuugcg

SEQ ID NO: 366941 - RNA, 23 nt, Bordetella pertussis
caggccggaugguagaugcgcgc

SEQ ID NO: 366942 - RNA, 13 nt, Bordetella pertussis
caggccggcaugc

SEQ ID NO: 366943 - RNA, 15 nt, Bordetella pertussis
caggccggcaugcgc

SEQ ID NO: 366944 - RNA, 19 nt, Bordetella pertussis
caggccggcaugcgccggc

SEQ ID NO: 366945 - RNA, 14 nt, Bordetella pertussis
caggccggccagca

SEQ ID NO: 366946 - RNA, 14 nt, Bordetella pertussis
caggccggccugca

SEQ ID NO: 366947 - RNA, 23 nt, Bordetella pertussis
caggccggccugcaaugcggcca

SEQ ID NO: 366948 - RNA, 18 nt, Bordetella pertussis
caggccggccugcaggcu

SEQ ID NO: 366949 - RNA, 16 nt, Bordetella pertussis
caggccggccugggga

SEQ ID NO: 366950 - RNA, 16 nt, Bordetella pertussis
caggccggccuuggcc

SEQ ID NO: 366951 - RNA, 13 nt, Bordetella pertussis
caggccggcgcgc

SEQ ID NO: 366952 - RNA, 14 nt, Bordetella pertussis
caggccggcgcgcg

SEQ ID NO: 366953 - RNA, 20 nt, Bordetella pertussis
caggccggcgcgcucggccu

SEQ ID NO: 366954 - RNA, 14 nt, Bordetella pertussis
caggccggcggcca

SEQ ID NO: 366955 - RNA, 21 nt, Bordetella pertussis
caggccggcggccagcgcgcc

SEQ ID NO: 366956 - RNA, 17 nt, Bordetella pertussis
caggccggcggcgauca

SEQ ID NO: 366957 - RNA, 17 nt, Bordetella pertussis
caggccgggcgagccga

SEQ ID NO: 366958 - RNA, 19 nt, Bordetella pertussis
caggccggggaaacggcca

SEQ ID NO: 366959 - RNA, 23 nt, Bordetella pertussis
caggccggggaaacggccaagca

SEQ ID NO: 366960 - RNA, 15 nt, Bordetella pertussis
caggccggggccgcc

SEQ ID NO: 366961 - RNA, 19 nt, Bordetella pertussis
caggccggggccgcccagc

SEQ ID NO: 366962 - RNA, 23 nt, Bordetella pertussis
caggccggggccgcccagcaccu

SEQ ID NO: 366963 - RNA, 16 nt, Bordetella pertussis
caggccggggccgugg

SEQ ID NO: 366964 - RNA, 17 nt, Bordetella pertussis
caggccguaaccggcca

SEQ ID NO: 366965 - RNA, 18 nt, Bordetella pertussis
caggccgucgagccgggc

SEQ ID NO: 366966 - RNA, 21 nt, Bordetella pertussis
caggccgucgagccgggcgcc

SEQ ID NO: 366967 - RNA, 17 nt, Bordetella pertussis
caggccgucgauuucgg

SEQ ID NO: 366968 - RNA, 14 nt, Bordetella pertussis
caggccgucggcca

SEQ ID NO: 366969 - RNA, 18 nt, Bordetella pertussis
caggccgucggccagggg

SEQ ID NO: 366970 - RNA, 20 nt, Bordetella pertussis
caggccgucggccaggggca

SEQ ID NO: 366971 - RNA, 16 nt, Bordetella pertussis
caggccgugagcgccg

SEQ ID NO: 366972 - RNA, 22 nt, Bordetella pertussis
caggccgugagcgccgccgcca

SEQ ID NO: 366973 - RNA, 16 nt, Bordetella pertussis
caggccguggcccagc

SEQ ID NO: 366974 - RNA, 23 nt, Bordetella pertussis
caggccguuccaguccagcgucg

SEQ ID NO: 366975 - RNA, 23 nt, Bordetella pertussis
caggccguugccgcuguggcgcg

SEQ ID NO: 366976 - RNA, 18 nt, Bordetella pertussis
caggccguuggccgcgcg

SEQ ID NO: 366977 - RNA, 19 nt, Bordetella pertussis
caggccguuggcgcgccuu

SEQ ID NO: 366978 - RNA, 22 nt, Bordetella pertussis
caggccguuggcgcgccuugcg

SEQ ID NO: 366979 - RNA, 19 nt, Bordetella pertussis
caggccguuguccuggcgc

SEQ ID NO: 366980 - RNA, 23 nt, Bordetella pertussis
caggccguuguccuggcgcgcca

SEQ ID NO: 366981 - RNA, 23 nt, Bordetella pertussis
caggcgaauccgcaacccagcag

SEQ ID NO: 366982 - RNA, 17 nt, Bordetella pertussis
caggcgacccagcaccg

SEQ ID NO: 366983 - RNA, 16 nt, Bordetella pertussis
caggcgagcgccgcgc

SEQ ID NO: 366984 - RNA, 14 nt, Bordetella pertussis
caggcgagcgcggc

SEQ ID NO: 366985 - RNA, 15 nt, Bordetella pertussis
caggcgagcgcggcg

SEQ ID NO: 366986 - RNA, 15 nt, Bordetella pertussis
caggcgagcggcguc

SEQ ID NO: 366987 - RNA, 16 nt, Bordetella pertussis
caggcgagcggcgucg

SEQ ID NO: 366988 - RNA, 23 nt, Bordetella pertussis
caggcgagcggcgucgcguccuu

SEQ ID NO: 366989 - RNA, 19 nt, Bordetella pertussis
caggcgaggcuggcgccca

SEQ ID NO: 366990 - RNA, 21 nt, Bordetella pertussis
caggcgauccugcccaccgcc

SEQ ID NO: 366991 - RNA, 21 nt, Bordetella pertussis
caggcgauggccgggagcggc

SEQ ID NO: 366992 - RNA, 15 nt, Bordetella pertussis
caggcgccagcggca

SEQ ID NO: 366993 - RNA, 14 nt, Bordetella pertussis
caggcgccacaggg

SEQ ID NO: 366994 - RNA, 14 nt, Bordetella pertussis
caggcgccaguccc

SEQ ID NO: 366995 - RNA, 16 nt, Bordetella pertussis
caggcgccccacccgg

SEQ ID NO: 366996 - RNA, 17 nt, Bordetella pertussis
caggcgcccggcgugac

SEQ ID NO: 366997 - RNA, 18 nt, Bordetella pertussis
caggcgccgccccgucau

SEQ ID NO: 366998 - RNA, 17 nt, Bordetella pertussis
caggcgccgccgcccgg

SEQ ID NO: 366999 - RNA, 18 nt, Bordetella pertussis
caggcgccgcucagcgcg

SEQ ID NO: 367000 - RNA, 19 nt, Bordetella pertussis
caggcgccgcucagcgcgg

SEQ ID NO: 367001 - RNA, 20 nt, Bordetella pertussis
caggcgccgcucagcgcggc

SEQ ID NO: 367002 - RNA, 14 nt, Bordetella pertussis
caggcgcgagacga

SEQ ID NO: 367003 - RNA, 15 nt, Bordetella pertussis
caggcgcgagcgccg

SEQ ID NO: 367004 - RNA, 14 nt, Bordetella pertussis
caggcgcguggcca

SEQ ID NO: 367005 - RNA, 21 nt, Bordetella pertussis
caggcgcguggccacggcguc

SEQ ID NO: 367006 - RNA, 15 nt, Bordetella pertussis
caggcgcguggcgcc

SEQ ID NO: 367007 - RNA, 18 nt, Bordetella pertussis
caggcgcguggcgcccag

SEQ ID NO: 367008 - RNA, 20 nt, Bordetella pertussis
caggcgcguugcgcuugcgc

SEQ ID NO: 367009 - RNA, 20 nt, Bordetella pertussis
caggcgccucgcgacggccu

SEQ ID NO: 367010 - RNA, 19 nt, Bordetella pertussis
caggcgccugccccgccgg

SEQ ID NO: 367011 - RNA, 20 nt, Bordetella pertussis
caggcgccugccccgccggg

SEQ ID NO: 367012 - RNA, 23 nt, Bordetella pertussis
caggcgccugccccgccgggaca

SEQ ID NO: 367013 - RNA, 23 nt, Bordetella pertussis
caggcgcguuucggucagggcga

SEQ ID NO: 367014 - RNA, 14 nt, Bordetella pertussis
caggcgcucagccg

SEQ ID NO: 367015 - RNA, 20 nt, Bordetella pertussis
caggcgcucagccgugccgc

SEQ ID NO: 367016 - RNA, 20 nt, Bordetella pertussis
caggcgcucgcccucgcgcc

SEQ ID NO: 367017 - RNA, 13 nt, Bordetella pertussis
caggcgcucgcgc

SEQ ID NO: 367018 - RNA, 14 nt, Bordetella pertussis
caggcgcucgcgcg

SEQ ID NO: 367019 - RNA, 17 nt, Bordetella pertussis
caggcgcucgcgcgcca

SEQ ID NO: 367020 - RNA, 19 nt, Bordetella pertussis
caggcgcucgcgcugcagg

SEQ ID NO: 367021 - RNA, 16 nt, Bordetella pertussis
caggcgcuccauggcg

SEQ ID NO: 367022 - RNA, 16 nt, Bordetella pertussis
caggcgcucggcguug

SEQ ID NO: 367023 - RNA, 12 nt, Bordetella pertussis
caggcgcugcag

SEQ ID NO: 367024 - RNA, 19 nt, Bordetella pertussis
caggcggagucgccccgac

SEQ ID NO: 367025 - RNA, 18 nt, Bordetella pertussis
caggcggcagaaggcgac

SEQ ID NO: 367026 - RNA, 18 nt, Bordetella pertussis
caggcggccaccaccagg

SEQ ID NO: 367027 - RNA, 22 nt, Bordetella pertussis
caggcggccaccaccaggccca

SEQ ID NO: 367028 - RNA, 16 nt, Bordetella pertussis
caggcggcaggcgccg

SEQ ID NO: 367029 - RNA, 12 nt, Bordetella pertussis
caggcggccacc

SEQ ID NO: 367030 - RNA, 17 nt, Bordetella pertussis
caggcggccagggccug

SEQ ID NO: 367031 - RNA, 13 nt, Bordetella pertussis
caggcggcccagc

SEQ ID NO: 367032 - RNA, 14 nt, Bordetella pertussis
caggcggcccagcg

SEQ ID NO: 367033 - RNA, 16 nt, Bordetella pertussis
caggcggccgcggaag

SEQ ID NO: 367034 - RNA, 18 nt, Bordetella pertussis
caggcggcgcaucagcgc

SEQ ID NO: 367035 - RNA, 20 nt, Bordetella pertussis
caggcggcggugccagcgca

SEQ ID NO: 367036 - RNA, 22 nt, Bordetella pertussis
caggcggcugcccaccuugcgc

SEQ ID NO: 367037 - RNA, 23 nt, Bordetella pertussis
caggcggcuggugccgacggcgc

SEQ ID NO: 367038 - RNA, 21 nt, Bordetella pertussis
caggcggcuuucaugggccug

SEQ ID NO: 367039 - RNA, 22 nt, Bordetella pertussis
caggcggcuuucaugggccugg

SEQ ID NO: 367040 - RNA, 16 nt, Bordetella pertussis
caggcgggccaggccg

SEQ ID NO: 367041 - RNA, 17 nt, Bordetella pertussis
caggcgggccaggccgg

SEQ ID NO: 367042 - RNA, 14 nt, Bordetella pertussis
caggcgggccaggu

SEQ ID NO: 367043 - RNA, 15 nt, Bordetella pertussis
caggcgggccaggua

SEQ ID NO: 367044 - RNA, 13 nt, Bordetella pertussis
caggcgggcccgc

SEQ ID NO: 367045 - RNA, 18 nt, Bordetella pertussis
caggcgggcccgcaucgc

SEQ ID NO: 367046 - RNA, 21 nt, Bordetella pertussis
caggcgggcccgcaucgcgcg

SEQ ID NO: 367047 - RNA, 14 nt, Bordetella pertussis
caggcgggcaucgc

SEQ ID NO: 367048 - RNA, 23 nt, Bordetella pertussis
caggcgggcaucgcccaccauga

SEQ ID NO: 367049 - RNA, 17 nt, Bordetella pertussis
caggcgguacaggccgg

SEQ ID NO: 367050 - RNA, 17 nt, Bordetella pertussis
caggcggucgaggcgca

SEQ ID NO: 367051 - RNA, 20 nt, Bordetella pertussis
caggcggugcguccaggacg

SEQ ID NO: 367052 - RNA, 22 nt, Bordetella pertussis
caggcgguggccucguccacgu

SEQ ID NO: 367053 - RNA, 23 nt, Bordetella pertussis
caggcgguuggccuugacggcgc

SEQ ID NO: 367054 - RNA, 17 nt, Bordetella pertussis
caggcgucggccagcgc

SEQ ID NO: 367055 - RNA, 19 nt, Bordetella pertussis
caggcgucguuggccgcgu

SEQ ID NO: 367056 - RNA, 20 nt, Bordetella pertussis
caggcgucguuggccgcgua

SEQ ID NO: 367057 - RNA, 21 nt, Bordetella pertussis
caggcgucugcuacaccgugc

SEQ ID NO: 367058 - RNA, 18 nt, Bordetella pertussis
caggcgugcgcgggcgcc

SEQ ID NO: 367059 - RNA, 18 nt, Bordetella pertussis
caggcguggcgacagcaa

SEQ ID NO: 367060 - RNA, 19 nt, Bordetella pertussis
caggcguugaccuggucga

SEQ ID NO: 367061 - RNA, 21 nt, Bordetella pertussis
caggcguugcgccgcaacgcc

SEQ ID NO: 367062 - RNA, 14 nt, Bordetella pertussis
caggcucagcccgg

SEQ ID NO: 367063 - RNA, 15 nt, Bordetella pertussis
caggcucagcccggc

SEQ ID NO: 367064 - RNA, 13 nt, Bordetella pertussis
caggcucaggcgg

SEQ ID NO: 367065 - RNA, 15 nt, Bordetella pertussis
caggcucuugaccag

SEQ ID NO: 367066 - RNA, 20 nt, Bordetella pertussis
caggcucuugaccagcuugu

SEQ ID NO: 367067 - RNA, 21 nt, Bordetella pertussis
caggcucuuuuucccggcgcg

SEQ ID NO: 367068 - RNA, 23 nt, Bordetella pertussis
caggcucuuuuucgagccgcaga

SEQ ID NO: 367069 - RNA, 19 nt, Bordetella pertussis
caggcucuggcugacgaug

SEQ ID NO: 367070 - RNA, 14 nt, Bordetella pertussis
caggcugaccagcg

SEQ ID NO: 367071 - RNA, 20 nt, Bordetella pertussis
caggcugaucacccacagca

SEQ ID NO: 367072 - RNA, 22 nt, Bordetella pertussis
caggcugcccuggcccaggccg

SEQ ID NO: 367073 - RNA, 23 nt, Bordetella pertussis
caggcugcccuggcccaggccga

SEQ ID NO: 367074 - RNA, 14 nt, Bordetella pertussis
caggcugccgucgg

SEQ ID NO: 367075 - RNA, 17 nt, Bordetella pertussis
caggcugccgucggcca

SEQ ID NO: 367076 - RNA, 20 nt, Bordetella pertussis
caggcugccgucggccagcu

SEQ ID NO: 367077 - RNA, 22 nt, Bordetella pertussis
caggcugccgucgucguccagg

SEQ ID NO: 367078 - RNA, 13 nt, Bordetella pertussis
caggcugccggcg

SEQ ID NO: 367079 - RNA, 17 nt, Bordetella pertussis
caggcugcgcaggcgcc

SEQ ID NO: 367080 - RNA, 15 nt, Bordetella pertussis
caggcugcgcgccgg

SEQ ID NO: 367081 - RNA, 22 nt, Bordetella pertussis
caggcuggaagucagccggugc

SEQ ID NO: 367082 - RNA, 22 nt, Bordetella pertussis
caggcuggccaccgaagcggcg

SEQ ID NO: 367083 - RNA, 20 nt, Bordetella pertussis
caggcuggccugcaggucgu

SEQ ID NO: 367084 - RNA, 13 nt, Bordetella pertussis
caggcuggcgcgg

SEQ ID NO: 367085 - RNA, 19 nt, Bordetella pertussis
caggcugggagagccggcc

SEQ ID NO: 367086 - RNA, 21 nt, Bordetella pertussis
caggcugggagagccggccac

SEQ ID NO: 367087 - RNA, 17 nt, Bordetella pertussis
caggcugggccagaugg

SEQ ID NO: 367088 - RNA, 23 nt, Bordetella pertussis
caggcugggcgaaacggccagcg

SEQ ID NO: 367089 - RNA, 16 nt, Bordetella pertussis
caggcuggggccgagc

SEQ ID NO: 367090 - RNA, 17 nt, Bordetella pertussis
caggcugucccagaugg

SEQ ID NO: 367091 - RNA, 19 nt, Bordetella pertussis
caggcugucgucgucggca

SEQ ID NO: 367092 - RNA, 16 nt, Bordetella pertussis
caggcuguggccgcgg

SEQ ID NO: 367093 - RNA, 19 nt, Bordetella pertussis
caggcuguggccgcggccc

SEQ ID NO: 367094 - RNA, 23 nt, Bordetella pertussis
caggcuguggccgcggcccagcg

SEQ ID NO: 367095 - RNA, 21 nt, Bordetella pertussis
caggcuuucgcaauacgucgc

SEQ ID NO: 367096 - RNA, 19 nt, Bordetella pertussis
caggcuuucgcacagccgg

SEQ ID NO: 367097 - RNA, 22 nt, Bordetella pertussis
caggcuuucgcacagccggggc

SEQ ID NO: 367098 - RNA, 23 nt, Bordetella pertussis
caggcuuucgcacagccggggcg

SEQ ID NO: 367099 - RNA, 17 nt, Bordetella pertussis
caggcuuugcgcgccau

SEQ ID NO: 367100 - RNA, 16 nt, Bordetella pertussis
caggcuuugcuggcca

SEQ ID NO: 367101 - RNA, 23 nt, Bordetella pertussis
cagggaggaacugggcgccggcc

SEQ ID NO: 367102 - RNA, 23 nt, Bordetella pertussis
cagggcaaagaaauugggcgugg

SEQ ID NO: 367103 - RNA, 14 nt, Bordetella pertussis
cagggcagcggcca

SEQ ID NO: 367104 - RNA, 15 nt, Bordetella pertussis
cagggcagggcgccg

SEQ ID NO: 367105 - RNA, 22 nt, Bordetella pertussis
cagggccgugcccgagggcgcg

SEQ ID NO: 367106 - RNA, 17 nt, Bordetella pertussis
cagggccuccugcagca

SEQ ID NO: 367107 - RNA, 22 nt, Bordetella pertussis
cagggccuccugcagcaggucg

SEQ ID NO: 367108 - RNA, 18 nt, Bordetella pertussis
cagggccucgcgggccuu

SEQ ID NO: 367109 - RNA, 22 nt, Bordetella pertussis
cagggccucgcgggccuuggcc

SEQ ID NO: 367110 - RNA, 20 nt, Bordetella pertussis
cagggccugcgggccgggca

SEQ ID NO: 367111 - RNA, 23 nt, Bordetella pertussis
cagggccuggaagcuggccagcg

SEQ ID NO: 367112 - RNA, 13 nt, Bordetella pertussis
cagggccuggcac

SEQ ID NO: 367113 - RNA, 20 nt, Bordetella pertussis
cagggccuggcacaucggcc

SEQ ID NO: 367114 - RNA, 22 nt, Bordetella pertussis
cagggcgaacgggguggccggc

SEQ ID NO: 367115 - RNA, 13 nt, Bordetella pertussis
cagggcgaagcgc

SEQ ID NO: 367116 - RNA, 20 nt, Bordetella pertussis
cagggcgaagcgcgccucgu

SEQ ID NO: 367117 - RNA, 17 nt, Bordetella pertussis
cagggcgacgucccagg

SEQ ID NO: 367118 - RNA, 20 nt, Bordetella pertussis
cagggcgacgucccaggccg

SEQ ID NO: 367119 - RNA, 21 nt, Bordetella pertussis
cagggcgacgucccaggccga

SEQ ID NO: 367120 - RNA, 18 nt, Bordetella pertussis
cagggcggugggcagcgc

SEQ ID NO: 367121 - RNA, 22 nt, Bordetella pertussis
cagggcggugggcagcgcgucg

SEQ ID NO: 367122 - RNA, 23 nt, Bordetella pertussis
cagggcggugggcagcgcgucga

SEQ ID NO: 367123 - RNA, 22 nt, Bordetella pertussis
cagggcgucgcgaugcgccagg

SEQ ID NO: 367124 - RNA, 17 nt, Bordetella pertussis
cagggcgucgcggcgua

SEQ ID NO: 367125 - RNA, 14 nt, Bordetella pertussis
cagggcgucggcga

SEQ ID NO: 367126 - RNA, 17 nt, Bordetella pertussis
cagggcgucggcgacgu

SEQ ID NO: 367127 - RNA, 20 nt, Bordetella pertussis
cagggcgugcgggacggcca

SEQ ID NO: 367128 - RNA, 22 nt, Bordetella pertussis
cagggcgugcgggacggccagg

SEQ ID NO: 367129 - RNA, 17 nt, Bordetella pertussis
cagggcgucggccgcgc

SEQ ID NO: 367130 - RNA, 22 nt, Bordetella pertussis
cagggcgucggccgcgcccagg

SEQ ID NO: 367131 - RNA, 23 nt, Bordetella pertussis
cagggcguuuuccagcaucaggg

SEQ ID NO: 367132 - RNA, 15 nt, Bordetella pertussis
cagggcucguagucg

SEQ ID NO: 367133 - RNA, 13 nt, Bordetella pertussis
cagggcugcagau

SEQ ID NO: 367134 - RNA, 18 nt, Bordetella pertussis
caggucgaugccggcggc

SEQ ID NO: 367135 - RNA, 19 nt, Bordetella pertussis
caggucgccagcaggcccu

SEQ ID NO: 367136 - RNA, 23 nt, Bordetella pertussis
caggucgccgccgcgcucggcgc

SEQ ID NO: 367137 - RNA, 20 nt, Bordetella pertussis
caggucgccguacucgccgg

SEQ ID NO: 367138 - RNA, 22 nt, Bordetella pertussis
caggucgccguucuggcugcgc

SEQ ID NO: 367139 - RNA, 21 nt, Bordetella pertussis
caggucgcgcaccaggucgcg

SEQ ID NO: 367140 - RNA, 16 nt, Bordetella pertussis
caggucgcgcacgcug

SEQ ID NO: 367141 - RNA, 17 nt, Bordetella pertussis
caggucgcgcacgcugg

SEQ ID NO: 367142 - RNA, 19 nt, Bordetella pertussis
caggucgcgcacgcuggca

SEQ ID NO: 367143 - RNA, 17 nt, Bordetella pertussis
caggucggacgcgccgg

SEQ ID NO: 367144 - RNA, 16 nt, Bordetella pertussis
caggucggagucggcg

SEQ ID NO: 367145 - RNA, 18 nt, Bordetella pertussis
caggucggagucggcgcc

SEQ ID NO: 367146 - RNA, 19 nt, Bordetella pertussis
caggucggccagccggccg

SEQ ID NO: 367147 - RNA, 17 nt, Bordetella pertussis
caggucggccaccgccg

SEQ ID NO: 367148 - RNA, 22 nt, Bordetella pertussis
caggucggccagcgugccggug

SEQ ID NO: 367149 - RNA, 18 nt, Bordetella pertussis
caggucggcgcccacgcc

SEQ ID NO: 367150 - RNA, 21 nt, Bordetella pertussis
caggucggcgaugcgcggggc

SEQ ID NO: 367151 - RNA, 14 nt, Bordetella pertussis
caggucggcgcggc

SEQ ID NO: 367152 - RNA, 15 nt, Bordetella pertussis
caggucggcgcggcc

SEQ ID NO: 367153 - RNA, 14 nt, Bordetella pertussis
caggucggcggcca

SEQ ID NO: 367154 - RNA, 21 nt, Bordetella pertussis
caggucggcggccagcgcgca

SEQ ID NO: 367155 - RNA, 18 nt, Bordetella pertussis
caggucuucgggcgugcg

SEQ ID NO: 367156 - RNA, 18 nt, Bordetella pertussis
caggugaaacagcagcgg

SEQ ID NO: 367157 - RNA, 19 nt, Bordetella pertussis
caggugaugcgcgcggcca

SEQ ID NO: 367158 - RNA, 22 nt, Bordetella pertussis
caggugaugcgcgcggccagcg

SEQ ID NO: 367159 - RNA, 19 nt, Bordetella pertussis
caggugcgcggcgcgccgu

SEQ ID NO: 367160 - RNA, 16 nt, Bordetella pertussis
caggugcggccgcagc

SEQ ID NO: 367161 - RNA, 22 nt, Bordetella pertussis
caggugcggccgcagcggacgu

SEQ ID NO: 367162 - RNA, 16 nt, Bordetella pertussis
caggugcgggccgcuc

SEQ ID NO: 367163 - RNA, 18 nt, Bordetella pertussis
cagguggacagcgccagc

SEQ ID NO: 367164 - RNA, 22 nt, Bordetella pertussis
caggugugccagccgcuggcga

SEQ ID NO: 367165 - RNA, 17 nt, Bordetella pertussis
cagguguucgcgcacca

SEQ ID NO: 367166 - RNA, 18 nt, Bordetella pertussis
cagguguucgcgcaccag

SEQ ID NO: 367167 - RNA, 20 nt, Bordetella pertussis
cagguguucgcgcaccagcg

SEQ ID NO: 367168 - RNA, 19 nt, Bordetella pertussis
cagguucaucgagaacacg

SEQ ID NO: 367169 - RNA, 22 nt, Bordetella pertussis
caguaucucggcgcccgcggcc

SEQ ID NO: 367170 - RNA, 20 nt, Bordetella pertussis
caguauggugaccggcguga

SEQ ID NO: 367171 - RNA, 16 nt, Bordetella pertussis
caguccguggcgcggc

SEQ ID NO: 367172 - RNA, 17 nt, Bordetella pertussis
caguccguggcgcggcc

SEQ ID NO: 367173 - RNA, 18 nt, Bordetella pertussis
caguccguggcgcggcca

SEQ ID NO: 367174 - RNA, 16 nt, Bordetella pertussis
caguccuucagcuuga

SEQ ID NO: 367175 - RNA, 14 nt, Bordetella pertussis
cagucgagcaccgc

SEQ ID NO: 367176 - RNA, 14 nt, Bordetella pertussis
cagucgggcagcgc

SEQ ID NO: 367177 - RNA, 18 nt, Bordetella pertussis
cagucgggcagcgcccgc

SEQ ID NO: 367178 - RNA, 13 nt, Bordetella pertussis
cagucggggccgc

SEQ ID NO: 367179 - RNA, 18 nt, Bordetella pertussis
cagucggggccgcagcug

SEQ ID NO: 367180 - RNA, 18 nt, Bordetella pertussis
cagucguccagcacgcgg

SEQ ID NO: 367181 - RNA, 19 nt, Bordetella pertussis
cagucguccagcacgcggc

SEQ ID NO: 367182 - RNA, 15 nt, Bordetella pertussis
cagucuccaggcuca

SEQ ID NO: 367183 - RNA, 21 nt, Bordetella pertussis
cagugaaacgcgacgcgccgg

SEQ ID NO: 367184 - RNA, 20 nt, Bordetella pertussis
cagugcccugacccgcuggc

SEQ ID NO: 367185 - RNA, 21 nt, Bordetella pertussis
cagugcuucgagauccgccgg

SEQ ID NO: 367186 - RNA, 19 nt, Bordetella pertussis
cagugugccugucccagcg

SEQ ID NO: 367187 - RNA, 21 nt, Bordetella pertussis
caguucgccccccgaggccac

SEQ ID NO: 367188 - RNA, 14 nt, Bordetella pertussis
caguucgccggcgc

SEQ ID NO: 367189 - RNA, 15 nt, Bordetella pertussis
caguucgcgcagcag

SEQ ID NO: 367190 - RNA, 17 nt, Bordetella pertussis
caguucgcgcagcagcu

SEQ ID NO: 367191 - RNA, 17 nt, Bordetella pertussis
caguucgcggccggccg

SEQ ID NO: 367192 - RNA, 18 nt, Bordetella pertussis
caguucgcggccggccgg

SEQ ID NO: 367193 - RNA, 17 nt, Bordetella pertussis
caguucggccagcggca

SEQ ID NO: 367194 - RNA, 18 nt, Bordetella pertussis
caguucggucagcgcggc

SEQ ID NO: 367195 - RNA, 20 nt, Bordetella pertussis
caguucggugcggugcgcga

SEQ ID NO: 367196 - RNA, 13 nt, Bordetella pertussis
caguucguccgcu

SEQ ID NO: 367197 - RNA, 18 nt, Bordetella pertussis
caguugacgaugcccagg

SEQ ID NO: 367198 - RNA, 20 nt, Bordetella pertussis
cauaaggcuucucgaccagg

SEQ ID NO: 367199 - RNA, 15 nt, Bordetella pertussis
cauaaucgucggcaa

SEQ ID NO: 367200 - RNA, 16 nt, Bordetella pertussis
cauacaaggcgcggca

SEQ ID NO: 367201 - RNA, 22 nt, Bordetella pertussis
cauacacggcgcgggcggucgg

SEQ ID NO: 367202 - RNA, 14 nt, Bordetella pertussis
cauaccggccgcgg

SEQ ID NO: 367203 - RNA, 23 nt, Bordetella pertussis
cauacgacacgucaucguggccg

SEQ ID NO: 367204 - RNA, 16 nt, Bordetella pertussis
cauacgcgcgcuccuu

SEQ ID NO: 367205 - RNA, 20 nt, Bordetella pertussis
cauacgcggguucgacgccg

SEQ ID NO: 367206 - RNA, 16 nt, Bordetella pertussis
cauagagauuguccag

SEQ ID NO: 367207 - RNA, 17 nt, Bordetella pertussis
cauagagauuguccagc

SEQ ID NO: 367208 - RNA, 15 nt, Bordetella pertussis
cauagacgcgcagcg

SEQ ID NO: 367209 - RNA, 17 nt, Bordetella pertussis
cauagacgcgcagcggc

SEQ ID NO: 367210 - RNA, 18 nt, Bordetella pertussis
cauagaucuccggcgccu

SEQ ID NO: 367211 - RNA, 23 nt, Bordetella pertussis
cauagaucuccggcgccuggccg

SEQ ID NO: 367212 - RNA, 17 nt, Bordetella pertussis
cauagaugccgaacagc

SEQ ID NO: 367213 - RNA, 14 nt, Bordetella pertussis
cauagcccggcgcg

SEQ ID NO: 367214 - RNA, 14 nt, Bordetella pertussis
cauagcugcgccaa

SEQ ID NO: 367215 - RNA, 17 nt, Bordetella pertussis
cauaggcaucgaccagc

SEQ ID NO: 367216 - RNA, 20 nt, Bordetella pertussis
caucaacgggccgcugguca

SEQ ID NO: 367217 - RNA, 14 nt, Bordetella pertussis
caucaagagcaccg

SEQ ID NO: 367218 - RNA, 22 nt, Bordetella pertussis
caucaaggccaugaucaggccg

SEQ ID NO: 367219 - RNA, 13 nt, Bordetella pertussis
caucacgggcgcc

SEQ ID NO: 367220 - RNA, 18 nt, Bordetella pertussis
caucacgguaggcgcguc

SEQ ID NO: 367221 - RNA, 18 nt, Bordetella pertussis
caucacggugccgccgau

SEQ ID NO: 367222 - RNA, 19 nt, Bordetella pertussis
caucagcagacccuggcgc

SEQ ID NO: 367223 - RNA, 22 nt, Bordetella pertussis
caucagcagacccuggcgcgcg

SEQ ID NO: 367224 - RNA, 21 nt, Bordetella pertussis
caucagcacgaucuggcgcgc

SEQ ID NO: 367225 - RNA, 13 nt, Bordetella pertussis
caucagcauggcg

SEQ ID NO: 367226 - RNA, 16 nt, Bordetella pertussis
caucagcauggcgugc

SEQ ID NO: 367227 - RNA, 14 nt, Bordetella pertussis
caucagcgcgcgca

SEQ ID NO: 367228 - RNA, 16 nt, Bordetella pertussis
caucagcgcgcgcagc

SEQ ID NO: 367229 - RNA, 17 nt, Bordetella pertussis
caucagcgcgcgcagcc

SEQ ID NO: 367230 - RNA, 16 nt, Bordetella pertussis
caucagcggcagcacg

SEQ ID NO: 367231 - RNA, 18 nt, Bordetella pertussis
caucagcggcagcacgau

SEQ ID NO: 367232 - RNA, 22 nt, Bordetella pertussis
caucaggcccacgaugcgggca

SEQ ID NO: 367233 - RNA, 18 nt, Bordetella pertussis
cauccagccgaugccgcu

SEQ ID NO: 367234 - RNA, 14 nt, Bordetella pertussis
cauccagcgccagc

SEQ ID NO: 367235 - RNA, 20 nt, Bordetella pertussis
cauccagcgccagcaccggc

SEQ ID NO: 367236 - RNA, 20 nt, Bordetella pertussis
cauccagcgcgcgaucgcca

SEQ ID NO: 367237 - RNA, 22 nt, Bordetella pertussis
cauccagcgcgcgaucgccagc

SEQ ID NO: 367238 - RNA, 13 nt, Bordetella pertussis
cauccagccaggc

SEQ ID NO: 367239 - RNA, 16 nt, Bordetella pertussis
cauccagccaggccgc

SEQ ID NO: 367240 - RNA, 15 nt, Bordetella pertussis
cauccagcggacggg

SEQ ID NO: 367241 - RNA, 17 nt, Bordetella pertussis
cauccagcggacgggcc

SEQ ID NO: 367242 - RNA, 23 nt, Bordetella pertussis
cauccagcggacgggccaggccg

SEQ ID NO: 367243 - RNA, 18 nt, Bordetella pertussis
cauccaggccgugagcgc

SEQ ID NO: 367244 - RNA, 20 nt, Bordetella pertussis
cauccaggccgugagcgccg

SEQ ID NO: 367245 - RNA, 21 nt, Bordetella pertussis
cauccaggcgcguugcgcuug

SEQ ID NO: 367246 - RNA, 14 nt, Bordetella pertussis
cauccaggcgcuca

SEQ ID NO: 367247 - RNA, 24 nt, Bordetella pertussis
cauccagcucggcgaugcgcgagc

SEQ ID NO: 367248 - RNA, 13 nt, Bordetella pertussis
cauccagguggcg

SEQ ID NO: 367249 - RNA, 20 nt, Bordetella pertussis
cauccagguggcggacaggc

SEQ ID NO: 367250 - RNA, 23 nt, Bordetella pertussis
cauccaugauuccaccuugccgc

SEQ ID NO: 367251 - RNA, 18 nt, Bordetella pertussis
cauccggccgcacgcggc

SEQ ID NO: 367252 - RNA, 13 nt, Bordetella pertussis
cauccggccacgc

SEQ ID NO: 367253 - RNA, 13 nt, Bordetella pertussis
cauccggcccggu

SEQ ID NO: 367254 - RNA, 18 nt, Bordetella pertussis
cauccucaucgugcucgu

SEQ ID NO: 367255 - RNA, 15 nt, Bordetella pertussis
cauccucgcccagcg

SEQ ID NO: 367256 - RNA, 18 nt, Bordetella pertussis
cauccucgggcgacucca

SEQ ID NO: 367257 - RNA, 15 nt, Bordetella pertussis
cauccugaacgccgc

SEQ ID NO: 367258 - RNA, 14 nt, Bordetella pertussis
cauccugaugucgg

SEQ ID NO: 367259 - RNA, 17 nt, Bordetella pertussis
cauccuggaugugcgcg

SEQ ID NO: 367260 - RNA, 23 nt, Bordetella pertussis
cauccuggccgauuucgcgcgcc

SEQ ID NO: 367261 - RNA, 22 nt, Bordetella pertussis
cauccuggccgccgcgggcgcc

SEQ ID NO: 367262 - RNA, 18 nt, Bordetella pertussis
cauccugggcgcgcgcca

SEQ ID NO: 367263 - RNA, 20 nt, Bordetella pertussis
cauccuggucgacgcgacgc

SEQ ID NO: 367264 - RNA, 22 nt, Bordetella pertussis
cauccuuuuuguuuuggcgcac

SEQ ID NO: 367265 - RNA, 21 nt, Bordetella pertussis
caucgaaggcaaucagcccgg

SEQ ID NO: 367266 - RNA, 23 nt, Bordetella pertussis
caucgaauuugaacagccgcccc

SEQ ID NO: 367267 - RNA, 15 nt, Bordetella pertussis
caucgacagcgcgcc

SEQ ID NO: 367268 - RNA, 17 nt, Bordetella pertussis
caucgacaugcccgccg

SEQ ID NO: 367269 - RNA, 13 nt, Bordetella pertussis
caucgaccaccag

SEQ ID NO: 367270 - RNA, 17 nt, Bordetella pertussis
caucgaccaccagcggc

SEQ ID NO: 367271 - RNA, 17 nt, Bordetella pertussis
caucgacgcuugccggc

SEQ ID NO: 367272 - RNA, 19 nt, Bordetella pertussis
caucgacgcuugccggcga

SEQ ID NO: 367273 - RNA, 13 nt, Bordetella pertussis
caucgacgcggcg

SEQ ID NO: 367274 - RNA, 19 nt, Bordetella pertussis
caucgacuuggccugguug

SEQ ID NO: 367275 - RNA, 19 nt, Bordetella pertussis
caucgagaaaccagccgcc

SEQ ID NO: 367276 - RNA, 20 nt, Bordetella pertussis
caucgagaaaccagccgccg

SEQ ID NO: 367277 - RNA, 20 nt, Bordetella pertussis
caucgagcgccugggcggcc

SEQ ID NO: 367278 - RNA, 18 nt, Bordetella pertussis
caucgagggcgucaucgg

SEQ ID NO: 367279 - RNA, 16 nt, Bordetella pertussis
caucgagcauugccgc

SEQ ID NO: 367280 - RNA, 19 nt, Bordetella pertussis
caucgagcauugccgcggc

SEQ ID NO: 367281 - RNA, 15 nt, Bordetella pertussis
caucgaucagcgcgc

SEQ ID NO: 367282 - RNA, 16 nt, Bordetella pertussis
caucgaucagcgcgcc

SEQ ID NO: 367283 - RNA, 18 nt, Bordetella pertussis
caucgaucagcgcgccgu

SEQ ID NO: 367284 - RNA, 16 nt, Bordetella pertussis
caucgaucucggccuc

SEQ ID NO: 367285 - RNA, 22 nt, Bordetella pertussis
caucgauggccaggugcacagc

SEQ ID NO: 367286 - RNA, 14 nt, Bordetella pertussis
caucgccaugccgg

SEQ ID NO: 367287 - RNA, 16 nt, Bordetella pertussis
caucgcccaccaugag

SEQ ID NO: 367288 - RNA, 19 nt, Bordetella pertussis
caucgcccauugcggcggg

SEQ ID NO: 367289 - RNA, 14 nt, Bordetella pertussis
caucgcccggcagg

SEQ ID NO: 367290 - RNA, 20 nt, Bordetella pertussis
caucgcccugcucgaucugg

SEQ ID NO: 367291 - RNA, 17 nt, Bordetella pertussis
caucgcccugucgguga

SEQ ID NO: 367292 - RNA, 14 nt, Bordetella pertussis
caucgccgaacagg

SEQ ID NO: 367293 - RNA, 13 nt, Bordetella pertussis
caucgcccggcag

SEQ ID NO: 367294 - RNA, 12 nt, Bordetella pertussis
caucgccgacgc

SEQ ID NO: 367295 - RNA, 13 nt, Bordetella pertussis
caucgccgccagc

SEQ ID NO: 367296 - RNA, 14 nt, Bordetella pertussis
caucgccgcugcgc

SEQ ID NO: 367297 - RNA, 13 nt, Bordetella pertussis
caucgccggcggc

SEQ ID NO: 367298 - RNA, 19 nt, Bordetella pertussis
caucgccggcggcguggcc

SEQ ID NO: 367299 - RNA, 20 nt, Bordetella pertussis
caucgccugcacgaccugcg

SEQ ID NO: 367300 - RNA, 13 nt, Bordetella pertussis
caucgcgaccccg

SEQ ID NO: 367301 - RNA, 18 nt, Bordetella pertussis
caucgcgaugcgcagcag

SEQ ID NO: 367302 - RNA, 13 nt, Bordetella pertussis
caucgcgcauggc

SEQ ID NO: 367303 - RNA, 13 nt, Bordetella pertussis
caucgcgcgccgc

SEQ ID NO: 367304 - RNA, 16 nt, Bordetella pertussis
caucgcgcgcgccggc

SEQ ID NO: 367305 - RNA, 19 nt, Bordetella pertussis
caucgcgccuucggcgcgc

SEQ ID NO: 367306 - RNA, 18 nt, Bordetella pertussis
caucgcgcugacagcgcu

SEQ ID NO: 367307 - RNA, 14 nt, Bordetella pertussis
caucgcgcugacga

SEQ ID NO: 367308 - RNA, 16 nt, Bordetella pertussis
caucgcgcuggcgcgc

SEQ ID NO: 367309 - RNA, 15 nt, Bordetella pertussis
caucgcgcuggcggu

SEQ ID NO: 367310 - RNA, 18 nt, Bordetella pertussis
caucgcgcuggcgguggc

SEQ ID NO: 367311 - RNA, 23 nt, Bordetella pertussis
caucgcgcuggcgguggccgcgc

SEQ ID NO: 367312 - RNA, 17 nt, Bordetella pertussis
caucgcggcagcccggc

SEQ ID NO: 367313 - RNA, 20 nt, Bordetella pertussis
caucgcugguaugcacgaug

SEQ ID NO: 367314 - RNA, 17 nt, Bordetella pertussis
caucgcuuccuugguca

SEQ ID NO: 367315 - RNA, 12 nt, Bordetella pertussis
caucggcaggcc

SEQ ID NO: 367316 - RNA, 18 nt, Bordetella pertussis
caucggcaggccggcgcg

SEQ ID NO: 367317 - RNA, 20 nt, Bordetella pertussis
caucggcaggccggcgcgcg

SEQ ID NO: 367318 - RNA, 22 nt, Bordetella pertussis
caucggcaggccggcgcgcgcg

SEQ ID NO: 367319 - RNA, 14 nt, Bordetella pertussis
caucggccacccgg

SEQ ID NO: 367320 - RNA, 21 nt, Bordetella pertussis
caucggccagcauacccugcg

SEQ ID NO: 367321 - RNA, 19 nt, Bordetella pertussis
caucggccggcggucgcgc

SEQ ID NO: 367322 - RNA, 17 nt, Bordetella pertussis
caucggccugcaccggc

SEQ ID NO: 367323 - RNA, 14 nt, Bordetella pertussis
caucggcgccaagc

SEQ ID NO: 367324 - RNA, 17 nt, Bordetella pertussis
caucggcgccaagcggc

SEQ ID NO: 367325 - RNA, 22 nt, Bordetella pertussis
caucggcgccaguagcgccggc

SEQ ID NO: 367326 - RNA, 23 nt, Bordetella pertussis
caucggcgccaguagcgccggcu

SEQ ID NO: 367327 - RNA, 15 nt, Bordetella pertussis
caucggcgccggcgu

SEQ ID NO: 367328 - RNA, 13 nt, Bordetella pertussis
caucggcgcgcgc

SEQ ID NO: 367329 - RNA, 14 nt, Bordetella pertussis
caucggcgcgcgcu

SEQ ID NO: 367330 - RNA, 14 nt, Bordetella pertussis
caucggcgcgcagc

SEQ ID NO: 367331 - RNA, 22 nt, Bordetella pertussis
caucggcguaccaggcagccgg

SEQ ID NO: 367332 - RNA, 13 nt, Bordetella pertussis
caugauggccggc

SEQ ID NO: 367333 - RNA, 19 nt, Bordetella pertussis
caugauggccggccugccg

SEQ ID NO: 367334 - RNA, 16 nt, Bordetella pertussis
caugauggugcugccg

SEQ ID NO: 367335 - RNA, 15 nt, Bordetella pertussis
caugaugucgcgcgc

SEQ ID NO: 367336 - RNA, 19 nt, Bordetella pertussis
caugaugucgcgggcccgc

SEQ ID NO: 367337 - RNA, 14 nt, Bordetella pertussis
caugaugucgucga

SEQ ID NO: 367338 - RNA, 18 nt, Bordetella pertussis
caugauuccaccuugccg

SEQ ID NO: 367339 - RNA, 19 nt, Bordetella pertussis
caugcaagacaggccgcua

SEQ ID NO: 367340 - RNA, 13 nt, Bordetella pertussis
caugcaccagcac

SEQ ID NO: 367341 - RNA, 14 nt, Bordetella pertussis
caugcacgggccau

SEQ ID NO: 367342 - RNA, 17 nt, Bordetella pertussis
caugcacgggccaugga

SEQ ID NO: 367343 - RNA, 21 nt, Bordetella pertussis
caugcacgggccauggaugcg

SEQ ID NO: 367344 - RNA, 19 nt, Bordetella pertussis
caugcacgacuacggcgga

SEQ ID NO: 367345 - RNA, 19 nt, Bordetella pertussis
caugccauggccgcgcggc

SEQ ID NO: 367346 - RNA, 19 nt, Bordetella pertussis
caugcccaggcccaguucg

SEQ ID NO: 367347 - RNA, 15 nt, Bordetella pertussis
caugcccaugccgcc

SEQ ID NO: 367348 - RNA, 22 nt, Bordetella pertussis
caugcccauuuccaccacgcgg

SEQ ID NO: 367349 - RNA, 17 nt, Bordetella pertussis
caugccccaacggcgca

SEQ ID NO: 367350 - RNA, 19 nt, Bordetella pertussis
caugcccgccggcacccgg

SEQ ID NO: 367351 - RNA, 17 nt, Bordetella pertussis
caugcccggccaccagc

SEQ ID NO: 367352 - RNA, 20 nt, Bordetella pertussis
caugccgcccaugccgccgg

SEQ ID NO: 367353 - RNA, 14 nt, Bordetella pertussis
caugccgcccgcca

SEQ ID NO: 367354 - RNA, 15 nt, Bordetella pertussis
caugccgcgcgccuu

SEQ ID NO: 367355 - RNA, 15 nt, Bordetella pertussis
caugccgcgcgcgca

SEQ ID NO: 367356 - RNA, 19 nt, Bordetella pertussis
caugccgcggacccaggcc

SEQ ID NO: 367357 - RNA, 24 nt, Bordetella pertussis
caugccgcggacccaggccucggc

SEQ ID NO: 367358 - RNA, 22 nt, Bordetella pertussis
caugccgcgggcggcgccggcc

SEQ ID NO: 367359 - RNA, 17 nt, Bordetella pertussis
caugccgcugcaggucg

SEQ ID NO: 367360 - RNA, 14 nt, Bordetella pertussis
caugccggcaagca

SEQ ID NO: 367361 - RNA, 23 nt, Bordetella pertussis
caugccggcauaggcggcgcagg

SEQ ID NO: 367362 - RNA, 15 nt, Bordetella pertussis
caugccgggcaagca

SEQ ID NO: 367363 - RNA, 14 nt, Bordetella pertussis
caugcgcuggcgca

SEQ ID NO: 367364 - RNA, 18 nt, Bordetella pertussis
caugcgcuugucgccgcu

SEQ ID NO: 367365 - RNA, 21 nt, Bordetella pertussis
caugcggaugaacgaccagca

SEQ ID NO: 367366 - RNA, 22 nt, Bordetella pertussis
caugcggaugaacgaccagcac

SEQ ID NO: 367367 - RNA, 16 nt, Bordetella pertussis
caugcggcccgcgcug

SEQ ID NO: 367368 - RNA, 16 nt, Bordetella pertussis
caugcggccgucgccg

SEQ ID NO: 367369 - RNA, 12 nt, Bordetella pertussis
caugcggcgcca

SEQ ID NO: 367370 - RNA, 15 nt, Bordetella pertussis
caugcggcuggccga

SEQ ID NO: 367371 - RNA, 20 nt, Bordetella pertussis
caugcggcuggccgaucacc

SEQ ID NO: 367372 - RNA, 18 nt, Bordetella pertussis
caugcgggacaggcgcca

SEQ ID NO: 367373 - RNA, 17 nt, Bordetella pertussis
caugcggggacaggcac

SEQ ID NO: 367374 - RNA, 22 nt, Bordetella pertussis
caugcggggacaggcacuccgg

SEQ ID NO: 367375 - RNA, 13 nt, Bordetella pertussis
caugcggggcggc

SEQ ID NO: 367376 - RNA, 17 nt, Bordetella pertussis
caugcgggucucggagc

SEQ ID NO: 367377 - RNA, 15 nt, Bordetella pertussis
caugcggugcgcccu

SEQ ID NO: 367378 - RNA, 13 nt, Bordetella pertussis
caugcgucgaacg

SEQ ID NO: 367379 - RNA, 20 nt, Bordetella pertussis
caugcgugaagcccauggcg

SEQ ID NO: 367380 - RNA, 16 nt, Bordetella pertussis
caugcguucggccagc

SEQ ID NO: 367381 - RNA, 17 nt, Bordetella pertussis
caugcguucggccagcc

SEQ ID NO: 367382 - RNA, 18 nt, Bordetella pertussis
caugcguucggccagccc

SEQ ID NO: 367383 - RNA, 17 nt, Bordetella pertussis
caugcucagcagcaccg

SEQ ID NO: 367384 - RNA, 17 nt, Bordetella pertussis
caugcucgcgcacagcg

SEQ ID NO: 367385 - RNA, 17 nt, Bordetella pertussis
caugcucguccaucgcc

SEQ ID NO: 367386 - RNA, 17 nt, Bordetella pertussis
caugcugcgacagcagg

SEQ ID NO: 367387 - RNA, 21 nt, Bordetella pertussis
caugcuggauucgccggucgg

SEQ ID NO: 367388 - RNA, 14 nt, Bordetella pertussis
caugcuggcccagc

SEQ ID NO: 367389 - RNA, 23 nt, Bordetella pertussis
cauggccugcaggaagccugcgc

SEQ ID NO: 367390 - RNA, 16 nt, Bordetella pertussis
cauggccuggcccagc

SEQ ID NO: 367391 - RNA, 17 nt, Bordetella pertussis
cauggccuggcccagcu

SEQ ID NO: 367392 - RNA, 23 nt, Bordetella pertussis
cauggccgugcgcccgacgcugu

SEQ ID NO: 367393 - RNA, 18 nt, Bordetella pertussis
cauggccucgucgaccac

SEQ ID NO: 367394 - RNA, 22 nt, Bordetella pertussis
cauggccucgucgaccacgccg

SEQ ID NO: 367395 - RNA, 19 nt, Bordetella pertussis
cauggcgccaugcgacagc

SEQ ID NO: 367396 - RNA, 22 nt, Bordetella pertussis
cauggcgccaugcgacagcccg

SEQ ID NO: 367397 - RNA, 23 nt, Bordetella pertussis
cauggcgccaugcgacagcccgg

SEQ ID NO: 367398 - RNA, 12 nt, Bordetella pertussis
caugggccaggc

SEQ ID NO: 367399 - RNA, 14 nt, Bordetella pertussis
caugggccaggcgc

SEQ ID NO: 367400 - RNA, 17 nt, Bordetella pertussis
caugggcccgggcgcgc

SEQ ID NO: 367401 - RNA, 19 nt, Bordetella pertussis
caugggcgaagccacggcc

SEQ ID NO: 367402 - RNA, 20 nt, Bordetella pertussis
caugggcgaagccacggccc

SEQ ID NO: 367403 - RNA, 22 nt, Bordetella pertussis
caugggcgaagccacggcccgc

SEQ ID NO: 367404 - RNA, 18 nt, Bordetella pertussis
caugggcgcaggccgcca

SEQ ID NO: 367405 - RNA, 16 nt, Bordetella pertussis
caugggcgcgcccggc

SEQ ID NO: 367406 - RNA, 14 nt, Bordetella pertussis
caugggcggcccgc

SEQ ID NO: 367407 - RNA, 21 nt, Bordetella pertussis
caugggcguggugcugacgga

SEQ ID NO: 367408 - RNA, 20 nt, Bordetella pertussis
caugggcucgcgcgagccca

SEQ ID NO: 367409 - RNA, 18 nt, Bordetella pertussis
caugggcucgugcagcag

SEQ ID NO: 367410 - RNA, 19 nt, Bordetella pertussis
cauggggcaggcgcagcgg

SEQ ID NO: 367411 - RNA, 15 nt, Bordetella pertussis
caugggcgugccgcg

SEQ ID NO: 367412 - RNA, 23 nt, Bordetella pertussis
cauggggugcuccugccaggcgc

SEQ ID NO: 367413 - RNA, 18 nt, Bordetella pertussis
cauggguaaagcgccggc

SEQ ID NO: 367414 - RNA, 19 nt, Bordetella pertussis
cauggguaaagcgccggcc

SEQ ID NO: 367415 - RNA, 17 nt, Bordetella pertussis
cauggugggcaggucgg

SEQ ID NO: 367416 - RNA, 21 nt, Bordetella pertussis
caugguguaccgggccgacgc

SEQ ID NO: 367417 - RNA, 14 nt, Bordetella pertussis
cauguacucggcca

SEQ ID NO: 367418 - RNA, 18 nt, Bordetella pertussis
cauguagauggccgccuu

SEQ ID NO: 367419 - RNA, 16 nt, Bordetella pertussis
cauguagcggccgccc

SEQ ID NO: 367420 - RNA, 16 nt, Bordetella pertussis
caugucguacaggccg

SEQ ID NO: 367421 - RNA, 16 nt, Bordetella pertussis
caugucguccucggcc

SEQ ID NO: 367422 - RNA, 17 nt, Bordetella pertussis
caugucguccucggcca

SEQ ID NO: 367423 - RNA, 20 nt, Bordetella pertussis
caugucguccucggccacgu

SEQ ID NO: 367424 - RNA, 22 nt, Bordetella pertussis
caugugccaccgcccaggcgca

SEQ ID NO: 367425 - RNA, 22 nt, Bordetella pertussis
caugugcgagagcuccagccgg

SEQ ID NO: 367426 - RNA, 20 nt, Bordetella pertussis
caugugcuugccgcagcggc

SEQ ID NO: 367427 - RNA, 23 nt, Bordetella pertussis
caugugcucgggacgcaggccca

SEQ ID NO: 367428 - RNA, 14 nt, Bordetella pertussis
cauguucgaccagg

SEQ ID NO: 367429 - RNA, 20 nt, Bordetella pertussis
cauuaccagcaacgcgccgc

SEQ ID NO: 367430 - RNA, 23 nt, Bordetella pertussis
cauuccuuccgggcccgcgccga

SEQ ID NO: 367431 - RNA, 19 nt, Bordetella pertussis
cauucgaacaacagcgccu

SEQ ID NO: 367432 - RNA, 16 nt, Bordetella pertussis
cauucgauggcggcgc

SEQ ID NO: 367433 - RNA, 16 nt, Bordetella pertussis
cauucggcgcgcucgg

SEQ ID NO: 367434 - RNA, 15 nt, Bordetella pertussis
cauucggcggccggc

SEQ ID NO: 367435 - RNA, 18 nt, Bordetella pertussis
cauugcacaacgggcagg

SEQ ID NO: 367436 - RNA, 19 nt, Bordetella pertussis
cauuuccucgaccagcgcg

SEQ ID NO: 367437 - RNA, 21 nt, Bordetella pertussis
cauuuccugggccucuagcuc

SEQ ID NO: 367438 - RNA, 23 nt, Bordetella pertussis
cauuucgauuucggcggccaggc

SEQ ID NO: 367439 - RNA, 16 nt, Bordetella pertussis
cauuucgcgugcgugg

SEQ ID NO: 367440 - RNA, 17 nt, Bordetella pertussis
cauuucgcugggcgcgc

SEQ ID NO: 367441 - RNA, 18 nt, Bordetella pertussis
ccaaaaaaaaaccccgcc

SEQ ID NO: 367442 - RNA, 16 nt, Bordetella pertussis
ccaacagcucgcgcca

SEQ ID NO: 367443 - RNA, 18 nt, Bordetella pertussis
ccaacagcucgcgccagg

SEQ ID NO: 367444 - RNA, 19 nt, Bordetella pertussis
ccaaccccgagggcgcggc

SEQ ID NO: 367445 - RNA, 19 nt, Bordetella pertussis
ccaaggcauuggcgccgcg

SEQ ID NO: 367446 - RNA, 21 nt, Bordetella pertussis
ccaaggcauuggcgccgcgcu

SEQ ID NO: 367447 - RNA, 14 nt, Bordetella pertussis
ccaagggcgccgcg

SEQ ID NO: 367448 - RNA, 17 nt, Bordetella pertussis
ccaagggcgccgcgccg

SEQ ID NO: 367449 - RNA, 16 nt, Bordetella pertussis
ccaagggcgccgggcg

SEQ ID NO: 367450 - RNA, 16 nt, Bordetella pertussis
ccaagggcgcgccagc

SEQ ID NO: 367451 - RNA, 20 nt, Bordetella pertussis
ccaauagcgguggcgggcca

SEQ ID NO: 367452 - RNA, 14 nt, Bordetella pertussis
ccaaucugccgcug

SEQ ID NO: 367453 - RNA, 19 nt, Bordetella pertussis
ccaaucugccgcugaccgg

SEQ ID NO: 367454 - RNA, 15 nt, Bordetella pertussis
ccaaugugcugacgg

SEQ ID NO: 367455 - RNA, 16 nt, Bordetella pertussis
ccaaugugcugacggu

SEQ ID NO: 367456 - RNA, 19 nt, Bordetella pertussis
ccacaagccguacagcgaa

SEQ ID NO: 367457 - RNA, 22 nt, Bordetella pertussis
ccacaaggauggacuggccgcg

SEQ ID NO: 367458 - RNA, 17 nt, Bordetella pertussis
ccacacgggcgccugcc

SEQ ID NO: 367459 - RNA, 16 nt, Bordetella pertussis
ccacagcagcgcgccg

SEQ ID NO: 367460 - RNA, 17 nt, Bordetella pertussis
ccacagcagcgcgccgc

SEQ ID NO: 367461 - RNA, 19 nt, Bordetella pertussis
ccacagcagcgcgccgccg

SEQ ID NO: 367462 - RNA, 13 nt, Bordetella pertussis
ccacagcaugacc

SEQ ID NO: 367463 - RNA, 13 nt, Bordetella pertussis
ccacagccacugc

SEQ ID NO: 367464 - RNA, 14 nt, Bordetella pertussis
ccacagccaggccg

SEQ ID NO: 367465 - RNA, 19 nt, Bordetella pertussis
ccacagcccggcccccagc

SEQ ID NO: 367466 - RNA, 12 nt, Bordetella pertussis
ccacagcgcccc

SEQ ID NO: 367467 - RNA, 16 nt, Bordetella pertussis
ccacagcgcccccagc

SEQ ID NO: 367468 - RNA, 12 nt, Bordetella pertussis
ccacagcgccgc

SEQ ID NO: 367469 - RNA, 16 nt, Bordetella pertussis
ccacagcgcguggccg

SEQ ID NO: 367470 - RNA, 22 nt, Bordetella pertussis
ccacagcgugacggcggcgcgc

SEQ ID NO: 367471 - RNA, 23 nt, Bordetella pertussis
ccacagcgugacggcggcgcgcg

SEQ ID NO: 367472 - RNA, 19 nt, Bordetella pertussis
ccacagcuggugccgguug

SEQ ID NO: 367473 - RNA, 17 nt, Bordetella pertussis
ccacaggaacaggccgg

SEQ ID NO: 367474 - RNA, 20 nt, Bordetella pertussis
ccacaggagacuggcagugc

SEQ ID NO: 367475 - RNA, 16 nt, Bordetella pertussis
ccacaggcccaugccg

SEQ ID NO: 367476 - RNA, 12 nt, Bordetella pertussis
ccacaggcgcgc

SEQ ID NO: 367477 - RNA, 13 nt, Bordetella pertussis
ccacaggcgcgcg

SEQ ID NO: 367478 - RNA, 17 nt, Bordetella pertussis
ccacaggcugacgcccg

SEQ ID NO: 367479 - RNA, 19 nt, Bordetella pertussis
ccacaggcugacgcccggc

SEQ ID NO: 367480 - RNA, 21 nt, Bordetella pertussis
ccacagggggacuggcacccg

SEQ ID NO: 367481 - RNA, 16 nt, Bordetella pertussis
ccacaggguggcgccc

SEQ ID NO: 367482 - RNA, 19 nt, Bordetella pertussis
ccacaggguggcgcccagg

SEQ ID NO: 367483 - RNA, 15 nt, Bordetella pertussis
ccacaggugcgcggc

SEQ ID NO: 367484 - RNA, 16 nt, Bordetella pertussis
ccacaggugcgcggcg

SEQ ID NO: 367485 - RNA, 17 nt, Bordetella pertussis
ccacaggugcgcggcgc

SEQ ID NO: 367486 - RNA, 19 nt, Bordetella pertussis
ccacaggugcgcggcgcgc

SEQ ID NO: 367487 - RNA, 17 nt, Bordetella pertussis
ccacagguuggccgcga

SEQ ID NO: 367488 - RNA, 18 nt, Bordetella pertussis
ccacagucggucgccgca

SEQ ID NO: 367489 - RNA, 16 nt, Bordetella pertussis
ccaccacccaggccca

SEQ ID NO: 367490 - RNA, 14 nt, Bordetella pertussis
ccaccaccaugugc

SEQ ID NO: 367491 - RNA, 14 nt, Bordetella pertussis
ccaccaccgcccgc

SEQ ID NO: 367492 - RNA, 15 nt, Bordetella pertussis
ccaccaccgcccgca

SEQ ID NO: 367493 - RNA, 19 nt, Bordetella pertussis
ccaccaccggcacgccggc

SEQ ID NO: 367494 - RNA, 17 nt, Bordetella pertussis
ccaccacgccgcccagc

SEQ ID NO: 367495 - RNA, 17 nt, Bordetella pertussis
ccaccacgauggcgcaa

SEQ ID NO: 367496 - RNA, 14 nt, Bordetella pertussis
ccaccacggcgcgg

SEQ ID NO: 367497 - RNA, 11 nt, Bordetella pertussis
ccaccagcgcc

SEQ ID NO: 367498 - RNA, 14 nt, Bordetella pertussis
ccaccagcgcgcca

SEQ ID NO: 367499 - RNA, 14 nt, Bordetella pertussis
ccaccagcggcgcc

SEQ ID NO: 367500 - RNA, 23 nt, Bordetella pertussis
ccaccagcggcguggcggccagg

SEQ ID NO: 367501 - RNA, 18 nt, Bordetella pertussis
ccaccagcuugcgcgccg

SEQ ID NO: 367502 - RNA, 20 nt, Bordetella pertussis
ccaccaggaacgccagcagc

SEQ ID NO: 367503 - RNA, 16 nt, Bordetella pertussis
ccacccccggcaccag

SEQ ID NO: 367504 - RNA, 23 nt, Bordetella pertussis
ccacccccgucagcacggucggc

SEQ ID NO: 367505 - RNA, 21 nt, Bordetella pertussis
ccaccccgucaucgccgcggc

SEQ ID NO: 367506 - RNA, 14 nt, Bordetella pertussis
ccacccgcacgccg

SEQ ID NO: 367507 - RNA, 12 nt, Bordetella pertussis
ccacccgcgcca

SEQ ID NO: 367508 - RNA, 13 nt, Bordetella pertussis
ccacccgcgccag

SEQ ID NO: 367509 - RNA, 14 nt, Bordetella pertussis
ccacccgcgccagg

SEQ ID NO: 367510 - RNA, 13 nt, Bordetella pertussis
ccacccgccgccg

SEQ ID NO: 367511 - RNA, 13 nt, Bordetella pertussis
ccacccggcacgc

SEQ ID NO: 367512 - RNA, 16 nt, Bordetella pertussis
ccacccuggcacgcug

SEQ ID NO: 367513 - RNA, 14 nt, Bordetella pertussis
ccaccgaagcggcg

SEQ ID NO: 367514 - RNA, 21 nt, Bordetella pertussis
ccaccgacaagccggucgacc

SEQ ID NO: 367515 - RNA, 16 nt, Bordetella pertussis
ccaccgacaugaccgc

SEQ ID NO: 367516 - RNA, 20 nt, Bordetella pertussis
ccaccgacaugaccgcgucc

SEQ ID NO: 367517 - RNA, 22 nt, Bordetella pertussis
ccaccgacaugaccgcguccgc

SEQ ID NO: 367518 - RNA, 16 nt, Bordetella pertussis
ccaccgacggcgcggc

SEQ ID NO: 367519 - RNA, 17 nt, Bordetella pertussis
ccaccgacggcgcggcg

SEQ ID NO: 367520 - RNA, 23 nt, Bordetella pertussis
ccaccgauccgaugaugcccagg

SEQ ID NO: 367521 - RNA, 17 nt, Bordetella pertussis
ccaccgcaucgcgcagc

SEQ ID NO: 367522 - RNA, 14 nt, Bordetella pertussis
ccaccgccagcccg

SEQ ID NO: 367523 - RNA, 12 nt, Bordetella pertussis
ccaccgcccaga

SEQ ID NO: 367524 - RNA, 12 nt, Bordetella pertussis
ccaccgcccagg

SEQ ID NO: 367525 - RNA, 17 nt, Bordetella pertussis
ccaccgccguggccggc

SEQ ID NO: 367526 - RNA, 17 nt, Bordetella pertussis
ccaccgcggcggaccac

SEQ ID NO: 367527 - RNA, 22 nt, Bordetella pertussis
ccaccgcggugccgcgcgcggc

SEQ ID NO: 367528 - RNA, 15 nt, Bordetella pertussis
ccaccggcaaggccg

SEQ ID NO: 367529 - RNA, 17 nt, Bordetella pertussis
ccaccggcaaggccgcg

SEQ ID NO: 367530 - RNA, 20 nt, Bordetella pertussis
ccaccggcaaggccgcgaac

SEQ ID NO: 367531 - RNA, 15 nt, Bordetella pertussis
ccaccggcacgccgg

SEQ ID NO: 367532 - RNA, 19 nt, Bordetella pertussis
ccaccggcacgccggcggc

SEQ ID NO: 367533 - RNA, 16 nt, Bordetella pertussis
ccaccggcgcgcgcau

SEQ ID NO: 367534 - RNA, 17 nt, Bordetella pertussis
ccaccggcuggauaucc

SEQ ID NO: 367535 - RNA, 16 nt, Bordetella pertussis
ccaccgggacaggcac

SEQ ID NO: 367536 - RNA, 17 nt, Bordetella pertussis
ccaccgggccggccugc

SEQ ID NO: 367537 - RNA, 19 nt, Bordetella pertussis
ccaccgggcugaacauccu

SEQ ID NO: 367538 - RNA, 21 nt, Bordetella pertussis
ccaccggucgccguccaggcg

SEQ ID NO: 367539 - RNA, 20 nt, Bordetella pertussis
ccaccgguugcagcgcgcca

SEQ ID NO: 367540 - RNA, 22 nt, Bordetella pertussis
ccaccgguugcagcgcgccagg

SEQ ID NO: 367541 - RNA, 23 nt, Bordetella pertussis
ccaccgguugcagcgcgccaggc

SEQ ID NO: 367542 - RNA, 23 nt, Bordetella pertussis
ccacgcucacgcccgugucgccg

SEQ ID NO: 367543 - RNA, 16 nt, Bordetella pertussis
ccacgcugcccugcug

SEQ ID NO: 367544 - RNA, 15 nt, Bordetella pertussis
ccacgcugcgcccgc

SEQ ID NO: 367545 - RNA, 14 nt, Bordetella pertussis
ccacgcuggccgcg

SEQ ID NO: 367546 - RNA, 15 nt, Bordetella pertussis
ccacgcuggccgcgc

SEQ ID NO: 367547 - RNA, 18 nt, Bordetella pertussis
ccacgcuggccgcgcugg

SEQ ID NO: 367548 - RNA, 22 nt, Bordetella pertussis
ccacgcuggcuucgucgccggc

SEQ ID NO: 367549 - RNA, 18 nt, Bordetella pertussis
ccacgcugggccagaccg

SEQ ID NO: 367550 - RNA, 23 nt, Bordetella pertussis
ccacgcugggccagaccgcgcgc

SEQ ID NO: 367551 - RNA, 22 nt, Bordetella pertussis
ccacgcuguacugguaccaggc

SEQ ID NO: 367552 - RNA, 20 nt, Bordetella pertussis
ccacgcuguuuucggccgac

SEQ ID NO: 367553 - RNA, 23 nt, Bordetella pertussis
ccacgcuguuuucggccgacucg

SEQ ID NO: 367554 - RNA, 22 nt, Bordetella pertussis
ccacgcugucggggugccguuc

SEQ ID NO: 367555 - RNA, 22 nt, Bordetella pertussis
ccacggcaggcgccugcccugc

SEQ ID NO: 367556 - RNA, 13 nt, Bordetella pertussis
ccacggcaucgcc

SEQ ID NO: 367557 - RNA, 14 nt, Bordetella pertussis
ccacggcaucgccg

SEQ ID NO: 367558 - RNA, 17 nt, Bordetella pertussis
ccacggcaucggccagc

SEQ ID NO: 367559 - RNA, 16 nt, Bordetella pertussis
ccacggcaucggcgcc

SEQ ID NO: 367560 - RNA, 22 nt, Bordetella pertussis
ccacggcaucggcgccgcgcgc

SEQ ID NO: 367561 - RNA, 15 nt, Bordetella pertussis
ccacggccacgucgg

SEQ ID NO: 367562 - RNA, 18 nt, Bordetella pertussis
ccacggccacgucggucg

SEQ ID NO: 367563 - RNA, 14 nt, Bordetella pertussis
ccacggccagcacu

SEQ ID NO: 367564 - RNA, 14 nt, Bordetella pertussis
ccacggccgcaugc

SEQ ID NO: 367565 - RNA, 16 nt, Bordetella pertussis
ccacggccggcgcacg

SEQ ID NO: 367566 - RNA, 17 nt, Bordetella pertussis
ccacggccggcgcacgc

SEQ ID NO: 367567 - RNA, 17 nt, Bordetella pertussis
ccacggccugcgcgccg

SEQ ID NO: 367568 - RNA, 15 nt, Bordetella pertussis
ccacggccuucaugg

SEQ ID NO: 367569 - RNA, 15 nt, Bordetella pertussis
ccacggcccgccagg

SEQ ID NO: 367570 - RNA, 22 nt, Bordetella pertussis
ccacggcgaugaacagcggcac

SEQ ID NO: 367571 - RNA, 15 nt, Bordetella pertussis
ccacgggcgucaccg

SEQ ID NO: 367572 - RNA, 21 nt, Bordetella pertussis
ccacgggcucgcugaccggcg

SEQ ID NO: 367573 - RNA, 13 nt, Bordetella pertussis
ccacggggacagg

SEQ ID NO: 367574 - RNA, 18 nt, Bordetella pertussis
ccacggggacaggcaccu

SEQ ID NO: 367575 - RNA, 20 nt, Bordetella pertussis
ccacggggacaggcaccucg

SEQ ID NO: 367576 - RNA, 17 nt, Bordetella pertussis
ccacguaggcaaagcgc

SEQ ID NO: 367577 - RNA, 23 nt, Bordetella pertussis
ccacgucacggaucagccgcuug

SEQ ID NO: 367578 - RNA, 22 nt, Bordetella pertussis
ccacgucauaggcuucgcccgc

SEQ ID NO: 367579 - RNA, 13 nt, Bordetella pertussis
ccacguccagcac

SEQ ID NO: 367580 - RNA, 20 nt, Bordetella pertussis
ccacguccagcacggccgcg

SEQ ID NO: 367581 - RNA, 19 nt, Bordetella pertussis
ccacucgaugggcgcgcgc

SEQ ID NO: 367582 - RNA, 15 nt, Bordetella pertussis
ccacucggccagcgc

SEQ ID NO: 367583 - RNA, 15 nt, Bordetella pertussis
ccacucggugcgcgc

SEQ ID NO: 367584 - RNA, 19 nt, Bordetella pertussis
ccacucggugcgcgcgccc

SEQ ID NO: 367585 - RNA, 22 nt, Bordetella pertussis
ccacugccaggcgagcgccgcg

SEQ ID NO: 367586 - RNA, 15 nt, Bordetella pertussis
ccacuuccagcgccu

SEQ ID NO: 367587 - RNA, 19 nt, Bordetella pertussis
ccacuuccucggcgcgcgc

SEQ ID NO: 367588 - RNA, 20 nt, Bordetella pertussis
ccacuuccucggcgcgcgcg

SEQ ID NO: 367589 - RNA, 14 nt, Bordetella pertussis
ccagaaagcgcggc

SEQ ID NO: 367590 - RNA, 16 nt, Bordetella pertussis
ccagaacccggccggc

SEQ ID NO: 367591 - RNA, 13 nt, Bordetella pertussis
ccagaacgcgccg

SEQ ID NO: 367592 - RNA, 18 nt, Bordetella pertussis
ccagcaaaugggccgcag

SEQ ID NO: 367593 - RNA, 22 nt, Bordetella pertussis
ccagcaaaugggccgcagcgaa

SEQ ID NO: 367594 - RNA, 16 nt, Bordetella pertussis
ccagcaagccggcggu

SEQ ID NO: 367595 - RNA, 14 nt, Bordetella pertussis
ccagcaagcgcgcc

SEQ ID NO: 367596 - RNA, 15 nt, Bordetella pertussis
ccagcaagcgcgcca

SEQ ID NO: 367597 - RNA, 16 nt, Bordetella pertussis
ccagcaagcgcucggc

SEQ ID NO: 367598 - RNA, 13 nt, Bordetella pertussis
ccagcaaggcggc

SEQ ID NO: 367599 - RNA, 18 nt, Bordetella pertussis
ccagcaaggcggcaaacc

SEQ ID NO: 367600 - RNA, 16 nt, Bordetella pertussis
ccagcaaggcgucggc

SEQ ID NO: 367601 - RNA, 22 nt, Bordetella pertussis
ccagcaauuaugcguggccgcc

SEQ ID NO: 367602 - RNA, 23 nt, Bordetella pertussis
ccagcaauucguugaucuggccg

SEQ ID NO: 367603 - RNA, 16 nt, Bordetella pertussis
ccagcacauacgccgc

SEQ ID NO: 367604 - RNA, 18 nt, Bordetella pertussis
ccagcacauacgccgccg

SEQ ID NO: 367605 - RNA, 21 nt, Bordetella pertussis
ccagcacauacgccgccgagg

SEQ ID NO: 367606 - RNA, 21 nt, Bordetella pertussis
ccagcacauagcgcaagcccg

SEQ ID NO: 367607 - RNA, 18 nt, Bordetella pertussis
ccagcaccagcgccugcc

SEQ ID NO: 367608 - RNA, 14 nt, Bordetella pertussis
ccagcaccaggccg

SEQ ID NO: 367609 - RNA, 17 nt, Bordetella pertussis
ccagcaccagggcgcgc

SEQ ID NO: 367610 - RNA, 18 nt, Bordetella pertussis
ccagcaccagggcgcgca

SEQ ID NO: 367611 - RNA, 14 nt, Bordetella pertussis
ccagcaccaugccg

SEQ ID NO: 367612 - RNA, 17 nt, Bordetella pertussis
ccagcaccaugccgaug

SEQ ID NO: 367613 - RNA, 13 nt, Bordetella pertussis
ccagcaccgccac

SEQ ID NO: 367614 - RNA, 13 nt, Bordetella pertussis
ccagcaccggcac

SEQ ID NO: 367615 - RNA, 13 nt, Bordetella pertussis
ccagcaccggccg

SEQ ID NO: 367616 - RNA, 15 nt, Bordetella pertussis
ccagcaccggccgcc

SEQ ID NO: 367617 - RNA, 17 nt, Bordetella pertussis
ccagcaccggccgccgc

SEQ ID NO: 367618 - RNA, 18 nt, Bordetella pertussis
ccagcaccggccgccgca

SEQ ID NO: 367619 - RNA, 22 nt, Bordetella pertussis
ccagcaccggcugccagggccg

SEQ ID NO: 367620 - RNA, 12 nt, Bordetella pertussis
ccagcacgcggc

SEQ ID NO: 367621 - RNA, 13 nt, Bordetella pertussis
ccagcacgcggcg

SEQ ID NO: 367622 - RNA, 23 nt, Bordetella pertussis
ccagcacgccuugcucgaccagg

SEQ ID NO: 367623 - RNA, 21 nt, Bordetella pertussis
ccagcacgcgcgccagcuggg

SEQ ID NO: 367624 - RNA, 14 nt, Bordetella pertussis
ccagcacggccgcg

SEQ ID NO: 367625 - RNA, 15 nt, Bordetella pertussis
ccagcacggccgcgg

SEQ ID NO: 367626 - RNA, 17 nt, Bordetella pertussis
ccagcacggccgcggcc

SEQ ID NO: 367627 - RNA, 20 nt, Bordetella pertussis
ccagcacggccgcggccggc

SEQ ID NO: 367628 - RNA, 16 nt, Bordetella pertussis
ccagcacggcgcacac

SEQ ID NO: 367629 - RNA, 17 nt, Bordetella pertussis
ccagcacggcgcacacc

SEQ ID NO: 367630 - RNA, 17 nt, Bordetella pertussis
ccagcacgguggcgccc

SEQ ID NO: 367631 - RNA, 19 nt, Bordetella pertussis
ccagcacgguggcgcccgg

SEQ ID NO: 367632 - RNA, 12 nt, Bordetella pertussis
ccagcacggugg

SEQ ID NO: 367633 - RNA, 12 nt, Bordetella pertussis
ccagcagcacgu

SEQ ID NO: 367634 - RNA, 17 nt, Bordetella pertussis
ccagcagcagcgccgcg

SEQ ID NO: 367635 - RNA, 21 nt, Bordetella pertussis
ccagcagcagcgccgcgccgc

SEQ ID NO: 367636 - RNA, 23 nt, Bordetella pertussis
ccagcagcaggaacaggcugcgc

SEQ ID NO: 367637 - RNA, 12 nt, Bordetella pertussis
ccagcagcaugc

SEQ ID NO: 367638 - RNA, 16 nt, Bordetella pertussis
ccagcagcaugccgcg

SEQ ID NO: 367639 - RNA, 18 nt, Bordetella pertussis
ccagcagcaugccgcggu

SEQ ID NO: 367640 - RNA, 21 nt, Bordetella pertussis
ccagcagccccagcguccagg

SEQ ID NO: 367641 - RNA, 19 nt, Bordetella pertussis
ccagcagcgggcuggggca

SEQ ID NO: 367642 - RNA, 23 nt, Bordetella pertussis
ccagcagcgggcuggggcaggca

SEQ ID NO: 367643 - RNA, 19 nt, Bordetella pertussis
ccagcagcggguugcgcgc

SEQ ID NO: 367644 - RNA, 20 nt, Bordetella pertussis
ccagcagcgugaugccgucg

SEQ ID NO: 367645 - RNA, 12 nt, Bordetella pertussis
ccagcagcgugg

SEQ ID NO: 367646 - RNA, 14 nt, Bordetella pertussis
ccagcagcguggcc

SEQ ID NO: 367647 - RNA, 22 nt, Bordetella pertussis
ccagcagcguggccaccaggcg

SEQ ID NO: 367648 - RNA, 23 nt, Bordetella pertussis
ccagcagcguggccaccaggcgc

SEQ ID NO: 367649 - RNA, 20 nt, Bordetella pertussis
ccagcagcuccucggccugc

SEQ ID NO: 367650 - RNA, 12 nt, Bordetella pertussis
ccagcagcucgg

SEQ ID NO: 367651 - RNA, 13 nt, Bordetella pertussis
ccagcagcucggc

SEQ ID NO: 367652 - RNA, 15 nt, Bordetella pertussis
ccagcagcucggcca

SEQ ID NO: 367653 - RNA, 18 nt, Bordetella pertussis
ccagcagcuggcgcagca

SEQ ID NO: 367654 - RNA, 17 nt, Bordetella pertussis
ccagcagggucagcggc

SEQ ID NO: 367655 - RNA, 21 nt, Bordetella pertussis
ccagcagggucagcggccggc

SEQ ID NO: 367656 - RNA, 18 nt, Bordetella pertussis
ccagcaggagcccgcugc

SEQ ID NO: 367657 - RNA, 18 nt, Bordetella pertussis
ccagcaucgccgccagcu

SEQ ID NO: 367658 - RNA, 15 nt, Bordetella pertussis
ccagcaucgcgccuu

SEQ ID NO: 367659 - RNA, 20 nt, Bordetella pertussis
ccagcaucgcgccuucggcg

SEQ ID NO: 367660 - RNA, 17 nt, Bordetella pertussis
ccagcaucggcacccag

SEQ ID NO: 367661 - RNA, 20 nt, Bordetella pertussis
ccagcaucggcacccagccg

SEQ ID NO: 367662 - RNA, 13 nt, Bordetella pertussis
ccagcaucgccgc

SEQ ID NO: 367663 - RNA, 21 nt, Bordetella pertussis
ccagcaugaucaugccgcugc

SEQ ID NO: 367664 - RNA, 13 nt, Bordetella pertussis
ccagccgcucggc

SEQ ID NO: 367665 - RNA, 22 nt, Bordetella pertussis
ccagccgcucggccacgcgcug

SEQ ID NO: 367666 - RNA, 14 nt, Bordetella pertussis
ccagccgcuggcga

SEQ ID NO: 367667 - RNA, 17 nt, Bordetella pertussis
ccagccgcuggcgcgcc

SEQ ID NO: 367668 - RNA, 18 nt, Bordetella pertussis
ccagccgcuggcgcgccg

SEQ ID NO: 367669 - RNA, 19 nt, Bordetella pertussis
ccagccgcuggcgcgccgc

SEQ ID NO: 367670 - RNA, 20 nt, Bordetella pertussis
ccagccggacccgcgccgca

SEQ ID NO: 367671 - RNA, 11 nt, Bordetella pertussis
ccagccggccc

SEQ ID NO: 367672 - RNA, 23 nt, Bordetella pertussis
ccagccggcccagcacgccgcgc

SEQ ID NO: 367673 - RNA, 18 nt, Bordetella pertussis
ccagccggcccagcaugc

SEQ ID NO: 367674 - RNA, 13 nt, Bordetella pertussis
ccagccggcgcgc

SEQ ID NO: 367675 - RNA, 14 nt, Bordetella pertussis
ccagccggcgcgcc

SEQ ID NO: 367676 - RNA, 12 nt, Bordetella pertussis
ccagccggcggc

SEQ ID NO: 367677 - RNA, 22 nt, Bordetella pertussis
ccagccggcggcaugcgccagc

SEQ ID NO: 367678 - RNA, 15 nt, Bordetella pertussis
ccagccgggcggcca

SEQ ID NO: 367679 - RNA, 20 nt, Bordetella pertussis
ccagccggguggucgcgccc

SEQ ID NO: 367680 - RNA, 22 nt, Bordetella pertussis
ccagccggguggucgcgcccgc

SEQ ID NO: 367681 - RNA, 16 nt, Bordetella pertussis
ccagccgucgcgcugc

SEQ ID NO: 367682 - RNA, 19 nt, Bordetella pertussis
ccagccgucgcgcugcaau

SEQ ID NO: 367683 - RNA, 18 nt, Bordetella pertussis
ccagccguucaucagcgc

SEQ ID NO: 367684 - RNA, 22 nt, Bordetella pertussis
ccagccguucaucagcgcgcgc

SEQ ID NO: 367685 - RNA, 19 nt, Bordetella pertussis
ccagccguuggcgcccagc

SEQ ID NO: 367686 - RNA, 23 nt, Bordetella pertussis
ccagccguuggcgcccagcgcca

SEQ ID NO: 367687 - RNA, 19 nt, Bordetella pertussis
ccagccugcccgggcagca

SEQ ID NO: 367688 - RNA, 16 nt, Bordetella pertussis
ccagccugccgcggcc

SEQ ID NO: 367689 - RNA, 18 nt, Bordetella pertussis
ccagccugccgcggccgc

SEQ ID NO: 367690 - RNA, 20 nt, Bordetella pertussis
ccagccugccgcggccgccc

SEQ ID NO: 367691 - RNA, 12 nt, Bordetella pertussis
ccagccuggccu

SEQ ID NO: 367692 - RNA, 17 nt, Bordetella pertussis
ccagccuggccuugcgc

SEQ ID NO: 367693 - RNA, 23 nt, Bordetella pertussis
ccagccuuggcccacucaugcgc

SEQ ID NO: 367694 - RNA, 23 nt, Bordetella pertussis
ccagcgauacccgcuucgacggc

SEQ ID NO: 367695 - RNA, 20 nt, Bordetella pertussis
ccagcgaguuguccuggccg

SEQ ID NO: 367696 - RNA, 21 nt, Bordetella pertussis
ccagcgaguuguccuggccgg

SEQ ID NO: 367697 - RNA, 19 nt, Bordetella pertussis
ccagcgccaccaccggcac

SEQ ID NO: 367698 - RNA, 15 nt, Bordetella pertussis
ccagcgccaccagca

SEQ ID NO: 367699 - RNA, 20 nt, Bordetella pertussis
ccagcgccaccagcagcgcc

SEQ ID NO: 367700 - RNA, 16 nt, Bordetella pertussis
ccagcgccacgcccag

SEQ ID NO: 367701 - RNA, 18 nt, Bordetella pertussis
ccagcgccacgcccuggc

SEQ ID NO: 367702 - RNA, 15 nt, Bordetella pertussis
ccagcgccacgccgg

SEQ ID NO: 367703 - RNA, 18 nt, Bordetella pertussis
ccagcgccacgccggcca

SEQ ID NO: 367704 - RNA, 16 nt, Bordetella pertussis
ccagcgccacggcggu

SEQ ID NO: 367705 - RNA, 22 nt, Bordetella pertussis
ccagcgccagaaagcgcggccg

SEQ ID NO: 367706 - RNA, 11 nt, Bordetella pertussis
ccagcgccagc

SEQ ID NO: 367707 - RNA, 12 nt, Bordetella pertussis
ccagcgccagca

SEQ ID NO: 367708 - RNA, 13 nt, Bordetella pertussis
ccagcgccagcag

SEQ ID NO: 367709 - RNA, 13 nt, Bordetella pertussis
ccagcgccagccg

SEQ ID NO: 367710 - RNA, 22 nt, Bordetella pertussis
ccagcgccaggaacagcgccgg

SEQ ID NO: 367711 - RNA, 14 nt, Bordetella pertussis
ccagcgccaggccg

SEQ ID NO: 367712 - RNA, 15 nt, Bordetella pertussis
ccagcgccagggccg

SEQ ID NO: 367713 - RNA, 17 nt, Bordetella pertussis
ccagcgccagggccgcc

SEQ ID NO: 367714 - RNA, 18 nt, Bordetella pertussis
ccagcgccagggccgccg

SEQ ID NO: 367715 - RNA, 17 nt, Bordetella pertussis
ccagcgccaguccgcgc

SEQ ID NO: 367716 - RNA, 16 nt, Bordetella pertussis
ccagcgcccaggcgau

SEQ ID NO: 367717 - RNA, 17 nt, Bordetella pertussis
ccagcgccugggcgcgg

SEQ ID NO: 367718 - RNA, 18 nt, Bordetella pertussis
ccagcgccugggcgcgga

SEQ ID NO: 367719 - RNA, 23 nt, Bordetella pertussis
ccagcgccugggguaggcgcggu

SEQ ID NO: 367720 - RNA, 14 nt, Bordetella pertussis
ccagcgccuggacc

SEQ ID NO: 367721 - RNA, 18 nt, Bordetella pertussis
ccagcgcgaaaacccgcg

SEQ ID NO: 367722 - RNA, 18 nt, Bordetella pertussis
ccagcgcgaacgccugcc

SEQ ID NO: 367723 - RNA, 19 nt, Bordetella pertussis
ccagcgcgaacgccugcca

SEQ ID NO: 367724 - RNA, 14 nt, Bordetella pertussis
ccagcgccuggcgg

SEQ ID NO: 367725 - RNA, 13 nt, Bordetella pertussis
ccagcgccugggc

SEQ ID NO: 367726 - RNA, 16 nt, Bordetella pertussis
ccagcgcgacgggcac

SEQ ID NO: 367727 - RNA, 22 nt, Bordetella pertussis
ccagcgcgacgggcaccgacac

SEQ ID NO: 367728 - RNA, 17 nt, Bordetella pertussis
ccagcgcgaucucgcgc

SEQ ID NO: 367729 - RNA, 16 nt, Bordetella pertussis
ccagcgcgauucccug

SEQ ID NO: 367730 - RNA, 20 nt, Bordetella pertussis
ccagcgcgauucccuggcgc

SEQ ID NO: 367731 - RNA, 22 nt, Bordetella pertussis
ccagcgcgauucccuggcgcgc

SEQ ID NO: 367732 - RNA, 13 nt, Bordetella pertussis
ccagcgcgcaacc

SEQ ID NO: 367733 - RNA, 13 nt, Bordetella pertussis
ccagcgcgccagc

SEQ ID NO: 367734 - RNA, 14 nt, Bordetella pertussis
ccagcgcgccagca

SEQ ID NO: 367735 - RNA, 19 nt, Bordetella pertussis
ccagcgcgccauggccggc

SEQ ID NO: 367736 - RNA, 11 nt, Bordetella pertussis
ccagcgcgccc

SEQ ID NO: 367737 - RNA, 14 nt, Bordetella pertussis
ccagcgcgccauac

SEQ ID NO: 367738 - RNA, 10 nt, Bordetella pertussis
ccagcgcggc

SEQ ID NO: 367739 - RNA, 21 nt, Bordetella pertussis
ccagcgcggccacggccugcc

SEQ ID NO: 367740 - RNA, 15 nt, Bordetella pertussis
ccagcgcggccagca

SEQ ID NO: 367741 - RNA, 16 nt, Bordetella pertussis
ccagcgcggccagcac

SEQ ID NO: 367742 - RNA, 23 nt, Bordetella pertussis
ccagcgcggccagcaccggccgc

SEQ ID NO: 367743 - RNA, 16 nt, Bordetella pertussis
ccagcgcggccagcgc

SEQ ID NO: 367744 - RNA, 18 nt, Bordetella pertussis
ccagcgcggccagcgcgu

SEQ ID NO: 367745 - RNA, 14 nt, Bordetella pertussis
ccagcgcggccagg

SEQ ID NO: 367746 - RNA, 23 nt, Bordetella pertussis
ccagcgcggccaggucggcgucg

SEQ ID NO: 367747 - RNA, 12 nt, Bordetella pertussis
ccagcgcggccg

SEQ ID NO: 367748 - RNA, 12 nt, Bordetella pertussis
ccagcgcggcca

SEQ ID NO: 367749 - RNA, 22 nt, Bordetella pertussis
ccagcgcggccgucaccgccgc

SEQ ID NO: 367750 - RNA, 23 nt, Bordetella pertussis
ccagcgcggcggccaugcccagg

SEQ ID NO: 367751 - RNA, 13 nt, Bordetella pertussis
ccagcgcggcggg

SEQ ID NO: 367752 - RNA, 18 nt, Bordetella pertussis
ccagcgcggcggcagcgc

SEQ ID NO: 367753 - RNA, 14 nt, Bordetella pertussis
ccagcgcguccagg

SEQ ID NO: 367754 - RNA, 19 nt, Bordetella pertussis
ccagcgcguccaggugcgg

SEQ ID NO: 367755 - RNA, 17 nt, Bordetella pertussis
ccagcgcgucgagcagc

SEQ ID NO: 367756 - RNA, 20 nt, Bordetella pertussis
ccagcgcgucgagcagcgca

SEQ ID NO: 367757 - RNA, 18 nt, Bordetella pertussis
ccagcgcgucgccgccau

SEQ ID NO: 367758 - RNA, 15 nt, Bordetella pertussis
ccagcgcgucggcca

SEQ ID NO: 367759 - RNA, 19 nt, Bordetella pertussis
ccagcgcgucggccagcgc

SEQ ID NO: 367760 - RNA, 21 nt, Bordetella pertussis
ccagcgcgucggccagcgccg

SEQ ID NO: 367761 - RNA, 23 nt, Bordetella pertussis
ccagcgcgucggccagcgccgcg

SEQ ID NO: 367762 - RNA, 17 nt, Bordetella pertussis
ccagcgcgucggccagg

SEQ ID NO: 367763 - RNA, 20 nt, Bordetella pertussis
ccagcgcgucggccaggcgc

SEQ ID NO: 367764 - RNA, 22 nt, Bordetella pertussis
ccagcgcgucggccaggcgcca

SEQ ID NO: 367765 - RNA, 21 nt, Bordetella pertussis
ccagcgcgucguccagcgugg

SEQ ID NO: 367766 - RNA, 16 nt, Bordetella pertussis
ccagcgcgucggccag

SEQ ID NO: 367767 - RNA, 18 nt, Bordetella pertussis
ccagcgcgugggccagca

SEQ ID NO: 367768 - RNA, 20 nt, Bordetella pertussis
ccagcgcuguccaggccggg

SEQ ID NO: 367769 - RNA, 22 nt, Bordetella pertussis
ccagcgcuguccaggccggggc

SEQ ID NO: 367770 - RNA, 14 nt, Bordetella pertussis
ccagcgcuucgggc

SEQ ID NO: 367771 - RNA, 20 nt, Bordetella pertussis
ccagcgcuucgggcagcucg

SEQ ID NO: 367772 - RNA, 23 nt, Bordetella pertussis
ccagcgcuucgugcagcgcgugg

SEQ ID NO: 367773 - RNA, 20 nt, Bordetella pertussis
ccagcggaaguauucgcgcg

SEQ ID NO: 367774 - RNA, 23 nt, Bordetella pertussis
ccagcggaaguauucgcgcggcg

SEQ ID NO: 367775 - RNA, 18 nt, Bordetella pertussis
ccagcggacgggccaggc

SEQ ID NO: 367776 - RNA, 21 nt, Bordetella pertussis
ccagcggacgggccaggccga

SEQ ID NO: 367777 - RNA, 16 nt, Bordetella pertussis
ccagcggaucgccggg

SEQ ID NO: 367778 - RNA, 14 nt, Bordetella pertussis
ccagcggaugaugc

SEQ ID NO: 367779 - RNA, 22 nt, Bordetella pertussis
ccagcggaugaugcggcgccac

SEQ ID NO: 367780 - RNA, 17 nt, Bordetella pertussis
ccagcggccgucgccuu

SEQ ID NO: 367781 - RNA, 18 nt, Bordetella pertussis
ccagcggcgaaaugucga

SEQ ID NO: 367782 - RNA, 21 nt, Bordetella pertussis
ccagcggcgaaaugucgagcg

SEQ ID NO: 367783 - RNA, 13 nt, Bordetella pertussis
ccagcggcgcacc

SEQ ID NO: 367784 - RNA, 14 nt, Bordetella pertussis
ccagcggcgcagcc

SEQ ID NO: 367785 - RNA, 15 nt, Bordetella pertussis
ccagcggcgcagccg

SEQ ID NO: 367786 - RNA, 16 nt, Bordetella pertussis
ccagcggcgcagccgg

SEQ ID NO: 367787 - RNA, 19 nt, Bordetella pertussis
ccagcggcgcagccggccg

SEQ ID NO: 367788 - RNA, 12 nt, Bordetella pertussis
ccagcggcgcca

SEQ ID NO: 367789 - RNA, 15 nt, Bordetella pertussis
ccagcggcgccagcg

SEQ ID NO: 367790 - RNA, 14 nt, Bordetella pertussis
ccagcggcgcaccg

SEQ ID NO: 367791 - RNA, 14 nt, Bordetella pertussis
ccagcggcgccgac

SEQ ID NO: 367792 - RNA, 23 nt, Bordetella pertussis
ccagcggcgccggaucggccggc

SEQ ID NO: 367793 - RNA, 13 nt, Bordetella pertussis
ccagcggcgcggc

SEQ ID NO: 367794 - RNA, 19 nt, Bordetella pertussis
ccagcggcgcggcgcgcug

SEQ ID NO: 367795 - RNA, 20 nt, Bordetella pertussis
ccagcggcgcggcgcgcugg

SEQ ID NO: 367796 - RNA, 21 nt, Bordetella pertussis
ccagcggcgcuuaccgcgccg

SEQ ID NO: 367797 - RNA, 20 nt, Bordetella pertussis
ccagcggcguauaggccacc

SEQ ID NO: 367798 - RNA, 17 nt, Bordetella pertussis
ccagcguguaggcggcc

SEQ ID NO: 367799 - RNA, 19 nt, Bordetella pertussis
ccagcguguaggcggccgg

SEQ ID NO: 367800 - RNA, 20 nt, Bordetella pertussis
ccagcguguaggcggccggc

SEQ ID NO: 367801 - RNA, 13 nt, Bordetella pertussis
ccagcguucgcgc

SEQ ID NO: 367802 - RNA, 22 nt, Bordetella pertussis
ccagcguucgcgcuugcggccg

SEQ ID NO: 367803 - RNA, 20 nt, Bordetella pertussis
ccagcguucggccacccggc

SEQ ID NO: 367804 - RNA, 17 nt, Bordetella pertussis
ccagcucagcagcgcca

SEQ ID NO: 367805 - RNA, 19 nt, Bordetella pertussis
ccagcucagcagcgccagg

SEQ ID NO: 367806 - RNA, 21 nt, Bordetella pertussis
ccagcucagcagcgccagggc

SEQ ID NO: 367807 - RNA, 23 nt, Bordetella pertussis
ccagcucauggcacagcgcggcg

SEQ ID NO: 367808 - RNA, 15 nt, Bordetella pertussis
ccagcuccaccgggc

SEQ ID NO: 367809 - RNA, 17 nt, Bordetella pertussis
ccagcuccagcgcgccg

SEQ ID NO: 367810 - RNA, 18 nt, Bordetella pertussis
ccagcuccagcgcgccga

SEQ ID NO: 367811 - RNA, 15 nt, Bordetella pertussis
ccagcuccagcuggc

SEQ ID NO: 367812 - RNA, 23 nt, Bordetella pertussis
ccagcuccagcuggcgcaccagg

SEQ ID NO: 367813 - RNA, 13 nt, Bordetella pertussis
ccagcuccagccg

SEQ ID NO: 367814 - RNA, 16 nt, Bordetella pertussis
ccagcuccagccgcag

SEQ ID NO: 367815 - RNA, 15 nt, Bordetella pertussis
ccagcucgacgccau

SEQ ID NO: 367816 - RNA, 20 nt, Bordetella pertussis
ccagcucgacgccaucucgc

SEQ ID NO: 367817 - RNA, 13 nt, Bordetella pertussis
ccagcucgacgcg

SEQ ID NO: 367818 - RNA, 20 nt, Bordetella pertussis
ccagcucgcgcagcaggccg

SEQ ID NO: 367819 - RNA, 16 nt, Bordetella pertussis
ccagcucggcggccgc

SEQ ID NO: 367820 - RNA, 19 nt, Bordetella pertussis
ccagcucggcggccgccug

SEQ ID NO: 367821 - RNA, 20 nt, Bordetella pertussis
ccagcucggcggccgccugc

SEQ ID NO: 367822 - RNA, 20 nt, Bordetella pertussis
ccagcucgguggucaacggc

SEQ ID NO: 367823 - RNA, 14 nt, Bordetella pertussis
ccagcucguccagg

SEQ ID NO: 367824 - RNA, 15 nt, Bordetella pertussis
ccagcucguccaggu

SEQ ID NO: 367825 - RNA, 18 nt, Bordetella pertussis
ccagcucugguccaggcg

SEQ ID NO: 367826 - RNA, 20 nt, Bordetella pertussis
ccagcucugguccaggcggu

SEQ ID NO: 367827 - RNA, 20 nt, Bordetella pertussis
ccagcucuucgagcgcggcg

SEQ ID NO: 367828 - RNA, 24 nt, Bordetella pertussis
ccagcugaccucgcccaggccggg

SEQ ID NO: 367829 - RNA, 11 nt, Bordetella pertussis
ccagcugcagu

SEQ ID NO: 367830 - RNA, 20 nt, Bordetella pertussis
ccagcugcaguaugcaaccg

SEQ ID NO: 367831 - RNA, 16 nt, Bordetella pertussis
ccagcugcaugcgcac

SEQ ID NO: 367832 - RNA, 22 nt, Bordetella pertussis
ccagcugcaugcgcacggacag

SEQ ID NO: 367833 - RNA, 13 nt, Bordetella pertussis
ccagcugcgcgcg

SEQ ID NO: 367834 - RNA, 23 nt, Bordetella pertussis
ccagcugcguggcgacgcgcugc

SEQ ID NO: 367835 - RNA, 22 nt, Bordetella pertussis
ccagcugcuucaugcgcuccug

SEQ ID NO: 367836 - RNA, 13 nt, Bordetella pertussis
ccagcuggcgcac

SEQ ID NO: 367837 - RNA, 15 nt, Bordetella pertussis
ccagcuggcgcacca

SEQ ID NO: 367838 - RNA, 20 nt, Bordetella pertussis
ccagcuggcgcaccaggcug

SEQ ID NO: 367839 - RNA, 12 nt, Bordetella pertussis
ccagcuggcgcc

SEQ ID NO: 367840 - RNA, 23 nt, Bordetella pertussis
ccagcuggcgcguggccgccacg

SEQ ID NO: 367841 - RNA, 17 nt, Bordetella pertussis
ccagcuggcggcgcagc

SEQ ID NO: 367842 - RNA, 18 nt, Bordetella pertussis
ccagcuggcggcgcagca

SEQ ID NO: 367843 - RNA, 21 nt, Bordetella pertussis
ccagcuggcggcgcagcacca

SEQ ID NO: 367844 - RNA, 18 nt, Bordetella pertussis
ccagcugggccacagggc

SEQ ID NO: 367845 - RNA, 13 nt, Bordetella pertussis
ccagcugggcggc

SEQ ID NO: 367846 - RNA, 19 nt, Bordetella pertussis
ccagcugggcggcgugacc

SEQ ID NO: 367847 - RNA, 14 nt, Bordetella pertussis
ccagcuucgggccc

SEQ ID NO: 367848 - RNA, 15 nt, Bordetella pertussis
ccagcuucugcgccu

SEQ ID NO: 367849 - RNA, 21 nt, Bordetella pertussis
ccagcuucugcgccugcuggu

SEQ ID NO: 367850 - RNA, 17 nt, Bordetella pertussis
ccagcuugaccgccagc

SEQ ID NO: 367851 - RNA, 17 nt, Bordetella pertussis
ccagcuugaugccgccg

SEQ ID NO: 367852 - RNA, 15 nt, Bordetella pertussis
ccagcuugccgcuca

SEQ ID NO: 367853 - RNA, 15 nt, Bordetella pertussis
ccagcuugcgcgccu

SEQ ID NO: 367854 - RNA, 17 nt, Bordetella pertussis
ccagcuuggccaggcug

SEQ ID NO: 367855 - RNA, 17 nt, Bordetella pertussis
ccagcuuggugcucagu

SEQ ID NO: 367856 - RNA, 16 nt, Bordetella pertussis
ccagcuugucggccgc

SEQ ID NO: 367857 - RNA, 18 nt, Bordetella pertussis
ccagcuugucggccgcgc

SEQ ID NO: 367858 - RNA, 21 nt, Bordetella pertussis
ccagcuugucggccgcgcgca

SEQ ID NO: 367859 - RNA, 18 nt, Bordetella pertussis
ccaggaaaaccggcgccu

SEQ ID NO: 367860 - RNA, 22 nt, Bordetella pertussis
ccaggaaaagccgccuucgggc

SEQ ID NO: 367861 - RNA, 16 nt, Bordetella pertussis
ccaggaaaccggcgac

SEQ ID NO: 367862 - RNA, 18 nt, Bordetella pertussis
ccaggaaagaggccaggc

SEQ ID NO: 367863 - RNA, 21 nt, Bordetella pertussis
ccaggaaagaggccaggcccu

SEQ ID NO: 367864 - RNA, 15 nt, Bordetella pertussis
ccaggaaagcgccgc

SEQ ID NO: 367865 - RNA, 16 nt, Bordetella pertussis
ccaggaaagcgccgcc

SEQ ID NO: 367866 - RNA, 17 nt, Bordetella pertussis
ccaggaaagcgccgccg

SEQ ID NO: 367867 - RNA, 21 nt, Bordetella pertussis
ccaggaaagcgccgccgccgg

SEQ ID NO: 367868 - RNA, 22 nt, Bordetella pertussis
ccaggaaagcgccgccgccggu

SEQ ID NO: 367869 - RNA, 18 nt, Bordetella pertussis
ccaggaacagcgccggca

SEQ ID NO: 367870 - RNA, 18 nt, Bordetella pertussis
ccaggaagagcuggcgcu

SEQ ID NO: 367871 - RNA, 22 nt, Bordetella pertussis
ccaggaagagcuggcgcugcuc

SEQ ID NO: 367872 - RNA, 16 nt, Bordetella pertussis
ccaggaacuccaggaa

SEQ ID NO: 367873 - RNA, 22 nt, Bordetella pertussis
ccaggaagaucggcccggcgcc

SEQ ID NO: 367874 - RNA, 15 nt, Bordetella pertussis
ccaggaagcgcgccu

SEQ ID NO: 367875 - RNA, 17 nt, Bordetella pertussis
ccaggaagcgcgccugc

SEQ ID NO: 367876 - RNA, 17 nt, Bordetella pertussis
ccaggaagcggcgcacc

SEQ ID NO: 367877 - RNA, 16 nt, Bordetella pertussis
ccaggaagcagcccag

SEQ ID NO: 367878 - RNA, 19 nt, Bordetella pertussis
ccaggaagcagcccagcac

SEQ ID NO: 367879 - RNA, 17 nt, Bordetella pertussis
ccaggaaguugcccacc

SEQ ID NO: 367880 - RNA, 20 nt, Bordetella pertussis
ccaggacgcgaagaucccgc

SEQ ID NO: 367881 - RNA, 13 nt, Bordetella pertussis
ccaggaucgcggc

SEQ ID NO: 367882 - RNA, 17 nt, Bordetella pertussis
ccaggaucgcggccagc

SEQ ID NO: 367883 - RNA, 17 nt, Bordetella pertussis
ccagggccaccacgccg

SEQ ID NO: 367884 - RNA, 13 nt, Bordetella pertussis
ccagggccagcuu

SEQ ID NO: 367885 - RNA, 20 nt, Bordetella pertussis
ccagggccccuccggcgccg

SEQ ID NO: 367886 - RNA, 16 nt, Bordetella pertussis
ccagggccacgccggc

SEQ ID NO: 367887 - RNA, 15 nt, Bordetella pertussis
ccagggccgccagca

SEQ ID NO: 367888 - RNA, 19 nt, Bordetella pertussis
ccagggccgccgcgcccag

SEQ ID NO: 367889 - RNA, 14 nt, Bordetella pertussis
ccagggccgcgccg

SEQ ID NO: 367890 - RNA, 17 nt, Bordetella pertussis
ccagggccugcgggccg

SEQ ID NO: 367891 - RNA, 21 nt, Bordetella pertussis
ccagggccugcgggccgggca

SEQ ID NO: 367892 - RNA, 16 nt, Bordetella pertussis
ccagggccucgcgggc

SEQ ID NO: 367893 - RNA, 12 nt, Bordetella pertussis
ccagggcgcgca

SEQ ID NO: 367894 - RNA, 15 nt, Bordetella pertussis
ccagggcgcgcagca

SEQ ID NO: 367895 - RNA, 14 nt, Bordetella pertussis
ccagggcgcgccgc

SEQ ID NO: 367896 - RNA, 21 nt, Bordetella pertussis
ccagggcgcgccgcagcgugg

SEQ ID NO: 367897 - RNA, 15 nt, Bordetella pertussis
ccagggcgcgccgga

SEQ ID NO: 367898 - RNA, 23 nt, Bordetella pertussis
ccagggcggugggcagcgcgucg

SEQ ID NO: 367899 - RNA, 15 nt, Bordetella pertussis
ccagggcgucggcga

SEQ ID NO: 367900 - RNA, 17 nt, Bordetella pertussis
ccagggcuugacgcgcg

SEQ ID NO: 367901 - RNA, 19 nt, Bordetella pertussis
ccagggcuugcggcgcugg

SEQ ID NO: 367902 - RNA, 14 nt, Bordetella pertussis
ccaggggacggcgc

SEQ ID NO: 367903 - RNA, 22 nt, Bordetella pertussis
ccaggggacggcgcacccgcgg

SEQ ID NO: 367904 - RNA, 13 nt, Bordetella pertussis
ccaggggccggcg

SEQ ID NO: 367905 - RNA, 18 nt, Bordetella pertussis
ccaggggccggcgcgccg

SEQ ID NO: 367906 - RNA, 14 nt, Bordetella pertussis
ccagggucugcugg

SEQ ID NO: 367907 - RNA, 22 nt, Bordetella pertussis
ccagggugaccuggcgcgcgaa

SEQ ID NO: 367908 - RNA, 13 nt, Bordetella pertussis
ccagggugccgcc

SEQ ID NO: 367909 - RNA, 14 nt, Bordetella pertussis
ccaggguggcgccg

SEQ ID NO: 367910 - RNA, 15 nt, Bordetella pertussis
ccaggguggcgccgg

SEQ ID NO: 367911 - RNA, 17 nt, Bordetella pertussis
ccaggguggcguccugg

SEQ ID NO: 367912 - RNA, 15 nt, Bordetella pertussis
ccagguaggccggcg

SEQ ID NO: 367913 - RNA, 21 nt, Bordetella pertussis
ccagguaggccggcgcgaccg

SEQ ID NO: 367914 - RNA, 19 nt, Bordetella pertussis
ccagguaggcggcgcgccc

SEQ ID NO: 367915 - RNA, 20 nt, Bordetella pertussis
ccagguaggcggcgcgcccg

SEQ ID NO: 367916 - RNA, 21 nt, Bordetella pertussis
ccagguaggcggcgcgcccgc

SEQ ID NO: 367917 - RNA, 16 nt, Bordetella pertussis
ccagguauucggcggu

SEQ ID NO: 367918 - RNA, 16 nt, Bordetella pertussis
ccaggucaucgccagg

SEQ ID NO: 367919 - RNA, 17 nt, Bordetella pertussis
ccaggucaucgccaggc

SEQ ID NO: 367920 - RNA, 19 nt, Bordetella pertussis
ccagguccacgaugcccau

SEQ ID NO: 367921 - RNA, 16 nt, Bordetella pertussis
ccagguccagcgccac

SEQ ID NO: 367922 - RNA, 19 nt, Bordetella pertussis
ccagguccagcgccacggc

SEQ ID NO: 367923 - RNA, 14 nt, Bordetella pertussis
ccagguccgccggc

SEQ ID NO: 367924 - RNA, 15 nt, Bordetella pertussis
ccagguccgccggca

SEQ ID NO: 367925 - RNA, 16 nt, Bordetella pertussis
ccagguccgccggcac

SEQ ID NO: 367926 - RNA, 19 nt, Bordetella pertussis
ccagguccgaaccgaccgc

SEQ ID NO: 367927 - RNA, 23 nt, Bordetella pertussis
ccagguccgaaccgaccgccacg

SEQ ID NO: 367928 - RNA, 19 nt, Bordetella pertussis
ccagguccguguucgacgc

SEQ ID NO: 367929 - RNA, 22 nt, Bordetella pertussis
ccagguccguguucgacgcggc

SEQ ID NO: 367930 - RNA, 23 nt, Bordetella pertussis
ccaggucggcggccagcgcgcaa

SEQ ID NO: 367931 - RNA, 17 nt, Bordetella pertussis
ccaggucggcgucgucg

SEQ ID NO: 367932 - RNA, 22 nt, Bordetella pertussis
ccaggucgggcacgaucaccgc

SEQ ID NO: 367933 - RNA, 17 nt, Bordetella pertussis
ccaggucguugcgcgaa

SEQ ID NO: 367934 - RNA, 15 nt, Bordetella pertussis
ccagguucuggucga

SEQ ID NO: 367935 - RNA, 17 nt, Bordetella pertussis
ccagguugaaggccgcg

SEQ ID NO: 367936 - RNA, 15 nt, Bordetella pertussis
ccagguugcauccgg

SEQ ID NO: 367937 - RNA, 20 nt, Bordetella pertussis
ccagguugagucuggagaug

SEQ ID NO: 367938 - RNA, 14 nt, Bordetella pertussis
ccagguugcggccg

SEQ ID NO: 367939 - RNA, 17 nt, Bordetella pertussis
ccagguugggugcgccg

SEQ ID NO: 367940 - RNA, 20 nt, Bordetella pertussis
ccagguugggugcgccgccg

SEQ ID NO: 367941 - RNA, 17 nt, Bordetella pertussis
ccagguugucggcgcca

SEQ ID NO: 367942 - RNA, 17 nt, Bordetella pertussis
ccagguuuuccacagcc

SEQ ID NO: 367943 - RNA, 18 nt, Bordetella pertussis
ccaguccccguggggacg

SEQ ID NO: 367944 - RNA, 20 nt, Bordetella pertussis
ccaguccccguucggggaca

SEQ ID NO: 367945 - RNA, 18 nt, Bordetella pertussis
ccagucccgcaccgggca

SEQ ID NO: 367946 - RNA, 17 nt, Bordetella pertussis
ccaguccgcagcgcagc

SEQ ID NO: 367947 - RNA, 20 nt, Bordetella pertussis
ccagucgacccaccuggcca

SEQ ID NO: 367948 - RNA, 21 nt, Bordetella pertussis
ccagucgaugcaaccgucggu

SEQ ID NO: 367949 - RNA, 17 nt, Bordetella pertussis
ccagucgccgcgcccgc

SEQ ID NO: 367950 - RNA, 14 nt, Bordetella pertussis
ccagucgccgcggu

SEQ ID NO: 367951 - RNA, 15 nt, Bordetella pertussis
ccagucgcggugcau

SEQ ID NO: 367952 - RNA, 21 nt, Bordetella pertussis
ccagucguccagcacgcggcg

SEQ ID NO: 367953 - RNA, 20 nt, Bordetella pertussis
ccagugaaacgcgacgcgcc

SEQ ID NO: 367954 - RNA, 21 nt, Bordetella pertussis
ccagugaaacgcgacgcgccg

SEQ ID NO: 367955 - RNA, 14 nt, Bordetella pertussis
ccaguggcgcggcg

SEQ ID NO: 367956 - RNA, 23 nt, Bordetella pertussis
ccaguugaaucggcgcgagcgug

SEQ ID NO: 367957 - RNA, 16 nt, Bordetella pertussis
ccaguugccgccgccg

SEQ ID NO: 367958 - RNA, 14 nt, Bordetella pertussis
ccaguugcgcgccg

SEQ ID NO: 367959 - RNA, 20 nt, Bordetella pertussis
ccaguugcgcgccgucggcg

SEQ ID NO: 367960 - RNA, 17 nt, Bordetella pertussis
ccaguugcgggccucga

SEQ ID NO: 367961 - RNA, 20 nt, Bordetella pertussis
ccaguugcggggcgcccagc

SEQ ID NO: 367962 - RNA, 16 nt, Bordetella pertussis
ccauaccagcccggcg

SEQ ID NO: 367963 - RNA, 23 nt, Bordetella pertussis
ccaucaggccgaugcguccgccg

SEQ ID NO: 367964 - RNA, 20 nt, Bordetella pertussis
ccaucaggugaaacagcagc

SEQ ID NO: 367965 - RNA, 20 nt, Bordetella pertussis
ccaucaucaacuucaucguc

SEQ ID NO: 367966 - RNA, 15 nt, Bordetella pertussis
ccaucaucagcaugg

SEQ ID NO: 367967 - RNA, 13 nt, Bordetella pertussis
ccauccagccagg

SEQ ID NO: 367968 - RNA, 22 nt, Bordetella pertussis
ccauccagcggacgggccaggc

SEQ ID NO: 367969 - RNA, 12 nt, Bordetella pertussis
ccauccggccgc

SEQ ID NO: 367970 - RNA, 22 nt, Bordetella pertussis
ccauccggccgcacgcggccgc

SEQ ID NO: 367971 - RNA, 19 nt, Bordetella pertussis
ccauccguccgccaggacg

SEQ ID NO: 367972 - RNA, 17 nt, Bordetella pertussis
ccauccugaacgccgcg

SEQ ID NO: 367973 - RNA, 18 nt, Bordetella pertussis
ccauccugaacgccgcgc

SEQ ID NO: 367974 - RNA, 12 nt, Bordetella pertussis
ccauccuggccg

SEQ ID NO: 367975 - RNA, 17 nt, Bordetella pertussis
ccauccuggccgccgcg

SEQ ID NO: 367976 - RNA, 22 nt, Bordetella pertussis
ccauccuggccgccgcgggcgc

SEQ ID NO: 367977 - RNA, 15 nt, Bordetella pertussis
ccauccugccccagg

SEQ ID NO: 367978 - RNA, 21 nt, Bordetella pertussis
ccaucgacgcuugccggcgau

SEQ ID NO: 367979 - RNA, 17 nt, Bordetella pertussis
ccaucgacgggcggcug

SEQ ID NO: 367980 - RNA, 22 nt, Bordetella pertussis
ccaucgccgccacgugcacgau

SEQ ID NO: 367981 - RNA, 17 nt, Bordetella pertussis
ccaucgcguccaggccc

SEQ ID NO: 367982 - RNA, 18 nt, Bordetella pertussis
ccaucgcguccaggccca

SEQ ID NO: 367983 - RNA, 15 nt, Bordetella pertussis
ccaucgcgucgacgg

SEQ ID NO: 367984 - RNA, 16 nt, Bordetella pertussis
ccaucgcgucgacggu

SEQ ID NO: 367985 - RNA, 20 nt, Bordetella pertussis
ccaucgcugguaugcacgau

SEQ ID NO: 367986 - RNA, 17 nt, Bordetella pertussis
ccaucugguugagcagc

SEQ ID NO: 367987 - RNA, 22 nt, Bordetella pertussis
ccaucuguacggccggcuccgc

SEQ ID NO: 367988 - RNA, 16 nt, Bordetella pertussis
ccaucuuggugcgcgc

SEQ ID NO: 367989 - RNA, 18 nt, Bordetella pertussis
ccaucuuggugcgcgcca

SEQ ID NO: 367990 - RNA, 18 nt, Bordetella pertussis
ccaucuugccggccuguu

SEQ ID NO: 367991 - RNA, 14 nt, Bordetella pertussis
ccaugaacgccgcg

SEQ ID NO: 367992 - RNA, 18 nt, Bordetella pertussis
ccaugaacgccgcgcccg

SEQ ID NO: 367993 - RNA, 19 nt, Bordetella pertussis
ccaugaacgccgcgcccgc

SEQ ID NO: 367994 - RNA, 22 nt, Bordetella pertussis
ccaugaacgcuugacggccagg

SEQ ID NO: 367995 - RNA, 21 nt, Bordetella pertussis
ccaugaaagcgaacagggcgc

SEQ ID NO: 367996 - RNA, 20 nt, Bordetella pertussis
ccaugaacaggcacgacgcg

SEQ ID NO: 367997 - RNA, 15 nt, Bordetella pertussis
ccaugaccaugccgg

SEQ ID NO: 367998 - RNA, 20 nt, Bordetella pertussis
ccaugacgaccuugcggccg

SEQ ID NO: 367999 - RNA, 22 nt, Bordetella pertussis
ccaugacgaccuugcggccgcg

SEQ ID NO: 368000 - RNA, 12 nt, Bordetella pertussis
ccaugacgccgg

SEQ ID NO: 368001 - RNA, 21 nt, Bordetella pertussis
ccaugacggccauccggccac

SEQ ID NO: 368002 - RNA, 21 nt, Bordetella pertussis
ccaugacguccagcgccacca

SEQ ID NO: 368003 - RNA, 19 nt, Bordetella pertussis
ccaugaggaacggcaccag

SEQ ID NO: 368004 - RNA, 21 nt, Bordetella pertussis
ccaugaggaacggcaccagcc

SEQ ID NO: 368005 - RNA, 23 nt, Bordetella pertussis
ccaugaucucgggcgaggucagc

SEQ ID NO: 368006 - RNA, 15 nt, Bordetella pertussis
ccaugauggccgcgc

SEQ ID NO: 368007 - RNA, 19 nt, Bordetella pertussis
ccaugauggccgcgcgcag

SEQ ID NO: 368008 - RNA, 17 nt, Bordetella pertussis
ccaugaugucgcgcgcc

SEQ ID NO: 368009 - RNA, 18 nt, Bordetella pertussis
ccaugaugucgcgcgccu

SEQ ID NO: 368010 - RNA, 18 nt, Bordetella pertussis
ccaugauuccaccuugcc

SEQ ID NO: 368011 - RNA, 17 nt, Bordetella pertussis
ccaugcaacacgaccag

SEQ ID NO: 368012 - RNA, 20 nt, Bordetella pertussis
ccaugcaacacgaccagcag

SEQ ID NO: 368013 - RNA, 13 nt, Bordetella pertussis
ccaugcaccagca

SEQ ID NO: 368014 - RNA, 18 nt, Bordetella pertussis
ccaugccgaugccgcagu

SEQ ID NO: 368015 - RNA, 16 nt, Bordetella pertussis
ccaugccgauggcggu

SEQ ID NO: 368016 - RNA, 14 nt, Bordetella pertussis
ccaugccgcccaug

SEQ ID NO: 368017 - RNA, 17 nt, Bordetella pertussis
ccaugccgcccaugccg

SEQ ID NO: 368018 - RNA, 22 nt, Bordetella pertussis
ccaugccgcccaugccgccggg

SEQ ID NO: 368019 - RNA, 13 nt, Bordetella pertussis
ccaugccgcccgc

SEQ ID NO: 368020 - RNA, 15 nt, Bordetella pertussis
ccaugccgccgggca

SEQ ID NO: 368021 - RNA, 15 nt, Bordetella pertussis
ccaugccgcgcccgc

SEQ ID NO: 368022 - RNA, 13 nt, Bordetella pertussis
ccaugccgcgcgc

SEQ ID NO: 368023 - RNA, 15 nt, Bordetella pertussis
ccaugccggaacagg

SEQ ID NO: 368024 - RNA, 21 nt, Bordetella pertussis
ccaugccggccaugcucagca

SEQ ID NO: 368025 - RNA, 15 nt, Bordetella pertussis
ccaugcugccaaccg

SEQ ID NO: 368026 - RNA, 22 nt, Bordetella pertussis
ccaugcugccaaccgcgacgca

SEQ ID NO: 368027 - RNA, 17 nt, Bordetella pertussis
ccaugcuggccgccgcg

SEQ ID NO: 368028 - RNA, 16 nt, Bordetella pertussis
ccauggacagcaccga

SEQ ID NO: 368029 - RNA, 13 nt, Bordetella pertussis
ccauggacgccgg

SEQ ID NO: 368030 - RNA, 21 nt, Bordetella pertussis
ccauggcaccgauacgcugga

SEQ ID NO: 368031 - RNA, 15 nt, Bordetella pertussis
ccauggaggcgcagc

SEQ ID NO: 368032 - RNA, 18 nt, Bordetella pertussis
ccauggcagggcgccgcg

SEQ ID NO: 368033 - RNA, 18 nt, Bordetella pertussis
ccauggccggccgccggg

SEQ ID NO: 368034 - RNA, 18 nt, Bordetella pertussis
ccauggcgcccacggccg

SEQ ID NO: 368035 - RNA, 23 nt, Bordetella pertussis
ccauucccgcccugacgccugcg

SEQ ID NO: 368036 - RNA, 16 nt, Bordetella pertussis
ccauuccggcuggucg

SEQ ID NO: 368037 - RNA, 17 nt, Bordetella pertussis
ccauuccggcuggucgg

SEQ ID NO: 368038 - RNA, 15 nt, Bordetella pertussis
ccauucgauggcggc

SEQ ID NO: 368039 - RNA, 23 nt, Bordetella pertussis
ccauucggccacuuucgcgcgcg

SEQ ID NO: 368040 - RNA, 16 nt, Bordetella pertussis
ccauugaaagcgcgag

SEQ ID NO: 368041 - RNA, 22 nt, Bordetella pertussis
ccauugcagggugucggccagg

SEQ ID NO: 368042 - RNA, 16 nt, Bordetella pertussis
ccauugccggcgcgca

SEQ ID NO: 368043 - RNA, 13 nt, Bordetella pertussis
cccaccagggcca

SEQ ID NO: 368044 - RNA, 14 nt, Bordetella pertussis
cccacccccagcag

SEQ ID NO: 368045 - RNA, 19 nt, Bordetella pertussis
cccacccggcacgcgccga

SEQ ID NO: 368046 - RNA, 16 nt, Bordetella pertussis
cccaccgagacgcugu

SEQ ID NO: 368047 - RNA, 16 nt, Bordetella pertussis
cccaccgggacaggca

SEQ ID NO: 368048 - RNA, 16 nt, Bordetella pertussis
cccaccgggccggccu

SEQ ID NO: 368049 - RNA, 16 nt, Bordetella pertussis
cccaccuugcgcgcga

SEQ ID NO: 368050 - RNA, 18 nt, Bordetella pertussis
cccaccuugcgcgcgaac

SEQ ID NO: 368051 - RNA, 12 nt, Bordetella pertussis
cccacgaccugc

SEQ ID NO: 368052 - RNA, 18 nt, Bordetella pertussis
cccacgaccugcaacccc

SEQ ID NO: 368053 - RNA, 22 nt, Bordetella pertussis
cccacgcacaugaugcccagcg

SEQ ID NO: 368054 - RNA, 20 nt, Bordetella pertussis
cccacgccauggacgccgaa

SEQ ID NO: 368055 - RNA, 13 nt, Bordetella pertussis
cccacgccgccgu

SEQ ID NO: 368056 - RNA, 15 nt, Bordetella pertussis
cccacgccgccuggc

SEQ ID NO: 368057 - RNA, 13 nt, Bordetella pertussis
cccacgcgccgcc

SEQ ID NO: 368058 - RNA, 20 nt, Bordetella pertussis
cccacgcucuggagccacca

SEQ ID NO: 368059 - RNA, 12 nt, Bordetella pertussis
cccacggccagc

SEQ ID NO: 368060 - RNA, 22 nt, Bordetella pertussis
cccacggcgacuuccagcagau

SEQ ID NO: 368061 - RNA, 15 nt, Bordetella pertussis
cccacggcgauggcc

SEQ ID NO: 368062 - RNA, 16 nt, Bordetella pertussis
cccacggcguggcgcg

SEQ ID NO: 368063 - RNA, 21 nt, Bordetella pertussis
cccacggcguggcgcgcccgc

SEQ ID NO: 368064 - RNA, 17 nt, Bordetella pertussis
cccagaccugcgcgccg

SEQ ID NO: 368065 - RNA, 20 nt, Bordetella pertussis
cccagaccugcgcgccggca

SEQ ID NO: 368066 - RNA, 18 nt, Bordetella pertussis
cccagauccgcaaguucg

SEQ ID NO: 368067 - RNA, 14 nt, Bordetella pertussis
cccagauggcgccu

SEQ ID NO: 368068 - RNA, 19 nt, Bordetella pertussis
cccagcaagccgaucaacc

SEQ ID NO: 368069 - RNA, 19 nt, Bordetella pertussis
cccagcaaggguucgggca

SEQ ID NO: 368070 - RNA, 24 nt, Bordetella pertussis
cccagcaauuaugcguggccgccg

SEQ ID NO: 368071 - RNA, 16 nt, Bordetella pertussis
cccagcaccacgggcu

SEQ ID NO: 368072 - RNA, 13 nt, Bordetella pertussis
cccagcaccgcca

SEQ ID NO: 368073 - RNA, 16 nt, Bordetella pertussis
cccagcacgacgaaga

SEQ ID NO: 368074 - RNA, 13 nt, Bordetella pertussis
cccagcacgcgcg

SEQ ID NO: 368075 - RNA, 21 nt, Bordetella pertussis
cccagcaccugcaggccgccg

SEQ ID NO: 368076 - RNA, 12 nt, Bordetella pertussis
cccagcagcagc

SEQ ID NO: 368077 - RNA, 13 nt, Bordetella pertussis
cccagcagcagcg

SEQ ID NO: 368078 - RNA, 13 nt, Bordetella pertussis
cccagcagcaugg

SEQ ID NO: 368079 - RNA, 13 nt, Bordetella pertussis
cccagcagcgccg

SEQ ID NO: 368080 - RNA, 16 nt, Bordetella pertussis
cccagcagcggcagca

SEQ ID NO: 368081 - RNA, 13 nt, Bordetella pertussis
cccagcagcggca

SEQ ID NO: 368082 - RNA, 22 nt, Bordetella pertussis
cccagcgcgaugucgcccaugc

SEQ ID NO: 368083 - RNA, 12 nt, Bordetella pertussis
cccagcgcgccu

SEQ ID NO: 368084 - RNA, 17 nt, Bordetella pertussis
cccagcgcgucggccag

SEQ ID NO: 368085 - RNA, 19 nt, Bordetella pertussis
cccagcgcgucggccagcg

SEQ ID NO: 368086 - RNA, 17 nt, Bordetella pertussis
cccagcgcucguccacg

SEQ ID NO: 368087 - RNA, 18 nt, Bordetella pertussis
cccagcgcuugcacgcca

SEQ ID NO: 368088 - RNA, 23 nt, Bordetella pertussis
cccagcgcuugcacgccauagcg

SEQ ID NO: 368089 - RNA, 20 nt, Bordetella pertussis
cccagcggcaggcuggccgg

SEQ ID NO: 368090 - RNA, 15 nt, Bordetella pertussis
cccagcggcgcaccg

SEQ ID NO: 368091 - RNA, 13 nt, Bordetella pertussis
cccagcggcgccg

SEQ ID NO: 368092 - RNA, 20 nt, Bordetella pertussis
cccagcggggacaggcacac

SEQ ID NO: 368093 - RNA, 17 nt, Bordetella pertussis
cccagcguccaggcggc

SEQ ID NO: 368094 - RNA, 22 nt, Bordetella pertussis
cccagcguccaggcggccaucg

SEQ ID NO: 368095 - RNA, 17 nt, Bordetella pertussis
cccagcggcuggccacu

SEQ ID NO: 368096 - RNA, 22 nt, Bordetella pertussis
cccagcggcuggccacuggccg

SEQ ID NO: 368097 - RNA, 23 nt, Bordetella pertussis
cccagcguucgcgcuugcggccg

SEQ ID NO: 368098 - RNA, 11 nt, Bordetella pertussis
cccaggaugcc

SEQ ID NO: 368099 - RNA, 14 nt, Bordetella pertussis
cccaggaugcgcac

SEQ ID NO: 368100 - RNA, 15 nt, Bordetella pertussis
cccaggcccagcauc

SEQ ID NO: 368101 - RNA, 12 nt, Bordetella pertussis
cccaggcccggc

SEQ ID NO: 368102 - RNA, 17 nt, Bordetella pertussis
cccaggccgaagccacc

SEQ ID NO: 368103 - RNA, 19 nt, Bordetella pertussis
cccaggccgaagccaccgu

SEQ ID NO: 368104 - RNA, 16 nt, Bordetella pertussis
cccaggccgaucagcg

SEQ ID NO: 368105 - RNA, 12 nt, Bordetella pertussis
cccaggccgccg

SEQ ID NO: 368106 - RNA, 16 nt, Bordetella pertussis
cccaggccgccggcgg

SEQ ID NO: 368107 - RNA, 19 nt, Bordetella pertussis
cccagguugaaggccgcga

SEQ ID NO: 368108 - RNA, 15 nt, Bordetella pertussis
cccagguugcggccg

SEQ ID NO: 368109 - RNA, 16 nt, Bordetella pertussis
cccagguugcggccgc

SEQ ID NO: 368110 - RNA, 18 nt, Bordetella pertussis
cccagguugcggccgcca

SEQ ID NO: 368111 - RNA, 16 nt, Bordetella pertussis
cccaguccaggccggc

SEQ ID NO: 368112 - RNA, 13 nt, Bordetella pertussis
cccagucgccgcg

SEQ ID NO: 368113 - RNA, 18 nt, Bordetella pertussis
cccagucguccagcacgc

SEQ ID NO: 368114 - RNA, 22 nt, Bordetella pertussis
cccagucguccagcacgcggcg

SEQ ID NO: 368115 - RNA, 23 nt, Bordetella pertussis
cccagucguccagcacgcggcgc

SEQ ID NO: 368116 - RNA, 14 nt, Bordetella pertussis
cccauaugccgccg

SEQ ID NO: 368117 - RNA, 22 nt, Bordetella pertussis
cccauccagcggacgggccagg

SEQ ID NO: 368118 - RNA, 15 nt, Bordetella pertussis
cccauugcgcggcca

SEQ ID NO: 368119 - RNA, 23 nt, Bordetella pertussis
cccauugcgggugggcauccagc

SEQ ID NO: 368120 - RNA, 14 nt, Bordetella pertussis
ccccaacgcggcca

SEQ ID NO: 368121 - RNA, 15 nt, Bordetella pertussis
ccccacgccgaugcc

SEQ ID NO: 368122 - RNA, 22 nt, Bordetella pertussis
ccccacguggacaggcaccugc

SEQ ID NO: 368123 - RNA, 13 nt, Bordetella pertussis
ccccagacgcaga

SEQ ID NO: 368124 - RNA, 21 nt, Bordetella pertussis
ccccagagcaccgagaccggg

SEQ ID NO: 368125 - RNA, 13 nt, Bordetella pertussis
ccccagcacgaag

SEQ ID NO: 368126 - RNA, 22 nt, Bordetella pertussis
ccccagcaugugcgcggcguug

SEQ ID NO: 368127 - RNA, 16 nt, Bordetella pertussis
ccccagcguccaggcg

SEQ ID NO: 368128 - RNA, 22 nt, Bordetella pertussis
ccccagcuugucggccgcgcgc

SEQ ID NO: 368129 - RNA, 13 nt, Bordetella pertussis
ccccaggcaggcg

SEQ ID NO: 368130 - RNA, 14 nt, Bordetella pertussis
ccccaggcguacga

SEQ ID NO: 368131 - RNA, 16 nt, Bordetella pertussis
ccccagggcgcgccgg

SEQ ID NO: 368132 - RNA, 17 nt, Bordetella pertussis
ccccaggggacggcgca

SEQ ID NO: 368133 - RNA, 15 nt, Bordetella pertussis
ccccagguagaccac

SEQ ID NO: 368134 - RNA, 17 nt, Bordetella pertussis
ccccagguccgccggca

SEQ ID NO: 368135 - RNA, 20 nt, Bordetella pertussis
ccccagguccgccggcacgc

SEQ ID NO: 368136 - RNA, 21 nt, Bordetella pertussis
ccccaguugcgcguccaggcg

SEQ ID NO: 368137 - RNA, 22 nt, Bordetella pertussis
ccccauaguccucuacuggcug

SEQ ID NO: 368138 - RNA, 20 nt, Bordetella pertussis
ccccaugccggaacaggcgc

SEQ ID NO: 368139 - RNA, 14 nt, Bordetella pertussis
ccccaugcgcggca

SEQ ID NO: 368140 - RNA, 20 nt, Bordetella pertussis
ccccaugcggggacaggcac

SEQ ID NO: 368141 - RNA, 14 nt, Bordetella pertussis
cccccagggcgcgc

SEQ ID NO: 368142 - RNA, 13 nt, Bordetella pertussis
ccccccggcgcgg

SEQ ID NO: 368143 - RNA, 18 nt, Bordetella pertussis
cccccgccgcacgggcgc

SEQ ID NO: 368144 - RNA, 21 nt, Bordetella pertussis
cccccgcgguggggcaguuga

SEQ ID NO: 368145 - RNA, 23 nt, Bordetella pertussis
cccccgcgucggacgcgcgccgc

SEQ ID NO: 368146 - RNA, 13 nt, Bordetella pertussis
cccccgcggggac

SEQ ID NO: 368147 - RNA, 16 nt, Bordetella pertussis
cccccgggcgcaagcg

SEQ ID NO: 368148 - RNA, 20 nt, Bordetella pertussis
cccccugcggggacaggcac

SEQ ID NO: 368149 - RNA, 19 nt, Bordetella pertussis
cccccguaggcggcccagg

SEQ ID NO: 368150 - RNA, 17 nt, Bordetella pertussis
ccccgaaggggacuggc

SEQ ID NO: 368151 - RNA, 21 nt, Bordetella pertussis
ccccgaggccaccuuggccaa

SEQ ID NO: 368152 - RNA, 14 nt, Bordetella pertussis
ccccgagggcgcgg

SEQ ID NO: 368153 - RNA, 21 nt, Bordetella pertussis
ccccgauacaaggugccuguc

SEQ ID NO: 368154 - RNA, 19 nt, Bordetella pertussis
ccccgauccgcgggcgggc

SEQ ID NO: 368155 - RNA, 13 nt, Bordetella pertussis
ccccgaucggcgc

SEQ ID NO: 368156 - RNA, 24 nt, Bordetella pertussis
ccccgaugauggauucgcgccggc

SEQ ID NO: 368157 - RNA, 13 nt, Bordetella pertussis
ccccgcacgggga

SEQ ID NO: 368158 - RNA, 20 nt, Bordetella pertussis
ccccgcacggggacaggcac

SEQ ID NO: 368159 - RNA, 15 nt, Bordetella pertussis
ccccgcagggacagg

SEQ ID NO: 368160 - RNA, 11 nt, Bordetella pertussis
ccccgccaggu

SEQ ID NO: 368161 - RNA, 18 nt, Bordetella pertussis
ccccgccgcacgggcgcc

SEQ ID NO: 368162 - RNA, 14 nt, Bordetella pertussis
ccccgccgggccgc

SEQ ID NO: 368163 - RNA, 13 nt, Bordetella pertussis
ccccgcgcggggg

SEQ ID NO: 368164 - RNA, 15 nt, Bordetella pertussis
ccccgcggggacagg

SEQ ID NO: 368165 - RNA, 18 nt, Bordetella pertussis
ccccgcggggacuggcuc

SEQ ID NO: 368166 - RNA, 12 nt, Bordetella pertussis
ccccgcuggccg

SEQ ID NO: 368167 - RNA, 20 nt, Bordetella pertussis
ccccgcugaccuggugugcc

SEQ ID NO: 368168 - RNA, 15 nt, Bordetella pertussis
ccccgcugggacagg

SEQ ID NO: 368169 - RNA, 18 nt, Bordetella pertussis
ccccggcaccaucgccgc

SEQ ID NO: 368170 - RNA, 17 nt, Bordetella pertussis
ccccggcccgcgccggg

SEQ ID NO: 368171 - RNA, 12 nt, Bordetella pertussis
ccccggcccggc

SEQ ID NO: 368172 - RNA, 13 nt, Bordetella pertussis
ccccggcccggcg

SEQ ID NO: 368173 - RNA, 16 nt, Bordetella pertussis
ccccggcccggcgggc

SEQ ID NO: 368174 - RNA, 16 nt, Bordetella pertussis
ccccggcgcggcgcgc

SEQ ID NO: 368175 - RNA, 19 nt, Bordetella pertussis
ccccggcgcggcgcgcgcc

SEQ ID NO: 368176 - RNA, 14 nt, Bordetella pertussis
ccccggcgcgcagc

SEQ ID NO: 368177 - RNA, 20 nt, Bordetella pertussis
cccgauaugcagccgcacca

SEQ ID NO: 368178 - RNA, 13 nt, Bordetella pertussis
cccgaucgacggc

SEQ ID NO: 368179 - RNA, 15 nt, Bordetella pertussis
cccgaucgacggccg

SEQ ID NO: 368180 - RNA, 16 nt, Bordetella pertussis
cccgaucggccggccg

SEQ ID NO: 368181 - RNA, 14 nt, Bordetella pertussis
cccgaucggcgccg

SEQ ID NO: 368182 - RNA, 21 nt, Bordetella pertussis
cccgaucuccgggagccuguc

SEQ ID NO: 368183 - RNA, 19 nt, Bordetella pertussis
cccgcaccgcccgcaagca

SEQ ID NO: 368184 - RNA, 14 nt, Bordetella pertussis
cccgcaccgggcaa

SEQ ID NO: 368185 - RNA, 16 nt, Bordetella pertussis
cccgcacggggacugg

SEQ ID NO: 368186 - RNA, 22 nt, Bordetella pertussis
cccgcaggcauugcgccagccg

SEQ ID NO: 368187 - RNA, 23 nt, Bordetella pertussis
cccgcaggcauugcgccagccgu

SEQ ID NO: 368188 - RNA, 17 nt, Bordetella pertussis
cccgcagggacaggcuc

SEQ ID NO: 368189 - RNA, 20 nt, Bordetella pertussis
cccgcagggacaggcuccga

SEQ ID NO: 368190 - RNA, 21 nt, Bordetella pertussis
cccgcccggguuggcguccag

SEQ ID NO: 368191 - RNA, 15 nt, Bordetella pertussis
cccgcccugcccggc

SEQ ID NO: 368192 - RNA, 19 nt, Bordetella pertussis
cccgcccuugccagggccu

SEQ ID NO: 368193 - RNA, 18 nt, Bordetella pertussis
cccgcccugacgccugcg

SEQ ID NO: 368194 - RNA, 12 nt, Bordetella pertussis
cccgccgcccgg

SEQ ID NO: 368195 - RNA, 15 nt, Bordetella pertussis
cccgccgcccggccg

SEQ ID NO: 368196 - RNA, 13 nt, Bordetella pertussis
cccgccgcggcag

SEQ ID NO: 368197 - RNA, 15 nt, Bordetella pertussis
cccgccgccgggcgc

SEQ ID NO: 368198 - RNA, 14 nt, Bordetella pertussis
cccgccgcugaacg

SEQ ID NO: 368199 - RNA, 16 nt, Bordetella pertussis
cccgccgugccgggcc

SEQ ID NO: 368200 - RNA, 20 nt, Bordetella pertussis
cccgccugcguggcgggccg

SEQ ID NO: 368201 - RNA, 23 nt, Bordetella pertussis
cccgccugcguggcgggccgcgc

SEQ ID NO: 368202 - RNA, 20 nt, Bordetella pertussis
cccgccuggcgccgcgcccg

SEQ ID NO: 368203 - RNA, 22 nt, Bordetella pertussis
cccgccuucgucgaggucagcg

SEQ ID NO: 368204 - RNA, 12 nt, Bordetella pertussis
cccgcgccacca

SEQ ID NO: 368205 - RNA, 18 nt, Bordetella pertussis
cccgcgccaucgcgucga

SEQ ID NO: 368206 - RNA, 13 nt, Bordetella pertussis
cccgcgccgcgca

SEQ ID NO: 368207 - RNA, 13 nt, Bordetella pertussis
cccgcgccggcgg

SEQ ID NO: 368208 - RNA, 13 nt, Bordetella pertussis
cccgcgccgucga

SEQ ID NO: 368209 - RNA, 21 nt, Bordetella pertussis
cccgcgccuaucaggccucga

SEQ ID NO: 368210 - RNA, 24 nt, Bordetella pertussis
cccgcgccucggcauccagcucgg

SEQ ID NO: 368211 - RNA, 20 nt, Bordetella pertussis
cccgcggcgcccccgcggcg

SEQ ID NO: 368212 - RNA, 15 nt, Bordetella pertussis
cccgcgggcgcccgg

SEQ ID NO: 368213 - RNA, 22 nt, Bordetella pertussis
cccgcgggcgcccggccggccu

SEQ ID NO: 368214 - RNA, 17 nt, Bordetella pertussis
cccgcggggacaggcac

SEQ ID NO: 368215 - RNA, 21 nt, Bordetella pertussis
cccgcggggacaggcacccug

SEQ ID NO: 368216 - RNA, 18 nt, Bordetella pertussis
cccgcggggacaggcucc

SEQ ID NO: 368217 - RNA, 21 nt, Bordetella pertussis
cccgcuaccccggcagcguca

SEQ ID NO: 368218 - RNA, 21 nt, Bordetella pertussis
cccgcuacgcgggcuugcugc

SEQ ID NO: 368219 - RNA, 21 nt, Bordetella pertussis
cccgcuaugcgggcuugcugc

SEQ ID NO: 368220 - RNA, 20 nt, Bordetella pertussis
cccgcugccgagacggccgc

SEQ ID NO: 368221 - RNA, 13 nt, Bordetella pertussis
cccgcugcggcaa

SEQ ID NO: 368222 - RNA, 13 nt, Bordetella pertussis
cccgcuggccgau

SEQ ID NO: 368223 - RNA, 19 nt, Bordetella pertussis
cccggaauaccgccagcuc

SEQ ID NO: 368224 - RNA, 13 nt, Bordetella pertussis
cccggaccgcgcu

SEQ ID NO: 368225 - RNA, 15 nt, Bordetella pertussis
cccggcaaucccggc

SEQ ID NO: 368226 - RNA, 17 nt, Bordetella pertussis
cccggcaaucccggcga

SEQ ID NO: 368227 - RNA, 19 nt, Bordetella pertussis
cccggcaccaugcgcacca

SEQ ID NO: 368228 - RNA, 13 nt, Bordetella pertussis
cccggcaggcaca

SEQ ID NO: 368229 - RNA, 14 nt, Bordetella pertussis
cccggcaggcacac

SEQ ID NO: 368230 - RNA, 20 nt, Bordetella pertussis
cccggcagggucucggccac

SEQ ID NO: 368231 - RNA, 19 nt, Bordetella pertussis
cccggcaugggcgugccgc

SEQ ID NO: 368232 - RNA, 21 nt, Bordetella pertussis
cccggcaugggcgugccgcgc

SEQ ID NO: 368233 - RNA, 22 nt, Bordetella pertussis
cccggcaugggcgugccgcgcu

SEQ ID NO: 368234 - RNA, 14 nt, Bordetella pertussis
cccggccaggcgcc

SEQ ID NO: 368235 - RNA, 14 nt, Bordetella pertussis
cccggcccaggccg

SEQ ID NO: 368236 - RNA, 14 nt, Bordetella pertussis
cccggccgaucgcg

SEQ ID NO: 368237 - RNA, 14 nt, Bordetella pertussis
cccggccgccagca

SEQ ID NO: 368238 - RNA, 14 nt, Bordetella pertussis
cccggccgccgccg

SEQ ID NO: 368239 - RNA, 12 nt, Bordetella pertussis
cccggccggcac

SEQ ID NO: 368240 - RNA, 19 nt, Bordetella pertussis
cccggccggcacggccggc

SEQ ID NO: 368241 - RNA, 20 nt, Bordetella pertussis
cccggccggcacggccggcc

SEQ ID NO: 368242 - RNA, 17 nt, Bordetella pertussis
cccggccggcgccggca

SEQ ID NO: 368243 - RNA, 19 nt, Bordetella pertussis
cccggccggcgccggcaaa

SEQ ID NO: 368244 - RNA, 11 nt, Bordetella pertussis
cccggccgccu

SEQ ID NO: 368245 - RNA, 17 nt, Bordetella pertussis
cccggccucagcggccg

SEQ ID NO: 368246 - RNA, 15 nt, Bordetella pertussis
cccggccucgcggcg

SEQ ID NO: 368247 - RNA, 16 nt, Bordetella pertussis
cccggccugcgggcgc

SEQ ID NO: 368248 - RNA, 18 nt, Bordetella pertussis
cccggccugcgggcgccg

SEQ ID NO: 368249 - RNA, 20 nt, Bordetella pertussis
cccggccugcgggcgccgcg

SEQ ID NO: 368250 - RNA, 22 nt, Bordetella pertussis
cccggccugcgugucaggcgga

SEQ ID NO: 368251 - RNA, 16 nt, Bordetella pertussis
cccggcgaggccgccc

SEQ ID NO: 368252 - RNA, 18 nt, Bordetella pertussis
cccggcgaggccgcccgc

SEQ ID NO: 368253 - RNA, 19 nt, Bordetella pertussis
cccggcgaucaugccgccg

SEQ ID NO: 368254 - RNA, 15 nt, Bordetella pertussis
cccggcggcgcgccg

SEQ ID NO: 368255 - RNA, 14 nt, Bordetella pertussis
cccggcggcgcggc

SEQ ID NO: 368256 - RNA, 19 nt, Bordetella pertussis
cccggcggcgcggcgagca

SEQ ID NO: 368257 - RNA, 13 nt, Bordetella pertussis
cccggcggggaca

SEQ ID NO: 368258 - RNA, 13 nt, Bordetella pertussis
cccggcgggccgg

SEQ ID NO: 368259 - RNA, 16 nt, Bordetella pertussis
cccggcgggccggcuc

SEQ ID NO: 368260 - RNA, 20 nt, Bordetella pertussis
cccggcguagcugcgccgca

SEQ ID NO: 368261 - RNA, 15 nt, Bordetella pertussis
cccggcuccaggccg

SEQ ID NO: 368262 - RNA, 23 nt, Bordetella pertussis
cccgggcgagauggcgugcacgc

SEQ ID NO: 368263 - RNA, 16 nt, Bordetella pertussis
cccgggcgugaccagc

SEQ ID NO: 368264 - RNA, 14 nt, Bordetella pertussis
cccgggcguggcgu

SEQ ID NO: 368265 - RNA, 14 nt, Bordetella pertussis
cccgguaggccacg

SEQ ID NO: 368266 - RNA, 23 nt, Bordetella pertussis
cccgguauuccucgacgauggcg

SEQ ID NO: 368267 - RNA, 19 nt, Bordetella pertussis
cccggucagcagggcgccg

SEQ ID NO: 368268 - RNA, 14 nt, Bordetella pertussis
cccgguccaggccg

SEQ ID NO: 368269 - RNA, 14 nt, Bordetella pertussis
cccguucggggaca

SEQ ID NO: 368270 - RNA, 21 nt, Bordetella pertussis
cccguucggggacaggcaccg

SEQ ID NO: 368271 - RNA, 14 nt, Bordetella pertussis
cccguugcagccca

SEQ ID NO: 368272 - RNA, 21 nt, Bordetella pertussis
cccguugcagcccagcgcgau

SEQ ID NO: 368273 - RNA, 21 nt, Bordetella pertussis
cccguuggcgucgagcaccgu

SEQ ID NO: 368274 - RNA, 12 nt, Bordetella pertussis
cccucgcccagc

SEQ ID NO: 368275 - RNA, 13 nt, Bordetella pertussis
cccucgcccagga

SEQ ID NO: 368276 - RNA, 17 nt, Bordetella pertussis
cccucgcccgugcgcgg

SEQ ID NO: 368277 - RNA, 22 nt, Bordetella pertussis
cccucgcccccgaaggccgcgc

SEQ ID NO: 368278 - RNA, 23 nt, Bordetella pertussis
cccucgcgcacggugcgcacgau

SEQ ID NO: 368279 - RNA, 19 nt, Bordetella pertussis
cccucgcggaugaccuggu

SEQ ID NO: 368280 - RNA, 14 nt, Bordetella pertussis
cccucggccugcgc

SEQ ID NO: 368281 - RNA, 17 nt, Bordetella pertussis
cccucggccugcgcgau

SEQ ID NO: 368282 - RNA, 18 nt, Bordetella pertussis
cccucgggcgacaggcgc

SEQ ID NO: 368283 - RNA, 20 nt, Bordetella pertussis
cccucgggcgacaggcgcgc

SEQ ID NO: 368284 - RNA, 18 nt, Bordetella pertussis
cccugaucccggcgcugg

SEQ ID NO: 368285 - RNA, 21 nt, Bordetella pertussis
cccugcaccgucacgcgcugg

SEQ ID NO: 368286 - RNA, 16 nt, Bordetella pertussis
cccugcagcggccagu

SEQ ID NO: 368287 - RNA, 22 nt, Bordetella pertussis
cccugcaugaccgccgccagca

SEQ ID NO: 368288 - RNA, 19 nt, Bordetella pertussis
cccugcggcgcggccagca

SEQ ID NO: 368289 - RNA, 17 nt, Bordetella pertussis
cccugcggggacaggca

SEQ ID NO: 368290 - RNA, 20 nt, Bordetella pertussis
cccugcggggacaggcaccc

SEQ ID NO: 368291 - RNA, 23 nt, Bordetella pertussis
cccugcggggacaggcacccccg

SEQ ID NO: 368292 - RNA, 20 nt, Bordetella pertussis
cccugcgggggcaggcacgc

SEQ ID NO: 368293 - RNA, 18 nt, Bordetella pertussis
cccugcugcccgccgccg

SEQ ID NO: 368294 - RNA, 19 nt, Bordetella pertussis
cccugcugcccgccgccgc

SEQ ID NO: 368295 - RNA, 17 nt, Bordetella pertussis
cccuguucgcgcggccc

SEQ ID NO: 368296 - RNA, 14 nt, Bordetella pertussis
cccugugggggaca

SEQ ID NO: 368297 - RNA, 13 nt, Bordetella pertussis
cccuucgacgcgg

SEQ ID NO: 368298 - RNA, 20 nt, Bordetella pertussis
cccuucgacgcggcggccgg

SEQ ID NO: 368299 - RNA, 16 nt, Bordetella pertussis
cccuucggcaugcugc

SEQ ID NO: 368300 - RNA, 16 nt, Bordetella pertussis
cccuugagcacggcgc

SEQ ID NO: 368301 - RNA, 18 nt, Bordetella pertussis
cccuugagcguggcgucc

SEQ ID NO: 368302 - RNA, 16 nt, Bordetella pertussis
cccuugauggccgggc

SEQ ID NO: 368303 - RNA, 20 nt, Bordetella pertussis
cccuugccgcagcggggaca

SEQ ID NO: 368304 - RNA, 17 nt, Bordetella pertussis
cccuugcccaacgcggc

SEQ ID NO: 368305 - RNA, 17 nt, Bordetella pertussis
cccuugcggccgccgaa

SEQ ID NO: 368306 - RNA, 22 nt, Bordetella pertussis
cccuugugcugccaugccgcgc

SEQ ID NO: 368307 - RNA, 16 nt, Bordetella pertussis
cccuuguggccgccga

SEQ ID NO: 368308 - RNA, 14 nt, Bordetella pertussis
ccgaacaaggucca

SEQ ID NO: 368309 - RNA, 23 nt, Bordetella pertussis
ccgaacaagguccaggcccggca

SEQ ID NO: 368310 - RNA, 17 nt, Bordetella pertussis
ccgaacacaucgagggc

SEQ ID NO: 368311 - RNA, 18 nt, Bordetella pertussis
ccgaacaccaccgagggc

SEQ ID NO: 368312 - RNA, 20 nt, Bordetella pertussis
ccgaacagaaggcgugcgug

SEQ ID NO: 368313 - RNA, 13 nt, Bordetella pertussis
ccgaacgccgccg

SEQ ID NO: 368314 - RNA, 20 nt, Bordetella pertussis
ccgaacgccgccgcagccgc

SEQ ID NO: 368315 - RNA, 20 nt, Bordetella pertussis
ccgaacgcggucgcauuggc

SEQ ID NO: 368316 - RNA, 19 nt, Bordetella pertussis
ccgaacgcgugcaccagcc

SEQ ID NO: 368317 - RNA, 21 nt, Bordetella pertussis
ccgaacgcgugcaccagccau

SEQ ID NO: 368318 - RNA, 22 nt, Bordetella pertussis
ccgaacggcagcagcgcgccgg

SEQ ID NO: 368319 - RNA, 22 nt, Bordetella pertussis
ccgaacggccggucagcccagg

SEQ ID NO: 368320 - RNA, 17 nt, Bordetella pertussis
ccgaacggggacuggca

SEQ ID NO: 368321 - RNA, 21 nt, Bordetella pertussis
ccgaacggggccgccucggcg

SEQ ID NO: 368322 - RNA, 17 nt, Bordetella pertussis
ccgaacugucgcgccac

SEQ ID NO: 368323 - RNA, 20 nt, Bordetella pertussis
ccgaacugucgcgccacggc

SEQ ID NO: 368324 - RNA, 15 nt, Bordetella pertussis
ccgaacuucagcccg

SEQ ID NO: 368325 - RNA, 19 nt, Bordetella pertussis
ccgaacugggacaggccca

SEQ ID NO: 368326 - RNA, 22 nt, Bordetella pertussis
ccgaagaaauagcccgcggcca

SEQ ID NO: 368327 - RNA, 14 nt, Bordetella pertussis
ccgaagcgucggcc

SEQ ID NO: 368328 - RNA, 19 nt, Bordetella pertussis
ccgaaggcgcggccgggcu

SEQ ID NO: 368329 - RNA, 17 nt, Bordetella pertussis
ccgaaggcggcgccggu

SEQ ID NO: 368330 - RNA, 23 nt, Bordetella pertussis
ccgaaggucuuggcgugcaggcu

SEQ ID NO: 368331 - RNA, 21 nt, Bordetella pertussis
ccgaaguacacggccagcacg

SEQ ID NO: 368332 - RNA, 18 nt, Bordetella pertussis
ccgaaguaguuggucgag

SEQ ID NO: 368333 - RNA, 16 nt, Bordetella pertussis
ccgaagucggcgcgcg

SEQ ID NO: 368334 - RNA, 12 nt, Bordetella pertussis
ccgacacgcugg

SEQ ID NO: 368335 - RNA, 18 nt, Bordetella pertussis
ccgacacgcuggcggaca

SEQ ID NO: 368336 - RNA, 19 nt, Bordetella pertussis
ccgacagcacauggcgcgc

SEQ ID NO: 368337 - RNA, 21 nt, Bordetella pertussis
ccgacagcacauggcgcgccg

SEQ ID NO: 368338 - RNA, 15 nt, Bordetella pertussis
ccgacagauggcgcu

SEQ ID NO: 368339 - RNA, 18 nt, Bordetella pertussis
ccgacagcacgcccgcca

SEQ ID NO: 368340 - RNA, 19 nt, Bordetella pertussis
ccgacaggaaggcgagcgc

SEQ ID NO: 368341 - RNA, 14 nt, Bordetella pertussis
ccgacaggcgccgc

SEQ ID NO: 368342 - RNA, 18 nt, Bordetella pertussis
ccgacaggcggcuguagu

SEQ ID NO: 368343 - RNA, 23 nt, Bordetella pertussis
ccgacaggcggcuguagucgccg

SEQ ID NO: 368344 - RNA, 13 nt, Bordetella pertussis
ccgaccaccagca

SEQ ID NO: 368345 - RNA, 22 nt, Bordetella pertussis
ccgaccaccagcaccgaugcgc

SEQ ID NO: 368346 - RNA, 18 nt, Bordetella pertussis
ccgaccacccgcgccagg

SEQ ID NO: 368347 - RNA, 21 nt, Bordetella pertussis
ccgaccacuggaagcugcggc

SEQ ID NO: 368348 - RNA, 14 nt, Bordetella pertussis
ccgaccagcacgau

SEQ ID NO: 368349 - RNA, 17 nt, Bordetella pertussis
ccgaccagcgcgcgccg

SEQ ID NO: 368350 - RNA, 17 nt, Bordetella pertussis
ccgaccagcucgacgcc

SEQ ID NO: 368351 - RNA, 14 nt, Bordetella pertussis
ccgaccaggcccgc

SEQ ID NO: 368352 - RNA, 19 nt, Bordetella pertussis
ccgaccaggcccgccacgg

SEQ ID NO: 368353 - RNA, 13 nt, Bordetella pertussis
ccgaccaggcugc

SEQ ID NO: 368354 - RNA, 19 nt, Bordetella pertussis
ccgaccaggcugcgcgccg

SEQ ID NO: 368355 - RNA, 20 nt, Bordetella pertussis
ccgaccaggcugcgcgccgg

SEQ ID NO: 368356 - RNA, 17 nt, Bordetella pertussis
ccgaccaggccggcggc

SEQ ID NO: 368357 - RNA, 16 nt, Bordetella pertussis
ccgacccccggcccgc

SEQ ID NO: 368358 - RNA, 20 nt, Bordetella pertussis
ccgacccccggcccgcgccg

SEQ ID NO: 368359 - RNA, 18 nt, Bordetella pertussis
ccgaccgcuuccgccacc

SEQ ID NO: 368360 - RNA, 18 nt, Bordetella pertussis
ccgaccggccccaccugg

SEQ ID NO: 368361 - RNA, 15 nt, Bordetella pertussis
ccgaccggcgcgcgc

SEQ ID NO: 368362 - RNA, 18 nt, Bordetella pertussis
ccgaccgggccgaccagg

SEQ ID NO: 368363 - RNA, 14 nt, Bordetella pertussis
ccgaccucgucggg

SEQ ID NO: 368364 - RNA, 16 nt, Bordetella pertussis
ccgaccugaucgcgca

SEQ ID NO: 368365 - RNA, 20 nt, Bordetella pertussis
ccgaccugaucgcgcagcgc

SEQ ID NO: 368366 - RNA, 12 nt, Bordetella pertussis
ccgaccugcugg

SEQ ID NO: 368367 - RNA, 20 nt, Bordetella pertussis
ccgacgaaaugccggcgaau

SEQ ID NO: 368368 - RNA, 21 nt, Bordetella pertussis
ccgacgaacugcgagugggug

SEQ ID NO: 368369 - RNA, 17 nt, Bordetella pertussis
ccgacgagaaugcgccg

SEQ ID NO: 368370 - RNA, 23 nt, Bordetella pertussis
ccgacgaggagccggcgggcggc

SEQ ID NO: 368371 - RNA, 13 nt, Bordetella pertussis
ccgacgaggcgcu

SEQ ID NO: 368372 - RNA, 12 nt, Bordetella pertussis
ccgacgauccgc

SEQ ID NO: 368373 - RNA, 22 nt, Bordetella pertussis
ccgacgauaucgcgaaagcggc

SEQ ID NO: 368374 - RNA, 22 nt, Bordetella pertussis
ccgacgaugaccaucacgagca

SEQ ID NO: 368375 - RNA, 16 nt, Bordetella pertussis
ccgacgaugaucauga

SEQ ID NO: 368376 - RNA, 16 nt, Bordetella pertussis
ccgacgaugccgccgc

SEQ ID NO: 368377 - RNA, 13 nt, Bordetella pertussis
ccgaugccgaaca

SEQ ID NO: 368378 - RNA, 18 nt, Bordetella pertussis
ccgaugccgcgcaccugg

SEQ ID NO: 368379 - RNA, 18 nt, Bordetella pertussis
ccgaugcgccaggccucg

SEQ ID NO: 368380 - RNA, 13 nt, Bordetella pertussis
ccgaugcgccggc

SEQ ID NO: 368381 - RNA, 14 nt, Bordetella pertussis
ccgaugcgccggcc

SEQ ID NO: 368382 - RNA, 21 nt, Bordetella pertussis
ccgaugcgccggccuggcgcg

SEQ ID NO: 368383 - RNA, 16 nt, Bordetella pertussis
ccgaugcgcugcugga

SEQ ID NO: 368384 - RNA, 16 nt, Bordetella pertussis
ccgaugcggcgcaugc

SEQ ID NO: 368385 - RNA, 20 nt, Bordetella pertussis
ccgaugcgguaggcccagca

SEQ ID NO: 368386 - RNA, 15 nt, Bordetella pertussis
ccgaugcguccgccg

SEQ ID NO: 368387 - RNA, 18 nt, Bordetella pertussis
ccgaugcucgccggcgcc

SEQ ID NO: 368388 - RNA, 13 nt, Bordetella pertussis
ccgauggcaucgc

SEQ ID NO: 368389 - RNA, 21 nt, Bordetella pertussis
ccgauggcauggggcaggcgc

SEQ ID NO: 368390 - RNA, 19 nt, Bordetella pertussis
ccgauggcgccaccuucgc

SEQ ID NO: 368391 - RNA, 21 nt, Bordetella pertussis
ccgauggcgccaccuucgccg

SEQ ID NO: 368392 - RNA, 15 nt, Bordetella pertussis
ccgauggcgcggccg

SEQ ID NO: 368393 - RNA, 16 nt, Bordetella pertussis
ccgauggcgcggccgc

SEQ ID NO: 368394 - RNA, 20 nt, Bordetella pertussis
ccgauggcgcggccgccagc

SEQ ID NO: 368395 - RNA, 22 nt, Bordetella pertussis
ccgauggcgcggccgccagccc

SEQ ID NO: 368396 - RNA, 18 nt, Bordetella pertussis
ccgauggcguccagcagc

SEQ ID NO: 368397 - RNA, 22 nt, Bordetella pertussis
ccgauggcguccagcagcagga

SEQ ID NO: 368398 - RNA, 15 nt, Bordetella pertussis
ccgauggcgcgcggc

SEQ ID NO: 368399 - RNA, 21 nt, Bordetella pertussis
ccgauggucagcgugucgccg

SEQ ID NO: 368400 - RNA, 17 nt, Bordetella pertussis
ccgauguagcccauggc

SEQ ID NO: 368401 - RNA, 19 nt, Bordetella pertussis
ccgauguccacgaaggcgc

SEQ ID NO: 368402 - RNA, 15 nt, Bordetella pertussis
ccgaugucgaccaug

SEQ ID NO: 368403 - RNA, 14 nt, Bordetella pertussis
ccgauuucgcgcgc

SEQ ID NO: 368404 - RNA, 23 nt, Bordetella pertussis
ccgcaagcuggccgaugucgccg

SEQ ID NO: 368405 - RNA, 17 nt, Bordetella pertussis
ccgcaagcuggcggcgc

SEQ ID NO: 368406 - RNA, 20 nt, Bordetella pertussis
ccgcaagcuggcggcgcgcg

SEQ ID NO: 368407 - RNA, 22 nt, Bordetella pertussis
ccgcaaggaaguggccgagcgc

SEQ ID NO: 368408 - RNA, 18 nt, Bordetella pertussis
ccgcaaguucggcagcga

SEQ ID NO: 368409 - RNA, 23 nt, Bordetella pertussis
ccgcaaguucggcagcgaggcgc

SEQ ID NO: 368410 - RNA, 18 nt, Bordetella pertussis
ccgcaagggggacuggca

SEQ ID NO: 368411 - RNA, 23 nt, Bordetella pertussis
ccgcaagggggacuggcaccggc

SEQ ID NO: 368412 - RNA, 21 nt, Bordetella pertussis
ccgcaauaccuucagcccggc

SEQ ID NO: 368413 - RNA, 22 nt, Bordetella pertussis
ccgcacccgaugacggggcggc

SEQ ID NO: 368414 - RNA, 14 nt, Bordetella pertussis
ccgcaccgggcggc

SEQ ID NO: 368415 - RNA, 18 nt, Bordetella pertussis
ccgcacgaucgcgccggc

SEQ ID NO: 368416 - RNA, 20 nt, Bordetella pertussis
ccgcacugaucuuucagcgc

SEQ ID NO: 368417 - RNA, 19 nt, Bordetella pertussis
ccgcacugggugacgcugg

SEQ ID NO: 368418 - RNA, 13 nt, Bordetella pertussis
ccgcagaacagca

SEQ ID NO: 368419 - RNA, 20 nt, Bordetella pertussis
ccgcagaagcagccgcgcgg

SEQ ID NO: 368420 - RNA, 21 nt, Bordetella pertussis
ccgcagaagcagccgcgcggc

SEQ ID NO: 368421 - RNA, 22 nt, Bordetella pertussis
ccgcagauggccagcagcgccg

SEQ ID NO: 368422 - RNA, 19 nt, Bordetella pertussis
ccgcagauuuccagcgcgu

SEQ ID NO: 368423 - RNA, 22 nt, Bordetella pertussis
ccgcagcaauugccccagcacg

SEQ ID NO: 368424 - RNA, 18 nt, Bordetella pertussis
ccgcagcaccacaucgcc

SEQ ID NO: 368425 - RNA, 19 nt, Bordetella pertussis
ccgcagcaccacaucgccg

SEQ ID NO: 368426 - RNA, 13 nt, Bordetella pertussis
ccgcagcaggcgc

SEQ ID NO: 368427 - RNA, 11 nt, Bordetella pertussis
ccgcagcaugg

SEQ ID NO: 368428 - RNA, 14 nt, Bordetella pertussis
ccgcagcauggcgc

SEQ ID NO: 368429 - RNA, 16 nt, Bordetella pertussis
ccgcagcauggcgcca

SEQ ID NO: 368430 - RNA, 17 nt, Bordetella pertussis
ccgcagcccgcgcgccu

SEQ ID NO: 368431 - RNA, 12 nt, Bordetella pertussis
ccgcagcgccac

SEQ ID NO: 368432 - RNA, 19 nt, Bordetella pertussis
ccgcagcgccaccggcugg

SEQ ID NO: 368433 - RNA, 14 nt, Bordetella pertussis
ccgcagcgcagcgc

SEQ ID NO: 368434 - RNA, 13 nt, Bordetella pertussis
ccgcagcggacgu

SEQ ID NO: 368435 - RNA, 18 nt, Bordetella pertussis
ccgcagcggcagcgcacc

SEQ ID NO: 368436 - RNA, 16 nt, Bordetella pertussis
ccgcagcgggcccguc

SEQ ID NO: 368437 - RNA, 19 nt, Bordetella pertussis
ccgcagcgggcccgucgcg

SEQ ID NO: 368438 - RNA, 16 nt, Bordetella pertussis
ccgcagcggggacagg

SEQ ID NO: 368439 - RNA, 13 nt, Bordetella pertussis
ccgcagcgucgcg

SEQ ID NO: 368440 - RNA, 21 nt, Bordetella pertussis
ccgcaucggccaggcgccuga

SEQ ID NO: 368441 - RNA, 13 nt, Bordetella pertussis
ccgcaucggcgua

SEQ ID NO: 368442 - RNA, 13 nt, Bordetella pertussis
ccgcaugccggcg

SEQ ID NO: 368443 - RNA, 20 nt, Bordetella pertussis
ccgcaugccgggcugcaugc

SEQ ID NO: 368444 - RNA, 13 nt, Bordetella pertussis
ccgcaugcgcaga

SEQ ID NO: 368445 - RNA, 14 nt, Bordetella pertussis
ccgcaugcggcggc

SEQ ID NO: 368446 - RNA, 17 nt, Bordetella pertussis
ccgcaugcugcagcugc

SEQ ID NO: 368447 - RNA, 18 nt, Bordetella pertussis
ccgcauggaccgccgccg

SEQ ID NO: 368448 - RNA, 17 nt, Bordetella pertussis
ccgcauggagaccggcg

SEQ ID NO: 368449 - RNA, 18 nt, Bordetella pertussis
ccgccaacgccaagcugc

SEQ ID NO: 368450 - RNA, 20 nt, Bordetella pertussis
ccgccaagcagaccuaccag

SEQ ID NO: 368451 - RNA, 15 nt, Bordetella pertussis
ccgccaagggcgcgc

SEQ ID NO: 368452 - RNA, 16 nt, Bordetella pertussis
ccgccaagggcgcgcc

SEQ ID NO: 368453 - RNA, 13 nt, Bordetella pertussis
ccgccacagcgcc

SEQ ID NO: 368454 - RNA, 16 nt, Bordetella pertussis
ccgccacagcgccgcg

SEQ ID NO: 368455 - RNA, 19 nt, Bordetella pertussis
ccgccacagcgccgcggcg

SEQ ID NO: 368456 - RNA, 16 nt, Bordetella pertussis
ccgccacaggcugacg

SEQ ID NO: 368457 - RNA, 20 nt, Bordetella pertussis
ccgccaccaccucggccucg

SEQ ID NO: 368458 - RNA, 12 nt, Bordetella pertussis
ccgccaccacgg

SEQ ID NO: 368459 - RNA, 14 nt, Bordetella pertussis
ccgccacccaggcg

SEQ ID NO: 368460 - RNA, 15 nt, Bordetella pertussis
ccgccacgcccuggc

SEQ ID NO: 368461 - RNA, 13 nt, Bordetella pertussis
ccgccacgccggc

SEQ ID NO: 368462 - RNA, 15 nt, Bordetella pertussis
ccgccacgccggcca

SEQ ID NO: 368463 - RNA, 23 nt, Bordetella pertussis
ccgccacgccuuguucgcgcgcg

SEQ ID NO: 368464 - RNA, 16 nt, Bordetella pertussis
ccgccacgcgcacggc

SEQ ID NO: 368465 - RNA, 23 nt, Bordetella pertussis
ccgccacgcgguccagccccugc

SEQ ID NO: 368466 - RNA, 12 nt, Bordetella pertussis
ccgccacgcugg

SEQ ID NO: 368467 - RNA, 17 nt, Bordetella pertussis
ccgccacgcuggccgcg

SEQ ID NO: 368468 - RNA, 19 nt, Bordetella pertussis
ccgccacgcuggccgcgcu

SEQ ID NO: 368469 - RNA, 21 nt, Bordetella pertussis
ccgccacgcuggccgcgcugg

SEQ ID NO: 368470 - RNA, 18 nt, Bordetella pertussis
ccgccacgggcccgcgca

SEQ ID NO: 368471 - RNA, 20 nt, Bordetella pertussis
ccgccacgggcccgcgcaga

SEQ ID NO: 368472 - RNA, 22 nt, Bordetella pertussis
ccgccacggucgcgagcugcgc

SEQ ID NO: 368473 - RNA, 16 nt, Bordetella pertussis
ccgccacgucauaggc

SEQ ID NO: 368474 - RNA, 14 nt, Bordetella pertussis
ccgccacgucgccg

SEQ ID NO: 368475 - RNA, 14 nt, Bordetella pertussis
ccgccagcagcgcc

SEQ ID NO: 368476 - RNA, 15 nt, Bordetella pertussis
ccgccagcagcgccg

SEQ ID NO: 368477 - RNA, 16 nt, Bordetella pertussis
ccgccagcagcucggc

SEQ ID NO: 368478 - RNA, 21 nt, Bordetella pertussis
ccgccagcagcucggcgacca

SEQ ID NO: 368479 - RNA, 14 nt, Bordetella pertussis
ccgccagcacgcca

SEQ ID NO: 368480 - RNA, 22 nt, Bordetella pertussis
ccgccagccaccccgucaucgc

SEQ ID NO: 368481 - RNA, 23 nt, Bordetella pertussis
ccgccagccaccccgucaucgcc

SEQ ID NO: 368482 - RNA, 20 nt, Bordetella pertussis
ccgccagcauggcggccagg

SEQ ID NO: 368483 - RNA, 22 nt, Bordetella pertussis
ccgccagggcguuuuccagcau

SEQ ID NO: 368484 - RNA, 15 nt, Bordetella pertussis
ccgccaggucggcca

SEQ ID NO: 368485 - RNA, 18 nt, Bordetella pertussis
ccgccagguucgccuggc

SEQ ID NO: 368486 - RNA, 19 nt, Bordetella pertussis
ccgccagguucgccuggcg

SEQ ID NO: 368487 - RNA, 14 nt, Bordetella pertussis
ccgccaucgcgcau

SEQ ID NO: 368488 - RNA, 17 nt, Bordetella pertussis
ccgccaucgucguagcg

SEQ ID NO: 368489 - RNA, 19 nt, Bordetella pertussis
ccgccaucgucguagcgcc

SEQ ID NO: 368490 - RNA, 15 nt, Bordetella pertussis
ccgccaugcacgggc

SEQ ID NO: 368491 - RNA, 21 nt, Bordetella pertussis
ccgccaugcgaugcugcaggg

SEQ ID NO: 368492 - RNA, 23 nt, Bordetella pertussis
ccgccaugcgaugcugcagggcc

SEQ ID NO: 368493 - RNA, 18 nt, Bordetella pertussis
ccgccaugcgcauggcca

SEQ ID NO: 368494 - RNA, 15 nt, Bordetella pertussis
ccgccaugcgccagc

SEQ ID NO: 368495 - RNA, 14 nt, Bordetella pertussis
ccgccaugcggcgc

SEQ ID NO: 368496 - RNA, 20 nt, Bordetella pertussis
ccgccauggaggcgcagcgc

SEQ ID NO: 368497 - RNA, 23 nt, Bordetella pertussis
ccgccauggaggcgcagcgcggc

SEQ ID NO: 368498 - RNA, 21 nt, Bordetella pertussis
ccgccauggccggcguugccg

SEQ ID NO: 368499 - RNA, 13 nt, Bordetella pertussis
ccgccauggcgcu

SEQ ID NO: 368500 - RNA, 15 nt, Bordetella pertussis
ccgccauggcggccg

SEQ ID NO: 368501 - RNA, 18 nt, Bordetella pertussis
ccgccauggcggccgccg

SEQ ID NO: 368502 - RNA, 21 nt, Bordetella pertussis
ccgccauggcggccgccgcca

SEQ ID NO: 368503 - RNA, 14 nt, Bordetella pertussis
ccgccauggucgcg

SEQ ID NO: 368504 - RNA, 20 nt, Bordetella pertussis
ccgccauguauaacguggcg

SEQ ID NO: 368505 - RNA, 22 nt, Bordetella pertussis
ccgccauguauaacguggcgcg

SEQ ID NO: 368506 - RNA, 16 nt, Bordetella pertussis
ccgccaugugcgccgc

SEQ ID NO: 368507 - RNA, 18 nt, Bordetella pertussis
ccgccaugugcgccgcgc

SEQ ID NO: 368508 - RNA, 23 nt, Bordetella pertussis
ccgccauggcgcuggcaggcgcc

SEQ ID NO: 368509 - RNA, 19 nt, Bordetella pertussis
ccgccauugcacgcgcagg

SEQ ID NO: 368510 - RNA, 17 nt, Bordetella pertussis
ccgcccacauggcggcg

SEQ ID NO: 368511 - RNA, 21 nt, Bordetella pertussis
ccgcccacauggcggcgaaca

SEQ ID NO: 368512 - RNA, 13 nt, Bordetella pertussis
ccgcccacgccgc

SEQ ID NO: 368513 - RNA, 19 nt, Bordetella pertussis
ccgcccacgccgccuggcc

SEQ ID NO: 368514 - RNA, 14 nt, Bordetella pertussis
ccgcccacgcggcg

SEQ ID NO: 368515 - RNA, 16 nt, Bordetella pertussis
ccgcccagaaugcggc

SEQ ID NO: 368516 - RNA, 17 nt, Bordetella pertussis
ccgcccagaaugcggcg

SEQ ID NO: 368517 - RNA, 12 nt, Bordetella pertussis
ccgcccagcacc

SEQ ID NO: 368518 - RNA, 11 nt, Bordetella pertussis
ccgcccagcau

SEQ ID NO: 368519 - RNA, 19 nt, Bordetella pertussis
ccgcccagcauuucgcgug

SEQ ID NO: 368520 - RNA, 12 nt, Bordetella pertussis
ccgcccagcgag

SEQ ID NO: 368521 - RNA, 16 nt, Bordetella pertussis
ccgcccagcgagucga

SEQ ID NO: 368522 - RNA, 16 nt, Bordetella pertussis
ccgcccagccgcgcca

SEQ ID NO: 368523 - RNA, 15 nt, Bordetella pertussis
ccgcccagcgccugc

SEQ ID NO: 368524 - RNA, 22 nt, Bordetella pertussis
ccgcccaggcgcagccgcgcgc

SEQ ID NO: 368525 - RNA, 18 nt, Bordetella pertussis
ccgcccaggucggacgcg

SEQ ID NO: 368526 - RNA, 19 nt, Bordetella pertussis
ccgcccaggucggacgcgc

SEQ ID NO: 368527 - RNA, 22 nt, Bordetella pertussis
ccgcccagucguccagcacgcg

SEQ ID NO: 368528 - RNA, 18 nt, Bordetella pertussis
ccgcccaugccgcccaug

SEQ ID NO: 368529 - RNA, 23 nt, Bordetella pertussis
ccgcccaugccgcccaugccgcc

SEQ ID NO: 368530 - RNA, 12 nt, Bordetella pertussis
ccgccccaggcg

SEQ ID NO: 368531 - RNA, 22 nt, Bordetella pertussis
ccgccccaguugcgcguccagg

SEQ ID NO: 368532 - RNA, 22 nt, Bordetella pertussis
ccgcccccagcgcgccugccca

SEQ ID NO: 368533 - RNA, 14 nt, Bordetella pertussis
ccgcccccgcccag

SEQ ID NO: 368534 - RNA, 15 nt, Bordetella pertussis
ccgcccccgcccagc

SEQ ID NO: 368535 - RNA, 14 nt, Bordetella pertussis
ccgcccccgccgca

SEQ ID NO: 368536 - RNA, 12 nt, Bordetella pertussis
ccgccccgaccc

SEQ ID NO: 368537 - RNA, 14 nt, Bordetella pertussis
ccgccccggcgcau

SEQ ID NO: 368538 - RNA, 14 nt, Bordetella pertussis
ccgccccggcgcgg

SEQ ID NO: 368539 - RNA, 15 nt, Bordetella pertussis
ccgccccggcgcggc

SEQ ID NO: 368540 - RNA, 21 nt, Bordetella pertussis
ccgccccggcgcggcgcgcgc

SEQ ID NO: 368541 - RNA, 22 nt, Bordetella pertussis
ccgccccggcgcggcgcgcgcc

SEQ ID NO: 368542 - RNA, 16 nt, Bordetella pertussis
ccgcccgacgaggagc

SEQ ID NO: 368543 - RNA, 14 nt, Bordetella pertussis
ccgcccgagcuggc

SEQ ID NO: 368544 - RNA, 21 nt, Bordetella pertussis
ccgcccgcaaggaccaugcgc

SEQ ID NO: 368545 - RNA, 23 nt, Bordetella pertussis
ccgcccgcaggcauugcgccagc

SEQ ID NO: 368546 - RNA, 14 nt, Bordetella pertussis
ccgcccgcaugucc

SEQ ID NO: 368547 - RNA, 18 nt, Bordetella pertussis
ccgcccgcaugucccagc

SEQ ID NO: 368548 - RNA, 17 nt, Bordetella pertussis
ccgcccgcgagcggcca

SEQ ID NO: 368549 - RNA, 13 nt, Bordetella pertussis
ccgcccgcccugg

SEQ ID NO: 368550 - RNA, 18 nt, Bordetella pertussis
ccgcccgcccugggcagc

SEQ ID NO: 368551 - RNA, 14 nt, Bordetella pertussis
ccgcccgccucagg

SEQ ID NO: 368552 - RNA, 12 nt, Bordetella pertussis
ccgcccgcggcc

SEQ ID NO: 368553 - RNA, 13 nt, Bordetella pertussis
ccgcccgcggcca

SEQ ID NO: 368554 - RNA, 13 nt, Bordetella pertussis
ccgcccgcggccu

SEQ ID NO: 368555 - RNA, 21 nt, Bordetella pertussis
ccgcccggcaacccgcccacg

SEQ ID NO: 368556 - RNA, 15 nt, Bordetella pertussis
ccgcccggcaugggc

SEQ ID NO: 368557 - RNA, 17 nt, Bordetella pertussis
ccgcccggcggcgcgcc

SEQ ID NO: 368558 - RNA, 14 nt, Bordetella pertussis
ccgcccgggccggc

SEQ ID NO: 368559 - RNA, 11 nt, Bordetella pertussis
ccgcccggggu

SEQ ID NO: 368560 - RNA, 13 nt, Bordetella pertussis
ccgcccggggcca

SEQ ID NO: 368561 - RNA, 23 nt, Bordetella pertussis
ccgcccggguuggcguccaggcg

SEQ ID NO: 368562 - RNA, 16 nt, Bordetella pertussis
ccgcccugcugcccgc

SEQ ID NO: 368563 - RNA, 16 nt, Bordetella pertussis
ccgcccuggccgcgcc

SEQ ID NO: 368564 - RNA, 16 nt, Bordetella pertussis
ccgcccuggucaucgc

SEQ ID NO: 368565 - RNA, 14 nt, Bordetella pertussis
ccgcccuugggcau

SEQ ID NO: 368566 - RNA, 20 nt, Bordetella pertussis
ccgccgaacggcagcagcgc

SEQ ID NO: 368567 - RNA, 23 nt, Bordetella pertussis
ccgccgaacggggccgccucggc

SEQ ID NO: 368568 - RNA, 13 nt, Bordetella pertussis
ccgccgaagccgc

SEQ ID NO: 368569 - RNA, 14 nt, Bordetella pertussis
ccgccgaagggcac

SEQ ID NO: 368570 - RNA, 16 nt, Bordetella pertussis
ccgccgaugccgccau

SEQ ID NO: 368571 - RNA, 16 nt, Bordetella pertussis
ccgccgauggcgcgcg

SEQ ID NO: 368572 - RNA, 17 nt, Bordetella pertussis
ccgccgauggcgcgcgg

SEQ ID NO: 368573 - RNA, 18 nt, Bordetella pertussis
ccgccgauggcgcgcggc

SEQ ID NO: 368574 - RNA, 15 nt, Bordetella pertussis
ccgccgaugugcggc

SEQ ID NO: 368575 - RNA, 21 nt, Bordetella pertussis
ccgccgccaccaccucggccu

SEQ ID NO: 368576 - RNA, 15 nt, Bordetella pertussis
ccgccgccaccagcg

SEQ ID NO: 368577 - RNA, 21 nt, Bordetella pertussis
ccgccgccaccagcggcgugg

SEQ ID NO: 368578 - RNA, 16 nt, Bordetella pertussis
ccgccgccagcacgcc

SEQ ID NO: 368579 - RNA, 20 nt, Bordetella pertussis
ccgccgccagcagcgccgga

SEQ ID NO: 368580 - RNA, 16 nt, Bordetella pertussis
ccgccgccauggucgc

SEQ ID NO: 368581 - RNA, 20 nt, Bordetella pertussis
ccgccgccauggucgcgacc

SEQ ID NO: 368582 - RNA, 20 nt, Bordetella pertussis
ccgccgcccacgccgccugg

SEQ ID NO: 368583 - RNA, 20 nt, Bordetella pertussis
ccgccgcccgacagcacgcc

SEQ ID NO: 368584 - RNA, 16 nt, Bordetella pertussis
ccgccgcccgccaggc

SEQ ID NO: 368585 - RNA, 18 nt, Bordetella pertussis
ccgccgcccgccucaggc

SEQ ID NO: 368586 - RNA, 13 nt, Bordetella pertussis
ccgccgcgccgcc

SEQ ID NO: 368587 - RNA, 12 nt, Bordetella pertussis
ccgccgcgcgcc

SEQ ID NO: 368588 - RNA, 13 nt, Bordetella pertussis
ccgccgcgcgccg

SEQ ID NO: 368589 - RNA, 15 nt, Bordetella pertussis
ccgccgcgcgccgcg

SEQ ID NO: 368590 - RNA, 14 nt, Bordetella pertussis
ccgccgcgcgcggc

SEQ ID NO: 368591 - RNA, 20 nt, Bordetella pertussis
ccgccgcgcggcggaucggc

SEQ ID NO: 368592 - RNA, 14 nt, Bordetella pertussis
ccgccgcgcgcugg

SEQ ID NO: 368593 - RNA, 17 nt, Bordetella pertussis
ccgccgcgcucaccgag

SEQ ID NO: 368594 - RNA, 13 nt, Bordetella pertussis
ccgccgcgcugug

SEQ ID NO: 368595 - RNA, 13 nt, Bordetella pertussis
ccgccgcggcagg

SEQ ID NO: 368596 - RNA, 16 nt, Bordetella pertussis
ccgccgcggccucggc

SEQ ID NO: 368597 - RNA, 18 nt, Bordetella pertussis
ccgccgcggccucggccg

SEQ ID NO: 368598 - RNA, 14 nt, Bordetella pertussis
ccgccgcggccugg

SEQ ID NO: 368599 - RNA, 17 nt, Bordetella pertussis
ccgccgcggccuggccg

SEQ ID NO: 368600 - RNA, 22 nt, Bordetella pertussis
ccgccgcggccagcgccgcgcc

SEQ ID NO: 368601 - RNA, 21 nt, Bordetella pertussis
ccgccgcggcgaugccggcca

SEQ ID NO: 368602 - RNA, 19 nt, Bordetella pertussis
ccgccgcgggcggccacgc

SEQ ID NO: 368603 - RNA, 13 nt, Bordetella pertussis
ccgccgcgggcgc

SEQ ID NO: 368604 - RNA, 14 nt, Bordetella pertussis
ccgccgcugccggc

SEQ ID NO: 368605 - RNA, 16 nt, Bordetella pertussis
ccgccgcugccggccg

SEQ ID NO: 368606 - RNA, 17 nt, Bordetella pertussis
ccgccgcugccggccga

SEQ ID NO: 368607 - RNA, 22 nt, Bordetella pertussis
ccgccgcugccggccgaccggc

SEQ ID NO: 368608 - RNA, 14 nt, Bordetella pertussis
ccgccggacgcagg

SEQ ID NO: 368609 - RNA, 20 nt, Bordetella pertussis
ccgccggccggugcaucggc

SEQ ID NO: 368610 - RNA, 22 nt, Bordetella pertussis
ccgccggccggugcaucggccg

SEQ ID NO: 368611 - RNA, 14 nt, Bordetella pertussis
ccgccggccugcug

SEQ ID NO: 368612 - RNA, 18 nt, Bordetella pertussis
ccgccggccugcugcagc

SEQ ID NO: 368613 - RNA, 15 nt, Bordetella pertussis
ccgccggcgacauag

SEQ ID NO: 368614 - RNA, 17 nt, Bordetella pertussis
ccgccggcgaugaucgc

SEQ ID NO: 368615 - RNA, 18 nt, Bordetella pertussis
ccgccggcgaugaucgcc

SEQ ID NO: 368616 - RNA, 14 nt, Bordetella pertussis
ccgccggcgugccc

SEQ ID NO: 368617 - RNA, 12 nt, Bordetella pertussis
ccgccgggacag

SEQ ID NO: 368618 - RNA, 15 nt, Bordetella pertussis
ccgccgggacaggca

SEQ ID NO: 368619 - RNA, 16 nt, Bordetella pertussis
ccgccgggacaggcac

SEQ ID NO: 368620 - RNA, 16 nt, Bordetella pertussis
ccgccgggccgcgacc

SEQ ID NO: 368621 - RNA, 14 nt, Bordetella pertussis
ccgccgggccgcgc

SEQ ID NO: 368622 - RNA, 15 nt, Bordetella pertussis
ccgccgggccgcgcc

SEQ ID NO: 368623 - RNA, 14 nt, Bordetella pertussis
ccgccgucagcucg

SEQ ID NO: 368624 - RNA, 18 nt, Bordetella pertussis
ccgccgugacuucggccg

SEQ ID NO: 368625 - RNA, 20 nt, Bordetella pertussis
ccgccgugacuucggccgcc

SEQ ID NO: 368626 - RNA, 21 nt, Bordetella pertussis
ccgccgugacuucggccgcca

SEQ ID NO: 368627 - RNA, 18 nt, Bordetella pertussis
ccgccgugaugccgcccg

SEQ ID NO: 368628 - RNA, 19 nt, Bordetella pertussis
ccgccgugaugccgcccgc

SEQ ID NO: 368629 - RNA, 21 nt, Bordetella pertussis
ccgccgugcaggcccgggcgc

SEQ ID NO: 368630 - RNA, 18 nt, Bordetella pertussis
ccgccgugccgggccugg

SEQ ID NO: 368631 - RNA, 14 nt, Bordetella pertussis
ccgccgugcgcggg

SEQ ID NO: 368632 - RNA, 21 nt, Bordetella pertussis
ccgccgugcgcgggcgcggca

SEQ ID NO: 368633 - RNA, 15 nt, Bordetella pertussis
ccgccguggcauaga

SEQ ID NO: 368634 - RNA, 17 nt, Bordetella pertussis
ccgccguggccaagggc

SEQ ID NO: 368635 - RNA, 19 nt, Bordetella pertussis
ccgccguggccaagggcgc

SEQ ID NO: 368636 - RNA, 13 nt, Bordetella pertussis
ccgccucgaccgg

SEQ ID NO: 368637 - RNA, 20 nt, Bordetella pertussis
ccgccucgaucgccaggucg

SEQ ID NO: 368638 - RNA, 18 nt, Bordetella pertussis
ccgccucgaugucaucgc

SEQ ID NO: 368639 - RNA, 14 nt, Bordetella pertussis
ccgccucgacgaug

SEQ ID NO: 368640 - RNA, 17 nt, Bordetella pertussis
ccgccucgacgaugccc

SEQ ID NO: 368641 - RNA, 24 nt, Bordetella pertussis
ccgccucgacgaugcccugcgcca

SEQ ID NO: 368642 - RNA, 16 nt, Bordetella pertussis
ccgccucgacgcccgg

SEQ ID NO: 368643 - RNA, 15 nt, Bordetella pertussis
ccgccucggcggcca

SEQ ID NO: 368644 - RNA, 13 nt, Bordetella pertussis
ccgccucggcggc

SEQ ID NO: 368645 - RNA, 17 nt, Bordetella pertussis
ccgccugcugcgccugg

SEQ ID NO: 368646 - RNA, 18 nt, Bordetella pertussis
ccgccugcugcgccuggc

SEQ ID NO: 368647 - RNA, 20 nt, Bordetella pertussis
ccgccugcugcgccuggccg

SEQ ID NO: 368648 - RNA, 15 nt, Bordetella pertussis
ccgccugcugggccg

SEQ ID NO: 368649 - RNA, 22 nt, Bordetella pertussis
ccgccugcugggccgcgcucga

SEQ ID NO: 368650 - RNA, 23 nt, Bordetella pertussis
ccgccuggcccaugaacaggcac

SEQ ID NO: 368651 - RNA, 13 nt, Bordetella pertussis
ccgccuggccuuc

SEQ ID NO: 368652 - RNA, 20 nt, Bordetella pertussis
ccgccuggccuucgcugccc

SEQ ID NO: 368653 - RNA, 14 nt, Bordetella pertussis
ccgccuggcgccgc

SEQ ID NO: 368654 - RNA, 19 nt, Bordetella pertussis
ccgccuggcgccgcgcccg

SEQ ID NO: 368655 - RNA, 17 nt, Bordetella pertussis
ccgccuggcgcggcgcc

SEQ ID NO: 368656 - RNA, 15 nt, Bordetella pertussis
ccgccuucccaggcg

SEQ ID NO: 368657 - RNA, 14 nt, Bordetella pertussis
ccgccuucgucgcg

SEQ ID NO: 368658 - RNA, 15 nt, Bordetella pertussis
ccgccuucgcugacg

SEQ ID NO: 368659 - RNA, 23 nt, Bordetella pertussis
ccgccuugacgguggccgcggcg

SEQ ID NO: 368660 - RNA, 23 nt, Bordetella pertussis
ccgccuugccuugcgcggccacc

SEQ ID NO: 368661 - RNA, 18 nt, Bordetella pertussis
ccgccuuggacgcgcugu

SEQ ID NO: 368662 - RNA, 23 nt, Bordetella pertussis
ccgcgacgaccccgccgugccgg

SEQ ID NO: 368663 - RNA, 20 nt, Bordetella pertussis
ccgcgacgcauauccaggcg

SEQ ID NO: 368664 - RNA, 20 nt, Bordetella pertussis
ccgcgacgcgccugcgcgcg

SEQ ID NO: 368665 - RNA, 23 nt, Bordetella pertussis
ccgcgacgcggacuucgcccggg

SEQ ID NO: 368666 - RNA, 15 nt, Bordetella pertussis
ccgcgacgcuacagc

SEQ ID NO: 368667 - RNA, 19 nt, Bordetella pertussis
ccgcgagcaugcgcagcgc

SEQ ID NO: 368668 - RNA, 23 nt, Bordetella pertussis
ccgcgagcaugcgcagcgcgucg

SEQ ID NO: 368669 - RNA, 15 nt, Bordetella pertussis
ccgcgagcggccagc

SEQ ID NO: 368670 - RNA, 15 nt, Bordetella pertussis
ccgcgaggcgcaggc

SEQ ID NO: 368671 - RNA, 16 nt, Bordetella pertussis
ccgcgaggggcccuug

SEQ ID NO: 368672 - RNA, 14 nt, Bordetella pertussis
ccgcgcacagcgcg

SEQ ID NO: 368673 - RNA, 16 nt, Bordetella pertussis
ccgcgcacagcgcggc

SEQ ID NO: 368674 - RNA, 12 nt, Bordetella pertussis
ccgcgcaccagg

SEQ ID NO: 368675 - RNA, 15 nt, Bordetella pertussis
ccgcgcaccaggcgc

SEQ ID NO: 368676 - RNA, 16 nt, Bordetella pertussis
ccgcgcaccaggcgcg

SEQ ID NO: 368677 - RNA, 13 nt, Bordetella pertussis
ccgcgcacccagg

SEQ ID NO: 368678 - RNA, 14 nt, Bordetella pertussis
ccgcgcacccaggc

SEQ ID NO: 368679 - RNA, 15 nt, Bordetella pertussis
ccgcgcaccugcugc

SEQ ID NO: 368680 - RNA, 19 nt, Bordetella pertussis
ccgcgcaccugcugcggca

SEQ ID NO: 368681 - RNA, 21 nt, Bordetella pertussis
ccgcgcacgauggggcagcca

SEQ ID NO: 368682 - RNA, 20 nt, Bordetella pertussis
ccgcgcacgggcgccugucc

SEQ ID NO: 368683 - RNA, 16 nt, Bordetella pertussis
ccgcgcagaaaccgcc

SEQ ID NO: 368684 - RNA, 20 nt, Bordetella pertussis
ccgcgccagcgccacgcccu

SEQ ID NO: 368685 - RNA, 15 nt, Bordetella pertussis
ccgcgccagcgccgg

SEQ ID NO: 368686 - RNA, 15 nt, Bordetella pertussis
ccgcgccagcugcgc

SEQ ID NO: 368687 - RNA, 22 nt, Bordetella pertussis
ccgcgcccagcuugaugccgcc

SEQ ID NO: 368688 - RNA, 18 nt, Bordetella pertussis
ccgcgccauugccacggc

SEQ ID NO: 368689 - RNA, 12 nt, Bordetella pertussis
ccgcgcccaggu

SEQ ID NO: 368690 - RNA, 21 nt, Bordetella pertussis
ccgcgcccaguuccacgcggc

SEQ ID NO: 368691 - RNA, 22 nt, Bordetella pertussis
ccgcgcccaugcgcuggcgcaa

SEQ ID NO: 368692 - RNA, 12 nt, Bordetella pertussis
ccgcgcccauuu

SEQ ID NO: 368693 - RNA, 23 nt, Bordetella pertussis
ccgcgcccauuuucugccacagc

SEQ ID NO: 368694 - RNA, 22 nt, Bordetella pertussis
ccgcgccccaucaccauggccg

SEQ ID NO: 368695 - RNA, 19 nt, Bordetella pertussis
ccgcgccccuagcgccgcg

SEQ ID NO: 368696 - RNA, 15 nt, Bordetella pertussis
ccgcgcccgccgcgc

SEQ ID NO: 368697 - RNA, 13 nt, Bordetella pertussis
ccgcgcccggccg

SEQ ID NO: 368698 - RNA, 15 nt, Bordetella pertussis
ccgcgcccggccggc

SEQ ID NO: 368699 - RNA, 17 nt, Bordetella pertussis
ccgcgcccggccggccc

SEQ ID NO: 368700 - RNA, 21 nt, Bordetella pertussis
ccgcgcccuggcgccgcggcc

SEQ ID NO: 368701 - RNA, 22 nt, Bordetella pertussis
ccgcgcccuggcgccgcggccg

SEQ ID NO: 368702 - RNA, 23 nt, Bordetella pertussis
ccgcgccgaacgacuuggcgcaa

SEQ ID NO: 368703 - RNA, 13 nt, Bordetella pertussis
ccgcgccgaaggc

SEQ ID NO: 368704 - RNA, 19 nt, Bordetella pertussis
ccgcgccgaaggcgugcug

SEQ ID NO: 368705 - RNA, 23 nt, Bordetella pertussis
ccgcgccgaaggcgugcugaacg

SEQ ID NO: 368706 - RNA, 23 nt, Bordetella pertussis
ccgcgccgaaguugcggccgugc

SEQ ID NO: 368707 - RNA, 20 nt, Bordetella pertussis
ccgcgcgguauugcgccacc

SEQ ID NO: 368708 - RNA, 21 nt, Bordetella pertussis
ccgcgcggugcucggcgaacu

SEQ ID NO: 368709 - RNA, 17 nt, Bordetella pertussis
ccgcgcgguggccgccg

SEQ ID NO: 368710 - RNA, 16 nt, Bordetella pertussis
ccgcgcguaucggcgc

SEQ ID NO: 368711 - RNA, 17 nt, Bordetella pertussis
ccgcgcguaucggcgcg

SEQ ID NO: 368712 - RNA, 23 nt, Bordetella pertussis
ccgcgcgguucgcauagcgccgg

SEQ ID NO: 368713 - RNA, 16 nt, Bordetella pertussis
ccgcgcugccagccau

SEQ ID NO: 368714 - RNA, 24 nt, Bordetella pertussis
ccgcgcugccugaaaccgcaggca

SEQ ID NO: 368715 - RNA, 17 nt, Bordetella pertussis
ccgcgcugcugcaggcc

SEQ ID NO: 368716 - RNA, 17 nt, Bordetella pertussis
ccgcgcuggaagacgug

SEQ ID NO: 368717 - RNA, 14 nt, Bordetella pertussis
ccgcgcugcgcccg

SEQ ID NO: 368718 - RNA, 23 nt, Bordetella pertussis
ccgcgcuggcgcuggccgcccgc

SEQ ID NO: 368719 - RNA, 23 nt, Bordetella pertussis
ccgcgcuggcggcgcaggccgcg

SEQ ID NO: 368720 - RNA, 17 nt, Bordetella pertussis
ccgcgcugggaaacagc

SEQ ID NO: 368721 - RNA, 18 nt, Bordetella pertussis
ccgcgcugggcgcugcug

SEQ ID NO: 368722 - RNA, 20 nt, Bordetella pertussis
ccgcgcuggcgcagcaggcg

SEQ ID NO: 368723 - RNA, 14 nt, Bordetella pertussis
ccgcgcuucgucgg

SEQ ID NO: 368724 - RNA, 18 nt, Bordetella pertussis
ccgcgcuucgucggcguc

SEQ ID NO: 368725 - RNA, 19 nt, Bordetella pertussis
ccgcgcuucgucggcgucg

SEQ ID NO: 368726 - RNA, 21 nt, Bordetella pertussis
ccgcggcagaucuccggaucc

SEQ ID NO: 368727 - RNA, 18 nt, Bordetella pertussis
ccgcggccagccacgccg

SEQ ID NO: 368728 - RNA, 17 nt, Bordetella pertussis
ccgcggccaccaggcug

SEQ ID NO: 368729 - RNA, 20 nt, Bordetella pertussis
ccgcggccggcacgcccagc

SEQ ID NO: 368730 - RNA, 18 nt, Bordetella pertussis
ccgcggccggcggcgccg

SEQ ID NO: 368731 - RNA, 16 nt, Bordetella pertussis
ccgcggccuggccggg

SEQ ID NO: 368732 - RNA, 17 nt, Bordetella pertussis
ccgcggccuucaccccg

SEQ ID NO: 368733 - RNA, 13 nt, Bordetella pertussis
ccgcggcgaagcc

SEQ ID NO: 368734 - RNA, 19 nt, Bordetella pertussis
ccgcggcgagcucggcaug

SEQ ID NO: 368735 - RNA, 13 nt, Bordetella pertussis
ccgcggcgcccag

SEQ ID NO: 368736 - RNA, 20 nt, Bordetella pertussis
ccgcggcgcccccgcggcgc

SEQ ID NO: 368737 - RNA, 16 nt, Bordetella pertussis
ccgcggcgcaugcagc

SEQ ID NO: 368738 - RNA, 18 nt, Bordetella pertussis
ccgcggcgcgcgcggcgc

SEQ ID NO: 368739 - RNA, 20 nt, Bordetella pertussis
ccgcggcgcuggauggcucg

SEQ ID NO: 368740 - RNA, 23 nt, Bordetella pertussis
ccgcgggcagcaauucgaccggc

SEQ ID NO: 368741 - RNA, 20 nt, Bordetella pertussis
ccgcgggccuacuugccggc

SEQ ID NO: 368742 - RNA, 23 nt, Bordetella pertussis
ccgcgggccuacuugccggcgcu

SEQ ID NO: 368743 - RNA, 17 nt, Bordetella pertussis
ccgcgggccgcuggucg

SEQ ID NO: 368744 - RNA, 15 nt, Bordetella pertussis
ccgcgggcgcccggc

SEQ ID NO: 368745 - RNA, 17 nt, Bordetella pertussis
ccgcgggcggcgccggc

SEQ ID NO: 368746 - RNA, 19 nt, Bordetella pertussis
ccgcgggcggcgccggccg

SEQ ID NO: 368747 - RNA, 15 nt, Bordetella pertussis
ccgcgggcggcgcgc

SEQ ID NO: 368748 - RNA, 16 nt, Bordetella pertussis
ccgcgggcggcgcgcc

SEQ ID NO: 368749 - RNA, 17 nt, Bordetella pertussis
ccgcgggcggcgcgccc

SEQ ID NO: 368750 - RNA, 20 nt, Bordetella pertussis
ccgcgggcggcgcgcccagc

SEQ ID NO: 368751 - RNA, 18 nt, Bordetella pertussis
ccgcggggacaggcaccc

SEQ ID NO: 368752 - RNA, 23 nt, Bordetella pertussis
ccgcggggacaggcaccccagca

SEQ ID NO: 368753 - RNA, 20 nt, Bordetella pertussis
ccgcggggacaggcaccccg

SEQ ID NO: 368754 - RNA, 21 nt, Bordetella pertussis
ccgcggggacaggcacccgca

SEQ ID NO: 368755 - RNA, 19 nt, Bordetella pertussis
ccgcggggacaggcacccu

SEQ ID NO: 368756 - RNA, 20 nt, Bordetella pertussis
ccgcggggacaggcaccgcc

SEQ ID NO: 368757 - RNA, 18 nt, Bordetella pertussis
ccgcggggacaggcaccu

SEQ ID NO: 368758 - RNA, 14 nt, Bordetella pertussis
ccgcgggcgugcug

SEQ ID NO: 368759 - RNA, 11 nt, Bordetella pertussis
ccgcggggcug

SEQ ID NO: 368760 - RNA, 16 nt, Bordetella pertussis
ccgcggggcuggccag

SEQ ID NO: 368761 - RNA, 17 nt, Bordetella pertussis
ccgcgguacgcgggcau

SEQ ID NO: 368762 - RNA, 14 nt, Bordetella pertussis
ccgcggucagccag

SEQ ID NO: 368763 - RNA, 14 nt, Bordetella pertussis
ccgcgguccagcac

SEQ ID NO: 368764 - RNA, 22 nt, Bordetella pertussis
ccgcgguccgggccauccgucc

SEQ ID NO: 368765 - RNA, 17 nt, Bordetella pertussis
ccgcggucgagacgaug

SEQ ID NO: 368766 - RNA, 15 nt, Bordetella pertussis
ccgcguacaacgccg

SEQ ID NO: 368767 - RNA, 16 nt, Bordetella pertussis
ccgcguacaacgccgc

SEQ ID NO: 368768 - RNA, 17 nt, Bordetella pertussis
ccgcguacaacgccgcg

SEQ ID NO: 368769 - RNA, 14 nt, Bordetella pertussis
ccgcguccggcgcc

SEQ ID NO: 368770 - RNA, 16 nt, Bordetella pertussis
ccgcgucgauccggca

SEQ ID NO: 368771 - RNA, 21 nt, Bordetella pertussis
ccgcgucgcuggccggacgca

SEQ ID NO: 368772 - RNA, 17 nt, Bordetella pertussis
ccgcgucgcugucggcg

SEQ ID NO: 368773 - RNA, 14 nt, Bordetella pertussis
ccgcgucggacgcg

SEQ ID NO: 368774 - RNA, 15 nt, Bordetella pertussis
ccgcgucggacgcgc

SEQ ID NO: 368775 - RNA, 16 nt, Bordetella pertussis
ccgcuaucauccgcgc

SEQ ID NO: 368776 - RNA, 19 nt, Bordetella pertussis
ccgcucaauucggccugac

SEQ ID NO: 368777 - RNA, 15 nt, Bordetella pertussis
ccgcucagcgcggcg

SEQ ID NO: 368778 - RNA, 16 nt, Bordetella pertussis
ccgcucagcgcggcgc

SEQ ID NO: 368779 - RNA, 13 nt, Bordetella pertussis
ccgcucaggucga

SEQ ID NO: 368780 - RNA, 16 nt, Bordetella pertussis
ccgcucaggucgaaca

SEQ ID NO: 368781 - RNA, 20 nt, Bordetella pertussis
ccgcucaguucuucgacggg

SEQ ID NO: 368782 - RNA, 16 nt, Bordetella pertussis
ccgcuccaccagcacc

SEQ ID NO: 368783 - RNA, 21 nt, Bordetella pertussis
ccgcuccauguaaaaacccgg

SEQ ID NO: 368784 - RNA, 14 nt, Bordetella pertussis
ccgcuccgccaugg

SEQ ID NO: 368785 - RNA, 14 nt, Bordetella pertussis
ccgcucggccacgc

SEQ ID NO: 368786 - RNA, 19 nt, Bordetella pertussis
ccgcucggccacgcgcugc

SEQ ID NO: 368787 - RNA, 16 nt, Bordetella pertussis
ccgcugaucaggucca

SEQ ID NO: 368788 - RNA, 16 nt, Bordetella pertussis
ccgcugaucuuccugg

SEQ ID NO: 368789 - RNA, 14 nt, Bordetella pertussis
ccgcugauggcggu

SEQ ID NO: 368790 - RNA, 21 nt, Bordetella pertussis
ccgcugcagcacgcaccaggc

SEQ ID NO: 368791 - RNA, 20 nt, Bordetella pertussis
ccgcugcaugggcggcccgc

SEQ ID NO: 368792 - RNA, 21 nt, Bordetella pertussis
ccgcugcccaccuuccugcug

SEQ ID NO: 368793 - RNA, 22 nt, Bordetella pertussis
ccgcugcccaccuuccugcugg

SEQ ID NO: 368794 - RNA, 12 nt, Bordetella pertussis
ccgcugcccagc

SEQ ID NO: 368795 - RNA, 19 nt, Bordetella pertussis
ccgcugccgagacggccgc

SEQ ID NO: 368796 - RNA, 15 nt, Bordetella pertussis
ccgcugcgaaaaagc

SEQ ID NO: 368797 - RNA, 19 nt, Bordetella pertussis
ccgcugcgaaaaagcccgc

SEQ ID NO: 368798 - RNA, 20 nt, Bordetella pertussis
ccgcugcgaaaaagcccgcg

SEQ ID NO: 368799 - RNA, 14 nt, Bordetella pertussis
ccgcugcgcgcggc

SEQ ID NO: 368800 - RNA, 18 nt, Bordetella pertussis
ccgcugcgcgcggccugg

SEQ ID NO: 368801 - RNA, 17 nt, Bordetella pertussis
ccgcugcgcuggccgcg

SEQ ID NO: 368802 - RNA, 15 nt, Bordetella pertussis
ccgcuggucaccgcc

SEQ ID NO: 368803 - RNA, 18 nt, Bordetella pertussis
ccgcuggucaccgccccg

SEQ ID NO: 368804 - RNA, 21 nt, Bordetella pertussis
ccgcuggucaccgccccgacc

SEQ ID NO: 368805 - RNA, 17 nt, Bordetella pertussis
ccgcuggucguaucgcc

SEQ ID NO: 368806 - RNA, 16 nt, Bordetella pertussis
ccgcuguaccguucgc

SEQ ID NO: 368807 - RNA, 16 nt, Bordetella pertussis
ccgcugucgcaggcgc

SEQ ID NO: 368808 - RNA, 22 nt, Bordetella pertussis
ccgcugucgcaggcgcugcagc

SEQ ID NO: 368809 - RNA, 21 nt, Bordetella pertussis
ccgcugugcgcguuccggccg

SEQ ID NO: 368810 - RNA, 17 nt, Bordetella pertussis
ccgcuguggacgccgcc

SEQ ID NO: 368811 - RNA, 19 nt, Bordetella pertussis
ccgcuguggacgccgccgg

SEQ ID NO: 368812 - RNA, 16 nt, Bordetella pertussis
ccgcuguggcgcgcca

SEQ ID NO: 368813 - RNA, 21 nt, Bordetella pertussis
ccgcuguucggcgagccgggc

SEQ ID NO: 368814 - RNA, 23 nt, Bordetella pertussis
ccgcuguucggcgagccgggcac

SEQ ID NO: 368815 - RNA, 21 nt, Bordetella pertussis
ccgcuuauuuccucagccugg

SEQ ID NO: 368816 - RNA, 14 nt, Bordetella pertussis
ccgcuucacgcugu

SEQ ID NO: 368817 - RNA, 13 nt, Bordetella pertussis
ccgcuuccggcau

SEQ ID NO: 368818 - RNA, 22 nt, Bordetella pertussis
ccgcuuccggcaugaccgcgga

SEQ ID NO: 368819 - RNA, 15 nt, Bordetella pertussis
ccgcuuccggccggg

SEQ ID NO: 368820 - RNA, 16 nt, Bordetella pertussis
ccgcuuccggccgggc

SEQ ID NO: 368821 - RNA, 14 nt, Bordetella pertussis
ccgcuuccugcugc

SEQ ID NO: 368822 - RNA, 16 nt, Bordetella pertussis
ccgcuuccugcugcgc

SEQ ID NO: 368823 - RNA, 21 nt, Bordetella pertussis
ccgcuucgacggcuugcgcau

SEQ ID NO: 368824 - RNA, 13 nt, Bordetella pertussis
ccgcuucggcggc

SEQ ID NO: 368825 - RNA, 17 nt, Bordetella pertussis
ccgcuucggcggccgcg

SEQ ID NO: 368826 - RNA, 12 nt, Bordetella pertussis
ccgcuucggccu

SEQ ID NO: 368827 - RNA, 16 nt, Bordetella pertussis
ccgcuucgucgggcag

SEQ ID NO: 368828 - RNA, 19 nt, Bordetella pertussis
ccgcuucgucgggcagcgc

SEQ ID NO: 368829 - RNA, 21 nt, Bordetella pertussis
ccgcuucgugcggccgcagca

SEQ ID NO: 368830 - RNA, 22 nt, Bordetella pertussis
ccgcuucucacugcccgcgccg

SEQ ID NO: 368831 - RNA, 20 nt, Bordetella pertussis
ccgcuucuucgucgcgccag

SEQ ID NO: 368832 - RNA, 21 nt, Bordetella pertussis
ccgcuucuucgucgcgccaga

SEQ ID NO: 368833 - RNA, 19 nt, Bordetella pertussis
ccgcuugcggccggcgcug

SEQ ID NO: 368834 - RNA, 22 nt, Bordetella pertussis
ccgcuugcccgucaugcgccgc

SEQ ID NO: 368835 - RNA, 18 nt, Bordetella pertussis
ccgcuugggccgcgccug

SEQ ID NO: 368836 - RNA, 19 nt, Bordetella pertussis
ccgcuugggccgcgccugc

SEQ ID NO: 368837 - RNA, 22 nt, Bordetella pertussis
ccgcuugucgaugacgcgccgc

SEQ ID NO: 368838 - RNA, 17 nt, Bordetella pertussis
ccgcuuuuuccugcugu

SEQ ID NO: 368839 - RNA, 22 nt, Bordetella pertussis
ccggaaagcuguccacgccgaa

SEQ ID NO: 368840 - RNA, 14 nt, Bordetella pertussis
ccggaacaccagca

SEQ ID NO: 368841 - RNA, 14 nt, Bordetella pertussis
ccggaacaggcgcc

SEQ ID NO: 368842 - RNA, 17 nt, Bordetella pertussis
ccggacaacgcgcgcca

SEQ ID NO: 368843 - RNA, 13 nt, Bordetella pertussis
ccggacaagcccc

SEQ ID NO: 368844 - RNA, 23 nt, Bordetella pertussis
ccggacacguacaaccgcgccga

SEQ ID NO: 368845 - RNA, 15 nt, Bordetella pertussis
ccggacagggccgcg

SEQ ID NO: 368846 - RNA, 16 nt, Bordetella pertussis
ccggacagggccgcga

SEQ ID NO: 368847 - RNA, 14 nt, Bordetella pertussis
ccggacccgcgccg

SEQ ID NO: 368848 - RNA, 20 nt, Bordetella pertussis
ccggacgcaaaaacgcccgg

SEQ ID NO: 368849 - RNA, 21 nt, Bordetella pertussis
ccggacgcaaaaacgcccggc

SEQ ID NO: 368850 - RNA, 23 nt, Bordetella pertussis
ccggacgcaaccggucggccggc

SEQ ID NO: 368851 - RNA, 12 nt, Bordetella pertussis
ccggacgccgac

SEQ ID NO: 368852 - RNA, 15 nt, Bordetella pertussis
ccggacgcggccggc

SEQ ID NO: 368853 - RNA, 16 nt, Bordetella pertussis
ccggacgcggccggca

SEQ ID NO: 368854 - RNA, 21 nt, Bordetella pertussis
ccggacggcgccuugacgcug

SEQ ID NO: 368855 - RNA, 21 nt, Bordetella pertussis
ccggacgugggcgccuacggc

SEQ ID NO: 368856 - RNA, 23 nt, Bordetella pertussis
ccggacugaacgcguccaggccc

SEQ ID NO: 368857 - RNA, 21 nt, Bordetella pertussis
ccggacuggauauggcgccgc

SEQ ID NO: 368858 - RNA, 22 nt, Bordetella pertussis
ccggacuggauauggcgccgca

SEQ ID NO: 368859 - RNA, 21 nt, Bordetella pertussis
ccggagcauggcaugagcgcc

SEQ ID NO: 368860 - RNA, 12 nt, Bordetella pertussis
ccggaggccgcc

SEQ ID NO: 368861 - RNA, 13 nt, Bordetella pertussis
ccggaggccgccc

SEQ ID NO: 368862 - RNA, 15 nt, Bordetella pertussis
ccggaggccgcccac

SEQ ID NO: 368863 - RNA, 14 nt, Bordetella pertussis
ccggaggcgccgcg

SEQ ID NO: 368864 - RNA, 14 nt, Bordetella pertussis
ccggaggcgcgcag

SEQ ID NO: 368865 - RNA, 21 nt, Bordetella pertussis
ccggauacugcacgcggucca

SEQ ID NO: 368866 - RNA, 14 nt, Bordetella pertussis
ccggauaccgccgc

SEQ ID NO: 368867 - RNA, 16 nt, Bordetella pertussis
ccggauaccgccgccg

SEQ ID NO: 368868 - RNA, 22 nt, Bordetella pertussis
ccggauauggccggcgcgcucg

SEQ ID NO: 368869 - RNA, 23 nt, Bordetella pertussis
ccggauauggccggcgcgcucgc

SEQ ID NO: 368870 - RNA, 14 nt, Bordetella pertussis
ccggaucagcgccu

SEQ ID NO: 368871 - RNA, 17 nt, Bordetella pertussis
ccggaucccaggccggc

SEQ ID NO: 368872 - RNA, 12 nt, Bordetella pertussis
ccggauccugcg

SEQ ID NO: 368873 - RNA, 22 nt, Bordetella pertussis
ccggaucgcacacaccgcguca

SEQ ID NO: 368874 - RNA, 18 nt, Bordetella pertussis
ccggaucguagugcgugg

SEQ ID NO: 368875 - RNA, 22 nt, Bordetella pertussis
ccggaugagcuacccccugacc

SEQ ID NO: 368876 - RNA, 14 nt, Bordetella pertussis
ccggaugcgcagga

SEQ ID NO: 368877 - RNA, 20 nt, Bordetella pertussis
ccggaugguagaugcgcgcg

SEQ ID NO: 368878 - RNA, 17 nt, Bordetella pertussis
ccggauuggcgcugcac

SEQ ID NO: 368879 - RNA, 18 nt, Bordetella pertussis
ccggcaaacccggcaauc

SEQ ID NO: 368880 - RNA, 20 nt, Bordetella pertussis
ccggcaaagaucaccugggc

SEQ ID NO: 368881 - RNA, 19 nt, Bordetella pertussis
ccggcaacaucuccaccag

SEQ ID NO: 368882 - RNA, 21 nt, Bordetella pertussis
ccggcaacaucuccaccagcg

SEQ ID NO: 368883 - RNA, 13 nt, Bordetella pertussis
ccggcaacccgcc

SEQ ID NO: 368884 - RNA, 18 nt, Bordetella pertussis
ccggcaacccgcccacgc

SEQ ID NO: 368885 - RNA, 22 nt, Bordetella pertussis
ccggcaagcacgaacagguuga

SEQ ID NO: 368886 - RNA, 20 nt, Bordetella pertussis
ccggcaagccuugcggcuug

SEQ ID NO: 368887 - RNA, 20 nt, Bordetella pertussis
ccggcaaggggccagccugg

SEQ ID NO: 368888 - RNA, 15 nt, Bordetella pertussis
ccggcaaggucagca

SEQ ID NO: 368889 - RNA, 19 nt, Bordetella pertussis
ccggcaaggccgcgaacgc

SEQ ID NO: 368890 - RNA, 15 nt, Bordetella pertussis
ccggcaccaggaucc

SEQ ID NO: 368891 - RNA, 16 nt, Bordetella pertussis
ccggcaccaucgccgc

SEQ ID NO: 368892 - RNA, 18 nt, Bordetella pertussis
ccggcaccaugcgcacca

SEQ ID NO: 368893 - RNA, 19 nt, Bordetella pertussis
ccggcacccgcuaccccgg

SEQ ID NO: 368894 - RNA, 20 nt, Bordetella pertussis
ccggcacccgcuaccccggc

SEQ ID NO: 368895 - RNA, 15 nt, Bordetella pertussis
ccggcaccguccagc

SEQ ID NO: 368896 - RNA, 15 nt, Bordetella pertussis
ccggcaccugggccu

SEQ ID NO: 368897 - RNA, 19 nt, Bordetella pertussis
ccggcaccuucuuccaggc

SEQ ID NO: 368898 - RNA, 17 nt, Bordetella pertussis
ccggcacgacgaucggc

SEQ ID NO: 368899 - RNA, 23 nt, Bordetella pertussis
ccggcacgacgaucggccugaac

SEQ ID NO: 368900 - RNA, 13 nt, Bordetella pertussis
ccggcacgcccag

SEQ ID NO: 368901 - RNA, 14 nt, Bordetella pertussis
ccggcacgcccagc

SEQ ID NO: 368902 - RNA, 17 nt, Bordetella pertussis
ccggcacgcccagccgc

SEQ ID NO: 368903 - RNA, 21 nt, Bordetella pertussis
ccggcacgcccagccgcagca

SEQ ID NO: 368904 - RNA, 14 nt, Bordetella pertussis
ccggcacgccggcg

SEQ ID NO: 368905 - RNA, 15 nt, Bordetella pertussis
ccggcacgccugccg

SEQ ID NO: 368906 - RNA, 16 nt, Bordetella pertussis
ccggcacgccugccgc

SEQ ID NO: 368907 - RNA, 18 nt, Bordetella pertussis
ccggcacgccugccgcgc

SEQ ID NO: 368908 - RNA, 23 nt, Bordetella pertussis
ccggcacgccugccgcgcccggc

SEQ ID NO: 368909 - RNA, 13 nt, Bordetella pertussis
ccggcacgcgcca

SEQ ID NO: 368910 - RNA, 20 nt, Bordetella pertussis
ccggcacgcgccagcugacc

SEQ ID NO: 368911 - RNA, 16 nt, Bordetella pertussis
ccggcacgcgccaggc

SEQ ID NO: 368912 - RNA, 13 nt, Bordetella pertussis
ccggcacgcgccg

SEQ ID NO: 368913 - RNA, 22 nt, Bordetella pertussis
ccggcacgcgcgguucgccgug

SEQ ID NO: 368914 - RNA, 18 nt, Bordetella pertussis
ccggcacggccggccagg

SEQ ID NO: 368915 - RNA, 21 nt, Bordetella pertussis
ccggcacgguucagaacgcgu

SEQ ID NO: 368916 - RNA, 23 nt, Bordetella pertussis
ccggcacguaccaggcgcugacc

SEQ ID NO: 368917 - RNA, 23 nt, Bordetella pertussis
ccggcagaacagcggaucgccgg

SEQ ID NO: 368918 - RNA, 16 nt, Bordetella pertussis
ccggcagcagcagcgu

SEQ ID NO: 368919 - RNA, 14 nt, Bordetella pertussis
ccggcagccccagc

SEQ ID NO: 368920 - RNA, 17 nt, Bordetella pertussis
ccggcagccccagcgcc

SEQ ID NO: 368921 - RNA, 23 nt, Bordetella pertussis
ccggcagcgcaaaacgcaugacc

SEQ ID NO: 368922 - RNA, 14 nt, Bordetella pertussis
ccggcagcgcgacc

SEQ ID NO: 368923 - RNA, 15 nt, Bordetella pertussis
ccggcagcgcgaccg

SEQ ID NO: 368924 - RNA, 19 nt, Bordetella pertussis
ccggcagcgcgaccggcgc

SEQ ID NO: 368925 - RNA, 20 nt, Bordetella pertussis
ccggcagcgcgaccggcgcg

SEQ ID NO: 368926 - RNA, 17 nt, Bordetella pertussis
ccggcagcggccagcgc

SEQ ID NO: 368927 - RNA, 15 nt, Bordetella pertussis
ccggcagcggcgcca

SEQ ID NO: 368928 - RNA, 21 nt, Bordetella pertussis
ccggcagcguaucgcccgcgc

SEQ ID NO: 368929 - RNA, 13 nt, Bordetella pertussis
ccggcaggccgcg

SEQ ID NO: 368930 - RNA, 14 nt, Bordetella pertussis
ccggcaggccgcgc

SEQ ID NO: 368931 - RNA, 12 nt, Bordetella pertussis
ccggcaggcgcg

SEQ ID NO: 368932 - RNA, 13 nt, Bordetella pertussis
ccggcaggcgcgc

SEQ ID NO: 368933 - RNA, 15 nt, Bordetella pertussis
ccggcaggcgcgcca

SEQ ID NO: 368934 - RNA, 15 nt, Bordetella pertussis
ccggcagggcggcca

SEQ ID NO: 368935 - RNA, 20 nt, Bordetella pertussis
ccggcagggugacgggcugg

SEQ ID NO: 368936 - RNA, 22 nt, Bordetella pertussis
ccggcaggucgaugcccuccca

SEQ ID NO: 368937 - RNA, 23 nt, Bordetella pertussis
ccggcaggucgaugcccucccag

SEQ ID NO: 368938 - RNA, 23 nt, Bordetella pertussis
ccggcagugccugcgaacgcccg

SEQ ID NO: 368939 - RNA, 14 nt, Bordetella pertussis
ccggcaucgcgcug

SEQ ID NO: 368940 - RNA, 14 nt, Bordetella pertussis
ccggcaugaagcgc

SEQ ID NO: 368941 - RNA, 18 nt, Bordetella pertussis
ccggcaugaagcgcagca

SEQ ID NO: 368942 - RNA, 21 nt, Bordetella pertussis
ccggcaugaccgcggacgcca

SEQ ID NO: 368943 - RNA, 18 nt, Bordetella pertussis
ccggcaugccguccacgc

SEQ ID NO: 368944 - RNA, 21 nt, Bordetella pertussis
ccggcaugccguccacgccca

SEQ ID NO: 368945 - RNA, 20 nt, Bordetella pertussis
ccggcaugggcgugccgcgc

SEQ ID NO: 368946 - RNA, 21 nt, Bordetella pertussis
ccggcaugguguaccgggccg

SEQ ID NO: 368947 - RNA, 13 nt, Bordetella pertussis
ccggccaccagcg

SEQ ID NO: 368948 - RNA, 20 nt, Bordetella pertussis
ccggccaccucuucagcccg

SEQ ID NO: 368949 - RNA, 13 nt, Bordetella pertussis
ccggccacggccg

SEQ ID NO: 368950 - RNA, 16 nt, Bordetella pertussis
ccggccacggccgggc

SEQ ID NO: 368951 - RNA, 11 nt, Bordetella pertussis
ccggccagcaa

SEQ ID NO: 368952 - RNA, 12 nt, Bordetella pertussis
ccggccagcacg

SEQ ID NO: 368953 - RNA, 15 nt, Bordetella pertussis
ccggccagcacgccg

SEQ ID NO: 368954 - RNA, 19 nt, Bordetella pertussis
ccggccagcacgccggcgg

SEQ ID NO: 368955 - RNA, 14 nt, Bordetella pertussis
ccggccagcacggg

SEQ ID NO: 368956 - RNA, 18 nt, Bordetella pertussis
ccggccagccugcccguc

SEQ ID NO: 368957 - RNA, 20 nt, Bordetella pertussis
ccggccagcgccaguccgcg

SEQ ID NO: 368958 - RNA, 18 nt, Bordetella pertussis
ccggccagcgccugggcg

SEQ ID NO: 368959 - RNA, 16 nt, Bordetella pertussis
ccggccagcgcgccgg

SEQ ID NO: 368960 - RNA, 21 nt, Bordetella pertussis
ccggccagcgcgccggccagg

SEQ ID NO: 368961 - RNA, 15 nt, Bordetella pertussis
ccggccagcgcggca

SEQ ID NO: 368962 - RNA, 18 nt, Bordetella pertussis
ccggccagcgccaccacc

SEQ ID NO: 368963 - RNA, 18 nt, Bordetella pertussis
ccggccagcuugagcagg

SEQ ID NO: 368964 - RNA, 22 nt, Bordetella pertussis
ccggccagcuugagcaggcgcg

SEQ ID NO: 368965 - RNA, 20 nt, Bordetella pertussis
ccggcgccagccgcuccagg

SEQ ID NO: 368966 - RNA, 20 nt, Bordetella pertussis
ccggcgccagcaugcgcgcg

SEQ ID NO: 368967 - RNA, 16 nt, Bordetella pertussis
ccggcgcccccagcag

SEQ ID NO: 368968 - RNA, 16 nt, Bordetella pertussis
ccggcgcccgccgccg

SEQ ID NO: 368969 - RNA, 17 nt, Bordetella pertussis
ccggcgcccgccgccgg

SEQ ID NO: 368970 - RNA, 18 nt, Bordetella pertussis
ccggcgcccgccgccggg

SEQ ID NO: 368971 - RNA, 23 nt, Bordetella pertussis
ccggcgcccgccgccgggcgcgc

SEQ ID NO: 368972 - RNA, 16 nt, Bordetella pertussis
ccggcgccgccggguu

SEQ ID NO: 368973 - RNA, 21 nt, Bordetella pertussis
ccggcgccgccucaggccggc

SEQ ID NO: 368974 - RNA, 19 nt, Bordetella pertussis
ccggcgccgcguucacgcc

SEQ ID NO: 368975 - RNA, 18 nt, Bordetella pertussis
ccggcgccggcaaacccg

SEQ ID NO: 368976 - RNA, 21 nt, Bordetella pertussis
ccggcgccggcaaacccggca

SEQ ID NO: 368977 - RNA, 11 nt, Bordetella pertussis
ccggcgccggu

SEQ ID NO: 368978 - RNA, 18 nt, Bordetella pertussis
ccggcgccggcgacgccg

SEQ ID NO: 368979 - RNA, 22 nt, Bordetella pertussis
ccggcgccgucuucgguggccc

SEQ ID NO: 368980 - RNA, 20 nt, Bordetella pertussis
ccggcgccguuuucagcgca

SEQ ID NO: 368981 - RNA, 12 nt, Bordetella pertussis
ccggcgccugcg

SEQ ID NO: 368982 - RNA, 13 nt, Bordetella pertussis
ccggcgccuggcc

SEQ ID NO: 368983 - RNA, 14 nt, Bordetella pertussis
ccggcgccuggccg

SEQ ID NO: 368984 - RNA, 17 nt, Bordetella pertussis
ccggcgccuggggcggg

SEQ ID NO: 368985 - RNA, 18 nt, Bordetella pertussis
ccggcgcgaacaccggca

SEQ ID NO: 368986 - RNA, 22 nt, Bordetella pertussis
ccggcgcgaaccccuccggcgu

SEQ ID NO: 368987 - RNA, 14 nt, Bordetella pertussis
ccggcgccuuggcc
